United States Patent 9,050,297 (MODIFIED POLYNUCLEOTIDES ENCODING ARYL HYDROCARBON RECEPTOR NUCLEAR TRANSLOCATOR) - sequence listing, part 7

SEQ ID NO: 10857 - DNA, 363 bp, Artificial Sequence
  Description of Artificial Sequence: Synthetic coding sequence
tgagagagaaccttcaactgctgctaccccggctgccacttcaagaccgtgcacggcatgaaggacctggacagacacctgagaatccacaccggcgacaagccccacaagtgcgagttctgcgacaagtgcttcagcagaaaggacaacctgaccatgcacatgagatgccacaccagcgtgaagccccacaagtgccacctgtgcgactacgccgccgtggacagcagcagcctgaagaagcacctgagaatccacagcgacgagagaccctacaagtgccagctgtgcccctacgccagcagaaacagcagccagctgaccgtgcacctgagaagccacaccggccccggccccggctag

SEQ ID NO: 10858 - DNA, 1572 bp, Artificial Sequence
  Description of Artificial Sequence: Synthetic coding sequence
atgaaggacatggagagacacctgaagatccacaccggcgacaagccccacaagtgcgaggtgtgcggcaagtgcttcagcagaaaggacaagctgaagacccacatgagatgccacaccggcgtgaagccctacaagtgcaagacctgcgactacgccgccgccgacagcagcagcctgaacaagcacctgagaatccacagcgacgagagacccttcaagtgccagatctgcccctacgccagcagaaacagcagccagctgaccgtgcacctgagaagccacaccggcgacgcccccttccagtgctggctgtgcagcgccaagttcaagatcagcagcgacctgaagagacacatgagagtgcacagcggcgagaagcccttcaagtgcgagttctgcaacgtgagatgcaccatgaagggcaacctgaagagccacatcagaatcaagcacagcggcaacaacttcaagtgcccccactgcgacttcctgggcgacagcaaggccaccctgagaaagcacagcagagtgcaccagagcgagcaccccgagaagtgcagcgagtgcagctacagctgcagcagcaaggccgccctgagaatccacgagagaatccactgcaccgacagacccttcaagtgcaactactgcagcttcgacaccaagcagcccagcaacctgagcaagcacatgaagaagttccacggcgacatggtgaagaccgaggccctggagagaaaggacaccggcagacagagcagcagacaggtggccaagctggacgccaagaagagcttccactgcgacatctgcgacgccagcttcatgagagaggacagcctgagaagccacaagagacagcacagcgagtacagcgagagcaagaacagcgacgtgaccgtgctgcagttccagatcgaccccagcaagcagcccgccacccccctgaccgtgggccacctgcaggtgcccctgcagcccagccaggtgccccagttcagcgagggcagagtgaagatcatcgtgggccaccaggtgccccaggccaacaccatcgtgcaggccgccgccgccgccgtgaacatcgtgccccccgccctggtggcccagaaccccgaggagctgcccggcaacagcagactgcagatcctgagacaggtgagcctgatcgcccccccccagagcagcagatgccccagcgaggccggcgccatgacccagcccgccgtgctgctgaccacccacgagcagaccgacggcgccaccctgcaccagaccctgatccccaccgccagcggcggcccccaggagggcagcggcaaccagaccttcatcaccagcagcggcatcacctgcaccgacttcgagggcctgaacgccctgatccaggagggcaccgccgaggtgaccgtggtgagcgacggcggccagaacatcgccgtggccaccaccgccccccccgtgttcagcagcagcagccagcaggagctgcccaagcagacctacagcatcatccagggcgccgcccaccccgccctgctgtgccccgccgacagcatccccgactag

SEQ ID NO: 10859 - DNA, 1581 bp, Artificial Sequence
  Description of Artificial Sequence: Synthetic coding sequence
atgccccagcagctgctgatcaccctgcccaccgaggccagcacctgggtgaagctgcagcaccccaagaaggccgtggagggcgcccccctgtgggaggacgtgaccaagatgttcgagggcgaggccctgctgagccaggacgccgaggacgtgaagacccagagagagagcctggaggacgaggtgacccccggcctgcccaccgccgagagccaggagctgctgaccttcaaggacatcagcatcgacttcacccaggaggagtggggccagctggcccccgcccaccagaacctgtacagagaggtgatgctggagaactacagcaacctggtgagcgtgggctaccagctgagcaagcccagcgtgatcagccagctggagaagggcgaggagccctggatggccgagaaggagggccccggcgaccccagcagcgacctgaagagcaagatcgagaccatcgagagcaccgccaagagcaccatcagccaggagagactgtaccacggcatcatgatggagagcttcatgagagacgacatcatctacagcaccctgagaaaggtgagcacctacgacgacgtgctggagagacaccaggagacctgcatgagagacgtgagacaggccatcctgacccacaagaagagagtgcaggagaccaacaagttcggcgagaacatcatcgtgcacagcaacgtgatcatcgagcagagacaccacaagtacgacacccccaccaagagaaacacctacaagctggacctgatcaaccaccccaccagctacatcagaaccaagacctacgagtgcaacatctgcgagaagatcttcaagcagcccatccacctgaccgagcacatgagaatccacaccggcgagaagcccttcagatgcaaggagtgcggcagagccttcagccagagcgccagcctgagcacccaccagagaatccacaccggcgagaagcccttcgagtgcgaggagtgcggcaaggccttcagacacagaagcagcctgaaccagcaccacagaacccacaccggcgagaagccctacgtgtgcgacaagtgccagaaggccttcagccagaacatcagcctggtgcagcacctgagaacccacagcggcgagaagcccttcacctgcaacgagtgcggcaagaccttcagacagatcagacacctgagcgagcacatcagaatccacaccggcgagaagccctacgcctgcaccgcctgctgcaagaccttcagccacagagcctacctgacccaccaccagagaatccacaccggcgagagaccctacaagtgcaaggagtgcggcaaggccttcagacagagaatccacctgagcaaccacaagaccgtgcacaccggcgtgaaggcctacgagtgcaacagatgcggcaaggcctacagacacgacagcagcttcaagaagcaccagagacaccacaccggcgagaagccctacgagtgcaacgagtgcggcaaggccttcagctacaacagcagcctgagcagacaccacgagatccacagaagaaacgccttcagaaacaaggtgtag

SEQ ID NO: 10860 - DNA, 1581 bp, Artificial Sequence; identical to SEQ ID NO: 10859
  Description of Artificial Sequence: Synthetic coding sequence

SEQ ID NO: 10861 - DNA, 1299 bp, Artificial Sequence
  Description of Artificial Sequence: Synthetic coding sequence
atgctggagaactacggcaacctggtgagcgtgggctgccagctgagcaagcccggcgtgatcagccagctggagaagggcgaggagccctggctgatggagagagacatcagcggcgtgcccagcagcgacctgaagagcaagaccaagaccaaggagagcgccctgcagaacgacatcagctgggaggagctgcactgcggcctgatgatggagagattcaccaagggcagcagcatgtacagcaccctgggcagaatcagcaagtgcaacaagctggagagccagcaggagaaccagagaatgggcaagggccagatccccctgatgtgcaagaagaccttcacccaggagagaggccaggagagcaacagattcgagaagagaatcaacgtgaagagcgaggtgatgcccggccccatcggcctgcccagaaagagagacagaaagtacgacacccccggcaagagaagcagatacaacatcgacctggtgaaccacagcagaagctacaccaagatgaagaccttcgagtgcaacatctgcgagaagatcttcaagcagctgatccacctgaccgagcacatgagaatccacaccggcgagaagcccttcagatgcaaggagtgcggcaaggccttcagccagagcagcagcctgatcccccaccagagaatccacaccggcgagaagccctacgagtgcaaggagtgcggcaagaccttcagacaccccagcagcctgacccagcacgtgagaatccacaccggcgagaagccctacgagtgcagagtgtgcgagaaggccttcagccagagcatcggcctgatccagcacctgagaacccacgtgagagagaagcccttcacctgcaaggactgcggcaaggccttcttccagatcagacacctgagacagcacgagatcatccacaccggcgtgaagccctacatctgcaacgtgtgcagcaagaccttcagccacagcacctacctgacccagcaccagagaacccacaccggcgagagaccctacaagtgcaaggagtgcggcaaggccttcagccagagaatccacctgagcatccaccagagagtgcacaccggcgtgaagccctacgagtgcagccactgcggcaaggccttcagacacgacagcagcttcgccaagcaccagagaatccacaccggcgagaagccctacgactgcaacgagtgcggcaaggccttcagctgcagcagcagcctgatcagacactgcaagacccacctgagaaacaccttcagcaacgtggtgtag

SEQ ID NO: 10862 - DNA, 1605 bp, Artificial Sequence
  Description of Artificial Sequence: Synthetic coding sequence
atgctgcagcagctgctgatcaccctgcccaccgaggccagcacctgggtgaagctgagacaccccaaggccgccaccgagagagtggccctgtgggaggacgtgaccaagatgttcaaggccgaggccctgctgagccaggacgccgacgagacccagggcgagagcctggagagcagagtgaccctgggcagcctgaccgccgagagccaggagctgctgaccttcaaggacgtgagcgtggacttcacccaggaggagtggggccagctggcccccgcccacagaaacctgtacagagaggtgatgctggagaactacggcaacctggtgagcgtgggctgccagctgagcaagcccggcgtgatcagccagctggagaagggcgaggagccctggctgatggagagagacatcagcggcgtgcccagcagcgacctgaagagcaagaccaagaccaaggagagcgccctgcagaacgacatcagctgggaggagctgcactgcggcctgatgatggagagattcaccaagggcagcagcatgtacagcaccctgggcagaatcagcaagtgcaacaagctggagagccagcaggagaaccagagaatgggcaagggccagatccccctgatgtgcaagaagaccttcacccaggagagaggccaggagagcaacagattcgagaagagaatcaacgtgaagagcgaggtgatgcccggccccatcggcctgcccagaaagagagacagaaagtacgacacccccggcaagagaagcagatacaacatcgacctggtgaaccacagcagaagctacaccaagatgaagaccttcgagtgcaacatctgcgagaagatcttcaagcagctgatccacctgaccgagcacatgagaatccacaccggcgagaagcccttcagatgcaaggagtgcggcaaggccttcagccagagcagcagcctgatcccccaccagagaatccacaccggcgagaagccctacgagtgcaaggagtgcggcaagaccttcagacaccccagcagcctgacccagcacgtgagaatccacaccggcgagaagccctacgagtgcagagtgtgcgagaaggccttcagccagagcatcggcctgatccagcacctgagaacccacgtgagagagaagcccttcacctgcaaggactgcggcaaggccttcttccagatcagacacctgagacagcacgagatcatccacaccggcgtgaagccctacatctgcaacgtgtgcagcaagaccttcagccacagcacctacctgacccagcaccagagaacccacaccggcgagagaccctacaagtgcaaggagtgcggcaaggccttcagccagagaatccacctgagcatccaccagagagtgcacaccggcgtgaagccctacgagtgcagccactgcggcaaggccttcagacacgacagcagcttcgccaagcaccagagaatccacaccggcgagaagccctacgactgcaacgagtgcggcaaggccttcagctgcagcagcagcctgatcagacactgcaagacccacctgagaaacaccttcagcaacgtggtgtag

SEQ ID NO: 10863 - DNA, 1398 bp, Artificial Sequence
  Description of Artificial Sequence: Synthetic coding sequence
atgctgttcagcgccctgttcttcctgctgtacagcgccttcttcagaagacccgagtaccagagaaccatcttcaagttcctgggctggctgtgcgacctgagcatctacagcctgttcttccccatcagcagaatgagcgccttccagacctggagagacttccccgtgggcgagagaagaagaccctggctgatggagagagacatcagcggcgtgcccagcagcgacctgaagagcaagaccaagaccaaggagagcgccctgcagaacgacatcagctgggaggagctgcactgcggcctgatgatggagagattcaccaagggcagcagcatgtacagcaccctgggcagaatcagcaagtgcaacaagctggagagccagcaggagaaccagagaatgggcaagggccagatccccctgatgtgcaagaagaccttcacccaggagagaggccaggagagcaacagattcgagaagagaatcaacgtgaagagcgaggtgatgcccggccccatcggcctgcccagaaagagagacagaaagtacgacacccccggcaagagaagcagatacaacatcgacctggtgaaccacagcagaagctacaccaagatgaagaccttcgagtgcaacatctgcgagaagatcttcaagcagctgatccacctgaccgagcacatgagaatccacaccggcgagaagcccttcagatgcaaggagtgcggcaaggccttcagccagagcagcagcctgatcccccaccagagaatccacaccggcgagaagccctacgagtgcaaggagtgcggcaagaccttcagacaccccagcagcctgacccagcacgtgagaatccacaccggcgagaagccctacgagtgcagagtgtgcgagaaggccttcagccagagcatcggcctgatccagcacctgagaacccacgtgagagagaagcccttcacctgcaaggactgcggcaaggccttcttccagatcagacacctgagacagcacgagatcatccacaccggcgtgaagccctacatctgcaacgtgtgcagcaagaccttcagccacagcacctacctgacccagcaccagagaacccacaccggcgagagaccctacaagtgcaaggagtgcggcaaggccttcagccagagaatccacctgagcatccaccagagagtgcacaccggcgtgaagccctacgagtgcagccactgcggcaaggccttcagacacgacagcagcttcgccaagcaccagagaatccacaccggcgagaagccctacgactgcaacgagtgcggcaaggccttcagctgcagcagcagcctgatcagacactgcaagacccacctgagaaacaccttcagcaacgtggtgtag

SEQ ID NO: 10864 - DNA, 5499 bp, Artificial Sequence
  Description of Artificial Sequence: Synthetic coding sequence
atggaggacaccccccccagcctgagctgcagcgactgccagagacacttccccagcctgcccgagctgagcagacacagagagctgctgcaccccagccccaaccaggacagcgaggaggccgacagcatccccagaccctacagatgccagcagtgcggcagaggctacagacaccccggcagcctggtgaaccacagaagaacccacgagaccggcctgttcccctgcaccacctgcggcaaggacttcagcaaccccatggccctgaagagccacatgagaacccacgcccccgagggcagaagaagacacagaccccccagacccaaggaggccaccccccacctgcagggcgagaccgtgagcaccgacagctggggccagagactgggcagcagcgagggctgggagaaccagaccaagcacaccgaggagacccccgactgcgagagcgtgcccgaccccagagccgccagcggcacctgggaggacctgcccaccagacagagagagggcctggccagccaccccggccccgaggacggcgccgacggctggggccccagcaccaacagcgccagagccccccccctgcccatccccgccagcagcctgctgagcaacctggagcagtacctggccgagagcgtggtgaacttcaccggcggccaggagcccacccagagcccccccgccgaggaggagagaagatacaagtgcagccagtgcggcaagacctacaagcacgccggcagcctgaccaaccacagacagagccacaccctgggcatctacccctgcgccatctgcttcaaggagttcagcaacctgatggccctgaagaaccacagcagactgcacgcccagtacagaccctaccactgcccccactgccccagagtgttcagactgcccagagagctgctggagcaccagcagagccacgagggcgagagacaggagcccagatgggaggagaagggcatgcccaccaccaacggccacaccgacgagagcagccaggaccagctgcccagcgcccagatgctgaacggcagcgccgagctgagcaccagcggcgagctggaggacagcggcctggaggagtacagacccttcagatgcggcgactgcggcagaacctacagacacgccggcagcctgatcaaccacagaaagagccaccagaccggcgtgtacccctgcagcctgtgcagcaagcagctgttcaacgccgccgccctgaagaaccacgtgagagcccaccacagacccagacagggcgtgggcgagaacggccagcccagcgtgccccccgcccccctgctgctggccgagaccacccacaaggaggaggaggaccccaccaccaccctggaccacagaccctacaagtgcagcgagtgcggcagagcctacagacacagaggcagcctggtgaaccacagacacagccacagaaccggcgagtaccagtgcagcctgtgccccagaaagtaccccaacctgatggccctgagaaaccacgtgagagtgcactgcaaggccgccagaagaagcgccgacatcggcgccgagggcgcccccagccacctgaaggtggagctgccccccgaccccgtggaggccgaggccgccccccacaccgaccaggaccacgtgtgcaagcacgaggaggaggccaccgacatcacccccgccgccgacaagaccgccgcccacatctgcagcatctgcggcctgctgttcgaggacgccgagagcctggagagacacggcctgacccacggcgccggcgagaaggagaacagcagaaccgagaccaccatgagcccccccagagccttcgcctgcagagactgcggcaagagctacagacacagcggcagcctgatcaaccacagacagacccaccagaccggcgacttcagctgcggcgcctgcgccaagcacttccacaccatggccgccatgaagaaccacctgagaagacacagcagaagaagaagcagaagacacagaaagagagccggcggcgccagcggcggcagagaggccaagctgctggccgccgagagctggaccagagagctggaggacaacgagggcctggagagcccccaggaccccagcggcgagagcccccacggcgccgagggcaacctggagagcgacggcgactgcctgcaggccgagagcgagggcgacaagtgcggcctggagagagacgagacccacttccagggcgacaaggagagcggcggcaccggcgagggcctggagagaaaggacgccagcctgctggacaacctggacatccccggcgaggagggcggcggcacccacttctgcgacagcctgaccggcgtggacgaggaccagaagcccgccaccggccagcccaacagcagcagccacagcgccaacgccgtgaccggctggcaggccggcgccgcccacacctgcagcgactgcggccacagcttcccccacgccaccggcctgctgagccacagaccctgccacccccccggcatctaccagtgcagcctgtgccccaaggagttcgacagcctgcccgccctgagaagccacttccagaaccacagacccggcgaggccaccagcgcccagcccttcctgtgctgcctgtgcggcatgatcttccccggcagagccggctacagactgcacagaagacaggcccacagcagcagcggcatgaccgagggcagcgaggaggagggcgaggaggagggcgtggccgaggccgcccccgccagaagcccccccctgcagctgagcgaggccgagctgctgaaccagctgcagagagaggtggaggccctggacagcgccggctacggccacatctgcggctgctgcggccagacctacgacgacctgggcagcctggagagacaccaccagagccagagcagcggcaccaccgccgacaaggcccccagccccctgggcgtggccggcgacgccatggagatggtggtggacagcgtgctggaggacatcgtgaacagcgtgagcggcgagggcggcgacgccaagagccaggagggcgccggcacccccctgggcgacagcctgtgcatccagggcggcgagagcctgctggaggcccagcccagacccttcagatgcaaccagtgcggcaagacctacagacacggcggcagcctggtgaaccacagaaagatccaccagaccggcgacttcctgtgccccgtgtgcagcagatgctaccccaacctggccgcctacagaaaccacctgagaaaccaccccagatgcaagggcagcgagccccaggtgggccccatccccgaggccgccggcagcagcgagctgcaggtgggccccatccccgagggcggcagcaacaagccccagcacatggccgaggagggccccggccaggccgaggtggagaagctgcaggaggagctgaaggtggagcccctggaggaggtggccagagtgaaggaggaggtgtgggaggagaccaccgtgaagggcgaggagatcgagcccagactggagaccgccgagaagggctgccagaccgaggccagcagcgagagacccttcagctgcgaggtgtgcggcagaagctacaagcacgccggcagcctgatcaaccacagacagagccaccagaccggccacttcggctgccaggcctgcagcaagggcttcagcaacctgatgagcctgaagaaccacagaagaatccacgccgaccccagaagattcagatgcagcgagtgcggcaaggccttcagactgagaaagcagctggccagccaccagagagtgcacatggagagaagaggcggcggcggcaccagaaaggccaccagagaggacagacccttcagatgcggccagtgcggcagaacctacagacacgccggcagcctgctgaaccacagaagaagccacgagaccggccagtacagctgccccacctgccccaagacctacagcaacagaatggccctgaaggaccaccagagactgcacagcgagaacagaagaagaagagccggcagaagcagaagaaccgccgtgagatgcgccctgtgcggcagaagcttccccggcagaggcagcctggagagacacctgagagagcacgaggagaccgagagagagcccgccaacggccagggcggcctggacggcaccgccgccagcgaggccaacctgaccggcagccagggcctggagacccagctgggcggcgccgagcccgtgccccacctggaggacggcgtgcccagacccggcgagagaagccagagccccatcagagccgccagcagcgaggcccccgagcccctgagctggggcgccggcaaggccggcggctggcccgtgggcggcggcctgggcaaccacagcggcggctgggtgccccagttcctgaccagaagcgaggagcccgaggacagcgtgcacagaagcccctgccacgccggcgactgccagctgaacggccccaccctgagccacatggacagctgggacaacagagacaacagcagccagctgcagcccggcagccacagcagctgcagccagtgcggcaagacctactgccagagcggcagcctgctgaaccacaacaccaacaagaccgacagacactactgcctgctgtgcagcaaggagttcctgaaccccgtggccaccaagagccacagccacaaccacatcgacgcccagaccttcgcctgccccgactgcggcaaggccttcgagagccaccaggagctggccagccacctgcaggcccacgccagaggccacagccaggtgcccgcccagatggaggaggccagagaccccaaggccggcaccggcgaggaccaggtggtgctgcccggccagggcaaggcccaggaggcccccagcgagacccccagaggccccggcgagagcgtggagagagccagaggcggccaggccgtgaccagcatggccgccgaggacaaggagagacccttcagatgcacccagtgcggcagaagctacagacacgccggcagcctgctgaaccaccagaaggcccacaccaccggcctgtacccctgcagcctgtgccccaagctgctgcccaacctgctgagcctgaagaaccacagcagaacccacaccgaccccaagagacactgctgcagcatctgcggcaaggccttcagaaccgccgccagactggagggccacggcagagtgcacgcccccagagagggccccttcacctgcccccactgccccagacacttcagaagaagaatcagcttcgtgcagcaccagcagcagcaccaggaggagtggaccgtggccggcagcggcgcccccgtggcccccgtgaccggcagaggcgacctgcccctgccccccccccccacccccaccacccccctgctggaccccagcccccagtggcccgccgacctgagcttcagcctgtag

SEQ ID NO: 10865 - DNA, 5490 bp, Artificial Sequence
  Description of Artificial Sequence: Synthetic coding sequence
atggaggacaccccccccagcctgagctgcagcgactgccagagacacttccccagcctgcccgagctgagcagacacagagagctgctgcaccccagccccaaccaggacagcgaggaggccgacagcatccccagaccctacagatgccagcagtgcggcagaggctacagacaccccggcagcctggtgaaccacagaagaacccacgagaccggcctgttcccctgcaccacctgcggcaaggacttcagcaaccccatggccctgaagagccacatgagaacccacgcccccgagggcagaagaagacacagaccccccagacccaaggaggccaccccccacctgcagggcgagaccgtgagcaccgacagctggggccagagactgggcagcagcgagggctgggagaaccagaccaagcacaccgaggagacccccgactgcgagagcgtgcccgaccccagagccgccagcggcacctgggaggacctgcccaccagacagagagagggcctggccagccaccccggccccgaggacggcgccgacggctggggccccagcaccaacagcgccagagccccccccctgcccatccccgccagcagcctgctgagcaacctggagcagtacctggccgagagcgtggtgaacttcaccggcggccaggagcccacccagagcccccccgccgaggaggagagaagatacaagtgcagccagtgcggcaagacctacaagcacgccggcagcctgaccaaccacagacagagccacaccctgggcatctacccctgcgccatctgcttcaaggagttcagcaacctgatggccctgaagaaccacagcagactgcacgcccagtacagaccctaccactgcccccactgccccagagtgttcagactgcccagagagctgctggagcaccagcagagccacgagggcgagagacaggagcccagatgggaggagaagggcatgcccaccaccaacggccacaccgacgagagcagccaggaccagctgcccagcgcccagatgctgaacggcagcgccgagctgagcaccagcggcgagctggaggacagcggcctggaggagtacagacccttcagatgcggcgactgcggcagaacctacagacacgccggcagcctgatcaaccacagaaagagccaccagaccggcgtgtacccctgcagcctgtgcagcaagcagctgttcaacgccgccgccctgaagaaccacgtgagagcccaccacagacccagacagggcgtgggcgagaacggccagcccagcgtgccccccgcccccctgctgctggccgagaccacccacaaggaggaggaggaccccaccaccaccctggaccacagaccctacaagtgcagcgagtgcggcagagcctacagacacagaggcagcctggtgaaccacagacacagccacagaaccggcgagtaccagtgcagcctgtgccccagaaagtaccccaacctgatggccctgagaaaccacgtgagagtgcactgcaaggccgccagaagaagcgccgacatcggcgccgagggcgcccccagccacctgaaggtggagctgccccccgaccccgtggaggccgaggccgccccccacaccgaccaggaccacgtgtgcaagcacgaggaggaggccaccgacatcacccccgccgccgacaagaccgccgcccacatctgcagcatctgcggcctgctgttcgaggacgccgagagcctggagagacacggcctgacccacggcgccggcgagaaggagaacagcagaaccgagaccaccatgagcccccccagagccttcgcctgcagagactgcggcaagagctacagacacagcggcagcctgatcaaccacagacagacccaccagaccggcgacttcagctgcggcgcctgcgccaagcacttccacaccatggccgccatgaagaaccacctgagaagacacagcagaagaagaagcagaagacacagaaagagagccggcggcgccagcggcggcagagaggccaagctgctggccgccgagagctggaccagagagctggaggacaacgagggcctggagagcccccaggaccccagcggcgagagcccccacggcgccgagggcaacctggagagcgacggcgactgcctgcaggccgagagcgagggcgacaagtgcggcctggagagagacgagacccacttccagggcgacaaggagagcggcggcaccggcgagggcctggagagaaaggacgccagcctgctggacaacctggacatccccggcgaggagggcggcggcacccacttctgcgacagcctgaccggcgtggacgaggaccagaagcccgccaccggccagcccaacagcagcagccacagcgccaacgccgtgaccggctggcaggccggcgccgcccacacctgcagcgactgcggccacagcttcccccacgccaccggcctgctgagccacagaccctgccacccccccggcatctaccagtgcagcctgtgccccaaggagttcgacagcctgcccgccctgagaagccacttccagaaccacagacccggcgaggccaccagcgcccagcccttcctgtgctgcctgtgcggcatgatcttccccggcagagccggctacagactgcacagaagacaggcccacagcagcagcggcatgaccgagggcagcgaggaggagggcgaggaggagggcgtggccgaggccgcccccgccagaagcccccccctgcagctgagcgaggccgagctgctgaaccagctgcagagagaggtggaggccctggacagcgccggctacggccacatctgcggctgctgcggccagacctacgacgacctgggcagcctggagagacaccaccagagccagagcagcggcaccaccgccgacaaggcccccagccccctgggcgtggccggcgacgccatggagatggtggtggacagcgtgctggaggacatcgtgaacagcgtgagcggcgagggcggcgacgccaagagccaggagggcgccggcacccccctgggcgacagcctgtgcatccagggcggcgagagcctgctggaggcccagcccagacccttcagatgcaaccagtgcggcaagacctacagacacggcggcagcctggtgaaccacagaaagatccaccagaccggcgacttcctgtgccccgtgtgcagcagatgctaccccaacctggccgcctacagaaaccacctgagaaaccaccccagatgcaagggcagcgagccccaggtgggccccatccccgaggccgccggcagcagcgagctgcaggtgggccccatccccgagggcggcagcaacaagccccagcacatggccgaggagggccccggccaggccgaggtggagaagctgcaggaggagctgaaggtggagcccctggaggaggtggccagagtgaaggaggaggtgtgggaggagaccaccgtgaagggcgaggagatcgagcccagactggagaccgccgagaagggctgccagaccgaggccagcagcgagagacccttcagctgcgaggtgtgcggcagaagctacaagcacgccggcagcctgatcaaccacagacagagccaccagaccggccacttcggctgccaggcctgcagcaagggcttcagcaacctgatgagcctgaagaaccacagaagaatccacgccgaccccagaagattcagatgcagcgagtgcggcaaggccttcagactgagaaagcagctggccagccaccagagagtgcacatggagagaagaggcggcggcggcaccagaaaggccaccagagaggacagacccttcagatgcggccagtgcggcagaacctacagacacgccggcagcctgctgaaccacagaagaagccacgagaccggccagtacagctgccccacctgccccaagacctacagcaacagaatggccctgaaggaccaccagagactgcacagcgagaacagaagaagaagagccggcagaagcagaagaaccgccgtgagatgcgccctgtgcggcagaagcttccccggcagaggcagcctggagagacacctgagagagcacgaggagaccgagagagagcccgccaacggccagggcggcctggacggcaccgccgccagcgaggccaacctgaccggcagccagggcctggagacccagctgggcggcgccgagcccgtgccccacctggaggacggcgtgcccagacccggcgagagaagccagagccccatcagagccgccagcagcgaggcccccgagcccctgagctggggcgccggcaaggccggcggctggcccgtgggcggcggcctgggcaaccacagcggcggctgggtgccccagttcctgaccagaagcgaggagcccgaggacagcgtgcacagaagcccctgccacgccggcgactgccagctgaacggccccaccctgagccacatggacagctgggacaacagagacaacagcagccagctgcagcccggcagccacagcagctgcagccagtgcggcaagacctactgccagagcggcagcctgctgaaccacaacaccaacaagaccgacagacactactgcctgctgtgcagcaaggagttcctgaaccccgtggccaccaagagccacagccacaaccacatcgacgcccagaccttcgcctgccccgactgcggcaaggccttcgagagccaccaggagctggccagccacctgcaggcccacgccagaggccacagccaggtgcccgcccagatggaggaggccagagaccccaaggccggcaccggcgaggaccaggtggtgctgcccggccagggcaaggcccaggaggcccccagcgagacccccagaggccccggcgagagcgtggagagagccagaggcggccaggccgtgaccagcatggccgccgaggacaaggagagacccttcagatgcacccagtgcggcagaagctacagacacgccggcagcctgctgaaccaccagaaggcccacaccaccggcctgtacccctgcagcctgtgccccaagctgctgcccaacctgctgagcctgaagaaccacagcagaacccacaccgaccccaagagacactgctgcagcatctgcggcaaggccttcagaaccgccgccagactggagggccacggcagagtgcacgcccccagagagggccccttcacctgcccccactgccccagacacttcagaagaagaatcagcttcgtgcagcaccagcagcagcaccaggaggagtggaccgtggccggcagcggcagaggccacgagggcagccaggaggaggtgggcacccagtggagaggcaagagcagccccaaggtgggcggcggcgccagaagcgagagaagagagcccagaggcttctag

SEQ ID NO: 10866 - DNA, 723 bp, Artificial Sequence
  Description of Artificial Sequence: Synthetic coding sequence
atggaggacaccccccccagcctgagctgcagcgactgccagagacacttccccagcctgcccgagctgagcagacacagagagctgctgcaccccagccccaaccaggacagcgaggaggccgacagcatccccagaccctacagatgccagcagtgcggcagaggctacagacaccccggcagcctggtgaaccacagaagaacccacgagaccggcctgttcccctgcaccacctgcggcaaggacttcagcaaccccatggccctgaagagccacatgagaacccacgcccccgagggcagaagaagacacagaccccccagacccaaggaggccaccccccacctgcagggcgagaccgtgagcaccgacagctggggccagagactgggcagcagcgagggctgggagaaccagaccaagcacaccgaggagacccccgactgcgagagcgtgcccgaccccagagccgccagcggcacctgggaggacctgcccaccagacagagagagggcctggccagccaccccggccccgaggacggcgccgacggctggggccccagcaccaacagcgccagagccccccccctgcccatccccgccagcagcctgctgagcaacctggagcagtacctggccgagagcgtggtgaacttcaccggcggccaggagcccacccagagcccccccgccgaggaggagagaagatacaagtag

SEQ ID NO: 10867 - DNA, 582 bp, Artificial Sequence
  Description of Artificial Sequence: Synthetic coding sequence
gagagaagatacaagtgcagccagtgcggcaagacctacaagcacgccggcagcctgaccaaccacagacagagccacaccctgggcatctacccctgcgccatctgcttcaaggagttcagcaacctgatggccctgaagaaccacagcagactgcacgcccagtacagaccctaccactgcccccactgccccagagtgttcagactgcccagagagctgctggagcaccagcagagccacgaggccgccagacccttcagctgcgaggtgtgcggcagaagctacaagcacgccggcagcctgatcaaccacagacagagccaccagaccggccacttcggctgccaggcctgcagcaagggcttcagcaacctgatgagcctgaagaaccacagaagaatccacgccgaccccagaagattcagatgcagcgagtgcggcaaggccttcagactgagaaagcagctggccagccaccagagagtgcacatggagagacacagacccttcagatgcggccagtgcggcagaacctacagacacgccggcagcctgctgaaccacagaagaagccactag

SEQ ID NO: 10868 - DNA, 1707 bp, Artificial Sequence
  Description of Artificial Sequence: Synthetic coding sequence
atggcccaggtggacagccaggacagatggggcgaggccagccccctgagcagcctgaccgaggaggcccacgacacccagatgctgagcatgaacctggagagcgacgacgaggacggcggcgaggccgagaaggagggcaccgccgaccccgtggcctgccccagaggcagcagccccgtgacccacgagaaccccgacctgccctggccccaccccctgggcaaggaggaggagaagttcagcgacagcagcagcgccggcggcatgggccagaagcccgtggagatgagcggcaaggccagctggagcagagacgtgaccaagatcaacgagacccagggcagccccggcgccagcagagccctgggcagcctgcccagcggcctggcccacaagctgctgggccagatgcagcccctgggcgacagactgcccgccggcgacgacggctacagcggcgccaaccaggacgccgtgctggacgtgccccccagcttccccagcaacggcaagtacctgtgcgcccacaagagcgtggacaccagcgccggcaacagcagcctgctgtgcttccccagacccggcagcaactgggacctgcccacccaggagacccacacccccgcccaggccagcgccacccccgccagcctggccgccgccgtgctggccaaggccagaaacagcagaaaggtgcagaaccaggccggcagaagagagggcggcgaggccgaggccagaccctacagatgcctgagaggcggcagagccttccagaagcccagcaagcccctgagccccgccgagaccagaggcggcgccgccaagagatacgcctgcgagctgtgcggcaaggcctacagccacagaggcaccctgcagcagcacagaagactgcacaccggcgagagaccctaccagtgcagcttctgcgacaaggcctacacctggagcagcgaccacagaaagcacatcagaacccacaccggcgagaagccctacccctgccccgactgcggcaaggccttcgtgagaagcagcgacctgagaaagcaccagagaaacatgcacagcaacaacaagcccttcccctgcagcgagtgcggcctgaccttcaacaagcccctgagcctgctgagacaccagagaacccacctgggcgccaagcccttcagatgccccgcctgcgacagagagttcgccgtggccagcagaatggtggagcaccagagagtgcacagcggcgagagacccttcccctgccccacctgcggcaagtgcttcaccaagagcagcaacctgagcgagcaccagaccctgcacaccggccagagacccttcaagtgcgccgactgcggcgtggccttcgcccagcccagcagactggtgagacaccagagaatccacaccggcgagagacccttcccctgcacccagtgcggccaggccttcgccagaagcagcaccctgaagagacaccagcagatccacagcggcgagaagggcttcctgtgcgccgagtgcggcagagccttcagaatcgccagcgagctggcccagcacatcagaatgcacaacggcgagagaccctaccagtgcgaggactgcggccaggccttcaccagaagcaaccacctgcagagacacagagccaagcacggcacctgcaagaaggagcccatccccagcagcagcgacgagtag

SEQ ID NO: 10869 - DNA, 1821 bp, Artificial Sequence
  Description of Artificial Sequence: Synthetic coding sequence
atgagccacaccgccagcagctgccaggagctggtggagaactgcgccgtgcacgtggccggcatggcccaggaggacagcagaagaggccaggtgcccagcagcttctaccacggcgccaaccaggagctggacctgagcaccaaggtgtacaagagagagagcggcagcccctacagcgtgctggtggacaccaagatgagcaagccccacctgcacgagaccgaggagcagccctacttcagagagaccagagccgtgagcgacgtgcacgccgtgaaggaggacagagagaacagcgacgacaccgaggaggaggaggaggaggtgagctacaagagagagcagatcatcgtggaggtgaacctgaacaaccagaccctgaacgtgagcaagggcgagaagggcgtgagcagccagagcaaggagacccccgtgctgaagaccagcagcgaggaggaggaggaggagagcgaggaggaggccaccgacgacagcaacgactacggcgagaacgagaagcagaagaagaaggagaagatcgtggagaaggtgagcgtgacccagagaagaaccagaagagccgccagcgtggccgccgccaccaccagccccacccccagaaccaccagaggcagaagaaagagcgtggagccccccaagagaaagaagagagccaccaaggagcccaaggcccccgtgcagaaggccaagtgcgaggagaaggagaccctgacctgcgagaagtgccccagagtgttcaacaccagatggtacctggagaagcacatgaacgtgacccacagaagaatgcagatctgcgacaagtgcggcaagaagttcgtgctggagagcgagctgagcctgcaccagcagaccgactgcgagaagaacatccagtgcgtgagctgcaacaagagcttcaagaagctgtggagcctgcacgagcacatcaagatcgtgcacggctacgccgagaagaagttcagctgcgagatctgcgagaagaagttctacaccatggcccacgtgagaaagcacatggtggcccacaccaaggacatgcccttcacctgcgagacctgcggcaagagcttcaagagaagcatgagcctgaaggtgcacagcctgcagcacagcggcgagaagcccttcagatgcgagaactgcgacgagagattccagtacaagtaccagctgagaagccacatgagcatccacatcggccacaagcagttcatgtgccagtggtgcggcaaggacttcaacatgaagcagtacttcgacgagcacatgaagacccacaccggcgagaagcccttcatctgcgagatctgcggcaagagcttcaccagcagacccaacatgaagagacacagaagaacccacaccggcgagaagccctacccctgcgacgtgtgcggccagagattcagattcagcaacatgctgaaggcccacaaggagaagtgcttcagagtgaccagccccgtgaacgtgccccccgccgtgcagatccccctgaccaccagccccgccacccccgtgcccagcgtggtgaacaccgccaccacccccaccccccccatcaacatgaaccccgtgagcaccctgccccccagacccatcccccaccccttcagccacctgcacatccacccccacccccaccacccccaccacctgcccatcccccccgtgccccacctgccccccccccccgccctgttcaagagcgagcccctgaaccacagaggccagagcgaggacaacttcctgagacacctggccgagaagaacagcagcgcccagcaccactag

SEQ ID NO: 10870 - DNA, 1821 bp, Artificial Sequence; identical to SEQ ID NO: 10869
  Description of Artificial Sequence: Synthetic coding sequence

SEQ ID NO: 10871 - DNA, 1281 bp, Artificial Sequence
  Description of Artificial Sequence: Synthetic coding sequence
atgagccacaccgccagcagctgccaggagctggtggagaactgcgccgtgcacgtggccggcatggcccaggaggacagcagaagaggccaggtgcccagcagcttctaccacggcgccaaccaggagctggacctgagcaccaaggtgtacaagagagagagcggcagcccctacagcgtgctggtggacaccaagatgagcaagccccacctgcacgagaccgaggagcagccctacttcagagagaccagagccgtgagcgacgtgcacgccgtgaaggaggacagagagaacagcgacgacaccgaggaggaggaggaggaggtgagctacaagagagagcagatcatcgtggagtgcgtgagctgcaacaagagcttcaagaagctgtggagcctgcacgagcacatcaagatcgtgcacggctacgccgagaagaagttcagctgcgagatctgcgagaagaagttctacaccatggcccacgtgagaaagcacatggtggcccacaccaaggacatgcccttcacctgcgagacctgcggcaagagcttcaagagaagcatgagcctgaaggtgcacagcctgcagcacagcggcgagaagcccttcagatgcgagaactgcgacgagagattccagtacaagtaccagctgagaagccacatgagcatccacatcggccacaagcagttcatgtgccagtggtgcggcaaggacttcaacatgaagcagtacttcgacgagcacatgaagacccacaccggcgagaagcccttcatctgcgagatctgcggcaagagcttcaccagcagacccaacatgaagagacacagaagaacccacaccggcgagaagccctacccctgcgacgtgtgcggccagagattcagattcagcaacatgctgaaggcccacaaggagaagtgcttcagagtgaccagccccgtgaacgtgccccccgccgtgcagatccccctgaccaccagccccgccacccccgtgcccagcgtggtgaacaccgccaccacccccaccccccccatcaacatgaaccccgtgagcaccctgccccccagacccatcccccaccccttcagccacctgcacatccacccccacccccaccacccccaccacctgcccatcccccccgtgccccacctgccccccccccccgccctgttcaagagcgagcccctgaaccacagaggccagagcgaggacaacttcctgagacacctggccgagaagaacagcagcgcccagcaccactag

SEQ ID NO: 10872 - DNA, 1848 bp, Artificial Sequence
  Description of Artificial Sequence: Synthetic coding sequence
atggccgagagagccctggagcccgaggccgaggccgaggccgaggccggcgccggcggcgaggccgccgccgaggagggcgccgccggcagaaaggccagaggcagacccagactgaccgagagcgacagagccagaagaagactggagagcagaaagaagtacgacgtgagaagagtgtacctgggcgaggcccacggcccctgggtggacctgagaagaagaagcggctggagcgacgccaagctggccgcctacctgatcagcctggagagaggccagagaagcggcagacacggcaagccctgggagcaggtgcccaagaagcccaagagaaagaagagaagaagaagaaacgtgaactgcctgaagaacgtggtgatctggtacgaggaccacaagcacagatgcccctacgagccccacctggccgagctggaccccaccttcggcctgtacaccaccgccgtgtggcagtgcgaggccggccacagatacttccaggacctgcacagccccctgaagcccctgagcgacagcgaccccgacagcgacaaggtgggcaacggcctggtggccggcagcagcgacagcagcagcagcggcagcgccagcgacagcgaggagagccccgagggccagcccgtgaaggccgccgccgccgccgccgccgccacccccaccagccccgtgggcagcagcggcctgatcacccaggagggcgtgcacatccccttcgacgtgcaccacgtggagagcctggccgagcagggcacccccctgtgcagcaaccccgccggcaacggccccgaggccctggagaccgtggtgtgcgtgcccgtgcccgtgcaggtgggcgccggccccagcgccctgttcgagaacgtgccccaggaggccctgggcgaggtggtggccagctgccccatgcccggcatggtgcccggcagccaggtgatcatcatcgccggccccggctacgacgccctgaccgccgagggcatccacctgaacatggccgccggcagcggcgtgcccggcagcggcctgggcgaggaggtgccctgcgccatgatggagggcgtggccgcctacacccagaccgagcccgagggcagccagcccagcaccatggacgccaccgccgtggccggcatcgagaccaagaaggagaaggaggacctgtgcctgctgaagaaggaggagaaggaggagcccgtggcccccgagctggccaccaccgtgcccgagagcgccgagcccgaggccgaggccgacggcgaggagctggacggcagcgacatgagcgccatcatctacgagatccccaaggagcccgagaagagaagaagaagcaagagaagcagagtgatggacgccgacggcctgctggagatgttccactgcccctacgagggctgcagccaggtgtacgtggccctgagcagcttccagaaccacgtgaacctggtgcacagaaagggcaagaccaaggtgtgcccccaccccggctgcggcaagaagttctacctgagcaaccacctgagaagacacatgatcatccacagcggcgtgagagagttcacctgcgagacctgcggcaagagcttcaagagaaagaaccacctggaggtgcacagaagaacccacaccggcgagacccccctgcagtgcgagatctgcggctaccagtgcagacagagagccagcctgaactggcacatgaagaagcacaccgccgaggtgcagtacaacttcacctgcgacagatgcggcaagagattcgagaagctggacagcgtgaagttccacaccctgaagagccaccccgaccacaagcccacctag

SEQ ID NO: 10873 - DNA, 1746 bp, Artificial Sequence
  Description of Artificial Sequence: Synthetic coding sequence
atgctgtgcaacaaggagttcctgggcggccacatcgtgagacacgcccaggcccaccagaagaagggcagcttcgcctgcgtgatctgcggcagaaagttcagaaacagaggcctgatgcagaagcacctgaagaaccacgtgaagaagatccagagacagcagatcgccgccgcccagcaggacgaccaggaggtgaccgccctggaggagatcaactgcagcagcagcagcatcagcttcgagaacggcaacagcgacagcaaggacctggaggtggagaccctgaccgccagcagcgagggcaacaaggaggtgatccccgagcacgtggccgagttcatcgagatccccatcagcgtgcccgaggacgtgatcgagaacgtgatcgagaacggcagccccaacaacagcctgaacaacgtgttcaagcccctgaccgagtgcggcgacgactacgaggaggaggaggacgaggagggcgactacgaggaggacgactacgacctgaaccaggagaccagcgtgatccacaagatcaacggcaccgtgtgccaccccaaggacatctacgccaccgaccaggagggcaacttcaagtgccccgccctgggctgcgtgagaatcttcaagagaatcggcttcctgaacaagcacgccatgaccgtgcaccccaccgacctgaacgtgagacagaccgtgatgaagtggagcaagggcaagtgcaagttctgccagagacagttcgaggacagccagcacttcatcgaccacctgaacagacacagctaccccaacgtgtacttctgcctgcacttcaactgcaacgagagcttcaagctgcccttccagctggcccagcacaccaagagccacagaatcttccaggcccagtgcagcttccccgagtgccacgagctgttcgaggacctgcccctgctgtacgagcacgaggcccagcactacctgagcaagacccccgagagcagcgcccagcccagcgagaccatcctgtgggacgtgcagaccgacagcaaccccaaccaggagaaggacagcagcagcaacgagaagcagaccatcagcctgcccgtgagcaccagcaagagcagaaaggagagcaccgagcccaagacctgcatcgagagcatggagaagaagaccgacagcctggtgcagaacggcaacgagagaagcgacgacaccgtgagcaacatcagcctgatcgaccagaagatgcccgacatcgagcccaacagcgagaacaactgcagcagcagcgacatcgtgaacggccacagcgagatcgagcagacccccctggtgagcagcgaccccgccctgaagatcgacaccaacagaatcagaaccgagaacggcagcatcctgcccagcgtggtgccccaggagcacaacaccctgcccgtgagccaggcccccagcaagcccaacctgaccagcgagcacaccagctacggcctgatcctgaccaagccctacgtgagacccctgccccccagctacctggacgagagatacctgagcatgcccaagagaagaaagttcctgaccgacagagtggacgcctgcagcgaccaggacaacgtgtacaagaagagcgtgaagagactgagatgcggcaagtgcctgaccacctactgcaacgccgaggccctggaggcccacctggcccagaagaagtgccagaccctgttcggcttcgacagcgacgacgagagcgcctag

SEQ ID NO: 10874 - DNA, 3180 bp, Artificial Sequence
  Description of Artificial Sequence: Synthetic coding sequence
atgaacatgagccaggccagcgtgagcttccaggacgtgaccgtggagttcaccagagaggagtggcagcacctgggccccgtggagagaaccctgtacagagacgtgatgctggagaactacagccacctgatcagcgtgggctactgcatcaccaagcccaaggtgatcagcaagctggagaagggcgaggagccctggagcctggaggacgagttcctgaaccagagataccccggctacttcaaggtggaccacatcaagggcatcagagagaagcaggagaagcccctgtggcaggagatcttcatcagcgacgccgacaagaccctgagcaaggagggccagaaggtgctggagaagcccttcaacctggagatcgcccccgagctgagcgagaagatcagctgcaagtgcgacagccacagaatgaacctgcccgtggccagccagctgatcatcagcgagagaaagtacagcagaaagaagaccgagtacatgaacgtgtgcgagaagctgcagctggacatcaagcacgagaaggcccacgccgaggagaagagctacgagcacggcgagaacgccaaggccttcagctacaagaaggaccagcactggaagttccagaccctggaggagagcttcgagtgcgacggcagcggccagggcctgtacgacaagaccatctgcatcaccccccagagcttcctgaccggcgagaagagctgcaaggacgacgagttcagaaagaacttcgacaagatcaccctgttcaaccacatgagaaccgacaccagaggcaagtgcagcgacctgaacgagtacggcaccagctgcgacaagaccaccgccgtggagtacaacaaggtgcacatggccatgacccactacgagtgcaacgagagaggcatcaacttcagcagaaagagccccctgacccagagccagagaaccatcaccggctggagcgccttcgagagcaacaagtgcgaggagaacttcagccagagcagcgcccacatcgtgcaccagaagacccaggccggcgacaagttcggcgagcacaacgagtgcaccgacgccctgtaccagaagctggacttcaccgcccaccagagaatccacaccgaggacaagttctacctgagcgacgagcacggcaagtgcagaaagagcttctacagaaaggcccacctgatccagcaccagagaccccacagcggcgagaagacctaccagtacgaggagtgcgccaagagcttctgcagcagcagccaccccatccagcaccccggcacctacgtgggcttcaagctgtacgagtgcaacgagtgcggcaaggccttctgccagaacagcaacctgagcaagcacctgagaatccacaccaaggagaagccctgcgacaacaacggctgcggcagaagctacaagagccccctgatcggccaccagaagaccgacgccgagatggagctgtgcggcggcagcgagtacggcaagaccagccacctgaagggccaccagagaatcctgatgggcgagaagccctacgagtgcatcgagtgcggcaagaccttcagcaagaccagccacctgagagcccaccagagaatccacaccggcgagaagccctacgagtgcgtggagtgcgagaagaccttcagccacaagacccacctgagcgtgcaccagagagtgcacaccggcgagaagccctacgagtgcaacgactgcggcaagagcttcacctacaacagcgccctgagagcccaccagagaatccacaccggcgagaagccctacgagtgcagcgactgcgagaagaccttcgcccacaacagcgccctgagagcccaccacagaatccacaccggcgagaagccctacgagtgcaacgagtgcggcagaagcttcgcccacatcagcgtgctgaaggcccaccagagaatccacaccggcgagaagccctacgagtgcaacgagtgcggcagaagcttcacctacaacagcgccctgagagcccaccagagaatccacaccggcagaaagccctacgagtgcagcgactgcgagaagaccttcgcccacaacagcgccctgaagatccaccagagaatccacaccggcgagaagccctacgagtgcaacgagtgcgagaagaccttcgcccacaacagcgccctgagagcccaccagaacatccacaccggcgagaagctgtacgagtgcagcgagtgcggcaagaccttcttccagaagaccagactgagcacccacagaagaatccacaccggcgagaagccctacgagtgcagcaagtgcggcaagaccttcagccagaagagctacctgagcggccacgagagaatccacaccggcgagaagccctacgagtgcaacgtgtgcggcaagaccttcgtgtacaaggccgccctgatcgtgcaccagagaatccacaccggcgagaagccctacgagtgcaaccagtgcggcaagaccttcagccagagaacccacctgtgcgcccaccagagaatccacaccggcgagaagccctacgagtgcaacgagtgcggcaagaccttcgccgacaacagcgccctgagagcccaccacagaatccacaccggcgagaagccctacgagtgcaacgactgcggcaagaccttcagcaagaccagccacctgagagcccacctgagaaccagaagcggcgagaagccctacgagtgcagcgagtgcggcaagaccttcagcgagaagagctacgtgagcgcccaccagagagtgcacaccggcgagaagccctacgagtgcaacgtgtgcggcaagcccttcgcccacaacagcaccctgagagtgcaccagagaatccacaccggcgagaagagctacgagtgcaacgactgcggcaagaccttcagccagaagagccacctgagcgcccaccagagaatccacaccggcgagaagccctacgagtgcaacgagtgcggcaaggccttcgcccagaacagcaccctgagagtgcaccagagaatccacaccggcgagaagccctacgagtgcgacgagtgcggcaagaccttcgtgagaaaggccgccctgagagtgcaccacaccagaatgcacaccagagagaagaccctggcctgcaacggcttcggcaagagctag

SEQ ID NO: 10875 - DNA, 1848 bp, Artificial Sequence
  Description of Artificial Sequence: Synthetic coding sequence
atgagccaggccagcgtgagcttccaggacgtgaccgtggagttcaccagagaggagtggcagcacctgggccccgtggagagaaccctgtacagagacgtgatgctggagaactacagccacctgatcagcgtgggctactgcatcaccaagcccaaggtgatcagcaagctggagaagggcgaggagccctggagcctggaggacgagttcctgaaccagagataccccggctacttcaaggtggaccacatcaagggcatcagagagaagcaggagaagcccctgtggcaggagatcttcatcagcgacgccgacaagaccctgagcaaggagggccagaaggtgctggagaagcccttcaacctggagatcgcccccgagctgagcgagaagatcagctgcaagtgcgacagccacagaatgaacctgcccgtggccagccagctgatcatcagcgagagaaagtacagcagaaagaagaccgagtacatgaacgtgtgcgagaagctgcagctggacatcaagcacgagaaggcccacgccgaggagaagagctacgagcacggcgagaacgccaaggccttcagctacaagaaggaccagcactggaagttccagaccctggaggagagcttcgagtgcgacggcagcggccagggcctgtacgacaagaccatctgcatcaccccccagagcttcctgaccggcgagaagagctgcaaggacgacgagttcagaaagaacttcgacaagatcaccctgttcaaccacatgagaaccgacaccagaggcaagtgcagcgacctgaacgagtacggcaccagctgcgacaagaccaccgccgtggagtacaacaaggtgcacatggccatgacccactacgagtgcaacgagagaggcatcaacttcagcagaaagagccccctgacccagagccagagaaccatcaccggctggagcgccttcgagagcaacaagtgcgaggagaacttcagccagagcagcgcccacatcgtgcaccagaagacccaggccggcgacaagttcggcgagcacaacgagtgcaccgacgccctgtaccagaagctggacttcaccgcccaccagagaatccacaccgaggacaagttctacctgagcgacgagcacggcaagtgcagaaagagcttctacagaaaggcccacctgatccagcaccagagaccccacagcggcgagaagacctaccagtacgaggagtgcgccaagagcttctgcagcagcagccaccccatccagcaccccggcacctacgtgggcttcaagctgtacgagtgcaacgagtgcggcaaggccttctgccagaacagcaacctgagcaagcacctgagaatccacaccaaggagaagccctgcgacaacaacggctgcggcagaagctacaagagccccctgatcggccaccagaagaccgacgccgagatggagctgtgcggcggcagcgagtacggcaagaccagccacctgaagggccaccagagaatcctgatgggcgagaagccctacgagtgcatcgagtgcggcaagaccttcagcaagaccagccacctgagagcccaccagagaatccacaccggcgagaagccctacgagtgcgtggagtgcgagaagaccttcagccacaagacccacctgagcgtgcaccagagagtgcacaccggcgagaagccctacgagtgcaacgactgcggcaagagcttcacctacaacagcgccctgagagcccaccagagaatccacaccggcctggccgtgtgccacgtgggcatcctgatggccaccaagagcctgttccaccagagctag

SEQ ID NO: 10876 - DNA, 996 bp, Artificial Sequence
  Description of Artificial Sequence: Synthetic coding sequence
atgagaagaaagaccagaaacttcaagcacaagaccgtgaaggacaacaaggtgctgaccgagggcagcgaccaggagagcgagaaggacaacagccagtgctgcgaccccgccaccaacgagagagtgcaggccgagaagagacagtacgtgtgcaccgagtgcggcaaggccttcagccagagcgccaacctgaccgtgcacgagagaatccacaccggcgagaagccctacaagtgcaaggagtgcggcaaggccttcagccacagcagcaacctggtggtgcacagaagaatccacaccggcctgaagccctacacctgcagcgagtgcggcaagagcttcagcggcaagagccacctgatcagacaccagggcatccacagcggcgagaagacctacgagtgcaaggagtgcggcaaggccttcagcagaagcagcggcctgatcagccaccacagagtgcacaccggcgagaagccctacagctgcatcgagtgcggcaaggccttcagcagaagcagcaacctgacccagcaccagagaatgcacagaggcaagaaggtgtacaagtgcaaggagtgcggcaagacctgcggcagcaacaccaagatcatggaccaccagagaatccacaccggcgagaagccctacgagtgcgacgagtgcggcaagaccttcatcctgagaaagaccctgaacgagcaccagagactgcacagaagagagaagccctacaagtgcaacgagtgcggcaaggccttcaccagcaacagaaacctggtggaccaccagagagtgcacaccggcgagaagccctacaagtgcaacgagtgcggcaagaccttcagacagaccagccaggtgatcctgcacctgagaacccacaccaaggagaagccctacaagtgcagcgagtgcggcaaggcctacagatacagcagccagctgatccagcaccagagaaagcacaacgaggagaaggagaccagctag

SEQ ID NO: 10877 - DNA, 120 bp, Artificial Sequence
  Description of Artificial Sequence: Synthetic coding sequence
atgagaagaaagaccagaaacttcaagcacaagaccgtgaaggacaacaaggtgctgaccgagggcagcgaccaggagagcgagaaggacaacagccagtgctgcgaccccgccacctag

SEQ ID NO: 10878 - DNA, 105 bp, Artificial Sequence
  Description of Artificial Sequence: Synthetic coding sequence
atgagaagaaagaccagaaacttcaagcacaagaccgtgaaggacaacaaggtgctgaccgagggcagcgaccaggagagcgagaaggacaacagccagtgctag

SEQ ID NO: 10879 - DNA, 1359 bp, Artificial Sequence
  Description of Artificial Sequence: Synthetic coding sequence
atggccgccgtggccctggccagcggcaccagactgggcctggtgctggagctgctgcccggccagcccgccctgcccagagccagaagagagagcgtgaccttcgaggacgtggccgtgtacttcagcgagaacgagtggatcggcctgggccccgcccagagagccctgtacagagacgtgatgctggagaactacggcgccgtggccagcctggccttccccttccccaagcccgccctgatcagccagctggagagaggcgagaccccctggtgcagcgtgcccagaggcgccctggacggcgaggcccccagaggcatcagcagcgagggcgtgctgaagagaaagaaggaggacttcatcctgaaggaggagatcatcgaggaggcccaggacctgatggtgctgagcagcggcccccagtggtgcggcagccaggagctgtggttcggcaagacctgcgaggagaagagcagactgggcagatggcccggctacctgaacggcggcagaatggagagcagcaccaacgacatcatcgaggtgatcgtgaaggacgagatgatcagcgtggaggagagcagcggcaacaccgacgtgaacaacctgctgggcatccaccacaagatcctgaacgagcagatcttctacatctgcgaggagtgcggcaagtgcttcgaccagaacgaggacttcgaccagcaccagaagacccacaacggcgagaaggtgtacggctgcaaggagtgcggcaaggccttcagcttcagaagccactgcatcgcccaccagagaatccacagcggcgtgaagccctacgagtgccaggagtgcgccaaggccttcgtgtggaagagcaacctgatcagacaccagagaatccacaccggcgagaagcccttcgagtgcaaggagtgcggcaagggcttcagccagaacaccagcctgacccagcaccagagaatccacaccggcgagaagccctacacctgcaaggagtgcggcaagagcttcaccagaaaccccgccctgctgagacaccagagaatgcacaccggcgagaagccctacgagtgcaaggactgcggcaagggcttcatgtggaacagcgacctgagccagcaccagagagtgcacaccggcgacaagccccacgagtgcaccgactgcggcaagagcttcttctgcaaggcccacctgatcagacaccagagaatccacaccggcgagagaccctacaagtgcaacgactgcggcaaggccttcagccagaacagcgtgctgatcaagcaccagagaagacacgccagagacaagccctacaactgccagatcagccacctgctggagcactag

SEQ ID NO: 10880 - DNA, 1281 bp, Artificial Sequence
  Description of Artificial Sequence: Synthetic coding sequence
atgctggagaactacggcgccgtggccagcctggccgccttccccttccccaagcccgccctgatcagccagctggagagaggcgagaccccctggtgcagcgtgcccagaggcgccctggacggcgaggcccccagaggcatcagcagcggctaccccttcctgaagcccgccggcatcagccaccccgagcaggtggaggagcccctgaacctgaagctgcagggcgagggccccagcctgatctgccccgagggcgtgctgaagagaaagaaggaggacttcatcctgaaggaggagatcatcgaggaggcccaggacctgatggtgctgagcagcggcccccagtggtgcggcagccaggagctgtggttcggcaagacctgcgaggagaagagcagactgggcagatggcccggctacctgaacggcggcagaatggagagcagcaccaacgacatcatcgaggtgatcgtgaaggacgagatgatcagcgtggaggagagcagcggcaacaccgacgtgaacaacctgctgggcatccaccacaagatcctgaacgagcagatcttctacatctgcgaggagtgcggcaagtgcttcgaccagaacgaggacttcgaccagcaccagaagacccacaacggcgagaaggtgtacggctgcaaggagtgcggcaaggccttcagcttcagaagccactgcatcgcccaccagagaatccacagcggcgtgaagccctacgagtgccaggagtgcgccaaggccttcgtgtggaagagcaacctgatcagacaccagagaatccacaccggcgagaagcccttcgagtgcaaggagtgcggcaagggcttcagccagaacaccagcctgacccagcaccagagaatccacaccggcgagaagccctacacctgcaaggagtgcggcaagagcttcaccagaaaccccgccctgctgagacaccagagaatgcacaccggcgagaagccctacgagtgcaaggactgcggcaagggcttcatgtggaacagcgacctgagccagcaccagagagtgcacaccggcgacaagccccacgagtgcaccgactgcggcaagagcttcttctgcaaggcccacctgatcagacaccagagaatccacaccggcgagagaccctacaagtgcaacgactgcggcaaggccttcagccagaacagcgtgctgatcaagcaccagagaagacacgccagagacaagccctacaactgccagatcagccacctgctggagcactag

SEQ ID NO: 10881 - DNA, 1281 bp, Artificial Sequence; identical to SEQ ID NO: 10880
  Description of Artificial Sequence: Synthetic coding sequence

SEQ ID NO: 10882 - DNA, 786 bp, Artificial Sequence
  Description of Artificial Sequence: Synthetic coding sequence
atgatctacaagtgccccatgtgcagagagttcttcagcgagagagccgacctgttcatgcaccagaagatccacaccgccgagaagccccacaagtgcgacaagtgcgacaagggcttcttccacatcagcgagctgcacatccactggagagaccacaccggcgagaaggtgtacaagtgcgacgactgcggcaaggacttcagcaccaccaccaagctgaacagacacaagaagatccacaccgtggagaagccctacaagtgctacgagtgcggcaaggccttcaactggagcagccacctgcagatccacatgagagtgcacaccggcgagaagccctacgtgtgcagcgagtgcggcagaggcttcagcaacagcagcaacctgtgcatgcaccagagagtgcacaccggcgagaagcccttcaagtgcgaggagtgcggcaaggccttcagacacaccagcagcctgtgcatgcaccagagagtgcacaccggcgagaagccctacaagtgctacgagtgcggcaaggccttcagccagagcagcagcctgtgcatccaccagagagtgcacaccggcgagaagccctacagatgctgcggctgcggcaaggccttcagccagagcagcagcctgtgcatccaccagagagtgcacaccggcgagaagcccttcaagtgcgacgagtgcggcaaggccttcagccagagcaccagcctgtgcatccaccagagagtgcacaccaaggagagaaaccacctgaagatcagcgtgatctag

SEQ ID NO: 10883 - DNA, 786 bp, Artificial Sequence; identical to SEQ ID NO: 10882
  Description of Artificial Sequence: Synthetic coding sequence

SEQ ID NO: 10884 - DNA, 600 bp, Artificial Sequence
  Description of Artificial Sequence: Synthetic coding sequence
atgatcgtggtgagaatcctggccctgcagcagaacctgatcgacatcagaaagagcacccagtggagaagccccatcaacgtgaccagcggcaaggccttcaactggagcagccacctgcagatccacatgagagtgcacaccggcgagaagccctacgtgtgcagcgagtgcggcagaggcttcagcaacagcagcaacctgtgcatgcaccagagagtgcacaccggcgagaagcccttcaagtgcgaggagtgcggcaaggccttcagacacaccagcagcctgtgcatgcaccagagagtgcacaccggcgagaagccctacaagtgctacgagtgcggcaaggccttcagccagagcagcagcctgtgcatccaccagagagtgcacaccggcgagaagccctacagatgctgcggctgcggcaaggccttcagccagagcagcagcctgtgcatccaccagagagtgcacaccggcgagaagcccttcaagtgcgacgagtgcggcaaggccttcagccagagcaccagcctgtgcatccaccagagagtgcacaccaaggagagaaaccacctgaagatcagcgtgatctag

SEQ ID NO: 10885 - DNA, 786 bp, Artificial Sequence; identical to SEQ ID NO: 10882
  Description of Artificial Sequence: Synthetic coding sequence

SEQ ID NO: 10886 - DNA, 786 bp, Artificial Sequence; identical to SEQ ID NO: 10882
  Description of Artificial Sequence: Synthetic coding sequence

SEQ ID NO: 10887 - DNA, 2037 bp, Artificial Sequence
  Description of Artificial Sequence: Synthetic coding sequence
atggccctgccccagggccagctgaccttcaaggacgtggccatcgagttcagccaggaggagtggacctgcctggaccccgcccagaagaccctgtacagagacgtgatgctggagaactacagaaacctggtgagcctggacatcagctgcaagtgcgtgaacaccgacctgccccccaagggcaagaacaacatgggcgaggccttctacaccgtgaagctggagagactggagagctgcgacaccgtgggcctgagcttccaggaggtgcagaagaacacctacgacttcgagtgccagtggaaggacgacgagggcaactacaagaccgtgctgatgctgcagaaggagaacctgcccggcagaagagcccagagagacagaagagccgccggcaacagacacatcgagaaccagctgggcgtgagcttccagagccacctgcccgagctgcagcagttccagcacgagggcaagatctacgagtacaaccaggtggagaagagccccaacaacagaggcaagcactacaagtgcgacgagtgcggcaaggtgttcagccagaacagcagactgaccagccacaagagaatccacaccggcgagaagccctaccagtgcaacaagtgcggcaaggccttcaccgtgagaagcaacctgaccatccaccaggtgatccacaccggcgagaagccctacaagtgcaacgagtgcggcaaggtgttcagccagcccagcaacctggccggccaccagagaatccacaccggcgagaagccctacaagtgcaacgagtgcggcaaggccttcagagcccacagcaagctgaccacccaccaggtgatccacaccggcgagaagccctacaagtgcaaggagtgcggcaagtgcttcacccagaacagccacctggccagccacagaagaatccacaccggcgagaagccctacaagtgcaacgagtgcggcaaggccttcagcgtgagaagcagcctgaccacccaccagaccatccacaccggcgagaagccctacaagtgcaacgagtgcggcaaggtgttcagacacaacagctacctggccaagcacagaagaatccacaccggcgagaagccctacaagtgcaacgagtgcggcaaggccttcagcatgcacagcaacctgaccaagcaccagatcatccacaccggcgagaagcccttcaagtgcaacgagtgcgtgaaggtgttcacccagtacagccacctggccaaccacagaagaatccacaccggcgagaagccctacagatgcgacgagtgcggcaaggccttcagcgtgagaagcagcctgaccacccaccaggccatccacaccggcgagaagccctacaagtgcaacgactgcggcaaggtgttcacccagaacagccacctggccagccacagaggcatccacagcggcgagaagccctacaagtgcgacgagtgcggcaaggccttcagccagaccagccagctggccagacactggagagtgcacaccggcgagaagccctacaagtgcaacgagtgcggcaaggccttcagcgtgcacagcagcctgaccatccaccagaccatccacaccggccagaagccctacaagtgcaacgactgcggcaaggtgttcagacacaacagctacctggccatccaccagagaatccacaccggcgagaagccctacaagtgcaacgagtgcggcaaggccttcagcgtgcacagcaacctggccacccaccaggtgatccacaccggcgagaagccctacaagtgcaacgagtgcggcaaggtgttcacccagaacagccacctggccaaccacagaagaatccacaccggcgagaagccctacagatgcaacgagtgcggcaaggccttcagcgtgagaagcaccctgaccacccacatggccgtgcacaccggcgacaagccctacaagtgcaaccagtgcggcaaggtgttcacccagaacagcaacctggccaagcacagaagaatccacagcggctag

SEQ ID NO: 10888 - DNA, 1860 bp, Artificial Sequence
  Description of Artificial Sequence: Synthetic coding sequence
atggaggtggaggccgccgaggccagaagccccgcccccggctacaagagaagcggcagaagatacaagtgcgtgagctgcaccaagaccttccccaacgcccccagagccgccagacacgccgccacccacggccccgccgactgcagcgaggaggtggccgaggtgaagcccaagcccgagaccgaggccaaggccgaggaggccagcggcgagaaggtgagcggcagcgccgccaagcccagaccctacgcctgccccctgtgccccaaggcctacaagaccgcccccgagctgagaagccacggcagaagccacaccggcgagaagcccttcccctgccccgagtgcggcagaagattcatgcagcccgtgtgcctgagagtgcacctggccagccacgccggcgagctgcccttcagatgcgcccactgccccaaggcctacggcgccctgagcaagctgaagatccaccagagaggccacaccggcgagagaccctacgcctgcgccgactgcggcaagagcttcgccgaccccagcgtgttcagaaagcacagaagaacccacgccggcctgagaccctacagctgcgagagatgcggcaaggcctacgccgagctgaaggacctgagaaaccacgagagaagccacaccggcgagagacccttcctgtgcagcgagtgcggcaagagcttcagcagaagcagcagcctgacctgccaccagagaatccacgccgcccagaagccctacagatgccccgcctgcggcaagggcttcacccagctgagcagctaccagagccacgagagaacccacagcggcgagaagcccttcctgtgccccagatgcggcagaatgttcagcgaccccagcagcttcagaagacaccagagagcccacgagggcgtgaagccctaccactgcgagaagtgcggcaaggacttcagacagcccgccgacctggccatgcacagaagagtgcacaccggcgacagacccttcaagtgcctgcagtgcgacaagaccttcgtggccagctgggacctgaagagacacgccctggtgcacagcggccagagacccttcagatgcgaggagtgcggcagagccttcgccgagagagccagcctgaccaagcacagcagagtgcacagcggcgagagacccttccactgcaacgcctgcggcaagagcttcgtggtgagcagcagcctgagaaagcacgagagaacccacagaagcagcgaggccgccggcgtgccccccgcccaggagctggtggtgggcctggccctgcccgtgggcgtggccggcgagagcagcgccgcccccgccgccggcgccggcctgggcgacccccccgccggcctgctgggcctgccccccgagagcggcggcgtgatggccacccagtggcaggtggtgggcatgaccgtggagcacgtggagtgccaggacgccggcgtgagagaggcccccggccccctggagggcgccggcgaggccggcggcgaggaggccgacgagaagcccccccagttcgtgtgcagagagtgcaaggagaccttcagcaccatgaccctgctgagaagacacgagagaagccaccccgagctgagacccttcccctgcacccagtgcggcaagagcttcagcgacagagccggcctgagaaagcacagcagaacccacagcagcgtgagaccctacacctgcccccactgccccaaggccttcctgagcgccagcgacctgagaaagcacgagagaacccaccccgtgcccatgggcacccccacccccctggagcccctggtggccctgctgggcatgcccgaggagggccccgcctag

SEQ ID NO: 10889 - DNA, 1860 bp, Artificial Sequence; identical to SEQ ID NO: 10888
  Description of Artificial Sequence: Synthetic coding sequence

SEQ ID NO: 10890 - DNA, 327 bp, Artificial Sequence
  Description of Artificial Sequence: Synthetic coding sequence
atggaggtggaggccgccgaggccagaagccccgcccccggctacaagagaagcggcagaagatacaagtgcgtgagctgcaccaagaccttccccaacgcccccagagccgccagacacgccgccacccacggccccgccgactgcagcgaggaggtggccgaggtgccccacagaagagcccccctgcccctgctgagagtgagagaggagctgctgcccctgatcctggcccacgtgccccccgcccaccccagaggcaccgaggccctgcccctgcccggcctgagacagggcctgcacgccgcccagttcctgcccgagtag

SEQ ID NO: 10891 - DNA, 279 bp, Artificial Sequence
  Description of Artificial Sequence: Synthetic coding sequence
atggaggtggaggccgccgaggccagaagccccgcccccggctacaagagaagcggcagaagatacaagtgcgtgagctgcaccaagaccttccccaacgcccccagagccgccagacacgccgccacccacggccccgccgactgcagcgaggaggtggccgaggtgaagcccaagcccgagaccgaggccaaggccgaggaggccagcggcgagaaggtgagcggcagcgccgccaagcccagaccctacgcctgccccctgtgccccaaggcctag

SEQ ID NO: 10892 - DNA, 231 bp, Artificial Sequence
  Description of Artificial Sequence: Synthetic coding sequence
atggaggtggaggccgccgaggccagaagccccgcccccggctacaagagaagcggcagaagatacaagtgcgtgagctgcaccaagaccttccccaacgcccccagagccgccagacacgccgccacccacggccccgccgactgcagcgaggaggtggccgaggtgaagcccaagcccgagaccgaggccaaggccgaggaggccagcggcgagaaggtgagcggctag

SEQ ID NO: 10893 - DNA, 312 bp, Artificial Sequence
  Description of Artificial Sequence: Synthetic coding sequence
atggaggtggaggccgccgaggccagaagccccgcccccggctacaagagaagcggcagaagatacaagtgcgtgagctgcaccaagaccttccccaacgcccccagagccgccagacacgccgccacccacggccccgccgactgcagcgaggaggtggccgaggtgaagcccaagcccgagaccgaggccaaggccgaggaggccagcggcgagaaggtgagcggcagcgccgccaagcccagaccctacgcctgccccctgtgccccaaggcctacaagaccgcccccgagctgagaagccacggctag

SEQ ID NO: 10894 - DNA, 1860 bp, Artificial Sequence; identical to SEQ ID NO: 10888
  Description of Artificial Sequence: Synthetic coding sequence

SEQ ID NO: 10895 - DNA, 1860 bp, Artificial Sequence; identical to SEQ ID NO: 10888
  Description of Artificial Sequence: Synthetic coding sequence

SEQ ID NO: 10896 - DNA, 1929 bp, Artificial Sequence
  Description of Artificial Sequence: Synthetic coding sequence
atgagcgagcccggcatgctgggcagaaaggacgtgtgggtgcccagagagacccccttcaccaaggccatggaggtggaggccgccgaggccagaagccccgcccccggctacaagagaagcggcagaagatacaagtgcgtgagctgcaccaagaccttccccaacgcccccagagccgccagacacgccgccacccacggccccgccgactgcagcgaggaggtggccgaggtgaagcccaagcccgagaccgaggccaaggccgaggaggccagcggcgagaaggtgagcggcagcgccgccaagcccagaccctacgcctgccccctgtgccccaaggcctacaagaccgcccccgagctgagaagccacggcagaagccacaccggcgagaagcccttcccctgccccgagtgcggcagaagattcatgcagcccgtgtgcctgagagtgcacctggccagccacgccggcgagctgcccttcagatgcgcccactgccccaaggcctacggcgccctgagcaagctgaagatccaccagagaggccacaccggcgagagaccctacgcctgcgccgactgcggcaagagcttcgccgaccccagcgtgttcagaaagcacagaagaacccacgccggcctgagaccctacagctgcgagagatgcggcaaggcctacgccgagctgaaggacctgagaaaccacgagagaagccacaccggcgagagacccttcctgtgcagcgagtgcggcaagagcttcagcagaagcagcagcctgacctgccaccagagaatccacgccgcccagaagccctacagatgccccgcctgcggcaagggcttcacccagctgagcagctaccagagccacgagagaacccacagcggcgagaagcccttcctgtgccccagatgcggcagaatgttcagcgaccccagcagcttcagaagacaccagagagcccacgagggcgtgaagccctaccactgcgagaagtgcggcaaggacttcagacagcccgccgacctggccatgcacagaagagtgcacaccggcgacagacccttcaagtgcctgcagtgcgacaagaccttcgtggccagctgggacctgaagagacacgccctggtgcacagcggccagagacccttcagatgcgaggagtgcggcagagccttcgccgagagagccagcctgaccaagcacagcagagtgcacagcggcgagagacccttccactgcaacgcctgcggcaagagcttcgtggtgagcagcagcctgagaaagcacgagagaacccacagaagcagcgaggccgccggcgtgccccccgcccaggagctggtggtgggcctggccctgcccgtgggcgtggccggcgagagcagcgccgcccccgccgccggcgccggcctgggcgacccccccgccggcctgctgggcctgccccccgagagcggcggcgtgatggccacccagtggcaggtggtgggcatgaccgtggagcacgtggagtgccaggacgccggcgtgagagaggcccccggccccctggagggcgccggcgaggccggcggcgaggaggccgacgagaagcccccccagttcgtgtgcagagagtgcaaggagaccttcagcaccatgaccctgctgagaagacacgagagaagccaccccgagctgagacccttcccctgcacccagtgcggcaagagcttcagcgacagagccggcctgagaaagcacagcagaacccacagcagcgtgagaccctacacctgcccccactgccccaaggccttcctgagcgccagcgacctgagaaagcacgagagaacccaccccgtgcccatgggcacccccacccccctggagcccctggtggccctgctgggcatgcccgaggagggccccgcctag

SEQ ID NO: 10897 - DNA, 1395 bp, Artificial Sequence
  Description of Artificial Sequence: Synthetic coding sequence
atggtgagcggcctgagactggccagcagaagcggcgaggagggctggctgaagcccgccgtggccagactgggcccccccagacacagactgagaaacctgagaaccgagagcccctggagaagcagaggcagcgtgctgttctgcagcggccccggcagagccggcagagccgccgagcccctgcaccccgtgtgcacctgcggcagacacttcagaagacccgagccctgcagagagcccctggccagccccatccaggacagcgtggccttcgaggacgtggccgtgaacttcacccaggaggagtgggccctgctggacagcagccagaagaacctgtacagagaggtgatgcaggagacctgcagaaacctggccagcgtgggcagccagtggaaggaccagaacatcgaggaccacttcgagaagcccggcaaggacatcagaaaccacatcgtgcagagactgtgcgagagcaaggaggacggccagtacggcgaggtggtgagccagatccccaacctggacctgaacgagaacatcagcaccggcctgaagccctgcgagtgcagcatctgcggcaaggtgttcgtgagacacagcctgctgaacagacacatcctggcccacagcggctacaagccctacggcgagaagcagtacaagtgcgagcagtgcggcaagttcttcgtgagcgtgcccggcgtgagaagacacatgatcatgcacagcggcaaccccgcctacaagtgcaccatctgcggcaaggccttctacttcctgaacagcgtggagagacaccagagaacccacaccggcgagaagccctacaagtgcaagcagtgcggcaaggccttcaccgtgagcggcagctgcctgatccacgagagaacccacaccggcgagaagccctacgagtgcaaggagtgcggcaagaccttcagattcagctgcagcttcaagacccacgagagaacccacaccggcgagagaccctacaagtgcaccaagtgcgacaaggccttcagctgcagcaccagcctgagataccacggcagcatccacaccggcgagagaccctacgagtgcaagcagtgcggcaaggccttcagcagactgagcagcctgtgcaaccacagaagcacccacaccggcgagaagccctacgagtgcaagcagtgcgaccaggccttcagcagactgagcagcctgcacctgcacgagagaatccacaccggcgagaagccctacgagtgcaagaagtgcggcaaggcctacaccagaagcagccacctgaccagacacgagagaagccacgacatcgaggccggctgcagcgacagcgcctacaaccccagcaccctgggcggccagggcgtgtggatcgcctag

SEQ ID NO: 10898 - DNA, 474 bp, Artificial Sequence
  Description of Artificial Sequence: Synthetic coding sequence
atggtgagcggcctgagactggccagcagaagcggcgaggagggctggctgaagcccgccgtggccagactgggcccccccagacacagactgagaaacctgagaaccgagagcccctggagaagcagaggcagcgtgctgttctgcagcggccccggcagagccggcagagccgccgagcccctgcaccccgtgtgcacctgcggcagacacttcagaagacccgagccctgcagagagcccctggccagccccatccaggacagcgtggccttcgaggacgtggccgtgaacttcacccaggaggagtgggccctgctggacagcagccagaagaacctgtacagagaggtgatgcaggagacctgcagaaacctggccagcgtggagatcatcagctacagagactgcgtgaaggtgaagaagatggtgagcatggagaagctgagcgccaagttccagatcctgatctag

SEQ ID NO: 10899 - DNA, 216 bp, Artificial Sequence
  Description of Artificial Sequence: Synthetic coding sequence
atggacagcgtggccttcgaggacgtggccgtgaacttcacccaggaggagtgggccctgctggacagcagccagaagaacctgtacagagaggtgatgcaggagacctgcagaaacctggccagcgtggagatcatcagctacagagactgcgtgaaggtgaagaagatggtgagcatggagaagctgagcgccaagttccagatcctgatctag

SEQ ID NO: 10900 - DNA, 186 bp, Artificial Sequence
  Description of Artificial Sequence: Synthetic coding sequence
atggacagcgtggccttcgaggacgtggccgtgaacttcacccaggaggagtgggccctgctggacagcagccagaagaacctgtacagagaggtgatgcaggagacctgcagaaacctggccagcgaggccaacggcaagaccagaatcctgaagatcaccagcaagaacctgggcaagatctag

SEQ ID NO: 10901 - DNA, 1137 bp, Artificial Sequence
  Description of Artificial Sequence: Synthetic coding sequence
atggacagcgtggccttcgaggacgtggccgtgaacttcacccaggaggagtgggccctgctggacagcagccagaagaacctgtacagagaggtgatgcaggagacctgcagaaacctggccagcgtgggcagccagtggaaggaccagaacatcgaggaccacttcgagaagcccggcaaggacatcagaaaccacatcgtgcagagactgtgcgagagcaaggaggacggccagtacggcgaggtggtgagccagatccccaacctggacctgaacgagaacatcagcaccggcctgaagccctgcgagtgcagcatctgcggcaaggtgttcgtgagacacagcctgctgaacagacacatcctggcccacagcggctacaagccctacggcgagaagcagtacaagtgcgagcagtgcggcaagttcttcgtgagcgtgcccggcgtgagaagacacatgatcatgcacagcggcaaccccgcctacaagtgcaccatctgcggcaaggccttctacttcctgaacagcgtggagagacaccagagaacccacaccggcgagaagccctacaagtgcaagcagtgcggcaaggccttcaccgtgagcggcagctgcctgatccacgagagaacccacaccggcgagaagccctacgagtgcaaggagtgcggcaagaccttcagattcagctgcagcttcaagacccacgagagaacccacaccggcgagagaccctacaagtgcaccaagtgcgacaaggccttcagctgcagcaccagcctgagataccacggcagcatccacaccggcgagagaccctacgagtgcaagcagtgcggcaaggccttcagcagactgagcagcctgtgcaaccacagaagcacccacaccggcgagaagccctacgagtgcaagcagtgcgaccaggccttcagcagactgagcagcctgcacctgcacgagagaatccacaccggcgagaagccctacgagtgcaagaagtgcggcaaggcctacaccagaagcagccacctgaccagacacgagagaagccacgacatcgaggccggctgcagcgacagcgcctacaaccccagcaccctgggcggccagggcgtgtggatcgcctag

SEQ ID NO: 10902 - DNA, 1137 bp, Artificial Sequence; identical to SEQ ID NO: 10901
  Description of Artificial Sequence: Synthetic coding sequence

SEQ ID NO: 10903 - DNA, 1170 bp, Artificial Sequence
  Description of Artificial Sequence: Synthetic coding sequence
atggacagcgtgagcttcgaggacgtggccgtggccttcacccaggaggagtgggccctgctggaccccagccagaagaacctgtacagagacgtgatgcaggagatcttcagaaacctggccagcgtgggcaacaagagcgaggaccagaacatccaggacgacttcaagaaccccggcagaaacctgagcagccacgtggtggagagactgttcgagatcaaggagggcagccagtacggcgagaccttcagccaggacagcaacctgaacctgaacaagaaggtgagcaccggcgtgaagccctgcgagtgcagcgtgtgcggcaaggtgttcatctgccacagcgccctgcacagacacatcctgagccacatcggcaacaagctgttcgagtgcgaggagtgccccgagaagctgtaccactgcaagcagtgcggcaaggccttcatcagcctgaccagcgtggacagacacatggtgacccacaccagcaacggcccctacaagggccccgtgtacgagaagcccttcgacttccccagcgtgttccagatgccccagagcacctacaccggcgagaagacctacaagtgcaagcactgcgacaaggccttcaactacagcagctacctgagagagcacgagagaacccacaccggcgagaagccctacgcctgcaagaagtgcggcaagagcttcaccttcagcagcagcctgagacagcacgagagaagccacaccggcgagaagccctacgagtgcaaggagtgcggcaaggccttcagcagaagcacctacctgggcatccacgagagaacccacaccggcgagaagccctacgagtgcatcaagtgcggcaaggccttcagatgcagcagagtgctgagagtgcacgagagaacccacagcggcgagaagccctacgagtgcaagcagtgcggcaaggccttcaagtacagcagcaacctgtgcgagcacgagagaacccacaccggcgtgaagccctacggctgcaaggagtgcggcaagagcttcaccagcagcagcgccctgagaagccacgagagaacccacaccggcgagaagccctacgagtgcaagaagtgcggcaaggccttcagctgcagcagcagcctgagaaagcacgagagagcctacatgtggtag

SEQ ID NO: 10904 - DNA, 357 bp, Artificial Sequence
  Description of Artificial Sequence: Synthetic coding sequence
atgggcctgctggccttcagagacgtggccctggagttcagccccgaggagtgggagtgcctggaccccgcccagagaagcctgtacagagacgtgatgctggagaactacagaaacctgatcagcctgggcctggccatgagcaagcccgagctgatcatctgcctggaggccagaaaggagccctggaacgtgaacaccgagaagaccgccagacacagcgtggagaccagattcagacacgtgggccaggccggcctgaagctgctgaccagcggcgacccccccgccctggccagccagagcgccggcatcaccggcaccggccaccactgccagcccatctgcgtgttctag

SEQ ID NO: 10905 - DNA, 1605 bp, Artificial Sequence
  Description of Artificial Sequence: Synthetic coding sequence
atgctgagccccgtgagcagagacgccagcgacgccctgcagggcagaaagtgcctgagacccagaagcagaagactgcccctgcccgccgccgtgagagcccacggccccatggccgagctgaccgacagcgccagaggctgcgtggtgttcgaggacgtgttcgtgtacttcagcagagaggagtgggagctgctggacgacgcccagagactgctgtaccacgacgtgatgctggagaacttcgccctgctggccagcctgggcatcgccttcagcagaagcagagccgtgatgaagctggagagaggcgaggagccctgggtgtacgaccaggtggacatgaccagcgccaccgagagagaggcccagagaggcctgagacccggctgctggcacggcgtggaggacgaggaggtgagcagcgagcagagcatcttcgtggccggcgtgagcgaggtgagaaccctgatggccgagctggagagccacccctgcgacatctgcggccccatcctgaaggacaccctgcacctggccaagtaccacggcggcaaggccagacagaagccctacctgtgcggcgcctgcggcaagcagttctggttcagcaccgacttcgaccagcaccagaaccagcccaacggcggcaagctgttccccagaaaggagggcagagacagcgtgaagagctgcagagtgcacgtgcccgagaagaccctgacctgcggcaagggcagaagagacttcagcgccaccagcggcctgctgcagcaccaggccagcctgagcagcatgaagccccacaagagcaccaagctggtgagcggcttcctgatgggccagagataccacagatgcggcgagtgcggcaaggccttcaccagaaaggacaccctggccagacaccagagaatccacaccggcgagagaccctacgagtgcaacgagtgcggcaagttcttcagccagagctacgacctgttcaagcaccagaccgtgcacaccggcgagagaccctacgagtgcagcgagtgcggcaagttcttcagacagatcagcggcctgatcgagcacagaagagtgcacaccggcgagagactgtaccagtgcggcaagtgcggcaagttcttcagcagcaagagcaacctgatcagacaccaggaggtgcacaccggcgccagaccctacgtgtgcagcgagtgcggcaaggagttcagcagaaagcacaccctggtgctgcaccagagaacccacaccggcgagagaccctacgagtgcagcgagtgcggcaaggccttcagccagagcagccacctgaacgtgcactggagaatccacagcagcgactacgagtgcagcagatgcggcaaggccttcagctgcatcagcaagctgatccagcaccagaaggtgcacagcggcgagaagccctacgagtgcagcaagtgcggcaaggccttcacccagagacccaacctgatcagacactggaaggtgcacaccggcgagagaccctacgtgtgcagcgagtgcggcagagagttcatcagaaagcagaccctggtgctgcaccagagagtgcacgccggcgagaagctgtag

SEQ ID NO: 10906 - DNA, 1311 bp, Artificial Sequence
  Description of Artificial Sequence: Synthetic coding sequence
atgaagctggagagaggcgaggagccctgggtgtacgaccaggtggacatgaccagcgccaccgagagagaggcccagagaggcctgagacccggctgctggcacggcgtggaggacgaggaggtgagcagcgagcagagcatcttcgtggccggcgtgagcgaggtgagaaccctgatggccgagctggagagccacccctgcgacatctgcggccccatcctgaaggacaccctgcacctggccaagtaccacggcggcaaggccagacagaagccctacctgtgcggcgcctgcggcaagcagttctggttcagcaccgacttcgaccagcaccagaaccagcccaacggcggcaagctgttccccagaaaggagggcagagacagcgtgaagagctgcagagtgcacgtgcccgagaagaccctgacctgcggcaagggcagaagagacttcagcgccaccagcggcctgctgcagcaccaggccagcctgagcagcatgaagccccacaagagcaccaagctggtgagcggcttcctgatgggccagagataccacagatgcggcgagtgcggcaaggccttcaccagaaaggacaccctggccagacaccagagaatccacaccggcgagagaccctacgagtgcaacgagtgcggcaagttcttcagccagagctacgacctgttcaagcaccagaccgtgcacaccggcgagagaccctacgagtgcagcgagtgcggcaagttcttcagacagatcagcggcctgatcgagcacagaagagtgcacaccggcgagagactgtaccagtgcggcaagtgcggcaagttcttcagcagcaagagcaacctgatcagacaccaggaggtgcacaccggcgccagaccctacgtgtgcagcgagtgcggcaaggagttcagcagaaagcacaccctggtgctgcaccagagaacccacaccggcgagagaccctacgagtgcagcgagtgcggcaaggccttcagccagagcagccacctgaacgtgcactggagaatccacagcagcgactacgagtgcagcagatgcggcaaggccttcagctgcatcagcaagctgatccagcaccagaaggtgcacagcggcgagaagccctacgagtgcagcaagtgcggcaaggccttcacccagagacccaacctgatcagacactggaaggtgcacaccggcgagagaccctacgtgtgcagcgagtgcggcagagagttcatcagaaagcagaccctggtgctgcaccagagagtgcacgccggcgagaagctgtag

SEQ ID NO: 10907 - DNA, 1359 bp, Artificial Sequence
  Description of Artificial Sequence: Synthetic coding sequence
atgttcgccaccagcggcgccgtggccgccggcaagccctacagctgcagcgagtgcggcaagagcttctgctacagcagcgtgctgctgagacacgagagagcccacggcggcgacggcagattcagatgcctggagtgcggcgagagatgcgccagagccgccgacctgagagcccacagaagaacccacgccggccagaccctgtacatctgcagcgagtgcggccagagcttcagacacagcggcagactggacctgcacctgggcgcccacagacagagatgcagaacctgcccctgcagaacctgcggcagaagattcccccacctgcccgccctgctgctgcacagaagaagacagcacctgcccgagagacccagaagatgccccctgtgcgccagaaccttcagacagagcgccctgctgttccaccaggccagagcccaccccctgggcaccaccagcgaccccgccgcccccccccacagatgcgcccagtgccccagagccttcagaagcggcgccggcctgagaagccacgccagaatccacgtgagcagaagccccaccagacccagagtgagcgacgcccaccagtgcggcgtgtgcggcaagtgcttcggcaagagcagcaccctgaccagacacctgcagacccacagcggcgagaagcccttcaagtgccccgagtgcggcaagggcttcctggagagcgccaccctggtgagacaccagagaacccacaccggcgagaagccctacgcctgcggcgactgcggcagatgcttcagcgagagcagcaccctgctgagacacagaagaagccaccagggcgagagaccccacgcctgcgccacctgcggcaagggcttcggccagagaagcgacctggtggtgcaccagagaatccacaccggcgagaagcccttcgcctgccccgagtgcggcagaagattcagcgacagaagcgacctgaccaagcacagaagaacccacaccggcgagaagccctacagatgcgagctgtgcggcaagagattcacctgcgtgagcaacctgaacgtgcacagaagaaaccacgccggccacaagccccacaagtgccccgagtgcagcaaggccttcagcgtggccagcaagctggccctgcacagaaagacccacctgggcgagagacccgccgagtgcgccgagtgcggcaagtgcttcagccacagcagaagcctgagccagcaccagagagcccacaccagagccagaaccgccgccgccgtggccatccagagcgccgtgggcaccgccctggtgttcgagggccccgccgagcaggagaagcccggcttcagcgtgagctag

SEQ ID NO: 10908 - DNA, 672 bp, Artificial Sequence
  Description of Artificial Sequence: Synthetic coding sequence
atgttcgccaccagcggcgccgtggccgccggcaagccctacagctgcagcgagtgcggcaagagcttctgctacagcagcgtgctgctgagacacgagagagcccacggcggcgacggcagattcagatgcctggagtgcggcgagagatgcgccagagccgccgacctgagagcccacagaagaacccacgccggccagaccctgtacatctgcagcgagtgcggccagagcttcagacacagcggcagactggacctgcacctgggcgcccacagacagagatgcagaacctgcccctgcagaacctgcggcagaagattcccccacctgcccgccctgctgctgcacagaagaagacagcacctgcccgagagacccctgctgccctgctgccccagaatcaccagaatcctgagcagcggcgtgggcgccggcagccagggcaccctgagactgccctgcgtgcaggagcccagatgctggtgcgtgcccctgatgctgctgtgcagcctggtgttcctgatcttcctgcccctgttctgcctgctgctgagctacctgatccccgcccacatcttcagcttccccgactacttctgctgccccgccagcagcggcaacggccacagattcggctgcagacacgtgaccagccccgtggccagctag

SEQ ID NO: 10909 - DNA, 114 bp, Artificial Sequence
  Description of Artificial Sequence: Synthetic coding sequence
atgttcgccaccagcggcgccgtggccgccggcaagccctacagctgcagcgagtgcggcaagagcttctgctacagcagcgtgctgctgagacacgagagagcccacggctag

SEQ ID NO: 10910 - DNA, 210 bp, Artificial Sequence
  Description of Artificial Sequence: Synthetic coding sequence
atgttcgccaccagcggcgccgtggccgccggcaagccctacagctgcagcgagtgcggcaagagcttctgctacagcagcgtgctgctgagacacgagagagcccacggcggcgacggcagattcagatgcctggagtgcggcgagagatgcgccagagccgccgacctgagagcccacagaagaacccacgccggccagaccctgtag

SEQ ID NO: 10911 - DNA, 15 bp, Artificial Sequence
  Description of Artificial Sequence: Synthetic coding sequence
atgttcgccacctag

SEQ ID NO: 10912 - DNA, 1767 bp, Artificial Sequence
  Description of Artificial Sequence: Synthetic coding sequence
atgctggagaactacagaaacctggtgttcctgggcatcgccgccttcaagcccgacctgatcatcttcctggagcagggcaaggagccctggaacatgaagagacacgagatggtggaggagccccccgtgatctgcagccacttcagccaggagttctggcccgagcagggcatcgaggacagcttccagaagatgatcctgagaagatacgacaagtgcggccacgagaacctgcacctgaagatcagctgcaccaacgtggacgagtgcaacgtgcacaaggagggctacaacaagctgaaccagagcctgaccaccacccagagcaaggtgttccagtgcggcaagtacgccaacgtgttccacaagtgcagcaacagcaacagacacaagatcagacacaccggcgagaagggcctgaagtgcaaggagtacgtgagaagcttctgcatgctgagccacctgagccagcacgagagaatctacaccagagagaacagctacaagtgcgaggagaacggcaaggccttcaactggagcagcaccctgacctactacaagagcatccacaccggcgagaagccctacaagtgcgaggagtgcggcaaggccttcagcaagttcagcatcctgaccaagcacaaggtgatccacaccggcgagaagccctacaagtgcgaggagtgcggcaaggccttcaacagaagcagcatcctgaccaagcacaagatcatccacaccggcgagaagccctacaagtgcgaggagtgcggcaagggcttcagcagcgtgagcaccctgaacacccacaaggccatccacgccgaggagaagccctacaagtgcgaggagtgcggcaaggccagcaacagcagcagcaagctgatggagcacaagagaatccacaccggcgagaagccctacaagtgcgaggagtgcggcaaggccttcagctggagcagcagcctgaccgagcacaagagaatccacgccggcgagaagccctacaagtgcgaggagtgcggcaaggccttcaacagaagcagcatcctgaccaagcacaagatcatccacaccggcgagaagccctacaagtgcgagggctgcggcaaggccttcagcaaggtgagcaccctgaacacccacaaggccatccacgccgaggagaagccctacaagtgcgaggagtgcggcaaggccagcaacagcagcagcaagctgatggagcacaagagaatccacaccggcgagaagccctacaagtgcgaggagtgcggcaaggccttcagctggagcagcagcctgaccgagcacaagagaatccacgccggcgagaagccctacaagtgcgaggagtgcggcaaggccttcacctggagcagcagcttcaccaagcacaagagaatccacgccgccgagaagccctacaagtgcgaggagtgcggcaagggcttcagcaccttcagcatcctgaccaagcacaagatcatccacaccggcgagaagagatacaagtgcgaggagtgcggcaaggccttcagctggagcagcatcctgaccgagcacaagatcatccacaccggcgagaagccctacaagtgcgaggagtgcggcaaggccttcagcagaagcagcagcctgaccagacacaagagaatccacaccggcgagaagccctacaagtgcgaggagtgcggcaaggccttcaagagcagcagcaccgtgagctaccacaagaagatccacaccggcgagaacccctag

SEQ ID NO: 10913 - DNA, 1755 bp, Artificial Sequence
  Description of Artificial Sequence: Synthetic coding sequence
atggccctgagccagggcctgttcaccttcaaggacgtggccatcgagttcagccaggaggagtgggagtgcctggaccccgcccagagagccctgtacagagacgtgatgctggagaactacagaaacctgctgagcctggacgaggacaacatcccccccgaggacgacatcagcgtgggcttcaccagcaagggcctgagccccaaggagaacaacaaggaggagctgtaccacctggtgatcctggagagaaaggagagccacggcatcaacaacttcgacctgaaggaggtgtgggagaacatgcccaagttcgacagcctgtgggactacgacgtgaagaactacaagggcatgcccctgacctgcaacaagaacctgacccacagaaaggaccagcagcacaacaagagcagcatccacttcagcctgaagcagagcgtgagcatcagagacagcgcccaccagtacttcatccacgacaagcccttcatcagaaacctgctgaagctgaagaacaacatcagatacgccggcaacaagtacgtgaagtgcttcgagaacaagatcggcctgagcctgcaggcccagctggccgagctgcagagattccagaccggcgagaagatgtacgagtgcaaccccgtggagaagagcatcaacagcagcagcgtgagccccctgcccccctgcgtgaagaacatctgcaacaagtacagaaagatcctgaagtaccccctgctgcacacccagtacggcagaacccacatcagagagaagagctacaagtgcaacgactgcggcaaggccttcagcaagagcagcaacctgaccaaccaccagagaatccacagcggccagagaccctacaagtgcaacgagtgcggcaaggccttcaaccagtgcagcaacctgaccagacaccagagagtgcacaccggcgagaagccctaccagtgcaacatctgcggcaaggtgtgcagccagaacagcaacctggccagccaccagagaatgcacaccggcgagaagccctacaagtgcaacgagtgcggcaaggccttcatccagagaagccacctgtggggccacgagagaatccacaccggcgagaagccctacaagtgcaacgagtgcgacaaggccttcgccgagagaagcagcctgacccagcacaagagaatccacaccggcgagaagccctacatctgcaacgagtgcggcaaggccttcaagcagtgcagccacctgaccagacaccagaacatccaccccggcgagaagccccacaagtgcaacgtgtgcggcagagccttcatccagagcagcagcctggtggagcaccagagaatccacaccggcgagaagccctacaagtgcaacaagtgcgacaaggccttcatcaagagaagccacctgtggggccaccagagaacccacaccggcgagaagccctacaagtgcaccgagtgcggcaaggccttcaccgagagaagcaacctgacccagcacaagaagatccacaccggcgagaagccctacaagtgcaccgagtgcggcaaggccttcacccagttcgccaacctgaccagacaccagaagatccacatcgagaagaagcactgcaagcacaacatccacggcaacgccctgttccagagcagcaacctgggcgaccaccagaagagctacaacagagagaagcacatcaagtacaacgagaccaagatcaagtacagcagctgcacctag

SEQ ID NO: 10914 - DNA, 540 bp, Artificial Sequence
  Description of Artificial Sequence: Synthetic coding sequence
atggccctgagccagggcctgttcaccttcaaggacgtggccatcgagttcagccaggaggagtgggagtgcctggaccccgcccagagagccctgtacagagacgtgatgctggagaactacagaaacctgctgagcctggacgaggacaacatcccccccgaggacgacatcagcgtgggcttcaccagcaagggcctgagccccaaggagaacaacaaggaggagctgtaccacctggtgatcctggagagaaaggagagccacggcatcaacaacttcgacctgaaggaggtgtgggagaacatgcccaagttcgacagcctgtgggactacgacgtgaagaactacaagggcatgcccctgacctgcaacaagaacctgacccacagaaaggaccagcagcacaacaagagcagcatccacttcagcctgaagaagaagaagaagaagaagaagaagcagaacaagaccaagcccaaggccaccaaggagaagagaagaaagaacaagggcaagaacaagaccaacaccaagtag

SEQ ID NO: 10915 - DNA, 1578 bp, Artificial Sequence
  Description of Artificial Sequence: Synthetic coding sequence
atgggcaccatcagcctgtgcatcggcgtgtgcgccttcgagggcgccaacaccagcaccagcttctacaagctggtgtacaccgccatcctgagctacagcatccaggacctgctgcccgagcaggacatgaaggacctgtgccagaaggtgaccctgaccagacacagaagctggggcctggacaacctgcacctggtgaaggactggagaaccgtgaacgagggcaagggccagaaggagtactgcaacagactgacccagtgcagcagcaccaagagcaagatcttccagtgcatcgagtgcggcagaaacttcagctggagaagcatcctgaccgagcacaagagaatccacaccggcgagaagccctacaagtgcgaggagtgcggcaaggtgttcaacagatgcagcaacctgaccaagcacaagagaatccacaccggcgagaagccctacaagtgcgacgagtgcggcaaggtgttcaactggtggagccagctgaccaaccacaagaagatccacaccggcgagaagccctacaagtgcgacgagtgcgacaaggtgttcaactggtggagccagctgaccagccacaagaagatccacagcggcgagaagccctacccctgcgaggagtgcggcaaggccttcacccagttcagcaacctgacccagcacaagagaatccacaccggcgagaagccctacaagtgcaaggagtgctgcaaggccttcaacaagttcagcaacctgacccagcacaagagaatccacaccggcgagaagccctacaagtgcgaggagtgcggcaacgtgttcaacgagtgcagccacctgaccagacacagaagaatccacaccggcgagaagccctacaagtgcgaggagtgcggcaaggccttcacccagttcgccagcctgaccagacacaagagaatccacaccggcgagaagccctaccagtgcgaggagtgcggcaagaccttcaacagatgcagccacctgagcagccacaagagaatccacaccggcgagaagccctacaagtgcgaggagtgcggcagaaccttcacccagttcagcaacctgacccagcacaagagaatccacaccggcgagaagccctacaagtgcaaggagtgcggcaaggccttcaacaagttcagcagcctgacccagcacagaagaatccacaccggcgtgaagccctacaagtgcgaggagtgcggcaaggtgttcaagcagtgcagccacctgaccagccacaagagaatccacaccggcgagaagccctacaagtgcaaggagtgcggcaaggccttctaccagagcagcatcctgagcaagcacaagagaatccacaccgaggagaagccctacaagtgcgaggagtgcggcaaggccttcaaccagttcagcagcctgaccagacacaagagaatccacaccggcgagaagagatacaagtgcaaggagtgcggcaagggcttctaccagagcagcatccacagcaagtacaagagaatctacaccggcgaggagcccgacaagtgcaagaagtgcggcagcctgtag

SEQ ID NO: 10916 - DNA, 1743 bp, Artificial Sequence
  Description of Artificial Sequence: Synthetic coding sequence
atgcccggccaccccgagagcagaaagaccagaagaatcctgaccatgctgcccagactggtgctgaacagcttcccccaggtgatcctgctgcccaacccccccaaggtgctgagactgcagggcctgctggccttcagcgacgtggtgatcgagttcagccccgaggagtgggcctgcctggaccccgcccagagaaacctgtacagagacgtgatgttcgagaactacagaaacctggtgagcctggccatcctgagctacagcatccaggacctgctgcccgagcaggacatgaaggacctgtgccagaaggtgaccctgaccagacacagaagctggggcctggacaacctgcacctggtgaaggactggagaaccgtgaacgagggcaagggccagaaggagtactgcaacagactgacccagtgcagcagcaccaagagcaagatcttccagtgcatcgagtgcggcagaaacttcagctggagaagcatcctgaccgagcacaagagaatccacaccggcgagaagccctacaagtgcgaggagtgcggcaaggtgttcaacagatgcagcaacctgaccaagcacaagagaatccacaccggcgagaagccctacaagtgcgacgagtgcggcaaggtgttcaactggtggagccagctgaccaaccacaagaagatccacaccggcgagaagccctacaagtgcgacgagtgcgacaaggtgttcaactggtggagccagctgaccagccacaagaagatccacagcggcgagaagccctacccctgcgaggagtgcggcaaggccttcacccagttcagcaacctgacccagcacaagagaatccacaccggcgagaagccctacaagtgcaaggagtgctgcaaggccttcaacaagttcagcaacctgacccagcacaagagaatccacaccggcgagaagccctacaagtgcgaggagtgcggcaacgtgttcaacgagtgcagccacctgaccagacacagaagaatccacaccggcgagaagccctacaagtgcgaggagtgcggcaaggccttcacccagttcgccagcctgaccagacacaagagaatccacaccggcgagaagccctaccagtgcgaggagtgcggcaagaccttcaacagatgcagccacctgagcagccacaagagaatccacaccggcgagaagccctacaagtgcgaggagtgcggcagaaccttcacccagttcagcaacctgacccagcacaagagaatccacaccggcgagaagccctacaagtgcaaggagtgcggcaaggccttcaacaagttcagcagcctgacccagcacagaagaatccacaccggcgtgaagccctacaagtgcgaggagtgcggcaaggtgttcaagcagtgcagccacctgaccagccacaagagaatccacaccggcgagaagccctacaagtgcaaggagtgcggcaaggccttctaccagagcagcatcctgagcaagcacaagagaatccacaccgaggagaagccctacaagtgcgaggagtgcggcaaggccttcaaccagttcagcagcctgaccagacacaagagaatccacaccggcgagaagagatacaagtgcaaggagtgcggcaagggcttctaccagagcagcatccacagcaagtacaagagaatctacaccggcgaggagcccgacaagtgcaagaagtgcggcagcctgtag

SEQ ID NO: 10917 - DNA, 684 bp, Artificial Sequence
  Description of Artificial Sequence: Synthetic coding sequence
atgcccggccaccccgagagcagaaagaccagaagaatcctgaccatgctgcccagactggtgctgaacagcttcccccaggtgatcctgctgcccaacccccccaaggtgctgagactgcagggcctgctggccttcagcgacgtggtgatcgagttcagccccgaggagtgggcctgcctggaccccgcccagagaaacctgtacagagacgtgatgttcgagaactacagaaacctggtgagcctggccatcctgagctacagcatccaggacctgctgcccgagcaggacatgaaggacctgtgccagaaggtgaccctgaccagacacagaagctggggcctggacaacctgcacctggtgaaggactggagaaccgtgaacgagggcaagggccagaaggagtactgcaacagactgacccagtgcagcagcaccaagagcaagatcttccagtgcatcgagtgcggcagaaacttcagctggagaagcatcctgaccgagcacaagagaatccacaccggcgagaagccctacaagtgcgaggagtgcggcaaggtgttcaacagatgcagcaacctgaccaagcacaagagaatccacaccggcgagaagccctacaagtgcgacgagtgcggcaaggtgttcaactggtggagccagctgaccaaccacaagtag

SEQ ID NO: 10918 - DNA, 1236 bp, Artificial Sequence
  Description of Artificial Sequence: Synthetic coding sequence
atggccaagagacccggcagccccggcagcagagagatgggcctgctgaccttcagagacgtggtgatcgagttcagcctggaggagtggcagtgcctggaccacgcccagcagaacctgtacagagacgtgatgctggagaactacagaaacctggtgagcctgggcatcgccgtgagcaagcccgacctgatcacctgcctggagcagaacaaggagccctggaacatcaagagaaacgagatggtgaccaagcaccccgtgatgtgcagccacttcacccaggacctgccccccgagctgggcatcaaggacagcctgcagaaggtgatccccagaagatacggcaagagcggccacgacaacctgcaggtgaagacctgcaagagcatgggcgagtgcgaggtgcagaagggcggctgcaacgaggtgaaccagtgcctgagcaccacccagaacaagatcttccagacccacaagtgcgtgaaggtgttcggcaagttcagcaacagcaacagacacaagaccagacacaccggcaagaagcacttcaagtgcaagaagtacggcaagagcttctgcatggtgagccagctgcaccagcaccagatcatccacaccagagagaacagctaccagtgcgaggagtgcggcaagcccttcaactgcagcagcaccctgagcaagcacaagagaatccacaccggcgagaagccctacagatgcgaggagtgcggcaaggccttcacctggagcagcaccctgaccaagcacagaagaatccacaccggcgagaagccctacacctgcgaggagtgcggccaggccttcagcagaagcagcaccctggccaaccacaagagaatccacaccggcgagaagccctacacctgcgaggagtgcggcaaggccttcagcctgagcagcagcctgacctaccacaagagaatccacaccggcgagaagccctacacctgcgaggagtgcggcaaggccttcaactgcagcagcaccctgaagaagcacaagatcatccacaccggcgagaagccctacaagtgcaaggagtgcggcaaggccttcgccttcagcagcaccctgaacacccacaagagaatccacaccggcgaggagccctacaagtgcgaggagtgcgacaaggccttcaagtggagcagcagcctggccaaccacaagagcatgcacaccggcgagaagccctacaagtgcgagtag

SEQ ID NO: 10919 - DNA, 1236 bp, Artificial Sequence; identical to SEQ ID NO: 10918
  Description of Artificial Sequence: Synthetic coding sequence

SEQ ID NO: 10920 - DNA, 1593 bp, Artificial Sequence
  Description of Artificial Sequence: Synthetic coding sequence
atgcccggcccccccggcagcctggagatgggccccctgaccttcagagacgtggccatcgagttcagcctggaggagtggcagtgcctggacaccgcccagagaaacctgtacagaaaggtgatgttcgagaactacagaaacctggtgttcctgggcatcgccgtgagcaagccccacctgatcacctgcctggagcagggcaaggagccctggaacagaaagagacaggagatggtggccaagccccccgtgatctacagccacttcaccgaggacctgtggcccgagcacagcatcaaggacagcttccagaaggtgatcctgagaggctacggcaagtgcggccacgagaacctgcagctgagaatcagctgcaagagcgtggacgagagcaaggtgttcaaggagggctacaacgagctgaaccagtgcctgagaaccacccagagcaagatcttccagtgcgacaagtacgtgaaggtgttccacaagttcagcaacagcaacagccacaagaagagaaacaccggcaagaaggtgttcaagtgcaaggagtgcggcaagagcttctgcatgctgagccacctgacccagcacatcagaatccacaccagagagaacagctacaagtgcgaggagtgcggcaaggtgctgaactggttcagcgagctgatcaagcacaagggcatccacatgggcgagaagccctacaagtgcgaggagtgcggcaaggccttcaaccagagcagcaccctgatcaagcacaagaagatccacatcgaggagaagcccttcaagtgcgaggagtgcggcaaggccttcagcctgttcagcatcctgagcaagcacaagatcatccacaccggcgacaagccctacaagtgcgacgagtgccacaaggccttcaactggttcgccaccctgaccaaccacaagagaatccacaccggcgagaagcccttcaagtgcgaggagtgcggcaaggacttcaaccagttcagcaacctgaccaagcacaagaagatccacaccggcgagaagccctacaagtgcgaggagtgcggcaaggccttcaaccagttcgccaacctgaccagacacaagaagatccacaccggcgagaagagctacaagtgcgaggagtgcggcaaggccttcatccagagcagcaacctgaccgagcacatgagaatccacaccggcgagaagccctacaagtgcgaggagtgcggcaaggccttcaacggctgcagcagcctgaccagacacaagagaatccacaccagagagaacacctacaagtgcgaggagtgcggcaagggcttcaccctgttcagcaccctgaccaaccacaaggtgatccacaccggcgagaagagctacaagtgcgacgagtgcggcaacgtgttcaactggcccgccaccctggccaaccacaagagaatccacgccagagagaagccctacaagtgcgaggagtgcggcaaggccttcaacagaagcagccacctgaccagacacaagaagatccacaccggcgagaagctgtacaagcccgagaagtgcgacaacaacttcgacaacacctag

SEQ ID NO: 10921 - DNA, 372 bp, Artificial Sequence
  Description of Artificial Sequence: Synthetic coding sequence
atgcccggcccccccggcagcctggagatgggccccctgaccttcagagacgtggccatcgagttcagcctggaggagtggcagtgcctggacaccgcccagagaaacctgtacagaaaggtgatgttcgagaactacagaaacctggtgttcctgggcatcgccgtgagcaagccccacctgatcacctgcctggagcagggcaaggagccctggaacagaaagagacaggagatggtggccaagccccccgagagctactgcgtggcccaggccgacctggagctgctggtgagcagctacctgaccgccctggccagcctgaagatgtgggactacagaaacaaccccctgtgccaggccaccatgtag

SEQ ID NO: 10922 - DNA, 1731 bp, Artificial Sequence
  Description of Artificial Sequence: Synthetic coding sequence
atggtggccgagccccccgtgatctgcagccacttcgcccaggacttcagccccgagcagaacatcaaggacagcttccagaaggtgacccccagaagatacggcaagtgcgagcacgagaacctgcagctgagcaagagcgtggacgagtgcaaggtgcagaagggcggctacaacggcctgaaccagtgcctgcccaccacccagagcaagatcttccagtgcgacaagtacatgaagatcttccacaagttcagcaacctgaacggccacaaggtgagacacaccagaaagaagcccttcaagtacaaggagttcggcaagagcttctgcatcttcagcaacctgacccagcacaagatcatctgcaccagagtgaacttctacaagtgcgaggactgcggcaaggccttcaacggcagcagcatcttcaccaagcacaagagaatccacatcggcgagaagagctacatctgcgaggagtgcggcaaggcctgcaaccagttcaccaacctgaccacccacaagatcatctacaccagagacaagctgtacaagagagaggagtgcagcaaggccttcaacctgagcagccacatcaccacccacaccatcatccacaccggcgagaacccctacaagagagaggagtgcgacaaggccttcaaccagagcctgaccctgaccacccacaagatcatccacaccagagagaagctgaacgagtacaaggagtgcggcaaggccttcaaccagagcagccacctgaccagacacaagatcatccacaccggcgagaagccctacaagtgcgaggagtgcggcaaggccttcaaccagagcagccacctgaccagacacaagatcatccacaccggcgagaagccctacagatgcgaggagtgcggcaaggccttcagacagagcagccacctgaccacccacaagatcatccacaccggcgagaagccctacaagtgcgaggagtgcggcaaggccttcaacaagagcagccacctgaccagacacaagagcatccacaccggcgagaagccctaccagtgcgagaagtgcggcaaggccagcaaccagagcagcaacctgaccgagcacaagaacatccacaccgaggagaagccctacaagtgcgaggagtgcggcaaggccttcaaccagttcagcaacctgaccacccacaagagaatccacaccggcgagaagccctacaagtgcgaggagtgcggcaaggccttcaaccagagcagcatcctgaccacccacaagagaatccacaccggcgagaagagctacaagtgcgaggagtgcggcaaggccttctacagaagcagcaagctgaccgagcacaagaagatccacaccggcgagaagccctacacctgcgaggagtgcggcaaggccttcaaccacagcagccacctggccacccacaaggtgatccacaccggcgagaagccctaccagtgcgaggagtgcggcaaggccttcaaccagagcagccacctgaccagacacaagagaatccacaccggcgagaagccctaccagtgcgagaagtgcggcaaggccttcaaccagagcagcaacctgaccggccacaagaagatccacaccggcgagaagctgtacaagcccaagagatgcaacagcgacttcgagaacaccagcaagttcagcaagcacaagagaaactacgccggcgagaagagctag

SEQ ID NO: 10923 - DNA, 1938 bp, Artificial Sequence
  Description of Artificial Sequence: Synthetic coding sequence
atggagcccctgaagttcagagacgtggccatcgagttcagcctggaggagtggcagtgcctggacaccatccagcagaacctgtacagaaacgtgatgctggagaactacagaaacctggtgttcctgggcatcgtggtgagcaagcccgacctgatcacctgcctggagcaggagaaggagccctggaccagaaagagacacagaatggtggccgagccccccgtgatctgcagccacttcgcccaggacttcagccccgagcagaacatcaaggacagcttccagaaggtgacccccagaagatacggcaagtgcgagcacgagaacctgcagctgagcaagagcgtggacgagtgcaaggtgcagaagggcggctacaacggcctgaaccagtgcctgcccaccacccagagcaagatcttccagtgcgacaagtacatgaagatcttccacaagttcagcaacctgaacggccacaaggtgagacacaccagaaagaagcccttcaagtacaaggagttcggcaagagcttctgcatcttcagcaacctgacccagcacaagatcatctgcaccagagtgaacttctacaagtgcgaggactgcggcaaggccttcaacggcagcagcatcttcaccaagcacaagagaatccacatcggcgagaagagctacatctgcgaggagtgcggcaaggcctgcaaccagttcaccaacctgaccacccacaagatcatctacaccagagacaagctgtacaagagagaggagtgcagcaaggccttcaacctgagcagccacatcaccacccacaccatcatccacaccggcgagaacccctacaagagagaggagtgcgacaaggccttcaaccagagcctgaccctgaccacccacaagatcatccacaccagagagaagctgaacgagtacaaggagtgcggcaaggccttcaaccagagcagccacctgaccagacacaagatcatccacaccggcgagaagccctacaagtgcgaggagtgcggcaaggccttcaaccagagcagccacctgaccagacacaagatcatccacaccggcgagaagccctacagatgcgaggagtgcggcaaggccttcagacagagcagccacctgaccacccacaagatcatccacaccggcgagaagccctacaagtgcgaggagtgcggcaaggccttcaacaagagcagccacctgaccagacacaagagcatccacaccggcgagaagccctaccagtgcgagaagtgcggcaaggccagcaaccagagcagcaacctgaccgagcacaagaacatccacaccgaggagaagccctacaagtgcgaggagtgcggcaaggccttcaaccagttcagcaacctgaccacccacaagagaatccacaccggcgagaagccctacaagtgcgaggagtgcggcaaggccttcaaccagagcagcatcctgaccacccacaagagaatccacaccggcgagaagagctacaagtgcgaggagtgcggcaaggccttctacagaagcagcaagctgaccgagcacaagaagatccacaccggcgagaagccctacacctgcgaggagtgcggcaaggccttcaaccacagcagccacctggccacccacaaggtgatccacaccggcgagaagccctaccagtgcgaggagtgcggcaaggccttcaaccagagcagccacctgaccagacacaagagaatccacaccggcgagaagccctaccagtgcgagaagtgcggcaaggccttcaaccagagcagcaacctgaccggccacaagaagatccacaccggcgagaagctgtacaagcccaagagatgcaacagcgacttcgagaacaccagcaagttcagcaagcacaagagaaactacgccggcgagaagagctag

SEQ ID NO: 10924 - DNA, 504 bp, Artificial Sequence
  Description of Artificial Sequence: Synthetic coding sequence
atgagaacccacaccggcgagaagccctacaagtgcgaggagtgcggcaaggccttcaacagcagcagcatcctgaccgagcacaaggtgatccacagcggcgagaagccctacaagtgcgagaagtgcgacaaggtgttcaagagattcagctacctgaccaagcacaagagaatccacaccggcgagaagccctacaagtgcgaggagtgcggcaaggccttcaactggagcagcatcctgaccgagcacaagagaatccacaccggcgagaagccctacaactgcgaggagtgcggcaaggccttcaacagatgcagccacctgaccagacacaagaagatccacaccgccgtgaagagatacaagtgcgaggagtgcggcaaggccttcaagagatgcagccacctgaacgagcacaagagagtgcagagaggcgagaagagctgcaagtacaagaagtgcggcgaggccttcaaccactgcagcaacctgaccacctag

SEQ ID NO: 10925 - DNA, 1401 bp, Artificial Sequence
  Description of Artificial Sequence: Synthetic coding sequence
atgctggagaactacagaaacctggtgagcctgggcctgaccgtgagcaagcccgagctgatcagcagactggagcagagacaggagccctggaacgtgaagagacacgagaccatcgccaagccccccgccatgagcagccactacaccgaggacctgctgcccgagcagtgcatgcaggacagcttccagaaggtgatcctgagaagatacggcagctgcggcctggaggacctgcacctgagaaaggacggcgagaacgtgggcgagtgcaaggaccagaaggagatctacaacggcctgaaccagtgcctgagcaccctgcccagcaagatcttcccctacaacaagtgcgtgaaggtgttcagcaagagcagcaacctgaacagagagaacatcagacacaccaccgagaagctgttcaagtgcatgcagtgcggcaaggtgttcaagagccacagcggcctgagctaccacaagatcatccacaccgaggagaagctgtgcatctgcgaggagtgcggcaagaccttcaagtggttcagctacctgaccaagcacaagagaatccacaccggcgagaagccctacaagtgcgaggagtgcggcaaggccttcaactggtgcagcagcctgaccaagcacaagagaatccacaccggcgagaagccctacaagtgcgaggagtgcggcaaggccttccactggtgcagccccttcgtgagacacaagaagatccacaccggcgagaagccctacacctgcgaggactgcggcagagccttcaacagacacagccacctgaccaagcacaagaccatccacaccggcaagaagccctacaagtgcaaggagtgcggcaaggccttcaaccactgcagcctgctgaccatccacgagagaacccacaccggcgagaagccctacaagtgcgaggagtgcggcaaggccttcaacagcagcagcatcctgaccgagcacaaggtgatccacagcggcgagaagccctacaagtgcgagaagtgcgacaaggtgttcaagagattcagctacctgaccaagcacaagagaatccacaccggcgagaagccctacaagtgcgaggagtgcggcaaggccttcaactggagcagcatcctgaccgagcacaagagaatccacaccggcgagaagccctacaactgcgaggagtgcggcaaggccttcaacagatgcagccacctgaccagacacaagaagatccacaccgccgtgaagagatacaagtgcgaggagtgcggcaaggccttcaagagatgcagccacctgaacgagcacaagagagtgcagagaggcgagaagagctgcaagtacaagaagtgcggcgaggccttcaaccactgcagcaacctgaccacctag

SEQ ID NO: 10926 - DNA, 1401 bp, Artificial Sequence; identical to SEQ ID NO: 10925
  Description of Artificial Sequence: Synthetic coding sequence

SEQ ID NO: 10927 - DNA, 1497 bp, Artificial Sequence
  Description of Artificial Sequence: Synthetic coding sequence
atggagctgctgaccttcagagacgtgaccatcgagttcagcctggaggagtgggagttcctgaaccccgcccagcagagcctgtacagaaaggtgatgctggagaactacagaaacctggtgagcctgggcctgaccgtgagcaagcccgagctgatcagcagactggagcagagacaggagccctggaacgtgaagagacacgagaccatcgccaagccccccgccatgagcagccactacaccgaggacctgctgcccgagcagtgcatgcaggacagcttccagaaggtgatcctgagaagatacggcagctgcggcctggaggacctgcacctgagaaaggacggcgagaacgtgggcgagtgcaaggaccagaaggagatctacaacggcctgaaccagtgcctgagcaccctgcccagcaagatcttcccctacaacaagtgcgtgaaggtgttcagcaagagcagcaacctgaacagagagaacatcagacacaccaccgagaagctgttcaagtgcatgcagtgcggcaaggtgttcaagagccacagcggcctgagctaccacaagatcatccacaccgaggagaagctgtgcatctgcgaggagtgcggcaagaccttcaagtggttcagctacctgaccaagcacaagagaatccacaccggcgagaagccctacaagtgcgaggagtgcggcaaggccttcaactggtgcagcagcctgaccaagcacaagagaatccacaccggcgagaagccctacaagtgcgaggagtgcggcaaggccttccactggtgcagccccttcgtgagacacaagaagatccacaccggcgagaagccctacacctgcgaggactgcggcagagccttcaacagacacagccacctgaccaagcacaagaccatccacaccggcaagaagccctacaagtgcaaggagtgcggcaaggccttcaaccactgcagcctgctgaccatccacgagagaacccacaccggcgagaagccctacaagtgcgaggagtgcggcaaggccttcaacagcagcagcatcctgaccgagcacaaggtgatccacagcggcgagaagccctacaagtgcgagaagtgcgacaaggtgttcaagagattcagctacctgaccaagcacaagagaatccacaccggcgagaagccctacaagtgcgaggagtgcggcaaggccttcaactggagcagcatcctgaccgagcacaagagaatccacaccggcgagaagccctacaactgcgaggagtgcggcaaggccttcaacagatgcagccacctgaccagacacaagaagatccacaccgccgtgaagagatacaagtgcgaggagtgcggcaaggccttcaagagatgcagccacctgaacgagcacaagagagtgcagagaggcgagaagagctgcaagtacaagaagtgcggcgaggccttcaaccactgcagcaacctgaccacctag

SEQ ID NO: 10928 - DNA, 1515 bp, Artificial Sequence
  Description of Artificial Sequence: Synthetic coding sequence
atgaaggaggagagcgccgcccagctgggctgctgccacagacccatggccctgggcggcaccggcggcagcctgagccccagcctggacttccagctgttcagaggcgaccaggtgttcagcgcctgcagacccctgcccgacatggtggacgcccacggccccagctgcgccagctggctgtgccccctgcccctggcccccggcagaagcgccctgctggcctgcctgcaggacctggacctgaacctgtgcaccccccagcccgcccccctgggcaccgacctgcagggcctgcaggaggacgccctgagcatgaagcacgagccccccggcctgcaggccagcagcaccgacgacaagaagttcaccgtgaagtacccccagaacaaggacaagctgggcaagcagcccgagagagccggcgagggcgccccctgccccgccttcagcagccacaacagcagcagccccccccccctgcagaacagaaagagccccagccccctggccttctgcccctgcccccccgtgaacagcatcagcaaggagctgcccttcctgctgcacgccttctaccccggctaccccctgctgctgccccccccccacctgttcacctacggcgccctgcccagcgaccagtgcccccacctgctgatgctgccccaggaccccagctaccccaccatggccatgcccagcctgctgatgatggtgaacgagctgggccaccccagcgccagatgggagaccctgctgccctaccccggcgccttccaggccagcggccaggccctgcccagccaggccagaaaccccggcgccggcgccgcccccaccgacagccccggcctggagagaggcggcatggccagccccgccaagagagtgcccctgagcagccagaccggcaccgccgccctgccctaccccctgaagaagaagaacggcaagatcctgtacgagtgcaacatctgcggcaagagcttcggccagctgagcaacctgaaggtgcacctgagagtgcacagcggcgagagacccttccagtgcgccctgtgccagaagagcttcacccagctggcccacctgcagaagcaccacctggtgcacaccggcgagagaccccacaagtgcagcgtgtgccacaagagattcagcagcagcagcaacctgaagacccacctgagactgcacagcggcgccagacccttccagtgcagcgtgtgcagaagcagattcacccagcacatccacctgaagctgcaccacagactgcacgccccccagccctgcggcctggtgcacacccagctgcccctggccagcctggcctgcctggcccagtggcaccagggcgccctggacctgatggccgtggccagcgagaagcacatgggctacgacatcgacgaggtgaaggtgagcagcaccagccagggcaaggccagagccgtgagcctgagcagcgccggcacccccctggtgatgggccaggaccagaacaactag

SEQ ID NO: 10929 - DNA, 507 bp, Artificial Sequence
  Description of Artificial Sequence: Synthetic coding sequence
atgaaggaggagagcgccgcccagctgggctgctgccacagacccatggccctgggcggcaccggcggcagcctgagccccagcctggacttccagctgttcagaggcgaccagagcaccagccaccagggctgcagacccgccccccccatgaccagaaacagccagagcagcacccacagaaccagaaccagctgggagaacagccagaaggagctggccagaggcccccccgcccagcccagccccctgatcaccgccctgccccaccacagatgcagaaccgagagagcccccgccccctggctgagcgcccccgtgcccctgagcacccccagccccagaagcagccacttcagcagcacccccagcaccctggacacccacttcagctgcctgcaccccacctgcagccccatgggcccctacctgctgaccaacgtgcccaccagcagctgctgccccaagaccccccccacccccccctggctgtgcctggcctgctag

SEQ ID NO: 10930 - DNA, 1515 bp, Artificial Sequence; identical to SEQ ID NO: 10928
  Description of Artificial Sequence: Synthetic coding sequence

SEQ ID NO: 10931 - DNA, 1575 bp, Artificial Sequence
  Description of Artificial Sequence: Synthetic coding sequence
atgaaggaggagagcgccgcccagctgggctgctgccacagacccatggccctgggcggcaccggcggcagcctgagccccagcctggacttccagctgttcagaggcgaccaggtgttcagcgcctgcagacccctgcccgacatggtggacgcccacggccccagctgcgccagctggctgtgccccctgcccctggcccccggcagaagcgccctgctggcctgcctgcaggacctggacctgaacctgtgcaccccccagcccgcccccctgggcaccgacctgcagggcctgcaggaggacgccctgagcatgaagcacgagccccccggcctgcaggccagcagcaccgacgacaagaagttcaccgtgaagtacccccagaacaaggacaagctgggcaagcagcccgagagagccggcgagggcgccccctgccccgccttcagcagccacaacagcagcagccccccccccctgcagaacagaaagagccccagccccctggccttctgcccctgcccccccgtgaacagcatcagcaaggagctgcccttcctgctgcacgccttctaccccggctaccccctgctgctgccccccccccacctgttcacctacggcgccctgcccagcgaccagtgcccccacctgctgatgctgccccaggaccccagctaccccaccatggccatgcccagcctgctgatgatggtgaacgagctgggccaccccagcgccagatgggagaccctgctgccctaccccggcgccttccaggccagcggccaggccctgcccagccaggccagaaaccccggcgccggcgccgcccccaccgacagccccggcctggagagaggcggcatggccagccccgccaagagagtgcccctgagcagccagaccggcaccgccgccctgccctaccccctgaagaagaagaacggcaagatcctgtacgagtgcaacatctgcggcaagagcttcggccagctgagcaacctgaaggtgcacctgagagtgcacagcggcgagagacccttccagtgcgccctgtgccagaagagcttcacccagctggcccacctgcagaagcaccacctggtgcacaccggcgagagaccccacaagtgcagcatcccctgggtgcccggcagaaaccactggaagagcttccaggcctggagagagagagaggtgtgccacaagagattcagcagcagcagcaacctgaagacccacctgagactgcacagcggcgccagacccttccagtgcagcgtgtgcagaagcagattcacccagcacatccacctgaagctgcaccacagactgcacgccccccagccctgcggcctggtgcacacccagctgcccctggccagcctggcctgcctggcccagtggcaccagggcgccctggacctgatggccgtggccagcgagaagcacatgggctacgacatcgacgaggtgaaggtgagcagcaccagccagggcaaggccagagccgtgagcctgagcagcgccggcacccccctggtgatgggccaggaccagaacaactag

SEQ ID NO: 10932 - DNA, 570 bp, Artificial Sequence
  Description of Artificial Sequence: Synthetic coding sequence
atgaaggaggagagcgccgcccagctgggctgctgccacagacccatggccctgggcggcaccggcggcagcctgagccccagcctggacttccagctgttcagaggcgaccaggtgttcagcgcctgcagacccctgcccgacatggtggacgcccacggccccagctgcgccagctggctgtgccccctgcccctggcccccggcagaagcgccctgctggcctgcctgcaggacctggacctgaacctgtgcaccccccagcccgcccccctgggcaccgacctgcagggcctgcaggaggacgccctgagcatgaagcacgagccccccggcctgcaggccagcagcaccgacgacaagaagttcaccgtgaagtacccccagaacaaggacaagctgggcaagcagcccgagagagccggcgagggcgccccctgccccgccttcagcagccacaacagcagcagccccccccccctgcagaacagaaagagccccagccccctggccttctgcccctgcccccccgtgaacagcatcagcaaggagctgcccttcctgctgtag

SEQ ID NO: 10933 - DNA, 1575 bp, Artificial Sequence; identical to SEQ ID NO: 10931
  Description of Artificial Sequence: Synthetic coding sequence

SEQ ID NO: 10934 - DNA, 810 bp, Artificial Sequence
  Description of Artificial Sequence: Synthetic coding sequence
atgaaggaggagagcgccgcccagctgggctgctgccacagacccatggccctgggcggcaccggcggcagcctgagccccagcctggacttccagctgttcagaggcgaccaggtgttcagcgcctgcagacccctgcccgacatggtggacgcccacggccccagctgcgccagctggctgtgccccctgcccctggcccccggcagaagcgccctgctggcctgcctgcaggacctggacctgaacctgtgcaccccccagcccgcccccctgggcaccgacctgcagggcctgcaggaggacgccctgagcatgaagcacgagccccccggcctgcaggccagcagcaccgacgacaagaagttcaccgtgaagtacccccagaacaaggacaagctgggcaagcagcccgagagagccggcgagggcgccccctgccccgccttcagcagccacaacagcagcagccccccccccctgcagaacagaaagagccccagccccctggccttctgcccctgcccccccgtgaacagcatcagcaaggagctgcccttcctgctgcacgccttctaccccggctaccccctgctgctgccccccccccacctgttcacctacggcgccctgcccagcgaccagtgcccccacctgctgatgctgccccaggaccccagctaccccaccatggccatgcccagcctgctgatgatggtgaacgagctgggccaccccagcgccagatgggagaccctgctgccctaccccggcgccttccaggccagcggccaggccctgcccagctag

SEQ ID NO: 10935 - DNA, 279 bp, Artificial Sequence
  Description of Artificial Sequence: Synthetic coding sequence
atgatcagcttccaggagagcgtgaccttccaggacgtggccgtggacttcaccgccgaggagtggcagctgctggactgcgccgagagaaccctgtactgggacgtgatgctggagaactacagaaacctgatcagcgtgggctgccccatcaccaagaccaaggtgatcctgaaggtggagcagggccaggagccctggatggtggagggcgccaacccccacgagagcagccccggctggagcgccgtggcccagagccagctgggcttcaagtag

SEQ ID NO: 10936 - DNA, 360 bp, Artificial Sequence
  Description of Artificial Sequence: Synthetic coding sequence
atgatcagcttccaggagagcgtgaccttccaggacgtggccgtggacttcaccgccgaggagtggcagctgctggactgcgccgagagaaccctgtactgggacgtgatgctggagaactacagaaacctgatcagcgtgggctgccccatcaccaagaccaaggtgatcctgaaggtggagcagggccaggagccctggatggtggagggcgccaacccccacgagagcagccccgagagcagaagcgtggccagactggagtgcagcggcgccatcagcgccagagtgcaggtgatcctgctgccccagccccccgaggagctggagctgcaggcccccgccaccatgcccggctag

SEQ ID NO: 10937 - DNA, 1137 bp, Artificial Sequence
  Description of Artificial Sequence: Synthetic coding sequence
atgatcagcttccaggagagcgtgaccttccaggacgtggccgtggacttcaccgccgaggagtggcagctgctggactgcgccgagagaaccctgtactgggacgtgatgctggagaactacagaaacctgatcagcgtgggctgccccatcaccaagaccaaggtgatcctgaaggtggagcagggccaggagccctggatggtggagggcgccaacccccacgagagcagccccgagagcgactaccccctggtggacgagcccggcaagcacagagagagcaaggacaacttcctgaagagcgtgctgctgaccttcaacaagatcctgaccatggagagaatccaccactacaacatgagcaccagcctgaaccccatgagaaagaagagctacaagagcttcgagaagtgcctgccccccaacctggacctgctgaagtacaacagaagctacaccgtggagaacgcctacgagtgcagcgagtgcggcaaggccttcaagaagaagttccacttcatcagacacgagaagaaccacaccagaaagaagcccttcgagtgcaacgactgcggcaaggcctacagcagaaaggcccacctggccacccaccagaagatccacaacggcgagagacccttcgtgtgcaacgactgcggcaaggccttcatgcacaaggcccagctggtggtgcaccagagactgcacaccggcgagaagccctacgagtgcagccagtgcggcaagaccttcacctggaacagcagcttcaaccagcacgtgaagagccacaccctggagaagagcttcgagtgcaaggagtgcggcaagaccttcagatacagcagcagcctgtacaagcacagcagattccacaccggcgagaagccctaccagtgcatcatctgcggcaaggccttcggcaacaccagcgtgctggtgacccaccagagaatccacaccggcgagaagccctacagctgcatcgagtgcggcaaggccttcatcaagaagagccacctgctgagacaccagatcacccacaccggcgagaagccctacgagtgcaacagatgcggcaaggccttcagccagaagagcaacctgatcgtgcaccagaagatccacacctag

SEQ ID NO: 10938 - DNA, 2052 bp, Artificial Sequence; identical to SEQ ID NO: 10605
  Description of Artificial Sequence: Synthetic coding sequence

SEQ ID NO: 10939 - DNA, 789 bp, Artificial Sequence
  Description of Artificial Sequence: Synthetic coding sequence
atgcccagaagccccctgagaagcagcctgagcaccgaggccagcggccccagaggccccttcaagtgccccgccagccccagacccatcaccgcccagctgctgcccggcagcagccccatcatcggcagatgcgtgctgagagtgcagagaggcttccccggccccaagcccgccctgatcagctggatggagcaggagagcgaggcctggagccccgccgcccaggaccccgagaagggcgagagactgggcggcgccagaagaggcgacgtgcccaacagaaaggaggaggagcccgaggaggtgcccagagccaagggccccagaaaggcccccgtgaaggagagccccgaggtgctggtggagagaaaccccgaccccgccatcagcgtggcccccgccagagcccagccccccaagaacgccgcctgggaccccaccaccggcgcccagccccccgcccccatccccagcatggacgcccaggccggccagagaagacacgtgtgcaccgactgcggcagaagattcacctaccccagcctgctggtgagccacagaagaatgcacagcggcgagagacccttcccctgccccgagtgcggcatgagattcaagagaaagttcgccgtggaggcccaccagtggatccacagaagctgcagcggcggcagaagaggcagaagacccggcatcagagccgtgcccagagcccccgtgagaggcgacagagacccccccgtgctgttcagacactaccccgacatcttcgaggagtgcggctag

SEQ ID NO: 10940 - DNA, 1503 bp, Artificial Sequence
  Description of Artificial Sequence: Synthetic coding sequence
atggccccccccagcgcccccctgcccgcccagggccccggcaaggccagacccagcagaaagagaggcagaagacccagagccctgaagttcgtggacgtggccgtgtacttcagccccgaggagtggggctgcctgagacccgcccagagagccctgtacagagacgtgatgagagagacctacggccacctgggcgccctgggctgcgccggccccaagcccgccctgatcagctggctggagagaaacaccgacgactgggagcccgccgccctggacccccaggagtaccccagaggcctgaccgtgcagagaaagagcagaaccagaaagaagaacggcgagaaggaggtgttcccccccaaggaggcccccagaaagggcaagagaggcagaagacccagcaagcccagactgatccccagacagaccagcggcggccccatctgccccgactgcggctgcaccttccccgaccaccaggccctggagagccacaagtgcgcccagaacctgaagaagccctacccctgccccgactgcggcagaagattcagctaccccagcctgctggtgagccacagaagagcccacagcggcgagtgcccctacgtgtgcgaccagtgcggcaagagattcagccagagaaagaacctgagccagcaccaggtgatccacaccggcgagaagccctaccactgccccgactgcggcagatgcttcagaagaagcagaagcctggccaaccacagaaccacccacaccggcgagaagccccaccagtgccccagctgcggcagaagattcgcctaccccagcctgctggccatccaccagagaacccacaccggcgagaagccctacacctgcctggagtgcaacagaagattcagacagagaaccgccctggtgatccaccagagaatccacaccggcgagaagccctacccctgccccgactgcgagagaagattcagcagcagcagcagactggtgagccacagaagagtgcacagcggcgagagaccctacgcctgcgagcactgcgaggccagattcagccagagaagcaccctgctgcagcaccagctgctgcacaccggcgagaagccctacccctgccccgactgcggcagagccttcagaagaagcggcagcctggccatccacagaagcacccacaccgaggagaagctgcacgcctgcgacgactgcggcagaagattcgcctaccccagcctgctggccagccacagaagagtgcacagcggcgagagaccctacgcctgcgacctgtgcagcaagagattcgcccagtggagccacctggcccagcaccagctgctgcacaccggcgagaagcccttcccctgcctggagtgcggcagatgcttcagacagagatggagcctggccgtgcacaagtgcagccccaaggcccccaactgcagccccagaagcgccatcggcggcagcagccagagaggcaacgcccactag

SEQ ID NO: 10941 - DNA, 1497 bp, Artificial Sequence
  Description of Artificial Sequence: Synthetic coding sequence
atggccccccccagcgcccccctgcccgcccagggccccggcaaggccagacccagcagaaagagaggcagaagacccagagccctgaagttcgtggacgtggccgtgtacttcagccccgaggagtggggctgcctgagacccgcccagagagccctgtacagagacgtgatgagagagacctacggccacctgggcgccctgggctgcgccggccccaagcccgccctgatcagctggctggagagaaacaccgacgactgggagcccgccgccctggacccccaggagtaccccagaggcctgaccgtgcagagaaagagcagaaccagaaagaagaacggcgagaaggaggtgttcccccccaaggaggcccccagaaagggcaagagaggcagaagacccagcaagcccagactgatccccagacagaccagcggcggccccatctgccccgactgcggctgcaccttccccgaccaccaggccctggagagccacaagtgcgcccagaacctgaagaagccctacccctgccccgactgcggcagaagattcagctaccccagcctgctggtgagccacagaagagcccacagcggcgagtgcccctacgtgtgcgaccagtgcggcaagagattcagccagagaaagaacctgagccagcaccaggtgatccacaccggcgagaagccctaccactgccccgactgcggcagatgcttcagaagaagcagaagcctggccaaccacagaaccacccacaccggcgagaagccccaccagtgccccagctgcggcagaagattcgcctaccccagcctgctggccatccaccagagaacccacaccggcgagaagccctacacctgcctggagtgcaacagaagattcagacagagaaccgccctggtgatccaccagagaatccacaccggcgagaagccctacccctgccccgactgcgagagaagattcagcagcagcagcagactggtgagccacagaagagtgcacagcggcgagagaccctacgcctgcgagcactgcgaggccagattcagccagagaagcaccctgctgcagcaccagctgctgcacaccggcgagaagccctacccctgccccgactgcggcagagccttcagaagaagcggcagcctggccatccacagaagcacccacaccgaggagaagctgcacgcctgcgacgactgcggcagaagattcgcctaccccagcctgctggccagccacagaagagtgcacagcggcgagagaccctacgcctgcgacctgtgcagcaagagattcgcccagtggagccacctggcccagcaccagctgctgcacaccggcgagaagcccttcccctgcctggagcccgtgctgccccccgaggtggtgagcgccgtgcacaagtgcagccccaaggcccccaactgcagccccagaagcgccatcggcggcagcagccagagaggcaacgcccactag

SEQ ID NO: 10942 - DNA, 921 bp, Artificial Sequence
  Description of Artificial Sequence: Synthetic coding sequence
atggcccagatcagcagcggcggcggcggccagagcagatgcctgctgttcgccctgggcagcgagatgggcagcgagaaggagcagagccccgagccccacctgcccgaggagggcgagggcggcaagccctggagagtggacgacagcgagggcagctggatcccccccggcgagaaggagcacggccaggagagcctgagcgacgagctgcaggagacccaccccaagaagccctggcagaaggtgaccgtgagagccagagagctgggcgaccccatcgcccaccccagacacgaggccgacgagaagcccttcatctgcgcccagtgcggcaagaccttcaacaacaccagcaacctgagaacccaccagagaatccacaccggcgagaagccctacaagtgcagcgagtgcggcaagagcttcagcagaagcagcaacagaatcagacacgagagaatccacctggaggagaagcactacaagtgccccaagtgccaggagagcttcagaagaagaagcgacctgaccacccaccagcaggaccacctgggcaagagaccctacagatgcgacatctgcggcaagagcttcagccagagcgccaccctggccgtgcaccacagaacccacctggagcccgccccctacatctgctgcgagtgcggcaagagcttcagcaacagcagcagcttcggcgtgcaccacagaacccacaccggcgagagaccctacgagtgcaccgagtgcggcagaaccttcagcgacatcagcaacttcggcgcccaccagagaacccacagaggcgagaagccctacagatgcaccgtgtgcggcaagcacttcagcagaagcagcaacctgatcagacaccagaagacccacctgggcgagcaggccggcaaggacagcagctag

SEQ ID NO: 10943 - DNA, 939 bp, Artificial Sequence
  Description of Artificial Sequence: Synthetic coding sequence
atgagcctgtgcagccccacccacagcgccgagatgagcctgttcctgcagggccccgaggagatgctgcccctgagcagcgagggcagcgagatgggcagcgagaaggagcagagccccgagccccacctgcccgaggagggcgagggcggcaagccctggagagtggacgacagcgagggcagctggatcccccccggcgagaaggagcacggccaggagagcctgagcgacgagctgcaggagacccaccccaagaagccctggcagaaggtgaccgtgagagccagagagctgggcgaccccatcgcccaccccagacacgaggccgacgagaagcccttcatctgcgcccagtgcggcaagaccttcaacaacaccagcaacctgagaacccaccagagaatccacaccggcgagaagccctacaagtgcagcgagtgcggcaagagcttcagcagaagcagcaacagaatcagacacgagagaatccacctggaggagaagcactacaagtgccccaagtgccaggagagcttcagaagaagaagcgacctgaccacccaccagcaggaccacctgggcaagagaccctacagatgcgacatctgcggcaagagcttcagccagagcgccaccctggccgtgcaccacagaacccacctggagcccgccccctacatctgctgcgagtgcggcaagagcttcagcaacagcagcagcttcggcgtgcaccacagaacccacaccggcgagagaccctacgagtgcaccgagtgcggcagaaccttcagcgacatcagcaacttcggcgcccaccagagaacccacagaggcgagaagccctacagatgcaccgtgtgcggcaagcacttcagcagaagcagcaacctgaagcccttcatccccctgtggagaatggtgctgtacagcctgtag

SEQ ID NO: 10944 - DNA, 921 bp, Artificial Sequence; identical to SEQ ID NO: 10942
  Description of Artificial Sequence: Synthetic coding sequence

SEQ ID NO: 10945 - DNA, 855 bp, Artificial Sequence
  Description of Artificial Sequence: Synthetic coding sequence
atgggcagcgagaaggagcagagccccgagccccacctgcccgaggagggcgagggcggcaagccctggagagtggacgacagcgagggcagctggatcccccccggcgagaaggagcacggccaggagagcctgagcgacgagctgcaggagacccaccccaagaagccctggcagaaggtgaccgtgagagccagagagctgggcgaccccatcgcccaccccagacacgaggccgacgagaagcccttcatctgcgcccagtgcggcaagaccttcaacaacaccagcaacctgagaacccaccagagaatccacaccggcgagaagccctacaagtgcagcgagtgcggcaagagcttcagcagaagcagcaacagaatcagacacgagagaatccacctggaggagaagcactacaagtgccccaagtgccaggagagcttcagaagaagaagcgacctgaccacccaccagcaggaccacctgggcaagagaccctacagatgcgacatctgcggcaagagcttcagccagagcgccaccctggccgtgcaccacagaacccacctggagcccgccccctacatctgctgcgagtgcggcaagagcttcagcaacagcagcagcttcggcgtgcaccacagaacccacaccggcgagagaccctacgagtgcaccgagtgcggcagaaccttcagcgacatcagcaacttcggcgcccaccagagaacccacagaggcgagaagccctacagatgcaccgtgtgcggcaagcacttcagcagaagcagcaacctgatcagacaccagaagacccacctgggcgagcaggccggcaaggacagcagctag

SEQ ID NO: 10946 - DNA, 855 bp, Artificial Sequence; identical to SEQ ID NO: 10945
  Description of Artificial Sequence: Synthetic coding sequence

SEQ ID NO: 10947 - DNA, 855 bp, Artificial Sequence; identical to SEQ ID NO: 10945
  Description of Artificial Sequence: Synthetic coding sequence

SEQ ID NO: 10948 - DNA, 402 bp, Artificial Sequence
  Description of Artificial Sequence: Synthetic coding sequence
atggcccagatcagcagcggcggcggcggccagagcagatgcctgctgttcgccctggtgctggccatctgcgtgcacagccagggcagcgagatgggcagcgagaaggagcagagccccgagccccacctgcccgaggagggcgagggcggcaagccctggagagtggacgacagcgagggcagctggatcccccccggcgagaaggagcacggccaggagagcctgagcgacgagctgcaggagacccaccccaagaagccctggcagaaggtgaccgtgagagccagagagctgggcgaccccatcgcccaccccagacacgaggccgacgagaagcccttcatctgcgcccagtgcggcaagaccttcaacaacaccagcaacctgagaacccactag

SEQ ID NO: 10949 - DNA, 948 bp, Artificial Sequence
  Description of Artificial Sequence: Synthetic coding sequence
atgagcctgtgcagccccacccacagcgccgagatgagcctgttcctgcagggccccgaggagatgctgcccctgagcagcgagggcagcgagatgggcagcgagaaggagcagagccccgagccccacctgcccgaggagggcgagggcggcaagccctggagagtggacgacagcgagggcagctggatcccccccggcgagaaggagcacggccaggagagcctgagcgacgagctgcaggagacccaccccaagaagccctggcagaaggtgaccgtgagagccagagagctgggcgaccccatcgcccaccccagacacgaggccgacgagaagcccttcatctgcgcccagtgcggcaagaccttcaacaacaccagcaacctgagaacccaccagagaatccacaccggcgagaagccctacaagtgcagcgagtgcggcaagagcttcagcagaagcagcaacagaatcagacacgagagaatccacctggaggagaagcactacaagtgccccaagtgccaggagagcttcagaagaagaagcgacctgaccacccaccagcaggaccacctgggcaagagaccctacagatgcgacatctgcggcaagagcttcagccagagcgccaccctggccgtgcaccacagaacccacctggagcccgccccctacatctgctgcgagtgcggcaagagcttcagcaacagcagcagcttcggcgtgcaccacagaacccacaccggcgagagaccctacgagtgcaccgagtgcggcagaaccttcagcgacatcagcaacttcggcgcccaccagagaacccacagaggcgagaagccctacagatgcaccgtgtgcggcaagcacttcagcagaagcagcaacctgatcagacaccagaagacccacctgggcgagcaggccggcaaggacagcagctag

SEQ ID NO: 10950 - DNA, 1560 bp, Artificial Sequence
  Description of Artificial Sequence: Synthetic coding sequence
atggccagcagccccgccgtggacgtgagctgcagaagaagagagaagagaagacagctggacgccagaagaagcaagtgcagaatcagactgggcggccacatggagcagtggtgcctgctgaaggagagactgggcttcagcctgcacagccagctggccaagttcctgctggacagatacaccagcagcggctgcgtgctgtgcgccggccccgagcccctgccccccaagggcctgcagtacctggtgctgctgagccacgcccacagcagagagtgcagcctggtgcccggcctgagaggccccggcggccaggacggcggcctggtgtgggagtgcagcgccggccacaccttcagctggggccccagcctgagccccacccccagcgaggcccccaagcccgccagcctgccccacaccaccagaagaagctggtgcagcgaggccaccagcggccaggagctggccgacctggagagcgagcacgacgagagaacccaggaggccagactgcccagaagagtgggccccccccccgagaccttccccccccccggcgaggaggagggcgaggaggaggaggacaacgacgaggacgaggaggagatgctgagcgacgccagcctgtggacctacagcagcagccccgacgacagcgagcccgacgcccccagactgctgcccagccccgtgacctgcacccccaaggagggcgagaccccccccgcccccgccgccctgagcagccccctggccgtgcccgccctgagcgccagcagcctgagcagcagagcccccccccccgccgaggtgagagtgcagccccagctgagcagaaccccccaggccgcccagcagaccgaggccctggccagcaccggcagccaggcccagagcgcccccacccccgcctgggacgaggacaccgcccagatcggccccaagagaatcagaaaggccgccaagagagagctgatgccctgcgacttccccggctgcggcagaatcttcagcaacagacagtacctgaaccaccacaagaagtaccagcacatccaccagaagagcttcagctgccccgagcccgcctgcggcaagagcttcaacttcaagaagcacctgaaggagcacatgaagctgcacagcgacaccagagactacatctgcgagttctgcgccagaagcttcagaaccagcagcaacctggtgatccacagaagaatccacaccggcgagaagcccctgcagtgcgagatctgcggcttcacctgcagacagaaggccagcctgaactggcaccagagaaagcacgccgagaccgtggccgccctgagattcccctgcgagttctgcggcaagagattcgagaagcccgacagcgtggccgcccacagaagcaagagccaccccgccctgctgctggccccccaggagagccccagcggccccctggagccctgccccagcatcagcgcccccggccccctgggcagcagcgagggcagcagacccagcgccagcccccaggcccccaccctgctgccccagcagtag

SEQ ID NO: 10951 - DNA, 1044 bp, Artificial Sequence
  Description of Artificial Sequence: Synthetic coding sequence
atggccagcagccccgccgtggacgtgagctgcagaagaagagagaagagaagacagctggacgccagaagaagcaagtgcagaatcagactgggcggccacatggagcagtggtgcctgctgaaggagagactgggcttcagcctgcacagccagctggccaagttcctgctggacagatacaccagcagcggctgcgtgctgtgcgccggccccgagcccctgccccccaagggcctgcagtacctggtgctgctgagccccagcagcctgagcagcagagcccccccccccgccgaggtgagagtgcagccccagctgagcagaaccccccaggccgcccagcagaccgaggccctggccagcaccggcagccaggcccagagcgcccccacccccgcctgggacgaggacaccgcccagatcggccccaagagaatcagaaaggccgccaagagagagctgatgccctgcgacttccccggctgcggcagaatcttcagcaacagacagtacctgaaccaccacaagaagtaccagcacatccaccagaagagcttcagctgccccgagcccgcctgcggcaagagcttcaacttcaagaagcacctgaaggagcacatgaagctgcacagcgacaccagagactacatctgcgagttctgcgccagaagcttcagaaccagcagcaacctggtgatccacagaagaatccacaccggcgagaagcccctgcagtgcgagatctgcggcttcacctgcagacagaaggccagcctgaactggcaccagagaaagcacgccgagaccgtggccgccctgagattcccctgcgagttctgcggcaagagattcgagaagcccgacagcgtggccgcccacagaagcaagagccaccccgccctgctgctggccccccaggagagccccagcggccccctggagccctgccccagcatcagcgcccccggccccctgggcagcagcgagggcagcagacccagcgccagcccccaggcccccaccctgctgccccagcagtag

SEQ ID NO: 10952 - DNA, 1425 bp, Artificial Sequence
  Description of Artificial Sequence: Synthetic coding sequence
atggccagcagccccgccgtggacgtgagctgcagaagaagagagaagagaagacagctggacgccagaagaagcaagtgcagaatcagactgggcggccacatggagcagtggtgcctgctgaaggagagactgggcttcagcctgcacagccagctggccaagttcctgctggacagatacaccagcagcggctgcgtgctgtgcgccggccccgagcccctgccccccaagggcctgcagtacctggtgctgctgagccacgcccacagcagagagtgcagcctggtgcccggcctgagaggccccggcggccaggacggcggcctggtgtgggagtgcagcgccggccacaccttcagctggggccccagcctgagccccacccccagcgaggcccccaagcccgccagcctgccccacaccaccagaagaagctggtgcagcgaggccaccagcggccaggagctggccgacctggagagcgagcacgacgagagaacccaggaggccagactgcccagcagcgagcccgacgcccccagactgctgcccagccccgtgacctgcacccccaaggagggcgagaccccccccgcccccgccgccctgagcagccccctggccgtgcccgccctgagcgccagcagcctgagcagcagagcccccccccccgccgaggtgagagtgcagccccagctgagcagaaccccccaggccgcccagcagaccgaggccctggccagcaccggcagccaggcccagagcgcccccacccccgcctgggacgaggacaccgcccagatcggccccaagagaatcagaaaggccgccaagagagagctgatgccctgcgacttccccggctgcggcagaatcttcagcaacagacagtacctgaaccaccacaagaagtaccagcacatccaccagaagagcttcagctgccccgagcccgcctgcggcaagagcttcaacttcaagaagcacctgaaggagcacatgaagctgcacagcgacaccagagactacatctgcgagttctgcgccagaagcttcagaaccagcagcaacctggtgatccacagaagaatccacaccggcgagaagcccctgcagtgcgagatctgcggcttcacctgcagacagaaggccagcctgaactggcaccagagaaagcacgccgagaccgtggccgccctgagattcccctgcgagttctgcggcaagagattcgagaagcccgacagcgtggccgcccacagaagcaagagccaccccgccctgctgctggccccccaggagagccccagcggccccctggagccctgccccagcatcagcgcccccggccccctgggcagcagcgagggcagcagacccagcgccagcccccaggcccccaccctgctgccccagcagtag

SEQ ID NO: 10953 - DNA, 291 bp, Artificial Sequence
  Description of Artificial Sequence: Synthetic coding sequence
atggccagcagccccgccgtggacgtgagctgcagaagaagagagaagagaagacagctggacgccagaagaagcaagtgcagaatcagactgggcggccacatggagcagtggtgcctgctgaaggagagactgggcttcagcctgcacagccagctggccaagttcctgctggacagagcctgccccgccgccctgttccacccccaggtgagccacttcaccagaaccgcctgcgtgacctgcggcctgagaggcagctgcagccccccccacggcctgagcgagtag

SEQ ID NO: 10954 - DNA, 1425 bp, Artificial Sequence; identical to SEQ ID NO: 10952
  Description of Artificial Sequence: Synthetic coding sequence

SEQ ID NO: 10955 - DNA, 1575 bp, Artificial Sequence
  Description of Artificial Sequence: Synthetic coding sequence
atgcccctggtgcacatggccagcagccccgccgtggacgtgagctgcagaagaagagagaagagaagacagctggacgccagaagaagcaagtgcagaatcagactgggcggccacatggagcagtggtgcctgctgaaggagagactgggcttcagcctgcacagccagctggccaagttcctgctggacagatacaccagcagcggctgcgtgctgtgcgccggccccgagcccctgccccccaagggcctgcagtacctggtgctgctgagccacgcccacagcagagagtgcagcctggtgcccggcctgagaggccccggcggccaggacggcggcctggtgtgggagtgcagcgccggccacaccttcagctggggccccagcctgagccccacccccagcgaggcccccaagcccgccagcctgccccacaccaccagaagaagctggtgcagcgaggccaccagcggccaggagctggccgacctggagagcgagcacgacgagagaacccaggaggccagactgcccagaagagtgggccccccccccgagaccttccccccccccggcgaggaggagggcgaggaggaggaggacaacgacgaggacgaggaggagatgctgagcgacgccagcctgtggacctacagcagcagccccgacgacagcgagcccgacgcccccagactgctgcccagccccgtgacctgcacccccaaggagggcgagaccccccccgcccccgccgccctgagcagccccctggccgtgcccgccctgagcgccagcagcctgagcagcagagcccccccccccgccgaggtgagagtgcagccccagctgagcagaaccccccaggccgcccagcagaccgaggccctggccagcaccggcagccaggcccagagcgcccccacccccgcctgggacgaggacaccgcccagatcggccccaagagaatcagaaaggccgccaagagagagctgatgccctgcgacttccccggctgcggcagaatcttcagcaacagacagtacctgaaccaccacaagaagtaccagcacatccaccagaagagcttcagctgccccgagcccgcctgcggcaagagcttcaacttcaagaagcacctgaaggagcacatgaagctgcacagcgacaccagagactacatctgcgagttctgcgccagaagcttcagaaccagcagcaacctggtgatccacagaagaatccacaccggcgagaagcccctgcagtgcgagatctgcggcttcacctgcagacagaaggccagcctgaactggcaccagagaaagcacgccgagaccgtggccgccctgagattcccctgcgagttctgcggcaagagattcgagaagcccgacagcgtggccgcccacagaagcaagagccaccccgccctgctgctggccccccaggagagccccagcggccccctggagccctgccccagcatcagcgcccccggccccctgggcagcagcgagggcagcagacccagcgccagcccccaggcccccaccctgctgccccagcagtag

SEQ ID NO: 10956 - DNA, 399 bp, Artificial Sequence
  Description of Artificial Sequence: Synthetic coding sequence
atggccagcagccccgccgtggacgtgagctgcagaagaagagagaagagaagacagctggacgccagaagaagcaagtgcagaatcagactgggcggccacatggagcagtggtgcctgctgaaggagagactgggcttcagcctgcacagccagctggccaagttcctgctggacagatacaccagcagcggctgcgtgctgtgcgccggccccgagcccctgccccccaagggcctgcagtacctggtgctgctgagccacgcccacagcagagagtgcagcctggtgcccggcctgagaggccccggcggccaggacggcggcctggtgtgggagtgcagcgccggccacaccttcagctggggccccagcctgagccccacccccagcgagtag

SEQ ID NO: 10957 - DNA, 1548 bp, Artificial Sequence
  Description of Artificial Sequence: Synthetic coding sequence
atgggcctgctggccttcagagacgtggccctggagttcagccccgaggagtgggagtgcctggaccccgcccagagaagcctgtacagagacgtgatgctggagaactacagaaacctgatcagcctgggcgaggacagcttcaacatgcagttcctgttccacagcctggccatgagcaagcccgagctgatcatctgcctggaggccagaaaggagccctggaacgtgaacaccgagaagaccgccagacacagcgtgctgagcagctacctgaccgaggacatcctgcccgagcagggcctgcaggtgagcttccagaaggtgatgctgagaagatacgagagatgctgcctggagaagctgagactgagaaacgactgggagatcgtgggcgagtggaagggccagaaggccagctacaacggcctggacctgtgcagcgccaccacccacagcaagaacttccagtgcaacaagtgcgtgaagggcttcagcaagttcgccaacctgaacaagtgcaagatcagccacaccggcgagaagcccttcaagtgcaaggagtgcggcaacgtgagctgcatgagcctgatcatgacccagcagcagagaatccacatcggcgagaacccctaccagtgcaagaagtgcggcaaggccttcaacgagtgcagctgcttcaccgactgcaagagaatccacgtgggcgagaagcactgcaagtgcgaggagtgcaacaacatcttcaagagctgcagcagcctggccgtggtggagaagaaccacaccgagaagaagacctacagatgcgaggagtgcggcaaggccttcaacctgtgcagcgtgctgaccaagcacaagaagatccacaccggcgagaagccctacaagtgcgaggagtgcggcaagagcttcaagctgttcccctacctgacccagcacaagagaatccacagcagagagaagccctacaagtgcgaggagtgcggcaaggtgttcaagctgctgagctacctgacccagcacagaagaatccacaccggcgagaagaccttcagatgcgaggagtgcggcaaggccttcaaccagagcagccacctgaccgagcacagaagaatccacaccggcgagaagccctacaagtgcgaggagtgcggcaaggccttcacctggttcagctacctgatccagcacaagagaatccacaccggccagaagccctacaagtgcgaggagtgcggcaaggccttcacctggttcagctacctgacccagcacaagagaatccacaccggcgagaagccctacaagtgcgacgagtgcggcaaggccttcaactggttcagctacctgaccaaccacaagagaatccacaccggcgagaagccctacaagtgcgaggagtgcggcaaggccttcggccagagcagccacctgagcaagcacaagaccatccacaccagagagaagccctacaagtgcgaggagtgcggcaaggccttcaaccacagcgcccagctggccgtgcacgagaagacccacacctag

SEQ ID NO: 10958 - DNA, 519 bp, Artificial Sequence
  Description of Artificial Sequence: Synthetic coding sequence
atgggcctgctggccttcagagacgtggccctggagttcagccccgaggagtgggagtgcctggaccccgcccagagaagcctgtacagagacgtgatgctggagaactacagaaacctgatcagcctgggcgaggacagcttcaacatgcagttcctgttccacagcctggccatgagcaagcccgagctgatcatctgcctggaggccagaaaggagccctggaacgtgaacaccgagaagaccgccagacacagcgtgctgagcagctacctgaccgaggacatcctgcccgagcagggcctgcaggtgagcttccagaaggtgatgctgagaagatacgagagatgctgcctggagaagctgagactgagaaacgactgggagatcccctgcgaggacgtgctggccagccccctgcccagcgccatgatcctgagcttcctgagacccccccagaagcagaagcacgtgaagcccaccgagcccatccagagcaagaccctgcagtggctgtag

SEQ ID NO: 10959 - DNA, 519 bp, Artificial Sequence
  Description of Artificial Sequence: Synthetic coding sequence
atgggcctgctggccttcagagacgtggccctggagttcagccccgaggagtgggagtgcctggaccccgcccagagaagcctgtacagagacgtgatgctggagaactacagaaacctgatcagcctgggcgaggacagcttcaacatgcagttcctgttccacagcctggccatgagcaagcccgagctgatcatctgcctggaggccagaaaggagccctggaacgtgaacaccgagaagaccgccagacacagcgtgctgagcagctacctgaccgaggacatcctgcccgagcagggcctgcaggtgagcttccagaaggtgatgctgagaagatacgagagatgctgcctggagaagctgagactgagaaacgactgggagatcccctgcgaggacgtgctggccagccccctgcccagcgccatgatcctgagcttcctgagacccccccagaagcagaagcacgtgaagcccaccgagcccgtgcagagcagcaccatcgagctgctgtag

SEQ ID NO: 10960 - DNA, 1125 bp, Artificial Sequence
  Description of Artificial Sequence: Synthetic coding sequence
atggagcccggcggcgagcccaccggcgccaaggagagcagcaccctgatggagagcctggccgccgtgaaggccgccttcctggcccaggcccccagcggcagcagaagcgccgaggtgcaggccgcccagagcaccgagcccgccgccgaggccggcgcccccgagggcgagggccacagaggcggcccccccagagccctgggcagcctgggcctgtgcgagaaccaggaggccagagagagacccggcggcagccccagaggccccgtgaccagcgagaagaccggcggccagagcggcctggagagcgacgtgccccccaacgccggccccggcgccgagggcggcggcagctggaagggcagacccttcccctgcggcgcctgcggcagaagcttcaagtgcagcagcgacgccgccaagcacagaagcatccacagcggcgagaagccctacgagtgcagcgactgcggcaaggccttcatccacagcagccacgtggtgagacaccagagagcccacagcggcgagagaccctacgcctgcgccgagtgcggcaaggccttcggccagagcttcaacctgctgagacaccagagagtgcacaccggcgagaagccctacgcctgcgccgactgcggcaaggccttcggccagagaagcgacgccgccaagcacagaagaacccacaccggcgagagactgtacgcctgcggcgagtgcggcaagagattcctgcacagcagcaacgtggtgagacacagaagaacccaccacggcgagaacccctacgagtgcagagagtgcggccaggccttcagccagagcagcaacctgctgcagcaccagagagtgcacaccggcgagagacccttcgcctgccaggactgcggcagagccttcagcagaagcagcttcctgagagagcacagaagaatccacaccggcgagaagccccaccagtgcggccactgcggcagagccttcagagccctgagcggcttcttcagacaccagagactgcacaccggcgagaagcccttcagatgcaccgagtgcggcagagccttcagactgagcttccacctgatccagcacagaagagtgcacggcgccgagtag

SEQ ID NO: 10961 - DNA, 324 bp, Artificial Sequence
  Description of Artificial Sequence: Synthetic coding sequence
atggagcccggcggcgagcccaccggcgccaaggagagcagcaccctgatggagagcctggccgccgtgaaggccgccttcctggcccaggcccccagcggcagcagaagcgccgaggtgcaggccgcccagagcaccgagcccgccgccgaggccggcgcccccgagggcgagggccacagaggcggcccccccagagccctgggcagcctgggcctgtgcgagaaccaggaggccagagagagacccggcggcagccccagaggccccgtgaccagcgagaagaccggcggccagagcggcctggagagcgacgtgccctag

SEQ ID NO: 10962 - DNA, 615 bp, Artificial Sequence
  Description of Artificial Sequence: Synthetic coding sequence
atggagcccggcggcgagcccaccggcgccaaggagagcagcaccctgatggagagcctggccgccgtgaaggccgccttcctggcccaggcccccagcggcagcagaagcgccgaggtgcaggccgcccagagcaccgagcccgccgccgaggccggcgcccccgagggcgagggccacagaggcggcccccccagagccctgggcagcctgggcctgtgcgagaaccaggaggccagagagagacccggcggcagccccagaggccccgtgaccagcgagaagaccggcggccagagcggcctggagagcgacgtgccccccaacgccggccccggcgccgagggcggcggcagctggaagggcagacccttcccctgcggcgcctgcggcagaagcttcaagtgcagcagcgacgccgccaagcacagaagcatccacagcggcgagaagccctacgagtgcagcgactgcggcaaggccttcatccacagcagccacgtggtgagacaccagagagcccacagcggcgagagaccctacgcctgcgccgagtgcggcaaggccttcggccagagcttcaacctgctgagacaccagagagtgcacacctag

SEQ ID NO: 10963 - DNA, 1638 bp, Artificial Sequence
  Description of Artificial Sequence: Synthetic coding sequence
atgaagcaggaggacaaccagggcgtgtgcgcccaccaggacagcgaggacaagggcatgggcagcgacttcgaggacagcgaggacagagagggcgaccccgaggagagagagatgggcagcaacccccacgacaccaacaagagagagggccaccccgagcccgagatgggcagcaacccccaggacagcagacacagagaggccgtgcccgacatctgcaccgagggccagctgagcgaggaggagggcgtgagcgtgagaggcgaggaggacgaccagagcggcgtggccgacatggccatgttccccggcctgagcgagagcgacagcatcagcagaagcctgagagaggacgacgacgagagcgccggcgagaacagactggaggaggaggaggagcagcccgccccccccgtgctgccctggagaagacacctgagcctgggcagcagacacagaggcgacaagcccgcccacagaagattccacagactgcaccaccccatggccgtggacctgggcgagctggacagcctggtggccagcatcatggacgcccccaccatctgccccgactgcggcgagagcttcagccccggcgccgccttcctgcagcaccagagaatccacagactggccgaggccgccgccgccgccagcctggagcccttcggcctggccggcgagtgcgacgccatggtgggcatgatgggcgtgggcgtggccggcggcttcggcgccggcccccccctggccagaccccccagagagaagcccttcagatgcggcgagtgcggcaagggcttcagcagaaacacctacctgaccaaccacctgagactgcacaccggcgagagacccaacctgtgcgccgactgcggcaagagcttcagctggagagccgacctgctgaagcacagaagactgcacaccggcgagaagccctacccctgccccgagtgcggcgaggccttcagcctgagcagccacctgctgagccacagaagagcccacgccgccgccagcggcgccggcgccgccgccctgagacccttcgcctgcggcgagtgcggcaagggcttcgtgagaagaagccacctggccaaccaccagagaatccacaccggcgagaagccccacggctgcggcgagtgcggcaagagattcagctggagaagcgacctggtgaagcaccagagagtgcacaccggcgagaagccctacatgtgcagcgagtgcggcgagaccttcagcgtgagcagccacctgttcacccacaagagaacccacagcggcgagagaccctacgtgtgcagagagtgcggcaagggcttcggcagaaacagccacctggtgaaccacctgagagtgcacaccggcgagaagcccttcagatgcggccagtgcgagaagagattcagcgacttcagcaccctgacccagcaccagagaacccacaccggcgagaagccctacacctgcatcgagtgcggcaagagcttcatccagagcagccacctgatcagacacagaagaatccacaccggcaacaagccccacaagtgcgccggctgcggcaagggcttcagatacaagacccacctggcccagcaccagaagctgcacctgtgctag

SEQ ID NO: 10964 - DNA, 1929 bp, Artificial Sequence
  Description of Artificial Sequence: Synthetic coding sequence
atggaggaggagagaaagaccgccgagctgcagaagaacagaatccaggacagcgtggtgttcgaggacgtggccgtggacttcacccaggaggagtgggccctgctggacctggcccagagaaacctgtacagagacgtgatgctggagaacttccagaacctggccagcctgggctaccccctgcacaccccccacctgatcagccagtgggagcaggaggaggacctgcagaccgtgaagagagagctgatccagggcatcttcatgggcgagcacagagagggcttcgagacccagctgaagaccaacgagagcgtggccagccaggacatctgcggcgagaagatcagcaacgagcagaagatcgtgagattcaagagaaacgacagctggttcagcagcctgcacgagaaccaggagagctgcggcatcgactaccagaacaagagccacgagagacacctgagaaaccacatggtggagaacatctacgagtgctacgaggagaaccaggacggccagaccttcagccaggtgcccaacctggacagcctgaagagaaacaccgaggtgaagagctgcgagtgccacgagtgcggcaaggccttcgtggaccacagcagcctgaagagccacatcagaagccacaccggcagcaagccctaccagtgcaaggagtgcggcaaggccttccacttcctggcctgcttcaagaagcacatgaagacccccaccgaggagaagccctacgagtgcaaggagtgcaccaaggccttcagctgcagcagcttcttcagagcccacatgaagatccacatcggcaagaccaactacgagtgcaaggagtgcggcaagggcttcagctgcagcagcagcctgaccgagcacaagagaatccacagcggcgacaagccctacgagtgcaaggagtgcggcaaggccttcagctgcagcagcagcctgagcaagcacaagagaatccacagcggcgacaagccctacgagtgcaaggagtgcggcaaggccttcagcagcagcagccacctgatcatccacatcagaatccacaccggcgagaagccctacgagtgcaaggagtgcggcaaggccttcagcgagagcagcaagctgaccgtgcacggcagaacccacaccggcgagaagccctacaagtgcaaggagtgcggcaaggcctacaactgccccagcagcctgagcatccacatgagaaagcacaccggcgagaagccctacgagtgcctggagtgcggcaaggccttctacctgcccaccagcctgaacacccacgtgaagaaccagagcagagagaagccctacgagtgcaaggagtgcggcaaggccttcagctgccccagcagcttcagagcccacgtgagagaccacaccggcaagatccagtacgagtgcaaggagtgcggcaagaccttcagcagaagcagcagcctgaccgagcacctgagaacccacagcggcgagaagccctacgagtgcaaggagtgcggcaaggccttcatcagcagcagccacctgaccgtgcacatcagaacccacaccggcgagaagccctacgagtgcaagaagtgcggcaaggccttcatctaccccagcgccctgagaatccacatgagaacccacaccggcgagaagccctacgagtgcaaggagtgcggcaaggccttcagacacagcagctacctgaccgtgcacgccagaatgcacaccggcgagaagcccttcgagtgcctggagtgcggcaaggccttcagctgccccagcagcttcagaagacacgtgagaagccacaccggcgagaagccctacgagtgcaaggagtgcggcaaggccttcgtgtgccccgcctacttcagaagacacgtgaagacccacaccagagagaacatctag

SEQ ID NO: 10965 - DNA, 2229 bp, Artificial Sequence
  Description of Artificial Sequence: Synthetic coding sequence
atgccctgctgcagccacagaagctgcagagaggaccccggcaccagcgagagcagagagatggaccccgtggccttcgaggacgtggccgtgaacttcacccaggaggagtggaccctgctggacatcagccagaagaacctgttcagagaggtgatgctggagaccttcagaaacctgaccagcatcggcaagaagtggagcgaccagaacatcgagtacgagtaccagaaccccagaagaagcttcagaagcctgatcgaggagaaggtgaacgagatcaaggaggacagccactgcggcgagaccttcacccaggtgcccgacgacagactgaacttccaggagaagaaggccagccccgaggtgaagagctgcgacagcttcgtgtgcgccgaggtgggcatcggcaacagcagcttcaacatgagcatcagaggcgacaccggccacaaggcctacgagtaccaggagtacggccccaagccctacaagtgccagcagcccaagaacaagaaggccttcagatacagacccagcatcagaacccaggagagagaccacaccggcgagaagccctacgcctgcaaggtgtgcggcaagaccttcatcttccacagcagcatcagaagacacatggtgatgcacagcggcgacggcacctacaagtgcaagttctgcggcaaggccttccacagcttcagcctgtacctgatccacgagagaacccacaccggcgagaagccctacgagtgcaagcagtgcggcaagagcttcacctacagcgccaccctgcagatccacgagagaacccacaccggcgagaagccctacgagtgcagcaagtgcgacaaggccttccacagcagcagcagctaccacagacacgagagaagccacatgggcgagaagccctaccagtgcaaggagtgcggcaaggccttcgcctacaccagcagcctgagaagacacgagagaacccacagcggcaagaagccctacgagtgcaagcagtacggcgagggcctgagctacctgatcagcttccagacccacatcagaatgaacagcggcgagagaccctacaagtgcaagatctgcggcaagggcttctacagcgccaagagcttccagacccacgagaagacccacaccggcgagaagagatacaagtgcaagcagtgcggcaaggccttcaacctgagcagcagcttcagataccacgagagaatccacaccggcgagaagccctacgagtgcaagcagtgcggcaaggccttcagaagcgccagccagctgagagtgcacggcggcacccacaccggcgagaagccctacgagtgcaaggagtgcggcaaggccttcagaagcaccagccacctgagagtgcacggcagaacccacaccggcgagaagccctacgagtgcaaggagtgcggcaaggccttcagatacgtgaagcacctgcagatccacgagagaaccgagaagcacatcagaatgcccagcggcgagagaccctacaagtgcagcatctgcgagaagggcttctacagcgccaagagcttccagacccacgagaagacccacaccggcgagaagccctacgagtgcaaccagtgcggcaaggccttcagatgctgcaacagcctgagataccacgagagaacccacaccggcgagaagccctacgagtgcaagcagtgcggcaaggccttcagaagcgccagccacctgagaatgcacgagagaacccacaccggcgagaagccctacgagtgcaagcagtgcggcaaggccttcagctgcgccagcaacctgagaaagcacggcagaacccacaccggcgagaagccctacgagtgcaagcagtgcggcaaggccttcagaagcgccagcaacctgcagatgcacgagagaacccacaccggcgagaagccctacgagtgcaaggagtgcgagaaggccttctgcaagttcagcagcttccagatccacgagagaaagcacagaggcgagaagccctacgagtgcaagcactgcggcaacggcttcaccagcgccaagatcctgcagatccacgccagaacccacatcggcgagaagcactacgagtgcaaggagtgcggcaaggccttcaactacttcagcagcctgcacatccacgccagaacccacatgggcgagaagccctacgagtgcaaggactgcggcaaggccttcagctag

SEQ ID NO: 10966 - DNA, 1596 bp, Artificial Sequence
  Description of Artificial Sequence: Synthetic coding sequence
atgggcttcctgcacgtgggccaggacggcctggagctgcccaccagcggcgacccccccgccagcgccagccagagcgccggcatcaccggcgtgagccacagaacccagcccccctgcttcgagggcctgaccagcaaggacctggtgagagaggagaagaccagaaagagaaagagaaaggccaaggagagcggcatggccctgctgcagggcctgctgaccttcagagacgtggccatcgagttcagccaggaggagtggaagtgcctggaccccgcccagagaaccctgtacagagacgtgatgctggagaactacagaaacctggtgagcctggacaccagcagcaagtgcatgatgaagatgttcagcagcaccggccagggcaacaccgaggtggtgcacaccggcaccctgcagatccacgccagccaccacatcggcgacacctgcttccaggagatcgagaaggacatccacgacttcgtgttccagtggcaggagaacgagaccaacggccacgaggccctgatgaccaagaccaagaagctgatgagcagcaccgagagacacgaccagagacacgccggcaacaagcccatcaagaacgagctgggcagcagcttccacagccacctgcccgaggtgcacatcttccaccccgagggcaagatcggcaaccaggtggagaaggccatcaacgacgccttcagcgtgagcgccagccagagaatcagctgcagacccaagaccagaatcagcaacaagtacagaaacaacttcctgcagagcagcctgctgacccagaagagagaggtgcacaccagagagaagagcttccagagaaacgagagcggcaaggccttcaacggcagcagcctgctgaagaagcaccagatcatccacctgggcgacaagcagtacaagtgcgacgtgtgcggcaaggacttccaccagaagagatacctggcctgccacagatgccacaccggcgagaacccctacacctgcaacgagtgcggcaagaccttcagccacaacagcgccctgctggtgcacaaggccatccacaccggcgagaagccctacaagtgcaacgagtgcggcaaggtgttcaaccagcagagcaacctggccagacaccacagagtgcacaccggcgagaagccctacaagtgcgaggagtgcgacaaggtgttcagcagaaagagccacctggagagacacagaagaatccacaccggcgagaagccctacaagtgcaaggtgtgcgacaaggccttcagaagagacagccacctggcccagcacaccgtgatccacaccggcgagaagccctacaagtgcaacgagtgcggcaagaccttcgtgcagaacagcagcctggtgatgcacaaggtgatccacaccggcgagaagagatacaagtgcaacgagtgcggcaaggtgttcaaccacaagagcaacctggcctgccacagaagactgcacaccggcgagaagccctacaagtgcaacgagtgcggcaaggtgttcaacagaaagagcaacctggagagacaccacagactgcacaccggcaagaagagctag

SEQ ID NO: 10967 - DNA, 1398 bp, Artificial Sequence
  Description of Artificial Sequence: Synthetic coding sequence
atggccctgctgcagggcctgctgaccttcagagacgtggccatcgagttcagccaggaggagtggaagtgcctggaccccgcccagagaaccctgtacagagacgtgatgctggagaactacagaaacctggtgagcctggacaccagcagcaagtgcatgatgaagatgttcagcagcaccggccagggcaacaccgaggtggtgcacaccggcaccctgcagatccacgccagccaccacatcggcgacacctgcttccaggagatcgagaaggacatccacgacttcgtgttccagtggcaggagaacgagaccaacggccacgaggccctgatgaccaagaccaagaagctgatgagcagcaccgagagacacgaccagagacacgccggcaacaagcccatcaagaacgagctgggcagcagcttccacagccacctgcccgaggtgcacatcttccaccccgagggcaagatcggcaaccaggtggagaaggccatcaacgacgccttcagcgtgagcgccagccagagaatcagctgcagacccaagaccagaatcagcaacaagtacagaaacaacttcctgcagagcagcctgctgacccagaagagagaggtgcacaccagagagaagagcttccagagaaacgagagcggcaaggccttcaacggcagcagcctgctgaagaagcaccagatcatccacctgggcgacaagcagtacaagtgcgacgtgtgcggcaaggacttccaccagaagagatacctggcctgccacagatgccacaccggcgagaacccctacacctgcaacgagtgcggcaagaccttcagccacaacagcgccctgctggtgcacaaggccatccacaccggcgagaagccctacaagtgcaacgagtgcggcaaggtgttcaaccagcagagcaacctggccagacaccacagagtgcacaccggcgagaagccctacaagtgcgaggagtgcgacaaggtgttcagcagaaagagccacctggagagacacagaagaatccacaccggcgagaagccctacaagtgcaaggtgtgcgacaaggccttcagaagagacagccacctggcccagcacaccgtgatccacaccggcgagaagccctacaagtgcaacgagtgcggcaagaccttcgtgcagaacagcagcctggtgatgcacaaggtgatccacaccggcgagaagagatacaagtgcaacgagtgcggcaaggtgttcaaccacaagagcaacctggcctgccacagaagactgcacaccggcgagaagccctacaagtgcaacgagtgcggcaaggtgttcaacagaaagagcaacctggagagacaccacagactgcacaccggcaagaagagctag

SEQ ID NO: 10968 - DNA, 1596 bp, Artificial Sequence; identical to SEQ ID NO: 10966
  Description of Artificial Sequence: Synthetic coding sequence

SEQ ID NO: 10969 - DNA, 903 bp, Artificial Sequence
  Description of Artificial Sequence: Synthetic coding sequence
atgcacagcctgaagaaggtgaccttcgaggacgtggccatcgacttcacccaggaggagtgggccatgatggacaccagcaagagaaagctgtacagagacgtgatgctggagaacatcagccacctggtgagcctgggctaccagatcagcaagagctacatcatcctgcagctggagcagggcaaggagctgtggagagagggcagagagttcctgcaggaccagaaccccgacagagagagcgccctgaagaagaagcacatgatcagcatgcaccccatcaccagaaaggacgccagcaccagcatgaccatggagaacagcctgatcctggaggaccccttcgagtgcaacgacagcggcgaggactgcacccacagcagcaccatcacccagagactgctgacccacagcggcaagaagccctacgtgagcaagcagtgcggcaagagcctgagaaacctgttcagccccaagccccacaagcagatccacaccaagggcaagagctaccagtgcaacctgtgcgagaaggcctacaccaactgcttcagactgagaagacacaagatgacccacaccggcgagagaccctacgcctgccacctgtgcggcaaggccttcacccagtgcagccacctgagaagacacgagaagacccacaccggcgagagaccctacaagtgccaccagtgcggcaaggccttcatccagagcttcaacctgagaagacacgagagaacccacctgggcaagaagtgctacgagtgcgacaagagcggcaaggccttcagccagagcagcggcttcagaggcaacaagatcatccacaccggcgagaagccccacgcctgcctgctgtgcggcaaggccttcagcctgagcagcgacctgagatag

SEQ ID NO: 10970 - DNA, 624 bp, Artificial Sequence
  Description of Artificial Sequence: Synthetic coding sequence
atgcacagcctgaagaaggtgaccttcgaggacgtggccatcgacttcacccaggaggagtgggccatgatggacaccagcaagagaaagctgtacagagacgtgatgctggagaacatcagccacctggtgagcctgggctaccagatcagcaagagctacatcatcctgcagctggagcagggcaaggagctgtggagagagggcagagagttcctgcaggaccagaaccccgacagagagagcgccctgaagaagaagcacatgatcagcatgcaccccatcaccagaaaggacgccagcaccagcatgaccatggagaacagcctgatcctggaggaccccttcgagtgcaacgacagcggcgaggactgcacccacagcagcaccatcacccagagactgctgacccacagcggcaagaagccctacgtgagcaagcagtgcggcaagagcctgagaaacctgttcagccccaagccccacaagcagatccacaccaagggcaagagctaccagtgcaacctgtgcgagaaggcctacaccaactgcttcagactgagaagacacaagatgacccacaccggcgagagaccctacgcctgccacctgtgcggcaagtag

SEQ ID NO: 10971 - DNA, 234 bp, Artificial Sequence
  Description of Artificial Sequence: Synthetic coding sequence
atgcacagcctgaagaaggtgaccttcgaggacgtggccatcgacttcacccaggaggagtgggccatgatggacaccagcaagagaaagctgtacagagacgtgatgctggagaacatcagccacctggtgagcctgggctaccagatcagcaagagctacatcatcctgcagctggagcagggcaaggagctgtggagagagggcagagagttcctgcaggaccagaactag

SEQ ID NO: 10972 - DNA, 903 bp, Artificial Sequence
  Description of Artificial Sequence: Synthetic coding sequence
atgcacagcctggagaaggtgaccttcgaggacgtggccatcgacttcacccaggaggagtgggacatgatggacaccagcaagagaaagctgtacagagacgtgatgctggagaacatcagccacctggtgagcctgggctaccagatcagcaagagctacatcatcctgcagctggagcagggcaaggagctgtggagagagggcagagtgttcctgcaggaccagaaccccgacagagagagcgccctgaagaagaagcacatgatcagcatgcaccccatcatcagaaaggacgccagcaccagcatgaccatggagaacagcctgatcctggaggaccccttcgagtacaacgacagcggcgaggactgcacccacagcagcaccatcacccagtgcctgctgacccacagcggcaagaagccctgcgtgagcaagcagtgcggcaagagcctgagaaacctgctgagccccaagcccagaaagcagatccacaccaagggcaagagctaccagtgcaacctgtgcgagaaggcctacaccaactgcttctacctgagaagacacaagatgacccacaccggcgagagaccctacgcctgccacctgtgcggcaaggccttcacccagtgcagccacctgagaagacacgagaagacccacaccggcgagagaccctacaagtgccaccagtgcggcaaggccttcatccagagcttcaacctgagaagacacgagagaacccacctgggccagaagtgctacgagtgcgacaagagcggcaaggccttcagccagagcagcggcttcagaggcaacaagatcatccacatcggcgagaagccccacgcctgcctgctgtgcggcaaggccttcagcctgagcagcgacctgagatag

SEQ ID NO: 10973 - DNA, 1116 bp, Artificial Sequence
  Description of Artificial Sequence: Synthetic coding sequence
atggacatggcccaggagcccgtgaccttcagagacgtggccatctacttcagcagagaggagtgggcctgcctggagcccagccagagagccctgtacagagacgtgatgctggacaacttcagcagcgtggccgccctgggcttctgcagccccagacccgacctggtgagcagactggagcagtgggaggagccctgggtggaggacagagagagacccgagttccaggccgtgcagagaggccccagacccggcgccagaaagagcgccgaccccaagagaccctgcgaccaccccgcctgggcccacaagaagacccacgtgagaagagagagagccagagagggcagcagcttcagaaagggcttcagactggacaccgacgacggccagctgcccagagccgcccccgagagaaccgacgccaagcccaccgccttcccctgccaggtgctgacccagagatgcggcagaagacccggcagaagagagagaagaaagcagagagccgtggagctgagcttcatctgcggcacctgcggcaaggccctgagctgccacagcagactgctggcccaccagaccgtgcacaccggcaccaaggccttcgagtgccccgagtgcggccagaccttcagatgggccagcaacctgcagagacaccagaagaaccacaccagagagaagcccttctgctgcgaggcctgcggccaggccttcagcctgaaggacagactggcccagcacagaaaggtgcacaccgagcacagaccctacagctgcggcgactgcggcaaggccttcaagcagaagagcaacctgctgagacaccagctggtgcacaccggcgagagacccttctactgcgccgactgcggcaaggccttcagaaccaaggagaacctgagccaccaccagagagtgcacagcggcgagaagccctacacctgcgccgagtgcggcaagagcttcagatggcccaagggcttcagcatccacagaagactgcacctgaccaagagattctacgagtgcggccactgcggcaagggcttcagacacctgggcttcttcaccagacaccagagaacccacagacacggcgaggtgtag

SEQ ID NO: 10974 - DNA, 1116 bp, Artificial Sequence; identical to SEQ ID NO: 10973
  Description of Artificial Sequence: Synthetic coding sequence

SEQ ID NO: 10975 - DNA, 1116 bp, Artificial Sequence; identical to SEQ ID NO: 10973
  Description of Artificial Sequence: Synthetic coding sequence

SEQ ID NO: 10976 - DNA, 144 bp, Artificial Sequence
  Description of Artificial Sequence: Synthetic coding sequence
atggacatggcccaggagcccgtgaccttcagagacgtggccatctacttcagcagagaggagtgggcctgcctggagcccagccagagagccctgtacagagacgtgatgctggacaacttcagcagcgtggccgccctgtag

SEQ ID NO: 10977 - DNA, 240 bp, Artificial Sequence
  Description of Artificial Sequence: Synthetic coding sequence
atggacatggcccaggagcccgtgaccttcagagacgtggccatctacttcagcagagaggagtgggcctgcctggagcccagccagagagccctgtacagagacgtgatgctggacaacttcagcagcgtggccgccctgggcttctgcagccccagacccgacctggtgagcagactggagcagtgggaggagccctgggtggaggacagagagagacccgagttccaggccgtgtag

SEQ ID NO: 10978 - DNA, 1116 bp, Artificial Sequence; identical to SEQ ID NO: 10973
  Description of Artificial Sequence: Synthetic coding sequence

SEQ ID NO: 10979 - DNA, 1116 bp, Artificial Sequence; identical to SEQ ID NO: 10973
  Description of Artificial Sequence: Synthetic coding sequence

SEQ ID NO: 10980 - DNA, 426 bp, Artificial Sequence
  Description of Artificial Sequence: Synthetic coding sequence
atggacatggcccaggagcccgtgaccttcagagacgtggccatctacttcagcagagaggagtgggcctgcctggagcccagccagagagccctgtacagagacgtgatgctggacaacttcagcagcgtggccgccctgggcttctgcagccccagacccgacctggtgagcagactggagcagtgggaggagccctgggtggaggacagagagagacccgagttccaggccgtgcagagaggccccagacccggcgccagaaagagcgccgaccccaagagaccctgcgaccaccccgcctgggcccacaagaagacccacgtgagaagagagagagccagagagggcagcagcttcagaaagggcttcagactggacaccgacgacggccagctgcccagagccgcccccgagagaacctag

SEQ ID NO: 10981 - DNA, 1692 bp, Artificial Sequence
  Description of Artificial Sequence: Synthetic coding sequence
atgggccccctgaccttcatggacgtggccatcgagttcagcctggaggagtggcagtgcctggacaccgcccagcagaacctgtacagaaacgtgatgctggagaactacagaaacctggtgttcctgggcatcgccgtgagcaacctggacctgatcacctgcctggagcagggcaaggagccctggaacatgaagagacacgagatggccgccaagccccccgccatgtgcagccacttcgccaaggacctgagacccgagcagtacatcaagaacagcttccagcaggtgatcctgagaagatacggcaagtgcggctaccagaagggctgcaagagcgtggacgagcacaagctgcacaagggcggccacaagggcctgaacagatgcgtgaccaccacccagagcaagatcgtgcagtgcgacaagtacgtgaaggtgttccacaagtacagcaacgccaagagacacaagatcagacacaccggcaagaaccccttcaagtgcaaggagtgcggcaagagcttctgcatgctgagccagctgacccagcacgagatcatccacaccggcgagaagccctacaagtgcgaggagtgcggcaaggccttcaagaagagcagcaacctgaccaaccacaagatcatccacaccggcgagaagccctacaagtgcgaggagtgcggcaaggccttcaaccagagcagcaccctgaccagacacaagatcatccacaccggcgagaagctgtacaagtgcgaggagtgcggcaaggccttcaacagaagcagcaacctgaccaagcacaagatcgtgcacaccggcgagaagccctacaagtgcgaggagtgcggcaaggccttcaagcagagcagcaacctgaccaaccacaagaagatccacaccggcgagaagccctacaagtgcggcgagtgcggcaaggccttcaccctgagcagccacctgaccacccacaagagaatccacaccggcgagaagccctacaagtgcgaggagtgcggcaaggccttcagcgtgttcagcaccctgaccaagcacaagatcatccacaccgaggagaagccctacaagtgcgaggagtgcggcaaggccttcaacagaagcagccacctgaccaaccacaaggtgatccacaccggcgagaagccctacaagtgcgaggagtgcggcaaggccttcaccaagagcagcaccctgacctaccacaaggtgatccacaccggcaagaagccctacaagtgcgaggagtgcggcaaggccttcagcatcttcagcatcctgaccaagcacaaggtgatccacaccgaggacaagccctacaagtgcgaggagtgcggcaagaccttcaactacagcagcaacttcaccaaccacaagaagatccacaccggcgagaagccctacaagtgcgaggagtgcggcaagagcttcatcctgagcagccacctgaccacccacaagatcatccacaccggcgagaagccctacaagtgcaaggagtgcggcaaggccttcaaccagagcagcaccctgatgaagcacaagatcatccacaccggcgagaagccctacaagtgcgaggagtgcggcaaggccttcaaccagagccccaacctgaccaagcacaagagaatccacaccaaggagaagccctacaagtgcaagtag

SEQ ID NO: 10982 - DNA, 1926 bp, Artificial Sequence
  Description of Artificial Sequence: Synthetic coding sequence
atggacagcgtggtgttcgaggacgtggccgtgaacttcacccaggaggagtgggccctgctgggccccagccagaagaagctgtacagagacgtgatgcaggagaccttcgtgaacctggccagcatcggcgagaactgggaggagaagaacatcgaggaccacaagaaccagggcagaaagctgagaagccacatggtggagagactgtgcgagagaaaggagggcagccagttcggcgagaccatcagccagacccccaaccccaagcccaacaagaagaccttcaccagagtgaagccctacgagtgcagcgtgtgcggcaaggactacatgtgccacagcagcctgaacagacacatgagaagccacaccgagcacagaagctacgagtaccacaagtacggcgagaagagctacgagtgcaaggagtgcggcaagagattcagcttcagaagcagcttcagaatccacgagagaacccacaccggcgagaagccctacaagtgcaagcagtgcggcaaggccttcagctggcccagcagcttccagatccacgagagaacccacaccggcgagaagccctacgagtgcaaggagtgcggcaaggccttcatctaccacaccaccttcagaggccacatgagaatgcacaccggcgagaagccctacaagtgcaaggagtgcggcaagaccttcagccaccccagcagcttcagaaaccacgagagaacccacagcggcgagaagccctacgagtgcaagcagtgcggcaaggccttcagatactaccagaccttccagatccacgagagaacccacaccggcgagaagccctaccagtgcaagcagtgcggcaaggccctgagctgccccaccagcttcagaagccacgagagaatccacaccggcgagaagccctacaagtgcaagaagtgcggcaaggccttcagcttccccagcagcttcagaaagcacgagagaatccacaccggcgagaagccctacgactgcaaggagtgcggcaaggccttcatcagcctgcccagctacagaagacacatgatcatgcacaccggcaacggcccctacaagtgcaaggagtgcggcaaggccttcgactgccccagcagcttccagatccacgagagaacccacaccggcgagaagccctacgagtgcaagcagtgcggcaaggccttcagctgcagcagcagcttcagaatgcacgagagaacccacaccggcgagaagccccacgagtgcaagcagtgcggcaaggccttcagctgcagcagcagcgtgagaatccacgagagaacccacaccggcgagaagccctacgagtgcaagcagtgcggcaaggccttcagctgcagcagcagcttcagaatgcacgagagaatccacaccggcgagaagccctacgagtgcaagcagtgcggcaaggccttcagcttcagcagcagcttcagaatgcacgagagaacccacaccggcgagaagccctacgagtgcaagcagtgcggcaaggccttcagctgcagcagcagcttcagaatgcacgagagaacccacaccggcgagaagccctacgagtgcaagcagtgcggcaaggccttcagctgcagcagcagcatcagaatccacgagagaacccacaccggcgagaagccctacgagtgcaagcagtgcggcaaggccttcagctgcagcagcagcgtgagaatgcacgagagaacccacaccggcgtgaagccctacgagtgcaagcagtgcgacaaggccttcagctgcagcagaagcttcagaatccacgagagaacccacaccggcgagaagccctacgcctgccagcagtgcggcaaggccttcaagtgcagcagaagcttcagaatccacgagagagtgcacagcggcgagtag

SEQ ID NO: 10983 - DNA, 1926 bp, Artificial Sequence; identical to SEQ ID NO: 10982
  Description of Artificial Sequence: Synthetic coding sequence

SEQ ID NO: 10984 - DNA, 1995 bp, Artificial Sequence
  Description of Artificial Sequence: Synthetic coding sequence
atggagggcttcatggacagcggcacccagaccgacgccgtggtggtgctgagcctggcccaggccgccgtgctgggcctggtgagcgagaacgagctgttcggcgccaccatcagcgccgaggccttctaccccgacctgggccccgagctgagcggcgccgccatgggcgagcccgagccccccggccccgacgtgtaccagctggcctgcaacggcagagccctggaggagcccgccgaggaggaggtgctggaggtggaggccgcctgcgagaagcacaccagaagaaagaccagaccccccgtgagactggtgcccaaggtgaagttcgagaaggtggaggaggaggagcaggaggtgtacgaggtgagcgtgcccggcgacgacaaggacgccggccccgccgaggcccccgccgaggccgccagcggcggctgcgacgccctggtgcagagcagcgccgtgaagatgatcgacctgagcgccttcagcagaaagcccagaaccctgagacacctgcccagaacccccagacccgagctgaacgtggccccctacgacccccacttccccgcccccgccagagacggcttccccgagcccagcatggccctgcccggccccgaggccctgcccaccgagtgcggcttcgagcccccccacctggcccccctgagcgaccccgaggcccccagcatggagagccccgagcccgtgaagcccgagcagggcttcgtgtggcaggaggccagcgagttcgaggccgacaccgccggcagcaccgtggagagacacaagaaggcccagctggacagactggacatcaacgtgcagatcgacgacagctacctggtggaggccggcgacagacagaagagatggcagtgcagaatgtgcgagaagagctacaccagcaagtacaacctggtgacccacatcctgggccacaacggcatcaagccccacagctgcccccactgcagcaagctgttcaagcagcccagccacctgcagacccacctgctgacccaccagggcaccagaccccacaagtgccaggtgtgccacaaggccttcacccagaccagccacctgaagagacacatgctgctgcacagcgaggtgaagccctacagctgccacttctgcggcagaggcttcgcctaccccagcgagctgaaggcccacgaggtgaagcacgagagcggcagatgccacgtgtgcgtggagtgcggcctggacttcagcaccctgacccagctgaagagacacctggccagccaccagggccccaccctgtaccagtgcctggagtgcgacaagagcttccactacagaagccagctgcagaaccacatgctgaagcaccagaacgtgagacccttcgtgtgcaccgagtgcggcatggagttcagccagatccaccacctgaagcagcacagcctgacccacaagggcgtgaaggagttcaagtgcgaggtgtgcggcagagagttcaccctgcaggccaacatgaagagacacatgctgatccacaccagcgtgagaccctaccagtgccacatctgcttcaagaccttcgtgcagaagcagaccctgaagacccacatgatcgtgcacagccccgtgaagcccttcaagtgcaaggtgtgcggcaagagcttcaacagaatgtacaacctgctgggccacatgcacctgcacgccggcagcaagcccttcaagtgcccctactgcagcagcaagttcaacctgaagggcaacctgagcagacacatgaaggtgaagcacggcgtgatggacatcggcctggacagccaggaccccatgatggagctgaccggcaccgaccccagcgagctggacggccagcaggagatggaggacttcgaggagaacgcctacagctacgccagcgtggacagcagcgccgaggccagcgtgctgaccgagcaggccatgaaggagatggcctactacaacgtgctgtag

SEQ ID NO: 10985 - DNA, 240 bp, Artificial Sequence
  Description of Artificial Sequence: Synthetic coding sequence
atggagggcttcatggacagcggcacccagaccgacgccgtggtggtgctgagcctggcccaggccgccgtgctgggcctggtgagcgagaacgagctgttcggcgccaccatcagcgccgaggccttctaccccgacctgggccccgagctgagcggcgccgccatgggcgagcccgagccccccggccccgacgtgtaccagctggcctgcaacggcagagccctggaggagccctag

SEQ ID NO: 10986 - DNA, 1293 bp, Artificial Sequence
  Description of Artificial Sequence: Synthetic coding sequence
atggaggaggaggagatgaacgacggcagccagatggtgagaagccaggagagcctgaccttccaggacgtggccgtggacttcaccagagaggagtgggaccagctgtaccccgcccagaagaacctgtacagagacgtgatgctggagaactacagaaacctggtggccctgggctaccagctgtgcaagcccgaggtgatcgcccagctggagctggaggaggagtgggtgatcgagagagacagcctgctggacacccaccccgacggcgagaacagacccgagatcaagaagagcaccaccagccagaacatcagcgacgagaaccagacccacgagatgatcatggagagactggccggcgacagcttctggtacagcatcctgggcggcctgtgggacttcgactaccaccccgagttcaaccaggagaaccacaagagatacctgggccaggtgaccctgacccacaagaagatcacccaggagagaagcctggagtgcaacaagttcgccgagaactgcaacctgaacagcaacctgatgcagcagagaatccccagcatcaagatccccctgaacagcgacacccagggcaacagcatcaagcacaacagcgacctgatctactaccagggcaactacgtgagagagaccccctacgagtacagcgagtgcggcaagatcttcaaccagcacatcctgctgaccgaccacatccacaccgccgagaagcccagcgagtgcggcaaggccttcagccacaccagcagcctgagccagccccagatgctgctgaccggcgagaagccctacaagtgcgacgagtgcggcaagagattcagccagagaatccacctgatccagcaccagagaatccacaccggcgagaagcccttcatctgcaacggctgcggcaaggccttcagacagcacagcagcttcacccagcacctgagaatccacaccggcgagaagccctacaagtgcaaccagtgcggcaaggccttcagcagaatcaccagcctgaccgagcaccacagactgcacaccggcgagaagccctacgagtgcggcttctgcggcaaggccttcagccagagaacccacctgaaccagcacgagagaacccacaccggcgagaagccctacaagtgcaacgagtgcggcaaggccttcagccagagcgcccacctgaaccagcacagaaagatccacaccagagagaagctgtgcgagtacaagtgcgagcagaccgtgagacacagccccagcttcagcagcacctag

SEQ ID NO: 10987 - DNA, 2736 bp, Artificial Sequence
  Description of Artificial Sequence: Synthetic coding sequence
atgtgcagccacttcacccaggacttcctgcccgtgcagggcatcgaggacagcttccacaagctgatcctgagaagatacgagaagtgcggccacgacaacctgcagctgagaaagggctgcaagagcatgaacgtgtgcaaggtgcagaagggcgtgtacaacggcatcaacaagtgcctgagcaacacccagagcaagatcttccagtgcaacgccagagtgaaggtgttcagcaagttcgccaacagcaacaaggacaagaccagacacaccggcgagaagcacttcaagtgcaacgagtgcggcaagagcttccagaagttcagcgacctgacccagcacaagggcatccacgccggcgagaagccctacacctgcgaggagagaggcaaggacttcggctggtacaccgacctgaaccagcacaagaagatccacaccggcgagaagccctacaagtgcgaggagtgcggcaaggccttcaacagaagcaccaacctgaccgcccacaagagaatccacaacagagagaaggcctacaccggcgaggacagagacagagccttcggctggagcaccaacctgaacgagtacaagaagatccacaccggcgacaagccctacaagtgcaaggagtgcggcaaggccttcatgcacagcagccacctgaacaagcacgagaagatccacaccggcgagaagccctacaagtgcaaggagtgcggcaaggtgatcagcagcagcagcagcttcgccaagcacaagagaatccacaccggcgagaagcccttcaagtgcctggagtgcggcaaggccttcaacatcagcaccaccctgaccaagcacagaagaatccacaccggcgagaagccctacacctgcgaggtgtgcggcaaggccttcagacagagcgccaacctgtacgtgcacagaagaatccacaccggcgagaagccctacacctgcggcgagtgcggcaagaccttcagacagagcgccaacctgtacgtgcacagaagaatccacaccggcgagaagccctacaagtgcgaggactgcggcaaggccttcggcagatacaccgccctgaaccagcacaagaagatccacaccggcgagaagccctacaagtgcgaggagtgcggcaaggccttcaacagcagcaccaacctgaccgcccacaagagaatccacaccagagagaagccctacacctgcgaggacagaggcagagccttcggcctgagcaccaacctgaacgagtacaagaagatccacaccggcgacaagccctacaagtgcaaggagtgcggcaaggccttcatccacagcctgcacctgaacaagcacgagaagatccacaccggcaagaagccctacaagtgcaagcagtgcggcaaggtgatcaccagcagcagcagcttcgccaagcacaagagaatccacaccggcgagaagcccttcgagtgcctggagtgcggcaaggccttcaccagcagcaccaccctgaccaagcacagaagaatccacaccggcgagaagccctacacctgcgaggtgtgcggcaaggccttcagacagagcgccatcctgtacgtgcacagaagaatccacaccggcgagaagccctacacctgcgaggagtgcggcaagaccttcagacagagcgccaacctgtacgtgcacagaagaatccacaccggcgagaagccctacaagtgcgaggagtgcggcaaggccttcggcagatacaccgacctgaaccagcacaagaagatccacaccggcgagaagctgtacaagtgcgaggagtgcggcaaggacttcgtgtggtacaccgacctgaaccagcagaagaagatctacaccggcgagaagccctacaagtgcgaggagtgcggcaaggccttcgcccccagcaccgacctgaaccagcacaccaagatcctgaccggcgagcagagctacaagtgcgaggagtgcggcaaggccttcggctggagcatcgccctgaaccagcacaagaagatccacaccggcgagaagccctacaagtgcgaggagtgcggcaaggccttcagcagaagcagaaacctgaccacccacagaagagtgcacaccagagagaagccctacaagtgcgaggacagaggcagaagcttcggctggagcaccaacctgaacgagtacaagaagatccacaccggcgacaagctgtacaagtgcaaggagtgcggcaaggtgttcaagcagagcagccacctgaacagacacgagaagatccacaccggcaagaagccctacaagtgcaaggagtgcggcaaggtgatcaccagcagcagcagcttcgccaagcacaagagaatccacaccggcgagaagcccttcaagtgcctggagtgcggcaaggccttcaccagcagcaccaccctgaccaagcacagaagaatccacaccggcgagaagccctacacctgcgaggagtgcggcaaggccttcagacagagcgccatcctgtacgtgcacagaagaatccacaccggcgagaagccctacacctgcggcgagtgcggcaagaccttcagacagagcgccaacctgtacgcccacaagaagatccacaccggcgagaagccctacacctgcggcgactgcggcaagaccttcagacagagcgccaacctgtacgcccacaagaagatccacaccggcgacaagaccatccaggtgtag

SEQ ID NO: 10988 - DNA, 399 bp, Artificial Sequence
  Description of Artificial Sequence: Synthetic coding sequence
atggagcccctgaccttcagagacgtggccatcgagttcagccccgaggagtggaagtgcctggaccccgcccagcagaacctgtacagagacgtgatgctggagaactacagaaacctggtgagcctggccatgtgcagccacttcacccaggacttcctgcccgtgcagggcatcgaggacagcttccacaagctgatcctgagaagatacgagaagttcagcagcctgatcagcagctgcagagtgatcagccacggcctgagcagaggcagaaacagagccaccgagaagaacgacctgctgaccaccgaggagcccgtggtgaagcacagattcgacctgcagtaccccgaggagatgtggagaaacaccgtggtgcagaagggcagaaagtag

SEQ ID NO: 10989 - DNA, 2772 bp, Artificial Sequence
  Description of Artificial Sequence: Synthetic coding sequence
atgctggagaactacagaaacctggtgagcctggccatgtgcagccacttcacccaggacttcctgcccgtgcagggcatcgaggacagcttccacaagctgatcctgagaagatacgagaagtgcggccacgacaacctgcagctgagaaagggctgcaagagcatgaacgtgtgcaaggtgcagaagggcgtgtacaacggcatcaacaagtgcctgagcaacacccagagcaagatcttccagtgcaacgccagagtgaaggtgttcagcaagttcgccaacagcaacaaggacaagaccagacacaccggcgagaagcacttcaagtgcaacgagtgcggcaagagcttccagaagttcagcgacctgacccagcacaagggcatccacgccggcgagaagccctacacctgcgaggagagaggcaaggacttcggctggtacaccgacctgaaccagcacaagaagatccacaccggcgagaagccctacaagtgcgaggagtgcggcaaggccttcaacagaagcaccaacctgaccgcccacaagagaatccacaacagagagaaggcctacaccggcgaggacagagacagagccttcggctggagcaccaacctgaacgagtacaagaagatccacaccggcgacaagccctacaagtgcaaggagtgcggcaaggccttcatgcacagcagccacctgaacaagcacgagaagatccacaccggcgagaagccctacaagtgcaaggagtgcggcaaggtgatcagcagcagcagcagcttcgccaagcacaagagaatccacaccggcgagaagcccttcaagtgcctggagtgcggcaaggccttcaacatcagcaccaccctgaccaagcacagaagaatccacaccggcgagaagccctacacctgcgaggtgtgcggcaaggccttcagacagagcgccaacctgtacgtgcacagaagaatccacaccggcgagaagccctacacctgcggcgagtgcggcaagaccttcagacagagcgccaacctgtacgtgcacagaagaatccacaccggcgagaagccctacaagtgcgaggactgcggcaaggccttcggcagatacaccgccctgaaccagcacaagaagatccacaccggcgagaagccctacaagtgcgaggagtgcggcaaggccttcaacagcagcaccaacctgaccgcccacaagagaatccacaccagagagaagccctacacctgcgaggacagaggcagagccttcggcctgagcaccaacctgaacgagtacaagaagatccacaccggcgacaagccctacaagtgcaaggagtgcggcaaggccttcatccacagcctgcacctgaacaagcacgagaagatccacaccggcaagaagccctacaagtgcaagcagtgcggcaaggtgatcaccagcagcagcagcttcgccaagcacaagagaatccacaccggcgagaagcccttcgagtgcctggagtgcggcaaggccttcaccagcagcaccaccctgaccaagcacagaagaatccacaccggcgagaagccctacacctgcgaggtgtgcggcaaggccttcagacagagcgccatcctgtacgtgcacagaagaatccacaccggcgagaagccctacacctgcgaggagtgcggcaagaccttcagacagagcgccaacctgtacgtgcacagaagaatccacaccggcgagaagccctacaagtgcgaggagtgcggcaaggccttcggcagatacaccgacctgaaccagcacaagaagatccacaccggcgagaagctgtacaagtgcgaggagtgcggcaaggacttcgtgtggtacaccgacctgaaccagcagaagaagatctacaccggcgagaagccctacaagtgcgaggagtgcggcaaggccttcgcccccagcaccgacctgaaccagcacaccaagatcctgaccggcgagcagagctacaagtgcgaggagtgcggcaaggccttcggctggagcatcgccctgaaccagcacaagaagatccacaccggcgagaagccctacaagtgcgaggagtgcggcaaggccttcagcagaagcagaaacctgaccacccacagaagagtgcacaccagagagaagccctacaagtgcgaggacagaggcagaagcttcggctggagcaccaacctgaacgagtacaagaagatccacaccggcgacaagctgtacaagtgcaaggagtgcggcaaggtgttcaagcagagcagccacctgaacagacacgagaagatccacaccggcaagaagccctacaagtgcaaggagtgcggcaaggtgatcaccagcagcagcagcttcgccaagcacaagagaatccacaccggcgagaagcccttcaagtgcctggagtgcggcaaggccttcaccagcagcaccaccctgaccaagcacagaagaatccacaccggcgagaagccctacacctgcgaggagtgcggcaaggccttcagacagagcgccatcctgtacgtgcacagaagaatccacaccggcgagaagccctacacctgcggcgagtgcggcaagaccttcagacagagcgccaacctgtacgcccacaagaagatccacaccggcgagaagccctacacctgcggcgactgcggcaagaccttcagacagagcgccaacctgtacgcccacaagaagatccacaccggcgacaagaccatccaggtgtag

SEQ ID NO: 10990 - DNA, 2217 bp, Artificial Sequence
  Description of Artificial Sequence: Synthetic coding sequence
atgggcctgctgaccttcagagacgtggccatcgagttcagcctggaggagtggcagtgcctggacaccgcccagaagaacctgtacagaaacgtgatgctggagaactacagaaacctggccttcctgggcatcgccgtgagcaagcccgacctgatcatctgcctggagaaggagaaggagccctggaacatgaagagagacgagatggtggacgagccccccggcatctgcccccacttcgcccaggacatctggcccgagcagggcgtggaggacagcttccagaaggtgatcctgagaagattcgagaagtgcggccacgagaacctgcagctgagaaagggctgcaagagcgtggacgagtgcaaggtgcacaaggagggctacaacggcctgaaccagtgcttcaccaccacccagggcaaggccagccagtgcggcaagtacctgaaggtgttctacaagttcatcaacctgaacagatacaagatcagacacaccagaaagaagcccttcaagtgcaagaactgcgtgaagagcttctgcatgttcagccacaagacccagcacaagagcatctacaccaccgagaagagctacaagtgcaaggagtgcggcaagaccttcaactggagcagcaccctgaccaaccacaagaagacccacaccgaggagaagccctacaagtgcgaggagtacggcaaggccttcaaccagagcagcaactacaccacccacaaggtgacccacaccggcgagaagccctacaagtgcgaggagtgcggcaaggccttcagccagagcagcaccctgaccatccacaagagaatccacaccggcgagaagccctgcaagtgcgaggagtgcggcaaggccttcagccagcccagcgccctgaccatccacaagagaatgcacatcggcgagaagccctacaagtgcgaggagtgcggcaaggccttcgtgtggagcagcaccctgaccagacacaagagactgcacagcggcgagaagccctacaagtgcgaggagtgcgccaaggccttcagccagttcggccacctgaccacccacagaatcatccacaccggcgagaagccctacaagtgcgaggagtgcggcaaggccttcatctggcccagcaccctgaccaagcacaagagaatccacaccggcgagaagccctacaagtgcgaggagtgcggcaaggccttccacagaagcagcaacctgaccaagcacaagatcatccacaccggcgagaagccctacaagtgcgaggagtgcggcaaggccttcatctggagcagcaacctgaccgagcacaagaagatccacaccagagagaagccctacaagtgcgaggagtgcagcaaggccttcagcagaagcagcgccctgaccacccacaagagaatgcacaccggcgagaagccctacaagtgcgaggagtgcggcaaggccttcagccagagcagcaccctgaccgcccacaagatcatccacaccggcgagaagccctacaagtgcgaggagtgcggcaaggccttcatcctgagcagcaccctgagcaagcacaagagaatccacaccggcgagaagccctacaagtgcgaggagtgcggcaagaccttcaaccagagcagcaacctgagcacccacaagatcatccacaccggcgagaagccctacaagtgcgaggagtgcggcaaggccttcaacagaagcagcaacctgagcacccacaagatcatccacaccggcgagaagccctacaagtgcgacgagtgcggcaagagcttcatctggagcagcaccctgttcaagcacaagatcatccacaccggcgagaagccctacaagtgcgaggagtgcggcaaggccttcaaccacagccagatcctgctgcacatcagacacaagagaatgcacaccggcgagaagccctacaagtgcgaggagtgcggcaagagcttcaacctgagcagcaccttcatcaagcacaaggtgatccacaccggcgtgaagctgtacaagtgcgaggagtgcggcaaggtgttcttctggagcagcgccctgaccagacacaagaagatccacgccggccagcagccctacaagtgggagaagatcggcaaggccttcaaccagagcagccacctgaccaccgacaagatcacccacatcggcgagaagagctacaagtgcgagtag

SEQ ID NO: 10991 - DNA, 327 bp, Artificial Sequence
  Description of Artificial Sequence: Synthetic coding sequence
atgggcctgctgaccttcagagacgtggccatcgagttcagcctggaggagtggcagtgcctggacaccgcccagaagaacctgtacagaaacgtgatgctggagaactacagaaacctggccttcctgggcatcgccgtgagcaagcccgacctgatcatctgcctggagaaggagaaggagccctggaacatgaagagagacgagatggtggacgagccccccggcctggccgtgagcaaccccgacctgatcagctgcctggagcagatcaaggagccctggaacgtgaagagacacgagaccgtggtgaagtacagcggctag

SEQ ID NO: 10992 - DNA, 270 bp, Artificial Sequence
  Description of Artificial Sequence: Synthetic coding sequence
atgggcctgctgaccttcagagacgtggccatcgagttcagcctggaggagtggcagtgcctggacaccgcccagaagaacctgtacagaaacgtgatgctggagaactacagaaacctggccttcctgggcatcgccgtgagcaagcccgacctgatcatctgcctggagaaggagaaggagccctggaacatgaagagagacgagatggtggacgagccccccgacggcgtgagcctgtgccaccccggctggagcgccgtggcctag

SEQ ID NO: 10993 - DNA, 234 bp, Artificial Sequence
  Description of Artificial Sequence: Synthetic coding sequence
atgggcctgctgaccttcagagacgtggccatcgagttcagcctggaggagtggcagtgcctggacaccgcccagaagaacctgtacagaaacgtgatgctggagaactacagaaacctggccttcctgggcatcgccgtgagcaagcccgacctgatcatctgcctggagaaggagaaggagccctggaacatgaagagagacgagatggtggacgagccccccggcagatag

SEQ ID NO: 10994 - DNA, 1851 bp, Artificial Sequence
  Description of Artificial Sequence: Synthetic coding sequence
atgggcctgctgaccttcagagacgtggccatcgagttcagcctggaggagtggcagtgcctggacaccgcccagaagaacctgtacagaaacgtgatgctggagaactacagaaacctggccttcctgggcatcgccgtgagcaagcccgacctgatcatctgcctggagaaggagaaggagccctggaacatgaagagagacgagatggtggacgagccccccggcatctgcccccacttcgcccaggacatctggcccgagcagggcgtggaggacagcttccagaaggtgatcctgagaagattcgagaagtgcggccacgagaacctgcagctgagaaagggctgcaagagcgtggacgagtgcaaggtgcacaaggagggctacaacggcctgaaccagtgcttcaccaccacccagggcaaggccagccagtgcggcaagtacctgaaggtgttctacaagttcatcaacctgaacagatacaagatcagacacaccagaaagaagcccttcaagtgcaagaactgcgtgaagagcttctgcatgttcagccacaagacccagcacaagagcatctacaccaccgagaagagctacaagtgcaaggagtgcggcaagaccttcaactggagcagcaccctgaccaaccacaagaagacccacaccgaggagaagccctacaagtgcgaggagtacggcaaggccttcaaccagagcagcaactacaccacccacaaggtgacccacaccggcgagaagccctacaagtgcgaggagtgcggcaaggccttcagccagagcagcaccctgaccatccacaagagaatccacaccggcgagaagccctgcaagtgcgaggagtgcggcaaggccttcagccagcccagcgccctgaccatccacaagagaatgcacatcggcgagaagccctacaagtgcgaggagtgcggcaaggccttcgtgtggagcagcaccctgaccagacacaagagactgcacagcggcgagaagccctacaagtgcgaggagtgcgccaaggccttcagccagttcggccacctgaccacccacagaatcatccacaccggcgagaagccctacaagtgcgaggagtgcggcaaggccttcatctggcccagcaccctgaccaagcacaagagaatccacaccggcgagaagccctacaagtgcgaggagtgcggcaaggccttccacagaagcagcaacctgaccaagcacaagatcatccacaccggcgagaagccctacaagtgcgaggagtgcggcaaggccttcatctggagcagcaacctgaccgagcacaagaagatccacaccagagagaagccctacaagtgcgaggagtgcagcaaggccttcagcagaagcagcgccctgaccacccacaagagaatgcacaccggcgagaagccctacaagtgcgaggagtgcggcaaggccttcagccagagcagcaccctgaccgcccacaagatcatccacaccggcgagaagccctacaagtgcgaggagtgcggcaaggccttcatcctgagcagcaccctgagcaagcacaagagaatccacaccggcgagaagccctacaagtgcgaggagtgcggcaagaccttcaaccagagcagcaacctgagcacccacaagatcatccacaccggcgagaagccctacaagtgcgaggagtgcggcaaggccttcaacagaagcagcaacctgagcacccacaagatcatccacaccggcgagaagccctacaagtgcgacgagtgcggcaagagcttcatctggagcagcaccctgttcaagcacaagagaatccacacctag

SEQ ID NO: 10995 - DNA, 3759 bp, Artificial Sequence
  Description of Artificial Sequence: Synthetic coding sequence
atgcccggcgcccccggcagcctggagatgggccccctgaccttcagagacgtgaccatcgagttcagcctggaggagtggcagtgcctggacaccgtgcagcagaacctgtacagagacgtgatgctggagaactacagaaacctggtgttcctgggcatggccgtgttcaagcccgacctgatcacctgcctgaagcagggcaaggagccctggaacatgaagagacacgagatggtgaccaagccccccgtgatgagaagccacttcacccaggacctgtggcccgaccagagcaccaaggacagcttccaggaggtgatcctgagaacctacgccagatgcggccacaagaacctgagactgagaaaggactgcaagagcgccaacgagggcaagatgcacaaggagggctacaacaagctgaaccagtgcagaaccgccacccagagaaagatcttccagtgcaacaagcacatgaaggtgttccacaagtacagcaacagaaacaaggtgagacacaccaagaagaagaccttcaagtgcatcaagtgcagcaagagcttcttcatgctgagctgcctgatcagacacaagagaatccacatcagacagaacatctacaagtgcgaggagagaggcaaggccttcaagagcttcagcaccctgaccaagcacaagatcatccacaccgaggacaagccctacaagtacaagaagtgcggcaacgccttcaagttcagcagcaccttcaccaagcacaagagaatccacaccggcgagacccccttcagatgcgaggagtgcggcaaggccttcaaccagagcagcaacctgaccgaccacaagagaatccacaccggcgagaagacctacaagtgcgaggagtgcggcaaggccttcaagggcagcagcaacttcaacgcccacaaggtgatccacaccgccgagaagccctacaagtgcgaggactgcggcaagaccttcaaccacttcagcgccctgagaaagcacaagatcatccacaccggcaagaagccctacaagagagaggagtgcggcaaggccttcagccagagcagcaccctgagaaagcacgagatcatccacaccggcgagaagccctacaagtgcgaggagtgcggcaaggccttcaagtggagcagcaagctgaccgtgcacaaggtggtgcacaccggcgagaagccctacaagtgcgaggagtgcggcaaggccttcagccagttcagcaccctgaagaagcacaagatcatccacaccggcaagaagccctacaagtgcgaggagtgcggcaaggccttcaacagcagcagcaccctgatgaagcacaagatcatccacaccggcgagaagccctacaagtgcgaggagtgcggcaaggccttcagacagagcagccacctgaccagacacaaggccatccacaccggcgagaagccctacaagtgcgaggagtgcggcaaggccttcaaccacttcagcgacctgagaagacacaagatcatccacaccggcaagaagccctacaagtgcgaggagtgcggcaaggccttcagccagagcagcaccctgagaaaccaccagatcatccacaccggcgagaagccctacaagtgcgaggagtgcggcaaggccttcaagtggagcagcaagctgaccgtgcacaaggtgatccacaccggcgagaagccctgcaagtgcgaggagtgcggcaaggccttcaagcacttcagcgccctgagaaagcacaaggtgatccacaccagagagaagctgtacaagtgcgaggagtgcggcaaggccttcaacaacagcagcatcctggccaagcacaagatcatccacaccggcaagaagccctacaagtgcgaggagtgcggcaaggccttcagacagagcagccacctgaccagacacaaggccatccacaccggcgagaagccctacaagtgcgaggagtgcggcaaggccttcagccacttcagcgccctgagaagacacaagatcatccacaccggcaagaagccctacaagtgcgaggagtgcggcaaggccttcagccacttcagcgccctgagaagacacaagatcatccacaccggcgagaagccctacaagtgcgaggagtgcggcaaggccttcaagtggagcagcaagctgaccgtgcacaaggtgatccacaccgccgagaagccctgcaagtgcgaggagtgcggcaagagcttcaagcacttcagcgccctgagaaagcacaaggtgatccacaccagagagaagctgtacaagtgcgaggagtgcgtgaaggccttcaacagcttcagcgccctgatgaagcacaaggtgatccacaccggcgagaagccctacaagtgcgaggagtgcggcaaggccttcaagtggagcagcaagctgaccgtgcacaaggtgatccacaccggcgagaagccctgcaagtgcgaggagtgcggcaaggccttcaagcacttcagcgccctgagaaagcacaaggtgatccacaccggcaagaagccctacaagtgcgaggagtgcggcaaggccttcagccagagcagcagcctgagaaagcacgagatcatccacagcggcgagaagccctacaagtgcgaggagtgcggcaaggccttcaagtggctgagcaagctgaccgtgcacaaggtgatccacaccgccgagaagccctgcaagtgcgaggagtgcggcaaggccttcaagcacttcagcgccctgagaaagcacaagatcatccacaccggcaagaagccctacaagtgcgaggagtgcggcaaggccttcaacgacagcagcaccctgatgaagcacaagatcatccacaccggcaagaagccctacaagtgcgccgagtgcggcaaggccttcaagcagagcagccacctgaccagacacaaggccatccacaccggcgagaagccctacaagtgcgaggagtgcggcaaggacttcaacaacagcagcaccctgaagaagcacaagctgatccacaccagagagaagctgtacaagtgcgaggagtgcgtgaaggccttcaacaacttcagcgccctgatgaagcacaagatcatccacaccggcgagaagccctacaagtgcgaggagtgcggcaaggccttcaagtggagcagcaagctgaccgagcacaaggtgatccacaccggcgagaagccctgcaagtgcgaggagtgcgacaaggccttcaagcacttcagcgccctgagaaagcacaaggtgatccacaccggcaagaagccctaccagtgcgacgagtgcggcaaggccttcaacaacagcagcaccctgaccaagcacaagatcatccacaccggcgagaagccctacaagtgcgaggagtgcggcaaggccttcagccagagcagcatcctgaccaagcacaagatcatccacagcgtggagaagccctacaagtgcgaggagtgcggcaaggccttcaaccagagcagccacctgaccagacacaagaccatccacaccggcgagaagccctacaagtgcgaggagtgcggcaaggccttcatccagtgcagctacctgatcagacacaagaccatccacaccagagagaagcccaccaacgtgaagaaggtgcccaagctgctgagcaacccccacaccctgctggacaagaccatccacaccggcgagaagccctacaagtgcgaggagtgcgccaaggccttctag

SEQ ID NO: 10996 - DNA, 1512 bp, Artificial Sequence
  Description of Artificial Sequence: Synthetic coding sequence
atgggcgccctgaccttcagagacgtggccatcgagttcagcctggaggagtggcagtgcctggacaccgagcagcagaacctgtacagaaacgtgatgctggacaactacagaaacctggtgttcctgggcatcgccgtgagcaagcccgacctgatcacctgcctggagcaggagaaggagccctggaacctgaagacccacgacatggtggccaagccccccgtgatctgcagccacatcgcccaggacctgtggcccgagcagggcatcaaggactacttccaggaggtgatcctgagacagtacaagaagtgcagacacgagaacctgctgctgagaaagggctgcaagaacgtggacgagttcaagatgcacaagaagggctacaacagacacaaccagtgcctgaccaccagccacagcaagatcttccagtgcgacaagtacgtgaaggtgttccacaagttcagcaacagcaacagacacaagatcagacacaccagcaagaagcccttcaagtgcaaggagtgcggcaagctgttctgcatcctgagccacctggcccagcacaagaagatccacaccggcgagaagagctacaagtgcgaggagtacggcaaggccttcaacgagagcagcaactgcaccacccacaagagaatcaccgagaagaagccctacaagtgcaaggagtgcggcaaggccttcaactggttcagccacttcaccacccacaagagaatccacaccggcgagaagccctaccagtgcgagaagtgcggcaagttcttcaaccagagcaccaacctgaccacccacaagagaatccacaccggcgagaagccctacaagtgcgaggagtgcggcaaggccttcaaccagagcagcaacctgaccgagcacaagaagatccacaccaaggagcagccctacaagtgcgagaagtgcggcaaggccttcaagtggagcagcaccctgaccaagcacaagagaatccacaacggcgagaagccctacaagtgcgaggagtgcggcaaggccttcaacagaagcagcaccctgaacagacacaagatcacccacaccggcggcaagccctacaagtacaaggagtgcggcaaggccttcaaccagagcagcaccctgaccatccacaagatcatccacaccgtggagaagttctacaagtgcgaggagtgcggcaaggccttcagcagaatcagccacctgaccacccacaagagaatccacaccggcgagaagccctacaagtgcgaggagtgcggcagagccttcaaccagagcagcaccctgaccacccacaagagaatccacaccggcgagaagccctacgagtgcgaggagtgcggcaaggccttcaacagaagcagcaccctgaccacccacaagatcatccacagcggcgagaagatctacaagtgcaaggagtgcggcaaggccttcagaagattcagccacctgaccagacacaagaccatccacacctag

SEQ ID NO: 10997 - DNA, 1758 bp, Artificial Sequence
  Description of Artificial Sequence: Synthetic coding sequence
atggagctgctgaccttcagagacgtggccatcgagttcagccccgaggagtggaagtgcctggaccccgcccagcagaacctgtacagagacgtgatgctggagaactacagaaacctgatcagcctgggcgtggccatcagcaaccccgacctggtgatctacctggagcagagaaaggagccctacaaggtgaagatccacgagaccgtggccaagcaccccgccgtgtgcagccacttcacccaggacttcctgcccgtgcagggcatcgaggacagcttccacaagctgatcctgagaagatacgagaagtgcggccacgagaacctggagctgagaaagagctgcaagagaaaggtgcagaagggcggctacaacgagttcaaccagtgcctgagcaccatccagagcaagatcttccagtgcaacgtgcacgtgaaggtgttcagcaccttcagcaacagcaaccagagaagaatcagacacaccggcgagaagcacttcaaggagtgcggcaagagcttccagaagttcagcgacctgacccagcaccagggcatccacgccggcgagaagccctacacctgcgaggagtgcggcaaggacttcaagtggtacctgatcttcaacgagtacgagatcatccacaccggcgagaagcccttcacctgcgaggagtgcggcaacatcttcaccaccagcagcaacttcgccaagcacaaggtgcacaccggcgagaagagctacaagtacgaggagtgcggcaaggccttcaacagaagcagcaccctgaccaagcacaagagaatccacgccgaggagaagcccttcacctgcgaggagtgcggcaagatcatcaccagcagcagcaacgtggccaagcacaagaagatccacaccggcgagaagctgtacaagtgccaggagtgcggcaaggtgttcaacagaagcaccaccctgaccaagcacaacagaatccacaccggcgagaagccctacacctgcgaggagtgcggcaaggccttcagcagaagcagcgtgctgaacgagcacaagagaatccacaccggcgagaagccctacaagtgcgagcagtgcggcaaggccttcagacagagcgccaccctgaacaagcacaagagcatccacaccggcgagaagccctacacctgcgaggagtgcggcaaggccttcagcagattcaccaccctgaacgagcacaagagaatccacaccggcgagagaccccacaagtgcgaggagtgcggcaaggccttcggctggagcaccgacctgaacaagcacaagatcatccacaccggcgagaagccctacaagtgcgaggagtgcggcaaggccttcggctggagcgcctacctgagcaagcacaagaagatccacaccggcgagaagccctacagatgcgaggagtgcggcaaggccttcctgtgcagcagagccctgaacaagcacaagaccatccacaccggcgagaagccctacgagtgcgaggagtgcggcaaggccttcggctggagcacctacctgagcaagcacaagaagatccacaccggcgagaagccctacagatgcgaggagtgcggcaaggccttcagaagaagcagagtgctgaacaagtacaagaccatccacaccggcgacaagacccccaagtgcaagggctgcggcaaggccttcaagtggagcagctacctgaaccagcacaacaagatctacaccggcgagaagctgtag

SEQ ID NO: 10998 - DNA, 1284 bp, Artificial Sequence
  Description of Artificial Sequence: Synthetic coding sequence
atgggcgtgctgaccttcagagacgtggccgtggagttcagccccgaggagtgggagtgcctggacagcgcccagcagagactgtacagagacgtgatgctggagaactacggcaacctggtgagcctgggcctggccatcttcaagcccgacctgatgacctgcctggagcagagaaaggagccctggaaggtgaagagacaggaggccgtggccaagcaccccgccggcagcttccacttcaccgccgagatcctgcccgaccacgacatcaaggacagcttccagaaggtgatcctgagaaagtacggcagctgcgacctgaacaacctgcacctgaagaaggactaccagagcgtgggcaactgcaagggccagaagagcagctacaacggcctgcaccagtgcctgagcgccacccacagcaagacctgccagtgcaacaagtgcggcagaggcttccagctgtgcagcatcttcaccgagcacaaggacatcttcagcagagagaagtgccacaagtgcgaggagtgcggcaaggactgcagactgttcagcgacttcaccagacacaagaagatccacaccgtggagagatgctacaagtgcgaggagtgcggcaaggccttcaagaagttcagcaacctgaccgagcacaagagagtgcacaccggcgagaagccctacaagtgcgagggctgcggcaagaccttcacctgcagcagcaccctggtgaagcacaagagaaaccacaccggcgacagaccctacaagtgcgaggagtgcggcaaggccttcaagtgcttcagcgacctgaccaaccacaagagaatccacaccggcgagaagccctacaagtgcgaggagtgcaacaaggcctacagatggttcagcgacctggccaagcacaagatcatccacaccggcgacaagccctacacctgcaacgagtgcggcaaggccttcaagtggttcagcgccctgagcaagcacaagagaatccacaccggcgagaagccctacatctgcgaggagtgcggcaaggccttcaccagaagcagcaccctgttcaaccacaagagaatccacatggaggagagaccctacaagtgcgaggagtgcagcaagaccttcaagtgcttcagcgacctgaccaaccacaagagaatccacaccggcgagaagccctacaagtgcgaggagtgcggcaaggccagcagctggttcagccacctgatcagacacaagagaatccacaccagagagaagctgcacaagtgctag

SEQ ID NO: 10999 - DNA, 1284 bp, Artificial Sequence; identical to SEQ ID NO: 10998
  Description of Artificial Sequence: Synthetic coding sequence

SEQ ID NO: 11000 - DNA, 414 bp, Artificial Sequence
  Description of Artificial Sequence: Synthetic coding sequence
atggacgacctgagatacggcgtgtaccccgtgaagggcgccagcggctaccccggcgccgagagaaacctgctggagtacagctacttcgagaagggccccctgaccttcagagacgtggtgatcgagttcagccaggaggagtggcagtgcctggacaccgcccagcaggacctgtacagaaaggtgatgctggagaacttcagaaacctggtgttcctgggcatcgacgtgagcaagcccgacctgatcacctgcctggagcagggcaaggacccctggaacatgaagagacacagcatggtggccaccccccccgagagcggcgtgctgaagttccccaccatcatcatcctgctgagcagatgcttcttccagagcgtgaacatctgcttcatctacctggagccctag

SEQ ID NO: 11001 - DNA, 354 bp, Artificial Sequence
  Description of Artificial Sequence: Synthetic coding sequence
atggacgacctgagatacggcgtgtaccccgtgaagggcgccagcggctaccccggcgccgagagaaacctgctggagtacagctacttcgagaagggccccctgaccttcagagacgtggtgatcgagttcagccaggaggagtggcagtgcctggacaccgcccagcaggacctgtacagaaaggtgatgctggagaacttcagaaacctggtgttcctgggcatcgacgtgagcaagcccgacctgatcacctgcctggagcagggcaaggacccctggaacatgaagagacacagcatggtggccaccccccccgacggcgtgagcctgctgttccccagacccgagtag

SEQ ID NO: 11002 - DNA, 582 bp, Artificial Sequence
  Description of Artificial Sequence: Synthetic coding sequence
atggcccaggccagcctgctggcctgcgagggcctggccggcgtgagcctggtgcccaccgccgccagcaagaagatgatgctgagccagatcgccagcaagcaggccgagaacggcgagagagccggcagccccgacgtgctgagatgcagcagccagggccacagaaaggacagcgacaagagcagaagcagaaaggacgacgacagcctgagcgaggccagccacagcaagaagaccgtgaagaaggtggtggtggtggagcagaacggcagcttccaggtgaagatccccaagaacttcgtgtgcgagcactgcttcggcgccttcagaagcagctaccacctgaagagacacatcctgatccacaccggcgagaagcccttcgagtgcgacatctgcgacatgagattcatccagaagtaccacctggagagacacaagagagtgcacagcggcgagaagccctaccagtgcgagagatgccaccagtgcttcagcagaaccgacagactgctgagacacaagagaatgtgccagggctgccagagcaagaccagcgacggccagttcagcctgtag

SEQ ID NO: 11003 - DNA, 2337 bp, Artificial Sequence
  Description of Artificial Sequence: Synthetic coding sequence
atgaacctgaccgaggactgcatggtgttcgaggacgtggccatctacttcagccaggaggagtggggcatcctgaacgacgcccagagacacctgcacagcaacgtgatgctggagaacttcgccctgctgagcagcgtgggctgctggcacggcgccaaggacgaggaggtgcccagcaagcagtgcgtgagcgtgagagtgctgcaggtgaccatccccaagcccgccctgagcaccctgaaggcccagccctgcaagatgtgcagcagcatcctgaaggacatcctgcacctggccgagcacgacggcacccaccccgagcagggcctgtacacctgcgccgccgagcacgacctgcaccagaaggagcagatcagagagaagctgaccagaagcgacgagtggagacccagcttcgtgaaccacagcgcccacgtgggcgagagaaacttcacctgcacccagggcggcaaggacttcaccgccagcagcgacctgctgcagcagcaggtgctgaacagcggctggaagctgtacagagacacccaggacggcgaggccttccagggcgagcagaacgacttcaacagcagccagggcggcaaggacttctgccaccagcacggcctgttcgagcaccagaagacccacaacggcgagagaccctacgagttcagcgagtgcggcgagctgttcagatacaacagcaacctgatcaagtaccagcagaaccacgccggcgagagaccctacgagggcaccgagtacggcaagaccttcatcagaaagagcaacctggtgcagcaccagaagatccacagcgagggcttcctgagcaagagaagcgaccccatcgagcaccaggagatcctgagcagacccaccccctacgagtgcacccagtgcggcaaggccttcctgacccaggcccacctggtgggccaccagaagacccacaccggcgagcagccctacgagtgcaacaagtgcggcaagttcttcatgtacaacagcaagctgatcagacaccagaaggtgcacaccggcgagagaagatacgagtgcagcgagtgcggcaagctgttcatggacagcttcaccctgggcagacaccagagagtgcacaccggcgagagacccttcgagtgcagcatctgcggcaagttcttcagccacagaagcaccctgaacatgcaccagagagtgcacgccggcaagagactgtacaagtgcagcgagtgcggcaaggccttcagcctgaagcacaacgtggtgcagcacctgaagatccacaccggcgagagaccctacgagtgcaccgagtgcgagaaggccttcgtgagaaagagccacctggtgcagcaccagaagatccacaccgacgccttcagcaagagaagcgacctgatccagcacaagagaatcgacatcagacccagaccctacacctgcagcgagtgcggcaaggccttcctgacccaggcccacctggtgggccaccagaagatccacaccggcgagagaccctacgagtgcacccagtgcgccaaggccttcgtgagaaagagccacctggtgcagcacgagaagatccacaccgacgccttcagcaagagaagcgacctgatccagcacaagagaatcgacctgagacccagaccctacgtgtgcagcgagtgcggcaaggccttcctgacccaggcccacctggacggccaccagaagatccagaccggcgagagaagatacgagtgcaacgagtgcggcaagttcttcctggacagctacaagctggtgatccaccagagaatccacaccggcgagaagccctacaagtgcagcaagtgcggcaagttcttcagatacagatgcaccctgagcagacaccagaaggtgcacaccggcgagagaccctacgagtgcagcgagtgcggcaagttcttcagagacagctacaagctgatcatccaccagagagtgcacaccggcgagaagccctacgagtgcagcaactgcggcaagttcctgagatacagaagcaccttcatcaagcaccacaaggtgtgcaccggcgagaagccccacgagtgcagcaagtgcagagagctgttcagaaccaagagcagcctgatcatccaccagcagagccacaccggcgagagccccttcaagctgagagagtgcggcaaggacttcaacaagtgcaacaccggccagagacagaagacccacaccggcgagagaagctacgagtgcggcgagagcagcaaggtgttcaagtacaacagcagcctgatcaagcaccagatcatccacaccggcaagagaccctag

SEQ ID NO: 11004 - DNA, 1194 bp, Artificial Sequence
  Description of Artificial Sequence: Synthetic coding sequence
atgatgttccaggaccccgtggcctgcgaggacgtggccgtgaacttcacccaggaggagtgggccctgctggacatcagccagagaaagctgtacagagaggtgatgctggagaccttcagaaacctgaccagcatcggcaagaagtggaaggaccagaacatcgagtacgagtaccagaaccccagaagaaacttcagaagcctgatcgagggcaacgtgaacgagatcaaggaggacagccactgcggcgagaccttcacccaggtgcccgacgacagactgaacttccaggagaagaaggccagccccgaggccaagagctgcgacaacttcgtgtgcggcgaggtgggcatcggcaacagcagcttcaacatgaacatcagaggcgacatcggccacaaggcctacgagtaccaggactacgcccccaagccctacaagtgccagcagcccaagaaggccttcagataccaccccagcttcagaacccaggagagaaaccacaccggcgagaagccctacgcctgcaaggagtgcggcaagaccttcatcagccacagcggcatcagaagaagaatggtgatgcacagcggcgacggcccctacaagtgcaagttctgcggcaaggccgtgcactgcctgagactgtacctgatccacgagagaacccacaccggcgagaagccctacgagtgcaagcagtgcgtgaagagcttcagctacagcgccacccacagaatccacgagagaacccacaccggcgagaagccctacgagtgccagcagtgcggcaaggccttccacagcagcagcagcttccaggcccacaagagaacccacaccggcggcaagccctacgagtgcaagcagtgcggcaagagcttcagctggtgccacagcttccagatccacgagagaacccacaccggcgagaagccctgcgagtgcagcaagtgcaacaaggccttcagaagctacagaagctacctgagacacaagagaagccacaccggcgagaagccctaccagtgcaaggagtgcagaaaggccttcacctaccccagcagcctgagaagacacgagagaacccacagcgccaagaagccctacgagtgcaagcagtgcggcaaggccctgagctacaagttcagcaacacccccaagaacgccctgtggagaaagaccctgtag

SEQ ID NO: 11005 - DNA, 1185 bp, Artificial Sequence
  Description of Artificial Sequence: Synthetic coding sequence
atggaccccgtggcctgcgaggacgtggccgtgaacttcacccaggaggagtgggccctgctggacatcagccagagaaagctgtacagagaggtgatgctggagaccttcagaaacctgaccagcatcggcaagaagtggaaggaccagaacatcgagtacgagtaccagaaccccagaagaaacttcagaagcctgatcgagggcaacgtgaacgagatcaaggaggacagccactgcggcgagaccttcacccaggtgcccgacgacagactgaacttccaggagaagaaggccagccccgaggccaagagctgcgacaacttcgtgtgcggcgaggtgggcatcggcaacagcagcttcaacatgaacatcagaggcgacatcggccacaaggcctacgagtaccaggactacgcccccaagccctacaagtgccagcagcccaagaaggccttcagataccaccccagcttcagaacccaggagagaaaccacaccggcgagaagccctacgcctgcaaggagtgcggcaagaccttcatcagccacagcggcatcagaagaagaatggtgatgcacagcggcgacggcccctacaagtgcaagttctgcggcaaggccgtgcactgcctgagactgtacctgatccacgagagaacccacaccggcgagaagccctacgagtgcaagcagtgcgtgaagagcttcagctacagcgccacccacagaatccacgagagaacccacaccggcgagaagccctacgagtgccagcagtgcggcaaggccttccacagcagcagcagcttccaggcccacaagagaacccacaccggcggcaagccctacgagtgcaagcagtgcggcaagagcttcagctggtgccacagcttccagatccacgagagaacccacaccggcgagaagccctgcgagtgcagcaagtgcaacaaggccttcagaagctacagaagctacctgagacacaagagaagccacaccggcgagaagccctaccagtgcaaggagtgcagaaaggccttcacctaccccagcagcctgagaagacacgagagaacccacagcgccaagaagccctacgagtgcaagcagtgcggcaaggccctgagctacaagttcagcaacacccccaagaacgccctgtggagaaagaccctgtag

SEQ ID NO: 11006 - DNA, 1245 bp, Artificial Sequence
  Description of Artificial Sequence: Synthetic coding sequence
atgccctgctgcagccacagaagctgcagagaggaccccggcaccagcgagagcagagagatggaccccgtggcctgcgaggacgtggccgtgaacttcacccaggaggagtgggccctgctggacatcagccagagaaagctgtacagagaggtgatgctggagaccttcagaaacctgaccagcatcggcaagaagtggaaggaccagaacatcgagtacgagtaccagaaccccagaagaaacttcagaagcctgatcgagggcaacgtgaacgagatcaaggaggacagccactgcggcgagaccttcacccaggtgcccgacgacagactgaacttccaggagaagaaggccagccccgaggccaagagctgcgacaacttcgtgtgcggcgaggtgggcatcggcaacagcagcttcaacatgaacatcagaggcgacatcggccacaaggcctacgagtaccaggactacgcccccaagccctacaagtgccagcagcccaagaaggccttcagataccaccccagcttcagaacccaggagagaaaccacaccggcgagaagccctacgcctgcaaggagtgcggcaagaccttcatcagccacagcggcatcagaagaagaatggtgatgcacagcggcgacggcccctacaagtgcaagttctgcggcaaggccgtgcactgcctgagactgtacctgatccacgagagaacccacaccggcgagaagccctacgagtgcaagcagtgcgtgaagagcttcagctacagcgccacccacagaatccacgagagaacccacaccggcgagaagccctacgagtgccagcagtgcggcaaggccttccacagcagcagcagcttccaggcccacaagagaacccacaccggcggcaagccctacgagtgcaagcagtgcggcaagagcttcagctggtgccacagcttccagatccacgagagaacccacaccggcgagaagccctgcgagtgcagcaagtgcaacaaggccttcagaagctacagaagctacctgagacacaagagaagccacaccggcgagaagccctaccagtgcaaggagtgcagaaaggccttcacctaccccagcagcctgagaagacacgagagaacccacagcgccaagaagccctacgagtgcaagcagtgcggcaaggccctgagctacaagttcagcaacacccccaagaacgccctgtggagaaagaccctgtag

SEQ ID NO: 11007 - DNA, 819 bp, Artificial Sequence
  Description of Artificial Sequence: Synthetic coding sequence
atgaacatcagaggcgacatcggccacaaggcctacgagtaccaggactacgcccccaagccctacaagtgccagcagcccaagaaggccttcagataccaccccagcttcagaacccaggagagaaaccacaccggcgagaagccctacgcctgcaaggagtgcggcaagaccttcatcagccacagcggcatcagaagaagaatggtgatgcacagcggcgacggcccctacaagtgcaagttctgcggcaaggccgtgcactgcctgagactgtacctgatccacgagagaacccacaccggcgagaagccctacgagtgcaagcagtgcgtgaagagcttcagctacagcgccacccacagaatccacgagagaacccacaccggcgagaagccctacgagtgccagcagtgcggcaaggccttccacagcagcagcagcttccaggcccacaagagaacccacaccggcggcaagccctacgagtgcaagcagtgcggcaagagcttcagctggtgccacagcttccagatccacgagagaacccacaccggcgagaagccctgcgagtgcagcaagtgcaacaaggccttcagaagctacagaagctacctgagacacaagagaagccacaccggcgagaagccctaccagtgcaaggagtgcagaaaggccttcacctaccccagcagcctgagaagacacgagagaacccacagcgccaagaagccctacgagtgcaagcagtgcggcaaggccctgagctacaagttcagcaacacccccaagaacgccctgtggagaaagaccctgtag

SEQ ID NO: 11008 - DNA, 1227 bp, Artificial Sequence
  Description of Artificial Sequence: Synthetic coding sequence
atggccccccccctggcccccctgccccccagagaccccaacggcgccggccccgagtggagagagcccggcgccgtgagcttcgccgacgtggccgtgtacttctgcagagaggagtggggctgcctgagacccgcccagagagccctgtacagagacgtgatgagagagacctacggccacctgagcgccctgggcatcggcggcaacaagcccgccctgatcagctgggtggaggaggaggccgagctgtggggccccgccgcccaggaccccgaggtggccaagtgccagacccagaccgaccccgccgacagcagaaacaagaagaaggagagacagagagagggcaccggcgccctggagaagcccgaccccgtggccgccggcagccccggcctgaagagcccccaggcccccagcgccggccccccctacggctgggagcagctgagcaaggccccccacagaggcagacccagcctgtgcgcccacccccccgtgcccagagccgaccagagacacggctgctacgtgtgcggcaagagcttcgcctggagaagcaccctggtggagcacgtgtacagccacaccggcgagaagcccttccactgcaccgactgcggcaagggcttcggccacgccagcagcctgagcaagcacagagccatccacagaggcgagagaccccacagatgcctggagtgcggcagagccttcacccagagaagcgccctgaccagccacctgagagtgcacaccggcgagaagccctacggctgcgccgactgcggcagaagattcagccagagcagcgccctgtaccagcacagaagagtgcacagcggcgagacccccttcccctgccccgactgcggcagagccttcgcctaccccagcgacctgagaagacacgtgagaacccacaccggcgagaagccctacccctgccccgactgcggcagatgcttcagacagagcagcgagatggccgcccacagaagaacccacagcggcgagaagccctacccctgcccccagtgcggcagaagattcggccagaagagcgccgtggccaagcaccagtgggtgcacagacccggcgccggcggccacagaggcagagtggccggcagactgagcgtgaccctgacccccggccacggcgacctggacccccccgtgggcttccagctgtaccccgagatcttccaggagtgcggctag

SEQ ID NO: 11009 - DNA, 1224 bp, Artificial Sequence
  Description of Artificial Sequence: Synthetic coding sequence
atggccccccccctggcccccctgccccccagagaccccaacggcgccggccccgagtggagagagcccggcgccgtgagcttcgccgacgtggccgtgtacttctgcagagaggagtggggctgcctgagacccgcccagagagccctgtacagagacgtgatgagagagacctacggccacctgagcgccctgggcatcggcggcaacaagcccgccctgatcagctgggtggaggaggaggccgagctgtggggccccgccgcccaggaccccgaggtggccaagtgccagacccagaccgaccccgacagcagaaacaagaagaaggagagacagagagagggcaccggcgccctggagaagcccgaccccgtggccgccggcagccccggcctgaagagcccccaggcccccagcgccggccccccctacggctgggagcagctgagcaaggccccccacagaggcagacccagcctgtgcgcccacccccccgtgcccagagccgaccagagacacggctgctacgtgtgcggcaagagcttcgcctggagaagcaccctggtggagcacgtgtacagccacaccggcgagaagcccttccactgcaccgactgcggcaagggcttcggccacgccagcagcctgagcaagcacagagccatccacagaggcgagagaccccacagatgcctggagtgcggcagagccttcacccagagaagcgccctgaccagccacctgagagtgcacaccggcgagaagccctacggctgcgccgactgcggcagaagattcagccagagcagcgccctgtaccagcacagaagagtgcacagcggcgagacccccttcccctgccccgactgcggcagagccttcgcctaccccagcgacctgagaagacacgtgagaacccacaccggcgagaagccctacccctgccccgactgcggcagatgcttcagacagagcagcgagatggccgcccacagaagaacccacagcggcgagaagccctacccctgcccccagtgcggcagaagattcggccagaagagcgccgtggccaagcaccagtgggtgcacagacccggcgccggcggccacagaggcagagtggccggcagactgagcgtgaccctgacccccggccacggcgacctggacccccccgtgggcttccagctgtaccccgagatcttccaggagtgcggctag

SEQ ID NO: 11010 - DNA, 21 bp, Artificial Sequence
  Description of Artificial Sequence: Synthetic coding sequence
atgatgaaggagttcagctag

SEQ ID NO: 11011 - DNA, 1572 bp, Artificial Sequence
  Description of Artificial Sequence: Synthetic coding sequence
atggccctgccccagggcctgctgaccttcagagacgtggccatcgagttcagccaggaggagtggaagtgcctggaccccgcccagagaaccctgtacagagacgtgatgctggagaactacagaaacctggtgagcctggacatcagcagcaagtgcatgatgaaggagttcagcagcaccgcccagggcaacagagaggtgttccacgccggcaccagccagagacacgagagccaccacaacggcgacttctgcttccaggacatcgacaaggacatccacgacatcgagttccagtggcaggaggacgagagaaacggccacgaggccctgatgaccaagatcaagaagctgaccggcagcaccgagagatacgaccagaactacgccggcaacaagcccgtgaagtaccagctgggcttcagcttccacagccacctgcccgagctgcacatcttccacaccgaggagaagatcgacaaccaggtggtgaagagcatccacgacgccagcctggtgagcaccgcccagagaatcagctgcagacccgagacccacatcagcaacgactacggcaacaacttcctgaacagcagcctgttcacccagaagcaggaggtgcacatgagagagaagagcttccagtgcaacgacagcggcaaggcctacaactgcagcagcctgctgagaaagcaccagctgatccacctgggcgagaagcagtacaagtgcgacatctgcggcaaggtgttcaacagcaagagatacgtggccagacacagaagatgccacaccggcgagaagccctacaagtgcaacgagtgcggcaagaccttcagccagacctactacctgacctgccacagaagactgcacaccggcgagaagccctacaagtgcgaggagtgcgacaaggccttccacttcaagagcaagctgcagatccacagaagaatccacaccggcgagaagccctacaagtgcaacgagtgcggcaagaccttcagccagaagagctacctgacctgccacagaagactgcacaccggcgagaagccctacaagtgcaacgagtgcggcaagaccttcagcagaaagagccacttcacctgccaccacagagtgcacaccggcgagaagccctacaagtgcaacgagtgcagcaagaccttcagccacaagagcagcctgacctaccacagaagactgcacaccgaggagaagccctacaagtgcaacgagtgcggcaagaccttcaaccagcagctgaccctgaacatctgcagactgcacagcggcgagaagccctacaagtgcgaggagtgcgacaaggcctacagcttcaagagcaacctggagatccaccagaagatccacaccgaggagaacccctacaagtgcaacgagtgcggcaagaccttcagcagaaccagcagcctgacctaccaccacagactgcacaccggccagaagccctacaagtgcgaggactgcgacgaggccttcagcttcaagagcaacctggagagacacagaagaatctacaccggcgagaagctgcacgtgtag

SEQ ID NO: 11012 - DNA, 387 bp, Artificial Sequence
  Description of Artificial Sequence: Synthetic coding sequence
atgatgaaggagttcagcagcaccgcccagggcaacagagaggtgttccacgccggcaccagccagagacacgagagccaccacaacggcgacttctgcttccaggacatcgacaaggacatccacgacatcgagttccagtggcaggaggacgagagaaacggccacgaggccctgatgaccaagatcaagaagctgaccggcagcaccgagagatacgaccagaactacgccggcaacaagcccgtgaagtaccagctgggcttcagcttccacagccacctgcccgagctgcacatcttccacaccgaggagaagatcgacaaccaggtggtgaagagcatccacgacgccagcctggtgagcaccgcccagagaatcagctag

SEQ ID NO: 11013 - DNA, 1416 bp, Artificial Sequence
  Description of Artificial Sequence: Synthetic coding sequence
atgctgtgcgagggcgaggcccagaagagaaaggccgaggagagcggcatgcccctgacccagggccacctgaccttcagagacgtggccatcgagttcagccaggaggagtggaagtgcctggaccccgtgcagaaggccctgtacagagacgtgatgctggagaactacagaaacctggtgagcctgggcatctgcctgcccgacctgagcatcatcagcatgatgaagcagagaaccgagccctggaccgtggagaacgagatgaaggtggccaagaaccccgacagatgggagggcatcaaggacatcaacaccggcagaagctgcgccgtgagaagcaaggccggcaacaagcccatcaccaaccagctgggcctgaccttccagctgcccctgcccgagctggagatcttccagggcgagggcaagatctacgagtgcaaccaggtgcagaagttcatcagccacagcagcagcgtgagccccctgcagagaatctacagcggcgtgaagacccacatcttcaacaagcacagaaacgacttcgtggacttccccctgctgagccaggagcagaaggcccacatcagaagaaagccctacgagtgcaacgagcagggcaaggtgttcagagtgagcagcagcctgcccaaccaccaggtgatccacaccgccgacaagcccaacagatgccacgagtgcggcaagaccgtgagagacaagagcggcctggccgagcactggagaatcagaaccggcgagaagccctacaagtgcaaggagtgcggcaagctgttcaacagaatcgcctacctggccagacacgagaaggtgcacaccggcgagagcccctacaagtgcaacgagtgcggcaaggtgttcagcagaatcacctacctggtgagacaccagaagatccacaccagagagaagccccacaagtgcaacaagtgcggcaaggtgtacagcagcagcagctacctggcccagcactggagaatccacaccggcgagaagctgtacaagtgcaacaagtgcggcaaggagttcagcggccacagcagcctgaccacccacctgctgatccacaccggcgagaagccctacaagtgcaaggagtgcgacaaggccttcagacacaagttcagcctgaccgtgcaccagagaaaccacaacggcgagaagccctacaagtgccacgagtgcggcaaggtgttcacccaggtgagccacctggccagacaccagaagatccacaccggcgagaagccctacaagtgcaacgagtgcggcaaggtgttcacccagaacagccacctggccaaccaccagagaatccacaccggcgagaagccctacaagtgccacgtgtgcggcctgagcctgtggagcggcaaggagagcgtgagatag

SEQ ID NO: 11014 - DNA, 1407 bp, Artificial Sequence
  Description of Artificial Sequence: Synthetic coding sequence
atggcccagctgagaagaggccacctgaccttcagagacgtggccatcgagttcagccaggaggagtggaagtgcctggaccccgtgcagaaggccctgtacagagacgtgatgctggagaactacagaaacctggtgagcctgggcatctgcctgcccgacctgagcatcatcagcatgatgaagcagagaaccgagccctggaccgtggagaacgagatgaaggtggccaagaaccccgacagatgggagggcatcaaggacatcaacaccggcagaagctgcgccgtgagaagcaaggccggcaacaagcccatcaccaaccagctgggcctgaccttccagctgcccctgcccgagctggagatcttccagggcgagggcaagatctacgagtgcaaccaggtgcagaagttcatcagccacagcagcagcgtgagccccctgcagagaatctacagcggcgtgaagacccacatcttcaacaagcacagaaacgacttcgtggacttccccctgctgagccaggagcagaaggcccacatcagaagaaagccctacgagtgcaacgagcagggcaaggtgttcagagtgagcagcagcctgcccaaccaccaggtgatccacaccgccgacaagcccaacagatgccacgagtgcggcaagaccgtgagagacaagagcggcctggccgagcactggagaatcagaaccggcgagaagccctacaagtgcaaggagtgcggcaagctgttcaacagaatcgcctacctggccagacacgagaaggtgcacaccggcgagagcccctacaagtgcaacgagtgcggcaaggtgttcagcagaatcacctacctggtgagacaccagaagatccacaccagagagaagccccacaagtgcaacaagtgcggcaaggtgtacagcagcagcagctacctggcccagcactggagaatccacaccggcgagaagctgtacaagtgcaacaagtgcggcaaggagttcagcggccacagcagcctgaccacccacctgctgatccacaccggcgagaagccctacaagtgcaaggagtgcgacaaggccttcagacacaagttcagcctgaccgtgcaccagagaaaccacaacggcgagaagccctacaagtgccacgagtgcggcaaggtgttcacccaggtgagccacctggccagacaccagaagatccacaccggcgagaagccctacaagtgcaacgagtgcggcaaggtgttcacccagaacagccacctggccaaccaccagagaatccacaccggcgagaagccctacaagtgccacgtgtgcggcaaggtgttcagacacagcagctggttcgtgcagcaccagagaagcgtgcacgagagagtgctgaccaactag

SEQ ID NO: 11015 - DNA, 1623 bp, Artificial Sequence
  Description of Artificial Sequence: Synthetic coding sequence
atggagagagaggccctgccctggggcctggagccccaggacgtgcagagcagcgacgagatgagaagccccgagggctacctgagaggcaacatgagcgagaacgaggaggaggagatcagccagcaggagggcagcggcgactacgaggtggaggagatccccttcggcctggagccccagagccccggcttcgagccccagagccccgagttcgagccccagagccccagattcgagcccgagagccccggcttcgagagcagaagccccggcctggtgccccccagccccgagttcgcccccagaagccccgagagcgacagccagagccccgagttcgagagccagagccccagatacgagccccagagccccggctacgagcccagaagccccggctacgagcccagaagccccggctacgagagcgagagcagcagatacgagagccagaacaccgagctgaagacccagagccccgagttcgaggcccagagcagcaagttccaggagggcgccgagatgctgctgaaccccgaggagaagagccccctgaacatcagcgtgggcgtgcaccccctggacagcttcacccagggcttcggcgagcagcccaccggcgacctgcccatcggcccccccttcgagatgcccaccggcgccctgctgagcaccccccagttcgagatgctgcagaaccccctgggcctgaccggcgccctgagaggccccggcagaagaggcggcagagccagaggcggccagggccccagacccaacatctgcggcatctgcggcaagagcttcggcagaggcagcaccctgatccagcaccagagaatccacaccggcgagaagccctacaagtgcgaggtgtgcagcaaggccttcagccagagcagcgacctgatcaagcaccagagaacccacaccggcgagagaccctacaagtgccccagatgcggcaaggccttcgccgacagcagctacctgctgagacaccagagaacccacagcggccagaagccctacaagtgcccccactgcggcaaggccttcggcgacagcagctacctgctgagacaccagagaacccacagccacgagagaccctacagctgcaccgagtgcggcaagtgctacagccagaacagcagcctgagaagccaccagagagtgcacaccggccagagacccttcagctgcggcatctgcggcaagagcttcagccagagaagcgccctgatcccccacgccagaagccacgccagagagaagcccttcaagtgccccgagtgcggcaagagattcggccagagcagcgtgctggccatccacgccagaacccacctgcccggcagaacctacagctgccccgactgcggcaagaccttcaacagaagcagcaccctgatccagcaccagagaagccacaccggcgagagaccctacagatgcgccgtgtgcggcaagggcttctgcagaagcagcaccctgctgcagcaccacagagtgcacagcggcgagagaccctacaagtgcgacgactgcggcaaggccttcagccagagcagcgacctgatcagacaccagagaacccacgccgccggcagaagatag

SEQ ID NO: 11016 - DNA, 1362 bp, Artificial Sequence
  Description of Artificial Sequence: Synthetic coding sequence
atgagcgagaacgaggaggaggagatcagccagcaggagggcagcggcgactacgaggtggaggagatccccttcggcctggagccccagagccccggcttcgagccccagagccccgagttcgagccccagagccccagattcgagcccgagagccccggcttcgagagcagaagccccggcctggtgccccccagccccgagttcgcccccagaagccccgagagcgacagccagagccccgagttcgagagccagagccccagatacgagccccagagccccggctacgagcccagaagccccggctacgagcccagaagccccggctacgagagcgagagcagcagatacgagagccagaacaccgagctgaagacccagagccccgagttcgaggcccagagcagcaagttccaggagggcgccgagatgctgctgaaccccgaggagaagagccccctgaacatcagcgtgggcgtgcaccccctggacagcttcacccagggcttcggcgagcagcccaccggcgacctgcccatcggcccccccttcgagatgcccaccggcgccctgctgagcaccccccagttcgagatgctgcagaaccccctgggcctgaccggcgccctgagaggccccggcagaagaggcggcagagccagaggcggccagggccccagacccaacatctgcggcatctgcggcaagagcttcggcagaggcagcaccctgatccagcaccagagaacccacagcggccagaagccctacaagtgcccccactgcggcaaggccttcggcgacagcagctacctgctgagacaccagagaacccacagccacgagagaccctacagctgcaccgagtgcggcaagtgctacagccagaacagcagcctgagaagccaccagagagtgcacaccggccagagacccttcagctgcggcatctgcggcaagagcttcagccagagaagcgccctgatcccccacgccagaagccacgccagagagaagcccttcaagtgccccgagtgcggcaagagattcggccagagcagcgtgctggccatccacgccagaacccacctgcccggcagaacctacagctgccccgactgcggcaagaccttcaacagaagcagcaccctgatccagcaccagagaagccacaccggcgagagaccctacagatgcgccgtgtgcggcaagggcttctgcagaagcagcaccctgctgcagcaccacagagtgcacagcggcgagagaccctacaagtgcgacgactgcggcaaggccttcagccagagcagcgacctgatcagacaccagagaacccacgccgccggcagaagatag

SEQ ID NO: 11017 - DNA, 2076 bp, Artificial Sequence
  Description of Artificial Sequence: Synthetic coding sequence
atgatggccgagaacaacctgaagatgctgaagatccagcagtgcgtggtggccaacaagctgcccagaaacagaccctacgtgtgcaacatctgcttcaagcacttcgagacccccagcaagctggccagacactacctgatccacaccggccagaagcccttcgagtgcgacgtgtgccacaagaccttcagacagctggtgcacctggagagacaccagctgacccacagcctgcccttcaagtgcagcatctgccagagacacttcaagaacctgaagaccttcgtgaagcaccagcagctgcacaacgagacctaccagaacaacgtgaagcaggtgagaagactgctggaggccaagcaggagaagagcatgtacggcgtgtacaacaccttcaccaccgaggagagatgggccctgcacccctgcagcaagagcgaccccatgtacagcatgaagagaagaaagaacatccacgcctgcaccatctgcggcaagatgttccccagccagagcaagctggacagacacgtgctgatccacaccggccagagacccttcaagtgcgtgctgtgcaccaagagcttcagacagagcacccacctgaagatccaccagctgacccacagcgaggagagacccttccagtgctgcttctgccagaagggcttcaagatccagagcaagctgctgaagcacaagcagatccacaccagaaacaaggccttcagagccctgctgctgaagaagagaagaaccgagagcagacccctgcccaacaagctgaacgccaaccagggcggcttcgagaacggcgagatcggcgagagcgaggagaacaaccccctggacgtgcacagcatctacatcgtgcccttccagtgccccaagtgcgagaagtgcttcgagagcgagcagatcctgaacgagcacagctgcttcgccgccagaagcggcaagatccccagcagattcaagagaagctacaactacaagaccatcgtgaagaagatcctggccaagctgaagagagccagaagcaagaagctggacaacttccagagcgagaagaaggtgttcaagaagagcttcctgagaaactgcgacctgatcagcggcgagcagagcagcgagcagacccagagaaccttcgtgggcagcctgggcaagcacggcacctacaagaccatcggcaacagaaagaagaagaccctgaccctgcccttcagctggcagaacatgggcaagaacctgaagggcatcctgaccaccgagaacatcctgagcatcgacaacagcgtgaacaagaaggacctgagcatctgcggcagcagcggcgaggagttcttcaacaactgcgaggtgctgcagtgcggcttcagcgtgcccagagagaacatcagaaccagacacaagatctgcccctgcgacaagtgcgagaaggtgttccccagcatcagcaagctgaagagacactacctgatccacaccggccagagacccttcggctgcaacatctgcggcaagagcttcagacagagcgcccacctgaagagacacgagcagacccacaacgagaagagcccctacgccagcctgtgccaggtggagttcggcaacttcaacaacctgagcaaccacagcggcaacaacgtgaactacaacgccagccagcagtgccaggcccccggcgtgcagaagtacgaggtgagcgagagcgaccagatgagcggcgtgaaggccgagagccaggacttcatccccggcagcaccggccagccctgcctgcccaacgtgctgctggagagcgagcagagcaaccccttctgcagctacagcgagcaccaggagaagaacgacgtgttcctgtacagatgcagcgtgtgcgccaagagcttcagaagccccagcaagctggagagacactacctgatccacgccggccagaagcccttcgagtgcagcgtgtgcggcaagaccttcagacaggccccccactggaagagacaccagctgacccacttcaaggagagaccccagggcaaggtggtggccctggacagcgtgatgtag

SEQ ID NO: 11018 - DNA, 399 bp, Artificial Sequence
  Description of Artificial Sequence: Synthetic coding sequence
atgatggccgagaacaacctgaagatgctgaagatccagcagtgcgtggtggccaacaagctgcccagaaacagaccctacgtgtgcaacatctgcttcaagcacttcgagacccccagcaagctggccagacactacctgatccacaccggccagaagcccttcgagtgcgacgtgtgccacaagaccttcagacagctggtgcacctggagagacaccagctgacccacagcctgcccttcaagtgcagcatctgccagagacacttcaagaacctgaagaccttcgtgaagcaccagcagctgcacaacgagacctaccagaacaacgtgaagcaggtgagaagactgctggaggccaagcaggagaagagcatgtacggcgtgtacaacacctag

SEQ ID NO: 11019 - DNA, 954 bp, Artificial Sequence
  Description of Artificial Sequence: Synthetic coding sequence
atgcccggcgagcagcaggccgaggaggaggaggaggaggagatgcaggaggagatggtgctgctggtgaagggcgaggaggacgagggcgaggagaagtacgaggtggtgaagctgaagatccccatggacaacaaggaggtgcccggcgaggcccccgcccccagcgccgaccccgccagaccccacgcctgccccgactgcggcagagccttcgccagaagaagcaccctggccaagcacgccagaacccacaccggcgagagacccttcggctgcaccgagtgcggcagaagattcagccagaagagcgccctgaccaagcacggcagaacccacaccggcgagagaccctacgagtgccccgagtgcgacaagagattcagcgccgccagcaacctgagacagcacagaagaagacacaccggcgagaagccctacgcctgcgcccactgcggcagaagattcgcccagagcagcaactacgcccagcacctgagagtgcacaccggcgagaagccctacgcctgccccgactgcggcagagccttcggcggcagcagctgcctggccagacacagaagaacccacaccggcgagagaccctacgcctgcgccgactgcggcaccagattcgcccagagcagcgccctggccaagcacagaagagtgcacaccggcgagaagccccacagatgcgccgtgtgcggcagaagattcggccacagaagcaacctggccgagcacgccagaacccacaccggcgagagaccctacccctgcgccgagtgcggcagaagattcagactgagcagccacttcatcagacacagaagagcccacatgagaagaagactgtacatctgcgccggctgcggcagagacttcaagctgccccccggcgccaccgccgccaccgccaccgagagatgccccgagtgcgagggcagctag

SEQ ID NO: 11020 - DNA, 954 bp, Artificial Sequence; identical to SEQ ID NO: 11019
  Description of Artificial Sequence: Synthetic coding sequence

SEQ ID NO: 11021 - DNA, 1245 bp, Artificial Sequence
  Description of Artificial Sequence: Synthetic coding sequence
atgaacagcgaggtgatcgtggaccccatccagggccaggtgaacttcgaggacgtgttcgtgtacttcagccaggaggagtgggtgctgctggacgaggcccagagactgctgtacagagacgtgatgctggagaacttcgccctgatggccagcctgggccacaccagcttcatgagccacatcgtggccagcctggtgatgggcagcgagccctgggtgcccgactgggtggacatgaccctggccgtggccaccggctgctggcacggcatggaggacgaggagatccccttcgagcagagcttcagcatcggcatcttcagcgccaacctgcaccagcaccagaagcagcacagcggcgagaagcccttcagaagcgacaagagcagacccttcctgctgaacaactgcgccgtgcagagcatggagatgagcttcgtgaccggcgaggcctgcaaggacttcctggccagcagcagcatcttcgagcaccacgccccccacaacgagtggaagccccacagcaacaccaagtgcgaggaggccagccactgcggcaagagacactacaagtgcagcgagtgcggcaagaccttcagcagaaaggacagcctggtgcagcaccagagagtgcacaccggcgagagaccctacgagtgcggcgagtgcggcaagaccttcagcagaaagcccatcctggcccagcaccagagaatccacaccggcgagatgccctacgagtgcggcatctgcggcaaggtgttcaaccacagcagcaacctgatcgtgcaccagagagtgcacaccggcgccagaccctacaagtgcagcgagtgcggcaaggcctacagccacaagagcaccctggtgcagcacgagagcatccacaccggcgagagaccctacgagtgcagcgagtgcggcaagtacttcggccacaagtacagactgatcaagcactggagcgtgcacaccggcgccagaccctacgagtgcatcgcctgcggcaagttcttcagccagagcagcgacctgatcgcccaccagagagtgcacaacggcgagaagccctacgtgtgcagcgagtgcggcaaggccttcagccacaagcacgtgctggtgcagcaccacagaatccacaccggcgagagaccctacaagtgcagcgagtgcggcaaggccttcagacagagagccagcctgatcagacactggaagatccacaccggcgagagaccctag

SEQ ID NO: 11022 - DNA, 735 bp, Artificial Sequence
  Description of Artificial Sequence: Synthetic coding sequence
atggccgccgccgagcccatgggccccgcccagggccaggtgaacttcgaggacgtgttcgtgtacttcagccaggaggagtgggtgctgctggacgaggcccagagactgctgtacagagacgtgatgctggagaacttcgccctgatggccagcctgggctgctggcacggcatggaggacgaggagatccccttcgagcagagcttcagcatcggcatgagccagatcagaatccccaagggcggccccagcacccagaaggcctacccctgcggcacctgcggcctggtgctgaaggacatcctgcacctggccgagcaccaggagacccaccccggccagaagccctacatgtgcgtgctgtgcggcaagcagttctgcttcagcgccaacctgcaccagcaccagaagcagcacagcggcgagaagcccttcagaagcgacaagagcagacccttcctgctgaacaactgcgccgtgcagagcatggagatgagcttcgtgaccggcgaggcctgcaaggacttcctggccagcagcagcatcttcgagcaccacgccccccacaacgagtggaagccccacagcaacaccaagtgcgaggaggccagccactgcggcaagagacactacaagtgcagcgagtgcgagaagaccgccgccaactacagagagtacgaccccagcaagggcaccagcacctgcgtgagcatcaccctggcccccctgtag

SEQ ID NO: 11023 - DNA, 1470 bp, Artificial Sequence
  Description of Artificial Sequence: Synthetic coding sequence
atggccgccgccgagcccatgggccccgcccaggtgcccatgaacagcgaggtgatcgtggaccccatccagggccaggtgaacttcgaggacgtgttcgtgtacttcagccaggaggagtgggtgctgctggacgaggcccagagactgctgtacagagacgtgatgctggagaacttcgccctgatggccagcctgggccacaccagcttcatgagccacatcgtggccagcctggtgatgggcagcgagccctgggtgcccgactgggtggacatgaccctggccgtggccaccgagacccccggcggcagcgaccccggctgctggcacggcatggaggacgaggagatccccttcgagcagagcttcagcatcggcatgagccagatcagaatccccaagggcggccccagcacccagaaggcctacccctgcggcacctgcggcctggtgctgaaggacatcctgcacctggccgagcaccaggagacccaccccggccagaagccctacatgtgcgtgctgtgcggcaagcagttctgcttcagcgccaacctgcaccagcaccagaagcagcacagcggcgagaagcccttcagaagcgacaagagcagacccttcctgctgaacaactgcgccgtgcagagcatggagatgagcttcgtgaccggcgaggcctgcaaggacttcctggccagcagcagcatcttcgagcaccacgccccccacaacgagtggaagccccacagcaacaccaagtgcgaggaggccagccactgcggcaagagacactacaagtgcagcgagtgcggcaagaccttcagcagaaaggacagcctggtgcagcaccagagagtgcacaccggcgagagaccctacgagtgcggcgagtgcggcaagaccttcagcagaaagcccatcctggcccagcaccagagaatccacaccggcgagatgccctacgagtgcggcatctgcggcaaggtgttcaaccacagcagcaacctgatcgtgcaccagagagtgcacaccggcgccagaccctacaagtgcagcgagtgcggcaaggcctacagccacaagagcaccctggtgcagcacgagagcatccacaccggcgagagaccctacgagtgcagcgagtgcggcaagtacttcggccacaagtacagactgatcaagcactggagcgtgcacaccggcgccagaccctacgagtgcatcgcctgcggcaagttcttcagccagagcagcgacctgatcgcccaccagagagtgcacaacggcgagaagccctacgtgtgcagcgagtgcggcaaggccttcagccacaagcacgtgctggtgcagcaccacagaatccacaccggcgagagaccctacaagtgcagcgagtgcggcaaggccttcagacagagagccagcctgatcagacactggaagatccacaccggcgagagaccctag

SEQ ID NO: 11024 - DNA, 1347 bp, Artificial Sequence
  Description of Artificial Sequence: Synthetic coding sequence
atggccgccgccgagcccatgggccccgcccaggtgcccatgaacagcgaggtgatcgtggaccccatccagggccaggtgaacttcgaggacgtgttcgtgtacttcagccaggaggagtgggtgctgctggacgaggcccagagactgctgtacagagacgtgatgctggagaacttcgccctgatggccagcctgggctgctggcacggcatggaggacgaggagatccccttcgagcagagcttcagcatcggcatgagccagatcagaatccccaagggcggccccagcacccagaaggcctacccctgcggcacctgcggcctggtgctgaaggacatcctgcacctggccgagcaccaggagacccaccccggccagaagccctacatgtgcgtgctgtgcggcaagcagttctgcttcagcgccaacctgcaccagcaccagaagcagcacagcggcgagaagcccttcagaagcgacaagagcagacccttcctgctgaacaactgcgccgtgcagagcatggagatgagcttcgtgaccggcgaggcctgcaaggacttcctggccagcagcagcatcttcgagcaccacgccccccacaacgagtggaagccccacagcaacaccaagtgcgaggaggccagccactgcggcaagagacactacaagtgcagcgagtgcggcaagaccttcagcagaaaggacagcctggtgcagcaccagagagtgcacaccggcgagagaccctacgagtgcggcgagtgcggcaagaccttcagcagaaagcccatcctggcccagcaccagagaatccacaccggcgagatgccctacgagtgcggcatctgcggcaaggtgttcaaccacagcagcaacctgatcgtgcaccagagagtgcacaccggcgccagaccctacaagtgcagcgagtgcggcaaggcctacagccacaagagcaccctggtgcagcacgagagcatccacaccggcgagagaccctacgagtgcagcgagtgcggcaagtacttcggccacaagtacagactgatcaagcactggagcgtgcacaccggcgccagaccctacgagtgcatcgcctgcggcaagttcttcagccagagcagcgacctgatcgcccaccagagagtgcacaacggcgagaagccctacgtgtgcagcgagtgcggcaaggccttcagccacaagcacgtgctggtgcagcaccacagaatccacaccggcgagagaccctacaagtgcagcgagtgcggcaaggccttcagacagagagccagcctgatcagacactggaagatccacaccggcgagagaccctag

SEQ ID NO: 11025 - DNA, 1134 bp, Artificial Sequence
  Description of Artificial Sequence: Synthetic coding sequence
atggaggacgaggagatccccttcgagcagagcttcagcatcggcatgagccagatcagaatccccaagggcggccccagcacccagaaggcctacccctgcggcacctgcggcctggtgctgaaggacatcctgcacctggccgagcaccaggagacccaccccggccagaagccctacatgtgcgtgctgtgcggcaagcagttctgcttcagcgccaacctgcaccagcaccagaagcagcacagcggcgagaagcccttcagaagcgacaagagcagacccttcctgctgaacaactgcgccgtgcagagcatggagatgagcttcgtgaccggcgaggcctgcaaggacttcctggccagcagcagcatcttcgagcaccacgccccccacaacgagtggaagccccacagcaacaccaagtgcgaggaggccagccactgcggcaagagacactacaagtgcagcgagtgcggcaagaccttcagcagaaaggacagcctggtgcagcaccagagagtgcacaccggcgagagaccctacgagtgcggcgagtgcggcaagaccttcagcagaaagcccatcctggcccagcaccagagaatccacaccggcgagatgccctacgagtgcggcatctgcggcaaggtgttcaaccacagcagcaacctgatcgtgcaccagagagtgcacaccggcgccagaccctacaagtgcagcgagtgcggcaaggcctacagccacaagagcaccctggtgcagcacgagagcatccacaccggcgagagaccctacgagtgcagcgagtgcggcaagtacttcggccacaagtacagactgatcaagcactggagcgtgcacaccggcgccagaccctacgagtgcatcgcctgcggcaagttcttcagccagagcagcgacctgatcgcccaccagagagtgcacaacggcgagaagccctacgtgtgcagcgagtgcggcaaggccttcagccacaagcacgtgctggtgcagcaccacagaatccacaccggcgagagaccctacaagtgcagcgagtgcggcaaggccttcagacagagagccagcctgatcagacactggaagatccacaccggcgagagaccctag

SEQ ID NO: 11026 - DNA, 1329 bp, Artificial Sequence
  Description of Artificial Sequence: Synthetic coding sequence
atggccgccgccaccctgagagaccccgcccagcagggctacgtgaccttcgaggacgtggccgtgtacttcagccaggaggagtggagactgctggacgacgcccagagactgctgtacagaaacgtgatgctggagaacttcaccctgctggccagcctgggcctggccagcagcaagacccacgagatcacccagctggagagctgggaggagcccttcatgcccgcctgggaggtggtgaccagcgccatcctgagaggcagctggcagggcgccaaggccgaggccgccgccgagcagagcgccagcgtggaggtgcccagcagcaacgtgcagcagcaccagaagcagcactgcggcgagaagcccctgaagagacaggagggcagagtgcccgtgctgagaagctgcagagtgcacctgagcgagaagagcctgcagagcagagaggtgggcaaggacctgctgaccagcagcggcgtgctgaagcaccaggtgacccacaccggcgagaagagccacagaagcagcaagagcagagaggccttccacgccggcaagagacactacaagtgcagcgagtgcggcaaggccttcggccagaagtacctgctggtgcagcaccagagactgcacaccggcgagaagccctacgagtgcagcgagtgcggcaagctgttcagccacaagagcaacctgttcatccaccagatcgtgcacaccggcgagagaccctacggctgcagcgactgcggcaagagcttcagcagaaacgccgacctgatccagcaccagagagtgcacaccggcgagaagcccttcacctgcagcgagtgcggcaaggccttcagacacaacagcaccctggtgcagcaccacagaatccacaccggcgtgagaccctacgagtgcagcgagtgcggcaagctgttcagcttcaacagcagcctgatgaagcaccagagagtgcacaccggcgagagaccctacaagtgcagcgagtgcggcaagttctacagccacaagagcagcctgatcaaccactggagagtgcacaccggcgagagaccctacgagtgcagcgagtgcggcaagttcttcagccagagcagcagcctgatgcagcacagaaaggtgcacaccggcgagaagcccttcaagtgcaacgagtgcggcagattcttcagcgagaacagcagcctggtgaagcaccagagagtgcacaccggcgccaagccctacgagtgcagagagtgcggcaagttcttcagacacagcagcagcctggtgaagcacagaagaatccacaccggcgagatccagtag

SEQ ID NO: 11027 - DNA, 423 bp, Artificial Sequence
  Description of Artificial Sequence: Synthetic coding sequence
ggcagcgtggccgcccccagagtggccagagccctgagcagcgtggtggtgagccccccccaggcccccatggccgccgccaccctgagagaccccgcccagcagggctacgtgaccttcgaggacgtggccgtgtacttcagccaggaggagtggagactgctggacgacgcccagagactgctgtacagaaacgtgatgctggagaacttcaccctgctggccagcctgggcctggccagcagcaagacccacgagatcacccagctggagagctgggaggagcccttcatgcccgcctgggaggtggtgaccagcgccatcctgagagtgtggctgagaaacagaagcgccaacctgctgacccagatcttcttccccaacagacagccccaggtggcccccgagcagggcagagagtag

SEQ ID NO: 11028 - DNA, 1452 bp, Artificial Sequence
  Description of Artificial Sequence: Synthetic coding sequence
atgtggctgggcaccagcggcaagagcggcctgcccggccactgcctggagaaccccctgcaggagtgccaccccgcccagctggaggagtgggccctgaagggcatcagcagacccagcgtgatcagccagcccgagcagaaggaggagccctgggtgctgcccctgcagaacttcgaggccagaaagatccccagagagagccacaccgactgcgagcaccaggtggccaagctgaaccaggacaacagcgagaccgccgagcagtgcggcaccagcagcgagagaaccaacaaggacctgagccacaccctgagctggggcggcaactgggagcagggcctggagctggagggccagcacggcaccctgcccggcgagggccagctggagagcttcagccaggagagagacctgaacaagctgctggacggctacgtgggcgagaagcccatgtgcgccgagtgcggcaagagcttcaaccagagcagctacctgatcagacacctgagaacccacaccggcgagagaccctacacctgcatcgagtgcggcaagggcttcaagcagagcagcgacctggtgacccacagaagaacccacaccggcgagaagccctaccagtgcaagggctgcgagaagaagttcagcgacagcagcaccctgatcaagcaccagagaacccacaccggcgagagaccctacgagtgccccgagtgcggcaagaccttcggcagaaagccccacctgatcatgcaccagagaacccacaccggcgagaagccctacgcctgcctggagtgccacaagagcttcagcagaagcagcaacttcatcacccaccagagaacccacaccggcgtgaagccctacagatgcaacgactgcggcgagagcttcagccagagcagcgacctgatcaagcaccagagaacccacaccggcgagagacccttcaagtgccccgagtgcggcaagggcttcagagacagcagccacttcgtggcccacatgagcacccacagcggcgagagacccttcagctgccccgactgccacaagagcttcagccagagcagccacctggtgacccaccagagaacccacaccggcgagagacccttcaagtgcgagaactgcggcaagggcttcgccgacagcagcgccctgatcaagcaccagagaatccacaccggcgagagaccctacaagtgcggcgagtgcggcaagagcttcaaccagagcagccacttcatcacccaccagagaatccacctgggcgacagaccctacagatgccccgagtgcggcaagaccttcaaccagagaagccacttcctgacccaccagagaacccacaccggcgagaagcccttccactgcagcaagtgcaacaagagcttcagacagaaggcccacctgctgtgccaccagaacacccacctgatctag

SEQ ID NO: 11029 - DNA, 240 bp, Artificial Sequence
  Description of Artificial Sequence: Synthetic coding sequence
atgtggctgggcaccagcggcaagagcggcctgcccggccactgcctggagaaccccctgcaggagtgccaccccgcccagctggaggagtgggccctgaagggcatcagcagacccagcgtgatcagccagcccgagcagaaggaggagccctgggtgctgcccctgcagaacttcgaggccagaaagatccccagagagagccacaccgactgcgagcaccaggtggccaagctgtag

SEQ ID NO: 11030 - DNA, 1614 bp, Artificial Sequence
  Description of Artificial Sequence: Synthetic coding sequence
atggagagcggcctggccggcaacggcaccggcgccggcctggtgatgaaggtgaagcaggagaagcccgagagactgctgcagaccctggccccccaggccatgctggtggagaaggacaaggagaacatcttccagcagcacagaggcctgccccccagacagaccatgggcagacccagagccctgggcggccaggaggagagcggcagccccagatgggccccccccaccgagcaggacgccggcctggccggcagagcccccggcagcgccagcggccccctgagccccagcctgagcagcggcgagggccacttcgtgtgcctggactgcggcaagagattcagctggtggagcagcctgaagatccaccagagaacccacaccggcgagaagccctacctgtgcggcaagtgcggcaagagcttcagccagaagcccaacctggccagacaccagagacaccacaccggcgagagacccttctgctgccccgagtgcgccagaagattcagccagaagcagcacctgctgaagcaccagaagacccacagcagacccgccacccacagctgccccgagtgcgagagatgcttcagacaccaggtgggcctgagaatccaccagagagcccacgccagagacagacagggcagcagagccggcctgcacgagctgatccaggacgccgccgccagaagagcctgcagactgcagcccggcccccccagaggcagacccgagtgggcctggctgggcctgtgccagggctggtggggccagcccggcgccagagccgccgtgagcggccccgagggccccggcgagcccagacagttcatctgcaacgagtgcggcaagagcttcacctggtggagcagcctgaacatccaccagagaatccacaccggcgagagaccctacgcctgccccgagtgcggcagaagattcagccagaagcccaacctgaccagacacctgagaaaccacaccggcgagagaccccacccctgcccccactgcggcagaggcttcagacagaagcagcacctgctgaagcacctgagaacccacctgcccggcgcccaggccgccccctgccccagctgcggcaagagctgcagaagcagagccgccctgagagcccaccagagagcccacgccgtggccgagcccgccgtgcccgccggcgagcccggcgaccagccccaggccgaggccatccccggcctggccgccagacccagaagcagccagagaagccccggcgccagagacaccctgtggggcagaggccaggccggcctggccggccccggcgagcccagacagttcatctgcaacgagtgcggcaagagcttcagctggtggagcgccctgaccatccaccagagaatccacaccggcgagagaccctacccctgccccgagtgcggcagaagattcagccagaagcccaacctgaccagacacagaagaaaccacaccggcgagagaccctacctgtgccccgcctgcggcagaggcttcagccagaagcagcacctgctgaagcaccagagagtgcacagagccgcccccgcctgcagccccaaggaggaggccagatag

SEQ ID NO: 11031 - DNA, 435 bp, Artificial Sequence
  Description of Artificial Sequence: Synthetic coding sequence
atggagagcggcctggccggcaacggcaccggcgccggcctggtgatgaaggtgaagcaggagaagcccgagagactgctgcagaccctggccccccaggccatgctggtggagaaggacaaggagaacatcttccagcagcacagaggcctgccccccagacagaccatgggcagacccagagccctgggcggccaggaggagagcggcagccccagatgggccccccccaccgagcaggacgccggcctggccggcagagcccccggcagcgccagcggccccctgagccccagcctgagcagcggcgagggccacttcgtgtgcctggactgcggcaagagattcagctggtggagcagcctgaagatccaccagagaacccacaccggcgagaagccctacctgtgcggcaagtgcggcaagagcttctag

SEQ ID NO: 11032 - DNA, 501 bp, Artificial Sequence
  Description of Artificial Sequence: Synthetic coding sequence
atggagagcggcctggccggcaacggcaccggcgccggcctggtgatgaaggtgaagcaggagaagcccgagagactgctgcagaccctggccccccaggccatgctggtggagaaggacaaggagaacatcttccagcagcacagaggcctgccccccagacagaccatgggcagacccagagccctgggcggccaggaggagagcggcagccccagatgggccccccccaccgagcaggacgccggcctggccggcagagcccccggcagcgccagcggccccctgagccccagcctgagcagcggcgagggccacttcgtgtgcctggactgcggcaagagattcagctggtggagcagcctgaagatccaccagagaacccacaccggcgagaagccctacctgtgcggcaagtgcggcaagagcttcagccagaagcccaacctggccagacaccagagacaccacaccggcgagagacccttctgctgcccctag

SEQ ID NO: 11033 - DNA, 1557 bp, Artificial Sequence
  Description of Artificial Sequence: Synthetic coding sequence
atggccgccgccgccctgagaccccccgcccagggcaccgtgaccttcgaggacgtggccgtgaacttcagccaggaggagtggagcctgctgagcgaggcccagagatgcctgtaccacgacgtgatgctggagaacctgaccctgatcagcagcctgggctgctggtacggcgccaaggacgagacccccagcaagcagaccctgagcatccagcaggagagccccctgagaacccactggaccggcgtgtgcaccaagaaggtgcacctgtggggcatgtgcggccccctgctgggcgacatcctgcaccagggcacccagcacaaccagaagctgaacggcttcggcgcctacgagaagaagctggacgacgacgccaaccaccaccaggaccagaagcagcacatcggcgagaagagctacagaagcaacgccaagggcaccagcttcgtgaagaactgcaagttccacatgagccacgagcccttcatcttccacgaggtgggcaaggacttcctgagcagcctgagactgctgcagcaggaggacatccacaccagcggcaagagcaacttcgagaccaagcacggcatccccctgcagggcggcaagacccactacatctgcggcgagagcaccatccccttcagcaacaagcacagcctggtgctgcaccagagactgctgcccagagagggcccctacgtgtgcagcgacagcggcaagttcaccagcaagagcaacagcttcaacaaccaccagggcgtgagaaccggcaagagaccctaccagtgcggccagtgcgacgagagcttctggtacaaggcccacctgaccgagcaccagagagtgcacaccggcgagagaccctacgagtgcggcgagtgcgacaagagcttcagccacaagcacagcctggtggaccaccagagagtgcacaccggcgagagaccctacgagtgcgacgagtgcggcaagagcttcagccacaagagaagcctggtgcaccaccagagagtgcacaccggcgagagaccctaccagtgcggcgagtgcggcaagagcttcaaccacaagtgcaacctgatccagcaccagagagtgcacaccggcgagagacccttcgagtgcaccgcctgcggcaagctgttcagaagcaacagccacctgaaggagcaccagagagtgcacaccggcgagagaccctacgagtgcaaggagtgcagaaagagcttcagatacaagagccacctgaccgagcaccagagagtgcacaccggcgagagaccctacgagtgcagagagtgcggcaagtgcttccaccagaagggcagcctgatccagcaccagcagatccacagcggcgagagaccccacgagtgcggcgagtgcggcaagtgcttccaccagaagggcagcctgatcagacaccagcagatccacagcggcgagagaccccacgagtgcggcgagtgcggcaagtgcttcagacagaagggcaacctgatcaagcaccagagagtgcacaccggcgagagacaccacgagtgctag

SEQ ID NO: 11034 - DNA, 2064 bp, Artificial Sequence
  Description of Artificial Sequence: Synthetic coding sequence
atgctggagaactacgagaacctggccagcgtgggccaccacctgttccagcccagcgtgatctactggctggagcaggaggaggagctgagagccggcagaagagccgtgctgcaggagtggagactgaagaccaagggccccgccctgagacaggacagaagctggttcagagccagcaacgagacccagaccgccagaagccacaacggcggccagctgtgcgacagaacccagtgcggcgaggccttcagcgagcacagcggcctgagcacccacgtgagaacccagaacaccggcgacagctgcgtgagcaaccactacgagagagacttcttcatcccctgccagaagaccctgttcaagatcggcgagcagttcagcgtgctgggccagtgcggcaaggccttcagcagcacccccaacgtggtgagccagcaggcctgcaccagagacagaagcctggactacagcagctgcggcgaggtgttcctgaaccagagctacctgcaggccagagccggcagccacaacggcgaggagacctggaagtggaagccctgcggcaaggccctgacccacagcatgggctgcgccacccccgtggagatgcacgccgtgagaaacccccacgtgtgcagagagtgcggcaaggccttcagatacaccgcctacctgaccggcagagtgcaggtgcaccccggcgagaagccctgcgagctggaggagtgcggcaaggccagccccgtgagcagcagcctgacccagcacgtgagaatccacgccgccgagaagccctgcgagtgcaaggagtgcggcaaggccttcaccggcctgagcggcctgagcaagcacgtgcagaccgaccccggccagaagccctacgagtgcaaggactgcggcaaggcctgcggcggcttctacctgctgaacgagcacggcaagacccacaccagagagaagcccttcgcctgcgtggtgtgcggcaagtacttcagaaacagcagctgcctgaacaaccacgtgagaatccacaccggcatcaagccctacacctgcagctactgcggcaaggccttcaccgtgagatgcggcctgaccagacacgtgagaacccacaccggcgagaagccctacacctgcaaggactgcggcaaggccttctgcaccagcagcggcctgaccgagcacgtgagaacccacaccggcgagaagccctacgagtgcaaggactgcggcaagagcttcaccgtgagcagcagcctgaccgagcacgccagaatccacaccggcgagaagccctacgagtgcaagcagtgcggcaaggccttcaccggcagaagcggcctgaccaagcacatgagaacccacaccggcgagaagccctacgagtgcaaggactgcggcaaggcctacaacagagtgtacctgctgaacgagcacgtgaagacccacaccgaggagaagcccttcatctgcaccgtgtgcagaaagagcttcagaaacagcagctgcctgaacaagcacatccagatccacaccggcatcaagccctacgagtgcaaggactgcggcaagaccttcaccgtgagcagcagcctgaccgagcacatcagaacccacaccggcgagaagccctacgagtgcaaggtgtgcggcaaggccttcaccaccagcagccacctgatcgtgcacatcagaacccacaccggcgagaagccctacatctgcaaggagtgcggcaaggccttcgccagcagcagccacctgatcgagcacagaagaacccacaccggcgagaagccctacatctgcaacgagtgcggcaaggccttcagagccagcagccacctgcacaagcacggcagaatccacaccggccagaagccctacaagtgcaaggagtgcggcaaggcctacaacagattctacctgctgaaggagcacctgaagacctacaccgaggagcaggtgttcgtgtgcaaggactgcggcaagagcttcaagaacagcagctgcctgaaccaccacacccagatccacaccgacgagaagcccttctag

SEQ ID NO: 11035 - DNA, 2190 bp, Artificial Sequence
  Description of Artificial Sequence: Synthetic coding sequence
atggccgcccccgacctggcccacggcggccacgtgagcagagacagcgtgtgcctgcacgaggagcagacccaggccgccggcatggtggccggctggctgatcaactgctaccaggacgccgtgaccttcgacgacgtggccgtggacttcacccaggaggagtggaccctgctggaccccagccagagagacctgtacagagacgtgatgctggagaactacgagaacctggccagcgtggagtggagactgaagaccaagggccccgccctgagacaggacagaagctggttcagagccagcaacgagacccagaccgccagaagccacaacggcggccagctgtgcgacagaacccagtgcggcgaggccttcagcgagcacagcggcctgagcacccacgtgagaacccagaacaccggcgacagctgcgtgagcaaccactacgagagagacttcttcatcccctgccagaagaccctgttcaagatcggcgagcagttcagcgtgctgggccagtgcggcaaggccttcagcagcacccccaacgtggtgagccagcaggcctgcaccagagacagaagcctggactacagcagctgcggcgaggtgttcctgaaccagagctacctgcaggccagagccggcagccacaacggcgaggagacctggaagtggaagccctgcggcaaggccctgacccacagcatgggctgcgccacccccgtggagatgcacgccgtgagaaacccccacgtgtgcagagagtgcggcaaggccttcagatacaccgcctacctgaccggcagagtgcaggtgcaccccggcgagaagccctgcgagctggaggagtgcggcaaggccagccccgtgagcagcagcctgacccagcacgtgagaatccacgccgccgagaagccctgcgagtgcaaggagtgcggcaaggccttcaccggcctgagcggcctgagcaagcacgtgcagaccgaccccggccagaagccctacgagtgcaaggactgcggcaaggcctgcggcggcttctacctgctgaacgagcacggcaagacccacaccagagagaagcccttcgcctgcgtggtgtgcggcaagtacttcagaaacagcagctgcctgaacaaccacgtgagaatccacaccggcatcaagccctacacctgcagctactgcggcaaggccttcaccgtgagatgcggcctgaccagacacgtgagaacccacaccggcgagaagccctacacctgcaaggactgcggcaaggccttctgcaccagcagcggcctgaccgagcacgtgagaacccacaccggcgagaagccctacgagtgcaaggactgcggcaagagcttcaccgtgagcagcagcctgaccgagcacgccagaatccacaccggcgagaagccctacgagtgcaagcagtgcggcaaggccttcaccggcagaagcggcctgaccaagcacatgagaacccacaccggcgagaagccctacgagtgcaaggactgcggcaaggcctacaacagagtgtacctgctgaacgagcacgtgaagacccacaccgaggagaagcccttcatctgcaccgtgtgcagaaagagcttcagaaacagcagctgcctgaacaagcacatccagatccacaccggcatcaagccctacgagtgcaaggactgcggcaagaccttcaccgtgagcagcagcctgaccgagcacatcagaacccacaccggcgagaagccctacgagtgcaaggtgtgcggcaaggccttcaccaccagcagccacctgatcgtgcacatcagaacccacaccggcgagaagccctacatctgcaaggagtgcggcaaggccttcgccagcagcagccacctgatcgagcacagaagaacccacaccggcgagaagccctacatctgcaacgagtgcggcaaggccttcagagccagcagccacctgcacaagcacggcagaatccacaccggccagaagccctacaagtgcaaggagtgcggcaaggcctacaacagattctacctgctgaaggagcacctgaagacctacaccgaggagcaggtgttcgtgtgcaaggactgcggcaagagcttcaagaacagcagctgcctgaaccaccacacccagatccacaccgacgagaagcccttctag

SEQ ID NO: 11036 - DNA, 1926 bp, Artificial Sequence
  Description of Artificial Sequence: Synthetic coding sequence
atggtgcacggcagcgtgaccttcagagacgtggccatcgacttcagccaggaggagtgggagtgcctgcagcccgaccagagaaccctgtacagagacgtgatgctggagaactacagccacctgatcagcctgggcagcagcatcagcaagcccgacgtgatcaccctgctggagcaggagaaggagccctggatggtggtgagaaaggagaccagcagaagataccccgacctggagctgaagtacggccccgagaaggtgagccccgagaacgacaccagcgaggtgaacctgcccaagcaggtgatcaagcagatcagcaccaccctgggcatcgaggccttctacttcagaaacgacagcgagtacagacagttcgagggcctgcagggctaccaggagggcaacatcaaccagaagatgatcagctacgagaagctgcccacccacaccccccacgccagcctgatctgcaacacccacaagccctacgagtgcaaggagtgcggcaagtacttcagcagaagcgccaacctgatccagcaccagagcatccacaccggcgagaagcccttcgagtgcaaggagtgcggcaaggccttcagactgcacatccagttcaccagacaccagaagttccacaccggcgagaagcccttcgagtgcaacgagtgcggcaaggccttcagcctgctgaccctgctgaacagacacaagaacatccacaccggcgagaagctgttcgagtgcaaggagtgcggcaagagcttcaacagaagcagcaacctggtgcagcaccagagcatccacagcggcgtgaagccctacgagtgcaaggagtgcggcaagggcttcaacagaggcgcccacctgatccagcaccagaagatccacagcaacgagaagcccttcgtgtgcaaggagtgcggcatggccttcagataccactaccagctgatcgagcactgccagatccacaccggcgagaagcccttcgagtgcaaggagtgcggcaaggccttcaccctgctgaccaagctggtgagacaccagaagatccacaccggcgagaagcccttcgagtgcagagagtgcggcaaggccttcagcctgctgaaccagctgaacagacacaagaacatccacaccggcgagaagcccttcgagtgcaaggagtgcggcaagagcttcaacagaagcagcaacctggtgcagcaccagagcatccacgccggcatcaagccctacgagtgcaaggagtgcggcaagggcttcaacagaggcgcccacctgatccagcaccagaagatccacagcaacgagaagcccttcgtgtgcagagagtgcgagatggccttcagataccactgccagctgatcgagcacagcagaatccacaccggcgacaagcccttcgagtgccaggactgcggcaaggccttcaacagaggcagcagcctggtgcagcaccagagcatccacaccggcgagaagccctacgagtgcaaggagtgcggcaaggccttcagactgtacctgcagctgagccagcaccagaagacccacaccggcgagaagcccttcgagtgcaaggagtgcggcaagttcttcagaagaggcagcaacctgaaccagcacagaagcatccacaccggcaagaagcccttcgagtgcaaggagtgcggcaaggccttcagactgcacatgcacctgatcagacaccagaagctgcacaccggcgagaagcccttcgagtgcaaggagtgcggcaaggccttcagactgcacatgcagctgatcagacaccagaagctgcacaccggcgagaagcccttcgagtgcaaggagtgcggcaaggtgttcagcctgcccacccagctgaacagacacaagaacatccacaccggcgagaaggccagctag

SEQ ID NO: 11037 - DNA, 477 bp, Artificial Sequence
  Description of Artificial Sequence: Synthetic coding sequence
atgggcagaagccccagaaagatcgaccagttctgcaacagcagcaacatggtgcacggcagcgtgaccttcagagacgtggccatcgacttcagccaggaggagtgggagtgcctgcagcccgaccagagaaccctgtacagagacgtgatgctggagaactacagccacctgatcagcctgggcagcagcatcagcaagcccgacgtgatcaccctgctggagcaggagaaggagccctggatggtggtgagaaaggagaccagcagaagataccccgacctggagctgaagtacggccccgagaaggtgagccccgagaacgacaccagcgaggtgaacctgcccaagcagatcagcagcctggccagcaagcccagcttcaccgccatccacatccagagaagaatccactgcagaatctgcatcgccttcggctacctgagcctggtgtactgcagcctggagatcctgtag

SEQ ID NO: 11038 - DNA, 348 bp, Artificial Sequence
  Description of Artificial Sequence: Synthetic coding sequence
atggtgcacggcagcgtgaccttcagagacgtggccatcgacttcagccaggaggagtgggagtgcctgcagcccgaccagagaaccctgtacagagacgtgatgctggagaactacagccacctgatcagcctgggcagcagcatcagcaagcccgacgtgatcaccctgctggagcaggagaaggagccctggatggtggtgagaaaggagaccagcagaagataccccgacctggagctgaagtacggccccgagaaggtgagccccgagaacgacaccagcgaggtgaacctgcccaagcaggtgatcaagcagaagaagggcaagaagaagaagaagaagtag

SEQ ID NO: 11039 - DNA, 1926 bp, Artificial Sequence; identical to SEQ ID NO: 11036
  Description of Artificial Sequence: Synthetic coding sequence

SEQ ID NO: 11040 - DNA, 1929 bp, Artificial Sequence
  Description of Artificial Sequence: Synthetic coding sequence
atggtgcacggcagcgtgaccttcagagacgtggccatcgacttcagccaggaggagtgggagtgcctgcagcccgaccagagaaccctgtacagagacgtgatgctggagaactacagccacctgatcagcctggccggcagcagcatcagcaagcccgacgtgatcaccctgctggagcaggagaaggagccctggatggtggtgagaaaggagaccagcagaagataccccgacctggagctgaagtacggccccgagaaggtgagccccgagaacgacaccagcgaggtgaacctgcccaagcaggtgatcaagcagatcagcaccaccctgggcatcgaggccttctacttcagaaacgacagcgagtacagacagttcgagggcctgcagggctaccaggagggcaacatcaaccagaagatgatcagctacgagaagctgcccacccacaccccccacgccagcctgatctgcaacacccacaagccctacgagtgcaaggagtgcggcaagtacttcagcagaagcgccaacctgatccagcaccagagcatccacaccggcgagaagcccttcgagtgcaaggagtgcggcaaggccttcagactgcacatccagttcaccagacaccagaagttccacaccggcgagaagcccttcgagtgcaacgagtgcggcaaggccttcagcctgctgaccctgctgaacagacacaagaacatccacaccggcgagaagctgttcgagtgcaaggagtgcggcaagagcttcaacagaagcagcaacctggtgcagcaccagagcatccacagcggcgtgaagccctacgagtgcaaggagtgcggcaagggcttcaacagaggcgcccacctgatccagcaccagaagatccacagcaacgagaagcccttcgtgtgcaaggagtgcggcatggccttcagataccactaccagctgatcgagcactgccagatccacaccggcgagaagcccttcgagtgcaaggagtgcggcaaggccttcaccctgctgaccaagctggtgagacaccagaagatccacaccggcgagaagcccttcgagtgcagagagtgcggcaaggccttcagcctgctgaaccagctgaacagacacaagaacatccacaccggcgagaagcccttcgagtgcaaggagtgcggcaagagcttcaacagaagcagcaacctggtgcagcaccagagcatccacgccggcatcaagccctacgagtgcaaggagtgcggcaagggcttcaacagaggcgcccacctgatccagcaccagaagatccacagcaacgagaagcccttcgtgtgcagagagtgcgagatggccttcagataccactgccagctgatcgagcacagcagaatccacaccggcgacaagcccttcgagtgccaggactgcggcaaggccttcaacagaggcagcagcctggtgcagcaccagagcatccacaccggcgagaagccctacgagtgcaaggagtgcggcaaggccttcagactgtacctgcagctgagccagcaccagaagacccacaccggcgagaagcccttcgagtgcaaggagtgcggcaagttcttcagaagaggcagcaacctgaaccagcacagaagcatccacaccggcaagaagcccttcgagtgcaaggagtgcggcaaggccttcagactgcacatgcacctgatcagacaccagaagctgcacaccggcgagaagcccttcgagtgcaaggagtgcggcaaggccttcagactgcacatgcagctgatcagacaccagaagctgcacaccggcgagaagcccttcgagtgcaaggagtgcggcaaggtgttcagcctgcccacccagctgaacagacacaagaacatccacaccggcgagaaggccagctag

SEQ ID NO: 11041 - DNA, 1926 bp, Artificial Sequence; identical to SEQ ID NO: 11036
  Description of Artificial Sequence: Synthetic coding sequence

SEQ ID NO: 11042 - DNA, 16218 bp, Artificial Sequence
  Description of Artificial Sequence: Synthetic coding sequence
atgggcgccctgtggagctggtggatcctgtgggccggcgccaccctgctgtggggcctgacccaggaggccagcgtggacctgaagaacaccggcagagaggagttcctgaccgccttcctgcagaactaccagctggcctacagcaaggcctaccccagactgctgatcagcagcctgagcgagagccccgccagcgtgagcatcctgagccaggccgacaacaccagcaagaaggtgaccgtgagacccggcgagagcgtgatggtgaacatcagcgccaaggccgagatgatcggcagcaagatcttccagcacgccgtggtgatccacagcgactacgccatcagcgtgcaggccctgaacgccaagcccgacaccgccgagctgaccctgctgagacccatccaggccctgggcaccgagtacttcgtgctgaccccccccggcaccagcgccagaaacgtgaaggagttcgccgtggtggccggcgccgccggcgccagcgtgagcgtgaccctgaagggcagcgtgaccttcaacggcaagttctaccccgccggcgacgtgctgagagtgaccctgcagccctacaacgtggcccagctgcagagcagcgtggacctgagcggcagcaaggtgaccgccagcagccccgtggccgtgctgagcggccacagctgcgcccagaagcacaccacctgcaaccacgtggtggagcagctgctgcccaccagcgcctggggcacccactacgtggtgcccaccctggccagccagagcagatacgacctggccttcgtggtggccagccaggccaccaagctgacctacaaccacggcggcatcaccggcagcagaggcctgcaggccggcgacgtggtggagttcgaggtgagacccagctggcccctgtacctgagcgccaacgtgggcatccaggtgctgctgttcggcaccggcgccatcagaaacgaggtgacctacgacccctacctggtgctgatccccgacgtggccgcctactgccccgcctacgtggtgaagagcgtgcccggctgcgagggcgtggccctggtggtggcccagaccaaggccatcagcggcctgaccatcgacggccacgccgtgggcgccaagctgacctgggaggccgtgcccggcagcgagttcagctacgccgaggtggagctgggcaccgccgacatgatccacaccgccgaggccaccaccaacctgggcctgctgaccttcggcctggccaaggccatcggctacgccaccgccgccgactgcggcagaaccgtgctgagccccgtggagcccagctgcgagggcatgcagtgcgccgccggccagagatgccaggtggtgggcggcaaggccggctgcgtggccgagagcaccgccgtgtgcagagcccagggcgacccccactacaccaccttcgacggcagaagatacgacatgatgggcacctgcagctacaccatggtggagctgtgcagcgaggacgacaccctgcccgccttcagcgtggaggccaagaacgagcacagaggcagcagaagagtgagctacgtgggcctggtgaccgtgagagcctacagccacagcgtgagcctgaccagaggcgaggtgggcttcgtgctggtggacaaccagagaagcagactgcccgtgagcctgagcgagggcagactgagagtgtaccagagcggccccagagccgtggtggagctggtgttcggcctggtggtgacctacgactgggactgccagctggccctgagcctgcccgccagattccaggaccaggtgtgcggcctgtgcggcaactacaacggcgaccccgccgacgacttcctgacccccgacggcgccctggcccccgacgccgtggagttcgccagcagctggaagctggacgacggcgactacctgtgcgaggacggctgccagaacaactgccccgcctgcacccccggccaggcccagcactacgagggcgacagactgtgcggcatgctgaccaagctggacggccccttcgccgtgtgccacgacaccctggaccccagacccttcctggagcagtgcgtgtacgacctgtgcgtggtgggcggcgagagactgagcctgtgcagaggcctgagcgcctacgcccaggcctgcctggagctgggcatcagcgtgggcgactggagaagccccgccaactgccccctgagctgccccgccaacagcagatacgagctgtgcggccccgcctgccccaccagctgcaacggcgccgccgcccccagcaactgcagcggcagaccctgcgtggagggctgcgtgtgcctgcccggcttcgtggccagcggcggcgcctgcgtgcccgccagcagctgcggctgcaccttccagggcctgcagctggcccccggccaggaggtgtgggccgacgagctgtgccagagaagatgcacctgcaacggcgccacccaccaggtgacctgcagagacaagcagagctgccccgccggcgagagatgcagcgtgcagaacggcctgctgggctgctaccccgacagattcggcacctgccagggcagcggcgacccccactacgtgagcttcgacggcagaagattcgacttcatgggcacctgcacctacctgctggtgggcagctgcggccagaacgccgccctgcccgccttcagagtgctggtggagaacgagcacagaggcagccagaccgtgagctacaccagagccgtgagagtggaggccagaggcgtgaaggtggccgtgagaagagagtaccccggccaggtgctggtggacgacgtgctgcagtacctgcccttccaggccgccgacggccaggtgcaggtgttcagacagggcagagacgccgtggtgagaaccgacttcggcctgaccgtgacctacgactggaacgccagagtgaccgccaaggtgcccagcagctacgccgaggccctgtgcggcctgtgcggcaacttcaacggcgaccccgccgacgacctggccctgagaggcggcggccaggccgccaacgccctggccttcggcaacagctggcaggaggagaccagacccggctgcggcgccaccgagcccggcgactgccccaagctggacagcctggtggcccagcagctgcagagcaagaacgagtgcggcatcctggccgaccccaagggccccttcagagagtgccacagcaagctggacccccagggcgccgtgagagactgcgtgtacgacagatgcctgctgcccggccagagcggccccctgtgcgacgccctggccacctacgccgccgcctgccaggccgccggcgccaccgtgcacccctggagaagcgaggagctgtgccccctgagctgccccccccacagccactacgaggcctgcagctacggctgccccctgagctgcggcgacctgcccgtgcccggcggctgcggcagcgagtgccacgagggctgcgtgtgcgacgagggcttcgccctgagcggcgagagctgcctgcccctggccagctgcggctgcgtgcaccagggcacctaccacccccccggccagaccttctaccccggccccggctgcgacagcctgtgccactgccaggagggcggcctggtgagctgcgagagcagcagctgcggcccccacgaggcctgccagcccagcggcggcagcctgggctgcgtggccgtgggcagcagcacctgccaggccagcggcgacccccactacaccaccttcgacggcagaagattcgacttcatgggcacctgcgtgtacgtgctggcccagacctgcggcaccagacccggcctgcacagattcgccgtgctgcaggagaacgtggcctggggcaacggcagagtgagcgtgaccagagtgatcaccgtgcaggtggccaacttcaccctgagactggagcagagacagtggaaggtgaccgtgaacggcgtggacatgaagctgcccgtggtgctggccaacggccagatcagagccagccagcacggcagcgacgtggtgatcgagaccgacttcggcctgagagtggcctacgacctggtgtactacgtgagagtgaccgtgcccggcaactactaccagcagatgtgcggcctgtgcggcaactacaacggcgaccccaaggacgacttccagaagcccaacggcagccaggccggcaacgccaacgagttcggcaacagctgggaggaggtggtgcccgacagcccctgcctgccccccaccccctgcccccccggcagcgaggactgcatccccagccacaagtgcccccccgagctggagaagaagtaccagaaggaggagttctgcggcctgctgagcagccccaccggccccctgagcagctgccacaagctggtggacccccagggccccctgaaggactgcatcttcgacctgtgcctgggcggcggcaacctgagcatcctgtgcagcaacatccacgcctacgtgagcgcctgccaggccgccggcggccacgtggagccctggagaaccgagaccttctgccccatggagtgcccccccaacagccactacgagctgtgcgccgacacctgcagcctgggctgcagcgccctgagcgcccccccccagtgccaggacggctgcgccgagggctgccagtgcgacagcggcttcctgtacaacggccaggcctgcgtgcccatccagcagtgcggctgctaccacaacggcgtgtactacgagcccgagcagaccgtgctgatcgacaactgcagacagcagtgcacctgccacgccggcaagggcatggtgtgccaggagcacagctgcaagcccggccaggtgtgccagcccagcggcggcatcctgagctgcgtgaccaaggacccctgccacggcgtgacctgcagaccccaggagacctgcaaggagcagggcggccagggcgtgtgcctgcccaactacgaggccacctgctggctgtggggcgacccccactaccacagcttcgacggcagaaagttcgacttccagggcacctgcaactacgtgctggccaccaccggctgccccggcgtgagcacccagggcctgacccccttcaccgtgaccaccaagaaccagaacagaggcaaccccgccgtgagctacgtgagagtggtgaccgtggccgccctgggcaccaacatcagcatccacaaggacgagatcggcaaggtgagagtgaacggcgtgctgaccgccctgcccgtgagcgtggccgacggcagaatcagcgtgacccagggcgccagcaaggccctgctggtggccgacttcggcctgcaggtgagctacgactggaactggagagtggacgtgaccctgcccagcagctaccacggcgccgtgtgcggcctgtgcggcaacatggacagaaaccccaacaacgaccaggtgttccccaacggcaccctggcccccagcatccccatctggggcggcagctggagagcccccggctgggaccccctgtgctgggacgagtgcagaggcagctgccccacctgccccgaggacagactggagcagtacgagggccccggcttctgcggccccctggcccccggcaccggcggccccttcaccacctgccacgcccacgtgccccccgagagcttcttcaagggctgcgtgctggacgtgtgcatgggcggcggcgacagagacatcctgtgcaaggccctggccagctacgtggccgcctgccaggccgccggcgtggtgatcgaggactggagagcccaggtgggctgcgagatcacctgccccgagaacagccactacgaggtgtgcggcagcccctgccccgccagctgccccagccccgcccccctgaccacccccgccgtgtgcgagggcccctgcgtggagggctgccagtgcgacgccggcttcgtgctgagcgccgacagatgcgtgcccctgaacaacggctgcggctgctgggccaacggcacctaccacgaggccggcagcgagttctgggccgacggcacctgcagccagtggtgcagatgcggccccggcggcggcagcctggtgtgcacccccgccagctgcggcctgggcgaggtgtgcggcctgctgcccagcggccagcacggctgccagcccgtgagcaccgccgagtgccaggcctggggcgacccccactacgtgaccctggacggccacagattcaacttccagggcacctgcgagtacctgctgagcgccccctgccacggcccccccctgggcgccgagaacttcaccgtgaccgtggccaacgagcacagaggcagccaggccgtgagctacaccagaagcgtgaccctgcagatctacaaccacagcctgaccctgagcgccagatggcccagaaagctgcaggtggacggcgtgttcgtgaccctgcccttccagctggacagcctgctgcacgcccacctgagcggcgccgacgtggtggtgaccaccaccagcggcctgagcctggccttcgacggcgacagcttcgtgagactgagagtgcccgccgcctacgccggcagcctgtgcggcctgtgcggcaactacaaccaggaccccgccgacgacctgaaggccgtgggcggcaagcccgccggctggcaggtgggcggcgcccagggctgcggcgagtgcgtgagcaagccctgccccagcccctgcacccccgagcagcaggagagcttcggcggccccgacgcctgcggcgtgatcagcgccaccgacggccccctggccccctgccacggcctggtgccccccgcccagtacttccagggctgcctgctggacgcctgccaggtgcagggccaccccggcggcctgtgccccgccgtggccacctacgtggccgcctgccaggccgccggcgcccagctgagagagtggagaagacccgacttctgccccttccagtgccccgcccacagccactacgagctgtgcggcgacagctgccccggcagctgccccagcctgagcgcccccgagggctgcgagagcgcctgcagagagggctgcgtgtgcgacgccggcttcgtgctgagcggcgacacctgcgtgcccgtgggccagtgcggctgcctgcacgacgacagatactaccccctgggccagaccttctaccccggccccggctgcgacagcctgtgcagatgcagagagggcggcgaggtgagctgcgagcccagcagctgcggcccccacgagacctgcagacccagcggcggcagcctgggctgcgtggccgtgggcagcaccacctgccaggccagcggcgacccccactacaccaccttcgacggcagaagattcgacttcatgggcacctgcgtgtacgtgctggcccagacctgcggcaccagacccggcctgcacagattcgccgtgctgcaggagaacgtggcctggggcaacggcagagtgagcgtgaccagagtgatcaccgtgcaggtggccaacttcaccctgagactggagcagagacagtggaaggtgaccgtgaacggcgtggacatgaagctgcccgtggtgctggccaacggccagatcagagccagccagcacggcagcgacgtggtgatcgagaccgacttcggcctgagagtggcctacgacctggtgtactacgtgagagtgaccgtgcccggcaactactaccagctgatgtgcggcctgtgcggcaactacaacggcgaccccaaggacgacttccagaagcccaacggcagccaggccggcaacgccaacgagttcggcaacagctgggaggaggtggtgcccgacagcccctgcctgcccccccccacctgcccccccggcagcgagggctgcatccccagcgaggagtgcccccccgagctggagaagaagtaccagaaggaggagttctgcggcctgctgagcagccccaccggccccctgagcagctgccacaagctggtggacccccagggccccctgaaggactgcatcttcgacctgtgcctgggcggcggcaacctgagcatcctgtgcagcaacatccacgcctacgtgagcgcctgccaggccgccggcggccaggtggagccctggagaaacgagaccttctgccccatggagtgcccccagaacagccactacgagctgtgcgccgacacctgcagcctgggctgcagcgccctgagcgcccccctgcagtgccccgacggctgcgccgagggctgccagtgcgacagcggcttcctgtacaacggccaggcctgcgtgcccatccagcagtgcggctgctaccacaacggcgcctactacgagcccgagcagaccgtgctgatcgacaactgcagacagcagtgcacctgccacgtgggcaaggtggtggtgtgccaggagcacagctgcaagcccggccaggtgtgccagcccagcggcggcatcctgagctgcgtgaacaaggacccctgccacggcgtgacctgcagaccccaggagacctgcaaggagcagggcggccagggcgtgtgcctgcccaactacgaggccacctgctggctgtggggcgacccccactaccacagcttcgacggcagaaagttcgacttccagggcacctgcaactacgtgctggccaccaccggctgccccggcgtgagcacccagggcctgacccccttcaccgtgaccaccaagaaccagaacagaggcaaccccgccgtgagctacgtgagagtggtgaccgtggccgccctgggcaccaacatcagcatccacaaggacgagatcggcaaggtgagagtgaacggcgtgctgaccgccctgcccgtgagcgtggccgacggcagaatcagcgtgacccagggcgccagcaaggccctgctggtggccgacttcggcctgcaggtgagctacgactggaactggagagtggacgtgaccctgcccagcagctaccacggcgccgtgtgcggcctgtgcggcaacatggacagaaaccccaacaacgaccaggtgttccccaacggcaccctggcccccagcatccccatctggggcggcagctggagagcccccggctgggaccccctgtgctgggacgagtgcagaggcagctgccccacctgccccgaggacagactggagcagtacgagggccccggcttctgcggccccctggcccccggcaccggcggccccttcaccacctgccacgcccacgtgccccccgagagcttcttcaagggctgcgtgctggacgtgtgcatgggcggcggcgacagagacatcctgtgcaaggccctggccagctacgtggccgcctgccaggccgccggcgtggtgatcgaggactggagagcccaggtgggctgcgagatcacctgccccgagaacagccactacgaggtgtgcggccccccctgccccgccagctgccccagccccgcccccctgaccacccccgccgtgtgcgagggcccctgcgtggagggctgccagtgcgacgccggcttcgtgctgagcgccgacagatgcgtgcccctgaacaacggctgcggctgctgggccaacggcacctaccacgaggccggcagcgagttctgggccgacggcacctgcagccagtggtgcagatgcggccccggcggcggcagcctggtgtgcacccccgccagctgcggcctgggcgaggtgtgcggcctgctgcccagcggccagcacggctgccagcccgtgagcaccgccgagtgccaggcctggggcgacccccactacgtgaccctggacggccacagattcgacttccagggcacctgcgagtacctgctgagcgccccctgccacggcccccccctgggcgccgagaacttcaccgtgaccgtggccaacgagcacagaggcagccaggccgtgagctacaccagaagcgtgaccctgcagatctacaaccacagcctgaccctgagcgccagatggcccagaaagctgcaggtggacggcgtgttcgtgaccctgcccttccagctggacagcctgctgcacgcccacctgagcggcgccgacgtggtggtgaccaccaccagcggcctgagcctggccttcgacggcgacagcttcgtgagactgagagtgcccgccgcctacgccggcagcctgtgcggcctgtgcggcaactacaaccaggaccccgccgacgacctgaaggccgtgggcggcaagcccgccggctggcaggtgggcggcgcccagggctgcggcgagtgcgtgagcaagccctgccccagcccctgcacccccgagcagcaggagagcttcggcggccccgacgcctgcggcgtgatcagcgccaccgacggccccctggccccctgccacggcctggtgccccccgcccagtacttccagggctgcctgctggacgcctgccaggtgcagggccaccccggcggcctgtgccccgccgtggccacctacgtggccgcctgccaggccgccggcgcccagctgagagagtggagaagacccgacttctgccccttccagtgccccgcccacagccactacgagctgtgcggcgacagctgccccggcagctgccccagcctgagcgcccccgagggctgcgagagcgcctgcagagagggctgcgtgtgcgacgccggcttcgtgctgagcggcgacacctgcgtgcccgtgggccagtgcggctgcctgcacgacgacagatactaccccctgggccagaccttctaccccggccccggctgcgacagcctgtgcagatgcagagagggcggcgaggtgagctgcgagcccagcagctgcggcccccacgagacctgcagacccagcggcggcagcctgggctgcgtggccgtgggcagcaccacctgccaggccagcggcgacccccactacaccaccttcgacggccacagattcgacttcatgggcacctgcgtgtacgtgctggcccagacctgcggcaccagacccggcctgcacagattcgccgtgctgcaggagaacgtggcctggggcaacggcagagtgagcgtgaccagagtgatcaccgtgcaggtggccaacttcaccctgagactggagcagagacagtggaaggtgaccgtgaacggcgtggacatgaagctgcccgtggtgctggccaacggccagatcagagccagccagcacggcagcgacgtggtgatcgagaccgacttcggcctgagagtggcctacgacctggtgtactacgtgagagtgaccgtgcccggcaactactaccagctgatgtgcggcctgtgcggcaactacaacggcgaccccaaggacgacttccagaagcccaacggcagccaggccggcaacgccaacgagttcggcaacagctgggaggaggtggtgcccgacagcccctgcctgcccccccccacctgcccccccggcagcgccggctgcatccccagcgacaagtgcccccccgagctggagaagaagtaccagaaggaggagttctgcggcctgctgagcagccccaccggccccctgagcagctgccacaagctggtggacccccagggccccctgaaggactgcatcttcgacctgtgcctgggcggcggcaacctgagcatcctgtgcagcaacatccacgcctacgtgagcgcctgccaggccgccggcggccacgtggagccctggagaaacgagaccttctgccccatggagtgcccccagaacagccactacgagctgtgcgccgacacctgcagcctgggctgcagcgccctgagcgcccccctgcagtgccccgacggctgcgccgagggctgccagtgcgacagcggcttcctgtacaacggccaggcctgcgtgcccatccagcagtgcggctgctaccacaacggcgtgtactacgagcccgagcagaccgtgctgatcgacaactgcagacagcagtgcacctgccacgtgggcaaggtggtggtgtgccaggagcacagctgcaagcccggccaggtgtgccagcccagcggcggcatcctgagctgcgtgaccaaggacccctgccacggcgtgacctgcagaccccaggagacctgcaaggagcagggcggccagggcgtgtgcctgcccaactacgaggccacctgctggctgtggggcgacccccactaccacagcttcgacggcagaaagttcgacttccagggcacctgcaactacgtgctggccaccaccggctgccccggcgtgagcacccagggcctgacccccttcaccgtgaccaccaagaaccagaacagaggcaaccccgccgtgagctacgtgagagtggtgaccgtggccgccctgggcaccaacatcagcatccacaaggacgagatcggcaaggtgagagtgaacggcgtgctgaccgccctgcccgtgagcgtggccgacggcagaatcagcgtggcccagggcgccagcaaggccctgctggtggccgacttcggcctgcaggtgagctacgactggaactggagagtggacgtgaccctgcccagcagctaccacggcgccgtgtgcggcctgtgcggcaacatggacagaaaccccaacaacgaccaggtgttccccaacggcaccctggcccccagcatccccatctggggcggcagctggagagcccccggctgggaccccctgtgctgggacgagtgcagaggcagctgccccacctgccccgaggacagactggagcagtacgagggccccggcttctgcggccccctgagcagcggcaccggcggccccttcaccacctgccacgcccacgtgccccccgagagcttcttcaagggctgcgtgctggacgtgtgcatgggcggcggcgacagagacatcctgtgcaaggccctggccagctacgtggccgcctgccaggccgccggcgtggtgatcgaggactggagagcccaggtgggctgcgagatcacctgccccgagaacagccactacgaggtgtgcggccccccctgccccgccagctgccccagccccgcccccctgaccacccccgccgtgtgcgagggcccctgcgtggagggctgccagtgcgacgccggcttcgtgctgagcgccgacagatgcgtgcccctgaacaacggctgcggctgctgggccaacggcacctaccacgaggccggcagcgagttctgggccgacggcacctgcagccagtggtgcagatgcggccccggcggcggcagcctggtgtgcacccccgccagctgcggcctgggcgaggtgtgcggcctgctgcccagcggccagcacggctgccagcccgtgagcaccgccgagtgccaggcctggggcgacccccactacgtgaccctggacggccacagattcgacttccagggcacctgcgagtacctgctgagcgccccctgccacggcccccccctgggcgccgagaacttcaccgtgaccgtggccaacgagcacagaggcagccaggccgtgagctacaccagaagcgtgaccctgcagatctacaaccacagcctgaccctgagcgccagatggcccagaaagctgcaggtggacggcgtgttcgtggccctgcccttccagctggacagcctgctgcacgcccacctgagcggcgccgacgtggtggtgaccaccaccagcggcctgagcctggccttcgacggcgacagcttcgtgagactgagagtgcccgccgcctacgccgccagcctgtgcggcctgtgcggcaactacaaccaggaccccgccgacgacctgaaggccgtgggcggcaagcccgccggctggcaggtgggcggcgcccagggctgcggcgagtgcgtgagcaagccctgccccagcccctgcacccccgagcagcaggagagcttcggcggccccgacgcctgcggcgtgatcagcgccaccgacggccccctggccccctgccacggcctggtgccccccgcccagtacttccagggctgcctgctggacgcctgccaggtgcagggccaccccggcggcctgtgccccgccgtggccacctacgtggccgcctgccaggccgccggcgcccagctgggcgagtggagaagacccgacttctgccccctgcagtgccccgcccacagccactacgagctgtgcggcgacagctgccccgtgagctgccccagcctgagcgcccccgagggctgcgagagcgcctgcagagagggctgcgtgtgcgacgccggcttcgtgctgagcggcgacacctgcgtgcccgtgggccagtgcggctgcctgcacgacggcagatactaccccctgggcgaggtgttctaccccggccccgagtgcgagagaagatgcgagtgcggccccggcggccacgtgacctgccaggagggcgccgcctgcggcccccacgaggagtgcagactggaggacggcgtgcaggcctgccacgccaccggctgcggcagatgcctggccaacggcggcatccactacatcaccctggacggcagagtgtacgacctgcacggcagctgcagctacgtgctggcccaggtgtgccaccccaagcccggcgacgaggacttcagcatcgtgctggagaagaacgccgccggcgacctgcagagactgctggtgaccgtggccggccaggtggtgagcctggcccagggccagcaggtgaccgtggacggcgaggccgtggccctgcccgtggccgtgggcagagtgagagtgaccgccgagggcagaaacatggtgctgcagaccaccaagggcctgagactgctgttcgacggcgacgcccacctgctgatgagcatccccagccccttcagaggcagactgtgcggcctgtgcggcaacttcaacggcaactggagcgacgacttcgtgctgcccaacggcagcgccgccagcagcgtggagaccttcggcgccgcctggagagcccccggcagcagcaagggctgcggcgagggctgcggcccccagggctgccccgtgtgcctggccgaggagaccgccccctacgagagcaacgaggcctgcggccagctgagaaacccccagggccccttcgccacctgccaggccgtgctgagccccagcgagtacttcagacagtgcgtgtacgacctgtgcgcccagaagggcgacaaggccttcctgtgcagaagcctggccgcctacaccgccgcctgccaggccgccggcgtggccgtgaagccctggagaaccgacagcttctgccccctgcactgccccgcccacagccactacagcatctgcaccagaacctgccagggcagctgcgccgccctgagcggcctgaccggctgcaccaccagatgcttcgagggctgcgagtgcgacgacagattcctgctgagccagggcgtgtgcatccccgtgcaggactgcggctgcacccacaacggcagatacctgcccgtgaacagcagcctgctgaccagcgactgcagcgagagatgcagctgcagcagcagcagcggcctgacctgccaggccgccggctgcccccccggcagagtgtgcgaggtgaaggccgaggccagaaactgctgggccaccagaggcctgtgcgtgctgagcgtgggcgccaacctgaccaccttcgacggcgccagaggcgccaccaccagccccggcgtgtacgagctgagcagcagatgccccggcctgcagaacaccatcccctggtacagagtggtggccgaggtgcagatctgccacggcaagaccgaggccgtgggccaggtgcacatcttcttccaggacggcatggtgaccctgacccccaacaagggcgtgtgggtgaacggcctgagagtggacctgcccgccgagaagctggccagcgtgagcgtgagcagaacccccgacggcagcctgctggtgagacagaaggccggcgtgcaggtgtggctgggcgccaacggcaaggtggccgtgatcgtgagcaacgaccacgccggcaagctgtgcggcgcctgcggcaacttcgacggcgaccagaccaacgactggcacgacagccaggagaagcccgccatggagaagtggagagcccaggacttcagcccctgctacggctag

SEQ ID NO: 11043 - DNA, 2502 bp, Artificial Sequence
  Description of Artificial Sequence: Synthetic coding sequence
atggtgcacggcagcgtgaccttcagagacgtggccatcgacttcagccaggaggagtgggagtgcctgcagcccgaccagagaaccctgtacagagacgtgatgctggagaactacagccacctgatcagcctgggcagcagcatcagcaagcccgacgtgatcaccctgctggagcaggagaaggagccctggatcgtggtgagcaaggagaccagcagatggtaccccgacctggagagcaagtacggccccgagaagatcagccccgagaacgacatcttcgagatcaacctgcccaagcacgtgatcaagcagatcagcaagaccctgggcctggaggccttctacttcagaaacgacagcgagtacagaagcagattcgagggcagacagggccaccaggagggctacatcaaccagaagatcatcagctacgaggagatgcccgcctacacccacgccagccccatccacaacacccacaagccctacgagtgcaaggagtgcggcaagtacttcagctgcggcagcaacctgatccagcaccagagcatccacaccggcgagaagccctacaagtgcaaggagtgcggcaaggccttccagctgcacatccagctgaccagacaccagaagttccacaccggcgagaagaccttcgagtgcaaggagtgcggcaaggccttcaacctgcccacccagctgaacagacacaagaacatccacaccgtgaagaagctgttcgagtgcaaggagtgcggcaagagcttcaacagaagcagcaacctgacccagcaccagagcatccacgccggcgtgaagccctaccagtgcaaggagtgcggcaaggccttcaacagaggcagcaacctgatccagcaccagaagatccacagcaacgagaagcccttcgtgtgcagagagtgcgagatggccttcagataccactaccagctgatcgagcactgcagaatccacaccggcgagaagcccttcgagtgcaaggagtgcagaaaggccttcaccctgctgaccaagctggtgagacaccagaagatccacatgggcgagaagcccttcgagtgcagagagtgcggcaaggccttcagcctgctgaaccagctgaacagacacaagaacatccacaccggcgagaagcccttcgagtgcaaggagtgcggcaagagcttcaacagaagcagcaacctgatccagcaccagagcatccacgccgacgtgaagccctacgagtgcaaggagtgcggcaagggcttcaacagaggcgccaacctgatccagcaccagaagatccacagcaacgagaagcccttcgtgtgcagagagtgcgagatggccttcagataccactaccagctgatccagcactgccagatccacaccggcggcaagcccttcgagtgcaaggagtgcggcaaggccttcagcctgctgacccagctggccagacacaagaacatccacaccggcgagaagcccttcgagtgcaaggactgcggcaaggccttcaacagaggcagcaacctggtgcagcaccagagcatccacaccggcgagaagccctacgagtgcaaggagtgcggcaaggccttcagactgcacctgcagctgagccagcacgagaagacccacaccggcgagaagcccttcgagtgcaaggagtgcggcaagttcttcagaagaggcagcaacctgaaccagcacagaagcatccacaccggcaagaagcccttcgagtgcaaggagtgcggcaaggccttcagactgcacatgcacctgatcagacaccagaagttccacaccggcgagaagcccttcgagtgcaaggagtgcggcaaggccttcagcctgcacacccagctgaaccaccacaagaacatccacaccggcgagaagcccttcaagtgcaaggagtgcggcaagagcttcaacagagtgagcaacctggtgcagcaccagagcatccacgccggcgtgaagccctacgagtgcaaggagtgcggcaagggcttcagcagagtgagcaacctgatccagcaccagaagacccacagcagcgccaagcccttcgtgtgcaaggagtgcagaaagaccttcagataccactaccagctgaccgagcactacagaatccacaccggcgagaagcccttcgagtgcaaggagtgcggcaaggccttcggcctgctgacccagctggcccagcaccagatcatccacaccggcgagaagcccttcaagtgcaaggagtgcggcaaggccttcaacagaggcagcaacctggtgcagccccagagcatccacaccggcgagaagccctacgagtgcaaggagtgcggcaaggccttcagactgcacctgcagctgagcctgcaccagaagctggtgcaggtgagaaaccccctgaacgtgagaaacgtgggccagcccagcgacatcagcagcaacctgctgaacatcagaaagttcatcctgggctag

SEQ ID NO: 11044 - DNA, 618 bp, Artificial Sequence
  Description of Artificial Sequence: Synthetic coding sequence
atgaacaccttccaggccagcgtgagcttccaggacgtgaccgtggagttcagccaggaggagtggcagcacatgggccccgtggagagaaccctgtacagagacgtgatgctggagaactacagccacctggtgagcgtgggctactgcttcaccaagcccgagctgatcttcaccctggagcagggcgaggacccctggctgctggagaaggagaagggcttcctgagcagaaacagccccgaggacagccagcccgacgagatcagcgagaagagccccgagaaccagggcaagcacctgctgcaggtgctgttcaccaacaagctgctgaccaccgagcaggagatcagcggcaagccccacaacagagacatcaacatcttcagagccagaatgatgccctgcaagtgcgacatcgccggcagcgcctgccagggcctgagcctgatggccccccactgccagtacagcaaggagaaggcccacgagagaaacgtgtgcgacaagtggctgatcagcatcaaggacggcagaaccaacacccaggagaagagcttcgcctacagcaagatcgtgaagaccctgcaccacaaggaggaggtgatccagcactag

SEQ ID NO: 11045 - DNA, 2100 bp, Artificial Sequence
  Description of Artificial Sequence: Synthetic coding sequence
atgaacaccttccaggccagcgtgagcttccaggacgtgaccgtggagttcagccaggaggagtggcagcacatgggccccgtggagagaaccctgtacagagacgtgatgctggagaactacagccacctggtgagcgtgggctactgcttcaccaagcccgagctgatcttcaccctggagcagggcgaggacccctggctgctggagaaggagaagggcttcctgagcagaaacagccccgaggacagccagcccgacgagatcagcgagaagagccccgagaaccagggcaagcacctgctgcaggtgctgttcaccaacaagctgctgaccaccgagcaggagatcagcggcaagccccacaacagagacatcaacatcttcagagccagaatgatgccctgcaagtgcgacatcgccggcagcgcctgccagggcctgagcctgatggccccccactgccagtacagcaaggagaaggcccacgagagaaacgtgtgcgacaagtggctgatcagcatcaaggacggcagaaccaacacccaggagaagagcttcgcctacagcaagatcgtgaagaccctgcaccacaaggaggaggtgatccagcaccagaccatccagaccctgggccaggacttcgagtacaacgagagcagaaaggccttcctggagaaggccgccctggtgaccagcaacagcacccaccccaagggcaagagctacaacttcaacaagttcggcgagaacaagtacgacaagagcaccttcatcatcccccagaacatgaaccccgagaagagccactacgagttcaacgacaccggcaactgcttctgcagaatcacccacaagaccctgaccggcggcaagagcttcagccagaagagccacatcagagagcaccacagagtgcacatcggcgtgaagcccttcgagtacggcaagagcttcaacagaaacagcaccctgcccgtgcaccagagaacccacgccaccgacaagtacagcgactaccacccctgcaccgagaccttcagctaccagagcaccttcagcgtgcaccagaaggtgcacatcagagccaagccctacgagtacaacgagtgcggcaagagctgcagcatgaacagccacctgatctggccccagaagagccacaccggcgagaagccctacgagtgccccgagtgcggcaaggccttcagcgagaagagcagactgagaaagcaccagagaacccacaccggcgagaagccctacaagtgcgacggctgcgacaaggccttcagcgccaagagcggcctgagaatccaccagagaacccacaccggcgagaagcccttcgagtgccacgagtgcggcaagagcttcaactacaagagcatcctgatcgtgcaccagagaacccacaccggcgagaagcccttcgagtgcaacgagtgcggcaagagcttcagccacatgagcggcctgagaaaccacagaagaacccacaccggcgagagaccctacaagtgcgacgagtgcggcaaggccttcaagctgaagagcggcctgagaaagcaccacagaacccacaccggcgagaagccctacaagtgcaaccagtgcggcaaggccttcggccagaagagccagctgagaggccaccacagaatccacaccggcgagaagccctacaagtgcaaccactgcggcgaggccttcagccagaagagcaacctgagagtgcaccacagaacccacaccggcgagaagccctaccagtgcgaggagtgcggcaagaccttcagacagaagagcaacctgagaggccaccagagaacccacaccggcgagaagccctacgagtgcaacgagtgcggcaaggccttcagcgagaagagcgtgctgagaaagcaccagagaacccacaccggcgagaagccctacaactgcaaccagtgcggcgaggccttcagccagaagagcaacctgagagtgcaccagagaacccacaccggcgagaagccctacaagtgcgacaagtgcggcagaaccttcagccagaagagcagcctgagagagcaccagaaggcccaccccggcgactag

SEQ ID NO: 11046 - DNA, 1704 bp, Artificial Sequence
  Description of Artificial Sequence: Synthetic coding sequence
atgatgccctgcaagtgcgacatcgccggcagcgcctgccagggcctgagcctgatggccccccactgccagtacagcaaggagaaggcccacgagagaaacgtgtgcgacaagtggctgatcagcatcaaggacggcagaaccaacacccaggagaagagcttcgcctacagcaagatcgtgaagaccctgcaccacaaggaggaggtgatccagcaccagaccatccagaccctgggccaggacttcgagtacaacgagagcagaaaggccttcctggagaaggccgccctggtgaccagcaacagcacccaccccaagggcaagagctacaacttcaacaagttcggcgagaacaagtacgacaagagcaccttcatcatcccccagaacatgaaccccgagaagagccactacgagttcaacgacaccggcaactgcttctgcagaatcacccacaagaccctgaccggcggcaagagcttcagccagaagagccacatcagagagcaccacagagtgcacatcggcgtgaagcccttcgagtacggcaagagcttcaacagaaacagcaccctgcccgtgcaccagagaacccacgccaccgacaagtacagcgactaccacccctgcaccgagaccttcagctaccagagcaccttcagcgtgcaccagaaggtgcacatcagagccaagccctacgagtacaacgagtgcggcaagagctgcagcatgaacagccacctgatctggccccagaagagccacaccggcgagaagccctacgagtgccccgagtgcggcaaggccttcagcgagaagagcagactgagaaagcaccagagaacccacaccggcgagaagccctacaagtgcgacggctgcgacaaggccttcagcgccaagagcggcctgagaatccaccagagaacccacaccggcgagaagcccttcgagtgccacgagtgcggcaagagcttcaactacaagagcatcctgatcgtgcaccagagaacccacaccggcgagaagcccttcgagtgcaacgagtgcggcaagagcttcagccacatgagcggcctgagaaaccacagaagaacccacaccggcgagagaccctacaagtgcgacgagtgcggcaaggccttcaagctgaagagcggcctgagaaagcaccacagaacccacaccggcgagaagccctacaagtgcaaccagtgcggcaaggccttcggccagaagagccagctgagaggccaccacagaatccacaccggcgagaagccctacaagtgcaaccactgcggcgaggccttcagccagaagagcaacctgagagtgcaccacagaacccacaccggcgagaagccctaccagtgcgaggagtgcggcaagaccttcagacagaagagcaacctgagaggccaccagagaacccacaccggcgagaagccctacgagtgcaacgagtgcggcaaggccttcagcgagaagagcgtgctgagaaagcaccagagaacccacaccggcgagaagccctacaactgcaaccagtgcggcgaggccttcagccagaagagcaacctgagagtgcaccagagaacccacaccggcgagaagccctacaagtgcgacaagtgcggcagaaccttcagccagaagagcagcctgagagagcaccagaaggcccaccccggcgactag

SEQ ID NO: 11047 - DNA, 972 bp, Artificial Sequence
  Description of Artificial Sequence: Synthetic coding sequence
atggccgccgccagacccgaggcccagagcagaagcagccccacccccgagagcagaagccaggagcccctggacctggtgctggtgcccgacgactgcagacccggcaccccccccagcgacctgatcgagatccaggtggtgaaggtgaccgacaccaccctggtgcccgagccccccgagcccggcagcttccactgcgccctgtgccccgccgccttcagactggtgagcgagctgctgttccacgagcacggccacctggccggcgccgagggcggcggccagggcggcgaccccagcagatgccacgtgtgcggccacagctgccccggccccgccagcctgagagcccactacagcctgcacaccggcgagagaccctacagatgcgccctgtgccccagagccttcaaggccctggcccccctgctgagacaccagcacagacacggcgtggagcccggcaccagcagaagaccccccgacaccgccgccgtggccgagcagagacccggcgtggcccccgagagagccgaggtggtgatggccgccgccgccgccggcgccgccgtgggcaagcccttcgcctgcagattctgcgccaagcccttcagaagaagcagcgacatgagagaccacgagagagtgcacaccggcgagagaccctaccactgcggcatctgcggcaagggcttcacccagagcagcgtgctgagcggccacgccagaatccacaccggcgagagacccttcagatgcaccctgtgcgacagaaccttcaacaacagcagcaacttcagaaagcaccagagaacccacttccacggccccggccccggcctgggcgacagcggcggccagctgggcagcagcgccgccgagggcagcggcagcggctgcggcgtgggcgaccccgccgaggagggcagaggcgagaccgccaaggtgaaggtggaggccgaccagtag

SEQ ID NO: 11048 - DNA, 1218 bp, Artificial Sequence
  Description of Artificial Sequence: Synthetic coding sequence
atgggcccccccctggcccccagacccgcccacgtgcccggcgaggccggccccagaagaaccagagagagcagacccggcgccgtgagcttcgccgacgtggccgtgtacttcagccccgaggagtgggagtgcctgagacccgcccagagagccctgtacagagacgtgatgagagagaccttcggccacctgggcgccctgggcttcagcgtgcccaagcccgccttcatcagctgggtggagggcgaggtggaggcctggagccccgaggcccaggaccccgacggcgagagcagcgccgccttcagcagaggccagggccaggaggccggcagcagagacggcaacgaggagaaggagagactgaagaagtgccccaagcagaaggaggtggcccacgaggtggccgtgaaggagtggtggcccagcgtggcctgccccgagttctgcaaccccagacagagccccatgaacccctggctgaaggacaccctgaccagaagactgccccacagctgccccgactgcggcagaaacttcagctaccccagcctgctggccagccaccagagagtgcacagcggcgagagacccttcagctgcggccagtgccaggccagattcagccagagaagatacctgctgcagcaccagttcatccacaccggcgagaagccctacccctgccccgactgcggcagaagattcagacagagaggcagcctggccatccacagaagagcccacaccggcgagaagccctacgcctgcagcgactgcaagagcagattcacctacccctacctgctggccatccaccagagaaagcacaccggcgagaagccctacagctgccccgactgcagcctgagattcgcctacaccagcctgctggccatccacagaagaatccacaccggcgagaagccctacccctgccccgactgcggcagaagattcacctacagcagcctgctgctgagccacagaagaatccacagcgacagcagacccttcccctgcgtggagtgcggcaagggcttcaagagaaagaccgccctggaggcccacagatggatccacagaagctgcagcgagagaagagcctggcagcaggccgtggtgggcagaagcgagcccatccccgtgctgggcggcaaggacccccccgtgcacttcagacacttccccgacatcttccaggagtgcggctag

SEQ ID NO: 11049 - DNA, 1113 bp, Artificial Sequence
  Description of Artificial Sequence: Synthetic coding sequence
atgcccgccgccagcgccgagggccccgtgcccggcagagacgccggcgacctgagaccccccggcagagccggcagagcccactgcttcagcttcgccggcttcagcgtgcccaagcccgccttcatcagctgggtggagggcgaggtggaggcctggagccccgaggcccaggaccccgacggcgagagcagcgccgccttcagcagaggccagggccaggaggccggcagcagagacggcaacgaggagaaggagagactgaagaagtgccccaagcagaaggaggtggcccacgaggtggccgtgaaggagtggtggcccagcgtggcctgccccgagttctgcaaccccagacagagccccatgaacccctggctgaaggacaccctgaccagaagactgccccacagctgccccgactgcggcagaaacttcagctaccccagcctgctggccagccaccagagagtgcacagcggcgagagacccttcagctgcggccagtgccaggccagattcagccagagaagatacctgctgcagcaccagttcatccacaccggcgagaagccctacccctgccccgactgcggcagaagattcagacagagaggcagcctggccatccacagaagagcccacaccggcgagaagccctacgcctgcagcgactgcaagagcagattcacctacccctacctgctggccatccaccagagaaagcacaccggcgagaagccctacagctgccccgactgcagcctgagattcgcctacaccagcctgctggccatccacagaagaatccacaccggcgagaagccctacccctgccccgactgcggcagaagattcacctacagcagcctgctgctgagccacagaagaatccacagcgacagcagacccttcccctgcgtggagtgcggcaagggcttcaagagaaagaccgccctggaggcccacagatggatccacagaagctgcagcgagagaagagcctggcagcaggccgtggtgggcagaagcgagcccatccccgtgctgggcggcaaggacccccccgtgcacttcagacacttccccgacatcttccaggagtgcggctag

SEQ ID NO: 11050 - DNA, 1173 bp, Artificial Sequence
  Description of Artificial Sequence: Synthetic coding sequence
atgggcccccccctggcccccagacccgcccacgtgcccggcgaggccggccccagaagaaccagagagagcagacccggcgccgtgagcttcgccgacgtggccgtgtacttcagccccgaggagtgggagtgcctgagacccgcccagagagccctgtacagagacgtgatgagagagaccttcggccacctgggcgccctgggcttcagcgtgcccaagcccgccttcatcagctgggtggagggcgaggtggaggcctggagccccgaggcccaggaccccgacggcagcagagacggcaacgaggagaaggagagactgaagaagtgccccaagcagaaggaggtggcccacgaggtggccgtgaaggagtggtggcccagcgtggcctgccccgagttctgcaaccccagacagagccccatgaacccctggctgaaggacaccctgaccagaagactgccccacagctgccccgactgcggcagaaacttcagctaccccagcctgctggccagccaccagagagtgcacagcggcgagagacccttcagctgcggccagtgccaggccagattcagccagagaagatacctgctgcagcaccagttcatccacaccggcgagaagccctacccctgccccgactgcggcagaagattcagacagagaggcagcctggccatccacagaagagcccacaccggcgagaagccctacgcctgcagcgactgcaagagcagattcacctacccctacctgctggccatccaccagagaaagcacaccggcgagaagccctacagctgccccgactgcagcctgagattcgcctacaccagcctgctggccatccacagaagaatccacaccggcgagaagccctacccctgccccgactgcggcagaagattcacctacagcagcctgctgctgagccacagaagaatccacagcgacagcagacccttcccctgcgtggagtgcggcaagggcttcaagagaaagaccgccctggaggcccacagatggatccacagaagctgcagcgagagaagagcctggcagcaggccgtggtgggcagaagcgagcccatccccgtgctgggcggcaaggacccccccgtgcacttcagacacttccccgacatcttccaggagtgcggctag

SEQ ID NO: 11051 - DNA, 2238 bp, Artificial Sequence
  Description of Artificial Sequence: Synthetic coding sequence
atgagaagcaactacgagaccctggtgagcctggacgacggcctgcccaagcccgagctgatcagctggatcgagcacggcggcgagcccttcagaaagtggagagagagccagaagagcggcaacatcatctgcagcagcgtggacatgcacttcgaccccggcttcgaggagcagctgttctggggcagccagcaggccatgaacagcggcaagaccaagagccacttccagctggaccccgagagccagtgcagcttcggcagcttcgtgagcttcagacccgaccagggcatcaccctgggcagcccccagagacacgacgccagagcccccccccccctggcctgcggccccagcgagagcaccctgaaggagggcatccccggccccagaaacctggacctgcccggcctgtgggacgtgcccgcctgggagagcacccagcacccctggcccgtgtgcggcgagagctgctgggagaacaaccacctggtgatgcaccagagaggccacagcaaggacagaaccagaagagcctgggagaagttcaacaagagagccgagacccagatgccctggagcagccccagagtgcagagacacttcagatgcggcgtgtgcggcaagagcttcagaagaaagctgtgcctgctgagacacctggccgcccacaccggcagaggccccttcagaaacgccgacggcgagatgtgcttcagacacgagctgacccaccccagccacagactgccccagcagggcgagaagcccgcccagtgcaccccctgcggcaagagaagcctgcccgtggacagcacccaggccagaagatgccagcacagcagagagggccccgccagctggagagagggcagaggcgccagcagcagcgtgcacagcggccagaagcccggcagcagactgccccaggagggcaacagccaccaggagggcgacaccgaggccctgcagcacggcgccgagggcccctgcagctgcagcgagtgcggcgagagaagccccatgagcgccagactggccagcccctgcagagcccacaccggcgagaagcccttccagtgcgcccactgcaccaagagattcagactgagaagactgctgcaggtgcaccagcacgcccacggcggcgagagacccttcagctgcagaaagtgcggcaagggcttcgccaagcagtgcaagctgaccgagcacatcagagtgcacagcggcgagaagcccttcagatgcgccaagtgcggcagaaacttcagacagagaggccagctgctgagacaccagagactgcacaccgacgagaagcccttccagtgccccgagtgcggcctgagcttcagactggagagcatgctgagagcccacagactgagacacggcggcgagagacccttcagctgcagcgagtgcggcagaggcttcacccaccagtgcaagctgagagagcacctgagagtgcacagcggcgagagacccttccagtgcctgaagtgcgacaagagattcagactgaagggcatcctgaaggcccaccagcacacccacagcaaggagagacccttcagctgcggcgagtgcggcaagggcttcaccagacagagcaagctgaccgagcacctgagagtgcacagcggcgagagacccttccagtgccccgagtgcaacagaagcttcagactgaagggccagctgctgagccaccagagactgcacaccggcgagagacccttccagtgccccgagtgcgacaagagatacagagtgaaggccgacatgaaggcccaccagctgctgcacagcggcgagatgcccttcagctgcgagtgcggcaagggcttcgtgaagcacagcaagctgatcgagcacatcagaacccacaccggcgagaagcccttccagtgccccaagtgcgacaagagcttcagactgaaggcccagctgctgagccaccagggcctgcacaccggcgagagacccttccactgccccgagtgcgacaagaacttcagagagagaggccacatgctgagacaccagagaatccacagacccgagagacccttcgcctgcggcgactgcggcaagggcttcatctacaagagcaagctggccgagcacatcagagtgcacaccaagagctgccccgcccccaacgagctggacatcaagaagagactgagccagctgttcgccatgatcgaggccgactggagctag

SEQ ID NO: 11052 - DNA, 2349 bp, Artificial Sequence
  Description of Artificial Sequence: Synthetic coding sequence
atggccgagccccccagactgcccctgaccttcgaggacgtggccatctacttcagcgagcaggagtggcaggacctggaggcctggcagaaggagctgtacaagcacgtgatgagaagcaactacgagaccctggtgagcctggacgacggcctgcccaagcccgagctgatcagctggatcgagcacggcggcgagcccttcagaaagtggagagagagccagaagagcggcaacatcatctgcagcagcgtggacatgcacttcgaccccggcttcgaggagcagctgttctggggcagccagcaggccatgaacagcggcaagaccaagagccacttccagctggaccccgagagccagtgcagcttcggcagcttcgtgagcttcagacccgaccagggcatcaccctgggcagcccccagagacacgacgccagagcccccccccccctggcctgcggccccagcgagagcaccctgaaggagggcatccccggccccagaaacctggacctgcccggcctgtgggacgtgcccgcctgggagagcacccagcacccctggcccgtgtgcggcgagagctgctgggagaacaaccacctggtgatgcaccagagaggccacagcaaggacagaaccagaagagcctgggagaagttcaacaagagagccgagacccagatgccctggagcagccccagagtgcagagacacttcagatgcggcgtgtgcggcaagagcttcagaagaaagctgtgcctgctgagacacctggccgcccacaccggcagaggccccttcagaaacgccgacggcgagatgtgcttcagacacgagctgacccaccccagccacagactgccccagcagggcgagaagcccgcccagtgcaccccctgcggcaagagaagcctgcccgtggacagcacccaggccagaagatgccagcacagcagagagggccccgccagctggagagagggcagaggcgccagcagcagcgtgcacagcggccagaagcccggcagcagactgccccaggagggcaacagccaccaggagggcgacaccgaggccctgcagcacggcgccgagggcccctgcagctgcagcgagtgcggcgagagaagccccatgagcgccagactggccagcccctgcagagcccacaccggcgagaagcccttccagtgcgcccactgcaccaagagattcagactgagaagactgctgcaggtgcaccagcacgcccacggcggcgagagacccttcagctgcagaaagtgcggcaagggcttcgccaagcagtgcaagctgaccgagcacatcagagtgcacagcggcgagaagcccttcagatgcgccaagtgcggcagaaacttcagacagagaggccagctgctgagacaccagagactgcacaccgacgagaagcccttccagtgccccgagtgcggcctgagcttcagactggagagcatgctgagagcccacagactgagacacggcggcgagagacccttcagctgcagcgagtgcggcagaggcttcacccaccagtgcaagctgagagagcacctgagagtgcacagcggcgagagacccttccagtgcctgaagtgcgacaagagattcagactgaagggcatcctgaaggcccaccagcacacccacagcaaggagagacccttcagctgcggcgagtgcggcaagggcttcaccagacagagcaagctgaccgagcacctgagagtgcacagcggcgagagacccttccagtgccccgagtgcaacagaagcttcagactgaagggccagctgctgagccaccagagactgcacaccggcgagagacccttccagtgccccgagtgcgacaagagatacagagtgaaggccgacatgaaggcccaccagctgctgcacagcggcgagatgcccttcagctgcgagtgcggcaagggcttcgtgaagcacagcaagctgatcgagcacatcagaacccacaccggcgagaagcccttccagtgccccaagtgcgacaagagcttcagactgaaggcccagctgctgagccaccagggcctgcacaccggcgagagacccttccactgccccgagtgcgacaagaacttcagagagagaggccacatgctgagacaccagagaatccacagacccgagagacccttcgcctgcggcgactgcggcaagggcttcatctacaagagcaagctggccgagcacatcagagtgcacaccaagagctgccccgcccccaacgagctggacatcaagaagagactgagccagctgttcgccatgatcgaggccgactggagctag

SEQ ID NO: 11053 - DNA, 1056 bp, Artificial Sequence
  Description of Artificial Sequence: Synthetic coding sequence
atgcacttcgaccccggcttcgaggagcagctgttctggggcagccagcaggccatgaacagcggcaagaccaagagccacttccagctggaccccgagagccagtgcagcttcggcagcttcgtgagcttcagacccgaccagggcatcaccctgggcagcccccagagacacgacgccagagcccccccccccctggcctgcggccccagcgagagcaccctgaaggagggcatccccggccccagaaacctggacctgcccggcctgtgggacgtgcccgcctgggagagcacccagcacccctggcccgtgtgcggcgagagctgctgggagaacaaccacctggtgatgcaccagagaggccacagcaaggacagaaccagaagagcctgggagaagttcaacaagagagccgagacccagatgccctggagcagccccagagtgcagagacacttcagatgcggcgtgtgcggcaagagcttcagaagaaagctgtgcctgctgagacacctggccgcccacaccggcagaggccccttcagaaacgccgacggcgagatgtgcttcagacacgagctgacccaccccagccacagactgccccagcagggcgagaagcccgcccagtgcaccccctgcggcaagagaagcctgcccgtggacagcacccaggccagaagatgccagcacagcagagagggccccgccagctggagagagggcagaggcgccagcagcagcgtgcacagcggccagaagcccggcagcagactgccccaggagggcaacagccaccaggagggcgacaccgaggccctgcagcacggcgccgagggcccctgcagctgcagcgagtgcggcgagagaagccccatgagcgccagactggccagcccctgcagagcccacaccggcgagaagcccttccagtgcgcccactgcaccaagagattcagactgagaagactgctgcaggtgcaccagcacgcccacggcggcgagaccgtgctgctgcaggaggtgtggcagggcctgagacaggccgtgtag

SEQ ID NO: 11054 - DNA, 1152 bp, Artificial Sequence
  Description of Artificial Sequence: Synthetic coding sequence
atggagctgagagaggaggcctggagccccggccccctggacagcgaggaccagcagatggccagccacgagaaccccgtggacatcctgatcatggacgacgacgacgtgcccagctggccccccaccaagctgagccccccccagagcgccccccccgccggccccccccccagacccagaccccccgccccctacatctgcaacgagtgcggcaagagcttcagccactggagcaagctgaccagacaccagagaacccacaccggcgagagacccaacgcctgcgccgactgcggcaagaccttcagccagagcagccacctggtgcagcacagaagaatccacaccggcgagaagccctacgcctgcctggagtgcggcaagagattcagctggagcagcaacctgatgcagcaccagagaatccacaccggcgagaagccctacacctgccccgactgcggcagaagcttcacccagagcaagagcctggccaagcacagaagaagccacagcggcctgaagcccttcgtgtgccccagatgcggcagaggcttcagccagcccaagagcctggccagacacctgagactgcaccccgagctgagcggccccggcgtggccgccaaggtgctggccgccagcgtgagaagagccaagggccccgaggaggccgtggccgccgacggcgagatcgccatccccgtgggcgacggcgagggcatcatcgtggtgggcgcccccggcgagggcgccgccgccgccgccgccatggccggcgccggcgccaaggccgccggccccagaagcagaagagcccccgcccccaagccctacgtgtgcctggagtgcggcaagggcttcggccacggcgccggcctgctggcccaccagagagcccagcacggcgacggcctgggcgccgccggcggcgaggagcccgcccacatctgcgtggagtgcggcgagggcttcgtgcagggcgccgccctgagaagacacaagaagatccacgccgtgggcgcccccagcgtgtgcagcagctgcggccagagctactacagagccggcggcgaggaggaggacgacgacgacgacgaggccgccggcggcagatgccccgagtgcagaggcggcgagggcagatag

SEQ ID NO: 11055 - DNA, 1848 bp, Artificial Sequence
  Description of Artificial Sequence: Synthetic coding sequence
atgaacgtgagaatcctgagaagacacctggtgttccccttcatcttcatcgtgatcaaggagctgaccctggagggcacccccatgaacgtgaacaacctggagaaccccctggacgccccccagaacttcaagtgcatgcagggcctgagcgtggagaagccctacaagtgcaagaagtgcgagaaggccttcaacaacctgagcagcttccagatccacgagagaatgcacagaggcggcaagtaccacgcctgcaagggcagcggcaacacctacagattcagcggcttctaccacagacacaagatgccccacgccggcggcaagttctacggctgcaagaagtgcggcaaggccttcatcagcttctgcgccttcagataccaccagagaacccacaccaaggagaagccctacgcctgcaagcagtgcggcaaggcctacatcagctacaccagcttccagtaccaccagctgaaccacaccggcgccaagtgctacgagtgcaagcagtgcggcaagggcttcgacctgcccaacagcatcagataccacgagatgacccacaccggcgagaagccccacgagtgcaagcagtgcggcaagaccttcagatgcgccagcagcctgagaatccacggcagaacccacaccggcgagaagccctacgagtgcaagcagtgcggcaaggtgagcagatactggagcggcctgcaggtgcacgaggtgacccacatcggcaagaagctgtacgagtgcaaggagtgcggcaagagctactacagcagcggcagcttcctgaaccacaagagaatccacaccagagagaagagctacgagtgcaaggagtgcggcaaggccttcggcaaccccatcagcttccagaagcacgagggcagccacagaaagtggaagccctacgagtgcaaggagtgcggcaaggtgttcagcttcagcagcagcctgagaagacacgagagaacccacaccgagaagctgtgcgagtgcaagcagcacggcaagggcttcttccacagaagctgccccagacacatgaagatcgacaccggcgagatcctgcacaagagaaagatcagaggcaaggtgttccacagccccagcagcttccagacctgcgagagaagccacaccagagagaagagatacaagtgcaagcagtgcggcaagcccttcatctacttcaacgccttccagagacaccagagaagccacaccggcgagaacccctacgagtgcaagcagtgcggcaaggcctgcatcagcagcaccgccttccagtgcagagagctgagccacaccggcgccaagagatacaagtgcaagcagtgcggcaagggcttcaacctgcccagcagcatcagataccacgagatgacccacaccggcgagaagccctacgagtgcaagcagtgcggcagagccttcagaagcgccagccacctgagaacccacgagagaacccacatcggcgagaagccctacgagtgcaagcagtgcggcaaggtgtacagatactggagcggcctgagaatccacggcctgacccacatcggcaagaagccctacgagttcaacgacagaggcaagagcttctacagcagcaacttcttcctgaaccacaagagagtgcacaccagagtgaagacctacgagtgcaaggagtgcggcaaggccttcgacaaccccaccagcttccagaagcacgagggcagccacagaaagggcaagagctacgagtgcaaggagtgcggcaaggtgttcagcttcagcagaagcttcagaagatacgagagagcccacaccggcgagaagccctgcgagtag

SEQ ID NO: 11056 - DNA, 780 bp, Artificial Sequence
  Description of Artificial Sequence: Synthetic coding sequence
agaagccacaccagagagaagagatacaagtgcaagcagtgcggcaagcccttcatctacttcaacgccttccagagacaccagagaagccacaccggcgagaacccctacgagtgcaagcagtgcggcaaggcctgcatcagcagcaccgccttccagtgcagagagctgagccacaccggcgccaagagatacaagtgcaagcagtgcggcaagggcttcaacctgcccagcagcatcagataccacgagatgacccacaccggcgagaagccctacgagtgcaagcagtgcggcagagccttcagaagcgccagccacctgagaacccacgagagaacccacatcggcgagaagccctacgagtgcaagcagtgcggcaaggtgtacagatactggagcggcctgagaatccacggcctgacccacatcggcaagaagccctacgagtgcaaggagtgcggcaaggccttcgacaaccccaccagcttccagaagcacgagggcagccacagaaagggcaagagctacgagtgcaaggagtgcggcaaggtgttcagcttcagcagaagcttcagaagacacggcagaatgcacaccggcgagaagccctacgagtgcaagaactgcggcaaggccttcaccagcgccaagagcctgcagaaccacggcagaacccacaccggcgagaagccctgcgagtgcaagcagtgcggcaaggccttcatctgcagcagcagctgccagagacacgaggagacccacagcgtgaacatgtag

SEQ ID NO: 11057 - DNA, 1278 bp, Artificial Sequence
  Description of Artificial Sequence: Synthetic coding sequence
atgttcccccccgccagaggcaaggagctgctgagcttcgaggacgtggccatgtacttcaccagagaggagtggggccacctgaactggggccagaaggacctgtacagagacgtgatgctggagaactacagaaacatggtgctgctgggcttccagttccccaagcccgagatgatctgccagctggagaactgggacgagcagtggatcctggacctgcccagaaccggcaacagaaaggccagcggcagcgcctgccccggcagcgaggccagacacaagatgaagaagctgacccccaagcagaagttcagcgaggacctggagagctacaagatcagcgtggtgatgcaggagagcgccgagaagctgagcgagaagctgcacaagtgcaaggagttcgtggacagctgcagactgaccttccccaccagcggcgacgagtacagcagaggcttcctgcagaacctgaacctgatccaggaccagaacgcccagaccagatggaagcagggcagatacgacgaggacggcaagcccttcaaccagagaagcctgctgctgggccacgagagaatcctgaccagagccaagagctacgagtgcagcgagtgcggcaaggtgatcagaagaaaggcctggttcgaccagcaccagagaatccacttcctggagaaccccttcgagtgcaaggtgtgcggccaggccttcagacagagaagcgccctgaccgtgcacaagcagtgccacctgcagaacaagccctacagatgccacgactgcggcaagtgcttcagacagctggcctacctggtggagcacaagagaatccacaccaaggagaagccctacaagtgcagcaagtgcgagaagaccttcagccagaacagcaccctgatcagacaccaggtgatccacagcggcgagaagagacacaagtgcctggagtgcggcaaggccttcggcagacacagcaccctgctgtgccaccagcagatccacagcaagcccaacacccacaagtgcagcgagtgcggccagagcttcggcagaaacgtggacctgatccagcaccagagaatccacaccaaggaggagttcttccagtgcggcgagtgcggcaagaccttcagcttcaagagaaacctgttcagacaccaggtgatccacaccggcagccagccctaccagtgcgtgatctgcggcaagagcttcaagtggcacaccagcttcatcaagcaccagggcacccacaagggccagatcagcacctag

SEQ ID NO: 11058 - DNA, 189 bp, Artificial Sequence
  Description of Artificial Sequence: Synthetic coding sequence
atgttcccccccgccagaggcaaggagctgctgagcttcgaggacgtggccatgtacttcaccagagaggagtggggccacctgaactggggccagaaggacctgtacagagacgtgatgctggagaactacagaaacatggtgctgctggtgtacttccagttcgacgccgccatccccctgtgctag

SEQ ID NO: 11059 - DNA, 1911 bp, Artificial Sequence
  Description of Artificial Sequence: Synthetic coding sequence
atggcccacctgatgatgttcagagacgtggccgtggacttcagccaggaggagtgggagtgcctggacctggagcagagagacctgtacagagacgtgatgctggagaactacagcaacatggtgagcctgggcttctgcatctaccagcccgaggccttcagcctgctggagaagggcaaggagccctggaagatcctgagagacgagaccagaggcccctgccccgacatgcagagcagatgccagaccaagaagctgctgcccaagaacggcatcttcgagagagagatcgcccagctggagatcatgagaatctgcaagaaccacagcctggactgcctgtgcttcagaggcgactgggagggcaacacccagttccagaccctgcaggacaaccaggaggagtgcttcaagcaggtgatcagaacctgcgagaagagacccaccttcaaccagcacaccgtgttcaacctgcaccagagactgaacaccggcgacaagctgaacgagttcaaggagctgggcaaggccttcatcagcggcagcgaccacacccagcaccagctgatccacaccagcgagaagttctgcggcgacaaggagtgcggcaacaccttcctgcccgacagcgaggtgatccagtaccagaccgtgcacaccgtgaagaagacctacgagtgcaaggagtgcggcaagagcttcagcctgagaagcagcctgaccggccacaagagaatccacaccggcgagaagcccttcaagtgcaaggactgcggcaaggccttcagattccacagccagctgagcgtgcacaagagaatccacaccggcgagaagagctacgagtgcaaggagtgcggcaaggccttcagctgcggcagcgacctgaccagacaccagagaatccacaccggcgagaagccctacgagtgcaacgagtgcagaaaggccttcagccagagaagccacctgatcaagcaccagagaatccacaccggcgagaagccctacgagtgcaaggagtgcggcaaggccttcaccagaggcagccacctgacccagcaccagagaatccacaccggcgagaagagccacgagtgcaaggagtgcggcaaggccttcatcagaggcagcaacctggcccagcaccagaacgtgcacgtgggcagaaagccctacaagtgcgagaagtgcggcaaggcctacatctggagcagccacctggccagacaccagagaatccacaccggcagaaagccctacgagtgcaagcagtgcggcaagaccttcacctgggccagctacctggcccagcacgagaagatccacaacgagagaaagagctacgagtgcaaggagtgcggcaagaccttcctgcacggcagcgagttcaacagacaccagaagatccacaccggcgagagaaactacgagtgcaaggagtgcggcaagaccttcttcagaggcagcgagctgaacagacaccagaagatccacaccggcaagagaccctacgagtgcgaggagtgcggcaaggccttcctgtggggcagccagctgaccagacaccagagaatgcacaccggcgaggagccctacgtgtgcaaggagtgcggcaagagcttcatctggggcagccagctgaccagacacaagaagatccacaccgacgccgagccctacggctgcaagaagagcagccacatcttcagccaccacagctacttcaccgagcagaagatccacaacagcgccaacctgtgcgagtggaccgactacggcaacaccttcagccacgagagcaacttcgcccagcaccagaacatctacaccttcgagaagagctacgagttcaaggacttcgagaaggccttcagcagcagcagccacttcatcagcctgctgtag

SEQ ID NO: 11060 - DNA, 408 bp, Artificial Sequence
  Description of Artificial Sequence: Synthetic coding sequence
atggcccacctgatgatgttcagagacgtggccgtggacttcagccaggaggagtgggagtgcctggacctggagcagagagacctgtacagagacgtgatgctggagaactacagcaacatggtgagcctgggcttctgcatctaccagcccgaggccttcagcctgctggagaagggcaaggagccctggaagatcctgagagacgagaccagaggcccctgccccgacatgcagagcagatgccagaccaagaagctgctgcccaagaacggcatcttcgagagagagatcgcccagctggagatcatgagaatctgcaagaaccacagcctggactgcctgtgcttcagaggcgactgggagggcaacacccagttccagaccctgcaggacaaccaggagtag

SEQ ID NO: 11061 - DNA, 150 bp, Artificial Sequence
  Description of Artificial Sequence: Synthetic coding sequence
atggcccacctgatgatgttcagagacgtggccgtggacttcagccaggaggagtgggagtgcctggacctggagcagagagacctgtacagagacgtgatgctggagaactacagcaacatggtgagcctgggcttctgcatctactag

SEQ ID NO: 11062 - DNA, 540 bp, Artificial Sequence
  Description of Artificial Sequence: Synthetic coding sequence
atggcccacctgatgatgttcagagacgtggccgtggacttcagccaggaggagtgggagtgcctggacctggagcagagagacctgtacagagacgtgatgctggagaactacagcaacatggtgagcctgggcttctgcatctaccagcccgaggccttcagcctgctggagaagggcaaggagccctggaagatcctgagagacgagaccagaggcccctgccccgacatgcagagcagatgccagaccaagaagctgctgcccaagaacggcatcttcgagagagagatcgcccagctggagatcatgagaatctgcaagaaccacagcctggactgcctgtgcttcagaggcgactgggagggcaacacccagttccagaccctgcaggacaaccaggaggagtgcttcaagcaggtgatcagaacctgcgagaagagacccaccttcaaccagcacaccgtgttcaacctgcaccagagactgaacaccggcgacaagctgaacgagttcaaggagctgggcaaggccttctag

SEQ ID NO: 11063 - DNA, 1731 bp, Artificial Sequence
  Description of Artificial Sequence: Synthetic coding sequence
atggacagcgtggccttcgaggacgtgagcgtgagcttcagccaggaggagtgggccctgctggcccccagccagaagaagctgtacagagacgtgatgcaggagaccttcaagaacctggccagcatcggcgagaagtgggaggaccccaacgtggaggaccagcacaagaaccagggcagaaacctgagaagccacaccggcgagagactgtgcgagggcaaggagggcagccagtgcgccgagaacttcagccccaacctgagcgtgaccaagaagaccgccggcgtgaagccctacgagtgcaccatctgcggcaaggccttcatgagactgagcagcctgaccagacacatgagaagccacaccggctacgagctgttcgagaagccctacaagtgcaaggagtgcgagaaggccttcagctacctgaagagcttccagagacacgagagaagccacaccggcgagaagccctacaagtgcaagcagtgcggcaagaccttcatctaccaccagcccttccagagacacgagagaacccacatcggcgagaagccctacgagtgcaagcagtgcggcaaggccctgagctgcagcagcagcctgagagtgcacgagagaatccacaccggcgagaagccctacgagtgcaagcagtgcggcaaggccttcagctgcagcagcagcatcagagtgcacgagagaacccacaccggcgagaagccctacgcctgcaaggagtgcggcaaggccttcatcagccacaccagcgtgctgacccacatgatcacccacaacggcgacagaccctacaagtgcaaggagtgcggcaaggccttcatcttccccagcttcctgagagtgcacgagagaatccacaccggcgagaagccctacaagtgcaagcagtgcggcaaggccttcagatgcagcaccagcatccagatccacgagagaatccacaccggcgagaagccctacaagtgcaaggagtgcggcaagagcttcagcgccagacccgccttcagagtgcacgtgagagtgcacaccggcgagaagccctacaagtgcaaggagtgcggcaaggccttcagcagaatcagctacttcagaatccacgagagaacccacaccggcgagaagccctacgagtgcaagaagtgcggcaagaccttcaactaccccctggacctgaagatccacaagagaaaccacaccggcgagaagccctacgagtgcaaggagtgcgccaagaccttcatcagcctggagaacttcagaagacacatgatcacccacaccggcgacggcccctacaagtgcagagactgcggcaaggtgttcatcttccccagcgccctgagaacccacgagagaacccacaccggcgagaagccctacgagtgcaagcagtgcggcaaggccttcagctgcagcagctacatcagaatccacaagagaacccacaccggcgagaagccctacgagtgcaaggagtgcggcaaggccttcatctaccccaccagcttccagggccacatgagaatgcacaccggcgagaagccctacaagtgcaaggagtgcggcaaggccttcagcctgcacagcagcttccagagacacaccagaatccacaactacgagaagcccctggagtgcaagcagtgcggcaaggccttcagcgtgagcaccagcctgaagaagcacatgagaatgcacaacagatag

SEQ ID NO: 11064 - DNA, 1434 bp, Artificial Sequence
  Description of Artificial Sequence: Synthetic coding sequence
atggacagcgtggccttcgaggacgtgagcgtgagcttcagccaggaggagtgggccctgctggcccccagccagaagaagctgtacagagacgtgatgcaggagaccttcaagaacctggccagcatcggcgagaagtgggaggaccccaacgtggaggaccagcacaagaaccagggcagaaacctgagaagccacaccggcgagagactgtgcgagggcaaggagggcagccagtgcgccgagaacttcagccccaacctgagcgtgaccaagaagaccgccggcgtgaagccctacgagtgcaccatctgcggcaaggccttcatgagactgagcagcctgaccagacacatgagaagccacaccggctacgagctgttcgagaagccctacaagtgcaaggagagcggcgagaagccctacaagtgcaagcagtgcggcaagaccttcatctaccaccagcccttccagagacacgagagaacccacatcggcgagaagccctacgagtgcaagcagtgcggcaaggccctgagctgcagcagcagcctgagagtgcacgagagaatccacaccggcgagaagccctacgagtgcaagcagtgcggcaaggccttcagctgcagcagcagcatcagagtgcacgagagaacccacaccggcgagaagccctacgcctgcaaggagtgcggcaaggccttcatcagccacaccagcgtgctgacccacatgatcacccacaacggcgacagaccctacaagtgcaaggagtgcggcaaggccttcatcttccccagcttcctgagagtgcacgagagaatccacaccggcgagaagccctacaagtgcaagcagtgcggcaaggccttcagatgcagcaccagcatccagatccacgagagaatccacaccggcgagaagccctacaagtgcaaggagtgcggcaagagcttcagcgccagacccgccttcagagtgcacgtgagagtgcacaccggcgagaagccctacaagtgcaaggagtgcggcaaggccttcagcagaatcagctacttcagaatccacgagagaacccacaccggcgagaagccctacgagtgcaagaagtgcggcaagaccttcaactaccccctggacctgaagatccacaagagaaaccacaccggcgagaagccctacgagtgcaaggactgcggcaaggtgttcatcttccccagcgccctgagaacccacgagagaacccacaccggcgagaagccctacgagtgcaagcagtgcggcaaggccttcagctgcagcagctacatcagaatccacaagagaacccacaccggcgagaagccctacgagtgcaaggagtgcggcaaggccttcatctaccccaccagcttccagggccacatgagaatgcacaccggcgagaagccctag

SEQ ID NO: 11065 - DNA, 1635 bp, Artificial Sequence
  Description of Artificial Sequence: Synthetic coding sequence
atgcaggagaccttcaagaacctggccagcatcggcgagaagtgggaggaccccaacgtggaggaccagcacaagaaccagggcagaaacctgagaagccacaccggcgagagactgtgcgagggcaaggagggcagccagtgcgccgagaacttcagccccaacctgagcgtgaccaagaagaccgccggcgtgaagccctacgagtgcaccatctgcggcaaggccttcatgagactgagcagcctgaccagacacatgagaagccacaccggctacgagctgttcgagaagccctacaagtgcaaggagtgcgagaaggccttcagctacctgaagagcttccagagacacgagagaagccacaccggcgagaagccctacaagtgcaagcagtgcggcaagaccttcatctaccaccagcccttccagagacacgagagaacccacatcggcgagaagccctacgagtgcaagcagtgcggcaaggccctgagctgcagcagcagcctgagagtgcacgagagaatccacaccggcgagaagccctacgagtgcaagcagtgcggcaaggccttcagctgcagcagcagcatcagagtgcacgagagaacccacaccggcgagaagccctacgcctgcaaggagtgcggcaaggccttcatcagccacaccagcgtgctgacccacatgatcacccacaacggcgacagaccctacaagtgcaaggagtgcggcaaggccttcatcttccccagcttcctgagagtgcacgagagaatccacaccggcgagaagccctacaagtgcaagcagtgcggcaaggccttcagatgcagcaccagcatccagatccacgagagaatccacaccggcgagaagccctacaagtgcaaggagtgcggcaagagcttcagcgccagacccgccttcagagtgcacgtgagagtgcacaccggcgagaagccctacaagtgcaaggagtgcggcaaggccttcagcagaatcagctacttcagaatccacgagagaacccacaccggcgagaagccctacgagtgcaagaagtgcggcaagaccttcaactaccccctggacctgaagatccacaagagaaaccacaccggcgagaagccctacgagtgcaaggagtgcgccaagaccttcatcagcctggagaacttcagaagacacatgatcacccacaccggcgacggcccctacaagtgcagagactgcggcaaggtgttcatcttccccagcgccctgagaacccacgagagaacccacaccggcgagaagccctacgagtgcaagcagtgcggcaaggccttcagctgcagcagctacatcagaatccacaagagaacccacaccggcgagaagccctacgagtgcaaggagtgcggcaaggccttcatctaccccaccagcttccagggccacatgagaatgcacaccggcgagaagccctacaagtgcaaggagtgcggcaaggccttcagcctgcacagcagcttccagagacacaccagaatccacaactacgagaagcccctggagtgcaagcagtgcggcaaggccttcagcgtgagcaccagcctgaagaagcacatgagaatgcacaacagatag

SEQ ID NO: 11066 - DNA, 1404 bp, Artificial Sequence
  Description of Artificial Sequence: Synthetic coding sequence
atgagactgagcagcctgaccagacacatgagaagccacaccggctacgagctgttcgagaagccctacaagtgcaaggagtgcgagaaggccttcagctacctgaagagcttccagagacacgagagaagccacaccggcgagaagccctacaagtgcaagcagtgcggcaagaccttcatctaccaccagcccttccagagacacgagagaacccacatcggcgagaagccctacgagtgcaagcagtgcggcaaggccctgagctgcagcagcagcctgagagtgcacgagagaatccacaccggcgagaagccctacgagtgcaagcagtgcggcaaggccttcagctgcagcagcagcatcagagtgcacgagagaacccacaccggcgagaagccctacgcctgcaaggagtgcggcaaggccttcatcagccacaccagcgtgctgacccacatgatcacccacaacggcgacagaccctacaagtgcaaggagtgcggcaaggccttcatcttccccagcttcctgagagtgcacgagagaatccacaccggcgagaagccctacaagtgcaagcagtgcggcaaggccttcagatgcagcaccagcatccagatccacgagagaatccacaccggcgagaagccctacaagtgcaaggagtgcggcaagagcttcagcgccagacccgccttcagagtgcacgtgagagtgcacaccggcgagaagccctacaagtgcaaggagtgcggcaaggccttcagcagaatcagctacttcagaatccacgagagaacccacaccggcgagaagccctacgagtgcaagaagtgcggcaagaccttcaactaccccctggacctgaagatccacaagagaaaccacaccggcgagaagccctacgagtgcaaggagtgcgccaagaccttcatcagcctggagaacttcagaagacacatgatcacccacaccggcgacggcccctacaagtgcagagactgcggcaaggtgttcatcttccccagcgccctgagaacccacgagagaacccacaccggcgagaagccctacgagtgcaagcagtgcggcaaggccttcagctgcagcagctacatcagaatccacaagagaacccacaccggcgagaagccctacgagtgcaaggagtgcggcaaggccttcatctaccccaccagcttccagggccacatgagaatgcacaccggcgagaagccctacaagtgcaaggagtgcggcaaggccttcagcctgcacagcagcttccagagacacaccagaatccacaactacgagaagcccctggagtgcaagcagtgcggcaaggccttcagcgtgagcaccagcctgaagaagcacatgagaatgcacaacagatag

SEQ ID NO: 11067 - DNA, 1035 bp, Artificial Sequence
  Description of Artificial Sequence: Synthetic coding sequence
ctggccgagcaccagaccacccaccccagacagaagcccttcgtgtgcgaggagagcggcgacgccttcaacaacaagagcaccctggtgcagcaccagagaatccacagcagagagagaccctacgagtgcagcaagtgcggcatcttcttcacctacgccgccgacctgacccagcaccagaaggtgcacaacagaggcaagccctacgagtgctgcgagtgcggcaagttcttcagccagcacagcagcctggtgaagcacagaagagtgcacaccggcgagagcccccacgtgtgcggcgactgcggcaagttcttcagcagaagcagcaacctgatccagcacaagagagtgcacaccggcgagaagccctacgagtgcagcgactgcggcaagttcttcagccagagaagcaacctgatccaccacaagagagtgcacaccggcagaagcgcccacgagtgcagcgagtgcggcaagagcttcaactgcaacagcagcctgatcaagcactggagagtgcacaccggcgagagaccctacaagtgcaacgagtgcggcaagttcttcagccacatcgccagcctgatccagcaccagatcgtgcacaccggcgagagaccccacggctgcggcgagtgcggcaaggccttcagcagaagcagcgacctgatgaagcaccagagagtgcacaccggcgagagaccctacgagtgcaacgagtgcggcaagctgttcagccagagcagcagcctgaacagccacagaagactgcacaccggcgagagaccctaccagtgcagcgagtgcggcaagttcttcaaccagagcagcagcctgaacaaccacagaagactgcacaccggcgagagaccctacgagtgcagcgagtgcggcaagaccttcagacagagaagcaacctgagacagcacctgaaggtgcacaagcccgacagaccctacgagtgcagcgagtgcggcaaggccttcaaccagagacccaccctgatcagacaccagaagatccactag

SEQ ID NO: 11068 - DNA, 1899 bp, Artificial Sequence
  Description of Artificial Sequence: Synthetic coding sequence
atggccgccgccgccctgagagaccccgcccagggctgcgtgaccttcgaggacgtgaccatctacttcagccaggaggagtgggtgctgctggacgaggcccagagactgctgtactgcgacgtgatgctggagaacttcgccctgatcgccagcctgggcctgatcagcttcagaagccacatcgtgagccagctggagatgggcaaggagccctgggtgcccgacagcgtggacatgaccagcgccatggccagaggcgcctacggcagacccggcagcgacttctgccacggcaccgagggcaaggacctgcccagcgagcacaacgtgagcgtggagggcgtggcccaggacagaagccccgaggccaccctgtgcccccagaagacctgcccctgcgacatctgcggcctgagactgaaggacatcctgcacctggccgagcaccagaccacccaccccagacagaagcccttcgtgtgcgaggcctacgtgaagggcagcgagttcagcgccaacctgcccagaaagcaggtgcagcagaacgtgcacaaccccatcagaaccgaggagggccaggccagccccgtgaagacctgcagagaccacaccagcgaccagctgagcacctgcagagagggcggcaaggacttcgtggccaccgccggcttcctgcagtgcgaggtgacccccagcgacggcgagccccacgaggccaccgagggcgtggtggacttccacatcgccctgagacacaacaagtgctgcgagagcggcgacgccttcaacaacaagagcaccctggtgcagcaccagagaatccacagcagagagagaccctacgagtgcagcaagtgcggcatcttcttcacctacgccgccgacctgacccagcaccagaaggtgcacaacagaggcaagccctacgagtgctgcgagtgcggcaagttcttcagccagcacagcagcctggtgaagcacagaagagtgcacaccggcgagagcccccacgtgtgcggcgactgcggcaagttcttcagcagaagcagcaacctgatccagcacaagagagtgcacaccggcgagaagccctacgagtgcagcgactgcggcaagttcttcagccagagaagcaacctgatccaccacaagagagtgcacaccggcagaagcgcccacgagtgcagcgagtgcggcaagagcttcaactgcaacagcagcctgatcaagcactggagagtgcacaccggcgagagaccctacaagtgcaacgagtgcggcaagttcttcagccacatcgccagcctgatccagcaccagatcgtgcacaccggcgagagaccccacggctgcggcgagtgcggcaaggccttcagcagaagcagcgacctgatgaagcaccagagagtgcacaccggcgagagaccctacgagtgcaacgagtgcggcaagctgttcagccagagcagcagcctgaacagccacagaagactgcacaccggcgagagaccctaccagtgcagcgagtgcggcaagttcttcaaccagagcagcagcctgaacaaccacagaagactgcacaccggcgagagaccctacgagtgcagcgagtgcggcaagaccttcagacagagaagcaacctgagacagcacctgaaggtgcacaagcccgacagaccctacgagtgcagcgagtgcggcaaggccttcaaccagagacccaccctgatcagacaccagaagatccacatcagagagagaagcatggagaacgtgctgctgccctgcagccagcacacccccgagatcagcagcgagaacagaccctaccagggcgccgtgaactacaagctgaagctggtgcaccccagcacccaccccggcgaggtgccctag

SEQ ID NO: 11069 - DNA, 1836 bp, Artificial Sequence
  Description of Artificial Sequence: Synthetic coding sequence
atgcaggagaccatcagaaacctggactgcgtgggcatgaagtggaaggaccagaacatcgaggaccagtacagataccccagaaagaacctgagatgcagaatgctggagagattcgtggagagcaaggacggcacccagtgcggcgagaccagcagccagatccaggacagcatcgtgaccaagaacaccctgcccggcgtgggcccctacgagagcagaatgagcggcgaggtgatcatgggccacagcagcctgaactgctacatcagagtgggcgccggccacaagccctacgagtaccacgagtgcggcgagaagcccgacacccacaagcagagaggcaaggccttcagctaccacaacagcctgcagacccacgagagactgcacaccggcaagaagccctacaactgcaaggagtgcggcaagagcttcagcagcctgggcaacctgcagagacacatggccgtgcagagaggcgacggcccctacaagtgcaagctgtgcggcaaggccttcttctggcccagcctgctgcacatgcacgagagaacccacaccggcgagaagccctacgagtgcaagcagtgcagcaaggccttcagcttctacagcagctacctgagacacgagagaacccacaccggcgagaagctgtacgagtgcaagcagtgcagcaaggccttccccgactacagcagctgcctgagacacgagagaacccacaccggcaagaagccctacacctgcaagcagtgcggcaaggccttcagcgccagcaccagcctgagaagacacgagaccacccacaccgacgagaagccctacgcctgccagcagtgcggcaaggccttccaccacctgggcagcttccagagacacatggtgatgcacaccagagacggcccccacaagtgcaagatctgcggcaagggcttcgactgccccagcagcctgaagagccacgagagaacccacaccggcgagaagctgtacgagtgcaagcagtgcggcaaggccctgagccacagcagcagcttcagaagacacatgaccatgcacaccggcgacggcccccacaagtgcaagatctgcggcaaggccttcgtgtaccccagcgtgttccagagacacgagaagacccacaccgccgagaagccctacaagtgcaagcagtgcggcaaggcctacagaatcagcagcagcctgagaagacacgagaccacccacaccggcgagaagccctacaagtgcaagtgcggcaaggccttcatcgacttctacagcttccagaaccacaagaccacccacgccggcgagaagccctacgagtgcaaggagtgcggcaaggccttcagctgcttccagtacctgagccagcacagaagaacccacaccggcgagaagccctacgagtgcaacacctgcaagaaggccttcagccacttcggcaacctgaaggtgcacgagagaatccacagcggcgagaagccctacgagtgcaaggagtgcggcaaggccttcagctggctgacctgcttcctgagacacgagagaatccacatgagagagaagccctacgagtgccagcagtgcggcaaggccttcacccacagcagattcctgcagggccacgagaagacccacaccggcgagaacccctacgagtgcaaggagtgcggcaaggccttcgccagcctgagcagcctgcacagacacaagaagacccactggaagaagacccacaccggcgagaacccctacggctgcaaggagtgcggcaaggccttcgccagcctgagcagcctgcacagacacaagaagacccactag

SEQ ID NO: 11070 - DNA, 1932 bp, Artificial Sequence
  Description of Artificial Sequence: Synthetic coding sequence
atggccagcgtggccctggaggacgtggccgtgaacttcaccagagaggagtgggccctgctgggcccctgccagaagaacctgtacaaggacgtgatgcaggagaccatcagaaacctggactgcgtgggcatgaagtggaaggaccagaacatcgaggaccagtacagataccccagaaagaacctgagatgcagaatgctggagagattcgtggagagcaaggacggcacccagtgcggcgagaccagcagccagatccaggacagcatcgtgaccaagaacaccctgcccggcgtgggcccctacgagagcagaatgagcggcgaggtgatcatgggccacagcagcctgaactgctacatcagagtgggcgccggccacaagccctacgagtaccacgagtgcggcgagaagcccgacacccacaagcagagaggcaaggccttcagctaccacaacagcctgcagacccacgagagactgcacaccggcaagaagccctacaactgcaaggagtgcggcaagagcttcagcagcctgggcaacctgcagagacacatggccgtgcagagaggcgacggcccctacaagtgcaagctgtgcggcaaggccttcttctggcccagcctgctgcacatgcacgagagaacccacaccggcgagaagccctacgagtgcaagcagtgcagcaaggccttcagcttctacagcagctacctgagacacgagagaacccacaccggcgagaagctgtacgagtgcaagcagtgcagcaaggccttccccgactacagcagctgcctgagacacgagagaacccacaccggcaagaagccctacacctgcaagcagtgcggcaaggccttcagcgccagcaccagcctgagaagacacgagaccacccacaccgacgagaagccctacgcctgccagcagtgcggcaaggccttccaccacctgggcagcttccagagacacatggtgatgcacaccagagacggcccccacaagtgcaagatctgcggcaagggcttcgactgccccagcagcctgaagagccacgagagaacccacaccggcgagaagctgtacgagtgcaagcagtgcggcaaggccctgagccacagcagcagcttcagaagacacatgaccatgcacaccggcgacggcccccacaagtgcaagatctgcggcaaggccttcgtgtaccccagcgtgttccagagacacgagaagacccacaccgccgagaagccctacaagtgcaagcagtgcggcaaggcctacagaatcagcagcagcctgagaagacacgagaccacccacaccggcgagaagccctacaagtgcaagtgcggcaaggccttcatcgacttctacagcttccagaaccacaagaccacccacgccggcgagaagccctacgagtgcaaggagtgcggcaaggccttcagctgcttccagtacctgagccagcacagaagaacccacaccggcgagaagccctacgagtgcaacacctgcaagaaggccttcagccacttcggcaacctgaaggtgcacgagagaatccacagcggcgagaagccctacgagtgcaaggagtgcggcaaggccttcagctggctgacctgcttcctgagacacgagagaatccacatgagagagaagccctacgagtgccagcagtgcggcaaggccttcacccacagcagattcctgcagggccacgagaagacccacaccggcgagaacccctacgagtgcaaggagtgcggcaaggccttcgccagcctgagcagcctgcacagacacaagaagacccactggaagaagacccacaccggcgagaacccctacggctgcaaggagtgcggcaaggccttcgccagcctgagcagcctgcacagacacaagaagacccactag

SEQ ID NO: 11071 - DNA, 1995 bp, Artificial Sequence
  Description of Artificial Sequence: Synthetic coding sequence
atgcccctgagagacaagtactgccagaccgaccaccaccaccacggctgctgcgagcccgtgtacatcctggagcccggcgacccccccctgctgcagcagcccctgcagaccagcaagagcggcatccagcagatcatcgagtgcttcagaagcggcaccaagcagctgaagcacatcctgctgaaggacgtggacaccatcttcgagtgcaagctgtgcagaagcctgttcagaggcctgcccaacctgatcacccacaagaagttctactgcccccccagcctgcagatggacgacaacctgcccgacgtgaacgacaagcagagccaggccatcaacgacctgctggaggccatctaccccagcgtggacaagagagagtacatcatcaagctggagcccatcgagaccaaccagaacgccgtgttccagtacatcagcagaaccgacaaccccatcgaggtgaccgagagcagcagcacccccgagcagaccgaggtgcagatccaggagaccagcaccgagcagagcaagaccgtgcccgtgaccgacaccgaggtggagaccgtggagcccccccccgtggagatcgtgaccgacgaggtggcccccaccagcgacgagcagccccaggagagccaggccgacctggagaccagcgacaacagcgacttcggccaccagctgatctgctgcctgtgcagaaaggagttcaacagcagaagaggcgtgagaagacacatcagaaaggtgcacaagaagaagatggaggagctgaagaagtacatcgagaccagaaagaaccccaaccagagcagcaagggcagaagcaagaacgtgctggtgcccctgagcagaagctgccccgtgtgctgcaagagcttcgccaccaaggccaacgtgagaagacacttcgacgaggtgcacagaggcctgagaagagacagcatcacccccgacatcgccaccaagcccggccagcccctgttcctggacagcatcagccccaagaagagcttcaagaccagaaagcagaagagcagcagcaaggccgagtacaacctgaccgcctgcaagtgcctgctgtgcaagagaaagtacagcagccagatcatgctgaagagacacatgcagatcgtgcacaagatcaccctgagcggcaccaacagcaagagagagaagggccccaacaacaccgccaacagcagcgagatcaaggtgaaggtggagcccgccgacagcgtggagagcagcccccccagcatcacccacagcccccagaacgagctgaagggcaccaaccacagcaacgagaagaagaacacccccgccgcccagaagaacaaggtgaagcaggacagcgagagccccaagagcaccagccccagcgccgccggcggccagcagaagaccagaaagcccaagctgagcgccggcttcgacttcaagcagctgtactgcaagctgtgcaagagacagttcaccagcaagcagaacctgaccaagcacatcgagctgcacaccgacggcaacaacatctacgtgaagttctacaagtgccccctgtgcacctacgagaccagaagaaagagagacgtgatcagacacatcaccgtggtgcacaagaagagcagcagatacctgggcaagatcaccgccagcctggagatcagagccatcaagaagcccatcgacttcgtgctgaacaaggtggccaagagaggccccagcagagacgaggccaagcacagcgacagcaagcacgacggcaccagcaacagccccagcaagaagtacgaggtggccgacgtgggcatcgaggtgaaggtgaccaagaacttcagcctgcacagatgcaacaagtgcggcaaggccttcgccaagaagacctacctggagcaccacaagaagacccacaaggccaacgccagcaacagccccgagggcaacaagaccaagggcagaagcaccagaagcaaggccctggtgtag

SEQ ID NO: 11072 - DNA, 1995 bp, Artificial Sequence; identical to SEQ ID NO: 11071
  Description of Artificial Sequence: Synthetic coding sequence

SEQ ID NO: 11073 - DNA, 1995 bp, Artificial Sequence; identical to SEQ ID NO: 11071
  Description of Artificial Sequence: Synthetic coding sequence

SEQ ID NO: 11074 - DNA, 729 bp, Artificial Sequence
  Description of Artificial Sequence: Synthetic coding sequence
atgcccctgagagacaagtactgccagaccgaccaccaccaccacggctgctgcgagcccgtgtacatcctggagcccggcgacccccccctgctgcagcagcccctgcagaccagcaagagcggcatccagcagatcatcgagtgcttcagaagcggcaccaagcagctgaagcacatcctgctgaaggacgtggacaccatcttcgagtgcaagctgtgcagaagcctgttcagaggcctgcccaacctgatcacccacaagaagttctactgcccccccagcctgcagatggacgacaacctgcccgacgtgaacgacaagcagagccaggccatcaacgacctgctggaggccatctaccccagcgtggacaagagagagtacatcatcaagctggagcccatcgagaccaaccagaacgccgtgttccagtacatcagcagaaccgacaaccccatcgaggtgaccgagagcagcagcacccccgagcagaccgaggtgcagatccaggagaccagcaccgagcagagcaagaccgtgcccgtgaccgacaccgaggtggagaccgtggagcccccccccgtggagatcgtgaccgacgaggtggcccccaccagcgacgagcagccccaggagagccaggccgacctggagaccagcgacaacagcgacttcggccaccagctgatctgctgcctgtgcagaaaggagttcaacagcagatag

SEQ ID NO: 11075 - DNA, 393 bp, Artificial Sequence
  Description of Artificial Sequence: Synthetic coding sequence
atgcccctgagagacaagtactgccagaccgaccaccaccaccacggctgctgcgagcccgtgtacatcctggagcccggcgacccccccctgctgcagcagcccctgcagaccagcaagagcggcatccagcagatcatcgagtgcttcagaagcggcaccaagcagctgaagcacatcctgctgaaggacgtggacaccatcttcgagtgcaagctgtgcagaagcctgttcagaggcctgcccaacctgatcacccacaagaagttctactgcccccccagcctgcagatggacgacaacctgcccgacgtgaacgacaagcagagccaggccatcaacgacctgctggaggccatctaccccagcgtggacaagagagagtacatctag

SEQ ID NO: 11076 - DNA, 297 bp, Artificial Sequence
  Description of Artificial Sequence: Synthetic coding sequence
atgcccctgagagacaagtactgccagaccgaccaccaccaccacggctgctgcgagcccgtgtacatcctggagcccggcgacccccccctgctgcagcagcccctgcagaccagcaagagcggcatccagcagatcatcgagtgcttcagaagcggcaccaagcagctgaagcacatcctgctgaaggacgtggacaccatcttcgagtgcaagctgtgcagaagcctgttcagaggcctgcccaacctgatcacccacaagaagttctactgcccccccagcctgcagatgtag

SEQ ID NO: 11077 - DNA, 1485 bp, Artificial Sequence
  Description of Artificial Sequence: Synthetic coding sequence
atgcagggcgagagactgagacccggcctggacagccagaaggagaagctgcccggcaagatgagccccaagcacgacggcctgggcaccgccgacagcgtgtgcagcagaatcatccaggacagagtgagcctgggcgacgacgtgcacgactgcgacagccacggcagcggcaagaaccccgtgatccaggaggaggagaacatcttcaagtgcaacgagtgcgagaaggtgttcaacaagaagagactgctggccagacacgagagaatccacagcggcgtgaagccctacgagtgcaccgagtgcggcaagaccttcagcaagagcacctacctgctgcagcaccacatggtgcacaccggcgagaagccctacaagtgcatggagtgcggcaaggccttcaacagaaagagccacctgacccagcaccagagaatccacagcggcgagaagccctacaagtgcagcgagtgcggcaaggccttcacccacagaagcaccttcgtgctgcacaacagaagccacaccggcgagaagcccttcgtgtgcaaggagtgcggcaaggccttcagagacagacccggcttcatcagacactacatcatccacagcggcgagaacccctacgagtgcttcgagtgcggcaaggtgttcaagcacagaagctacctgatgtggcaccagcagacccacaccggcgagaagccctacgagtgcagcgagtgcggcaaggccttctgcgagagcgccgccctgatccaccactacgtgatccacaccggcgagaagcccttcgagtgcctggagtgcggcaaggccttcaaccacagaagctacctgaagagacaccagagaatccacaccggcgagaagccctacgtgtgcagcgagtgcggcaaggccttcacccactgcagcaccttcatcctgcacaagagagcccacaccggcgagaagcccttcgagtgcaaggagtgcggcaaggccttcagcaacagagccgacctgatcagacacttcagcatccacaccggcgagaagccctacgagtgcatggagtgcggcaaggccttcaacagaagaagcggcctgaccagacaccagagaatccacagcggcgagaagccctacgagtgcatcgagtgcggcaagaccttctgctggagcaccaacctgatcagacacagcatcatccacaccggcgagaagccctacgagtgcagcgagtgcggcaaggccttcagcagaagcagcagcctgacccagcaccagagaatgcacaccggcagaaaccccatcagcgtgaccgacgtgggcagacccttcaccagcggccagaccagcgtgaacatccaggagctgctgctgggcaagaacttcctgaacgtgaccaccgaggagaacctgctgcaggaggaggccagctacatggccagcgacagaacctaccagagagagaccccccaggtgagcagcctgtag

SEQ ID NO: 11078 - DNA, 1884 bp, Artificial Sequence
  Description of Artificial Sequence: Synthetic coding sequence
atggccatggccctgaccgaccccgcccaggtgagcgtgaccttcgacgacgtggccgtgaccttcacccaggaggagtggggccagctggacctggcccagagaaccctgtaccaggaggtgatgctggagaactgcggcctgctggtgagcctgggctgccccgtgcccagacccgagctgatctaccacctggagcacggccaggagccctggaccagaaaggaggacctgagccagggcacctgccccggcgacaagggcaagcccaagagcaccgagcccaccacctgcgagctggccctgagcgagggcatcagcttctggggccagctgacccagggcgccagcggcgacagccagctgggccagcccaaggaccaggacggcttcagcgagatgcagggcgagagactgagacccggcctggacagccagaaggagaagctgcccggcaagatgagccccaagcacgacggcctgggcaccgccgacagcgtgtgcagcagaatcatccaggacagagtgagcctgggcgacgacgtgcacgactgcgacagccacggcagcggcaagaaccccgtgatccaggaggaggagaacatcttcaagtgcaacgagtgcgagaaggtgttcaacaagaagagactgctggccagacacgagagaatccacagcggcgtgaagccctacgagtgcaccgagtgcggcaagaccttcagcaagagcacctacctgctgcagcaccacatggtgcacaccggcgagaagccctacaagtgcatggagtgcggcaaggccttcaacagaaagagccacctgacccagcaccagagaatccacagcggcgagaagccctacaagtgcagcgagtgcggcaaggccttcacccacagaagcaccttcgtgctgcacaacagaagccacaccggcgagaagcccttcgtgtgcaaggagtgcggcaaggccttcagagacagacccggcttcatcagacactacatcatccacagcggcgagaacccctacgagtgcttcgagtgcggcaaggtgttcaagcacagaagctacctgatgtggcaccagcagacccacaccggcgagaagccctacgagtgcagcgagtgcggcaaggccttctgcgagagcgccgccctgatccaccactacgtgatccacaccggcgagaagcccttcgagtgcctggagtgcggcaaggccttcaaccacagaagctacctgaagagacaccagagaatccacaccggcgagaagccctacgtgtgcagcgagtgcggcaaggccttcacccactgcagcaccttcatcctgcacaagagagcccacaccggcgagaagcccttcgagtgcaaggagtgcggcaaggccttcagcaacagagccgacctgatcagacacttcagcatccacaccggcgagaagccctacgagtgcatggagtgcggcaaggccttcaacagaagaagcggcctgaccagacaccagagaatccacagcggcgagaagccctacgagtgcatcgagtgcggcaagaccttctgctggagcaccaacctgatcagacacagcatcatccacaccggcgagaagccctacgagtgcagcgagtgcggcaaggccttcagcagaagcagcagcctgacccagcaccagagaatgcacaccggcagaaaccccatcagcgtgaccgacgtgggcagacccttcaccagcggccagaccagcgtgaacatccaggagctgctgctgggcaagaacttcctgaacgtgaccaccgaggagaacctgctgcaggaggaggccagctacatggccagcgacagaacctaccagagagagaccccccaggtgagcagcctgtag

SEQ ID NO: 11079 - DNA, 1485 bp, Artificial Sequence; identical to SEQ ID NO: 11077
  Description of Artificial Sequence: Synthetic coding sequence

SEQ ID NO: 11080 - DNA, 153 bp, Artificial Sequence
  Description of Artificial Sequence: Synthetic coding sequence
gcccccctgctgagctgcatcaccggcgccaccctggagaccctgtgcgtgcagagagtgaaggccttcagagacagacccggcttcatcagacactacatcatccacagcggcgagaacccctacgagtgcttcgagtgcggcaaggtgtag

SEQ ID NO: 11081 - DNA, 2712 bp, Artificial Sequence
  Description of Artificial Sequence: Synthetic coding sequence
atgctgagagaggaggccgcccagaagagaaagggcaaggagagcggcatggccctgccccagggcagactgaccttcagagacgtggccatcgagttcagcctggccgagtggaagttcctgaaccccgcccagagagccctgtacagagaggtgatgctggagaactacagaaacctggaggccgtggacatcagcagcaagcacatgatgaaggaggtgctgagcaccggccagggcaacagagaggtgatccacaccggcaccctgcagagacaccagagctaccacatcggcgacttctgcttccaggagatcgagaaggagatccacaacatcgagttccagtgccaggaggacgagagaaacggccacgaggcccccaccaccaagatcaagaagctgaccggcagcaccgaccagcacgaccacagacacgccggcaacaagcccatcaaggaccagctgggcagcagcttctacagccacctgcccgagctgcacatcttccagatcaagggcgagatcgccaaccagctggagaagagcaccagcgacgccagcagcgtgagcaccagccagagaatcagctgcagaccccagatccacatcagcaacaactacggcaacaaccccctgaacagcagcctgctgccccagaagcaggaggtgcacatgagagagaagagcttcccctgcaacgagagcggcaaggccttcaactgcagcagcctgctgagaaagcaccagatcccccacctgggcgacaagcagtacaagtgcgacgtgtgcggcaagctgttcaaccacaagcagtacctggcctgccacagaagatgccacaccggcgagaagccctacaagtgcaaggagtgcggcaagagcttcagctacaagagcagcctgacctgccaccacagactgcacaccggcgtgaagccctacaagtgcaacgagtgcggcaaggtgttcagacagaacagcgccctggtgatccacaaggccatccacaccggcgagaagccctacaagtgcaacgagtgcggcaaggccttcaaccagcagagccacctgagcagacaccagagactgcacaccggcgtgaagccctacaagtgcaagatctgcgagaaggccttcgcctgccacagctacctggccaaccacaccagaatccacagcggcgagaagacctacaagtgcaacgagtgcggcaaggccttcaaccaccagagcagcctggccagacaccacatcctgcacaccggcgagaagccctacaagtgcgaggagtgcgacaaggtgttcagccagaagagcaccctggagagacacaagagaatccacaccggcgagaagccctacaagtgcaaggtgtgcgacaccgccttcacctgcaacagccagctggccagacacagaagaatccacaccggcgagaagacctacaagtgcaacgagtgcagaaagaccttcagcagaagaagcagcctgctgtgccacagaagactgcacagcggcgagaagccctacaagtgcaaccagtgcggcaacaccttcagacacagagccagcctggtgtaccacagaagactgcacaccctggagaagagctacaagtgcaccgtgtgcaacaaggtgttcatgagaaacagcgtgctggccgtgcacaccagaatccacaccgccaagaagccctacaagtgcaacgagtgcggcaaggccttcaaccagcagagccacctgagcagacacagaagactgcacaccggcgagaagccctacaagtgcgaggcctgcgacaaggtgttcggccagaagagcgccctggagagccacaagagaatccacaccggcgagaagccctacagatgccaggtgtgcgacaccgccttcacctggaacagccagctggccagacacaccagaatccacaccggcgagaagacctacaagtgcaacgagtgcggcaagaccttcagctacaagagcagcctggtgtggcacagaagactgcacggcggcgagaagagctacaagtgcaaggtgtgcgacaaggccttcgtgtgcagaagctacgtggccaagcacaccagaatccacagcggcatgaagccctacaagtgcaacgagtgcagcaagaccttcagcaacagaagcagcctggtgtgccacagaagaatccacagcggcgagaagccctacaagtgcagcgagtgcagcaagaccttcagccagaaggccaccctgctgtgccacagaagactgcacagcggcgagaagccctacaagtgcaacgactgcggcaacaccttcagacactggagcagcctggtgtaccacagaagactgcacaccggcgagaagagctacaagtgcaccgtgtgcgacaaggccttcgtgagaaacagctacctggccagacacatcagaatccacaccgccgagaagccctacaagtgcaacgagtgcggcaaggccttcaacgagcagagccacctgagcagacaccacagaatccacaccggcgagaagccctacaagtgcgaggcctgcgacaaggtgttcagcagaaagagccacctgaagagacacagaatcatccacaccggcgagaagccctacaagtgcaacgagtgcggcaaggccttcagcgacagaagcaccctgatccaccaccaggccatccacggcatcggcaagttcgactag

SEQ ID NO: 11082 - DNA, 1854 bp, Artificial Sequence
  Description of Artificial Sequence: Synthetic coding sequence
atggccctgccccagggcctgctgaccttcagagacgtggccatcgagttcagccaggaggagtggaagtgcctggaccccgcccagagaaccctgtacagagacgtgatgctggagaactacagaaacctggtgagcctggacatcagcagcaagtgcatgatgaaggagttcagcagcaccgcccagggcaacagagaggtgatccacaccggcaccctgcagagacacgagagccaccacaccggcgacttcagattccaggagatcgacaaggacatccacaacctggagttccagtggcaggaggacgagagaaacagccacgaggcccccatgaccgagatcaagaagctgaccggcagcgccgacagatacgaccagagacacgccggcaacaagcccatcaaggaccagctgggcagcagcttccacagccacctgcccgagctgcacatgttccagacccagggcaagatcggcaaccaggtggagaagagcatcaacgacgccagcagcatcagcaccagccagagaatcagctgcagacccaagacccacatcagcaacaactacggcaacaacttcagaaacagcagcctgctgacccagaagcaggaggtgcacatgagagagaagagcttccagtgcaacgagagcggcaaggccttcaactacagcagcctgctgagaaagcaccagatcatccacctgggcgagaagcagtacaagtgcgacgtgtgcggcaaggtgttcaacagaaagagaaacctggtgtgccacagaagatgccacaccggcgagaagccctacagatgcaacgagtgcggcaagaccttcagccagacctacagcctgacctgccacagaagactgcacaccggcgagaagccctacaagtgcgaggagtgcgacaaggccttcagcttcaagagcaacctgaagagacacagaagaatccacgccggcgagaagccctacaagtgcaacgagtgcggcaagaccttcagccagaccagcagcctgacctgccacagaagactgcacaccggcgagaagcccttcaagtgcaacgagtgcggcaagaccttcagcagaaagagcagcctgacctgccaccacagactgcacaccggcgagaagccctacaagtgcaacgagtgcggcaagaccttcagccaggagctgaccctgaagtgccacagaagactgcacaccggcgagaagccctacaagtgcaacgagtgcggcaaggtgttcaacaagaaggccaacctggccagacaccacagactgcacagcggcgagaagccctacaagtgcaccgagtgcgtgaagaccttcagcagaaacagcgccctggtgatccacaaggccatccacatcggcgagaagagatacaagtgcaacgagtgcggcaagaccttcagcagaatcagcgccctggtgatccacaccgccatccacaccggcgagaagccctacaagtgcaacgagtgcggcaagggcttcaacagaaagacccacctggcctgccaccacagactgcacaccggcgagaagccctacaagtgcaacgagtgcggcaaggtgttcaacagaaagacccacctggcccaccaccacagactgcacaccggcgacaagccctacaagtgcaacgagtgcggcaaggtgttcaaccagaaggcccacctggccagacaccacagactgcacaccggcgagaagccctacaagtgcaacgagtgcggcaaggtgttcaaccagaaggccaacctggccagacaccacagactgcacaccggcgagaagccctacaagttcaacgagtgcggcaaggccttcaactag

SEQ ID NO: 11083 - DNA, 183 bp, Artificial Sequence
  Description of Artificial Sequence: Synthetic coding sequence
atggccctgccccagggcctgctgaccttcagagacgtggccatcgagttcagccaggaggagtggaagtgcctggaccccgcccagagaaccctgtacagagacgtgatgctggagaactacagaaacctggtgagcctggagctgagcggcgagtgccccctggccgcccccgccagctag

SEQ ID NO: 11084 - DNA, 1956 bp, Artificial Sequence
  Description of Artificial Sequence: Synthetic coding sequence
atgctgagagaggaggccaccaagaagagcaaggagaaggagcccggcatggccctgccccagggcagactgaccttcagagacgtggccatcgagttcagcctggaggagtggaagtgcctgaaccccgcccagagagccctgtacagagccgtgatgctggagaactacagaaacctggagttcgtggacagcagcctgaagagcatgatggagttcagcagcaccagacacagcatcaccggcgaggtgatccacaccggcaccctgcagagacacaagagccaccacatcggcgacttctgcttccccgagatgaagaaggacatccaccacttcgagttccagtggcaggaggtggagagaaacggccacgaggcccccatgaccaagatcaagaagctgaccggcagcaccgacagaagcgaccacagacacgccggcaacaagcccatcaaggaccagctgggcctgagcttccacagccacctgcccgagctgcacatgttccagaccaagggcaagatcagcaaccagctggacaagagcatcggcgccagcagcgccagcgagagccagagaatcagctgcagactgaagacccacatcagcaacaagtacggcaagaacttcctgcacagcagcttcacccagatccaggagatctgcatgagagagaagccctgccagagcaacgagtgcggcaaggccttcaactacagcagcctgctgagaagacaccacatcacccacagcagagagagagagtacaagtgcgacgtgtgcggcaagatcttcaaccagaagcagtacatcgtgtaccaccacagatgccacaccggcgagaagacctacaagtgcaacgagtgcggcaagaccttcacccagatgagcagcctggtgtgccacagaagactgcacaccggcgagaagccctacaagtgcaacgagtgcggcaagaccttcagcgagaagagcagcctgagatgccacagaagactgcacaccggcgagaagccctacaagtgcaacgagtgcggcaagaccttcggcagaaacagcgccctggtgatccacaaggccatccacaccggcgagaagccctacaagtgcaacgagtgcggcaagaccttcagccagaagagcagcctgcagtgccaccacatcctgcacaccggcgagaagccctacaagtgcgaggagtgcgacaacgtgtacatcagaagaagccacctggagagacacagaaagatccacaccggcgagggcagctacaagtgcaaggtgtgcgacaaggtgttcagaagcgacagctacctggccgagcaccagagagtgcacaccggcgagaagccctacaagtgcaacaagtgcggcagaagcttcagcagaaagagcagcctgcagtaccaccacaccctgcacaccggcgagaagccctacacctgcaacgagtgcggcaaggtgttcagcagaagagagaacctggccagacaccacagactgcacgccggcgagaagccctacaagtgcgaggagtgcgacaaggtgttcagcagaagaagccacctggagagacacagaagaatccacaccggcgagaagccctacaagtgcaaggtgtgcgacaaggccttcagaagcgacagctgcctggccaaccacaccagagtgcacaccggcgagaagccctacaagtgcaacaagtgcgccaaggtgttcaaccagaagggcatcctggcccagcaccagagagtgcacaccggcgagaagccctacaagtgcaacgagtgcggcaaggtgttcaaccagaaggccagcctggccaagcaccagagagtgcacaccgccgagaagccctacaagtgcaacgagtgcggcaaggccttcaccggccagagcaccctgatccaccaccaggccatccacggctgcagagagaccctgcagatgtag

SEQ ID NO: 11085 - DNA, 702 bp, Artificial Sequence
  Description of Artificial Sequence: Synthetic coding sequence
atgctgagagaggaggccaccaagaagagcaaggagaaggagcccggcatggccctgccccagggcagactgaccttcagagacgtggccatcgagttcagcctggaggagtggaagtgcctgaaccccgcccagagagccctgtacagagccgtgatgctggagaactacagaaacctggagttcgtggacatcagcagcaagtgcatgatgaaggagttcagcagcaccgcccagggcaacaccgaggtgatccacaccggcaccctgcagagacacgagagccaccacatcagagacttctgcttccaggagatcgagaaggacatccacaacttcgagttccagtggcaggaggaggagagaaacggccacgaggcccccatgaccgagatcaaggagctgaccggcagcaccgacagacacgaccagagacacgccggcaacaagcccatcaaggaccagctgggcagcagcttccacagccacctgcccgagctgcacatcttccagcccgagtggaagatcggcaaccaggtggagaagagcatcatcaacgccagcctgatcctgaccagccagagaatcagctgcagccccaagaccagaatcagcaacaactacggcaacaacagcctgcacagcagcctgcccatccagaagctgggcagcacccacgagagaaagatcttccccatgtag

SEQ ID NO: 11086 - DNA, 1956 bp, Artificial Sequence; identical to SEQ ID NO: 11084
  Description of Artificial Sequence: Synthetic coding sequence

SEQ ID NO: 11087 - DNA, 345 bp, Artificial Sequence
  Description of Artificial Sequence: Synthetic coding sequence
atgctgagagaggaggccaccaagaagagcaaggagaaggagcccggcatggccctgccccagggcagactgaccttcagagacgtggccatcgagttcagcctggaggagtggaagtgcctgaaccccgcccagagagccctgtacagagccgtgatgctggagaactacagaaacctggagttcgtggacagcagcctgaagagcatgatggagttcagcagcaccagacacagcatcaccggcgaggtgatccacaccggcaccctgcagagacacaagagccaccacatcggcgacttctgcttccccgagatgaagaaggacatccaccacttcgagtag

SEQ ID NO: 11088 - DNA, 495 bp, Artificial Sequence
  Description of Artificial Sequence: Synthetic coding sequence
atgatgaaggagttcagcagcaccgcccagggcaacaccgaggtgatccacaccggcaccctgcagagacacgagagccaccacatcagagacttctgcttccaggagatcgagaaggacatccacaacttcgagttccagtggcaggaggaggagagaaacggccacgaggcccccatgaccgagatcaaggagctgaccggcagcaccgacagacacgaccagagacacgccggcaacaagcccatcaaggaccagctgggcagcagcttccacagccacctgcccgagctgcacatcttccagcccgagtggaagatcggcaaccaggtggagaagagcatcatcaacgccagcctgatcctgaccagccagagaatcagctgcagccccaagaccagaatcagcaacaactacggcaacaacagcctgcacagcagcctgcccatccagaagctgggcagcacccacgagagaaagatcttccccatgtag

SEQ ID NO: 11089 - DNA, 1599 bp, Artificial Sequence
  Description of Artificial Sequence: Synthetic coding sequence
atggccctgagaagcgtgatgttcagcgacgtgagcatcgacttcagccccgaggagtgggagtacctggacctggagcagaaggacctgtacagagacgtgatgctggagaactacagcaacctggtgagcctgggctgcttcatcagcaagcccgacgtgatcagcagcctggagcagggcaaggagccctggaaggtggtgagaaagggcagaagacagtaccccgacctggagaccaagtacgagaccaagaagctgagcctggagaacgacatctacgagatcaacctgagccagtggaagatcatggagagaatcgagaaccacggcctgaagggcctgatcctgaagaacgactgggagagcaccggcaagatcgagggccaggagagaccccaggagggctacttcagcagcgtgaagatgcccagcgagaaggtgagcagctaccagaagagaaccagcgtgaccccccaccagagactgcacttcgtggacaagccctacgagtgcaaggagtgcggcaaggccttcagagtgagacagcagctgaccttccaccacagaatccacaccggcgagaagccctacgagtgcaaggagtgcggcatggccttcagacagaccgcccacctgaccagacaccagagactgcacagcggcgagaagctgtacgagtgcaaggagtgcggcgaggccttcatctgcggcgccgacctgagagtgcaccagaagatgcacatcggcgagaagccctacgagtgcaaggagtgcggcaaggccttcagagtgagaggccagctgaccctgcaccagagaatccacaccggcgagaagccctacgtgtgcaaggagtgcggcaaggccttcagacagtacgcccacctgaccagacaccagaagctgaacagcgccgacagactgtacgagtgcaaggagtgcggcaaggccttcctgtgcggcagcggcctgagagtgcaccacaagctgcacaccggcgagaagccctacgagtgcaaggagtgcggcaaggccttcagagtgagacagcagctgaccctgcaccagagaatccacaccggcgagaagccctacgagtgcaaggagtgcggcaagaccttcagcagaggctaccacctgatcctgcaccacagaatccacaccggcgagaagccctacgagtgcaaggagtgctggaaggccttcagcagatacagccagctgatcagccaccagagcatccacatcggcgtgaagccctacgactgcaaggagtgcggcaaggccttcagactgctgagccagctgacccagcaccagagcatccacatcggcgagaagccctacaagtgcaaggagtgcggcaaggccttcagactgagacagaagctgaccctgcaccagagcatccacaccggcgagaagcccttcgagtgcaaggagtgcagaaaggccttcagactgaacagcagcctgatccagcacctgagaatccacagcggcgagaagccctacgagtgcaaggagtgcaagaaggccttcagacagcacagccacctgacccaccacctgaagatccacaacgtgaagatctag

SEQ ID NO: 11090 - DNA, 1599 bp, Artificial Sequence
  Description of Artificial Sequence: Synthetic coding sequence
atggccctgagaagcgtgatgttcagcgacgtgagcatcgacttcagccccgaggagtgggagtacctggacctggagcagaaggacctgtacagagacgtgatgctggagaactacagcaacctggtgagcctgggcctgctgctgctgagcttcatcagcaccctggagatgctgctgctgctggtgaaggagaacagcatgtgcctgctgagctgcttcatcctggacctggagaccaagtacgagaccaagaagctgagcctggagaacgacatctacgagatcaacctgagccagtggaagatcatggagagaatcgagaaccacggcctgaagggcctgatcctgaagaacgactgggagagcaccggcaagatcgagggccaggagagaccccaggagggctacttcagcagcgtgaagatgcccagcgagaaggtgagcagctaccagaagagaaccagcgtgaccccccaccagagactgcacttcgtggacaagccctacgagtgcaaggagtgcggcaaggccttcagagtgagacagcagctgaccttccaccacagaatccacaccggcgagaagccctacgagtgcaaggagtgcggcatggccttcagacagaccgcccacctgaccagacaccagagactgcacagcggcgagaagctgtacgagtgcaaggagtgcggcgaggccttcatctgcggcgccgacctgagagtgcaccagaagatgcacatcggcgagaagccctacgagtgcaaggagtgcggcaaggccttcagagtgagaggccagctgaccctgcaccagagaatccacaccggcgagaagccctacgtgtgcaaggagtgcggcaaggccttcagacagtacgcccacctgaccagacaccagaagctgaacagcgccgacagactgtacgagtgcaaggagtgcggcaaggccttcctgtgcggcagcggcctgagagtgcaccacaagctgcacaccggcgagaagccctacgagtgcaaggagtgcggcaaggccttcagagtgagacagcagctgaccctgcaccagagaatccacaccggcgagaagccctacgagtgcaaggagtgcggcaagaccttcagcagaggctaccacctgatcctgcaccacagaatccacaccggcgagaagccctacgagtgcaaggagtgctggaaggccttcagcagatacagccagctgatcagccaccagagcatccacatcggcgtgaagccctacgactgcaaggagtgcggcaaggccttcagactgctgagccagctgacccagcaccagagcatccacatcggcgagaagccctacaagtgcaaggagtgcggcaaggccttcagactgagacagaagctgaccctgcaccagagcatccacaccggcgagaagcccttcgagtgcaaggagtgcagaaaggccttcagactgaacagcagcctgatccagcacctgagaatccacagcggcgagaagccctacgagtgcaaggagtgcaagaaggccttcagacagcacagccacctgacccaccacctgaagatccacaacgtgaagatctag

SEQ ID NO: 11091 - DNA, 1833 bp, Artificial Sequence
  Description of Artificial Sequence: Synthetic coding sequence
atggacagcgtggccttcgaggacgtggccgtgaacttcacccaggaggagtgggccctgctgggccccagccagaagagcctgtacagaaacgtgatgcaggagaccatcagaaacctggactgcatcgagatgaagtgggaggaccagaacatcggcgaccagtgccagaacgccaagagaaacctgagaagccacacctgcgagatcaaggacgacagccagtgcggcgagaccttcggccagatccccgacagcatcgtgaacaagaacacccccagagtgaacccctgcgacagcggcgagtgcggcgaggtggtgctgggccacagcagcctgaactgcaacatcagagtggacaccggccacaagagctgcgagcaccaggagtacggcgagaagccctacacccacaagcagagaggcaaggccatcagccaccagcacagcttccagacccacgagagaccccccaccggcaagaagcccttcgactgcaaggagtgcgccaagaccttcagcagcctgggcaacctgagaagacacatggccgcccaccacggcgacggcccctacaagtgcaagctgtgcggcaaggccttcgtgtggcccagcctgttccacctgcacgagagaacccacaccggcgagaagccctacgagtgcaagcagtgcagcaaggccttccccttctacagcagctacctgagacacgagagaatccacaccggcgagaaggcctacgagtgcaagcagtgcagcaaggccttccccgactacagcacctacctgagacacgagagaacccacaccggcgagaagccctacaagtgcacccagtgcggcaaggccttcagctgctactactacaccagactgcacgagagaacccacaccggcgagcagccctacgcctgcaagcagtgcggcaagaccttctaccaccacaccagcttcagaagacacatgatcagacacaccggcgacggcccccacaagtgcaagatctgcggcaagggcttcgactgccccagcagcgtgagaaaccacgagaccacccacaccggcgagaagccctacgagtgcaagcagtgcggcaaggtgctgagccacagcagcagcttcagaagccacatgatcacccacaccggcgacggcccccagaagtgcaagatctgcggcaaggccttcggctgccccagcctgttccagagacacgagagaacccacaccggcgagaagccctaccagtgcaagcagtgcggcaaggccttcagcctggccggcagcctgagaagacacgaggccacccacaccggcgtgaagccctacaagtgccagtgcggcaaggccttcagcgacctgagcagcttccagaaccacgagaccacccacaccggcgagaagccctacgagtgcaaggagtgcggcaaggccttcagctgcttcaagtacctgagccagcacaagagaacccacaccgtggagaagccctacgagtgcaagacctgcagaaaggccttcagccacttcagcaacctgaaggtgcacgagagaatccacagcggcgagaagccctacgagtgcaaggagtgcggcaaggccttcagctggctgacctgcctgctgagacacgagagaatccacaccggcgagaagccctacgagtgcctgcagtgcggcaaggccttcaccagaagcagattcctgagaggccacgagaagacccacaccggcgagaagctgtacgagtgcaaggagtgcggcaaggccctgagcagcctgagaagcctgcacagacacaagagaacccactggaaggacaccctgtag

SEQ ID NO: 11092 - DNA, 1410 bp, Artificial Sequence
  Description of Artificial Sequence: Synthetic coding sequence
atgaagtgggaggaccagaacatcggcgaccagtgccagaacgccaagagaaacctgagaagccacacctgcgagatcaaggacgacagccagtgcggcgagaccttcggccagatccccgacagcatcgtgaacaagaacacccccagagtgaacccctgcgacagcggcgagtgcggcgaggtggtgctgggccacagcagcctgaactgcaacatcagagtggacaccggccacaagagctgcgagcaccaggagtacggcgagaagccctacacccacaagcagagaggcaaggccatcagccaccagcacagcttccagacccacgagagaccccccaccggcaagaagcccttcgactgcaaggagtgcgccaagaccttcagcagcctgggcaacctgagaagacacatggccgcccaccacggcgacggcccctacaagtgcaagctgtgcggcaaggccttcgtgtggcccagcctgttccacctgcacgagagaacccacaccggcgagaagccctacgagtgcaagcagtgcagcaaggccttccccttctacagcagctacctgagacacgagagaatccacaccggcgagaaggcctacgagtgcaagcagtgcagcaaggccttccccgactacagcacctacctgagacacgagagaacccacaccggcgagaagccctacaagtgcacccagtgcggcaaggccttcagctgctactactacaccagactgcacgagagaacccacaccggcgagcagccctacgcctgcaagcagtgcggcaagaccttctaccaccacaccagcttcagaagacacatgatcagacacaccggcgacggcccccacaagtgcaagatctgcggcaagggcttcgactgccccagcagcgtgagaaaccacgagaccacccacaccggcgagaagccctacgagtgcaagcagtgcggcaaggtgctgagccacagcagcagcttcagaagccacatgatcacccacaccggcgacggcccccagaagtgcaagatctgcggcaaggccttcggctgccccagcctgttccagagacacgagagaacccacaccggcgagaagccctaccagtgcaagcagtgcggcaaggccttcagcctggccggcagcctgagaagacacgaggccacccacaccggcgtgaagccctacaagtgccagtgcggcaaggccttcagcgacctgagcagcttccagaaccacgagaccacccacaccggcgagaagccctacgagtgcaaggagtgcggcaaggccttcagctgcttcaagtacctgagccagcacaagagaacccacaccgtggagaagccctacgagtgcaagacctgcagaaaggccttcagccacttcagcaactag

SEQ ID NO: 11093 - DNA, 1287 bp, Artificial Sequence
  Description of Artificial Sequence: Synthetic coding sequence
atggccgcccaccacggcgacggcccctacaagtgcaagctgtgcggcaaggccttcgtgtggcccagcctgttccacctgcacgagagaacccacaccggcgagaagccctacgagtgcaagcagtgcagcaaggccttccccttctacagcagctacctgagacacgagagaatccacaccggcgagaaggcctacgagtgcaagcagtgcagcaaggccttccccgactacagcacctacctgagacacgagagaacccacaccggcgagaagccctacaagtgcacccagtgcggcaaggccttcagctgctactactacaccagactgcacgagagaacccacaccggcgagcagccctacgcctgcaagcagtgcggcaagaccttctaccaccacaccagcttcagaagacacatgatcagacacaccggcgacggcccccacaagtgcaagatctgcggcaagggcttcgactgccccagcagcgtgagaaaccacgagaccacccacaccggcgagaagccctacgagtgcaagcagtgcggcaaggtgctgagccacagcagcagcttcagaagccacatgatcacccacaccggcgacggcccccagaagtgcaagatctgcggcaaggccttcggctgccccagcctgttccagagacacgagagaacccacaccggcgagaagccctaccagtgcaagcagtgcggcaaggccttcagcctggccggcagcctgagaagacacgaggccacccacaccggcgtgaagccctacaagtgccagtgcggcaaggccttcagcgacctgagcagcttccagaaccacgagaccacccacaccggcgagaagccctacgagtgcaaggagtgcggcaaggccttcagctgcttcaagtacctgagccagcacaagagaacccacaccgtggagaagccctacgagtgcaagacctgcagaaaggccttcagccacttcagcaacctgaaggtgcacgagagaatccacagcggcgagaagccctacgagtgcaaggagtgcggcaaggccttcagctggctgacctgcctgctgagacacgagagaatccacaccggcgagaagccctacgagtgcctgcagtgcggcaaggccttcaccagaagcagattcctgagaggccacgagaagacccacaccggcgagaagctgtacgagtgcaaggagtgcggcaaggccctgagcagcctgagaagcctgcacagacacaagagaacccactggaaggacaccctgtag

SEQ ID NO: 11094 - DNA, 3243 bp, Artificial Sequence
  Description of Artificial Sequence: Synthetic coding sequence
cccagcagacagaagaagaagaagaagaagctgaccagcgacgtgagcagacaggaggaggccgagggcgagctgagcgagggcgagcactggtacggcaacagcagcgagacccccagcgaggccagctacggcgaggtgcaggagaactacaagctgagcctggaggacagaatccaggagcagagcaccagccccgacaccagcctgggcagcaccacccccagcagccacaccctggagctggtggccctggacagcgaggtgctgagagacagcctgcagtgccaggaccacctgagccccggcgtgagcagcctgtgcgacgacgaccccggcagcaacaagcccctgagcagcaacctgagaagactgctggaggccggcagcctgaagctggacgccgccgccaccgccaacggcagagtggagagccccgtgaacgtgggcagcaacctgagcttcagcccccccagccaccacgcccagcagctgagcgtgctggccagaaagctggccgagaagcaggagcagaacgaccagtacacccccagcaacagattcatctggaaccagggcaagtggctgcccaacagcaccaccacctgcagcctgagccccgacagcgccatcctgaagctgaaggccgccgccaacgccgtgctgcaggacaagagcctgaccagaaccgaggagaccatgagattcgagagcttcagcagccccttcagcagccagagcgccagcagcaccctggccgccctgagcaagaaggtgagcgagagaagcctgacccccggccaggagcaccccccccccgccagcagcttcctgagcctggccagcatgaccagcagcgccgccctgctgaaggaggtggccgccagagccgccggcagcctgctggccgagaagagcagcctgctgcccgaggaccccctgccccccccccccagcgagaagaagcccgagaaggtgaccccccccccccccccccccccccccccccccccccccccccccccccagagcctggagctgctgctgctgcccgtgcccaagggcagagtgagcaagcccagcaacagcgccagcgaggaggagagcggcaagcccttccagtgccccatctgcggcctggtgatcaagagaaagagctactggaagagacacatggtgatccacaccggcctgaagagccaccagtgccccctgtgccccttcagatgcgccagaaaggacaacctgaagagccacatgaaggtgcaccagcaccaggacagaggcgagaccttccagtgccagctgtgccccttcaccagcagcagacacttcagcctgaagctgcacatgagatgccaccagcacttcctgagaaccgaggccaaggtgaaggaggagatccccgaccccgacgtgaagggcagcccccacctgagcgacagcgcctgcctgggccagcagagagagggcggcggcaccgagctggtgggcaccatgatgaccagcaacacccccgagagaaccagccagggcggcgccggcgtgagccccctgctggtgaaggaggagcccaaggaggacaacggcctgcccaccagcttcaccctgaacgccgccgacagacccgccaaccacaccaagctgaaggaccccagcgagtacgtggccaacagcgccagcgccctgttcagccaggacatcagcgtgaagatggccagcgacttcctgatgaagctgagcgccgccaaccagaaggagcccatgaacctgaacttcaaggtgaaggaggagcccaaggagggcgagagcctgagcaccaccctgcccagaagcagctacgtgttcagccccgagagcgaggtgagcgcccccggcgtgagcgaggacgccctgaagccccaggagggcaagggcagcgtgctgagaagagacgtgagcgtgaaggccgccagcgagctgctgatgaagctgagcgccgagagctacaaggagacccagatggtgaagatcaaggaggagcccatggaggtggacatccaggacagccacgtgagcatcagccccagcagaaacgtgggctacagcaccctgatcggcagagagaagaccgagcccctgcagaagatgcccgagggcagagtgccccccgagagaaacctgttcagccaggacatcagcgtgaagatggccagcgagctgctgttccagctgagcgagaaggtgagcaaggagcacaaccacaccaaggagaacaccatcagaaccaccaccagccccttcttcagcgaggacaccttcagacagagccccttcaccagcaacagcaaggagctgctgcccagcgacagcgtgctgcacggcagaatcagcgcccccgagaccgagaagatcgtgctggaggccggcaacggcctgcccagctggaagttcaacgaccagctgttcccctgcgacgtgtgcggcaaggtgttcggcagacagcagaccctgagcagacacctgagcctgcacaccgaggagagaaagtacaagtgccacctgtgcccctacgccgccaagtgcagagccaacctgaaccagcacctgaccgtgcacagcgtgaagctggtgagcaccgacaccgaggacatcgtgagcgccgtgaccagcgagggcagcgacggcaagaagcacccctactactacagctgccacgtgtgcggcttcgagaccgagctgaacgtgcagttcgtgagccacatgagcctgcacgtggacaaggagcagtggatgttcagcatctgctgcaccgcctgcgacttcgtgaccatggaggaggccgagatcaagacccacatcggcaccaagcacaccggcgaggacagaaagacccccagcgagagcaacagccccagcagcagcagcctgagcgccctgagcgacagcgccaacagcaaggacgacagcgacggcagccagaagaacaagggcggcaacaacctgctggtgatcagcgtgatgcccggcagccagcccagcctgaacagcgaggagaagcccgagaagggcttcgagtgcgtgttctgcaacttcgtgtgcaagaccaagaacatgttcgagagacacctgcagatccacctgatcaccagaatgttcgagtgcgacgtgtgccacaagttcatgaagacccccgagcagctgctggagcacaagaagtgccacaccgtgcccaccggcggcctgaacagcggccagtggtag

SEQ ID NO: 11095 - DNA, 2196 bp, Artificial Sequence
  Description of Artificial Sequence: Synthetic coding sequence
atgcccagaagaaagcaggagcagcccaagagactgcccagccccagcgaggaggagagcggcaagcccttccagtgccccatctgcggcctggtgatcaagagaaagagctactggaagagacacatggtgatccacaccggcctgaagagccaccagtgccccctgtgccccttcagatgcgccagaaaggacaacctgaagagccacatgaaggtgcaccagcaccaggacagaggcgagaccttccagtgccagctgtgccccttcaccagcagcagacacttcagcctgaagctgcacatgagatgccaccagcacttcctgagaaccgaggccaaggtgaaggaggagatccccgaccccgacgtgaagggcagcccccacctgagcgacagcgcctgcctgggccagcagagagagggcggcggcaccgagctggtgggcaccatgatgaccagcaacacccccgagagaaccagccagggcggcgccggcgtgagccccctgctggtgaaggaggagcccaaggaggacaacggcctgcccaccagcttcaccctgaacgccgccgacagacccgccaaccacaccaagctgaaggaccccagcgagtacgtggccaacagcgccagcgccctgttcagccaggacatcagcgtgaagatggccagcgacttcctgatgaagctgagcgccgccaaccagaaggagcccatgaacctgaacttcaaggtgaaggaggagcccaaggagggcgagagcctgagcaccaccctgcccagaagcagctacgtgttcagccccgagagcgaggtgagcgcccccggcgtgagcgaggacgccctgaagccccaggagggcaagggcagcgtgctgagaagagacgtgagcgtgaaggccgccagcgagctgctgatgaagctgagcgccgagagctacaaggagacccagatggtgaagatcaaggaggagcccatggaggtggacatccaggacagccacgtgagcatcagccccagcagaaacgtgggctacagcaccctgatcggcagagagaagaccgagcccctgcagaagatgcccgagggcagagtgccccccgagagaaacctgttcagccaggacatcagcgtgaagatggccagcgagctgctgttccagctgagcgagaaggtgagcaaggagcacaaccacaccaaggagaacaccatcagaaccaccaccagccccttcttcagcgaggacaccttcagacagagccccttcaccagcaacagcaaggagctgctgcccagcgacagcgtgctgcacggcagaatcagcgcccccgagaccgagaagatcgtgctggaggccggcaacggcctgcccagctggaagttcaacgaccagctgttcccctgcgacgtgtgcggcaaggtgttcggcagacagcagaccctgagcagacacctgagcctgcacaccgaggagagaaagtacaagtgccacctgtgcccctacgccgccaagtgcagagccaacctgaaccagcacctgaccgtgcacagcgtgaagctggtgagcaccgacaccgaggacatcgtgagcgccgtgaccagcgagggcagcgacggcaagaagcacccctactactacagctgccacgtgtgcggcttcgagaccgagctgaacgtgcagttcgtgagccacatgagcctgcacgtggacaaggagcagtggatgttcagcatctgctgcaccgcctgcgacttcgtgaccatggaggaggccgagatcaagacccacatcggcaccaagcacaccggcgaggacagaaagacccccagcgagagcaacagccccagcagcagcagcctgagcgccctgagcgacagcgccaacagcaaggacgacagcgacggcagccagaagaacaagggcggcaacaacctgctggtgatcagcgtgatgcccggcagccagcccagcctgaacagcgaggagaagcccgagaagggcttcgagtgcgtgttctgcaacttcgtgtgcaagaccaagaacatgttcgagagacacctgcagatccacctgatcaccagaatgttcgagtgcgacgtgtgccacaagttcatgaagacccccgagcagctgctggagcacaagaagtgccacaccgtgcccaccggcggcctgaagagaggcgcctggtag

SEQ ID NO: 11096 - DNA, 3246 bp, Artificial Sequence
  Description of Artificial Sequence: Synthetic coding sequence
atgcccagaagaaagcaggagcagcccaagagactgcccagccacgtgagcagacaggaggaggccgagggcgagctgagcgagggcgagcactggtacggcaacagcagcgagacccccagcgaggccagctacggcgaggtgcaggagaactacaagctgagcctggaggacagaatccaggagcagagcaccagccccgacaccagcctgggcagcaccacccccagcagccacaccctggagctggtggccctggacagcgaggtgctgagagacagcctgcagtgccaggaccacctgagccccggcgtgagcagcctgtgcgacgacgaccccggcagcaacaagcccctgagcagcaacctgagaagactgctggaggccggcagcctgaagctggacgccgccgccaccgccaacggcagagtggagagccccgtgaacgtgggcagcaacctgagcttcagcccccccagccaccacgcccagcagctgagcgtgctggccagaaagctggccgagaagcaggagcagaacgaccagtacacccccagcaacagattcatctggaaccagggcaagtggctgcccaacagcaccaccacctgcagcctgagccccgacagcgccatcctgaagctgaaggccgccgccaacgccgtgctgcaggacaagagcctgaccagaaccgaggagaccatgagattcgagagcttcagcagccccttcagcagccagagcgccagcagcaccctggccgccctgagcaagaaggtgagcgagagaagcctgacccccggccaggagcaccccccccccgccagcagcttcctgagcctggccagcatgaccagcagcgccgccctgctgaaggaggtggccgccagagccgccggcagcctgctggccgagaagagcagcctgctgcccgaggaccccctgccccccccccccagcgagaagaagcccgagaaggtgaccccccccccccccccccccccccccccccccccccccccccccccccagagcctggagctgctgctgctgcccgtgcccaagggcagagtgagcaagcccagcaacagcgccagcgaggaggagagcggcaagcccttccagtgccccatctgcggcctggtgatcaagagaaagagctactggaagagacacatggtgatccacaccggcctgaagagccaccagtgccccctgtgccccttcagatgcgccagaaaggacaacctgaagagccacatgaaggtgcaccagcaccaggacagaggcgagaccttccagtgccagctgtgccccttcaccagcagcagacacttcagcctgaagctgcacatgagatgccaccagcacttcctgagaaccgaggccaaggtgaaggaggagatccccgaccccgacgtgaagggcagcccccacctgagcgacagcgcctgcctgggccagcagagagagggcggcggcaccgagctggtgggcaccatgatgaccagcaacacccccgagagaaccagccagggcggcgccggcgtgagccccctgctggtgaaggaggagcccaaggaggacaacggcctgcccaccagcttcaccctgaacgccgccgacagacccgccaaccacaccaagctgaaggaccccagcgagtacgtggccaacagcgccagcgccctgttcagccaggacatcagcgtgaagatggccagcgacttcctgatgaagctgagcgccgccaaccagaaggagcccatgaacctgaacttcaaggtgaaggaggagcccaaggagggcgagagcctgagcaccaccctgcccagaagcagctacgtgttcagccccgagagcgaggtgagcgcccccggcgtgagcgaggacgccctgaagccccaggagggcaagggcagcgtgctgagaagagacgtgagcgtgaaggccgccagcgagctgctgatgaagctgagcgccgagagctacaaggagacccagatggtgaagatcaaggaggagcccatggaggtggacatccaggacagccacgtgagcatcagccccagcagaaacgtgggctacagcaccctgatcggcagagagaagaccgagcccctgcagaagatgcccgagggcagagtgccccccgagagaaacctgttcagccaggacatcagcgtgaagatggccagcgagctgctgttccagctgagcgagaaggtgagcaaggagcacaaccacaccaaggagaacaccatcagaaccaccaccagccccttcttcagcgaggacaccttcagacagagccccttcaccagcaacagcaaggagctgctgcccagcgacagcgtgctgcacggcagaatcagcgcccccgagaccgagaagatcgtgctggaggccggcaacggcctgcccagctggaagttcaacgaccagctgttcccctgcgacgtgtgcggcaaggtgttcggcagacagcagaccctgagcagacacctgagcctgcacaccgaggagagaaagtacaagtgccacctgtgcccctacgccgccaagtgcagagccaacctgaaccagcacctgaccgtgcacagcgtgaagctggtgagcaccgacaccgaggacatcgtgagcgccgtgaccagcgagggcagcgacggcaagaagcacccctactactacagctgccacgtgtgcggcttcgagaccgagctgaacgtgcagttcgtgagccacatgagcctgcacgtggacaaggagcagtggatgttcagcatctgctgcaccgcctgcgacttcgtgaccatggaggaggccgagatcaagacccacatcggcaccaagcacaccggcgaggacagaaagacccccagcgagagcaacagccccagcagcagcagcctgagcgccctgagcgacagcgccaacagcaaggacgacagcgacggcagccagaagaacaagggcggcaacaacctgctggtgatcagcgtgatgcccggcagccagcccagcctgaacagcgaggagaagcccgagaagggcttcgagtgcgtgttctgcaacttcgtgtgcaagaccaagaacatgttcgagagacacctgcagatccacctgatcaccagaatgttcgagtgcgacgtgtgccacaagttcatgaagacccccgagcagctgctggagcacaagaagtgccacaccgtgcccaccggcggcctgaacagcggccagtggtag

SEQ ID NO: 11097 - DNA, 2196 bp, Artificial Sequence
  Description of Artificial Sequence: Synthetic coding sequence
atgcccagaagaaagcaggagcagcccaagagactgcccagccccagcgaggaggagagcggcaagcccttccagtgccccatctgcggcctggtgatcaagagaaagagctactggaagagacacatggtgatccacaccggcctgaagagccaccagtgccccctgtgccccttcagatgcgccagaaaggacaacctgaagagccacatgaaggtgcaccagcaccaggacagaggcgagaccttccagtgccagctgtgccccttcaccagcagcagacacttcagcctgaagctgcacatgagatgccaccagcacttcctgagaaccgaggccaaggtgaaggaggagatccccgaccccgacgtgaagggcagcccccacctgagcgacagcgcctgcctgggccagcagagagagggcggcggcaccgagctggtgggcaccatgatgaccagcaacacccccgagagaaccagccagggcggcgccggcgtgagccccctgctggtgaaggaggagcccaaggaggacaacggcctgcccaccagcttcaccctgaacgccgccgacagacccgccaaccacaccaagctgaaggaccccagcgagtacgtggccaacagcgccagcgccctgttcagccaggacatcagcgtgaagatggccagcgacttcctgatgaagctgagcgccgccaaccagaaggagcccatgaacctgaacttcaaggtgaaggaggagcccaaggagggcgagagcctgagcaccaccctgcccagaagcagctacgtgttcagccccgagagcgaggtgagcgcccccggcgtgagcgaggacgccctgaagccccaggagggcaagggcagcgtgctgagaagagacgtgagcgtgaaggccgccagcgagctgctgatgaagctgagcgccgagagctacaaggagacccagatggtgaagatcaaggaggagcccatggaggtggacatccaggacagccacgtgagcatcagccccagcagaaacgtgggctacagcaccctgatcggcagagagaagaccgagcccctgcagaagatgcccgagggcagagtgccccccgagagaaacctgttcagccaggacatcagcgtgaagatggccagcgagctgctgttccagctgagcgagaaggtgagcaaggagcacaaccacaccaaggagaacaccatcagaaccaccaccagccccttcttcagcgaggacaccttcagacagagccccttcaccagcaacagcaaggagctgctgcccagcgacagcgtgctgcacggcagaatcagcgcccccgagaccgagaagatcgtgctggaggccggcaacggcctgcccagctggaagttcaacgaccagctgttcccctgcgacgtgtgcggcaaggtgttcggcagacagcagaccctgagcagacacctgagcctgcacaccgaggagagaaagtacaagtgccacctgtgcccctacgccgccaagtgcagagccaacctgaaccagcacctgaccgtgcacagcgtgaagctggtgagcaccgacaccgaggacatcgtgagcgccgtgaccagcgagggcagcgacggcaagaagcacccctactactacagctgccacgtgtgcggcttcgagaccgagctgaacgtgcagttcgtgagccacatgagcctgcacgtggacaaggagcagtggatgttcagcatctgctgcaccgcctgcgacttcgtgaccatggaggaggccgagatcaagacccacatcggcaccaagcacaccggcgaggacagaaagacccccagcgagagcaacagccccagcagcagcagcctgagcgccctgagcgacagcgccaacagcaaggacgacagcgacggcagccagaagaacaagggcggcaacaacctgctggtgatcagcgtgatgcccggcagccagcccagcctgaacagcgaggagaagcccgagaagggcttcgagtgcgtgttctgcaacttcgtgtgcaagaccaagaacatgttcgagagacacctgcagatccacctgatcaccagaatgttcgagtgcgacgtgtgccacaagttcatgaagacccccgagcagctgctggagcacaagaagtgccacaccgtgcccaccggcggcctgaacagcggccagtggtag

SEQ ID NO: 11098 - DNA, 3234 bp, Artificial Sequence
  Description of Artificial Sequence: Synthetic coding sequence
atgcccagaagaaagcaggagcagcccaagagactgcccagccacgtgagcagacaggaggaggccgagggcgagctgagcgagggcgagcactggtacggcaacagcagcgagacccccagcgaggccagctacggcgaggtgcaggagaactacaagctgagcctggaggacagaatccaggagcagagcaccagccccgacaccagcctgggcagcaccacccccagcagccacaccctggagctggtggccctggacagcgaggtgctgagagacagcctgcagtgccaggaccacctgagccccggcgtgagcagcctgtgcgacgacgaccccggcagcaacaagcccctgagcagcaacctgagaagactgctggaggccggcagcctgaagctggacgccgccgccaccgccaacggcagagtggagagccccgtgaacgtgggcagcaacctgagcttcagcccccccagccaccacgcccagcagctgagcgtgctggccagaaagctggccgagaagcaggagcagaacgaccagtacacccccagcaacagattcatctggaaccagggcaagtggctgcccaacagcaccaccacctgcagcctgagccccgacagcgccatcctgaagctgaaggccgccgccaacgccgtgctgcaggacaagagcctgaccagaaccgaggagaccatgagattcgagagcttcagcagccccttcagcagccagagcgccagcagcaccctggccgccctgagcaagaaggtgagcgagagaagcctgacccccggccaggagcaccccccccccgccagcagcttcctgagcctggccagcatgaccagcagcgccgccctgctgaaggaggtggccgccagagccgccggcagcctgctggccgagaagagcagcctgctgcccgaggaccccctgccccccccccccagcgagaagaagcccgagaaggtgaccccccccccccccccccccccccccccccccccccccccccccccccagagcctggagctgctgctgctgcccgtgcccaagggcagagtgagcaagcccagcaacagcgccagcgaggaggagagcggcaagcccttccagtgccccatctgcggcctggtgatcaagagaaagagctactggaagagacacatggtgatccacaccggcctgaagagccaccagtgccccctgtgccccttcagatgcgccagaaaggacaacctgaagagccacatgaaggtgcaccagcaccaggacagaggcgagaccttccagtgccagctgtgccccttcaccagcagcagacacttcagcctgaagctgcacatgagatgccaccagcacttcctgagaaccgaggccaaggtgaaggaggagatccccgaccccgacgtgaagggcagcccccacctgagcgacagcgcctgcctgggccagcagagagagggcggcggcaccgagctggtgggcaccatgatgaccagcaacacccccgagagaaccagccagggcggcgccggcgtgagccccctgctggtgaaggaggagcccaaggaggacaacggcctgcccaccagcttcaccctgaacgccgccgacagacccgccaaccacaccaagctgaaggaccccagcgagtacgtggccaacagcgccagcgccctgttcagccaggacatcagcgtgaagatggccagcgacttcctgatgaagctgagcgccgccaaccagaaggagcccatgaacctgaacttcaaggtgaaggaggagcccaaggagggcgagagcctgagcaccaccctgcccagaagcagctacgtgttcagccccgagagcgaggtgagcgcccccggcgtgagcgaggacgccctgaagccccaggagggcaagggcagcgtgctgagaagagacgtgagcgtgaaggccgccagcgagctgctgatgaagctgagcgccgagagctacaaggagacccagatggtgaagatcaaggaggagcccatggaggtggacatccaggacagccacgtgagcatcagccccagcagaaacgtgggctacagcaccctgatcggcagagagaagaccgagcccctgcagaagatgcccgagggcagagtgccccccgagagaaacctgttcagccaggacatcagcgtgaagatggccagcgagctgctgttccagctgagcgagaaggtgagcaaggagcacaaccacaccaaggagaacaccatcagaaccaccaccagccccttcttcagcgaggacaccttcagacagagccccttcaccagcaacagcaaggagctgctgcccagcgacagcgtgctgcacggcagaatcagcgcccccgagaccgagaagatcgtgctggaggccggcaacggcctgcccagctggaagttcaacgaccagctgttcccctgcgacgtgtgcggcaaggtgttcggcagacagcagaccctgagcagacacctgagcctgcacaccgaggagagaaagtacaagtgccacctgtgcccctacgccgccaagtgcagagccaacctgaaccagcacctgaccgtgcacagcgtgaagctggtgagcaccgacaccgaggacatcgtgagcgccgtgaccagcgagggcagcgacggcaagaagcacccctactactacagctgccacgtgtgcggcttcgagaccgagctgaacgtgcagttcgtgagccacatgagcctgcacgtggacaaggagcagtggatgttcagcatctgctgcaccgcctgcgacttcgtgaccatggaggaggccgagatcaagacccacatcggcaccaagcacaccggcgaggacagaaagacccccagcgagagcaacagccccagcagcagcagcctgagcgccctgagcgacagcgccaacagcaaggacgacagcgacggcagccagaagaacaagggcggcaacaacctgctggtgatcagcgtgatgcccggcagccagcccagcctgaacagcgaggagaagcccgagaagggcttcgagtgcgtgttctgcaacttcgtgtgcaagaccaagaacatgttcgagagacacctgcagatccacctgatcaccagaatgttcgagtgcgacgtgtgccacaagttcatgaagacccccgagcagctgctggagcacaagaagtgccacaccgtgcccaccggcggcctgaagtag

SEQ ID NO: 11099 - DNA, 1299 bp, Artificial Sequence
  Description of Artificial Sequence: Synthetic coding sequence
atgccccacagccccctgatcagcatcccccacgtgtggtgccaccccgaggaggaggagagaatgcacgacgagctgctgcaggccgtgagcaagggccccgtgatgttcagagacgtgagcatcgacttcagccaggaggagtgggagtgcctggacgccgaccagatgaacctgtacaaggaggtgatgctggagaacttcagcaacctggtgagcgtgggcctgagcaacagcaagcccgccgtgatcagcctgctggagcagggcaaggagccctggatggtggacagagagctgaccagaggcctgtgcagcgacctggagagcatgtgcgagaccaagatcctgagcctgaagaagagacacttcagccaggtgatcatcaccagagaggacatgagcaccttcatccagcccaccttcctgatccccccccagaagaccatgagcgaggagaagccctgggagtgcaagatctgcggcaagaccttcaaccagaacagccagttcatccagcaccagagaatccacttcggcgagaagcactacgagagcaaggagtacggcaagagcttcagcagaggcagcctggtgaccagacaccagagaatccacaccggcaagaagccctacgagtgcaaggagtgcggcaaggccttcagctgcagcagctacttcagccagcaccagagaatccacaccggcgagaagccctacgagtgcaaggagtgcggcaaggccttcaagtactgcagcaacctgaacgaccaccagagaatccacaccggcgagaagccctacgagtgcaaggtgtgcggcaaggccttcaccaagagcagccagctgttcctgcacctgagaatccacaccggcgagaagccctacgagtgcaaggagtgcggcaaggccttcacccagcacagcagactgatccagcaccagagaatgcacaccggcgagaagccctacgagtgcaagcagtgcggcaaggccttcaacagcgccagcaccctgaccaaccaccacagaatccacgccggcgagaagctgtacgagtgcgaggagtgcagaaaggccttcatccagagcagcgagctgatccagcaccagagaatccacaccgacgagaagccctacgagtgcaacgagtgcggcaaggccttcaacaagggcagcaacctgaccagacaccagagaatccacaccggcgagaagccctacgactgcaaggagtgcggcaaggccttcggcagcagaagcgacctgatcagacacgagggcatccacaccggctag

SEQ ID NO: 11100 - DNA, 1299 bp, Artificial Sequence; identical to SEQ ID NO: 11099
  Description of Artificial Sequence: Synthetic coding sequence

SEQ ID NO: 11101 - DNA, 2811 bp, Artificial Sequence
  Description of Artificial Sequence: Synthetic coding sequence
atggccctgacccagggccccctgaccttcagagacgtggccatcgagttcagccaggaggagtggaagagcctggaccccgtgcagaaggccctgtactgggacgtgatgctggagaactacagaaacctggtgttcctgggcatcctgcccaagtgcatgaccaaggagctgccccccatcggcaacagcaacaccggcgagaagtgccagaccgtgaccctggagagacacgagtgctacgacgtggagaacttctacctgagagagatccagaagaacctgcaggacctggagttccagtggaaggacggcgagatcaactacaaggaggtgcccatgacctacaagaacaacctgaacggcaagagaggccagcacagccaggaggacgtggagaacaagtgcatcgagaaccagctgaccctgagcttccagagcagactgaccgagctgcagaagttccagaccgagggcaagatctacgagtgcaaccagagcgagaagaccgtgaacaacagcagcctggtgagccccctgcagagaatcctgcccagcgtgcagaccaacatcagcaagaagtacgagaacgagttcctgcagctgagcctgcccacccagctggagaagacccacatcagagagaagccctacatgtgcaagggctgcggcaaggccttcagagtgagcagcagcctgatcaaccaccagatggtgcacaccaccgagaagccctacaagtgcaacgagtgcggcaaggccttccacagaggcagcctgctgaccatccaccagatcgtgcacaccagaggcaagccctaccagtgcggcgtgtgcggcaagatcttcagacagaacagcgacctggtgaaccacagaagaagccacaccggcgagaagccctacaagtgcaacgagtgcggcaagagcttcagccagagctacaacctggccatccaccagagaatccacaccggcgagaagccctacaagtgcaacgagtgcggcaagaccttcaagcagggcagctgcctgaccacccaccagatcatccacaccggcgagaagccctaccagtgcgacatctgcggcaaggtgttcagacagaacagcaacctggtgaaccaccagagaatccacaccggcgagaagccctacaagtgcaacatctgcggcaagagcttcagccagagcagcaacctggccacccaccagaccgtgcacagcggcaacaagccctacaagtgcgacgagtgcggcaagaccttcaagagaagcagcagcctgaccacccaccagatcatccacaccggcgagaagccctacacctgcgacgtgtgcgacaaggtgttcagccagagaagccagctggccagacaccagagaagccacaccggcgagaagccctacaagtgcaacgagtgcggcaaggtgttcagccagaccagccacctggtgggccacagaagaatccacaccggcgagaagccctacaagtgcgacaagtgcggcaaggccttcaagcagggcagcctgctgaccagacacaagatcatccacaccagagagaagagataccagtgcggcgagtgcggcaaggtgttcagcgagaacagctgcctggtgagacacctgagaatccacaccggcgagcagccctacaagtgcaacgtgtgcggcaaggtgttcaactacagcggcaacctgagcatccacaagagaatccacaccggcgagaagcccttccagtgcaacgagtgcggcaccgtgttcagaaactacagctgcctggccagacacctgagaatccacaccggccagaagccctacaagtgcaacgtgtgcggcaaggtgttcaacgacagcggcaacctgagcaaccacaagagaatccacaccggcgagaagcccttccagtgcaacgagtgcggcaaggtgttcagctactacagctgcctggccagacacagaaagatccacaccggcgagaagccctacaagtgcaacgactgcggcaaggcctacacccagagaagcagcctgaccaagcacctgatcatccacaccggcgagaagccctacaactgcaacgagttcggcggcgccttcatccagagcagcaagctggccagataccacagaaaccccaccggcgagaagccccacaagtgcagccactgcggcagaaccttcagccacatcaccggcctgacctaccaccagagaagacacaccggcgagatgccctacaagtgcatcgagtgcggccaggtgttcaacagcaccagcaacctggccagacacagaagaatccacaccggcgagaagccctacaagtgcaacgagtgcggcaaggtgttcagacaccagagcaccctggccagacacagaagcatccacaccggcgagaagccctacgtgtgcaacgagtgcggcaaggccttcagagtgagaagcatcctggtgaaccaccagaagatgcacaccggcgacaagccctacaagtgcaacgagtgcggcaaggccttcatcgagagaagcaagctggtgtaccaccagagaaaccacaccggcgagaagccctacaagtgcatcgagtgcggcaaggccttcggcagattcagctgcctgaacaagcaccagatgatccacagcggcgagaagccctacaagtgcaacgagtgcggcaagagcttcatcagcagaagcggcctgaccaagcaccagaccaagcacaccgccgagagcctgaagaccaagttcaacgtggagaagcccctggacgtgctgctgaccagcggcttcaagtag

SEQ ID NO: 11102 - DNA, 534 bp, Artificial Sequence
  Description of Artificial Sequence: Synthetic coding sequence
agcctgcccacccagctggagaagacccacatcagagagaagccctacatgtgcaagggctgcggcaaggccttcagagtgagcagcagcctgatcaaccaccagatggtgcacaccaccgagaagccctacaagtgcaacgagtgcggcaaggccttccacagaggcagcctgctgaccatccaccagatcgtgcacaccagaggcaagccctaccagtgcggcgtgtgcggcaagatcttcagacagaacagcgacctggtgaaccacagaagaagccacaccggcgagaagccctacaagtgcaacgagtgcggcaagagcttcagccagagctacaacctggccatccaccagagaatccacaccggcgagcagccctacaagtgcaacgtgtgcggcaaggtgttcaactacagcggcaacctgagcatccacaagagaatccacaccggcgagaagcccttccagtgcaacgagtgcggcaccgtgttcagaaactacagctgcctggccagacacctgagaatctag

SEQ ID NO: 11103 - DNA, 1596 bp, Artificial Sequence
  Description of Artificial Sequence: Synthetic coding sequence
atggaggcccccgcccagaaggccggccagggcggcctgcccaaggccgacgcccagggcgccagcggcgccagagagaagagacccgaggagcccagacccctggaggaggacagagccggcagcagacccacccagaagggcgacctgagaggcgccgccggcggcagaaccaccccccccggcggcggcagcagaggctgcagcctgggcgtgagccccggccccggcaccagacacagcgccggcaccagacccctggtgagagagccctgcggccccaccagcagccagaaccccgagctggtgatccccgagggcctgcaggccagagagggcccctgcagaagccccgccagaggcggcgactgcagcagaaacagctgcctggcctggcacagaggcgcccccgccggcgagaccccccccgtgtgcgacccctgccccgagagaatccagaaccaccccagaacccagctgtgcgaggtgcacaccgactgctggccctgccagcccggcaccggcgcccccacctgccccagaacccccaagcccaccagcagaggcagaaaccccctggtggagcagcccagagcctgcgcctgcggcgaggccttcgcctggagagccctgagaatcccccaggagagactgcaggccaccgaggagcccagaccctgcgccagatgcggcaagagattcagacccaaccagcagcagcaggccggcaagagcccccccgtgtgccccgagtgcggccagaccagcagacccagacccatcgtgcccgacccccccgcccagagactgtacgcctgcgacgagtgcggcaaggccttcaccagaaccagcagcctgctgcagcaccagagaatccacaccggcgagagaccctacgagtgcgccgagtgcggcaaggccttcgtgagatgcagcggcctgtacagacaccagaagacccacagcgccgagagacacagaagaggccccgtgctggccagaagagccttcagactgggctgccccccctgcggcgactacagcgagagaagccccagaagaggcagcggcgccggcgagaagccctacgagtgcgccgactgcgccaaggccttcggcctgttcagccacctggtggagcacagaagagtgcacaccggcgagaagccctacgcctgccccgagtgcggcaaggccttcaaccagagaagcaacctgagcagacaccagagaacccacagcagcgccaagccctacgcctgccccctgtgcgagaaggccttcaagggcagaagcggcctggtgcagcaccagagagcccacaccggcgagagaccctacggctgcagcgagtgcggcaagaccttcagaggctgcagcgagctgagacagcacgagagactgcacagcggcgagaagccctacatctgcagagactgcggcaaggccttcgtgagaaactgcagcctggtgagacacctgagaacccacaccggcgagagaccctacgcctgcggcgactgcggcagagccttcagccagagaagcaacctgaacgagcacagaaagagacacggcggcagagccgccccctag

SEQ ID NO: 11104 - DNA, 1596 bp, Artificial Sequence; identical to SEQ ID NO: 11103
  Description of Artificial Sequence: Synthetic coding sequence

SEQ ID NO: 11105 - DNA, 2217 bp, Artificial Sequence
  Description of Artificial Sequence: Synthetic coding sequence
atgaccatgctgcaggagagcttcagcttcgacgacctgagcgtggacttcacccagaaggagtggcagctgctggaccccagccagaagaacctgtacaaggacgtgatgctggagaactacagcagcctggtgagcctgggctacgaggtgatgaagcccgacgtgatcttcaagctggagcagggcgaggagccctgggtgggcgacggcgagatccccagcagcgacagccccgaggtgtggaaggtggacggcaacatgatgtggcaccaggacaaccaggacaagctgaagatcatcaagagaggccacgagtgcgacgccttcggcaagaacttcaacctgaacatgaacttcgtgcccctgagaaagagcaacagcgagggcgacctggacggcctgatcctgaagcaccacctggacctgctgatccccaagggcgactacggcaaggccgagagcgacgacttcaacgtgttcgacaacttcttcctgcacagcaagcccgaggacaccgacacctggctgaagtactacgactgcgacaagtacaaggagagctacaagaagagccagatcatcatctaccacagaaacagactgggcgagaagctgtacgagtgcagcgagtgcagaaagagattcagcaagaagcccagcctgatcaagcaccagagcagacacatcagagacatcgccttcggctgcggcaactgcggcaagaccttcccccagaagagccagttcatcacccaccacagaacccacaccggcgagaagccctacaactgcagccagtgcggcaaggccttcagccagaagagccagctgaccagccaccagagaacccacaccggcgagaagccctacgagtgcggcgagtgcggcaaggccttcagcagaaagagccacctgatcagccactggagaacccacaccggcgagaagccctacggctgcaacgagtgcggcagagccttcagcgagaagagcaacctgatcaaccaccagagaatccacaccggcgagaagcccttcgagtgcagagagtgcggcaaggccttcagcagaaagagccagctggtgacccaccacagaacccacaccggcaccaagcccttcggctgcagcgactgcagaaaggccttcttcgagaagagcgagctgatcagacaccagaccatccacaccggcgagaagccctacgagtgcagcgagtgcagaaaggccttcagagagagaagcagcctgatcaaccaccagagaacccacaccggcgagaagccccacggctgcatccagtgcggcaaggccttcagccagaagagccacctgatcagccaccagatgacccacaccggcgagaagcccttcatctgcagcaagtgcggcaaggccttcagcagaaagagccagctggtgagacaccagagaacccacaccggcgagaagccctacgagtgcagcgagtgcggcaaggccttcagcgagaagctgagcctgaccaaccaccagagaatccacaccggcgagaagccctacgtgtgcagcgagtgcggcaaggccttctgccagaagagccacctgatcagccaccagagaacccacaccggcgagaagccctacgagtgcagcgagtgcggcaaggccttcggcgagaagagcagcctggccacccaccagagaacccacaccggcgagaagccctacgagtgcagagactgcgagaaggccttcagccagaagagccagctgaacacccaccagagaatccacaccggcgagaagccctacgagtgcagcctgtgcagaaaggccttcttcgagaagagcgagctgatcagacacctgagaacccacaccggcgagaagccctacgagtgcaacgagtgcagaaaggccttcagagagaagagcagcctgatcaaccaccagagaatccacaccggcgagaagcccttcgagtgcagcgagtgcggcaaggccttcagcagaaagagccacctgatcccccaccagagaacccacaccggcgagaagccctacggctgcagcgagtgcagaaaggccttcagccagaagagccagctggtgaaccaccagagaatccacaccggcgagaagccctacagatgcatcgagtgcggcaaggccttcagccagaagagccagctgatcaaccaccagagaacccacaccgtgaagaagagctag

SEQ ID NO: 11106 - DNA, 2217 bp, Artificial Sequence; identical to SEQ ID NO: 11105
  Description of Artificial Sequence: Synthetic coding sequence

SEQ ID NO: 11107 - DNA, 210 bp, Artificial Sequence
  Description of Artificial Sequence: Synthetic coding sequence
atgaccatgctgcaggagagcttcagcttcgacgacctgagcgtggacttcacccagaaggagtggcagctgctggaccccagccagaagaacctgtacaaggacgtgatgctggagaactacagcagcctggtgagcctgggctacgaggtgatgaagcccgacgtgatcttcaagctggagcagggcgaggagccctgggtgggctag

SEQ ID NO: 11108 - DNA, 2217 bp, Artificial Sequence; identical to SEQ ID NO: 11105
  Description of Artificial Sequence: Synthetic coding sequence

SEQ ID NO: 11109 - DNA, 168 bp, Artificial Sequence
  Description of Artificial Sequence: Synthetic coding sequence
atgaccatgctgcaggagagcttcagcttcgacgacctgagcgtggacttcacccagaaggagtggcagctgctggaccccagccagaagaacctgtacaaggacgtgatgctggagaactacagcagcctggtgagcctgggctacgaggtgatgaagcccgactag

SEQ ID NO: 11110 - DNA, 2217 bp, Artificial Sequence; identical to SEQ ID NO: 11105
  Description of Artificial Sequence: Synthetic coding sequence

SEQ ID NO: 11111 - DNA, 711 bp, Artificial Sequence
  Description of Artificial Sequence: Synthetic coding sequence
atgaccatgctgcaggagagcttcagcttcgacgacctgagcgtggacttcacccagaaggagtggcagctgctggaccccagccagaagaacctgtacaaggacgtgatgctggagaactacagcagcctggtgagcctgggctacgaggtgatgaagcccgacgtgatcttcaagctggagcagggcgaggagccctgggtgggcgacggcgagatccccagcagcgacagccccgaggtgtggaaggtggacggcaacatgatgtggcaccaggacaaccaggacaagctgaagatcatcaagagaggccacgagtgcgacgccttcggcaagaacttcaacctgaacatgaacttcgtgcccctgagaaagagcaacagcgagggcgacctggacggcctgatcctgaagcaccacctggacctgctgatccccaagggcgactacggcaaggccgagagcgacgacttcaacgtgttcgacaacttcttcctgcacagcaagcccgaggacaccgacacctggctgaagtactacgactgcgacaagtacaaggagagctacaagaagagccagatcatcatctaccacagaaacagactgggcgagaagctgtacgagtgcagcgagtgcagaaagagattcagcaagaagcccagcctgatcaagcaccagagcagacacatcagagacatcgccttcggctag

SEQ ID NO: 11112 - DNA, 204 bp, Artificial Sequence
  Description of Artificial Sequence: Synthetic coding sequence
atgaccatgctgcaggagagcttcagcttcgacgacctgagcgtggacttcacccagaaggagtggcagctgctggaccccagccagaagaacctgtacaaggacgtgatgctggagaactacagcagcctggtgagcctgggctacgaggtgatgaagcccgacgtgatcttcaagctggagcagggcgaggagccctggtag

SEQ ID NO: 11113 - DNA, 237 bp, Artificial Sequence
  Description of Artificial Sequence: Synthetic coding sequence
atgaccatgctgcaggagagcttcagcttcgacgacctgagcgtggacttcacccagaaggagtggcagctgctggaccccagccagaagaacctgtacaaggacgtgatgctggagaactacagcagcctggtgagcctgggctacgaggtgatgaagcccgacgtgatcttcaagctggagcagggcgaggagccctgggtgggcgacggcgagatccccagcagcgacagctag

SEQ ID NO: 11114 - DNA, 2214 bp, Artificial Sequence
  Description of Artificial Sequence: Synthetic coding sequence
atgaccatgctgcaggagagcttcagcttcgacgacctgagcgtggacttcacccagaaggagtggcagctgctggaccccagccagaagaacctgtacaaggacgtgatgctggagaactacagcagcctggtgagcctgggctacgaggtgatgaagcccgacgtgatcttcaagctggagcagggcgaggagccctgggtgggcgacggcgagatccccagcagcgacagccccgtgtggaaggtggacggcaacatgatgtggcaccaggacaaccaggacaagctgaagatcatcaagagaggccacgagtgcgacgccttcggcaagaacttcaacctgaacatgaacttcgtgcccctgagaaagagcaacagcgagggcgacctggacggcctgatcctgaagcaccacctggacctgctgatccccaagggcgactacggcaaggccgagagcgacgacttcaacgtgttcgacaacttcttcctgcacagcaagcccgaggacaccgacacctggctgaagtactacgactgcgacaagtacaaggagagctacaagaagagccagatcatcatctaccacagaaacagactgggcgagaagctgtacgagtgcagcgagtgcagaaagagattcagcaagaagcccagcctgatcaagcaccagagcagacacatcagagacatcgccttcggctgcggcaactgcggcaagaccttcccccagaagagccagttcatcacccaccacagaacccacaccggcgagaagccctacaactgcagccagtgcggcaaggccttcagccagaagagccagctgaccagccaccagagaacccacaccggcgagaagccctacgagtgcggcgagtgcggcaaggccttcagcagaaagagccacctgatcagccactggagaacccacaccggcgagaagccctacggctgcaacgagtgcggcagagccttcagcgagaagagcaacctgatcaaccaccagagaatccacaccggcgagaagcccttcgagtgcagagagtgcggcaaggccttcagcagaaagagccagctggtgacccaccacagaacccacaccggcaccaagcccttcggctgcagcgactgcagaaaggccttcttcgagaagagcgagctgatcagacaccagaccatccacaccggcgagaagccctacgagtgcagcgagtgcagaaaggccttcagagagagaagcagcctgatcaaccaccagagaacccacaccggcgagaagccccacggctgcatccagtgcggcaaggccttcagccagaagagccacctgatcagccaccagatgacccacaccggcgagaagcccttcatctgcagcaagtgcggcaaggccttcagcagaaagagccagctggtgagacaccagagaacccacaccggcgagaagccctacgagtgcagcgagtgcggcaaggccttcagcgagaagctgagcctgaccaaccaccagagaatccacaccggcgagaagccctacgtgtgcagcgagtgcggcaaggccttctgccagaagagccacctgatcagccaccagagaacccacaccggcgagaagccctacgagtgcagcgagtgcggcaaggccttcggcgagaagagcagcctggccacccaccagagaacccacaccggcgagaagccctacgagtgcagagactgcgagaaggccttcagccagaagagccagctgaacacccaccagagaatccacaccggcgagaagccctacgagtgcagcctgtgcagaaaggccttcttcgagaagagcgagctgatcagacacctgagaacccacaccggcgagaagccctacgagtgcaacgagtgcagaaaggccttcagagagaagagcagcctgatcaaccaccagagaatccacaccggcgagaagcccttcgagtgcagcgagtgcggcaaggccttcagcagaaagagccacctgatcccccaccagagaacccacaccggcgagaagccctacggctgcagcgagtgcagaaaggccttcagccagaagagccagctggtgaaccaccagagaatccacaccggcgagaagccctacagatgcatcgagtgcggcaaggccttcagccagaagagccagctgatcaaccaccagagaacccacaccgtgaagaagagctag

SEQ ID NO: 11115 - DNA, 21 bp, Artificial Sequence
  Description of Artificial Sequence: Synthetic coding sequence
atgaccatgctgcaggtgtag

SEQ ID NO: 11116 - DNA, 1503 bp, Artificial Sequence
  Description of Artificial Sequence: Synthetic coding sequence
atgctggagggccacgagagctacgacaccgagaacttctacttcagagagatcagaaagaacctgcaggaggtggacttccagtggaaggacggcgagatcaactacaaggagggccccatgacccacaagaacaacctgaccggccagagagtgagacacagccagggcgacgtggagaacaagcacatggagaaccagctgatcctgagattccagagcggcctgggcgagctgcagaagttccagaccgccgagaagatctacggctgcaaccagatcgagagaaccgtgaacaactgcttcctggccagccccctgcagagaatcttccccggcgtgcagaccaacatcagcagaaagtacggcaacgacttcctgcagctgagcctgcccacccaggacgagaagacccacatcagagagaagccctacatcggcaacgagtgcggcaaggccttcagagtgagcagcagcctgatcaaccaccagatgatccacaccaccgagaagccctacagatgcaacgagagcggcaaggccttccacagaggcagcctgctgaccgtgcaccagatcgtgcacaccagaggcaagccctaccagtgcgacgtgtgcggcagaatcttcagacagaacagcgacctggtgaaccacagaagaagccacaccggcgacaagccctacatctgcaacgagtgcggcaagagcttcagcaagagcagccacctggccgtgcaccagagaatccacaccggcgagaagccctacaagtgcaacagatgcggcaagtgcttcagccagagcagcagcctggccacccaccagaccgtgcacaccggcgacaagccctacaagtgcaacgagtgcggcaagaccttcaagagaaacagcagcctgaccgcccaccacatcatccacgccggcaagaagccctacacctgcgacgtgtgcggcaaggtgttctaccagaacagccagctggtgagacaccagatcatccacaccggcgagaccccctacaagtgcaacgagtgcggcaaggtgttcagatacagaagcggcctggccagacactggagcatccacaccggcgagaagccctacaagtgcaacgagtgcggcaaggccttcagagtgagaagcatcctgctgaaccaccagatgatgcacaccggcgagaagccctacaagtgcaacgagtgcggcaaggccttcatcgagagaagcaacctggtgtaccaccagagaaaccacaccggcgagaagccctacaagtgcatggagtgcggcaaggccttcggcagaagaagctgcctgaccaagcaccagagaatccacagcagcgagaagccctacaagtgcaacgagtgcggcaagagctacatcagcagaagcggcctgaccaagcaccagatcaagcacgccggcgagaacctgaccaccaagctgaacgtggagagacccctggacgtggtgctgaccagcggcatccccaagtag

SEQ ID NO: 11117 - DNA, 2775 bp, Artificial Sequence
  Description of Artificial Sequence: Synthetic coding sequence
atggccctgccccagggcagcctgaccttcagagacgtggccgtggagttcagccaggaggagtggaagtgcctggaccccgtgcagaaggccctgtacagagacgtgatgctggagaactacagaaacctgggcttcctgggcctgtgcctgcccgacctgaacatcatcagcatgctggagcagggcaaggagccctggaccgtggtgagccaggtgaagatcgccagaaaccccaactgcggcgagtgcatgaagggcgtgatcaccggcatcagccccaagtgcgtgatcaaggagctgccccccatccagaacagcaacaccggcgagaagttccaggccgtgatgctggagggccacgagagctacgacaccgagaacttctacttcagagagatcagaaagaacctgcaggaggtggacttccagtggaaggacggcgagatcaactacaaggagggccccatgacccacaagaacaacctgaccggccagagagtgagacacagccagggcgacgtggagaacaagcacatggagaaccagctgatcctgagattccagagcggcctgggcgagctgcagaagttccagaccgccgagaagatctacggctgcaaccagatcgagagaaccgtgaacaactgcttcctggccagccccctgcagagaatcttccccggcgtgcagaccaacatcagcagaaagtacggcaacgacttcctgcagctgagcctgcccacccaggacgagaagacccacatcagagagaagccctacatcggcaacgagtgcggcaaggccttcagagtgagcagcagcctgatcaaccaccagatgatccacaccaccgagaagccctacagatgcaacgagagcggcaaggccttccacagaggcagcctgctgaccgtgcaccagatcgtgcacaccagaggcaagccctaccagtgcgacgtgtgcggcagaatcttcagacagaacagcgacctggtgaaccacagaagaagccacaccggcgacaagccctacatctgcaacgagtgcggcaagagcttcagcaagagcagccacctggccgtgcaccagagaatccacaccggcgagaagccctacaagtgcaacagatgcggcaagtgcttcagccagagcagcagcctggccacccaccagaccgtgcacaccggcgacaagccctacaagtgcaacgagtgcggcaagaccttcaagagaaacagcagcctgaccgcccaccacatcatccacgccggcaagaagccctacacctgcgacgtgtgcggcaaggtgttctaccagaacagccagctggtgagacaccagatcatccacaccggcgagaccccctacaagtgcaacgagtgcggcaaggtgttcttccagagaagcagactggccggccacagaagaatccacaccggcgagaagccctacaagtgcaacgagtgcggcaaggtgttcagccagcacagccacctggccgtgcaccagagagtgcacaccggcgagaagccctacaagtgcaacgagtgcggcaaggccttcaactggggcagcctgctgaccgtgcaccagagaatccacaccggcgagaagccctacaagtgcaacgtgtgcggcaaggtgttcaactacggcggctacctgagcgtgcacatgagatgccacaccggcgagaagcccctgcactgcaacaagtgcggcatggtgttcacctactacagctgcctggccagacaccagagaatgcacaccggcgagaagccctacaagtgcaacgtgtgcggcaaggtgttcatcgacagcggcaacctgagcatccacagaagaagccacaccggcgagaagcccttccagtgcaacgagtgcggcaaggtgttcagctactacagctgcctggccagacacagaaagatccacaccggcgagaagccctacaagtgcaacgactgcggcaaggcctacacccagagaagcagcctgaccaagcacctggtgatccacaccggcgagaacccctaccactgcaacgagttcggcgaggccttcatccagagcagcaagctggccagataccacagaaaccccaccggcgagaagccccacaagtgcagcgagtgcggcagaaccttcagccacaagaccagcctggtgtaccaccagagaagacacaccggcgagatgccctacaagtgcatcgagtgcggcaaggtgttcaacagcaccaccaccctggccagacacagaagaatccacaccggcgagaagccctacaagtgcaacgagtgcggcaaggtgttcagatacagaagcggcctggccagacactggagcatccacaccggcgagaagccctacaagtgcaacgagtgcggcaaggccttcagagtgagaagcatcctgctgaaccaccagatgatgcacaccggcgagaagccctacaagtgcaacgagtgcggcaaggccttcatcgagagaagcaacctggtgtaccaccagagaaaccacaccggcgagaagccctacaagtgcatggagtgcggcaaggccttcggcagaagaagctgcctgaccaagcaccagagaatccacagcagcgagaagccctacaagtgcaacgagtgcggcaagagctacatcagcagaagcggcctgaccaagcaccagatcaagcacgccggcgagaacctgaccaccaagctgaacgtggagagacccctggacgtggtgctgaccagcggcatccccaagtag

SEQ ID NO: 11118 - DNA, 2427 bp, Artificial Sequence
  Description of Artificial Sequence: Synthetic coding sequence
atgctggagggccacgagagctacgacaccgagaacttctacttcagagagatcagaaagaacctgcaggaggtggacttccagtggaaggacggcgagatcaactacaaggagggccccatgacccacaagaacaacctgaccggccagagagtgagacacagccagggcgacgtggagaacaagcacatggagaaccagctgatcctgagattccagagcggcctgggcgagctgcagaagttccagaccgccgagaagatctacggctgcaaccagatcgagagaaccgtgaacaactgcttcctggccagccccctgcagagaatcttccccggcgtgcagaccaacatcagcagaaagtacggcaacgacttcctgcagctgagcctgcccacccaggacgagaagacccacatcagagagaagccctacatcggcaacgagtgcggcaaggccttcagagtgagcagcagcctgatcaaccaccagatgatccacaccaccgagaagccctacagatgcaacgagagcggcaaggccttccacagaggcagcctgctgaccgtgcaccagatcgtgcacaccagaggcaagccctaccagtgcgacgtgtgcggcagaatcttcagacagaacagcgacctggtgaaccacagaagaagccacaccggcgacaagccctacatctgcaacgagtgcggcaagagcttcagcaagagcagccacctggccgtgcaccagagaatccacaccggcgagaagccctacaagtgcaacagatgcggcaagtgcttcagccagagcagcagcctggccacccaccagaccgtgcacaccggcgacaagccctacaagtgcaacgagtgcggcaagaccttcaagagaaacagcagcctgaccgcccaccacatcatccacgccggcaagaagccctacacctgcgacgtgtgcggcaaggtgttctaccagaacagccagctggtgagacaccagatcatccacaccggcgagaccccctacaagtgcaacgagtgcggcaaggtgttcttccagagaagcagactggccggccacagaagaatccacaccggcgagaagccctacaagtgcaacgagtgcggcaaggtgttcagccagcacagccacctggccgtgcaccagagagtgcacaccggcgagaagccctacaagtgcaacgagtgcggcaaggccttcaactggggcagcctgctgaccgtgcaccagagaatccacaccggcgagaagccctacaagtgcaacgtgtgcggcaaggtgttcaactacggcggctacctgagcgtgcacatgagatgccacaccggcgagaagcccctgcactgcaacaagtgcggcatggtgttcacctactacagctgcctggccagacaccagagaatgcacaccggcgagaagccctacaagtgcaacgtgtgcggcaaggtgttcatcgacagcggcaacctgagcatccacagaagaagccacaccggcgagaagcccttccagtgcaacgagtgcggcaaggtgttcagctactacagctgcctggccagacacagaaagatccacaccggcgagaagccctacaagtgcaacgactgcggcaaggcctacacccagagaagcagcctgaccaagcacctggtgatccacaccggcgagaacccctaccactgcaacgagttcggcgaggccttcatccagagcagcaagctggccagataccacagaaaccccaccggcgagaagccccacaagtgcagcgagtgcggcagaaccttcagccacaagaccagcctggtgtaccaccagagaagacacaccggcgagatgccctacaagtgcatcgagtgcggcaaggtgttcaacagcaccaccaccctggccagacacagaagaatccacaccggcgagaagccctacaagtgcaacgagtgcggcaaggtgttcagatacagaagcggcctggccagacactggagcatccacaccggcgagaagccctacaagtgcaacgagtgcggcaaggccttcagagtgagaagcatcctgctgaaccaccagatgatgcacaccggcgagaagccctacaagtgcaacgagtgcggcaaggccttcatcgagagaagcaacctggtgtaccaccagagaaaccacaccggcgagaagccctacaagtgcatggagtgcggcaaggccttcggcagaagaagctgcctgaccaagcaccagagaatccacagcagcgagaagccctacaagtgcaacgagtgcggcaagagctacatcagcagaagcggcctgaccaagcaccagatcaagcacgccggcgagaacctgaccaccaagctgaacgtggagagacccctggacgtggtgctgaccagcggcatccccaagtag

SEQ ID NO: 11119 - DNA, 2001 bp, Artificial Sequence
  Description of Artificial Sequence: Synthetic coding sequence
atggacctggtggccttcgaggacgtggccgtgaacttcacccaggaggagtggagcctgctggaccccagccagaagaacctgtacagagaggtgatgcaggagaccctgagaaacctggccagcatcggcgagaagtggaaggaccagaacatcgaggaccagtacaagaaccccagaaacaacctgagaagcctgctgggcgagagagtggacgagaacaccgaggagaaccactgcggcgagaccagcagccagatccccgacgacaccctgaacaagaagaccagccccggcgtgaagagctgcgagagcagcgtgtgcggcgaggtgttcgtgggccacagcagcctgaacagacacatcagagccgacaccgcccacaagcccagcgagtaccaggagtacggccaggagccctacaagtgccagcagagaaagaaggccttcagatgccaccccagcttccagatgcaggagaaggcccacaccggcgagaagctgtacgactgcaaggagtgcggcaagaccttcatcagccacagcagcatccagagacacatgatcatgcacaacggcgacggcacctacaagtgcaagttctgcggcaaggcctgcccctgcctgagcatctacctgatccacgagagagtgcacaccggcgagaagccctacaagtgcaagcagtgcggcaaggccttcagctacagcaccagcctgcagatccacgagagaacccacaccggcgagaagccctacgagtgcaaggagtgcggcaaggccttcggcagccccaacagcctgtacgagcacagaagaacccacaccggcgagaagccctacgagtgcaagcagtgcggcaaggccttcagatggttccacagcttccagatccacgagagaacccacagcgaggagaaggcctacgagtgcaccaagtgcggcaaggccttcaagtgccccagctacctgtgcagacacgaggtgacccacagcggcaagaagccctgcgagtgcaagcagtgcggcaaggccctgagctacctgaacttccagagacacatgaagatgcacaccagaatgagaccctacaagtgcaagaccgtggagaagcccctgatcctgcccgtgagattcgaggacatgaaggagctgaccctggagagaaacctgatgaacgccagcaccgtggtgaagcccagcatcgtgcccgtgcccttcaccatcatgaagggcctgaccctggagagaaaccccatgaacgtgagcagcgtggtgaagcccagcttcctgcccctgcccttcgacatcatgaagggcctgaccctggagagaaacagaatgagcgtgagcaacgtgggcaagcccagcgacctgccccacaccttcaagtgcatggagggcctgaccctgaagagaaaccccatgaacgtgagcagcgtggtgaagcccagcttcttccccctgcccttcgacatcatgaagggcctgaccctggagagaaaccccatgagcgtgagcaacgtgggcaagcccagccacctgccccacaccttcaagtgcatgaagggcctgaccctggagagcaactgcatgaacctgaacaacgtgaagaagcccctggacctgagcgagaccttcaagttcatgaagagacacaccctggagagaaaccccatcagaaacatggagaagcacagcaccatcagcctgcccttcaagtacatgcagcagtgcaccgaggacagaatgcccatgaacgtgaagagcgtgaccaagcacagctacctgcccagaagcttcgagtacatgcaggagcacaccctggagagaaaccccatgaacgtgagaaacgccgagaagagaagcatcatcttcctgctgtgcgtgtacaccaagggctgcaccctggagagaaaccacatcaacgtgagaatcgtgggcaagcacagcgtgtgcctggtgcccttcgtggacatcaagggcctgaccctggagtag

SEQ ID NO: 11120 - DNA, 1035 bp, Artificial Sequence
  Description of Artificial Sequence: Synthetic coding sequence
atggacctggtggccttcgaggacgtggccgtgaacttcacccaggaggagtggagcctgctggaccccagccagaagaacctgtacagagaggtgatgcaggagaccctgagaaacctggccagcatcggcgagaagtggaaggaccagaacatcgaggaccagtacaagaaccccagaaacaacctgagaagcctgctgggcgagagagtggacgagaacaccgaggagaaccactgcggcgagaccagcagccagatccccgacgacaccctgaacaagaagaccagccccggcgtgaagagctgcgagagcagcgtgtgcggcgaggtgttcgtgggccacagcagcctgaacagacacatcagagccgacacctgccaccccagcttccagatgcaggagaaggcccacaccggcgagaagctgtacgactgcaaggagtgcggcaagaccttcatcagccacagcagcatccagagacacatgatcatgcacaacggcgacggcacctacaagtgcaagttctgcggcaaggcctgcccctgcctgagcatctacctgatccacgagagagtgcacaccggcgagaagccctacaagtgcaagcagtgcggcaaggccttcagctacagcaccagcctgcagatccacgagagaacccacaccggcgagaagccctacgagtgcaaggagtgcggcaaggccttcggcagccccaacagcctgtacgagcacagaagaacccacaccggcgagaagccctacgagtgcaagcagtgcggcaaggccttcagatggttccacagcttccagatccacgagagaacccacagcgaggagaaggcctacgagtgcaccaagtgcggcaaggccttcaagtgccccagctacctgtgcagacacgaggtgacccacagcggcaagaagccctgcgagtgcaagcagtgcggcaaggccctgagctacctgaacttccagagacacgagagaacccacaccggcgagaagccctacgagtgcaagcactgctag

SEQ ID NO: 11121 - DNA, 1578 bp, Artificial Sequence
  Description of Artificial Sequence: Synthetic coding sequence
atggacctggtggccttcgaggacgtggccgtgaacttcacccaggaggagtggagcctgctggaccccagccagaagaacctgtacagagaggtgatgcaggagaccctgagaaacctggccagcatcggcgagaagtggaaggaccagaacatcgaggaccagtacaagaaccccagaaacaacctgagaagcctgctgggcgagagagtggacgagaacaccgaggagaaccactgcggcgagaccagcagccagatccccgacgacaccctgaacaagaagaccagccccggcgtgaagagctgcgagagcagcgtgtgcggcgaggtgttcgtgggccacagcagcctgaacagacacatcagagccgacaccgcccacaagcccagcgagtaccaggagtacggccaggagccctacaagtgccagcagagaaagaaggccttcagatgccaccccagcttccagatgcaggagaaggcccacaccggcgagaagctgtacgactgcaaggagtgcggcaagaccttcatcagccacagcagcatccagagacacatgatcatgcacaacggcgacggcacctacaagtgcaagttctgcggcaaggcctgcccctgcctgagcatctacctgatccacgagagagtgcacaccggcgagaagccctacaagtgcaagcagtgcggcaaggccttcagctacagcaccagcctgcagatccacgagagaacccacaccggcgagaagccctacgagtgcaaggagtgcggcaaggccttcggcagccccaacagcctgtacgagcacagaagaacccacaccggcgagaagccctacgagtgcaagcagtgcggcaaggccttcagatggttccacagcttccagatccacgagagaacccacagcgaggagaaggcctacgagtgcaccaagtgcggcaaggccttcaagtgccccagctacctgtgcagacacgaggtgacccacagcggcaagaagccctgcgagtgcaagcagtgcggcaaggccctgagctacctgaacttccagagacacatgaagatgcacaccagaatgagaccctacaagtgcaagaccgtggagaagcccctgatcctgcccgtgagattcgaggacatgaaggagctgaccctggagagaaacctgatgaacgccagcaccgtggtgaagcccagcatcgtgcccgtgcccttcaccatcatgaagggcctgaccctggagagaaaccccatgaacgtgagcagcgtggtgaagcccagcttcctgcccctgcccttcgacatcatgaagggcctgaccctggagagaaacagaatgagcgtgagcaacgtgggcaagcccagcgacctgccccacaccttcaagtgcatggagggcctgaccctgaagagaaaccccatgaacgtgagcagcgtggtgaagcccagcttcttccccctgcccttcgacatcatgaagggcctgaccctggagagaaaccccatgagcgtgagcaacgtgggcaagcccagccacctgccccacaccttcaagtgcatgaagggccagtag

SEQ ID NO: 11122 - DNA, 183 bp, Artificial Sequence
  Description of Artificial Sequence: Synthetic coding sequence
ctgagcctgccccagggcctgctgaccttcagagacgtggccatcgagttcagccaggaggagtggaagtgcctggaccccgcccagagaaccctgtacagagacgtgatgctggagaactacagaaacctggtgagcctgggcagcagcgccgtgtgcgacctgggcagcccccagccctag

SEQ ID NO: 11123 - DNA, 2661 bp, Artificial Sequence
  Description of Artificial Sequence: Synthetic coding sequence
atggccctgagccagggcctgctgaccttcagagacgtggccatcgagttcagccaggaggagtggaagtgcctggaccccgcccagagaaccctgtacagagacgtgatgctggagaactacagaaacctggtgagcctggacatcagcagcaagtgcatgatgaaggagttcagcagcaccgcccagggcaacaccgaggtgatccacaccggcaccctgcagagacacgagagacaccacatcggcgacttctgcttccaggagatggagaaggacatccacgacttcgagttccagtggaaggaggacgagagaaacagccacgaggcccccatgaccgagatcaagcagctgaccggcagcaccaacagacacgaccagagacacgccggcaacaagcccatcaaggaccagctgggcagcagcttccacagccacctgcccgagctgcacatgttccagaccgagggcaagatcggcaaccaggtggagaagagcatcaacagcgccagcctggtgagcaccagccagagaatcagctgcagacccaagacccacatcagcaagaactacggcaacaacttcctgaacagcagcctgctgacccagaagcaggaggtgcacatgagagagaagagcttccagtgcaacgagagcggcaaggccttcaactacagcagcgtgctgagaaagcaccagatcatccacctgggcgccaagcagtacaagtgcgacgtgtgcggcaaggtgttcaaccagaagagatacctggcctgccacagaagatgccacaccggcaagaagccctacaagtgcaacgactgcggcaagaccttcagccaggagctgaccctgacctgccaccacagactgcacaccggcgagaagcactacaagtgcagcgagtgcggcaagaccttcagcagaaacagcgccctggtgatccacaaggccatccacaccggcgagaagagctacaagtgcaacgagtgcggcaagaccttcagccagaccagctacctggtgtaccacagaagactgcacaccggcgagaagccctacaagtgcgaggagtgcgacaaggccttcagcttcaagagcaacctggagagacacagaaagatccacaccggcgagaagccctacaagtgcaacgagtgcagcagaaccttcagcagaaagagcagcctgaccagacacagaagactgcacaccggcgagaagccctacaagtgcaacgactgcggcaagaccttcagccagatgagcagcctggtgtaccacagaagactgcacaccggcgagaagccctacaagtgcgaggagtgcgacgaggccttcagcttcaagagcaacctggagagacacagaagaatccacaccggcgagaagccctacaagtgcaacgactgcggcaagaccttcagccagaccagcagcctggtgtaccacagaagactgcacaccggcgagaagccctacaagtgcgaggagtgcgacgaggccttcagcttcaagagcaacctggagagacacagaatcatccacaccggcgagaagctgtacaagtgcaacgagtgcggcaagaccttcagcagaaagagcagcctgaccagacactgcagactgcacaccggcgagaagccctaccagtgcaacgagtgcggcaaggccttcagaggccagagcgccctgatctaccaccaggccatccacggcatcggcaagctgtacaagtgcaacgactgccaccaggtgttcagcaacgccaccaccatcgccaaccactggagaatccacaacgaggagagaagctacaagtgcaacagatgcggcaagttcttcagacacagaagctacctggccgtgcactggagaacccacagcggcgagaagccctacaagtgcgaggagtgcgacgaggccttcagcttcaagagcaacctgcagagacacagaagaatccacaccggcgagaagccctacaagtgcgaggagtgcgacaaggtgttcagcagaaagagcagcctggagaagcacagaagaatccacaccggcgagaagccctacaagtgcaaggtgtgcgacaaggccttcggcagagacagccacctggcccagcacaccagaatccacaccggcgagaagccctacaagtgcaacgagtgcggcaagaacttcagacacaacagcgccctggtgatccacaaggccatccacagcggcgagaagccctacaagtgcaacgagtgcggcaagaccttcagacacaacagcgccctggagatccacaaggccatccacaccggcgagaagccctacaagtgcagcgagtgcggcaaggtgttcaacagaaaggccaacctgagcagacaccacagactgcacaccggcgagaagccctacaagtgcaacaagtgcggcaaggtgttcaaccagcaggcccacctggcctgccaccacagaatccacaccggcgagaagccctacaagtgcaacgagtgcggcaagaccttcagacacaacagcgtgctggtgatccacaagaccatccacaccggcgagaagccctacaagtgcaacgagtgcggcaaggtgttcaacagaaaggccaagctggccagacaccacagaatccacaccggcaagaagcactag

SEQ ID NO: 11124 - DNA, 2913 bp, Artificial Sequence
  Description of Artificial Sequence: Synthetic coding sequence
atggccctgagccagggcctgctgaccttcagagacgtggccatcgagttcagccaggaggagtggaagtgcctggaccccgcccagagaaccctgtacagagacgtgatgctggagaactacagaaacctggtgagcctggacatcagcagcaagtgcatgatgaaggagttcagcagcaccgcccagggcaacaccgaggtgatccacaccggcaccctgcagagacacgagagacaccacatcggcgacttctgcttccaggagatggagaaggacatccacgacttcgagttccagtggaaggaggacgagagaaacagccacgaggcccccatgaccgagatcaagcagctgaccggcagcaccaacagacacgaccagagacacgccggcaacaagcccatcaaggaccagctgggcagcagcttccacagccacctgcccgagctgcacatgttccagaccgagggcaagatcggcaaccaggtggagaagagcatcaacagcgccagcctggtgagcaccagccagagaatcagctgcagacccaagacccacatcagcaagaactacggcaacaacttcctgaacagcagcctgctgacccagaagcaggaggtgcacatgagagagaagagcttccagtgcaacgagagcggcaaggccttcaactacagcagcgtgctgagaaagcaccagatcatccacctgggcgccaagcagtacaagtgcgacgtgtgcggcaaggtgttcaaccagaagagatacctggcctgccacagaagatgccacaccggcaagaagccctacaagtgcaacgactgcggcaagaccttcagccaggagctgaccctgacctgccaccacagactgcacaccggcgagaagcactacaagtgcagcgagtgcggcaagaccttcagcagaaacagcgccctggtgatccacaaggccatccacaccggcgagaagagctacaagtgcaacgagtgcggcaagaccttcagccagaccagctacctggtgtaccacagaagactgcacaccggcgagaagccctacaagtgcgaggagtgcgacaaggccttcagcttcaagagcaacctggagagacacagaaagatccacaccggcgagaagccctacaagtgcaacgagtgcagcagaaccttcagcagaaagagcagcctgaccagacacagaagactgcacaccggcgagaagccctacaagtgcaacgactgcggcaagaccttcagccagatgagcagcctggtgtaccacagaagactgcacaccggcgagaagccctacaagtgcgaggagtgcgacgaggccttcagcttcaagagcaacctggagagacacagaagaatccacaccggcgagaagccctacaagtgcaacgactgcggcaagaccttcagccagaccagcagcctggtgtaccacagaagactgcacaccggcgagaagccctacaagtgcgaggagtgcgacgaggccttcagcttcaagagcaacctggagagacacagaatcatccacaccggcgagaagctgtacaagtgcaacgagtgcggcaagaccttcagcagaaagagcagcctgaccagacactgcagactgcacaccggcgagaagccctaccagtgcaacgagtgcggcaaggccttcagaggccagagcgccctgatctaccaccaggccatccacggcatcggcaagctgtacaagtgcaacgactgccaccaggtgttcagcaacgccaccaccatcgccaaccactggagaatccacaacgaggagagaagctacaagtgcaacagatgcggcaagttcttcagacacagaagctacctggccgtgcactggagaacccacagcggcgagaagccctacaagtgcgaggagtgcgacgaggccttcagcttcaagagcaacctgcagagacacagaagaatccacaccggcgagaagccctacagatgcaacgagtgcggcaagaccttcagcagaaagagctacctgacctgccacagaagactgcacaccggcgagaagccctacaagtgcaacgagtgcggcaagaccttcggcagaaacagcgccctgatcatccacaaggccatccacaccggcgagaagccctacaagtgcaacgagtgcggcaaggccttcagccagaagagcagcctgacctgccacctgagactgcacaccggcgagaagccctacaagtgcgaggagtgcgacaaggtgttcagcagaaagagcagcctggagaagcacagaagaatccacaccggcgagaagccctacaagtgcaaggtgtgcgacaaggccttcggcagagacagccacctggcccagcacaccagaatccacaccggcgagaagccctacaagtgcaacgagtgcggcaagaacttcagacacaacagcgccctggtgatccacaaggccatccacagcggcgagaagccctacaagtgcaacgagtgcggcaagaccttcagacacaacagcgccctggagatccacaaggccatccacaccggcgagaagccctacaagtgcagcgagtgcggcaaggtgttcaacagaaaggccaacctgagcagacaccacagactgcacaccggcgagaagccctacaagtgcaacaagtgcggcaaggtgttcaaccagcaggcccacctggcctgccaccacagaatccacaccggcgagaagccctacaagtgcaacgagtgcggcaagaccttcagacacaacagcgtgctggtgatccacaagaccatccacaccggcgagaagccctacaagtgcaacgagtgcggcaaggtgttcaacagaaaggccaagctggccagacaccacagaatccacaccggcaagaagcactag

SEQ ID NO: 11125 - DNA, 1602 bp, Artificial Sequence
  Description of Artificial Sequence: Synthetic coding sequence
atggacagcagccagcacctggtgaccttcgaggacgtggccgtggacttcacccaggaggagtggaccctgctggaccaggcccagagagacctgtacagagacgtgatgctggagaactacaagaacctgatcatcctggccggcagcgagctgttcaagagaagcctgatgagcggcctggagcagatggaggagctgagaaccggcgtgaccggcgtgctgcaggagctggacctgcagctgaagaccaagggcagccccctgctgcaggacatcagcgccgagagaagccccaacggcgtgcagctggagagaagcaacaccgccgagaagctgtacgacagcaaccacagcggcaaggtgttcaacgagcaccccttcctgatgacccacatgatcacccacatcggcgagaagaccagcgaggacaaccagagcggcaaggccctgagaaagaacttcccccacagcttctacaagaagagccacgccgagggcaagatgcccaagtgcgtgaagcacgagaaggccttcaaccagttccccaacctgaccagacagaacaagacccacacccaggagaagctgtgcgagtgcaaggactgctggagaaccttcctgaaccagagcagcctgaagctgcacatcagaagccacaacggcgacaagcactacgtgtgcaaggagtgcggcaaggccttcagcaacagcagccacctgatcggccacggcagaatccacagcggcgagaagccctacgtgtgcaaggagtgcggcaaggccttcacccagagcaccggcctgaagctgcacatcagaacccacagcggcgagaagccctacaagtgcaaggagtgcggcaaggccttcacccacagcagctacctgaccgaccacaccagaatccacagcggcaagaagccctacgtgtgcatggagtgcggcaaggccttcaccagaagcaccggcctgatcctgcacatgagaatccacaccggcgagaagccctacgagtgcaaggagtgcggcaaggccttcatccacagcagctacctgaccaagcacgtgagaatccacagcggcgagaagctgtacctgtgcaaggcctgcggcaaggccttcaccagaagcagcggcctggtgctgcacatgagaacccacaccggcgagaagccctacgagtgcaaggagtgcggcaaggccttcaacaacagcagcatgctgagccagcacgtgagaatccacaccggcgagaagccctacgagtgcaaggagtgcggcaaggccttcacccagagcagcggcctgagcacccacctgagaacccacaccggcgagaaggcctgcgagtgcaaggagtgcggcaaggccttcgccagaagcaccaacctgaacatgcacatgagaacccacaccggcgagaagccctacgcctgcaaggagtgcggcaaggccttcagatacagcacctacctgaacgtgcacaccagaacccacaccggcgccaagccctacgagtgcaagaagtgcggcaagaacttcacccagagcagcgccctggccaagcacctgagaaccaaggcctgcgagaagacctag

SEQ ID NO: 11126 - DNA, 1899 bp, Artificial Sequence
  Description of Artificial Sequence: Synthetic coding sequence
atgctgagagaggaggccgcccagaagagaaaggagaaggagcccggcatggccctgccccagggccacctgaccttcagagacgtggccatcgagttcagcctggaggagtggaagtgcctggaccccacccagagagccctgtacagagccatgatgctggagaactacagaaacctgcacagcgtggacatcagcagcaagtgcatgatgaagaagttcagcagcaccgcccagggcaacaccgaggtggacaccggcaccctggagagacacgagagccaccacatcggcgacttctgcttccagaagatcggcaaggacatccacgacttcgagttccagtggcaggaggacaagagaaacagccacgaggccaccatgacccagatcaagaagctgaccggcagcaccgacagatacgacagaagacaccccggcaacaagcccatcaaggaccagctgggcctgagcttccacagccacctgcccgagctgcacatcttccagaccaagggcaaggtgggcaaccaggtggagaagagcatcaacgacgccagcagcgtgctgaccagccagagaatcagcagcagacccaagatccacatcagcaacaactacgagaacaacttcttccacagcagcctgctgaccctgaagcaggaggtgcacatcagagagaagagcttccagtgcaacgagagcggcaaggccttcaactgcagcagcctgctgagaaagcaccagatcatctacctgggcggcaagcagtacaagtgcgacgtgtgcggcaaggtgttcaaccagaagagatacctggcctgccaccacagatgccacaccggcgagaagccctacaagtgcaacgagtgcggcaaggtgttcaaccagcagagcaacctggccagccaccacagactgcacaccggcgagaagccctacaagtgcgaggagtgcgacaaggtgttcagcagaaagagcaacctggagagacacagaagaatccacaccggcgagaagccctacaagtgcaaggtgtgcgagaaggccttcagaagagacagccacctgacccagcacaccagaatccacaccggcgagaagccctacaagtgcaacgagtgcggcaaggccttcagcggccagagcaccctgatccaccaccaggccatccacggcatcggcaagctgtacaagtgcaacgactgccacaaggtgttcagcaacgccaccaccatcgccaaccactggagaatccacaacgaggagagaagctacaagtgcaacaagtgcggcaagttcttcagaagaagaagctacctggtggtgcactggagaacccacaccggcgagaagccctacaagtgcaacgagtgcggcaagaccttccaccacaacagcgccctggtgatccacaaggccatccacaccggcgagaagccctacaagtgcaacgagtgcggcaagaccttcagacacaacagcgccctggtgatccacaaggccatccacaccggcgagaagccctacaagtgcaacgagtgcggcaaggtgttcaaccagcaggccaccctggccagacaccacagactgcacaccggcgagaagccctacaagtgcgaggagtgcgacaccgtgttcagcagaaagagccaccacgagacccacaagagaatccacaccggcgagaagccctacaagtgcgacgacttcgacgaggccttcagccaggccagcagctacgccaagcagagaagaatccacatgggcgagaagcaccacaagtgcgacgactgcggcaaggccttcaccagccacagccacagaatcagacaccagagaatccacaccggccagaagagctacaagtgccacaagagaggcaaggtgttcagctag

SEQ ID NO: 11127 - DNA, 1122 bp, Artificial Sequence
  Description of Artificial Sequence: Synthetic coding sequence
atgagcctgagaagacacatcggcaaccccgagtacctgatgaagagaatcccccagaaccccagataccagcacatcaagagcagactggacaccggcaacagcatgaccaagtacaccgagaagctggaggagatcaagaagaactacagatacaagaaggacgagctgttcaagagactgaaggtgaccaccttcgcccagctgatcatccaggtggccagcctgagcgaccagaccctggaggtgaccgccgaggagatccagagactggaggacaacgacagcgccgccagcgaccccgacgccgagaccaccgccagaaccaacggcaagggcaaccccggcgagcagagccccagccccgagcagttcatcaacaacgccggcgccggcgacagcagcagaagcaccctgcagagcgtgatcagcggcgtgggcgagctggacctggacaagggccccgtgaagaaggccgagccccacaccaaggacaagccctaccccgactgccccttcctgctgctggacgtgagagacagagacagctaccagcagtgccacatcgtgggcgcctacagctaccccatcgccaccctgagcagaaccatgaacccctacagcaacgacatcctggagtacaagaacgcccacggcaagatcatcatcctgtacgacgacgacgagagactggccagccaggccgccaccaccatgtgcgagagaggcttcgagaacctgttcatgctgagcggcggcctgaaggtgctggcccagaagttccccgagggcctgatcaccggcagcctgcccgccagctgccagcaggccctgccccccggcagcgccagaaagagaagcagccccaagggcccccccctgcccgccgagaacaagtggagattcacccccgaggacctgaagaagatcgagtactacctggaggaggagcagggccccgccgaccaccccagcagactgaaccaggccaacagcagcggcagagagagcaaggtgcccggcgccagaagcgcccagaacctgcccggcggcggccccgccagccacagcaaccccagaagcctgagcagcggccacctgcagggcaagccctggaagtag

SEQ ID NO: 11128 - DNA, 1692 bp, Artificial Sequence
  Description of Artificial Sequence: Synthetic coding sequence
atggccagaagactgctgcccgcccacgtgcaggagagcgtgaccttcagagacgtggccgtgttcttcagccaggacgagtggctgcacctggacagcgcccagagagccctgtacagagaggtgatgctggagaactacagcatcctggtgagcctgggcatcctgttcagcaagcccaaggtgatcagccagctggagcagggcgaggacccctggatggtggagagcggcgtgccccagggcgcccacctgggctgggagagcctgttcggcaccatcgtgagcaaggaggagaaccaggaggtgatgaagaagctgatcatcgacggcaccttcgacttcaagctggagaagacctacatcaacgaggacaagctggagaagcagcagggcaagaagaacagactgttcagcaaggtgctggtgaccatcaagaaggtgtacatgaaggagagaagcttcaagggcgtggagttcggcaagaacctgggcctgaagagcagcctgatcagaaagcccagaatcgtgagcagaggcagaagacccagaagccagcagtacagcgtgctgttcaagcagctgggcgtgaacaccgtgagaaagtgctacaagtgcaacatctgcggcaagatcttcctgcacagcagcagcctgagcaagcaccagagaatccacaccggcgagaagctgtacaagtgcaaggagtgcagaaaggccttcagccagagcagcagcctgacccagcacctgagagtgcacaccggcgagaagccctacatctgcagcgagtgcggcaaggccttcagcttcaccaccagcctgatcggccaccagagaatgcacaccggcgagagaccctacaagtgcaaggagtgcggcaagaccttcaagggcagcagcagcctgaacaaccaccagagaatccacaccggcgagaagccctacaagtgcaacgagtgcggcagagccttcagccagtgcagcagcctgatccagcaccacagaatccacaccggcgagaagccctacgagtgcacccagtgcggcaaggccttcaccagcatcagcagactgagcagacaccacagaatccacaccggcgagaagcccttccactgcaacgagtgcggcaaggtgttcagctaccacagcgccctgatcatccaccagagaatccacaccggcgagaagccctacgcctgcaaggagtgcggcaaggccttcagccagagcagcgccctgatccagcaccagagaatccacaccggcgagaagccctacaagtgcaacgagtgcggcaaggccttcagctggatcagcagactgaacatccaccacagaatccacaccggcgagaagccctacaactgcaaggagtgcggcaaggccttcagcagccacagcggcgtgaacacccacagaaagatccacaccggcgagaagccctacaagtgcaacgactgcgagaaggccttcaaccagagcagcgccctgatccagcaccagagaatccacaccggcgagaagccctacaactgcaaggtgtgcggcaaggccttcagacagagcagcagcctgatgacccacatgagaatccacaccggcgagaagccctacaagtgcaaggagtgcggcaaggccttcagccagagcagcagcctgaccaaccaccagagaacccacaactag

SEQ ID NO: 11129 - DNA, 126 bp, Artificial Sequence
  Description of Artificial Sequence: Synthetic coding sequence
atggccagaagactgctgcccgcccacgtgcaggagagcgtgaccttcagagacgtggccgtgttcttcagccaggacgagtggctgcacctggacagcgcccagagagccctgtacagagagtag

SEQ ID NO: 11130 - DNA, 405 bp, Artificial Sequence
  Description of Artificial Sequence: Synthetic coding sequence
atggccagaagactgctgcccgcccacgtgcaggagagcgtgaccttcagagacgtggccgtgttcttcagccaggacgagtggctgcacctggacagcgcccagagagccctgtacagagaggtgatgctggagaactacagcatcctggtgagcctgggcatcctgttcagcaagcccaaggtgatcagccagctggagcagggcgaggacccctggatggtggagagcggcgtgccccagggcgcccacctgggctgggagagcctgttcggcaccatcgtgagcaaggaggagaaccaggaggtgatgaagaagctgatcatcgacggcaccttcgacttcaagctggagaagacctacatcaacgaggacaagctggagaagcagcagggcaagaagtag

SEQ ID NO: 11131 - DNA, 1713 bp, Artificial Sequence
  Description of Artificial Sequence: Synthetic coding sequence
atgcccggcgagaccgaggagcccagaccccccgagcagcaggaccaggagggcggcgaggccgccaaggccgcccccgaggagccccagcagagaccccccgaggccgtggccgccgcccccgccggcaccaccagcagcagagtgctgagaggcggcagagacagaggcagagccgccgccgccgccgccgccgccgccgtgagcagaagaagaaaggccgagtaccccagaagaagaagaagcagccccagcgccagaccccccgacgtgcccggccagcagccccaggccgccaagagccccagccccgtgcagggcaagaagagccccagactgctgtgcatcgagaaggtgaccaccgacaaggaccccaaggaggagaaggaggaggaggacgacagcgccctgccccaggaggtgagcatcgccgccagcagacccagcagaggctggagaagcagcagaaccagcgtgagcagacacagagacaccgagaacaccagaagcagcagaagcaagaccggcagcctgcagctgatctgcaagagcgagcccaacaccgaccagctggactacgacgtgggcgaggagcaccagagccccggcggcatcagcagcgaggaggaggaggaggaggaggaggagatgctgatcagcgaggaggagatccccttcaaggacgaccccagagacgagacctacaagccccacctggagagagagacccccaagcccagaagaaagagcggcaaggtgaaggaggagaaggagaagaaggagatcaaggtggaggtggaggtggaggtgaaggaggaggagaacgagatcagagaggacgaggagccccccagaaagagaggcagaagaagaaaggacgacaagagccccagactgcccaagagaagaaagaagccccccatccagtacgtgagatgcgagatggagggctgcggcaccgtgctggcccaccccagatacctgcagcaccacatcaagtaccagcacctgctgaagaagaagtacgtgtgcccccaccccagctgcggcagactgttcagactgcagaagcagctgctgagacacgccaagcaccacaccgaccagagagactacatctgcgagtactgcgccagagccttcaagagcagccacaacctggccgtgcacagaatgatccacaccggcgagaagcccctgcagtgcgagatctgcggcttcacctgcagacagaaggccagcctgaactggcacatgaagaagcacgacgccgacagcttctaccagttcagctgcaacatctgcggcaagaagttcgagaagaaggacagcgtggtggcccacaaggccaagagccaccccgaggtgctgatcgccgaggccctggccgccaacgccggcgccctgatcaccagcaccgacatcctgggcaccaaccccgagagcctgacccagcccagcgacggccagggcctgcccctgctgcccgagcccctgggcaacagcaccagcggcgagtgcctgctgctggaggccgagggcatgagcaagagctactgcagcggcaccgagagagtgagcctgatggccgacggcaagatcttcgtgggcagcggcagcagcggcggcaccgagggcctggtgatgaacagcgacatcctgggcgccaccaccgaggtgctgatcgaggacagcgacagcgccggcccctag

SEQ ID NO: 11132 - DNA, 1590 bp, Artificial Sequence
  Description of Artificial Sequence: Synthetic coding sequence
atgcccggcgagaccgaggagcccagaccccccgagcagcaggaccaggagggcggcgaggccgccaaggccgcccccgaggagccccagcagagaccccccgaggccgtggccgccgcccccgccggcaccaccagcagcagagtgctgagaggcggcagagacagaggcagagccgccgccgccgccgccgccgccgccgtgagcagaagaagaaaggccgagtaccccagaagaagaagaagcagccccagcgccagaccccccgacgtgcccggccagcagccccaggccgccaagagccccagccccgtgcagggcaagaagagccccagactgctgtgcatcgagaaggtgaccaccgacaaggaccccaaggaggagaaggaggaggaggacgacagcgccctgccccaggaggtgagcatcgccgccagcagacccagcagaggctggagaagcagcagaaccagcgtgagcagacacagagacaccgagaacaccagaagcagcagaagcaagaccggcagcctgcagctgatctgcaagagcgagcccaacaccgaccagctggactacgacgtgggcgaggagcaccagagccccggcggcatcagcagcgaggaggaggaggaggaggaggaggagatgctgatcagcgaggaggagatccccttcaaggacgaccccagagacgagacctacaagccccacctggagagagagacccccaagcccagaagaaagagcggcaaggtgaaggaggagaaggagaagaaggagatcaaggtggaggtggaggtggaggtgaaggaggaggagaacgagatcagagaggacgaggagccccccagaaagagaggcagaagaagaaaggacgacaagagccccagactgcccaagagaagaaagaagccccccatccagtacgtgagatgcgagatggagggctgcggcaccgtgctggcccaccccagatacctgcagcaccacatcaagtaccagcacctgctgaagaagaagtacgtgtgcccccaccccagctgcggcagactgttcagactgcagaagcagctgctgagacacgccaagcaccacaccgaccagagagactacatctgcgagtactgcgccagagccttcaagagcagccacaacctggccgtgcacagaatgatccacaccggcgagaagcccctgcagtgcgagatctgcggcttcacctgcagacagaaggccagcctgaactggcacatgaagaagcacgacgccgacagcttctaccagttcagctgcaacatctgcggcaagaagttcgagaagaaggacagcgtggtggcccacaaggccaagagccaccccgaggtgctgatcgccgaggccctggccgccaacgccggcgccctgatcaccagcaccgacatcctgggcaccaaccccgagagcctgacccagcccagcgacggccagggcctgcccctgctgcccgagcccctgggcaacagcaccagcggcgagtgcctgctgctggaggccgagggcatgagcaagagctactgcagcggcaccgagagagccagacacagatag

SEQ ID NO: 11133 - DNA, 1464 bp, Artificial Sequence
  Description of Artificial Sequence: Synthetic coding sequence
atggccgccgccgccctgagagcccccacccaggtgaccgtgagccccgagacccacatggacctgaccaagggctgcgtgaccttcgaggacatcgccatctacttcagccaggacgagtggggcctgctggacgaggcccagagactgctgtacctggaggtgatgctggagaacttcgccctggtggccagcctgggctgcggccacggcaccgaggacgaggagacccccagcgaccagaacgtgagcgtgggcgtgagccagagcaaggccggcagcagcacccagaagacccagagctgcgagatgtgcgtgcccgtgctgaaggacatcctgcacctggccgacctgcccggccagaagccctacctggtgggcgagtgcaccaaccaccaccagcaccagaagcaccacagcgccaagaagagcctgaagagagacatggacagagccagctacgtgaagtgctgcctgttctgcatgagcctgaagcccttcagaaagtgggaggtgggcaaggacctgcccgccatgctgagactgctgagaagcctggtgttccccggcggcaagaagcccggcaccatcaccgagtgcggcgaggacatcagaagccagaagagccactacaagagcggcgagtgcggcaaggccagcagacacaagcacacccccgtgtaccaccccagagtgtacaccggcaagaagctgtacgagtgcagcaagtgcggcaaggccttcagaggcaagtacagcctggtgcagcaccagagagtgcacaccggcgagagaccctgggagtgcaacgagtgcggcaagttcttcagccagaccagccacctgaacgaccacagaagaatccacaccggcgagagaccctacgagtgcagcgagtgcggcaagctgttcagacagaacagcagcctggtggaccaccagaagatccacaccggcgccagaccctacgagtgcagccagtgcggcaagagcttcagccagaaggccaccctggtgaagcaccagagagtgcacaccggcgagagaccctacaagtgcggcgagtgcggcaacagcttcagccagagcgccatcctgaaccagcacagaagaatccacaccggcgccaagccctacgagtgcggccagtgcggcaagagcttcagccagaaggccaccctgatcaagcaccagagagtgcacaccggcgagagaccctacaagtgcggcgactgcggcaagagcttcagccagagcagcatcctgatccagcacagaagaatccacaccggcgccagaccctacgagtgcggccagtgcggcaagagcttcagccagaagagcggcctgatccagcaccaggtggtgcacaccggcgagagaccctacgagtgcaacaagtgcggcaacagcttcagccagtgcagcagcctgatccaccaccagaagtgccacaacacctag

SEQ ID NO: 11134 - DNA, 1317 bp, Artificial Sequence
  Description of Artificial Sequence: Synthetic coding sequence
atggacctgaccaagggctgcgtgaccttcgaggacatcgccatctacttcagccaggacgagtggggcctgctggacgaggcccagagactgctgtacctggaggtgatgctggagaacttcgccctggtggccagcctgggctgcggccacggcaccgaggacgaggagacccccagcgaccagaacgtgagcgtgggcgtgagccagagcaaggccggcagcagcacccagaagacccagagctgcgagatgtgcgtgcccgtgctgaaggacatcctgcacctggccgacctgcccggccagaagccctacctggtgggcgagtgcaccaaccaccaccagcaccagaagcaccacagcgccaagaagagcctgaagagagacatggacagagccagctacgtgaagtgctgcctgttctgcatgagcctgaagcccttcagaaagtgggaggtgggcaaggacctgcccgccatgctgagactgctgagaagcctggtgttccccggcggcaagaagcccggcaccatcaccgagtgcggcgaggacatcagaagccagaagagccactacaagagcggcgagtgcggcaaggccagcagacacaagcacacccccgtgtaccaccccagagtgtacaccggcaagaagctgtacgagtgcagcaagtgcggcaaggccttcagaggcaagtacagcctggtgcagcaccagagagtgcacaccggcgagagaccctgggagtgcaacgagtgcggcaagttcttcagccagaccagccacctgaacgaccacagaagaatccacaccggcgagagaccctacgagtgcagccagtgcggcaagagcttcagccagaaggccaccctggtgaagcaccagagagtgcacaccggcgagagaccctacaagtgcggcgagtgcggcaacagcttcagccagagcgccatcctgaaccagcacagaagaatccacaccggcgccaagccctacgagtgcggccagtgcggcaagagcttcagccagaaggccaccctgatcaagcaccagagagtgcacaccggcgagagaccctacaagtgcggcgactgcggcaagagcttcagccagagcagcatcctgatccagcacagaagaatccacaccggcgccagaccctacgagtgcggccagtgcggcaagagcttcagccagaagagcggcctgatccagcaccaggtggtgcacaccggcgagagaccctacgagtgcaacaagtgcggcaacagcttcagccagtgcagcagcctgatccaccaccagaagtgccactag

SEQ ID NO: 11135 - DNA, 1425 bp, Artificial Sequence
  Description of Artificial Sequence: Synthetic coding sequence
atggccgccgccgccctgagagcccccacccagggctgcgtgaccttcgaggacatcgccatctacttcagccaggacgagtggggcctgctggacgaggcccagagactgctgtacctggaggtgatgctggagaacttcgccctggtggccagcctgggctgcggccacggcaccgaggacgaggagacccccagcgaccagaacgtgagcgtgggcgtgagccagagcaaggccggcagcagcacccagaagacccagagctgcgagatgtgcgtgcccgtgctgaaggacatcctgcacctggccgacctgcccggccagaagccctacctggtgggcgagtgcaccaaccaccaccagcaccagaagcaccacagcgccaagaagagcctgaagagagacatggacagagccagctacgtgaagtgctgcctgttctgcatgagcctgaagcccttcagaaagtgggaggtgggcaaggacctgcccgccatgctgagactgctgagaagcctggtgttccccggcggcaagaagcccggcaccatcaccgagtgcggcgaggacatcagaagccagaagagccactacaagagcggcgagtgcggcaaggccagcagacacaagcacacccccgtgtaccaccccagagtgtacaccggcaagaagctgtacgagtgcagcaagtgcggcaaggccttcagaggcaagtacagcctggtgcagcaccagagagtgcacaccggcgagagaccctgggagtgcaacgagtgcggcaagttcttcagccagaccagccacctgaacgaccacagaagaatccacaccggcgagagaccctacgagtgcagcgagtgcggcaagctgttcagacagaacagcagcctggtggaccaccagaagatccacaccggcgccagaccctacgagtgcagccagtgcggcaagagcttcagccagaaggccaccctggtgaagcaccagagagtgcacaccggcgagagaccctacaagtgcggcgagtgcggcaacagcttcagccagagcgccatcctgaaccagcacagaagaatccacaccggcgccaagccctacgagtgcggccagtgcggcaagagcttcagccagaaggccaccctgatcaagcaccagagagtgcacaccggcgagagaccctacaagtgcggcgactgcggcaagagcttcagccagagcagcatcctgatccagcacagaagaatccacaccggcgccagaccctacgagtgcggccagtgcggcaagagcttcagccagaagagcggcctgatccagcaccaggtggtgcacaccggcgagagaccctacgagtgcaacaagtgcggcaacagcttcagccagtgcagcagcctgatccaccaccagaagtgccacaacacctag

SEQ ID NO: 11136 - DNA, 1464 bp, Artificial Sequence; identical to SEQ ID NO: 11133
  Description of Artificial Sequence: Synthetic coding sequence

SEQ ID NO: 11137 - DNA, 1692 bp, Artificial Sequence
  Description of Artificial Sequence: Synthetic coding sequence
atgatgaccgccgagagcagagaggccaccggcctgagcccccaggccgcccaggagaaggacggcatcgtgatcgtgaaggtggaggaggaggacgaggaggaccacatgtggggccaggacagcaccctgcaggacacccccccccccgaccccgagatcttcagacagagattcagaagattctgctaccagaacaccttcggccccagagaggccctgagcagactgaaggagctgtgccaccagtggctgagacccgagatcaacaccaaggagcagatcctggagctgctggtgctggagcagttcctgagcatcctgcccaaggagctgcaggtgtggctgcaggagtacagacccgacagcggcgaggaggccgtgaccctgctggaggacctggagctggacctgagcggccagcaggtgcccggccaggtgcacggccccgagatgctggccagaggcatggtgcccctggaccccgtgcaggagagcagcagcttcgacctgcaccacgaggccacccagagccacttcaagcacagcagcagaaagcccagactgctgcagagcagagccctgcccgccgcccacatccccgcccccccccacgagggcagccccagagaccaggccatggccagcgccctgttcaccgccgacagccaggccatggtgaagatcgaggacatggccgtgagcctgatcctggaggagtggggctgccagaacctggccagaagaaacctgagcagagacaacagacaggagaactacggcagcgccttcccccagggcggcgagaacagaaacgagaacgaggagagcaccagcaaggccgagaccagcgaggacagcgccagcagaggcgagaccaccggcagaagccagaaggagttcggcgagaagagagaccaggagggcaagaccggcgagagacagcagaagaaccccgaggagaagaccagaaaggagaagagagacagcggccccgccatcggcaaggacaagaagaccatcaccggcgagagaggccccagagagaagggcaagggcctgggcagaagcttcagcctgagcagcaacttcaccacccccgaggaggtgcccaccggcaccaagagccacagatgcgacgagtgcggcaagtgcttcaccagaagcagcagcctgatcagacacaagatcatccacaccggcgagaagccctacgagtgcagcgagtgcggcaaggccttcagcctgaacagcaacctggtgctgcaccagagaatccacaccggcgagaagccccacgagtgcaacgagtgcggcaaggccttcagccacagcagcaacctgatcctgcaccagagaatccacagcggcgagaagccctacgagtgcaacgagtgcggcaaggccttcagccagagcagcgacctgaccaagcaccagagaatccacaccggcgagaagccctacgagtgcagcgagtgcggcaaggccttcaacagaaacagctacctgatcctgcacagaagaatccacaccagagagaagccctacaagtgcaccaagtgcggcaaggccttcaccagaagcagcaccctgaccctgcaccacagaatccacgccagagagagagccagcgagtacagccccgccagcctggacgccttcggcgccttcctgaagagctgcgtgtag

SEQ ID NO: 11138 - DNA, 1584 bp, Artificial Sequence
  Description of Artificial Sequence: Synthetic coding sequence
atgtggggccaggacagcaccctgcaggacacccccccccccgaccccgagatcttcagacagagattcagaagattctgctaccagaacaccttcggccccagagaggccctgagcagactgaaggagctgtgccaccagtggctgagacccgagatcaacaccaaggagcagatcctggagctgctggtgctggagcagttcctgagcatcctgcccaaggagctgcaggtgtggctgcaggagtacagacccgacagcggcgaggaggccgtgaccctgctggaggacctggagctggacctgagcggccagcaggtgcccggccaggtgcacggccccgagatgctggccagaggcatggtgcccctggaccccgtgcaggagagcagcagcttcgacctgcaccacgaggccacccagagccacttcaagcacagcagcagaaagcccagactgctgcagagcagagccctgcccgccgcccacatccccgcccccccccacgagggcagccccagagaccaggccatggccagcgccctgttcaccgccgacagccaggccatggtgaagatcgaggacatggccgtgagcctgatcctggaggagtggggctgccagaacctggccagaagaaacctgagcagagacaacagacaggagaactacggcagcgccttcccccagggcggcgagaacagaaacgagaacgaggagagcaccagcaaggccgagaccagcgaggacagcgccagcagaggcgagaccaccggcagaagccagaaggagttcggcgagaagagagaccaggagggcaagaccggcgagagacagcagaagaaccccgaggagaagaccagaaaggagaagagagacagcggccccgccatcggcaaggacaagaagaccatcaccggcgagagaggccccagagagaagggcaagggcctgggcagaagcttcagcctgagcagcaacttcaccacccccgaggaggtgcccaccggcaccaagagccacagatgcgacgagtgcggcaagtgcttcaccagaagcagcagcctgatcagacacaagatcatccacaccggcgagaagccctacgagtgcagcgagtgcggcaaggccttcagcctgaacagcaacctggtgctgcaccagagaatccacaccggcgagaagccccacgagtgcaacgagtgcggcaaggccttcagccacagcagcaacctgatcctgcaccagagaatccacagcggcgagaagccctacgagtgcaacgagtgcggcaaggccttcagccagagcagcgacctgaccaagcaccagagaatccacaccggcgagaagccctacgagtgcagcgagtgcggcaaggccttcaacagaaacagctacctgatcctgcacagaagaatccacaccagagagaagccctacaagtgcaccaagtgcggcaaggccttcaccagaagcagcaccctgaccctgcaccacagaatccacgccagagagagagccagcgagtacagccccgccagcctggacgccttcggcgccttcctgaagagctgcgtgtag

SEQ ID NO: 11139 - DNA, 378 bp, Artificial Sequence
  Description of Artificial Sequence: Synthetic coding sequence
atgatgaccgccgagagcagagaggccaccggcctgagcccccaggccgcccaggagaaggacggcatcgtgatcgtgaaggtggaggaggaggacgaggaggaccacatgtggggccaggacagcaccctgcaggacacccccccccccgaccccgagatcttcagacagagattcagaagattctgctaccagaacaccttcggccccagagaggccctgagcagactgaaggagctgtgccaccagtggctgagacccgagatcaacaccaaggagcagatcctggagctgctggtgctggagcagttcctgagcatcctgcccaaggagctgcaggtgtggctgcaggagtacagacccgacagcggcgagtag

SEQ ID NO: 11140 - DNA, 1053 bp, Artificial Sequence
  Description of Artificial Sequence: Synthetic coding sequence
atggccagcgccctgttcaccgccgacagccaggccatggtgaagatcgaggacatggccgtgagcctgatcctggaggagtggggctgccagaacctggccagaagaaacctgagcagagacaacagacaggagaactacggcagcgccttcccccagggcggcgagaacagaaacgagaacgaggagagcaccagcaaggccgagaccagcgaggacagcgccagcagaggcgagaccaccggcagaagccagaaggagttcggcgagaagagagaccaggagggcaagaccggcgagagacagcagaagaaccccgaggagaagaccagaaaggagaagagagacagcggccccgccatcggcaaggacaagaagaccatcaccggcgagagaggccccagagagaagggcaagggcctgggcagaagcttcagcctgagcagcaacttcaccacccccgaggaggtgcccaccggcaccaagagccacagatgcgacgagtgcggcaagtgcttcaccagaagcagcagcctgatcagacacaagatcatccacaccggcgagaagccctacgagtgcagcgagtgcggcaaggccttcagcctgaacagcaacctggtgctgcaccagagaatccacaccggcgagaagccccacgagtgcaacgagtgcggcaaggccttcagccacagcagcaacctgatcctgcaccagagaatccacagcggcgagaagccctacgagtgcaacgagtgcggcaaggccttcagccagagcagcgacctgaccaagcaccagagaatccacaccggcgagaagccctacgagtgcagcgagtgcggcaaggccttcaacagaaacagctacctgatcctgcacagaagaatccacaccagagagaagccctacaagtgcaccaagtgcggcaaggccttcaccagaagcagcaccctgaccctgcaccacagaatccacgccagagagagagccagcgagtacagccccgccagcctggacgccttcggcgccttcctgaagagctgcgtgtag

SEQ ID NO: 11141 - DNA, 2904 bp, Artificial Sequence
  Description of Artificial Sequence: Synthetic coding sequence
atggccgtggccctggacagccagatcgacgcccccctggaggtggagggctgcctgatcatgaaggtggagaaggaccccgagtgggccagcgagcccatcctggagggcagcgacagcagcgagaccttcagaaagtgcttcagacagttctgctacgaggacgtgaccggcccccacgaggccttcagcaagctgtgggagctgtgctgcagatggctgaagcccgagatgagaagcaaggagcagatcctggagctgctggtgatcgagcagttcctgaccatcctgcccgagaagatccaggcctgggcccagaagcagtgcccccagagcggcgaggaggccgtggccctggtggtgcacctggagaaggagaccggcagactgagacagcaggtgagcagccccgtgcacagagagaagcacagccccctgggcgccgcctgggaggtggccgacttccagcccgagcaggtggagacccagcccagagccgtgagcagagaggagcccggcagcctgcacagcggccaccaggagcagctgaacagaaagagagagagaagacccctgcccaagaacgccagacccagcccctgggtgcccgccctggccgacgagtggaacaccctggaccaggaggtgaccaccaccagactgcccgccggcagccaggagcccgtgaaggacgtgcacgtggccagaggcttcagctacagaaagagcgtgcaccagatccccgcccagagagacctgtacagagacttcagaaaggagaacgtgggcaacgtggtgagcctgggcagcgccgtgagcaccagcaacaagatcaccagactggagcagagaaaggagccctggaccctgggcctgcacagcagcaacaagagaagcatcctgagaagcaactacgtgaaggagaagagcgtgcacgccatccaggtgcccgccagaagcgccggcaagacctggagagagcagcagcagtggggcctggaggacgagaagatcgccggcgtgcactggagctacgaggagaccaagaccttcctggccatcctgaaggagagcagattctacgagaccctgcaggcctgccccagaaacagccaggtgtacggcgccgtggccgagtggctgagagagtgcggcttcctgagaacccccgagcagtgcagaaccaagttcaagagcctgcagaagagctacagaaaggtgagaaacggccacatgctggagccctgcgccttcttcgaggacatggacgccctgctgaaccccgccgccagagcccccagcaccgacaagcccaaggagatgatccccgtgcccagactgaagagaatcgccatcagcgccaaggagcacatcagcctggtggaggaggaggaggccgccgaggacagcgacgacgacgagatcggcatcgagttcatcagaaagagcgagatccacggcgcccccgtgctgttccagaacctgagcggcgtgcactggggctacgaggagaccaagaccttcctggacatcctgagagagaccagattctacgaggccctgcaggcctgccacagaaagagcaagctgtacggcgccgtggccgagcagctgagagagtgcggcttcctgagaacccccgagcagtgcagaaccaagttcaagagcctgcagaagagctacagaaaggtgaagaacggccacgtgctggagagctgcgccttctacaaggagatggacgccctgatcaacagcagagccagcgcccccagccccagcacccccgaggaggtgcccagccccagcagacaggagagaggcggcatcgaggtggagccccaggagcccaccggctgggagcccgaggagaccagccaggaggccgtgatcgaggacagctgcagcgagagaatgagcgaggaggagatcgtgcaggagcccgagttccagggcccccccggcctgctgcagagccccaacgacttcgagatcggcagcagcatcaaggaggaccccacccagatcgtgtacaaggacatggagcagcacagagccctgatcgagaagagcaagagagtggtgagccagagcaccgaccccagcaagtacagaaagagagagtgcatcagcggcagacagtgggagaacctgcagggcatcagacagggcaagcccatgagccagcccagagacctgggcaaggccgtggtgcaccagagacccttcgtgggcaagagaccctacagactgctgaagtacggcgagagcttcggcagaagcaccagactgatgtgcagaatgacccaccacaaggagaacccctacaagtgcggcgtgtgcggcaagtgcttcggcagaagcagaagcctgatcagacaccagagaatccacaccggcgagaagcccttcaagtgcctggactgcggcaagagcttcaacgacagcagcaacttcggcgcccaccagagaatccacaccggcgagaagccctacagatgcggcgagtgcggcaagtgcttcagccagagcagcagcctgatcatccaccagagaacccacaccggcgagaagccctaccagtgcggcgagtgcggcaagagcttcaccaacagcagccacttcagcgcccacagaagagtgcacaccggcgagaacccctacaagtgcgtggactgcgagaagagcttcaacaactgcaccagattcagagagcacagaagaatccacaccggcgagaagccctacggctgcgcccagtgcggcaagagattcagcaagagcagcgtgctgaccaagcacagagaggtgcacgtgagagagaagcccctgccccacccccccagcctgtactgccccgagaacccccacaagggcaagaccgacgagttcagaaagaccttctag

SEQ ID NO: 11142 - DNA, 2511 bp, Artificial Sequence
  Description of Artificial Sequence: Synthetic coding sequence
atggccgtggccctggacagccagatcgacgcccccctggaggtggagggctgcctgatcatgaaggtggagaaggaccccgagtgggccagcgagcccatcctggagggcagcgacagcagcgagaccttcagaaagtgcttcagacagttctgctacgaggacgtgaccggcccccacgaggccttcagcaagctgtgggagctgtgctgcagatggctgaagcccgagatgagaagcaaggagcagatcctggagctgctggtgatcgagcagttcctgaccatcctgcccgagaagatccaggcctgggcccagaagcagtgcccccagagcggcgaggaggccgtggccctggtggtgcacctggagaaggagaccggcagactgagacagcaggtgagcagccccgtgcacagagagaagcacagccccctgggcgccgcctgggaggtggccgacttccagcccgagcaggtggagacccagcccagagccgtgagcagagaggagcccggcagcctgcacagcggccaccaggagcagctgaacagaaagagagagagaagacccctgcccaagaacgccagacccagcccctgggtgcccgccctggccgacgagtggaacaccctggaccaggaggtgaccaccaccagactgcccgccggcagccaggagcccgtgaaggacgtgcacgtggccagaggcttcagctacagaaagagcgtgcaccagatccccgcccagagagacctgtacagagacttcagaaaggagaacgtgggcaacgtggtgagcctgggcagcgccgtgagcaccagcaacaagatcaccagactggagcagagaaaggagccctggaccctgggcctgcacagcagcaacaagagaagcatcctgagaagcaactacgtgaaggagaagagcgtgcacgccatccaggtgcccgccagaagcgccggcaagacctggagagagcagcagcagtggggcctggaggacgagaagatcgccggcgtgcactggagctacgaggagaccaagaccttcctggccatcctgaaggagagcagattctacgagaccctgcaggcctgccccagaaacagccaggtgtacggcgccgtggccgagtggctgagagagtgcggcttcctgagaacccccgagcagtgcagaaccaagttcaagagcctgcagaagagctacagaaaggtgagaaacggccacatgctggagccctgcgccttcttcgaggacatggacgccctgctgaaccccgccgccagagcccccagcaccgacaagcccaaggagatgatccccgtgcccagactgaagagaatcgccatcagcgccaaggagcacatcagcctggtggaggaggaggaggccgccgaggacagcgacgacgacgagatcggcatcgagttcatcagaaagagcgagatccacggcgcccccgtgctgttccagaacctgagcggcgtgcactggggctacgaggagaccaagaccttcctggacatcctgagagagaccagattctacgaggccctgcaggcctgccacagaaagagcaagctgtacggcgccgtggccgagcagctgagagagtgcggcttcctgagaacccccgagcagtgcagaaccaagttcaagagcctgcagaagagctacagaaaggtgaagaacggccacgtgctggagagctgcgccttctacaaggagatggacgccctgatcaacagcagagccagcgcccccagccccagcacccccgaggaggtgcccagccccagcagacaggagagaggcggcatcgaggtggagccccaggagcccaccggctgggagcccgaggagaccagccaggaggccgtgatcgaggacagctgcagcgagagaatgagcgaggaggagatcgtgcaggagcccgagttccagggcccccccggcctgctgcagagccccaacgacttcgagatcggcagcagcatcaaggaggaccccacccagatcgtgtacaaggacatggagcagcacagagccctgatcgagaagagcaagagagtggtgagccagagcaccgaccccagcaagtacagaaagagagagtgcatcagcggcagacagtgggagaacctgcagggcatcagacagggcaagcccatgagccagcccagagacctgggcaaggccgtggtgcaccagagacccttcgtgggcaagagaccctacagactgctgaagtacggcgagagcttcggcagaagcaccagactgatgtgcagaatgacccaccacaaggagaacccctacaagtgcggcgtgtgcggcaagtgcttcggcagaagcagaagcctgatcagacaccagagaatccacaccggcgagaagcccttcaagtgcctggactgcggcaagagcttcaacgacagcagcaacttcggcgcccaccagagaatccacaccggcgagaagcccagcatcagcgtgctgccctag

SEQ ID NO: 11143 - DNA, 2520 bp, Artificial Sequence
  Description of Artificial Sequence: Synthetic coding sequence
atgatcatgaccgagagcagagaggtgatcgacctggacccccccgccgagaccagccaggagcaggaggacctgttcatcgtgaaggtggaggaggaggactgcacctggatgcaggagtacaacccccccaccttcgagaccttctaccagagattcagacacttccagtaccacgaggccagcggccccagagaggccctgagccagctgagagtgctgtgctgcgagtggctgagacccgagctgcacaccaaggagcagatcctggagctgctggtgctggagcagttcctgaccatcctgcccgaggagttccagccctgggtgagagagcaccaccccgagagcggcgaggaggccgtggccgtgatcgagaacatccagagagagctggaggagagaagacagcagatcgtggcctgccccgacgtgctgcccagaaagatggccacccccggcgccgtgcaggagagctgcagcccccaccccctgaccgtggacacccagcccgagcaggccccccagaagcccagactgctggaggagaacgccctgcccgtgctgcaggtgcccagcctgcccctgaaggacagccaggagctgaccgccagcctgctgagcaccggcagccagaagctggtgaagatcgaggaggtggccgacgtggccgtgagcttcatcctggaggagtggggccacctggaccagagccagaagagcctgtacagagacgacagaaaggagaactacggcagcatcaccagcatgggctacgagagcagagacaacatggagctgatcgtgaagcagatcagcgacgacagcgagagccactgggtggcccccgagcacaccgagagaagcgtgccccaggaccccgacttcgccgaggtgagcgacctgaagggcatggtgcagagatggcaggtgaaccccaccgtgggcaagagcagacagaaccccagccagaagagagacctggacgccatcaccgacatcagccccaagcagagcacccacggcgagagaggccacagatgcagcgactgcggcaagttcttcctgcaggccagcaacttcatccagcacagaagaatccacaccggcgagaagcccttcaagtgcggcgagtgcggcaagagctacaaccagagagtgcacctgacccagcaccagagagtgcacaccggcgagaagccctacaagtgccaggtgtgcggcaaggccttcagagtgagcagccacctggtgcagcaccacagcgtgcacagcggcgagagaccctacggctgcaacgagtgcggcaagaacttcggcagacacagccacctgatcgagcacctgaagagacacttcagagagaagagccagagatgcagcgacaagagaagcaagaacaccaagctgagcgtgaagaagaagatcagcgagtacagcgaggccgacatggagctgagcggcaagacccagagaaacgtgagccaggtgcaggacttcggcgagggctgcgagttccagggcaagctggacagaaagcagggcatccccatgaaggagatcctgggccagcccagcagcaagagaatgaactacagcgaggtgccctacgtgcacaagaagagcagcaccggcgagagaccccacaagtgcaacgagtgcggcaagagcttcatccagagcgcccacctgatccagcaccagagaatccacaccggcgagaagcccttcagatgcgaggagtgcggcaagagctacaaccagagagtgcacctgacccagcaccagagagtgcacaccggcgagaagccctacacctgccccctgtgcggcaaggccttcagagtgagaagccacctggtgcagcaccagagcgtgcacagcggcgagagacccttcaagtgcaacgagtgcggcaagggcttcggcagaagaagccacctggccggccacctgagactgcacagcagagagaagagccaccagtgcagagagtgcggcgagatcttcttccagtacgtgagcctgatcgagcaccaggtgctgcacatgggccagaagaacgagaagaacggcatctgcgaggaggcctacagctggaacctgaccgtgatcgaggacaagaagatcgagctgcaggagcagccctaccagtgcgacatctgcggcaaggccttcggctacagcagcgacctgatccagcactacagaacccacaccgccgagaagccctaccagtgcgacatctgcagagagaacgtgggccagtgcagccacaccaagcagcaccagaagatctacagcagcaccaagagccaccagtgccacgagtgcggcagaggcttcaccctgaagagccacctgaaccagcaccagagaatccacaccggcgagaagcccttccagtgcaaggagtgcggcatgaacttcagctggagctgcagcctgttcaagcacctgagaagccacgagagaaccgaccccatcaacaccctgagcgtggagggcagcctgctgtag

SEQ ID NO: 11144 - DNA, 2520 bp, Artificial Sequence; identical to SEQ ID NO: 11143
  Description of Artificial Sequence: Synthetic coding sequence

SEQ ID NO: 11145 - DNA, 291 bp, Artificial Sequence
  Description of Artificial Sequence: Synthetic coding sequence
ttcagacacttccagtaccacgaggccagcggccccagagaggccctgagccagctgagagtgctgtgctgcgagtggctgagacccgagctgcacaccaaggagcagatcctggagctgctggtgctggagcagttcctgaccatcctgcccgaggagttccagccctgggtgagagagcaccaccccgagagcggcgaggaggccgtggccgtgatcgagaacatccagagagagctggaggagagaagacagcaggtgagcagagcccagtggctgaccctggtgtag

SEQ ID NO: 11146 - DNA, 2520 bp, Artificial Sequence; identical to SEQ ID NO: 11143
  Description of Artificial Sequence: Synthetic coding sequence

SEQ ID NO: 11147 - DNA, 2301 bp, Artificial Sequence
  Description of Artificial Sequence: Synthetic coding sequence
atgatcatgaccgagagcagagaggtgatcgacctggacccccccgccgagaccagccaggagcaggaggacctgttcatcgtgaaggtggaggaggaggactgcacctggatgcaggagtacaacccccccaccttcgagaccttctaccagagattcagacacttccagtaccacgaggccagcggccccagagaggccctgagccagctgagagtgctgtgctgcgagtggctgagacccgagctgcacaccaaggagcagatcctggagctgctggtgctggagcagttcctgaccatcctgcccgaggagttccagccctgggtgagagagcaccaccccgagagcggcgaggaggccgtggccgtgatcgagaacatccagagagagctggaggagagaagacagcagatcgtggcctgccccgacgtgctgcccagaaagatggccacccccggcgccgtgcaggagagctgcagcccccaccccctgaccgtggacacccagcccgagcaggccccccagaagcccagactgctggaggagaacgccctgcccgtgctgcaggtgcccagcctgcccctgaaggacagccaggagctgaccgccagcctgctgagcaccggcagccagaagctggtgaagatcgaggaggtggccgacgtggccgtgagcttcatcctggaggagtggggccacctggaccagagccagaagagcctgtacagagacgacagaaaggagaactacggcagcatcaccagcatgggctacgagagcagagacaacatggagctgatcgtgaagcagatcagcgacgacagcgagagccactgggtggcccccgagcacaccgagagaagcgtgccccaggaccccgacttcgccgaggtgagcgacctgaagggcatggtgcagagatggcaggtgaaccccaccgtgggcaagagcagacagaaccccagccagaagagagacctggacgccatcaccgacatcagccccaagcagagcacccacggcgagagaggccacagatgcagcgactgcggcaagttcttcctgcaggccagcaacttcatccagcacagaagaatccacaccggcgagaagcccttcaagtgcggcgagtgcggcaagagctacaaccagagagtgcacctgacccagcaccagagagtgcacaccggcgagaagccctacaagtgccaggtgtgcggcaaggccttcagagtgagcagccacctggtgcagcaccacagcgtgcacagcggcgagagaccctacggctgcaacgagtgcggcaagaacttcggcagacacagccacctgatcgagcacctgaagagacacttcagagagaagagccagagatgcagcgacaagagaagcaagaacaccaagctgagcgtgaagaagaagatcagcgagtacagcgaggccgacatggagctgagcggcaagacccagagaaacgtgagccaggtgcaggacttcggcgagggctgcgagttccagggcaagctggacagaaagcagggcatccccatgaaggagatcctgggccagcccagcagcaagagaatgaactacagcgaggtgccctacgtgcacaagaagagcagcaccggcgagagaccccacaagtgcaacgagtgcggcaagagcttcatccagagcgcccacctgatccagcaccagagaatccacaccggcgagaagcccttcagatgcgaggagtgcggcaagagctacaaccagagagtgcacctgacccagcaccagagagtgcacaccggcgagaagccctacacctgccccctgtgcggcaaggccttcagagtgagaagccacctggtgcagcaccagagcgtgcacagcggcgagagacccttcaagtgcaacgagtgcggcaagggcttcggcagaagaagccacctggccggccacctgagactgcacagcagagagaagagccaccagtgcagagagtgcggcgagatcttcttccagtacgtgagcctgatcgagcaccaggtgctgcacatgggccagaagaacgagaagaacggcatctgcgaggaggcctacagctggaacctgaccgtgatcgaggacaagaagatcgagctgcaggagcagccctaccagtgcgacatctgcggcaaggccttcggctacagcagcgacctgatccagcactacagaacccacaccgccgagaagccctaccagtgcgacatctgcagagtggtgatctacagaatgagcttcagcctgcactgcagctgggactag

SEQ ID NO: 11148 - DNA, 1446 bp, Artificial Sequence
  Description of Artificial Sequence: Synthetic coding sequence
atgagaggcctgcccagaaagagagaggcctggacccagccccaccccctggaggccctgtacgagagcctgagagtgctggagaaggacaccagcgccaccagccagagcgtgaacggcagcccccaggccgagcagcccagcctggagagcaccagcaaggaggccttcttcagcagagtggagaccttcagcagcctgaagtgggccggcaagcccttcgagctgagccccctggtgtgcgccaagtacggctgggtgaccgtggagtgcgacatgctgaagtgcagcagctgccaggccttcctgtgcgccagcctgcagcccgccttcgacttcgacagatacaagcagagatgcgccgagctgaagaaggccctgtgcaccgcccacgagaagttctgcttctggcccgacagccccagccccgacagattcggcatgctgcccctggacgagcccgccatcctggtgagcgagttcctggacagattccagagcctgtgccacctggacctgcagctgcccagcctgagacccgaggacctgaagaccatgtgcctgaccgaggacaagatcagcctgctgctgcacctgctggaggacgagctggaccacagaaccgacgagagaaagaccaccatcaagctgggcagcgacatccaggtgcacgtgaccgcctgcatcctgagcgtgtgcggctgggcctgcagcagcagcctggagagcatgcagctgagcctgatcacctgcagccagtgcatgagaaaggtgggcctgtggggcttccagcagatcgagagcagcatgaccgacctggacgccagcttcggcctgaccagcagccccatccccggcctggagggcagacccgagagactgcccctggtgcccgagagccccagaagaatgatgaccagaagccaggacgccaccttcagccccggcagcgagcaggccgagaagagccccggccccatcgtgagcagaaccagaagctgggacagcagcagccccgtggacagacccgagcccgaggccgccagccccaccaccagaaccagacccgtgaccagaagcatgggcaccggcgacacccccggcctggaggtgcccagcagccccctgagaaaggccaagagagccagactgtgcagcagcagcagcagcgacaccagcagcagaagcttcttcgaccccaccagccagcacagagactggtgcccctgggtgaacatcaccctgggcaaggagagcagagagaacggcggcaccgagcccgacgccagcgcccccgccgagcccggctggaaggccgtgctgaccatcctgctggcccacaagcagagcagccagcccgccgagaccgacagcatgagcctgagcgagaagagcagaaaggtgttcagaatcttcagacagtgggagagcctgtgcagctgctag

SEQ ID NO: 11149 - DNA, 1509 bp, Artificial Sequence
  Description of Artificial Sequence: Synthetic coding sequence
atggccgccccctgcgagggccaggccttcgccgtgggcgtggagaagaactggggcgccgtggtgagaagccccgagggcaccccccagaagatcagacagctgatcgacgagggcatcgcccccgaggagggcggcgtggacgccaaggacaccagcgccaccagccagagcgtgaacggcagcccccaggccgagcagcccagcctggagagcaccagcaaggaggccttcttcagcagagtggagaccttcagcagcctgaagtgggccggcaagcccttcgagctgagccccctggtgtgcgccaagtacggctgggtgaccgtggagtgcgacatgctgaagtgcagcagctgccaggccttcctgtgcgccagcctgcagcccgccttcgacttcgacagatacaagcagagatgcgccgagctgaagaaggccctgtgcaccgcccacgagaagttctgcttctggcccgacagccccagccccgacagattcggcatgctgcccctggacgagcccgccatcctggtgagcgagttcctggacagattccagagcctgtgccacctggacctgcagctgcccagcctgagacccgaggacctgaagaccatgtgcctgaccgaggacaagatcagcctgctgctgcacctgctggaggacgagctggaccacagaaccgacgagagaaagaccaccatcaagctgggcagcgacatccaggtgcacgtgaccgcctgcatcctgagcgtgtgcggctgggcctgcagcagcagcctggagagcatgcagctgagcctgatcacctgcagccagtgcatgagaaaggtgggcctgtggggcttccagcagatcgagagcagcatgaccgacctggacgccagcttcggcctgaccagcagccccatccccggcctggagggcagacccgagagactgcccctggtgcccgagagccccagaagaatgatgaccagaagccaggacgccaccttcagccccggcagcgagcaggccgagaagagccccggccccatcgtgagcagaaccagaagctgggacagcagcagccccgtggacagacccgagcccgaggccgccagccccaccaccagaaccagacccgtgaccagaagcatgggcaccggcgacacccccggcctggaggtgcccagcagccccctgagaaaggccaagagagccagactgtgcagcagcagcagcagcgacaccagcagcagaagcttcttcgaccccaccagccagcacagagactggtgcccctgggtgaacatcaccctgggcaaggagagcagagagaacggcggcaccgagcccgacgccagcgcccccgccgagcccggctggaaggccgtgctgaccatcctgctggcccacaagcagagcagccagcccgccgagaccgacagcatgagcctgagcgagaagagcagaaaggtgttcagaatcttcagacagtgggagagcctgtgcagctgctag

SEQ ID NO: 11150 - DNA, 1296 bp, Artificial Sequence
  Description of Artificial Sequence: Synthetic coding sequence
atggccgccccctgcgagggccaggccttcgccgtgggcgtggagaagaactggggcgccgtggtgagaagccccgagggcaccccccagaagatcagacagctgatcgacgagggcatcgcccccgaggagggcggcgtggacgccaaggacaccagcgccaccagccagagcgtgaacggcagcccccaggccgagcagcccagcctggagagcaccagcaaggaggccttcttcagcagagtggagaccttcagcagcctgaagtgggccggcaagcccttcgagctgagccccctggtgtgcgccaagtacggctgggtgaccgtggagtgcgacatgctgaagtgcagcagctgccaggccttcctgtgcgccagcctgcagcccgccttcgacttcgacagatacaagcagagatgcgccgagctgaagaaggccctgtgcaccgcccacgagaagttctgcttctggcccgacagccccagccccgacagattcggcatgctgcccctggacgagcccgccatcctggtgagcgagttcctggacagattccagagcctgtgccacctggacctgcagctgcccagcctgagacccgaggacctgaagaccatgtgcctgaccgaggacaagatcagcctgctgctgcacctgctggaggacgagctggaccacagaaccgacgagagaaagaccaccatcaagctgggcagcgacatccaggtgcacgtgaccgcctgcatcctgagcgtgtgcggctgggcctgcagcagcagcctggagagcatgcagctgagcctgatcacctgcagccagtgcatgagaaaggtgggcctgtggggcttccagcagatcgagagcagcatgaccgacctggacgccagcttcggcctgaccagcagccccatccccggcctggagggcagacccgagagactgcccctggtgcccgagagccccagaagaatgatgaccagaagccaggacgccaccttcagccccggcagcgagcaggacaccagcagcagaagcttcttcgaccccaccagccagcacagagactggtgcccctgggtgaacatcaccctgggcaaggagagcagagagaacggcggcaccgagcccgacgccagcgcccccgccgagcccggctggaaggccgtgctgaccatcctgctggcccacaagcagagcagccagcccgccgagaccgacagcatgagcctgagcgagaagagcagaaaggtgttcagaatcttcagacagtgggagagcctgtgcagctgctag

SEQ ID NO: 11151 - DNA, 1596 bp, Artificial Sequence
  Description of Artificial Sequence: Synthetic coding sequence
atggacgaggagagcctggagagcgccctgcagacctacagagcccagctgcagcaggtggagctggccctgggcgccggcctggacagcagcgagcaggccgacctgagacagctgcagggcgacctgaaggagctgatcgagctgaccgaggccagcctggtgagcgtgagaaagagcagcctgctggccgccctggacgaggagagacccggcagacaggaggacgccgagtaccaggccttcagagaggccatcaccgaggccgtggaggcccccgccgccgccagaggcagcggcagcgagaccgtgcccaaggccgaggccggccccgagagcgccgccggcggccaggaggaggaggagggcgaggacgaggaggagctgagcggcaccaaggtgagcgccccctactacagcagctggggcaccctggagtaccacaacgccatggtggtgggcaccgaggaggccgaggacggcagcgccggcgtgagagtgctgtacctgtaccccacccacaagagcctgaagccctgccccttcttcctggagggcaagtgcagattcaaggagaactgcagattcagccacggccaggtggtgagcctggacgagctgagacccttccaggaccccgacctgagcagcctgcaggccggcagcgcctgcctggccaagcaccaggacggcctgtggcacgccgccagaatcaccgacgtggacaacggctactacaccgtgaagttcgacagcctgctgctgagagaggccgtggtggagggcgacggcatcctgccccccctgagaaccgaggccaccgagagcgacagcgacagcgacggcaccggcgacagcagctacgccagagtggtgggcagcgacgccgtggacagcgcccagagcagcgccctgtgccccagcctggccgtggtgggcagcgacgccgtggacagcggcacctgcagcagcgccttcgccggctgggaggtgcacaccagaggcatcggcagcagactgctgaccaagatgggctacgagttcggcaagggcctgggcagacacgccgagggcagagtggagcccatccacgccgtggtgctgcccagaggcaagagcctggaccagtgcgtggagaccctgcagaagcagaccagagtgggcaaggccggcaccaacaagccccccagatgcagaggcagaggcgccagacccggcggcagacccgcccccagaaacgtgttcgacttcctgaacgagaagctgcagggccaggcccccggcgccctggaggccggcgccgcccccgccggcagaagaagcaaggacatgtaccacgccagcaagagcgccaagagagccctgagcctgagactgttccagaccgaggagaagatcgagagaacccagagagacatcagaagcatccaggaggccctggccagaaacgccggcagacacagcgtggccagcgcccagctgcaggagaagctggccggcgcccagagacagctgggccagctgagagcccaggaggccggcctgcagcaggagcagagaaaggccgacacccacaagaagatgaccgagttctag

SEQ ID NO: 11152 - DNA, 1536 bp, Artificial Sequence
  Description of Artificial Sequence: Synthetic coding sequence
atggacgaggagagcctggagagcgccctgcagacctacagagcccagctgcagcaggtggagctggccctgggcgccggcctggacagcagcgagcaggccgacctgagacagctgcagggcgacctgaaggagctgatcgagctgaccgaggccagcctggtgagcgtgagaaagagcagcctgctggccgccctggacgaggagagacccggcagacaggaggacgccgagtaccaggccttcagagaggccatcaccgaggccgtggaggcccccgccgccgccagaggcagcggcagcgagaccgtgcccaaggccgaggccggccccgagagcgccgccggcggccaggaggaggaggagggcgaggacgaggaggagctgagcggcaccaaggtgagcgccccctactacagcagctggggcaccctggagtaccacaacgccatggtggtgggcaccgaggaggccgaggacggcagcgccggcgtgagagtgctgtacctgtaccccacccacaagagcctgaagccctgccccttcttcctggagggcaagtgcagattcaaggagaactgcagattcagccacggccaggtggtgagcctggacgagctgagacccttccaggaccccgacctgagcagcctgcaggccggcagcgcctgcctggccaagcaccaggacggcctgtggcacgccgccagaatcaccgacgtggacaacggctactacaccgtgaagttcgacagcctgctgctgagagaggccgtggtggagggcgacggcatcctgccccccctgagaaccgaggccaccgagagcgacagcgacagcgacggcaccggcgacagcagctacgccagagtggtgggcagcgacgccgtggacagcggcacctgcagcagcgccttcgccggctgggaggtgcacaccagaggcatcggcagcagactgctgaccaagatgggctacgagttcggcaagggcctgggcagacacgccgagggcagagtggagcccatccacgccgtggtgctgcccagaggcaagagcctggaccagtgcgtggagaccctgcagaagcagaccagagtgggcaaggccggcaccaacaagccccccagatgcagaggcagaggcgccagacccggcggcagacccgcccccagaaacgtgttcgacttcctgaacgagaagctgcagggccaggcccccggcgccctggaggccggcgccgcccccgccggcagaagaagcaaggacatgtaccacgccagcaagagcgccaagagagccctgagcctgagactgttccagaccgaggagaagatcgagagaacccagagagacatcagaagcatccaggaggccctggccagaaacgccggcagacacagcgtggccagcgcccagctgcaggagaagctggccggcgcccagagacagctgggccagctgagagcccaggaggccggcctgcagcaggagcagagaaaggccgacacccacaagaagatgaccgagttctag

SEQ ID NO: 11153 - DNA, 1509 bp, Artificial Sequence
  Description of Artificial Sequence: Synthetic coding sequence
atggacgaggagagcctggagagcgccctgcagacctacagagcccagctgcagcaggtggagctggccctgggcgccggcctggacagcagcgagcaggccgacctgagacagctgcagggcgacctgaaggagctgatcgagctgaccgaggccagcctggtgagcgtgagaaagagcagcctgctggccgccctggacgaggagagacccggcagacaggaggacgccgagtaccaggccttcagagaggccatcaccgaggccgtggaggcccccgccgccgccagaggcagcggcagcgagaccgtgcccaaggccgaggccggccccgagagcgccgccggcggccaggaggaggaggagggcgaggacgaggaggagctgagcggcaccaaggtgagcgccccctactacagcagctggggcaccctggagtaccacaacgccatggtggtgggcaccgaggaggccgaggacggcagcgccggcgtgagagtgctgtacctgtaccccacccacaagagcctgaagccctgccccttcttcctggagggcaagtgcagattcaaggagaactgcagattcagccacggccaggtggtgagcctggacgagctgagacccttccaggaccccgacctgagcagcctgcaggccggcagcgcctgcctggccaagcaccaggacggcctgtggcacgccgccagaatcaccgacgtggacaacggctactacaccgtgaagttcgacagcctgctgctgagagaggccgtggtggagggcgacggcatcctgccccccctgagaaccgaggccaccgagagcgacagcgacagcgacgtggtgggcagcgacgccgtggacagcggcacctgcagcagcgccttcgccggctgggaggtgcacaccagaggcatcggcagcagactgctgaccaagatgggctacgagttcggcaagggcctgggcagacacgccgagggcagagtggagcccatccacgccgtggtgctgcccagaggcaagagcctggaccagtgcgtggagaccctgcagaagcagaccagagtgggcaaggccggcaccaacaagccccccagatgcagaggcagaggcgccagacccggcggcagacccgcccccagaaacgtgttcgacttcctgaacgagaagctgcagggccaggcccccggcgccctggaggccggcgccgcccccgccggcagaagaagcaaggacatgtaccacgccagcaagagcgccaagagagccctgagcctgagactgttccagaccgaggagaagatcgagagaacccagagagacatcagaagcatccaggaggccctggccagaaacgccggcagacacagcgtggccagcgcccagctgcaggagaagctggccggcgcccagagacagctgggccagctgagagcccaggaggccggcctgcagcaggagcagagaaaggccgacacccacaagaagatgaccgagttctag

SEQ ID NO: 11154 - DNA, 1536 bp, Artificial Sequence; identical to SEQ ID NO: 11152
  Description of Artificial Sequence: Synthetic coding sequence

SEQ ID NO: 11155 - DNA, 294 bp, Artificial Sequence
  Description of Artificial Sequence: Synthetic coding sequence
atggacgaggagagcctggagagcgccctgcagacctacagagcccagctgcagcaggtggagctggccctgggcgccggcctggacagcagcgagcaggccgacctgagacagctgcagggcgacctgaaggagctgatcgagctgaccgaggccagcctggtgagcgtgagaaagagcagcctgctggccgccctggacgaggagagacccggcagacaggaggacgccgagtaccaggccttcagagaggccatcaccgaggccgtggaggcccccgccgccgccagatag

SEQ ID NO: 11156 - DNA, 1536 bp, Artificial Sequence; identical to SEQ ID NO: 11152
  Description of Artificial Sequence: Synthetic coding sequence

SEQ ID NO: 11157 - DNA, 1419 bp, Artificial Sequence
  Description of Artificial Sequence: Synthetic coding sequence
atgaacaacagccagggcagagtgaccttcgaggacgtgaccgtgaacttcacccagggcgagtggcagagactgaaccccgagcagagaaacctgtacagagacgtgatgctggagaactacagcaacctggtgagcgtgggccagggcgagaccaccaagcccgacgtgatcctgagactggagcagggcaaggagccctggctggaggaggaggaggtgctgggcagcggcagagccgagaagaacggcgacatcggcggccagatctggaagcccaaggacgtgaaggagagcctggccagagaggtgcccagcatcaacaaggagaccctgaccacccagaagggcgtggagtgcgacggcagcaagaagatcctgcccctgggcatcgacgacgtgagcagcctgcagcactacgtgcagaacaacagccacgacgacaacggctacagaaagctggtgggcaacaaccccagcaagttcgtgggccagcagctgaagtgcaacgcctgcagaaagctgttcagcagcaagagcagactgcagagccacctgagaagacacgcctgccagaagcccttcgagtgccacagctgcggcagagccttcggcgagaagtggaagctggacaagcaccagaagacccacgccgaggagagaccctacaagtgcgagaactgcggcaacgcctacaagcagaagagcaacctgttccagcaccagaagatgcacaccaaggagaagccctaccagtgcaagacctgcggcaaggccttcagctggaagagcagctgcatcaaccacgagaagatccacaacgccaagaagagctaccagtgcaacgagtgcgagaagagcttcagacagaacagcaccctgatccagcacaagaaggtgcacaccggccagaagcccttccagtgcaccgactgcggcaaggccttcatctacaagagcgacctggtgaagcaccagagaatccacaccggcgagaagccctacaagtgcagcatctgcgagaaggccttcagccagaagagcaacgtgatcgaccacgagaagatccacaccggcaagagagcctacgagtgcgacctgtgcggcaacaccttcatccagaagaagaacctgatccagcacaagaagatccacaccggcgagaagccctacgagtgcaacagatgcggcaaggccttcttccagaagagcaacctgcacagccaccagaagacccacagcggcgagagaacctacagatgcagcgagtgcggcaagaccttcatcagaaagctgaacctgagcctgcacaagaagacccacaccggccagaagccctacggctgcagcgagtgcggcaaggccttcgccgacagaagctacctggtgagacaccagaagagaatccacagcagatag

SEQ ID NO: 11158 - DNA, 1917 bp, Artificial Sequence
  Description of Artificial Sequence: Synthetic coding sequence
atggagagctgcagcgtgaccagactggagtgcagcggcgccatcagcgcccactgcagcctgcacctgcccggcagcagcgacagccccgccagcgccagccagatcgccggcaccaccgacgccatctggaacgagcaggagaaggccgagctgttcaccgacaagttctgccaggtgtgcggcgtgatgctgcagttcgagagccagagaatcagccactacgagggcgagaagcacgcccagaacgtgagcttctacttccagatgcacggcgagcagaacgaggtgcccggcaagaagatgaagatgcacgtggagaacttccaggtgcacagatacgagggcgtggacaagaacaagttctgcgacctgtgcaacatgatgttcagcagccccctgatcgcccagagccactacgtgggcaaggtgcacgccaagaagctgaagcagctgatggaggagcacgaccaggccagccccagcggcttccagcccgagatggccttcagcatgagaacctacgtgtgccacatctgcagcatcgccttcaccagcctggacatgttcagaagccacatgcagggcagcgagcaccagatcaaggagagcatcgtgatcaacctggtgaagaacagcagaaagacccaggacagctaccagaacgagtgcgccgactacatcaacgtgcagaaggccagaggcctggaggccaagacctgcttcagaaagatggaggagagcagcctggagaccagaagatacagagaggtggtggacagcagacccagacacagaatgttcgagcagagactgcccttcgagaccttcagaacctacgccgccccctacaacatcagccaggccatggagaagcagctgccccacagcaagaagacctacgacagcttccaggacgagctggaggactacatcaaggtgcagaaggccagaggcctggaccccaagacctgcttcagaaagatgagagagaacagcgtggacacccacggctacagagagatggtggacagcggccccagaagcagaatgtgcgagcagagattcagccacgaggccagccagacctaccagagaccctaccacatcagccccgtggagagccagctgccccagtggctgcccacccacagcaagagaacctacgacagcttccaggacgagctggaggactacatcaaggtgcagaaggccagaggcctggagcccaagacctgcttcagaaagatcggcgacagcagcgtggagacccacagaaacagagagatggtggacgtgagacccagacacagaatgctggagcagaagctgccctgcgagaccttccagacctacagcggcccctacagcatcagccaggtggtggagaaccagctgccccactgcctgcccgcccacgacagcaagcagagactggacagcatcagctactgccagctgaccagagactgcttccccgagaagcccgtgcccctgagcctgaaccagcaggagaacaacagcggcagctacagcgtggagagcgaggtgtacaagcacctgagcagcgagaacaacaccgccgaccaccaggccggccacaagcagaagcaccagaagagaaagagacacctggaggagggcaaggagagacccgagaaggagcagagcaagcacaagagaaagaagagctacgaggacaccgacctggacaaggacaagagcatcagacagagaaagagagaggaggacagagtgaaggtgagcagcggcaagctgaagcacagaaagaagaagaagagccacgacgtgcccagcgagaaggaggagagaaagcacagaaaggagaagaagaagagcgtggaggagagaaccgaggaggagatgctgtgggacgagagcatcctgggcttctag

SEQ ID NO: 11159 - DNA, 1404 bp, Artificial Sequence
  Description of Artificial Sequence: Synthetic coding sequence
atgagaacctacgtgtgccacatctgcagcatcgccttcaccagcctggacatgttcagaagccacatgcagggcagcgagcaccagatcaaggagagcatcgtgatcaacctggtgaagaacagcagaaagacccaggacagctaccagaacgagtgcgccgactacatcaacgtgcagaaggccagaggcctggaggccaagacctgcttcagaaagatggaggagagcagcctggagaccagaagatacagagaggtggtggacagcagacccagacacagaatgttcgagcagagactgcccttcgagaccttcagaacctacgccgccccctacaacatcagccaggccatggagaagcagctgccccacagcaagaagacctacgacagcttccaggacgagctggaggactacatcaaggtgcagaaggccagaggcctggaccccaagacctgcttcagaaagatgagagagaacagcgtggacacccacggctacagagagatggtggacagcggccccagaagcagaatgtgcgagcagagattcagccacgaggccagccagacctaccagagaccctaccacatcagccccgtggagagccagctgccccagtggctgcccacccacagcaagagaacctacgacagcttccaggacgagctggaggactacatcaaggtgcagaaggccagaggcctggagcccaagacctgcttcagaaagatcggcgacagcagcgtggagacccacagaaacagagagatggtggacgtgagacccagacacagaatgctggagcagaagctgccctgcgagaccttccagacctacagcggcccctacagcatcagccaggtggtggagaaccagctgccccactgcctgcccgcccacgacagcaagcagagactggacagcatcagctactgccagctgaccagagactgcttccccgagaagcccgtgcccctgagcctgaaccagcaggagaacaacagcggcagctacagcgtggagagcgaggtgtacaagcacctgagcagcgagaacaacaccgccgaccaccaggccggccacaagcagaagcaccagaagagaaagagacacctggaggagggcaaggagagacccgagaaggagcagagcaagcacaagagaaagaagagctacgaggacaccgacctggacaaggacaagagcatcagacagagaaagagagaggaggacagagtgaaggtgagcagcggcaagctgaagcacagaaagaagaagaagagccacgacgtgcccagcgagaaggaggagagaaagcacagaaaggagaagaagaagagcgtggaggagagaaccgaggaggagatgctgtgggacgagagcatcctgggcttctag

SEQ ID NO: 11160 - DNA, 1917 bp, Artificial Sequence; identical to SEQ ID NO: 11158
  Description of Artificial Sequence: Synthetic coding sequence

SEQ ID NO: 11161 - DNA, 600 bp, Artificial Sequence
  Description of Artificial Sequence: Synthetic coding sequence
atggccagcggcagcggcaccaagaacctggacttcagaagaaagtgggacaaggacgagtacgagaagctggccgagaagagactgaccgaggagagagagaagaaggacggcaagcccgtgcagcccgtgaagagagagctgctgagacacagagactacaaggtggacctggagagcaagctgggcaagaccatcgtgatcaccaagaccaccccccagagcgagatgggcggctactactgcaacgtgtgcgactgcgtggtgaaggacagcatcaacttcctggaccacatcaacggcaagaagcaccagagaaacctgggcatgagcatgagagtggagagaagcaccctggaccaggtgaagaagagattcgaggtgaacaagaagaagatggaggagaagcagaaggactacgacttcgaggagagaatgaaggagctgagagaggaggaggagaaggccaaggcctacaagaaggagaagcagaaggagaagaagagaagagccgaggaggacctgaccttcgaggaggacgacgagatggccgccgtgatgggcttcagcggcttcggcagcaccaagaagagctactag

SEQ ID NO: 11162 - DNA, 870 bp, Artificial Sequence
  Description of Artificial Sequence: Synthetic coding sequence
atgatcctgctgcagcacgccgtgctgcccccccccaagcagcccagccccagcccccccatgagcgtggccaccagaagcaccggcaccctgcagctgcccccccagaagcccttcggccaggaggccagcctgcccctggccggcgaggaggagctgagcaagggcggcgagcaggactgcgccctggaggagctgtgcaagcccctgtactgcaagctgtgcaacgtgaccctgaacagcgcccagcaggcccaggcccactaccagggcaagaaccacggcaagaagctgagaaactactacgccgccaacagctgccccccccccgccagaatgagcaacgtggtggagcccgccgccacccccgtggtgcccgtgcccccccagatgggcagcttcaagcccggcggcagagtgatcctggccaccgagaacgactactgcaagctgtgcgacgccagcttcagcagccccgccgtggcccaggcccactaccagggcaagaaccacgccaagagactgagactggccgaggcccagagcaacagcttcagcgagagcagcgagctgggccagagaagagccagaaaggagggcaacgagttcaagatgatgcccaacagaagaaacatgtacaccgtgcagaacaacagcgccggcccctacttcaaccccagaagcagacagagaatccccagagacctggccatgtgcgtgacccccagcggccagttctactgcagcatgtgcaacgtgggcgccggcgaggagatggagttcagacagcacctggagagcaagcagcacaagagcaaggtgagcgagcagagatacagaaacgagatggagaacctgggctacgtgtag

SEQ ID NO: 11163 - DNA, 447 bp, Artificial Sequence
  Description of Artificial Sequence: Synthetic coding sequence
atgatcctgctgcagcacgccgtgctgcccccccccaagcagcccagccccagcccccccatgagcgtggccaccagaagcaccggcaccctgcagctgcccccccagaagcccttcggccaggaggccagcctgcccctggccggcgaggaggagctgagcaagggcggcgagcaggactgcgccctggaggagctgtgcaagcccctgtactgcaagctgtgcaacgtgaccctgaacagcgcccagcaggcccaggcccactaccagggcaagaaccacggcaagaagctgagaaactactacgccgccaacagctgccccccccccgccagaatgagcaacgtggtggagcccgccgccacccccgtggtgcccgtgcccccccagatgggcagcttcaagcccggcggcagagtgatcctggccaccgagaacgactactag

SEQ ID NO: 11164 - DNA, 867 bp, Artificial Sequence
  Description of Artificial Sequence: Synthetic coding sequence
atgatcctgctgcagcacgccgtgctgcccccccccaagcagcccagccccagcccccccatgagcgtggccaccagaagcaccggcaccctgcagctgcccccccagaagcccttcggccaggaggccagcctgcccctggccggcgaggaggagctgagcaagggcggcgagcaggactgcgccctggaggagctgtgcaagcccctgtactgcaagctgtgcaacgtgaccctgaacagcgcccagcaggcccaggcccactaccagggcaagaaccacggcaagaagctgagaaactactacgccgccaacagctgccccccccccgccagaatgagcaacgtggtggagcccgccgccacccccgtggtgcccgtgcccccccagatgggcagcttcaagcccggcggcagagtgatcctggccaccgagaacgactactgcaagctgtgcgacgccagcttcagcagccccgccgtggcccaggcccactaccagggcaagaaccacgccaagagactgagactggccgaggcccagagcaacagcttcagcgagagcagcgagctgggccagagaagagccagaaaggagggcaacgagttcaagatgatgcccaacagaagaaacatgtacaccgtgcagaacaacagcggcccctacttcaaccccagaagcagacagagaatccccagagacctggccatgtgcgtgacccccagcggccagttctactgcagcatgtgcaacgtgggcgccggcgaggagatggagttcagacagcacctggagagcaagcagcacaagagcaaggtgagcgagcagagatacagaaacgagatggagaacctgggctacgtgtag

SEQ ID NO: 11165 - DNA, 690 bp, Artificial Sequence
  Description of Artificial Sequence: Synthetic coding sequence
atgaagagcagcgacatcgaccaggacctgttcaccgacagctactgcaaggtgtgcagcgcccagctgatcagcgagagccagagagtggcccactacgagagcagaaagcacgccagcaaggtgagactgtactacatgctgcaccccagagacggcggctgccccgccaagagactgagaagcgagaacggcagcgacgccgacatggtggacaagaacaagtgctgcaccctgtgcaacatgagcttcaccagcgccgtggtggccgacagccactaccagggcaagatccacgccaagagactgaagctgctgctgggcgagaagacccccctgaagaccaccgccacccccctgagccccctgaagccccccagaatggacaccgcccccgtggtggccagcccctaccagagaagagacagcgacagatactgcggcctgtgcgccgcctggttcaacaaccccctgatggcccagcagcactacgacggcaagaagcacaagaagaacgccgccagagtggccctgctggagcagctgggcaccaccctggacatgggcgagctgagaggcctgagaagaaactacagatgcaccatctgcagcgtgagcctgaacagcatcgagcagtaccacgcccacctgaagggcagcaagcaccagaccaacctgaagaacaagtag

SEQ ID NO: 11166 - DNA, 462 bp, Artificial Sequence
  Description of Artificial Sequence: Synthetic coding sequence
atgaagagcagcgacatcgaccaggacctgttcaccgacagctactgcaaggtgtgcagcgcccagctgatcagcgagagccagagagtggcccactacgagagcagaaagcacgccagcaaggtgagactgtactacatgctgcaccccagagacggcggctgccccgccaagagactgagaagcgagaacggcagcgacgccgacatggtggacaagaacaagtgctgcaccctgtgcaacatgagcttcaccagcgccgtggtggccgacagccactaccagggcaagatccacgccaagagactgaagctgctgctgggcgagaagacccccctgaagaccaccggcctgagaagaaactacagatgcaccatctgcagcgtgagcctgaacagcatcgagcagtaccacgcccacctgaagggcagcaagcaccagaccaacctgaagaacaagtag

SEQ ID NO: 11167 - DNA, 636 bp, Artificial Sequence
  Description of Artificial Sequence: Synthetic coding sequence
atgaagagcagcgacatcgaccaggacctgttcaccgacagctactgcaaggtgtgcagcgcccagctgatcagcgagagccagagagtggcccactacgagagcagaaagcacgccagcaaggtgagactgtactacatgctgcaccccagagacggcggctgccccgccaagagactgagaagcgagaacggcagcgacgccgacatggtggacaagaacaagtgctgcaccctgtgcaacatgagcttcaccagcgccgtggtggccgacagccactaccagggcaagatccacgccaagagactgaagctgctgctgggcgagaagacccccctgaagaccaccgccacccccctgagccccctgaagccccccagaatggacaccgcccccgtggtggccagcccctaccagagaagagacagcgacagatactgcggcctgtgcgccgcctggttcaacaaccccctgatggcccagcagcactacgacggcaagaagcacaagaagaacgccgccagagtggccctgctggagcagctgggcaccaccctggacatgggcgagctgagaggcctgagaagaaactacagatgcaccatctgcagcgtgagcctgaacagcatcgagtag

SEQ ID NO: 11168 - DNA, 2685 bp, Artificial Sequence
  Description of Artificial Sequence: Synthetic coding sequence
atgaacagcatgaaccccatgaagcccgccctgccccccgccccccacggcgacggcagcttcgcctacgagagcgtgccctggcagcagagcgccacccagcccgccggcagcctgagcgtggtgaccaccgtgtggggcgtgggcaacgccacccagagccaggtgctgggcaaccccatgggccccgccggcagccccagcggcagcagcatgatgcccggcgtggccggcggcagcagcgccctgaccagcccccagtgcctgggccagcaggccttcgccgagggcggcgccaacaagggctacgtgcagcagggcgtgtacagcagaggcggctaccccggcgcccccggcttcaccaccggctacgccggcggccccggcggcctgggcctgcccagccacgccgccagacccagcaccgacttcacccaggccgccgccgccgccgccgtggccgccgccgccgccaccgccaccgccaccgccaccgccaccgtggccgccctgcaggagaagcagagccaggagctgagccagtacggcgccatgggcgccggccagagcttcaacagccagttcctgcagcacggcggccccagaggccccagcgtgcccgccggcatgaaccccaccggcatcggcggcgtgatgggccccagcggcctgagccccctggccatgaaccccaccagagccgccggcatgacccccctgtacgccggccagagactgccccagcacggctaccccggccccccccaggcccagcccctgcccagacagggcgtgaagagaacctacagcgaggtgtaccccggccagcagtacctgcagggcggccagtacgcccccagcaccgcccagttcgcccccagccccggccagccccccgcccccagccccagctaccccggccacagactgcccctgcagcagggcatgacccagagcctgagcgtgcccggccccaccggcctgcactacaagcccaccagaagcatccccggctaccccagcagccccctgcccggcaaccccaccccccccatgacccccagcagcagcgtgccctacatgagccccaaccaggaggtgaagagccccttcctgcccgacctgaagcccaacctgaacagcctgcacagcagccccagcggcagcggcccctgcgacgagctgagactgaccttccccgtgagagacggcgtggtgctggagcccttcagactgcagcacaacctggccgtgagcaaccacgtgttccagctgagagacagcgtgtacaagaccctgatcatgagacccgacctggagctgcagttcaagtgctaccaccacgaggacagacagatgaacaccaactggcccgccagcgtgcaggtgagcgtgaacgccacccccctgaccatcgagagaggcgacaacaagaccagccacaagcccctgtacctgaagcacgtgtgccagcccggcagaaacaccatccagatcaccgtgaccgcctgctgctgcagccacctgttcgtgctgcagctggtgcacagacccagcgtgagaagcgtgctgcagggcctgctgaagaagagactgctgcccgccgagcactgcatcaccaagatcaagagaaacttcagcagcggcaccatccccggcacccccggccccaacggcgaggacggcgtggagcagaccgccatcaaggtgagcctgaagtgccccatcaccttcagaagaatccagctgcccgccagaggccacgactgcagacacatccagtgcttcgacctggagagctacctgcagctgaactgcgagagaggcacctggagatgccccgtgtgcaacaagaccgccctgctggagggcctggaggtggaccagtacatgctgggcatcctgatctacatccagaacagcgactacgaggagatcaccatcgaccccacctgcagctggaagcccgtgcccgtgaagcccgacatgcacatcaaggaggagcccgacggccccgccctgaagagatgcagaaccgtgagccccgcccacgtgctgatgcccagcgtgatggagatgatcgccgccctgggccccggcgccgcccccttcgcccccctgcagccccccagcgtgcccgcccccagcgactaccccggccagggcagcagcttcctgggccccggcaccttccccgagagcttcccccccaccacccccagcacccccaccctggccgagttcacccccggccccccccccatcagctaccagagcgacatccccagcagcctgctgaccagcgagaagagcaccgcctgcctgcccagccagatggcccccgccggccacctggaccccacccacaaccccggcacccccggcctgcacaccagcaacctgggcgccccccccggcccccagctgcaccacagcaaccccccccccgccagcagacagagcctgggccaggccagcctgggccccaccggcgagctggccttcagccccgccaccggcgtgatgggcccccccagcatgagcggcgccggcgaggcccccgagcccgccctggacctgctgcccgagctgaccaaccccgacgagctgctgagctacctgggcccccccgacctgcccaccaacaacaacgacgacctgctgagcctgttcgagaacaactag

SEQ ID NO: 11169 - DNA, 2763 bp, Artificial Sequence
  Description of Artificial Sequence: Synthetic coding sequence
atgaacagcatgaaccccatgaagcccgccctgccccccgccccccacggcgacggcagcttcgcctacgagagcgtgccctggcagcagagcgccacccagcccgccggcagcctgagcgtggtgaccaccgtgtggggcgtgggcaacgccacccagagccaggtgctgggcaaccccatgggccccgccggcagccccagcggcagcagcatgatgcccggcgtggccggcggcagcagcgccctgaccagcccccagtgcctgggccagcaggccttcgccgagggcggcgccaacaagggctacgtgcagcagggcgtgtacagcagaggcggctaccccggcgcccccggcttcaccaccggctacgccggcggccccggcggcctgggcctgcccagccacgccgccagacccagcaccgacttcacccaggccgccgccgccgccgccgtggccgccgccgccgccaccgccaccgccaccgccaccgccaccgtggccgccctgcaggagaagcagagccaggagctgagccagtacggcgccatgggcgccggccagagcttcaacagccagttcctgcagcacggcggccccagaggccccagcgtgcccgccggcatgaaccccaccggcatcggcggcgtgatgggccccagcggcctgagccccctggccatgaaccccaccagagccgccggcatgacccccctgtacgccggccagagactgccccagcacggctaccccggccccccccaggcccagcccctgcccagacagggcgtgaagagaacctacagcgaggtgtaccccggccagcagtacctgcagggcggccagtacgcccccagcaccgcccagttcgcccccagccccggccagccccccgcccccagccccagctaccccggccacagactgcccctgcagcagggcatgacccagagcctgagcgtgcccggccccaccggcctgcactacaagcccaccgagcagttcaacggccagggcgccagcttcaacggcggcagcgtgagctacagccagcccggcctgagcggccccaccagaagcatccccggctaccccagcagccccctgcccggcaaccccaccccccccatgacccccagcagcagcgtgccctacatgagccccaaccaggaggtgaagagccccttcctgcccgacctgaagcccaacctgaacagcctgcacagcagccccagcggcagcggcccctgcgacgagctgagactgaccttccccgtgagagacggcgtggtgctggagcccttcagactgcagcacaacctggccgtgagcaaccacgtgttccagctgagagacagcgtgtacaagaccctgatcatgagacccgacctggagctgcagttcaagtgctaccaccacgaggacagacagatgaacaccaactggcccgccagcgtgcaggtgagcgtgaacgccacccccctgaccatcgagagaggcgacaacaagaccagccacaagcccctgtacctgaagcacgtgtgccagcccggcagaaacaccatccagatcaccgtgaccgcctgctgctgcagccacctgttcgtgctgcagctggtgcacagacccagcgtgagaagcgtgctgcagggcctgctgaagaagagactgctgcccgccgagcactgcatcaccaagatcaagagaaacttcagcagcggcaccatccccggcacccccggccccaacggcgaggacggcgtggagcagaccgccatcaaggtgagcctgaagtgccccatcaccttcagaagaatccagctgcccgccagaggccacgactgcagacacatccagtgcttcgacctggagagctacctgcagctgaactgcgagagaggcacctggagatgccccgtgtgcaacaagaccgccctgctggagggcctggaggtggaccagtacatgctgggcatcctgatctacatccagaacagcgactacgaggagatcaccatcgaccccacctgcagctggaagcccgtgcccgtgaagcccgacatgcacatcaaggaggagcccgacggccccgccctgaagagatgcagaaccgtgagccccgcccacgtgctgatgcccagcgtgatggagatgatcgccgccctgggccccggcgccgcccccttcgcccccctgcagccccccagcgtgcccgcccccagcgactaccccggccagggcagcagcttcctgggccccggcaccttccccgagagcttcccccccaccacccccagcacccccaccctggccgagttcacccccggccccccccccatcagctaccagagcgacatccccagcagcctgctgaccagcgagaagagcaccgcctgcctgcccagccagatggcccccgccggccacctggaccccacccacaaccccggcacccccggcctgcacaccagcaacctgggcgccccccccggcccccagctgcaccacagcaaccccccccccgccagcagacagagcctgggccaggccagcctgggccccaccggcgagctggccttcagccccgccaccggcgtgatgggcccccccagcatgagcggcgccggcgaggcccccgagcccgccctggacctgctgcccgagctgaccaaccccgacgagctgctgagctacctgggcccccccgacctgcccaccaacaacaacgacgacctgctgagcctgttcgagaacaactag

SEQ ID NO: 11170 - DNA, 2772 bp, Artificial Sequence
  Description of Artificial Sequence: Synthetic coding sequence
atgaacagcatgaaccccatgaagcccgccctgccccccgccccccacggcgacggcagcttcgcctacgagagcgtgccctggcagcagagcgccacccagcccgccggcagcctgagcgtggtgaccaccgtgtggggcgtgggcaacgccacccagagccaggtgctgggcaaccccatgggccccgccggcagccccagcggcagcagcatgatgcccggcgtggccggcggcagcagcgccctgaccagcccccagtgcctgggccagcaggccttcgccgagggcggcgccaacaagggctacgtgcagcagggcgtgtacagcagaggcggctaccccggcgcccccggcttcaccaccggctacgccggcggccccggcggcctgggcctgcccagccacgccgccagacccagcaccgacttcacccaggccgccgccgccgccgccgtggccgccgccgccgccaccgccaccgccaccgccaccgccaccgtggccgccctgcaggagaagcagagccaggagctgagccagtacggcgccatgggcgccggccagagcttcaacagccagttcctgcagcacggcggccccagaggccccagcgtgcccgccggcatgaaccccaccggcatcggcggcgtgatgggccccagcggcctgagccccctggccatgaaccccaccagagccgccggcatgacccccctgtacgccggccagagactgccccagcacggctaccccggccccccccaggcccagcccctgcccagacagggcgtgaagagaacctacagcgaggtgtaccccggccagcagtacctgcagggcggccagtacgcccccagcaccgcccagttcgcccccagccccggccagccccccgcccccagccccagctaccccggccacagactgcccctgcagcagggcatgacccagagcctgagcgtgcccggccccaccggcctgcactacaagcccaccgagcagttcaacggccagggcgccagcttcaacggcggcagcgtgagctacagccagcccggcctgagcggccccaccagaagcatccccggctaccccagcagccccctgcccggcaaccccaccccccccatgacccccagcagcagcgtgccctacatgagccccaaccaggaggtgaagagccccttcctgcccgacctgaagcccaacctgaacagcctgcacagcagccccagcggcagcggcccctgcgacgagctgagactgaccttccccgtgagagacggcgtggtgctggagcccttcagactgcagcacaacctggccgtgagcaaccacgtgttccagctgagagacagcgtgtacaagaccctgatcatgagacccgacctggagctgcagttcaagtgctaccaccacgaggacagacagatgaacaccaactggcccgccagcgtgcaggtgagcgtgaacgccacccccctgaccatcgagagaggcgacaacaagaccagccacaagcccctgtacctgaagcacgtgtgcgccagaccccagcaccaccccagccccagcccccccgccgccgcctgcgtgagctgcagccacctgttcgtgctgcagctggtgcacagacccagcgtgagaagcgtgctgcagggcctgctgaagaagagactgctgcccgccgagcactgcatcaccaagatcaagagaaacttcagcagcggcaccatccccggcacccccggccccaacggcgaggacggcgtggagcagaccgccatcaaggtgagcctgaagtgccccatcaccttcagaagaatccagctgcccgccagaggccacgactgcagacacatccagtgcttcgacctggagagctacctgcagctgaactgcgagagaggcacctggagatgccccgtgtgcaacaagaccgccctgctggagggcctggaggtggaccagtacatgctgggcatcctgatctacatccagaacagcgactacgaggagatcaccatcgaccccacctgcagctggaagcccgtgcccgtgaagcccgacatgcacatcaaggaggagcccgacggccccgccctgaagagatgcagaaccgtgagccccgcccacgtgctgatgcccagcgtgatggagatgatcgccgccctgggccccggcgccgcccccttcgcccccctgcagccccccagcgtgcccgcccccagcgactaccccggccagggcagcagcttcctgggccccggcaccttccccgagagcttcccccccaccacccccagcacccccaccctggccgagttcacccccggccccccccccatcagctaccagagcgacatccccagcagcctgctgaccagcgagaagagcaccgcctgcctgcccagccagatggcccccgccggccacctggaccccacccacaaccccggcacccccggcctgcacaccagcaacctgggcgccccccccggcccccagctgcaccacagcaaccccccccccgccagcagacagagcctgggccaggccagcctgggccccaccggcgagctggccttcagccccgccaccggcgtgatgggcccccccagcatgagcggcgccggcgaggcccccgagcccgccctggacctgctgcccgagctgaccaaccccgacgagctgctgagctacctgggcccccccgacctgcccaccaacaacaacgacgacctgctgagcctgttcgagaacaactag

SEQ ID NO: 11171 - DNA, 2763 bp, Artificial Sequence; identical to SEQ ID NO: 11169
  Description of Artificial Sequence: Synthetic coding sequence

SEQ ID NO: 11172 - DNA, 273 bp, Artificial Sequence
  Description of Artificial Sequence: Synthetic coding sequence
atgaacagcatgaaccccatgaagcccgccctgccccccgccccccacggcgacggcagcttcgcctacgagagcgtgccctggcagcagagcgccacccagcccgccggcagcctgagcgtggtgaccaccgtgtggggcgtgggcaacgccacccagagccaggtgctgggcaaccccatgggccccgccggcagccccagcggcagcagcatgatgcccggcgtggccggcggcagcagcgccctgaccagcccccagtgcctgggctag

SEQ ID NO: 11173 - DNA, 3429 bp, Artificial Sequence
  Description of Artificial Sequence: Synthetic coding sequence
atgaaggagcccctgctgggcggcgagtgcgacaaggccgtggccagccagctgggcctgctggacgagatcaagaccgagcccgacaacgcccaggagtactgccacagacagcagagcagaacccaggagaacgagctgaagatcaacgccgtgttcagcgagagcgccagccagctgaccgccggcatccagctgagcctggccagcagcggcgtgaacaagatgctgcccagcgtgagcaccaccgccatccaggtgagctgcgccggctgcaagaagatcctgcagaagggccagaccgcctaccagagaaagggcagcgcccagctgttctgcagcatcccctgcatcaccgagtacatcagcagcgccagcagccccgtgcccagcaagagaacctgcagcaactgcagcaaggacatcctgaaccccaaggacgtgatcagcgtgcagctggaggacaccaccagctgcaagaccttctgcagcctgagctgcctgagcagctacgaggagaagagaaagcccttcgtgaccatctgcaccaacagcatcctgaccaagtgcagcatgtgccagaagaccgccatcatccagtacgaggtgaagtaccagaacgtgaagcacaacctgtgcagcaacgcctgcctgagcaagttccacagcgccaacaacttcatcatgaactgctgcgagaactgcggcacctactgctacaccagcagcagcctgagccacatcctgcagatggagggccagagccactacttcaacagcagcaagagcatcaccgcctacaagcagaagcccgccaagcccctgatcagcgtgccctgcaagcccctgaagcccagcgacgagatgatcgagaccaccagcgacctgggcaagaccgagctgttctgcagcatcaactgcttcagcgcctacagcaaggccaagatggagagcagcagcgtgagcgtggtgagcgtggtgcacgacaccagcaccgagctgctgagccccaagaaggacaccacccccgtgatcagcaacatcgtgagcctggccgacaccgacgtggccctgcccatcatgaacaccgacgtgctgcaggacaccgtgagcagcgtgaccgccaccgccgacgtgatcgtggacctgagcaagagcagccccagcgagcccagcaacgccgtggccagcagcagcaccgagcagcccagcgtgagccccagcagcagcgtgttcagccagcacgccatcggcagcagcaccgaggtgcagaaggacaacatgaagagcatgaagatcagcgacgagctgtgccaccccaagtgcaccagcaaggtgcagaaggtgaagggcaagagcagaagcatcaagaagagctgctgcgccgacttcgagtgcctggagaacagcaagaaggacgtggccttctgctacagctgccagctgttctgccagaagtacttcagctgcggcagagagagcttcgccacccacggcaccagcaactggaagaagaccctggagaagttcagaaagcacgagaagagcgagatgcacctgaagagcctggagttctggagagagtaccagttctgcgacggcgccgtgagcgacgacctgagcatccacagcaagcagatcgagggcaacaagaagtacctgaagctgatcatcgagaacatcctgttcctgggcaagcagtgcctgcccctgagaggcaacgaccagagcgtgagcagcgtgaacaagggcaacttcctggagctgctggagatgagagccaaggacaagggcgaggagaccttcagactgatgaacagccaggtggacttctacaacagcacccagatccagagcgacatcatcgagatcatcaagaccgagatgctgcaggacatcgtgaacgagatcaacgacagcagcgccttcagcatcatctgcgacgagaccatcaacagcgccatgaaggagcagctgagcatctgcgtgagatacccccagaagagcagcaaggccatcctgatcaaggagagattcctgggcttcgtggacaccgaggagatgaccggcacccacctgcacagaaccatcaagacctacctgcagcagatcggcgtggacatggacaagatccacggccaggcctacgacagcaccaccaacctgaagatcaagttcaacaagatcgccgccgagttcaagaaggaggagcccagagccctgtacatccactgctacgcccacttcctggacctgagcatcatcagattctgcaaggaggtgaaggagctgagaagcgccctgaagaccctgagcagcctgttcaacaccatctgcatgagcggcgagatgctggccaacttcagaaacatctacagactgagccagaacaagacctgcaagaagcacatcagccagagctgctggaccgtgcacgacagaaccctgctgagcgtgatcgacagcctgcccgagatcatcgagaccctggaggtgatcgccagccacagcagcaacaccagcttcgccgacgagctgagccacctgctgaccctggtgagcaagttcgagttcgtgttctgcctgaagttcctgtacagagtgctgagcgtgaccggcatcctgagcaaggagctgcagaacaagaccatcgacatcttcagcctgagcagcaagatcgaggccatcctggagtgcctgagcagcgagagaaacgacgtgtacttcaagaccatctgggacggcaccgaggagatctgccagaagatcacctgcaagggcttcaaggtggagaagcccagcctgcagaagagaagaaagatccagaagagcgtggacctgggcaacagcgacaacatgttcttccccaccagcaccgaggagcagtacaagatcaacatctactaccagggcctggacaccatcctgcagaacctgaagctgtgcttcagcgagttcgactactgcaagatcaagcagatcagcgagctgctgttcaagtggaacgagcccctgaacgagaccaccgccaagcacgtgcaggagttctacaagctggacgaggacatcatccccgagctgagattctacagacactacgccaagctgaacttcgtgatcgacgacagctgcatcaacttcgtgagcctgggctgcctgttcatccagcacggcctgcacagcaacatcccctgcctgagcaagctgctgtacatcgccctgagctggcccatcaccagcgccagcaccgagaacagcttcagcaccctgcccagactgaagacctacctgtgcaacaccatgggccaggagaagctgaccggccccgccctgatggccgtggagcaggagctggtgaacaagctgatggagcccgagagactgaacgagatcgtggagaagttcatcagccagatgaaggagatctag

SEQ ID NO: 11174 - DNA, 3204 bp, Artificial Sequence
  Description of Artificial Sequence: Synthetic coding sequence
atgctgcccagcgtgagcaccaccgccatccaggtgagctgcgccggctgcaagaagatcctgcagaagggccagaccgcctaccagagaaagggcagcgcccagctgttctgcagcatcccctgcatcaccgagtacatcagcagcgccagcagccccgtgcccagcaagagaacctgcagcaactgcagcaaggacatcctgaaccccaaggacgtgatcagcgtgcagctggaggacaccaccagctgcaagaccttctgcagcctgagctgcctgagcagctacgaggagaagagaaagcccttcgtgaccatctgcaccaacagcatcctgaccaagtgcagcatgtgccagaagaccgccatcatccagtacgaggtgaagtaccagaacgtgaagcacaacctgtgcagcaacgcctgcctgagcaagttccacagcgccaacaacttcatcatgaactgctgcgagaactgcggcacctactgctacaccagcagcagcctgagccacatcctgcagatggagggccagagccactacttcaacagcagcaagagcatcaccgcctacaagcagaagcccgccaagcccctgatcagcgtgccctgcaagcccctgaagcccagcgacgagatgatcgagaccaccagcgacctgggcaagaccgagctgttctgcagcatcaactgcttcagcgcctacagcaaggccaagatggagagcagcagcgtgagcgtggtgagcgtggtgcacgacaccagcaccgagctgctgagccccaagaaggacaccacccccgtgatcagcaacatcgtgagcctggccgacaccgacgtggccctgcccatcatgaacaccgacgtgctgcaggacaccgtgagcagcgtgaccgccaccgccgacgtgatcgtggacctgagcaagagcagccccagcgagcccagcaacgccgtggccagcagcagcaccgagcagcccagcgtgagccccagcagcagcgtgttcagccagcacgccatcggcagcagcaccgaggtgcagaaggacaacatgaagagcatgaagatcagcgacgagctgtgccaccccaagtgcaccagcaaggtgcagaaggtgaagggcaagagcagaagcatcaagaagagctgctgcgccgacttcgagtgcctggagaacagcaagaaggacgtggccttctgctacagctgccagctgttctgccagaagtacttcagctgcggcagagagagcttcgccacccacggcaccagcaactggaagaagaccctggagaagttcagaaagcacgagaagagcgagatgcacctgaagagcctggagttctggagagagtaccagttctgcgacggcgccgtgagcgacgacctgagcatccacagcaagcagatcgagggcaacaagaagtacctgaagctgatcatcgagaacatcctgttcctgggcaagcagtgcctgcccctgagaggcaacgaccagagcgtgagcagcgtgaacaagggcaacttcctggagctgctggagatgagagccaaggacaagggcgaggagaccttcagactgatgaacagccaggtggacttctacaacagcacccagatccagagcgacatcatcgagatcatcaagaccgagatgctgcaggacatcgtgaacgagatcaacgacagcagcgccttcagcatcatctgcgacgagaccatcaacagcgccatgaaggagcagctgagcatctgcgtgagatacccccagaagagcagcaaggccatcctgatcaaggagagattcctgggcttcgtggacaccgaggagatgaccggcacccacctgcacagaaccatcaagacctacctgcagcagatcggcgtggacatggacaagatccacggccaggcctacgacagcaccaccaacctgaagatcaagttcaacaagatcgccgccgagttcaagaaggaggagcccagagccctgtacatccactgctacgcccacttcctggacctgagcatcatcagattctgcaaggaggtgaaggagctgagaagcgccctgaagaccctgagcagcctgttcaacaccatctgcatgagcggcgagatgctggccaacttcagaaacatctacagactgagccagaacaagacctgcaagaagcacatcagccagagctgctggaccgtgcacgacagaaccctgctgagcgtgatcgacagcctgcccgagatcatcgagaccctggaggtgatcgccagccacagcagcaacaccagcttcgccgacgagctgagccacctgctgaccctggtgagcaagttcgagttcgtgttctgcctgaagttcctgtacagagtgctgagcgtgaccggcatcctgagcaaggagctgcagaacaagaccatcgacatcttcagcctgagcagcaagatcgaggccatcctggagtgcctgagcagcgagagaaacgacgtgtacttcaagaccatctgggacggcaccgaggagatctgccagaagatcacctgcaagggcttcaaggtggagaagcccagcctgcagaagagaagaaagatccagaagagcgtggacctgggcaacagcgacaacatgttcttccccaccagcaccgaggagcagtacaagatcaacatctactaccagggcctggacaccatcctgcagaacctgaagctgtgcttcagcgagttcgactactgcaagatcaagcagatcagcgagctgctgttcaagtggaacgagcccctgaacgagaccaccgccaagcacgtgcaggagttctacaagctggacgaggacatcatccccgagctgagattctacagacactacgccaagctgaacttcgtgatcgacgacagctgcatcaacttcgtgagcctgggctgcctgttcatccagcacggcctgcacagcaacatcccctgcctgagcaagctgctgtacatcgccctgagctggcccatcaccagcgccagcaccgagaacagcttcagcaccctgcccagactgaagacctacctgtgcaacaccatgggccaggagaagctgaccggccccgccctgatggccgtggagcaggagctggtgaacaagctgatggagcccgagagactgaacgagatcgtggagaagttcatcagccagatgaaggagatctag

SEQ ID NO: 11175 - DNA, 3429 bp, Artificial Sequence; identical to SEQ ID NO: 11173
  Description of Artificial Sequence: Synthetic coding sequence

SEQ ID NO: 11176 - DNA, 1389 bp, Artificial Sequence
  Description of Artificial Sequence: Synthetic coding sequence
atgaaggagcccctgctgggcggcgagtgcgacaaggccgtggccagccagctgggcctgctggacgagatcaagaccgagcccgacaacgcccaggagtactgccacagacagcagagcagaacccaggagaacgagctgaagatcaacgccgtgttcagcgagagcgccagccagctgaccgccggcatccagctgagcctggccagcagcggcgtgaacaagatgctgcccagcgtgagcaccaccgccatccaggtgagctgcgccggctgcaagaagatcctgcagaagggccagaccgcctaccagagaaagggcagcgcccagctgttctgcagcatcccctgcatcaccgagtacatcagcagcgccagcagccccgtgcccagcaagagaacctgcagcaactgcagcaaggacatcctgaaccccaaggacgtgatcagcgtgcagctggaggacaccaccagctgcaagaccttctgcagcctgagctgcctgagcagctacgaggagaagagaaagcccttcgtgaccatctgcaccaacagcatcctgaccaagtgcagcatgtgccagaagaccgccatcatccagtacgaggtgaagtaccagaacgtgaagcacaacctgtgcagcaacgcctgcctgagcaagttccacagcgccaacaacttcatcatgaactgctgcgagaactgcggcacctactgctacaccagcagcagcctgagccacatcctgcagatggagggccagagccactacttcaacagcagcaagagcatcaccgcctacaagcagaagcccgccaagcccctgatcagcgtgccctgcaagcccctgaagcccagcgacgagatgatcgagaccaccagcgacctgggcaagaccgagctgttctgcagcatcaactgcttcagcgcctacagcaaggccaagatggagagcagcagcgtgagcgtggtgagcgtggtgcacgacaccagcaccgagctgctgagccccaagaaggacaccacccccgtgatcagcaacatcgtgagcctggccgacaccgacgtggccctgcccatcatgaacaccgacgtgctgcaggacaccgtgagcagcgtgaccgccaccgccgacgtgatcgtggacctgagcaagagcagccccagcgagcccagcaacgccgtggccagcagcagcaccgagcagcccagcgtgagccccagcagcagcgtgttcagccagcacgccatcggcagcagcaccgaggtgcagaaggacaacatgaagagcatgaagatcagcgacgagctgtgccaccccaagtgcaccagcaaggtgcagaaggtgaagggcaagagcagaagcatcaagaagagctgctgcgcctag

SEQ ID NO: 11177 - DNA, 2010 bp, Artificial Sequence
  Description of Artificial Sequence: Synthetic coding sequence
atggagaagtgcagcgtgggcggcctggagctgaccgagcagacccccgccctgctgggcaacatggccatggccaccagcctgatggacatcggcgacagcttcggccaccccgcctgccccctggtgagcagaagcagaaacagccccgtggaggacgacgacgacgacgacgacgtggtgttcatcgagagcatccagccccccagcatcagcgcccccgccatcgccgaccagagaaacttcatcttcgccagcagcaagaacgagaagccccagggcaactacagcgtgatcccccccagcagcagagacctggccagccagaagggcaacatcagcgagaccatcgtgatcgacgacgaggaggacatcgagaccaacggcggcgccgagaagaagagcagctgcttcatcgagtggggcctgcccggcaccaagaacaagaccaacgacctggacttcagcaccagcagcctgagcagaagcaagaccaagaccggcgtgagacccttcaaccccggcagaatgaacgtggccggcgacctgttccagaacggcgagttcgccacccaccacagccccgacagctggatcagccagagcgccagcttccccagcaaccagaagcagcccggcgtggacagcctgagccccgtggccctgctgagaaagcagaacttccagcccaccgcccagcagcagctgaccaagcccgccaagatcacctgcgccaactgcaagaagcccctgcagaagggccagaccgcctaccagagaaagggcagcgcccacctgttctgcagcaccacctgcctgagcagcttcagccacaagagaacccagaacaccagaagcatcatctgcaagaaggacgccagcaccaagaaggccaacgtgatcctgcccgtggagagcagcaagagcttccaggagttctacagcaccagctgcctgagcccctgcgagaacaactggaacctgaagaagggcgtgttcaacaagagcagatgcaccatctgcagcaagctggccgagatcagacacgaggtgagcgtgaacaacgtgacccacaagctgtgcagcaaccactgcttcaacaagtacagactggccaacggcctgatcatgaactgctgcgagcactgcggcgagtacatgcccagcaagagcaccggcaacaacatcctggtgatcggcggccagcagaagagattctgctgccagagctgcatcaacgagtacaagcagatgatggagaccaagagcaagaagctgaccgccagcgagaacagaaagagaaacgccttcagagaggagaacgagaagcagctgtacggcagcagcaacaccctgctgaagaagatcgagggcatccccgagaagaaggagaagaccagccagctgcagctgagcgtggagtgcggcaccgacaccctgctgatccaggagaacgtgaacctgccccccagcagcaccagcaccatcgccgacaccttccaggagcagctggaggagaagaacttcgaggacagcatcgtgcccgtggtgctgagcgccgaccccggcacctggcccagaatcctgaacatcaagcagagagacaccctggtggagaacgtgcccccccaggtgagaaacttcaacttccccaaggacaacaccggcagaaagttcagcgagacctactacaccagaatcctgcccaacggcgagaagaccaccagaagctggctgctgtacagcaccagcaaggacagcgtgttctgcctgtactgcaagctgttcggcgagggcaagaaccagctgaagaacgagaacggctgcaaggactggcagcacctgagccacatcctgagcaagcacgaggagagcgagatgcacgtgaacaacagcgtgaagtacagcaagctgaagagcgacctgaagaagaacaaggccatcgacgccgccgagcacagactgtacgagaacgagaagaacgacggcgtgctgctgctgtacacctag

SEQ ID NO: 11178 - DNA, 1149 bp, Artificial Sequence
  Description of Artificial Sequence: Synthetic coding sequence
atggagaagtgcagcgtgggcggcctggagctgaccgagcagacccccgccctgctgggcaacatggccatggccaccagcctgatggacatcggcgacagcttcggccaccccgcctgccccctggtgagcagaagcagaaacagccccgtggaggacgacgacgacgacgacgacgtggtgttcatcgagagcatccagccccccagcatcagcgcccccgccatcgccgaccagagaaacttcatcttcgccagcagcaagaacgagaagccccagggcaactacagcgtgatcccccccagcagcagagacctggccagccagaagggcaacatcagcgagaccatcgtgatcgacgacgaggaggacatcgagaccaacggcggcgccgagaagaagagcagctgcttcatcgagtggggcctgcccggcaccaagaacaagaccaacgacctggacttcagcaccagcagcctgagcagaagcaagaccaagaccggcgtgagacccttcaaccccggcagaatgaacgtggccggcgacctgttccagaacggcgagttcgccacccaccacagccccgacagctggatcagccagagcgccagcttccccagcaaccagaagcagcccggcgtggacagcctgagccccgtggccctgctgagaaagcagaacttccagcccaccgcccagcagcagctgaccaagcccgccaagatcacctgcgccaactgcaagaagcccctgcagaagggccagaccgcctaccagagaaagggcagcgcccacctgttctgcagcaccacctgcctgagcagcttcagccacaagagaacccagaacaccagaagcatcatctgcaagaaggacgccagcaccaagaaggccaacgtgatcctgcccgtggagagcagcaagagcttccaggagttctacagcaccagctgcctgagcccctgcgagaacaactggaacctgaagaagggcgtgttcaacaagagcagatgcaccatctgcagcaagctggccgaggtgtggatcttcatccccaagctgctgttcagactgaccgtgatcatcctgaccttcaagtgctactacgtgctgttccacctgcacaacgccagagtgctggacgtgtag

SEQ ID NO: 11179 - DNA, 627 bp, Artificial Sequence
  Description of Artificial Sequence: Synthetic coding sequence
atggagaagtgcagcgtgggcggcctggagctgaccgagcagacccccgccctgctgggcaacatggccatggccaccagcctgatggacatcggcgacagcttcggccaccccgcctgccccctggtgagcagaagcagaaacagccccgtggaggacgacgacgacgacgacgacgtggtgttcatcgagagcatccagccccccagcatcagcgcccccgccatcgccgaccagagaaacttcatcttcgccagcagcaagaacgagaagccccagggcaactacagcgtgatcccccccagcagcagagacctggccagccagaagggcaacatcagcgagaccatcgtgatcgacgacgaggaggacatcgagaccaacggcggcgccgagaagaagagcagctgcttcatcgagtggggcctgcccggcaccaagaacaagaccaacgacctggacttcagcaccagcagcctgagcagaagcaagaccaagaccggcgtgagacccttcaaccccggcagaatgaacgtggccggcgacctgttccagaacggcgagttcgccacccaccacagccccgagatgcacctgcagagaagactgatgagcttcttccagtag

SEQ ID NO: 11180 - DNA, 513 bp, Artificial Sequence
  Description of Artificial Sequence: Synthetic coding sequence
atgaaggagcccctggacggcgagtgcggcaaggccgtggtgccccagcaggagctgctggacaagatcaaggaggagcccgacaacgcccaggagtacggctgcgtgcagcagcccaagacccaggagagcaagctgaagatcggcggcgtgagcagcgtgaacgagagacccatcgcccagcagctgaaccccggcttccagctgagcttcgccagcagcggccccagcgtgctgctgcccagcgtgcccgccgtggccatcaaggtgttctgcagcggctgcaagaagatgctgtacaagggccagaccgcctaccacaagaccggcagcacccagctgttctgcagcaccagatgcatcaccagacacagcagccccgcctgcctgccccccccccccaagaagacctgcaccaactgcagcaagtacaagatcctgaacatccccttctacttcaccttcttcctggtgtgcatcctgttcagcagcaacatcctgctgatcctgtag

SEQ ID NO: 11181 - DNA, 3978 bp, Artificial Sequence
  Description of Artificial Sequence: Synthetic coding sequence
atgaaggagcccctggacggcgagtgcggcaaggccgtggtgccccagcaggagctgctggacaagatcaaggaggagcccgacaacgcccaggagtacggctgcgtgcagcagcccaagacccaggagagcaagctgaagatcggcggcgtgagcagcgtgaacgagagacccatcgcccagcagctgaaccccggcttccagctgagcttcgccagcagcggccccagcgtgctgctgcccagcgtgcccgccgtggccatcaaggtgttctgcagcggctgcaagaagatgctgtacaagggccagaccgcctaccacaagaccggcagcacccagctgttctgcagcaccagatgcatcaccagacacagcagccccgcctgcctgccccccccccccaagaagacctgcaccaactgcagcaaggacatcctgaaccccaaggacgtgatcaccaccagattcgagaacagctaccccagcaaggacttctgcagccagagctgcctgagcagctacgagctgaagaagaagcccgtggtgaccatctacaccaagagcatcagcaccaagtgcagcatgtgccagaagaacgccgacaccagattcgaggtgaagtaccagaacgtggtgcacggcctgtgcagcgacgcctgcttcagcaagttccacagcaccaacaacctgaccatgaactgctgcgagaactgcggcagctactgctacagcagcagcggcccctgccagagccagaaggtgttcagcagcaccagcgtgaccgcctacaagcagaacagcgcccagatccccccctacgccctgggcaagagcctgagacccagcgccgagatgatcgagaccaccaacgacagcggcaagaccgagctgttctgcagcatcaactgcctgagcgcctacagagtgaagaccgtgaccagcagcggcgtgcaggtgagctgccacagctgcaagaccagcgccatcccccagtaccacctggccatgagcaacggcaccatctacagcttctgcagcagcagctgcgtggtggccttccagaacgtgttcagcaagcccaagggcaccaacagcagcgccgtgcccctgagccagggccaggtggtggtgagcccccccagcagcagaagcgccgtgagcatcggcggcggcaacaccagcgccgtgagccccagcagcatcagaggcagcgccgccgccagcctgcagcccctggccgagcagagccagcaggtggccctgacccacaccgtggtgaagctgaagtgccagcactgcaaccacctgttcgccaccaagcccgagctgctgttctacaagggcaagatgttcctgttctgcggcaagaactgcagcgacgagtacaagaagaagaacaaggtggtggccatgtgcgactactgcaagctgcagaagatcatcaaggagaccgtgagattcagcggcgtggacaagcccttctgcagcgaggtgtgcaagttcctgagcgccagagacttcggcgagagatggggcaactactgcaagatgtgcagctactgcagccagaccagccccaacctggtggagaacagactggagggcaagctggaggagttctgctgcgaggactgcatgagcaagttcaccgtgctgttctaccagatggccaagtgcgacggctgcaagagacagggcaagctgagcgagagcatcaagtggagaggcaacatcaagcacttctgcaacctgttctgcgtgctggagttctgccaccagcagatcatgaacgactgcctgccccagaacaaggtgaacatcagcaaggccaagaccgccgtgaccgagctgcccagcgccagaaccgacaccacccccgtgatcaccagcgtgatgagcctggccaagatccccgccaccctgagcaccggcaacaccaacagcgtgctgaagggcgccgtgaccaaggaggccgccaagatcatccaggacgagagcacccaggaggacgccatgaagttccccagcagccagagcagccagcccagcagactgctgaagaacaagggcatcagctgcaagcccgtgacccagaccaaggccaccagctgcaagccccacacccagcacaaggagtgccagaccgacctgcccatgcccaacgagaagaacgacgccgagctggacagcccccccagcaagaagaagagactgggcttcttccagacctacgacaccgagtacctgaaggtgggcttcatcatctgccccggcagcaaggagagcagccccagaccccagtgcgtgatctgcggcgagatcctgagcagcgagaacatgaagcccgccaacctgagccaccacctgaagaccaagcacagcgagctggagaacaagcccgtggacttcttcgagcagaagagcctggagatggagtgccagaacagcagcctgaagaagtgcctgctggtggagaagagcctggtgaaggccagctacctgatcgccttccagaccgccgccagcaagaagcccttcagcatcgccgaggagctgatcaagccctacctggtggagatgtgcagcgaggtgctgggcagcagcgccggcgacaagatgaagaccatccccctgagcaacgtgaccatccagcacagaatcgacgagctgagcgccgacatcgaggaccagctgatccagaaggtgagagagagcaagtggttcgccctgcagatcgacgagagcagcgagatcagcaacatcaccctgctgctgtgctacatcagattcatcgactacgactgcagagacgtgaaggaggagctgctgttctgcatcgagatgcccacccagatcaccggcttcgagatcttcgagctgatcaacaagtacatcgacagcaagagcctgaactggaagcactgcgtgggcctgtgcaccgacggcgccgccagcatgaccggcagatacagcggcctgaaggccaagatccaggaggtggccatgaacaccgccgccttcacccactgcttcatccacagagagagactggtggccgagaagctgagcccctgcctgcacaagatcctgctgcagagcgcccagatcctgagcttcatcaagagcaacgccctgaacagcagaatgctgaccatcctgtgcgaggagatgggcagcgagcacgtgagcctgcccctgcacgccgaggtgagatggatcagcagaggcagaatgctgaagagactgttcgagctgagacacgagatcgagatcttcctgagccagaagcacagcgacctggccaagtacttccacgacgaggagtgggtgggcaagctggcctacctgagcgacatcttcagcctgatcaacgagctgaacctgagcctgcagggcaccctgaccaccttcttcaacctgtgcaacaagatcgacgtgttcaagagaaagctgaagatgtggctgaagagaacccaggagaacgactacgacatgttccccagcttcagcgagttcagcaacagcagcggcctgaacatgaccgacatcaccagaatcatcttcgagcacctggagggcctgagccaggtgttcagcgactgcttcccccccgagcaggacctgagaagcggcaacctgtggatcatccaccccttcatgaaccaccagaacaacaacctgaccgacttcgaggaggagaagctgaccgagctgagcagcgacctgggcctgcaggccctgttcaagagcgtgagcgtgacccagttctggatcaacgccaagaccagctaccccgagctgcacgagagagccatgaagttcctgctgcccttcagcaccgtgtacctgtgcgacgccgccttcagcgccctgaccgagagcaagcagaagaacctgctgggcagcggccccgccctgagactggccgtgaccagcctgatccccagaatcgagaagctggtgaaggagaaggagtag

SEQ ID NO: 11182 - DNA, 513 bp, Artificial Sequence; identical to SEQ ID NO: 11180
  Description of Artificial Sequence: Synthetic coding sequence

SEQ ID NO: 11183 - DNA, 2172 bp, Artificial Sequence
  Description of Artificial Sequence: Synthetic coding sequence
atgaaggagcccctggacggcgagtgcggcaaggccgtggtgccccagcaggagctgctggacaagatcaaggaggagcccgacaacgcccaggagtacggctgcgtgcagcagcccaagacccaggagagcaagctgaagatcggcggcgtgagcagcgtgaacgagagacccatcgcccagcagctgaaccccggcttccagctgagcttcgccagcagcggccccagcgtgctgctgcccagcgtgcccgccgtggccatcaaggtgttctgcagcggctgcaagaagatgctgtacaagggccagaccgcctaccacaagaccggcagcacccagctgttctgcagcaccagatgcatcaccagacacagcagccccgcctgcctgccccccccccccaagaagacctgcaccaactgcagcaaggacatcctgaaccccaaggacgtgatcaccaccagattcgagaacagctaccccagcaaggacttctgcagccagagctgcctgagcagctacgagctgaagaagaagcccgtggtgaccatctacaccaagagcatcagcaccaagtgcagcatgtgccagaagaacgccgacaccagattcgaggtgaagtaccagaacgtggtgcacggcctgtgcagcgacgcctgcttcagcaagttccacagcaccaacaacctgaccatgaactgctgcgagaactgcggcagctactgctacagcagcagcggcccctgccagagccagaaggtgttcagcagcaccagcgtgaccgcctacaagcagaacagcgcccagatccccccctacgccctgggcaagagcctgagacccagcgccgagatgatcgagaccaccaacgacagcggcaagaccgagctgttctgcagcatcaactgcctgagcgcctacagagtgaagaccgtgaccagcagcggcgtgcaggtgagctgccacagctgcaagaccagcgccatcccccagtaccacctggccatgagcaacggcaccatctacagcttctgcagcagcagctgcgtggtggccttccagaacgtgttcagcaagcccaagggcaccaacagcagcgccgtgcccctgagccagggccaggtggtggtgagcccccccagcagcagaagcgccgtgagcatcggcggcggcaacaccagcgccgtgagccccagcagcatcagaggcagcgccgccgccagcctgcagcccctggccgagcagagccagcaggtggccctgacccacaccgtggtgaagctgaagtgccagcactgcaaccacctgttcgccaccaagcccgagctgctgttctacaagggcaagatgttcctgttctgcggcaagaactgcagcgacgagtacaagaagaagaacaaggtggtggccatgtgcgactactgcaagctgcagaagatcatcaaggagaccgtgagattcagcggcgtggacaagcccttctgcagcgaggtgtgcaagttcctgagcgccagagacttcggcgagagatggggcaactactgcaagatgtgcagctactgcagccagaccagccccaacctggtggagaacagactggagggcaagctggaggagttctgctgcgaggactgcatgagcaagttcaccgtgctgttctaccagatggccaagtgcgacggctgcaagagacagggcaagctgagcgagagcatcaagtggagaggcaacatcaagcacttctgcaacctgttctgcgtgctggagttctgccaccagcagatcatgaacgactgcctgccccagaacaaggtgaacatcagcaaggccaagaccgccgtgaccgagctgcccagcgccagaaccgacaccacccccgtgatcaccagcgtgatgagcctggccaagatccccgccaccctgagcaccggcaacaccaacagcgtgctgaagggcgccgtgaccaaggaggccgccaagatcatccaggacgagagcacccaggaggacgccatgaagttccccagcagccagagcagccagcccagcagactgctgaagaacaagggcatcagctgcaagcccgtgacccagaccaaggccaccagctgcaagccccacacccagcacaaggagtgccagaccgagtgccccgtgagagccgtgtgctag

SEQ ID NO: 11184 - DNA, 627 bp, Artificial Sequence
  Description of Artificial Sequence: Synthetic coding sequence
atgaaggagcccctggacggcgagtgcggcaaggccgtggtgccccagcaggagctgctggacaagatcaaggaggagcccgacaacgcccaggagtacggctgcgtgcagcagcccaagacccaggagagcaagctgaagatcggcggcgtgagcagcgtgaacgagagacccatcgcccagcagctgaaccccggcttccagctgagcttcgccagcagcggccccagcgtgctgctgcccagcgtgcccgccgtggccatcaaggtgttctgcagcggctgcaagaagatgctgtacaagggccagaccgcctaccacaagaccggcagcacccagctgttctgcagcaccagatgcatcaccagacacagcagccccgcctgcctgccccccccccccaagaagacctgcaccaactgcagcaaggacatcctgaaccccaaggacgtgatcaccaccagattcgagaacagctaccccagcaaggacttctgcagccagagctgcctgagcagctacgagctgaagaagaagcccgtggtgaccatctacaccaagagcatcagcaccaagtgcagcatgtgccagaagaacgccgacaccagattcgaggtgaagtactag

SEQ ID NO: 11185 - DNA, 1689 bp, Artificial Sequence
  Description of Artificial Sequence: Synthetic coding sequence
atgagcagagtgcacggcatgcaccccaaggagaccaccagacagctgagcctggccgtgaaggacggcctgatcgtggagaccctgaccgtgggctgcaagggcagcaaggccggcatcgagcaggagggctactggctgcccggcgacgagatcgactgggagaccgagaaccacgactggtactgcttcgagtgccacctgcccggcgaggtgctgatctgcgacctgtgcttcagagtgtaccacagcaagtgcctgagcgacgagttcagactgagagacagcagcagcccctggcagtgccccgtgtgcagaagcatcaagaagaagaacaccaacaagcaggagatgggcacctacctgagattcatcgtgagcagaatgaaggagagagccatcgacctgaacaagaagggcaaggacaacaagcaccccatgtacagaagactggtgcacagcgccgtggacgtgcccaccatccaggagaaggtgaacgagggcaagtacagaagctacgaggagttcaaggccgacgcccagctgctgctgcacaacaccgtgatcttctacggcgccgacagcgagcaggccgacatcgccagaatgctgtacaaggacacctgccacgagctggacgagctgcagctgtgcaagaactgcttctacctgagcaacgccagacccgacaactggttctgctacccctgcatccccaaccacgagctggtgtgggccaagatgaagggcttcggcttctggcccgccaaggtgatgcagaaggaggacaaccaggtggacgtgagattcttcggccaccaccaccagagagcctggatccccagcgagaacatccaggacatcaccgtgaacatccacagactgcacgtgaagagaagcatgggctggaagaaggcctgcgacgagctggagctgcaccagagattcctgagagagggcagattctggaagagcaagaacgaggacagaggcgaggaggaggccgagagcagcatcagcagcaccagcaacgagcagctgaaggtgacccaggagcccagagccaagaagggcagaagaaaccagagcgtggagcccaagaaggaggagcccgagcccgagaccgaggccgtgagcagcagccaggagatccccaccatgccccagcccatcgagaaggtgagcgtgagcacccagaccaagaagctgagcgccagcagccccagaatgctgcacagaagcacccagaccaccaacgacggcgtgtgccagagcatgtgccacgacaagtacaccaagatcttcaacgacttcaaggacagaatgaagagcgaccacaagagagagaccgagagagtggtgagagaggccctggagaagctgagaagcgagatggaggaggagaagagacaggccgtgaacaaggccgtggccaacatgcagggcgagatggacagaaagtgcaagcaggtgaaggagaagtgcaaggaggagttcgtggaggagatcaagaagctggccacccagcacaagcagctgatcagccagaccaagaagaagcagtggtgctacaactgcgaggaggaggccatgtaccactgctgctggaacaccagctactgcagcatcaagtgccagcaggagcactggcacgccgagcacaagagaacctgcagaagaaagagatag

SEQ ID NO: 11186 - DNA, 1758 bp, Artificial Sequence
  Description of Artificial Sequence: Synthetic coding sequence
atggtgatcttcaccagcctgcacagatacgtgatcttcatcagctgcatcatcgtgatcaactggtacatgagcagagtgcacggcatgcaccccaaggagaccaccagacagctgagcctggccgtgaaggacggcctgatcgtggagaccctgaccgtgggctgcaagggcagcaaggccggcatcgagcaggagggctactggctgcccggcgacgagatcgactgggagaccgagaaccacgactggtactgcttcgagtgccacctgcccggcgaggtgctgatctgcgacctgtgcttcagagtgtaccacagcaagtgcctgagcgacgagttcagactgagagacagcagcagcccctggcagtgccccgtgtgcagaagcatcaagaagaagaacaccaacaagcaggagatgggcacctacctgagattcatcgtgagcagaatgaaggagagagccatcgacctgaacaagaagggcaaggacaacaagcaccccatgtacagaagactggtgcacagcgccgtggacgtgcccaccatccaggagaaggtgaacgagggcaagtacagaagctacgaggagttcaaggccgacgcccagctgctgctgcacaacaccgtgatcttctacggcgccgacagcgagcaggccgacatcgccagaatgctgtacaaggacacctgccacgagctggacgagctgcagctgtgcaagaactgcttctacctgagcaacgccagacccgacaactggttctgctacccctgcatccccaaccacgagctggtgtgggccaagatgaagggcttcggcttctggcccgccaaggtgatgcagaaggaggacaaccaggtggacgtgagattcttcggccaccaccaccagagagcctggatccccagcgagaacatccaggacatcaccgtgaacatccacagactgcacgtgaagagaagcatgggctggaagaaggcctgcgacgagctggagctgcaccagagattcctgagagagggcagattctggaagagcaagaacgaggacagaggcgaggaggaggccgagagcagcatcagcagcaccagcaacgagcagctgaaggtgacccaggagcccagagccaagaagggcagaagaaaccagagcgtggagcccaagaaggaggagcccgagcccgagaccgaggccgtgagcagcagccaggagatccccaccatgccccagcccatcgagaaggtgagcgtgagcacccagaccaagaagctgagcgccagcagccccagaatgctgcacagaagcacccagaccaccaacgacggcgtgtgccagagcatgtgccacgacaagtacaccaagatcttcaacgacttcaaggacagaatgaagagcgaccacaagagagagaccgagagagtggtgagagaggccctggagaagctgagaagcgagatggaggaggagaagagacaggccgtgaacaaggccgtggccaacatgcagggcgagatggacagaaagtgcaagcaggtgaaggagaagtgcaaggaggagttcgtggaggagatcaagaagctggccacccagcacaagcagctgatcagccagaccaagaagaagcagtggtgctacaactgcgaggaggaggccatgtaccactgctgctggaacaccagctactgcagcatcaagtgccagcaggagcactggcacgccgagcacaagagaacctgcagaagaaagagatag

SEQ ID NO: 11187 - DNA, 1809 bp, Artificial Sequence
  Description of Artificial Sequence: Synthetic coding sequence
atggccagactgaccaagagaagacaggccgacaccaaggccatccagcacctgtgggccgccatcgagatcatcagaaaccagaagcagatcgccaacatcgacagaatcaccaagtacatgagcagagtgcacggcatgcaccccaaggagaccaccagacagctgagcctggccgtgaaggacggcctgatcgtggagaccctgaccgtgggctgcaagggcagcaaggccggcatcgagcaggagggctactggctgcccggcgacgagatcgactgggagaccgagaaccacgactggtactgcttcgagtgccacctgcccggcgaggtgctgatctgcgacctgtgcttcagagtgtaccacagcaagtgcctgagcgacgagttcagactgagagacagcagcagcccctggcagtgccccgtgtgcagaagcatcaagaagaagaacaccaacaagcaggagatgggcacctacctgagattcatcgtgagcagaatgaaggagagagccatcgacctgaacaagaagggcaaggacaacaagcaccccatgtacagaagactggtgcacagcgccgtggacgtgcccaccatccaggagaaggtgaacgagggcaagtacagaagctacgaggagttcaaggccgacgcccagctgctgctgcacaacaccgtgatcttctacggcgccgacagcgagcaggccgacatcgccagaatgctgtacaaggacacctgccacgagctggacgagctgcagctgtgcaagaactgcttctacctgagcaacgccagacccgacaactggttctgctacccctgcatccccaaccacgagctggtgtgggccaagatgaagggcttcggcttctggcccgccaaggtgatgcagaaggaggacaaccaggtggacgtgagattcttcggccaccaccaccagagagcctggatccccagcgagaacatccaggacatcaccgtgaacatccacagactgcacgtgaagagaagcatgggctggaagaaggcctgcgacgagctggagctgcaccagagattcctgagagagggcagattctggaagagcaagaacgaggacagaggcgaggaggaggccgagagcagcatcagcagcaccagcaacgagcagctgaaggtgacccaggagcccagagccaagaagggcagaagaaaccagagcgtggagcccaagaaggaggagcccgagcccgagaccgaggccgtgagcagcagccaggagatccccaccatgccccagcccatcgagaaggtgagcgtgagcacccagaccaagaagctgagcgccagcagccccagaatgctgcacagaagcacccagaccaccaacgacggcgtgtgccagagcatgtgccacgacaagtacaccaagatcttcaacgacttcaaggacagaatgaagagcgaccacaagagagagaccgagagagtggtgagagaggccctggagaagctgagaagcgagatggaggaggagaagagacaggccgtgaacaaggccgtggccaacatgcagggcgagatggacagaaagtgcaagcaggtgaaggagaagtgcaaggaggagttcgtggaggagatcaagaagctggccacccagcacaagcagctgatcagccagaccaagaagaagcagtggtgctacaactgcgaggaggaggccatgtaccactgctgctggaacaccagctactgcagcatcaagtgccagcaggagcactggcacgccgagcacaagagaacctgcagaagaaagagatag

SEQ ID NO: 11188 - DNA, 1587 bp, Artificial Sequence
  Description of Artificial Sequence: Synthetic coding sequence
atgagcagagtgcacggcatgcaccccaaggagaccaccagacagctgagcctggccgtgaaggacggcctgatcgtggagaccctgaccgtgggctgcaagggcagcaaggccggcatcgagcaggagggctactggctgcccggcgacgagatcgactgggagaccgagaaccacgactggtactgcttcgagtgccacctgcccggcgaggtgctgatctgcgacctgtgcttcagagtgtaccacagcaagtgcctgagcgacgagttcagactgagagacagcagcagcccctggcagtgccccgtgtgcagaagcatcaagaagaagaacaccaacaagcaggagatgggcacctacctgagattcatcgtgagcagaatgaaggagagagccatcgacctgaacaagaagggcaaggacaacaagcaccccatgtacagaagactggtgcacagcgccgtggacgtgcccaccatccaggagaaggtgaacgagggcaagtacagaagctacgaggagttcaaggccgacgcccagctgctgctgcacaacaccgtgatcttctacggcgccgacagcgagcaggccgacatcgccagaatgctgtacaaggacacctgccacgagctggacgagctgcagctgtgcaagaactgcttctacctgagcaacgccagacccgacaactggttctgctacccctgcatccccaaccacgagctggtgtgggccaagatgaagggcttcggcttctggcccgccaaggtgatgcagaaggaggacaaccaggtggacgtgagattcttcggccaccaccaccagagagcctggatccccagcgagaacatccaggacatcaccgtgaacatccacagactgcacgtgaagagaagcatgggctggaagaaggcctgcgacgagctggagctgcaccagagattcctgagagagggcagattctggaagagcaagaacgaggacagaggcgaggaggaggccgagagcagcatcagcagcaccagcaacgagcagctgaaggtgacccaggagcccagagccaagaagggcagaagaaaccagagcgtggagcccaagaaggaggagcccgagcccgagaccgaggccgtgagcagcagccaggagatccccaccatgccccagcccatcgagaaggtgagcgtgagcacccagaccaagaagctgagcgccagcagccccagaatgctgcacagaagcacccagaccaccaacgacggcgtgtgccagagcatgtgccacgacaagtacaccaagatcttcaacgacttcaaggacagaatgaagagcgaccacaagagagagaccgagagagtggtgagagaggccctggagaagctgagaagcgagatggaggaggagaagagacaggccgtgaacaaggccgtggccaacatgcagggcgagatggacagaaagtgcaagcaggtgaaggagaagtgcaaggaggagttcgtggaggagatcaagaagctggccacccagcacaagcagctgatcagccagaccaagaagaagcagtgggtgaacaccagcctgttctag

SEQ ID NO: 11189 - DNA, 1689 bp, Artificial Sequence; identical to SEQ ID NO: 11185
  Description of Artificial Sequence: Synthetic coding sequence

SEQ ID NO: 11190 - DNA, 1527 bp, Artificial Sequence
  Description of Artificial Sequence: Synthetic coding sequence
atgagcagagtgcacggcatgcaccccaaggagaccaccagacagctgagcctggccgtgaaggacggcctgatcgtggagaccctgaccgtgggctgcaagggcagcaaggccggcatcgagcaggagggctactggctgcccggcgacgagatcagcatcaagaagaagaacaccaacaagcaggagatgggcacctacctgagattcatcgtgagcagaatgaaggagagagccatcgacctgaacaagaagggcaaggacaacaagcaccccatgtacagaagactggtgcacagcgccgtggacgtgcccaccatccaggagaaggtgaacgagggcaagtacagaagctacgaggagttcaaggccgacgcccagctgctgctgcacaacaccgtgatcttctacggcgccgacagcgagcaggccgacatcgccagaatgctgtacaaggacacctgccacgagctggacgagctgcagctgtgcaagaactgcttctacctgagcaacgccagacccgacaactggttctgctacccctgcatccccaaccacgagctggtgtgggccaagatgaagggcttcggcttctggcccgccaaggtgatgcagaaggaggacaaccaggtggacgtgagattcttcggccaccaccaccagagagcctggatccccagcgagaacatccaggacatcaccgtgaacatccacagactgcacgtgaagagaagcatgggctggaagaaggcctgcgacgagctggagctgcaccagagattcctgagagagggcagattctggaagagcaagaacgaggacagaggcgaggaggaggccgagagcagcatcagcagcaccagcaacgagcagctgaaggtgacccaggagcccagagccaagaagggcagaagaaaccagagcgtggagcccaagaaggaggagcccgagcccgagaccgaggccgtgagcagcagccaggagatccccaccatgccccagcccatcgagaaggtgagcgtgagcacccagaccaagaagctgagcgccagcagccccagaatgctgcacagaagcacccagaccaccaacgacggcgtgtgccagagcatgtgccacgacaagtacaccaagatcttcaacgacttcaaggacagaatgaagagcgaccacaagagagagaccgagagagtggtgagagaggccctggagaagctgagaagcgagatggaggaggagaagagacaggccgtgaacaaggccgtggccaacatgcagggcgagatggacagaaagtgcaagcaggtgaaggagaagtgcaaggaggagttcgtggaggagatcaagaagctggccacccagcacaagcagctgatcagccagaccaagaagaagcagtggtgctacaactgcgaggaggaggccatgtaccactgctgctggaacaccagctactgcagcatcaagtgccagcaggagcactggcacgccgagcacaagagaacctgcagaagaaagagatag

SEQ ID NO: 11191 - DNA, 1554 bp, Artificial Sequence
  Description of Artificial Sequence: Synthetic coding sequence
atggccagactgaccaagagaagacaggccgacaccaaggccatccagcacctgtgggccgccatcgagatcatcagaaaccagaagcagatcgccaacatcgacagaatcaccaagtacatgagcagagtgcacggcatgcaccccaaggagaccaccagacagctgagcctggccgtgaaggacggcctgatcgtggagaccctgaccgtgggctgcaagggcagcaaggccggcatcgagcaggagggctactggctgcccggcgacgagatcagcatcaagaagaagaacaccaacaagcaggagatgggcacctacctgagattcatcgtgagcagaatgaaggagagaaaggtgaacgagggcaagtacagaagctacgaggagttcaaggccgacgcccagctgctgctgcacaacaccgtgatcttctacggcgccgacagcgagcaggccgacatcgccagaatgctgtacaaggacacctgccacgagctggacgagctgcagctgtgcaagaactgcttctacctgagcaacgccagacccgacaactggttctgctacccctgcatccccaaccacgagctggtgtgggccaagatgaagggcttcggcttctggcccgccaaggtgatgcagaaggaggacaaccaggtggacgtgagattcttcggccaccaccaccagagagcctggatccccagcgagaacatccaggacatcaccgtgaacatccacagactgcacgtgaagagaagcatgggctggaagaaggcctgcgacgagctggagctgcaccagagattcctgagagagggcagattctggaagagcaagaacgaggacagaggcgaggaggaggccgagagcagcatcagcagcaccagcaacgagcagctgaaggtgacccaggagcccagagccaagaagggcagaagaaaccagagcgtggagcccaagaaggaggagcccgagcccgagaccgaggccgtgagcagcagccaggagatccccaccatgccccagcccatcgagaaggtgagcgtgagcacccagaccaagaagctgagcgccagcagccccagaatgctgcacagaagcacccagaccaccaacgacggcgtgtgccagagcatgtgccacgacaagtacaccaagatcttcaacgacttcaaggacagaatgaagagcgaccacaagagagagaccgagagagtggtgagagaggccctggagaagctgagaagcgagatggaggaggagaagagacaggccgtgaacaaggccgtggccaacatgcagggcgagatggacagaaagtgcaagcaggtgaaggagaagtgcaaggaggagttcgtggaggagatcaagaagctggccacccagcacaagcagctgatcagccagaccaagaagaagcagtggtgctacaactgcgaggaggaggccatgtaccactgctgctggaacaccagctactgcagcatcaagtgccagcaggagcactggcacgccgagcacaagagaacctgcagaagaaagagatag

SEQ ID NO: 11192 - DNA, 1809 bp, Artificial Sequence; identical to SEQ ID NO: 11187
  Description of Artificial Sequence: Synthetic coding sequence

SEQ ID NO: 11193 - DNA, 1569 bp, Artificial Sequence
  Description of Artificial Sequence: Synthetic coding sequence
atggccagactgaccaagagaagacaggccgacaccaaggccatccagcacctgtgggccgccatcgagatcatcagaaaccagaagcagatcgccaacatcgacagaatcaccaagtacatgagcagagtgcacggcatgcaccccaaggagaccaccagacagctgagcctggccgtgaaggacggcctgatcgtggagaccctgaccgtgggctgcaagggcagcaaggccggcatcgagcaggagggctactggctgcccggcgacgagatcagcatcaagaagaagaacaccaacaagcaggagatgggcacctacctgagattcatcgtgagcagaatgaaggagagagccatcgacctgaacaagaagggcaaggacaacaagcaccccatgtacagaagactggtgcacagcgccgtggacgtgcccaccatccaggagaaggtgaacgagggcaagtacagaagctacgaggagttcaaggccgacgcccagctgctgctgcacaacaccgtgatcttctacggcgccgacagcgagcaggccgacatcgccagaatgctgtacaaggacacctgccacgagatccccaaccacgagctggtgtgggccaagatgaagggcttcggcttctggcccgccaaggtgatgcagaaggaggacaaccaggtggacgtgagattcttcggccaccaccaccagagagcctggatccccagcgagaacatccaggacatcaccgtgaacatccacagactgcacgtgaagagaagcatgggctggaagaaggcctgcgacgagctggagctgcaccagagattcctgagagagggcagattctggaagagcaagaacgaggacagaggcgaggaggaggccgagagcagcatcagcagcaccagcaacgagcagctgaaggtgacccaggagcccagagccaagaagggcagaagaaaccagagcgtggagcccaagaaggaggagcccgagcccgagaccgaggccgtgagcagcagccaggagatccccaccatgccccagcccatcgagaaggtgagcgtgagcacccagaccaagaagctgagcgccagcagccccagaatgctgcacagaagcacccagaccaccaacgacggcgtgtgccagagcatgtgccacgacaagtacaccaagatcttcaacgacttcaaggacagaatgaagagcgaccacaagagagagaccgagagagtggtgagagaggccctggagaagctgagaagcgagatggaggaggagaagagacaggccgtgaacaaggccgtggccaacatgcagggcgagatggacagaaagtgcaagcaggtgaaggagaagtgcaaggaggagttcgtggaggagatcaagaagctggccacccagcacaagcagctgatcagccagaccaagaagaagcagtggtgctacaactgcgaggaggaggccatgtaccactgctgctggaacaccagctactgcagcatcaagtgccagcaggagcactggcacgccgagcacaagagaacctgcagaagaaagagatag

SEQ ID NO: 11194 - DNA, 1704 bp, Artificial Sequence
  Description of Artificial Sequence: Synthetic coding sequence
atggccagactgaccaagagaagacaggccgacaccaaggccatccagcacctgtgggccgccatcgagatcatcagaaaccagaagcagatcgccaacatcgacagaatcaccaagtacatgagcagagtgcacggcatgcaccccaaggagaccaccagacagctgagcctggccgtgaaggacggcctgatcgtggagaccctgaccgtgggctgcaagggcagcaaggccggcatcgagcaggagggctactggctgcccggcgacgagatcgactgggagaccgagaaccacgactggtactgcttcgagtgccacctgcccggcgaggtgctgatctgcgacctgtgcttcagagtgtaccacagcaagtgcctgagcgacgagttcagactgagagacagcagcagcccctggcagtgccccgtgtgcagaagcatcaagaagaagaacaccaacaagcaggagatgggcacctacctgagattcatcgtgagcagaatgaaggagagagccatcgacctgaacaagaagggcaaggacaacaagcaccccatgtacagaagactggtgcacagcgccgtggacgtgcccaccatccaggagaaggtgaacgagggcaagtacagaagctacgaggagttcaaggccgacgcccagctgctgctgcacaacaccgtgatcttctacggcgacagcgagcaggccgacatcgccagaatgctgtacaaggacacctgccacgagctggacgagctgcagctgtgcaagaactgcttctacctgagcaacgccagacccgacaactggttctgctacccctgcatccccaaccacgagctggtgtgggccaagatgaagggcttcggcttctggcccgccaaggtgatgcagaaggaggacaaccaggtggacgtgagattcttcggccaccaccaccagagagcctggatccccagcgagaacatccaggacatcaccgtgaacatccacagactgcacgtgaagagaagcatgggctggaagaaggcctgcgacgagctggagctgcaccagagattcctgagagagggcagattctggaagagcaagaacgaggacagaggcgaggaggaggccgagagcagcatcagcagcaccagcaacgagcagctgaaggtgacccaggagcccagagccaagaagggcagaagaaaccagagcgtggagcccaagaaggaggagcccgagcccgagaccgaggccgtgagcagcagccaggagatccccaccatgccccagcccatcgagaaggtgagcgtgagcacccagaccaagaagctgagcgccagcagccccagaatgctgcacagaagcacccagaccaccaacgacggcgtgtgccagagcatgtgccacgacaagtacaccaagatcttcaacgacttcaaggacagaatgaagagcgaccacaagagagagaccgagagagtggtgagagaggccctggagaagctgagaagcgagatggaggaggagaagagacaggccgtgaacaaggccgtggccaacatgcagggcgagatggacagaaagtgcaagcaggtgaaggagaagtgcaaggaggagttcgtggaggagatcaagaagctggccacccagcacaagcagctgatcagccagaccaagaagaagcagtgggtgaacaccagcctgttctag

SEQ ID NO: 11195 - DNA, 1194 bp, Artificial Sequence
  Description of Artificial Sequence: Synthetic coding sequence
atgggcacctacctgagattcatcgtgagcagaatgaaggagagagccatcgacctgaacaagaagggcaaggacaacaagcaccccatgtacagaagactggtgcacagcgccgtggacgtgcccaccatccaggagctggacgagctgcagctgtgcaagaactgcttctacctgagcaacgccagacccgacaactggttctgctacccctgcatccccaaccacgagctggtgtgggccaagatgaagggcttcggcttctggcccgccaaggtgatgcagaaggaggacaaccaggtggacgtgagattcttcggccaccaccaccagagagcctggatccccagcgagaacatccaggacatcaccgtgaacatccacagactgcacgtgaagagaagcatgggctggaagaaggcctgcgacgagctggagctgcaccagagattcctgagagagggcagattctggaagagcaagaacgaggacagaggcgaggaggaggccgagagcagcatcagcagcaccagcaacgagcagctgaaggtgacccaggagcccagagccaagaagggcagaagaaaccagagcgtggagcccaagaaggaggagcccgagcccgagaccgaggccgtgagcagcagccaggagatccccaccatgccccagcccatcgagaaggtgagcgtgagcacccagaccaagaagctgagcgccagcagccccagaatgctgcacagaagcacccagaccaccaacgacggcgtgtgccagagcatgtgccacgacaagtacaccaagatcttcaacgacttcaaggacagaatgaagagcgaccacaagagagagaccgagagagtggtgagagaggccctggagaagctgagaagcgagatggaggaggagaagagacaggccgtgaacaaggccgtggccaacatgcagggcgagatggacagaaagtgcaagcaggtgaaggagaagtgcaaggaggagttcgtggaggagatcaagaagctggccacccagcacaagcagctgatcagccagaccaagaagaagcagtggtgctacaactgcgaggaggaggccatgtaccactgctgctggaacaccagctactgcagcatcaagtgccagcaggagcactggcacgccgagcacaagagaacctgcagaagaaagagatag

SEQ ID NO: 11196 - DNA, 1449 bp, Artificial Sequence
  Description of Artificial Sequence: Synthetic coding sequence
atgagcagagtgcacggcatgcaccccaaggagaccaccagacagctgagcctggccgtgaaggacggcctgatcgtggagaccctgaccgtgggctgcaagggcagcaaggccggcatcgagcaggagggctactggctgcccggcgacgagatcagcatcaagaagaagaacaccaacaagcaggagatgggcacctacctgagattcatcgtgagcagaatgaaggagagagccatcgacctgaacaagaagggcaaggacaacaagcaccccatgtacagaagactggtgcacagcgccgtggacgtgcccaccatccaggagaaggtgaacgagggcaagtacagaagctacgaggagttcaaggccgacgcccagctgctgctgcacaacaccgtgatcttctacggcgccgacagcgagcaggccgacatcgccagaatgctgtacaaggacacctgccacgagatccccaaccacgagctggtgtgggccaagatgaagggcttcggcttctggcccgccaaggtgatgcagaaggaggacaaccaggtggacgtgagattcttcggccaccaccaccagagagcctggatccccagcgagaacatccaggacatcaccgtgaacatccacagactgcacgtgaagagaagcatgggctggaagaaggcctgcgacgagctggagctgcaccagagattcctgagagagggcagattctggaagagcaagaacgaggacagaggcgaggaggaggccgagagcagcatcagcagcaccagcaacgagcagctgaaggtgacccaggagcccagagccaagaagggcagaagaaaccagagcgtggagcccaagaaggaggagcccgagcccgagaccgaggccgtgagcagcagccaggagatccccaccatgccccagcccatcgagaaggtgagcgtgagcacccagaccaagaagctgagcgccagcagccccagaatgctgcacagaagcacccagaccaccaacgacggcgtgtgccagagcatgtgccacgacaagtacaccaagatcttcaacgacttcaaggacagaatgaagagcgaccacaagagagagaccgagagagtggtgagagaggccctggagaagctgagaagcgagatggaggaggagaagagacaggccgtgaacaaggccgtggccaacatgcagggcgagatggacagaaagtgcaagcaggtgaaggagaagtgcaaggaggagttcgtggaggagatcaagaagctggccacccagcacaagcagctgatcagccagaccaagaagaagcagtggtgctacaactgcgaggaggaggccatgtaccactgctgctggaacaccagctactgcagcatcaagtgccagcaggagcactggcacgccgagcacaagagaacctgcagaagaaagagatag

SEQ ID NO: 11197 - DNA, 3510 bp, Artificial Sequence
  Description of Artificial Sequence: Synthetic coding sequence
atggacatcagcaccagaagcaaggaccccggcagcgccgagagaaccgcccagaagagaaagttccccagccccccccacagcagcaacggccacagcccccaggacaccagcaccagccccatcaagaagaagaagaagcccggcctgctgaacagcaacaacaaggagcagagcgagctgagacacggccccttctactacatgaagcagcccctgaccaccgaccccgtggacgtggtgccccaggacggcagaaacgacttctactgctgggtgtgccacagagagggccaggtgctgtgctgcgagctgtgccccagagtgtaccacgccaagtgcctgagactgaccagcgagcccgagggcgactggttctgccccgagtgcgagaagatcaccgtggccgagtgcatcgagacccagagcaaggccatgaccatgctgaccatcgagcagctgagctacctgctgaagttcgccatccagaagatgaagcagcccggcaccgacgccttccagaagcccgtgcccctggagcagcaccccgactacgccgagtacatcttccaccccatggacctgtgcaccctggagaagaacgccaagaagaagatgtacggctgcaccgaggccttcctggccgacgccaagtggatcctgcacaactgcatcatctacaacggcggcaaccacaagctgacccagatcgccaaggtggtgatcaagatctgcgagcacgagatgaacgagatcgaggtgtgccccgagtgctacctggccgcctgccagaagagagacaactggttctgcgagccctgcagcaacccccaccccctggtgtgggccaagctgaagggcttccccttctggcccgccaaggccctgagagacaaggacggccaggtggacgccagattcttcggccagcacgacagagcctgggtgcccatcaacaactgctacctgatgagcaaggagatccccttcagcgtgaagaagaccaagagcatcttcaacagcgccatgcaggagatggaggtgtacgtggagaacatcagaagaaagttcggcgtgttcaactacagccccttcagaaccccctacacccccaacagccagtaccagatgctgctggaccccaccaaccccagcgccggcaccgccaagatcgacaagcaggagaaggtgaagctgaacttcgacatgaccgccagccccaagatcctgatgagcaagcccgtgctgagcggcggcaccggcagaagaatcagcctgagcgacatgcccagaagccccatgagcaccaacagcagcgtgcacaccggcagcgacgtggagcaggacgccgagaagaaggccaccagcagccacttcagcgccagcgaggagagcatggacttcctggacaagagcaccgccagccccgccagcaccaagaccggccaggccggcagcctgagcggcagccccaagcccttcagcccccagctgagcgcccccatcaccaccaagaccgacaagaccagcaccaccggcagcatcctgaacctgaacctgggccacagaagcaaggccgagatggacctgaaggagctgagcgagagcgtgcagcagcagagcacccccgtgcccctgatcagccccaagagacagatcagaagcagattccagctgaacctggacaagaccatcgagagctgcaaggcccagctgggcatcaacgagatcagcgaggacgtgtacaccgccgtggagcacagcgacagcgaggacagcgagaagagcgacagcagcgacagcgagtacatcagcgacgacgagcagaagagcaagaacgagcccgaggacaccgaggacaaggagggctgccagatggacaaggagcccagcgccgtgaagaagaagcccaagcccaccaaccccgtggagatcaaggaggagctgaagagcaccagccccgccagcgagaaggccgaccccggcgccgtgaaggacaaggccagccccgagcccgagaaggacttcagcgagaaggccaagcccagcccccaccccatcaaggacaagctgaagggcaaggacgagaccgacagccccaccgtgcacctgggcctggacagcgacagcgagagcgagctggtgatcgacctgggcgaggaccacagcggcagagagggcagaaagaacaagaaggagcccaaggagcccagccccaagcaggacgtggtgggcaagaccccccccagcaccaccgtgggcagccacagcccccccgagacccccgtgctgaccagaagcagcgcccagaccagcgccgccggcgccaccgccaccaccagcaccagcagcaccgtgaccgtgaccgcccccgcccccgccgccaccggcagccccgtgaagaagcagagacccctgctgcccaaggagaccgcccccgccgtgcagagagtggtgtggaacagcagcaccgtgcagcagaaggagatcacccagagccccagcaccagcaccatcaccctggtgaccagcacccagagcagccccctggtgaccagcagcggcagcatgagcaccctggtgagcagcgtgaacgccgacctgcccatcgccaccgccagcgccgacgtggccgccgacatcgccaagtacaccagcaagatgatggacgccatcaagggcaccatgaccgagatctacaacgacctgagcaagaacaccaccggcagcaccatcgccgagatcagaagactgagaatcgagatcgagaagctgcagtggctgcaccagcaggagctgagcgagatgaagcacaacctggagctgaccatggccgagatgagacagagcctggagcaggagagagacagactgatcgccgaggtgaagaagcagctggagctggagaagcagcaggccgtggacgagaccaagaagaagcagtggtgcgccaactgcaagaaggaggccatcttctactgctgctggaacaccagctactgcgactacccctgccagcaggcccactggcccgagcacatgaagagctgcacccagagcgccaccgccccccagcaggaggccgacgccgaggtgaacaccgagaccctgaacaagagcagccagggcagcagcagcagcacccagagcgcccccagcgagaccgccagcgccagcaaggagaaggagaccagcgccgagaagagcaaggagagcggcagcaccctggacctgagcggcagcagagagacccccagcagcatcctgctgggcagcaaccagggcagcgtgagcaagagatgcgacaagcagcccgcctacgcccccaccaccaccgaccaccagccccaccccaactaccccgcccagaagtaccacagcagaagcaacaagagcagctggagcagcagcgacgagaagagaggcagcaccagaagcgaccacaacaccagcaccagcaccaagagcctgctgcccaaggagagcagactggacaccttctgggactag

SEQ ID NO: 11198 - DNA, 3561 bp, Artificial Sequence
  Description of Artificial Sequence: Synthetic coding sequence
atggacatcagcaccagaagcaaggaccccggcagcgccgagagaaccgcccagaagagaaagttccccagccccccccacagcagcaacggccacagcccccaggacaccagcaccagccccatcaagaagaagaagaagcccggcctgctgaacagcaacaacaaggagcagagcgagctgagacacggccccttctactacatgaagcagcccctgaccaccgaccccgtggacgtggtgccccaggacggcagaaacgacttctactgctgggtgtgccacagagagggccaggtgctgtgctgcgagctgtgccccagagtgtaccacgccaagtgcctgagactgaccagcgagcccgagggcgactggttctgccccgagtgcgagaagatcaccgtggccgagtgcatcgagacccagagcaaggccatgaccatgctgaccatcgagcagctgagctacctgctgaagttcgccatccagaagatgaagcagcccggcaccgacgccttccagaagcccgtgcccctggagcagcaccccgactacgccgagtacatcttccaccccatggacctgtgcaccctggagaagaacgccaagaagaagatgtacggctgcaccgaggccttcctggccgacgccaagtggatcctgcacaactgcatcatctacaacggcggcaaccacaagctgacccagatcgccaaggtggtgatcaagatctgcgagcacgagatgaacgagatcgaggtgtgccccgagtgctacctggccgcctgccagaagagagacaactggttctgcgagccctgcagcaacccccaccccctggtgtgggccaagctgaagggcttccccttctggcccgccaaggccctgagagacaaggacggccaggtggacgccagattcttcggccagcacgacagagcctgggtgcccatcaacaactgctacctgatgagcaaggagatccccttcagcgtgaagaagaccaagagcatcttcaacagcgccatgcaggagatggaggtgtacgtggagaacatcagaagaaagttcggcgtgttcaactacagccccttcagaaccccctacacccccaacagccagtaccagatgctgctggaccccaccaaccccagcgccggcaccgccaagatcgacaagcaggagaaggtgaagctgaacttcgacatgaccgccagccccaagatcctgatgagcaagcccgtgctgagcggcggcaccggcagaagaatcagcctgagcgacatgcccagaagccccatgagcaccaacagcagcgtgcacaccggcagcgacgtggagcaggacgccgagaagaaggccaccagcagccacttcagcgccagcgaggagagcatggacttcctggacaagagcaccgccagccccgccagcaccaagaccggccaggccggcagcctgagcggcagccccaagcccttcagcccccagctgagcgcccccatcaccaccaagaccgacaagaccagcaccaccggcagcatcctgaacctgaacctggacagaagcaaggccgagatggacctgaaggagctgagcgagagcgtgcagcagcagagcacccccgtgcccctgatcagccccaagagacagatcagaagcagattccagctgaacctggacaagaccatcgagagctgcaaggcccagctgggcatcaacgagatcagcgaggacgtgtacaccgccgtggagcacagcgacagcgaggacagcgagaagagcgacagcagcgacagcgagtacatcagcgacgacgagcagaagagcaagaacgagcccgaggacaccgaggacaaggagggctgccagatggacaaggagcccagcgccgtgaagaagaagcccaagcccaccaaccccgtggagatcaaggaggagctgaagagcaccagccccgccagcgagaaggccgaccccggcgccgtgaaggacaaggccagccccgagcccgagaaggacttcagcgagaaggccaagcccagcccccaccccatcaaggacaagctgaagggcaaggacgagaccgacagccccaccgtgcacctgggcctggacagcgacagcgagagcgagctggtgatcgacctgggcgaggaccacagcggcagagagggcagaaagaacaagaaggagcccaaggagcccagccccaagcaggacgtggtgggcaagaccccccccagcaccaccgtgggcagccacagcccccccgagacccccgtgctgaccagaagcagcgcccagaccagcgccgccggcgccaccgccaccaccagcaccagcagcaccgtgaccgtgaccgcccccgcccccgccgccaccggcagccccgtgaagaagcagagacccctgctgcccaaggagaccgcccccgccgtgcagagagtggtgtggaacagcagcagcaagttccagaccagcagccagaagtggcacatgcagaagatgcagagacagcagcagcagcagcagcagcagaaccagcagcagcagccccagagcagccagggcaccagataccagaccagacaggccgtgaaggccgtgcagcagaaggagatcacccagagccccagcaccagcaccatcaccctggtgaccagcacccagagcagccccctggtgaccagcagcggcagcatgagcaccctggtgagcagcgtgaacgccgacctgcccatcgccaccgccagcgccgacgtggccgccgacatcgccaagtacaccagcaagatgatggacgccatcaagggcaccatgaccgagatctacaacgacctgagcaagaacaccaccggcagcaccatcgccgagatcagaagactgagaatcgagatcgagaagctgcagtggctgcaccagcaggagctgagcgagatgaagcacaacctggagctgaccatggccgagatgagacagagcctggagcaggagagagacagactgatcgccgaggtgaagaagcagctggagctggagaagcagcaggccgtggacgagaccaagaagaagcagtggtgcgccaactgcaagaaggaggccatcttctactgctgctggaacaccagctactgcgactacccctgccagcaggcccactggcccgagcacatgaagagctgcacccagagcgccaccgccccccagcaggaggccgacgccgaggtgaacaccgagaccctgaacaagagcagccagggcagcagcagcagcacccagagcgcccccagcgagaccgccagcgccagcaaggagaaggagaccagcgccgagaagagcaaggagagcggcagcaccctggacctgagcggcagcagagagacccccagcagcatcctgctgggcagcaaccagggcagcgaccacagcagaagcaacaagagcagctggagcagcagcgacgagaagagaggcagcaccagaagcgaccacaacaccagcaccagcaccaagagcctgctgcccaaggagagcagactggacaccttctgggactag

SEQ ID NO: 11199 - DNA, 3483 bp, Artificial Sequence
  Description of Artificial Sequence: Synthetic coding sequence
atgcacccccagagcctggccgaggaggagatcaagaccgagcaggaggtggtggagggcatggacatcagcaccagaagcaaggaccccggcagcgccgagagaaccgcccagaagagaaagttccccagccccccccacagcagcaacggccacagcccccaggacaccagcaccagccccatcaagaagaagaagaagcccggcctgctgaacagcaacaacaaggagcagagcgagctgagacacggccccttctactacatgaagcagcccctgaccaccgaccccgtggacgtggtgccccaggacggcagaaacgacttctactgctgggtgtgccacagagagggccaggtgctgtgctgcgagctgtgccccagagtgtaccacgccaagtgcctgagactgaccagcgagcccgagggcgactggttctgccccgagtgcgagaagatcaccgtggccgagtgcatcgagacccagagcaaggccatgaccatgctgaccatcgagcagctgagctacctgctgaagttcgccatccagaagatgaagcagcccggcaccgacgccttccagaagcccgtgcccctggagcagcaccccgactacgccgagtacatcttccaccccatggacctgtgcaccctggagaagaacgccaagaagaagatgtacggctgcaccgaggccttcctggccgacgccaagtggatcctgcacaactgcatcatctacaacggcggcaaccacaagctgacccagatcgccaaggtggtgatcaagatctgcgagcacgagatgaacgagatcgaggtgtgccccgagtgctacctggccgcctgccagaagagagacaactggttctgcgagccctgcagcaacccccaccccctggtgtgggccaagctgaagggcttccccttctggcccgccaaggccctgagagacaaggacggccaggtggacgccagattcttcggccagcacgacagagcctgggtgcccatcaacaactgctacctgatgagcaaggagatccccttcagcgtgaagaagaccaagagcatcttcaacagcgccatgcaggagatggaggtgtacgtggagaacatcagaagaaagttcggcgtgttcaactacagccccttcagaaccccctacacccccaacagccagtaccagatgctgctggaccccaccaaccccagcgccggcaccgccaagatcgacaagcaggagaaggtgaagctgaacttcgacatgaccgccagccccaagatcctgatgagcaagcccgtgctgagcggcggcaccggcagaagaatcagcctgagcgacatgcccagaagccccatgagcaccaacagcagcgtgcacaccggcagcgacgtggagcaggacgccgagaagaaggccaccagcagccacttcagcgccagcgaggagagcatggacttcctggacaagagcaccgccagccccgccagcaccaagaccggccaggccggcagcctgagcggcagccccaagcccttcagcccccagctgagcgcccccatcaccaccaagaccgacaagaccagcaccaccggcagcatcctgaacctgaacctggacagaagcaaggccgagatggacctgaaggagctgagcgagagcgtgcagcagcagagcacccccgtgcccctgatcagccccaagagacagatcagaagcagattccagctgaacctggacaagaccatcgagagctgcaaggcccagctgggcatcaacgagatcagcgaggacgtgtacaccgccgtggagcacagcgacagcgaggacagcgagaagagcgacagcagcgacagcgagtacatcagcgacgacgagcagaagagcaagaacgagcccgaggacaccgaggacaaggagggctgccagatggacaaggagcccagcgccgtgaagaagaagcccaagcccaccaaccccgtggagatcaaggaggagctgaagagcaccagccccgccagcgagaaggccgaccccggcgccgtgaaggacaaggccagccccgagcccgagaaggacttcagcgagaaggccaagcccagcccccaccccatcaaggacaagctgaagggcaaggacgagaccgacagccccaccgtgcacctgggcctggacagcgacagcgagagcgagctggtgatcgacctgggcgaggaccacagcggcagagagggcagaaagaacaagaaggagcccaaggagcccagccccaagcaggacgtggtgggcaagaccccccccagcaccaccgtgggcagccacagcccccccgagacccccgtgctgaccagaagcagcgcccagaccagcgccgccggcgccaccgccaccaccagcaccagcagcaccgtgaccgtgaccgcccccgcccccgccgccaccggcagccccgtgaagaagcagagacccctgctgcccaaggagaccgcccccgccgtgcagagagtggtgtggaacagcagcaccgtgcagcagaaggagatcacccagagccccagcaccagcaccatcaccctggtgaccagcacccagagcagccccctggtgaccagcagcggcagcatgagcaccctggtgagcagcgtgaacgccgacctgcccatcgccaccgccagcgccgacgtggccgccgacatcgccaagtacaccagcaagatgatggacgccatcaagggcaccatgaccgagatctacaacgacctgagcaagaacaccaccggcagcaccatcgccgagatcagaagactgagaatcgagatcgagaagctgcagtggctgcaccagcaggagctgagcgagatgaagcacaacctggagctgaccatggccgagatgagacagagcctggagcaggagagagacagactgatcgccgaggtgaagaagcagctggagctggagaagcagcaggccgtggacgagaccaagaagaagcagtggtgcgccaactgcaagaaggaggccatcttctactgctgctggaacaccagctactgcgactacccctgccagcaggcccactggcccgagcacatgaagagctgcacccagagcgccaccgccccccagcaggaggccgacgccgaggtgaacaccgagaccctgaacaagagcagccagggcagcagcagcagcacccagagcgcccccagcgagaccgccagcgccagcaaggagaaggagaccagcgccgagaagagcaaggagagcggcagcaccctggacctgagcggcagcagagagacccccagcagcatcctgctgggcagcaaccagggcagcgaccacagcagaagcaacaagagcagctggagcagcagcgacgagaagagaggcagcaccagaagcgaccacaacaccagcaccagcaccaagagcctgctgcccaaggagagcagactggacaccttctgggactag

SEQ ID NO: 11200 - DNA, 3645 bp, Artificial Sequence
  Description of Artificial Sequence: Synthetic coding sequence
atggacatcagcaccagaagcaaggaccccggcagcgccgagagaaccgcccagaagagaaagttccccagccccccccacagcagcaacggccacagcccccaggacaccagcaccagccccatcaagaagaagaagaagcccggcctgctgaacagcaacaacaaggagcagagcgagctgagacacggccccttctactacatgaagcagcccctgaccaccgaccccgtggacgtggtgccccaggacggcagaaacgacttctactgctgggtgtgccacagagagggccaggtgctgtgctgcgagctgtgccccagagtgtaccacgccaagtgcctgagactgaccagcgagcccgagggcgactggttctgccccgagtgcgagaagatcaccgtggccgagtgcatcgagacccagagcaaggccatgaccatgctgaccatcgagcagctgagctacctgctgaagttcgccatccagaagatgaagcagcccggcaccgacgccttccagaagcccgtgcccctggagcagcaccccgactacgccgagtacatcttccaccccatggacctgtgcaccctggagaagaacgccaagaagaagatgtacggctgcaccgaggccttcctggccgacgccaagtggatcctgcacaactgcatcatctacaacggcggcaaccacaagctgacccagatcgccaaggtggtgatcaagatctgcgagcacgagatgaacgagatcgaggtgtgccccgagtgctacctggccgcctgccagaagagagacaactggttctgcgagccctgcagcaacccccaccccctggtgtgggccaagctgaagggcttccccttctggcccgccaaggccctgagagacaaggacggccaggtggacgccagattcttcggccagcacgacagagcctgggtgcccatcaacaactgctacctgatgagcaaggagatccccttcagcgtgaagaagaccaagagcatcttcaacagcgccatgcaggagatggaggtgtacgtggagaacatcagaagaaagttcggcgtgttcaactacagccccttcagaaccccctacacccccaacagccagtaccagatgctgctggaccccaccaaccccagcgccggcaccgccaagatcgacaagcaggagaaggtgaagctgaacttcgacatgaccgccagccccaagatcctgatgagcaagcccgtgctgagcggcggcaccggcagaagaatcagcctgagcgacatgcccagaagccccatgagcaccaacagcagcgtgcacaccggcagcgacgtggagcaggacgccgagaagaaggccaccagcagccacttcagcgccagcgaggagagcatggacttcctggacaagagcaccgccagccccgccagcaccaagaccggccaggccggcagcctgagcggcagccccaagcccttcagcccccagctgagcgcccccatcaccaccaagaccgacaagaccagcaccaccggcagcatcctgaacctgaacctggacagaagcaaggccgagatggacctgaaggagctgagcgagagcgtgcagcagcagagcacccccgtgcccctgatcagccccaagagacagatcagaagcagattccagctgaacctggacaagaccatcgagagctgcaaggcccagctgggcatcaacgagatcagcgaggacgtgtacaccgccgtggagcacagcgacagcgaggacagcgagaagagcgacagcagcgacagcgagtacatcagcgacgacgagcagaagagcaagaacgagcccgaggacaccgaggacaaggagggctgccagatggacaaggagcccagcgccgtgaagaagaagcccaagcccaccaaccccgtggagatcaaggaggagctgaagagcaccagccccgccagcgagaaggccgaccccggcgccgtgaaggacaaggccagccccgagcccgagaaggacttcagcgagaaggccaagcccagcccccaccccatcaaggacaagctgaagggcaaggacgagaccgacagccccaccgtgcacctgggcctggacagcgacagcgagagcgagctggtgatcgacctgggcgaggaccacagcggcagagagggcagaaagaacaagaaggagcccaaggagcccagccccaagcaggacgtggtgggcaagaccccccccagcaccaccgtgggcagccacagcccccccgagacccccgtgctgaccagaagcagcgcccagaccagcgccgccggcgccaccgccaccaccagcaccagcagcaccgtgaccgtgaccgcccccgcccccgccgccaccggcagccccgtgaagaagcagagacccctgctgcccaaggagaccgcccccgccgtgcagagagtggtgtggaacagcagcagcaagttccagaccagcagccagaagtggcacatgcagaagatgcagagacagcagcagcagcagcagcagcagaaccagcagcagcagccccagagcagccagggcaccagataccagaccagacaggccgtgaaggccgtgcagcagaaggagatcacccagagccccagcaccagcaccatcaccctggtgaccagcacccagagcagccccctggtgaccagcagcggcagcatgagcaccctggtgagcagcgtgaacgccgacctgcccatcgccaccgccagcgccgacgtggccgccgacatcgccaagtacaccagcaagatgatggacgccatcaagggcaccatgaccgagatctacaacgacctgagcaagaacaccaccggcagcaccatcgccgagatcagaagactgagaatcgagatcgagaagctgcagtggctgcaccagcaggagctgagcgagatgaagcacaacctggagctgaccatggccgagatgagacagagcctggagcaggagagagacagactgatcgccgaggtgaagaagcagctggagctggagaagcagcaggccgtggacgagaccaagaagaagcagtggtgcgccaactgcaagaaggaggccatcttctactgctgctggaacaccagctactgcgactacccctgccagcaggcccactggcccgagcacatgaagagctgcacccagagcgccaccgccccccagcaggaggccgacgccgaggtgaacaccgagaccctgaacaagagcagccagggcagcagcagcagcacccagagcgcccccagcgagaccgccagcgccagcaaggagaaggagaccagcgccgagaagagcaaggagagcggcagcaccctggacctgagcggcagcagagagacccccagcagcatcctgctgggcagcaaccagggcagcgtgagcaagagatgcgacaagcagcccgcctacgcccccaccaccaccgaccaccagccccaccccaactaccccgcccagaagtaccacagcagaagcaacaagagcagctggagcagcagcgacgagaagagaggcagcaccagaagcgaccacaacaccagcaccagcaccaagagcctgctgcccaaggagagcagactggacaccttctgggactag

SEQ ID NO: 11201 - DNA, 3408 bp, Artificial Sequence
  Description of Artificial Sequence: Synthetic coding sequence
atgcacccccagagcctggccgaggaggagatcaagaccgagcaggaggtggtggagggcatggacatcagcaccagaagcaaggaccccggcagcgccgagagaaccgcccagaagagaaagttccccagccccccccacagcagcaacggccacagcccccaggacaccagcaccagccccatcaagaagaagaagaagcccggcctgctgaacagcaacaacaaggagcaggacggcagaaacgacttctactgctgggtgtgccacagagagggccaggtgctgtgctgcgagctgtgccccagagtgtaccacgccaagtgcctgagactgaccagcgagcccgagggcgactggttctgccccgagtgcgagaagatcaccgtggccgagtgcatcgagacccagagcaaggccatgaccatgctgaccatcgagcagctgagctacctgctgaagttcgccatccagaagatgaagcagcccggcaccgacgccttccagaagcccgtgcccctggagcagcaccccgactacgccgagtacatcttccaccccatggacctgtgcaccctggagaagaacgccaagaagaagatgtacggctgcaccgaggccttcctggccgacgccaagtggatcctgcacaactgcatcatctacaacggcggcaaccacaagctgacccagatcgccaaggtggtgatcaagatctgcgagcacgagatgaacgagatcgaggtgtgccccgagtgctacctggccgcctgccagaagagagacaactggttctgcgagccctgcagcaacccccaccccctggtgtgggccaagctgaagggcttccccttctggcccgccaaggccctgagagacaaggacggccaggtggacgccagattcttcggccagcacgacagagcctgggtgcccatcaacaactgctacctgatgagcaaggagatccccttcagcgtgaagaagaccaagagcatcttcaacagcgccatgcaggagatggaggtgtacgtggagaacatcagaagaaagttcggcgtgttcaactacagccccttcagaaccccctacacccccaacagccagtaccagatgctgctggaccccaccaaccccagcgccggcaccgccaagatcgacaagcaggagaaggtgaagctgaacttcgacatgaccgccagccccaagatcctgatgagcaagcccgtgctgagcggcggcaccggcagaagaatcagcctgagcgacatgcccagaagccccatgagcaccaacagcagcgtgcacaccggcagcgacgtggagcaggacgccgagaagaaggccaccagcagccacttcagcgccagcgaggagagcatggacttcctggacaagagcaccgccagccccgccagcaccaagaccggccaggccggcagcctgagcggcagccccaagcccttcagcccccagctgagcgcccccatcaccaccaagaccgacaagaccagcaccaccggcagcatcctgaacctgaacctggacagaagcaaggccgagatggacctgaaggagctgagcgagagcgtgcagcagcagagcacccccgtgcccctgatcagccccaagagacagatcagaagcagattccagctgaacctggacaagaccatcgagagctgcaaggcccagctgggcatcaacgagatcagcgaggacgtgtacaccgccgtggagcacagcgacagcgaggacagcgagaagagcgacagcagcgacagcgagtacatcagcgacgacgagcagaagagcaagaacgagcccgaggacaccgaggacaaggagggctgccagatggacaaggagcccagcgccgtgaagaagaagcccaagcccaccaaccccgtggagatcaaggaggagctgaagagcaccagccccgccagcgagaaggccgaccccggcgccgtgaaggacaaggccagccccgagcccgagaaggacttcagcgagaaggccaagcccagcccccaccccatcaaggacaagctgaagggcaaggacgagaccgacagccccaccgtgcacctgggcctggacagcgacagcgagagcgagctggtgatcgacctgggcgaggaccacagcggcagagagggcagaaagaacaagaaggagcccaaggagcccagccccaagcaggacgtggtgggcaagaccccccccagcaccaccgtgggcagccacagcccccccgagacccccgtgctgaccagaagcagcgcccagaccagcgccgccggcgccaccgccaccaccagcaccagcagcaccgtgaccgtgaccgcccccgcccccgccgccaccggcagccccgtgaagaagcagagacccctgctgcccaaggagaccgcccccgccgtgcagagagtggtgtggaacagcagcaccgtgcagcagaaggagatcacccagagccccagcaccagcaccatcaccctggtgaccagcacccagagcagccccctggtgaccagcagcggcagcatgagcaccctggtgagcagcgtgaacgccgacctgcccatcgccaccgccagcgccgacgtggccgccgacatcgccaagtacaccagcaagatgatggacgccatcaagggcaccatgaccgagatctacaacgacctgagcaagaacaccaccggcagcaccatcgccgagatcagaagactgagaatcgagatcgagaagctgcagtggctgcaccagcaggagctgagcgagatgaagcacaacctggagctgaccatggccgagatgagacagagcctggagcaggagagagacagactgatcgccgaggtgaagaagcagctggagctggagaagcagcaggccgtggacgagaccaagaagaagcagtggtgcgccaactgcaagaaggaggccatcttctactgctgctggaacaccagctactgcgactacccctgccagcaggcccactggcccgagcacatgaagagctgcacccagagcgccaccgccccccagcaggaggccgacgccgaggtgaacaccgagaccctgaacaagagcagccagggcagcagcagcagcacccagagcgcccccagcgagaccgccagcgccagcaaggagaaggagaccagcgccgagaagagcaaggagagcggcagcaccctggacctgagcggcagcagagagacccccagcagcatcctgctgggcagcaaccagggcagcgaccacagcagaagcaacaagagcagctggagcagcagcgacgagaagagaggcagcaccagaagcgaccacaacaccagcaccagcaccaagagcctgctgcccaaggagagcagactggacaccttctgggactag

SEQ ID NO: 11202 - DNA, 3411 bp, Artificial Sequence
  Description of Artificial Sequence: Synthetic coding sequence
atgcacccccagagcctggccgaggaggagatcaagaccgagcaggaggtggtggagggcatggacatcagcaccagaagcaaggaccccggcagcgccgagagaaccgcccagaagagaaagttccccagccccccccacagcagcaacggccacagcccccaggacaccagcaccagccccatcaagaagaagaagaagcccggcctgctgaacagcaacaacaaggagcaggacggcagaaacgacttctactgctgggtgtgccacagagagggccaggtgctgtgctgcgagctgtgccccagagtgtaccacgccaagtgcctgagactgaccagcgagcccgagggcgactggttctgccccgagtgcgagaagatcaccgtggccgagtgcatcgagacccagagcaaggccatgaccatgctgaccatcgagcagctgagctacctgctgaagttcgccatccagaagatgaagcagcccggcaccgacgccttccagaagcccgtgcccctggagcagcaccccgactacgccgagtacatcttccaccccatggacctgtgcaccctggagaagaacgccaagaagaagatgtacggctgcaccgaggccttcctggccgacgccaagtggatcctgcacaactgcatcatctacaacggcggcaaccacaagctgacccagatcgccaaggtggtgatcaagatctgcgagcacgagatgaacgagatcgaggtgtgccccgagtgctacctggccgcctgccagaagagagacaactggttctgcgagccctgcagcaacccccaccccctggtgtgggccaagctgaagggcttccccttctggcccgccaaggccctgagagacaaggacggccaggtggacgccagattcttcggccagcacgacagagcctgggtgcccatcaacaactgctacctgatgagcaaggagatccccttcagcgtgaagaagaccaagagcatcttcaacagcgccatgcaggagatggaggtgtacgtggagaacatcagaagaaagttcggcgtgttcaactacagccccttcagaaccccctacacccccaacagccagtaccagatgctgctggaccccaccaaccccagcgccggcaccgccaagatcgacaagcaggagaaggtgaagctgaacttcgacatgaccgccagccccaagatcctgatgagcaagcccgtgctgagcggcggcaccggcagaagaatcagcctgagcgacatgcccagaagccccatgagcaccaacagcagcgtgcacaccggcagcgacgtggagcaggacgccgagaagaaggccaccagcagccacttcagcgccagcgaggagagcatggacttcctggacaagagcaccgccagccccgccagcaccaagaccggccaggccggcagcctgagcggcagccccaagcccttcagcccccagctgagcgcccccatcaccaccaagaccgacaagaccagcaccaccggcagcatcctgaacctgaacctggacagaagcaaggccgagatggacctgaaggagctgagcgagagcgtgcagcagcagagcacccccgtgcccctgatcagccccaagagacagatcagaagcagattccagctgaacctggacaagaccatcgagagctgcaaggcccagctgggcatcaacgagatcagcgaggacgtgtacaccgccgtggagcacagcgacagcgaggacagcgagaagagcgacagcagcgacagcgagtacatcagcgacgacgagcagaagagcaagaacgagcccgaggacaccgaggacaaggagggctgccagatggacaaggagcccagcgccgtgaagaagaagcccaagcccaccaaccccgtggagatcaaggaggagctgaagagcaccagccccgccagcgagaaggccgaccccggcgccgtgaaggacaaggccagccccgagcccgagaaggacttcagcgagaaggccaagcccagcccccaccccatcaaggacaagctgaagggcaaggacgagaccgacagccccaccgtgcacctgggcctggacagcgacagcgagagcgagctggtgatcgacctgggcgaggaccacagcggcagagagggcagaaagaacaagaaggagcccaaggagcccagccccaagcaggacgtggtgggcaagaccccccccagcaccaccgtgggcagccacagcccccccgagacccccgtgctgaccagaagcagcgcccagaccagcgccgccggcgccaccgccaccaccagcaccagcagcaccgtgaccgtgaccgcccccgcccccgccgccaccggcagccccgtgaagaagcagagacccctgctgcccaaggagaccgcccccgccgtgcagagagtggtgtggaacagcagcaccgtgcagcagaaggagatcacccagagccccagcaccagcaccatcaccctggtgaccagcacccagagcagccccctggtgaccagcagcggcagcatgagcaccctggtgagcagcgtgaacgccgacctgcccatcgccaccgccagcgccgacgtggccgccgacatcgccaagtacaccagcaagatcagaagactgagaatcgagatcgagaagctgcagtggctgcaccagcaggagctgagcgagatgaagcacaacctggagctgaccatggccgagatgagacagagcctggagcaggagagagacagactgatcgccgaggtgaagaagcagctggagctggagaagcagcaggccgtggacgagaccaagaagaagcagtggtgcgccaactgcaagaaggaggccatcttctactgctgctggaacaccagctactgcgactacccctgccagcaggcccactggcccgagcacatgaagagctgcacccagagcgccaccgccccccagcaggaggccgacgccgaggtgaacaccgagaccctgaacaagagcagccagggcagcagcagcagcacccagagcgcccccagcgagaccgccagcgccagcaaggagaaggagaccagcgccgagaagagcaaggagagcggcagcaccctggacctgagcggcagcagagagacccccagcagcatcctgctgggcagcaaccagggcagcgtgagcaagagatgcgacaagcagcccgcctacgcccccaccaccaccgaccaccagccccaccccaactaccccgcccagaagtaccacagcagaagcaacaagagcagctggagcagcagcgacgagaagagaggcagcaccagaagcgaccacaacaccagcaccagcaccaagagcctgctgcccaaggagagcagactggacaccttctgggactag

SEQ ID NO: 11203 - DNA, 3561 bp, Artificial Sequence
  Description of Artificial Sequence: Synthetic coding sequence
atgttcagcagcctgcagaagagcttcaacctggccgaggaggagatcaagaccgagcaggaggtggtggagggcatggacatcagcaccagaagcaaggaccccggcagcgccgagagaaccgcccagaagagaaagttccccagccccccccacagcagcaacggccacagcccccaggacaccagcaccagccccatcaagaagaagaagaagcccggcctgctgaacagcaacaacaaggagcaggacggcagaaacgacttctactgctgggtgtgccacagagagggccaggtgctgtgctgcgagctgtgccccagagtgtaccacgccaagtgcctgagactgaccagcgagcccgagggcgactggttctgccccgagtgcgagaagatcaccgtggccgagtgcatcgagacccagagcaaggccatgaccatgctgaccatcgagcagctgagctacctgctgaagttcgccatccagaagatgaagcagcccggcaccgacgccttccagaagcccgtgcccctggagcagcaccccgactacgccgagtacatcttccaccccatggacctgtgcaccctggagaagaacgccaagaagaagatgtacggctgcaccgaggccttcctggccgacgccaagtggatcctgcacaactgcatcatctacaacggcggcaaccacaagctgacccagatcgccaaggtggtgatcaagatctgcgagcacgagatgaacgagatcgaggtgtgccccgagtgctacctggccgcctgccagaagagagacaactggttctgcgagccctgcagcaacccccaccccctggtgtgggccaagctgaagggcttccccttctggcccgccaaggccctgagagacaaggacggccaggtggacgccagattcttcggccagcacgacagagcctgggtgcccatcaacaactgctacctgatgagcaaggagatccccttcagcgtgaagaagaccaagagcatcttcaacagcgccatgcaggagatggaggtgtacgtggagaacatcagaagaaagttcggcgtgttcaactacagccccttcagaaccccctacacccccaacagccagtaccagatgctgctggaccccaccaaccccagcgccggcaccgccaagatcgacaagcaggagaaggtgaagctgaacttcgacatgaccgccagccccaagatcctgatgagcaagcccgtgctgagcggcggcaccggcagaagaatcagcctgagcgacatgcccagaagccccatgagcaccaacagcagcgtgcacaccggcagcgacgtggagcaggacgccgagaagaaggccaccagcagccacttcagcgccagcgaggagagcatggacttcctggacaagagcaccgccagccccgccagcaccaagaccggccaggccggcagcctgagcggcagccccaagcccttcagcccccagctgagcgcccccatcaccaccaagaccgacaagaccagcaccaccggcagcatcctgaacctgaacctggacagaagcaaggccgagatggacctgaaggagctgagcgagagcgtgcagcagcagagcacccccgtgcccctgatcagccccaagagacagatcagaagcagattccagctgaacctggacaagaccatcgagagctgcaaggcccagctgggcatcaacgagatcagcgaggacgtgtacaccgccgtggagcacagcgacagcgaggacagcgagaagagcgacagcagcgacagcgagtacatcagcgacgacgagcagaagagcaagaacgagcccgaggacaccgaggacaaggagggctgccagatggacaaggagcccagcgccgtgaagaagaagcccaagcccaccaaccccgtggagatcaaggaggagctgaagagcaccagccccgccagcgagaaggccgaccccggcgccgtgaaggacaaggccagccccgagcccgagaaggacttcagcgagaaggccaagcccagcccccaccccatcaaggacaagctgaagggcaaggacgagaccgacagccccaccgtgcacctgggcctggacagcgacagcgagagcgagctggtgatcgacctgggcgaggaccacagcggcagagagggcagaaagaacaagaaggagcccaaggagcccagccccaagcaggacgtggtgggcaagaccccccccagcaccaccgtgggcagccacagcccccccgagacccccgtgctgaccagaagcagcgcccagaccagcgccgccggcgccaccgccaccaccagcaccagcagcaccgtgaccgtgaccgcccccgcccccgccgccaccggcagccccgtgaagaagcagagacccctgctgcccaaggagaccgcccccgccgtgcagagagtggtgtggaacagcagcagcaagttccagaccagcagccagaagtggcacatgcagaagatgcagagacagcagcagcagcagcagcagcagaaccagcagcagcagccccagagcagccagggcaccagataccagaccagacaggccgtgaaggccgtgcagcagaaggagatcacccagagccccagcaccagcaccatcaccctggtgaccagcacccagagcagccccctggtgaccagcagcggcagcatgagcaccctggtgagcagcgtgaacgccgacctgcccatcgccaccgccagcgccgacgtggccgccgacatcgccaagtacaccagcaagatgatggacgccatcaagggcaccatgaccgagatctacaacgacctgagcaagaacaccaccggcagcaccatcgccgagatcagaagactgagaatcgagatcgagaagctgcagtggctgcaccagcaggagctgagcgagatgaagcacaacctggagctgaccatggccgagatgagacagagcctggagcaggagagagacagactgatcgccgaggtgaagaagcagctggagctggagaagcagcaggccgtggacgagaccaagaagaagcagtggtgcgccaactgcaagaaggaggccatcttctactgctgctggaacaccagctactgcgactacccctgccagcaggcccactggcccgagcacatgaagagctgcacccagagcgccaccgccccccagcaggaggccgacgccgaggtgaacaccgagaccctgaacaagagcagccagggcagcagcagcagcacccagagcgcccccagcgagaccgccagcgccagcaaggagaaggagaccagcgccgagaagagcaaggagagcggcagcaccctggacctgagcggcagcagagagacccccagcagcatcctgctgggcagcaaccagggcagcgaccacagcagaagcaacaagagcagctggagcagcagcgacgagaagagaggcagcaccagaagcgaccacaacaccagcaccagcaccaagagcctgctgcccaaggagagcagactggacaccttctgggactag

SEQ ID NO: 11204 - DNA, 75 bp, Artificial Sequence
  Description of Artificial Sequence: Synthetic coding sequence
atggacatcagcaccagaagcaaggaccccggcagcgccgagagaaccgcccagaagagaaagttccccagctag

SEQ ID NO: 11205 - DNA, 129 bp, Artificial Sequence
  Description of Artificial Sequence: Synthetic coding sequence
atggacatcagcaccagaagcaaggaccccggcagcgccgagagaaccgcccagaagagaaagttccccagccccccccacagcagcaacggccacagcccccaggacaccagcaccagccccatctag

SEQ ID NO: 11206 - DNA, 3318 bp, Artificial Sequence
  Description of Artificial Sequence: Synthetic coding sequence
atggacatcagcaccagaagcaaggaccccggcagcgccgagagaaccgcccagaagagaaagttccccagccccccccacagcagcaacggccacagcccccaggacaccagcaccagccccatcaagaagaagaagaagcccggcctgctgaacagcaacaacaaggagcaggacggcagaaacgacttctactgctgggtgtgccacagagagggccaggtgctgtgctgcgagctgtgccccagagtgtaccacgccaagtgcctgagactgaccagcgagcccgagggcgactggttctgccccgagtgcgagaccgacgccttccagaagcccgtgcccctggagcagcaccccgactacgccgagtacatcttccaccccatggacctgtgcaccctggagaagaacgccaagaagaagatgtacggctgcaccgaggccttcctggccgacgccaagtggatcctgcacaactgcatcatctacaacggcggcaaccacaagctgacccagatcgccaaggtggtgatcaagatctgcgagcacgagatgaacgagatcgaggtgtgccccgagtgctacctggccgcctgccagaagagagacaactggttctgcgagccctgcagcaacccccaccccctggtgtgggccaagctgaagggcttccccttctggcccgccaaggccctgagagacaaggacggccaggtggacgccagattcttcggccagcacgacagagcctgggtgcccatcaacaactgctacctgatgagcaaggagatccccttcagcgtgaagaagaccaagagcatcttcaacagcgccatgcaggagatggaggtgtacgtggagaacatcagaagaaagttcggcgtgttcaactacagccccttcagaaccccctacacccccaacagccagtaccagatgctgctggaccccaccaaccccagcgccggcaccgccaagatcgacaagcaggagaaggtgaagctgaacttcgacatgaccgccagccccaagatcctgatgagcaagcccgtgctgagcggcggcaccggcagaagaatcagcctgagcgacatgcccagaagccccatgagcaccaacagcagcgtgcacaccggcagcgacgtggagcaggacgccgagaagaaggccaccagcagccacttcagcgccagcgaggagagcatggacttcctggacaagagcaccgccagccccgccagcaccaagaccggccaggccggcagcctgagcggcagccccaagcccttcagcccccagctgagcgcccccatcaccaccaagaccgacaagaccagcaccaccggcagcatcctgaacctgaacctggacagaagcaaggccgagatggacctgaaggagctgagcgagagcgtgcagcagcagagcacccccgtgcccctgatcagccccaagagacagatcagaagcagattccagctgaacctggacaagaccatcgagagctgcaaggcccagctgggcatcaacgagatcagcgaggacgtgtacaccgccgtggagcacagcgacagcgaggacagcgagaagagcgacagcagcgacagcgagtacatcagcgacgacgagcagaagagcaagaacgagcccgaggacaccgaggacaaggagggctgccagatggacaaggagcccagcgccgtgaagaagaagcccaagcccaccaaccccgtggagatcaaggaggagctgaagagcaccagccccgccagcgagaaggccgaccccggcgccgtgaaggacaaggccagccccgagcccgagaaggacttcagcgagaaggccaagcccagcccccaccccatcaaggacaagctgaagggcaaggacgagaccgacagccccaccgtgcacctgggcctggacagcgacagcgagagcgagctggtgatcgacctgggcgaggaccacagcggcagagagggcagaaagaacaagaaggagcccaaggagcccagccccaagcaggacgtggtgggcaagaccccccccagcaccaccgtgggcagccacagcccccccgagacccccgtgctgaccagaagcagcgcccagaccagcgccgccggcgccaccgccaccaccagcaccagcagcaccgtgaccgtgaccgcccccgcccccgccgccaccggcagccccgtgaagaagcagagacccctgctgcccaaggagaccgcccccgccgtgcagagagtggtgtggaacagcagcaccgtgcagcagaaggagatcacccagagccccagcaccagcaccatcaccctggtgaccagcacccagagcagccccctggtgaccagcagcggcagcatgagcaccctggtgagcagcgtgaacgccgacctgcccatcgccaccgccagcgccgacgtggccgccgacatcgccaagtacaccagcaagatgatggacgccatcaagggcaccatgaccgagatctacaacgacctgagcaagaacaccaccggcagcaccatcgccgagatcagaagactgagaatcgagatcgagaagctgcagtggctgcaccagcaggagctgagcgagatgaagcacaacctggagctgaccatggccgagatgagacagagcctggagcaggagagagacagactgatcgccgaggtgaagaagcagctggagctggagaagcagcaggccgtggacgagaccaagaagaagcagtggtgcgccaactgcaagaaggaggccatcttctactgctgctggaacaccagctactgcgactacccctgccagcaggcccactggcccgagcacatgaagagctgcacccagagcgccaccgccccccagcaggaggccgacgccgaggtgaacaccgagaccctgaacaagagcagccagggcagcagcagcagcacccagagcgcccccagcgagaccgccagcgccagcaaggagaaggagaccagcgccgagaagagcaaggagagcggcagcaccctggacctgagcggcagcagagagacccccagcagcatcctgctgggcagcaaccagggcagcgtgagcaagagatgcgacaagcagcccgcctacgcccccaccaccaccgaccaccagccccaccccaactaccccgcccagaagtaccacagcagaagcaacaagagcagctggagcagcagcgacgagaagagaggcagcaccagaagcgaccacaacaccagcaccagcaccaagagcctgctgcccaaggagagcagactggacaccttctgggactag

SEQ ID NO: 11207 - DNA, 3567 bp, Artificial Sequence
  Description of Artificial Sequence: Synthetic coding sequence
atgcacccccagagcctggccgaggaggagatcaagaccgagcaggaggtggtggagggcatggacatcagcaccagaagcaaggaccccggcagcgccgagagaaccgcccagaagagaaagttccccagccccccccacagcagcaacggccacagcccccaggacaccagcaccagccccatcaagaagaagaagaagcccggcctgctgaacagcaacaacaaggagcagagcgagctgagacacggccccttctactacatgaagcagcccctgaccaccgaccccgtggacgtggtgccccaggacggcagaaacgacttctactgctgggtgtgccacagagagggccaggtgctgtgctgcgagctgtgccccagagtgtaccacgccaagtgcctgagactgaccagcgagcccgagggcgactggttctgccccgagtgcgagaagatcaccgtggccgagtgcatcgagacccagagcaaggccatgaccatgctgaccatcgagcagctgagctacctgctgaagttcgccatccagaagatgaagcagcccggcaccgacgccttccagaagcccgtgcccctggagcagcaccccgactacgccgagtacatcttccaccccatggacctgtgcaccctggagaagaacgccaagaagaagatgtacggctgcaccgaggccttcctggccgacgccaagtggatcctgcacaactgcatcatctacaacggcggcaaccacaagctgacccagatcgccaaggtggtgatcaagatctgcgagcacgagatgaacgagatcgaggtgtgccccgagtgctacctggccgcctgccagaagagagacaactggttctgcgagccctgcagcaacccccaccccctggtgtgggccaagctgaagggcttccccttctggcccgccaaggccctgagagacaaggacggccaggtggacgccagattcttcggccagcacgacagagcctgggtgcccatcaacaactgctacctgatgagcaaggagatccccttcagcgtgaagaagaccaagagcatcttcaacagcgccatgcaggagatggaggtgtacgtggagaacatcagaagaaagttcggcgtgttcaactacagccccttcagaaccccctacacccccaacagccagtaccagatgctgctggaccccaccaaccccagcgccggcaccgccaagatcgacaagcaggagaaggtgaagctgaacttcgacatgaccgccagccccaagatcctgatgagcaagcccgtgctgagcggcggcaccggcagaagaatcagcctgagcgacatgcccagaagccccatgagcaccaacagcagcgtgcacaccggcagcgacgtggagcaggacgccgagaagaaggccaccagcagccacttcagcgccagcgaggagagcatggacttcctggacaagagcaccgccagccccgccagcaccaagaccggccaggccggcagcctgagcggcagccccaagcccttcagcccccagctgagcgcccccatcaccaccaagaccgacaagaccagcaccaccggcagcatcctgaacctgaacctggacagaagcaaggccgagatggacctgaaggagctgagcgagagcgtgcagcagcagagcacccccgtgcccctgatcagccccaagagacagatcagaagcagattccagctgaacctggacaagaccatcgagagctgcaaggcccagctgggcatcaacgagatcagcgaggacgtgtacaccgccgtggagcacagcgacagcgaggacagcgagaagagcgacagcagcgacagcgagtacatcagcgacgacgagcagaagagcaagaacgagcccgaggacaccgaggacaaggagggctgccagatggacaaggagcccagcgccgtgaagaagaagcccaagcccaccaaccccgtggagatcaaggaggagctgaagagcaccagccccgccagcgagaaggccgaccccggcgccgtgaaggacaaggccagccccgagcccgagaaggacttcagcgagaaggccaagcccagcccccaccccatcaaggacaagctgaagggcaaggacgagaccgacagccccaccgtgcacctgggcctggacagcgacagcgagagcgagctggtgatcgacctgggcgaggaccacagcggcagagagggcagaaagaacaagaaggagcccaaggagcccagccccaagcaggacgtggtgggcaagaccccccccagcaccaccgtgggcagccacagcccccccgagacccccgtgctgaccagaagcagcgcccagaccagcgccgccggcgccaccgccaccaccagcaccagcagcaccgtgaccgtgaccgcccccgcccccgccgccaccggcagccccgtgaagaagcagagacccctgctgcccaaggagaccgcccccgccgtgcagagagtggtgtggaacagcagcaccgtgcagcagaaggagatcacccagagccccagcaccagcaccatcaccctggtgaccagcacccagagcagccccctggtgaccagcagcggcagcatgagcaccctggtgagcagcgtgaacgccgacctgcccatcgccaccgccagcgccgacgtggccgccgacatcgccaagtacaccagcaagatgatggacgccatcaagggcaccatgaccgagatctacaacgacctgagcaagaacaccaccggcagcaccatcgccgagatcagaagactgagaatcgagatcgagaagctgcagtggctgcaccagcaggagctgagcgagatgaagcacaacctggagctgaccatggccgagatgagacagagcctggagcaggagagagacagactgatcgccgaggtgaagaagcagctggagctggagaagcagcaggccgtggacgagaccaagaagaagcagtggtgcgccaactgcaagaaggaggccatcttctactgctgctggaacaccagctactgcgactacccctgccagcaggcccactggcccgagcacatgaagagctgcacccagagcgccaccgccccccagcaggaggccgacgccgaggtgaacaccgagaccctgaacaagagcagccagggcagcagcagcagcacccagagcgcccccagcgagaccgccagcgccagcaaggagaaggagaccagcgccgagaagagcaaggagagcggcagcaccctggacctgagcggcagcagagagacccccagcagcatcctgctgggcagcaaccagggcagcgtgagcaagagatgcgacaagcagcccgcctacgcccccaccaccaccgaccaccagccccaccccaactaccccgcccagaagtaccacagcagaagcaacaagagcagctggagcagcagcgacgagaagagaggcagcaccagaagcgaccacaacaccagcaccagcaccaagagcctgctgcccaaggagagcagactggacaccttctgggactag

SEQ ID NO: 11208 - DNA, 3291 bp, Artificial Sequence
  Description of Artificial Sequence: Synthetic coding sequence
tgaaccgaccccgtggacgtggtgccccaggacggcagaaacgacttctactgctgggtgtgccacagagagggccaggtgctgtgctgcgagctgtgccccagagtgtaccacgccaagtgcctgagactgaccagcgagcccgagggcgactggttctgccccgagtgcgagaagatcaccgtggccgagtgcatcgagacccagagcaaggccatgaccatgctgaccatcgagcagctgagctacctgctgaagttcgccatccagaagatgaagcagcccggcaccgacgccttccagaagcccgtgcccctggagcagcaccccgactacgccgagtacatcttccaccccatggacctgtgcaccctggagaagaacgccaagaagaagatgtacggctgcaccgaggccttcctggccgacgccaagtggatcctgcacaactgcatcatctacaacggcggcaaccacaagctgacccagatcgccaaggtggtgatcaagatctgcgagcacgagatgaacgagatcgaggtgtgccccgagtgctacctggccgcctgccagaagagagacaactggttctgcgagccctgcagcaacccccaccccctggtgtgggccaagctgaagggcttccccttctggcccgccaaggccctgagagacaaggacggccaggtggacgccagattcttcggccagcacgacagagcctgggtgcccatcaacaactgctacctgatgagcaaggagatccccttcagcgtgaagaagaccaagagcatcttcaacagcgccatgcaggagatggaggtgtacgtggagaacatcagaagaaagttcggcgtgttcaactacagccccttcagaaccccctacacccccaacagccagtaccagatgctgctggaccccaccaaccccagcgccggcaccgccaagatcgacaagcaggagaaggtgaagctgaacttcgacatgaccgccagccccaagatcctgatgagcaagcccgtgctgagcggcggcaccggcagaagaatcagcctgagcgacatgcccagaagccccatgagcaccaacagcagcgtgcacaccggcagcgacgtggagcaggacgccgagaagaaggccaccagcagccacttcagcgccagcgaggagagcatggacttcctggacaagagcaccgccagccccgccagcaccaagaccggccaggccggcagcctgagcggcagccccaagcccttcagcccccagctgagcgcccccatcaccaccaagaccgacaagaccagcaccaccggcagcatcctgaacctgaacctgggccacagaagcaaggccgagatggacctgaaggagctgagcgagagcgtgcagcagcagagcacccccgtgcccctgatcagccccaagagacagatcagaagcagattccagctgaacctggacaagaccatcgagagctgcaaggcccagctgggcatcaacgagatcagcgaggacgtgtacaccgccgtggagcacagcgacagcgaggacagcgagaagagcgacagcagcgacagcgagtacatcagcgacgacgagcagaagagcaagaacgagcccgaggacaccgaggacaaggagggctgccagatggacaaggagcccagcgccgtgaagaagaagcccaagcccaccaaccccgtggagatcaaggaggagctgaagagcaccagccccgccagcgagaaggccgaccccggcgccgtgaaggacaaggccagccccgagcccgagaaggacttcagcgagaaggccaagcccagcccccaccccatcaaggacaagctgaagggcaaggacgagaccgacagccccaccgtgcacctgggcctggacagcgacagcgagagcgagctggtgatcgacctgggcgaggaccacagcggcagagagggcagaaagaacaagaaggagcccaaggagcccagccccaagcaggacgtggtgggcaagaccccccccagcaccaccgtgggcagccacagcccccccgagacccccgtgctgaccagaagcagcgcccagaccagcgccgccggcgccaccgccaccaccagcaccagcagcaccgtgaccgtgaccgcccccgcccccgccgccaccggcagccccgtgaagaagcagagacccctgctgcccaaggagaccgcccccgccgtgcagagagtggtgtggaacagcagcaccgtgcagcagaaggagatcacccagagccccagcaccagcaccatcaccctggtgaccagcacccagagcagccccctggtgaccagcagcggcagcatgagcaccctggtgagcagcgtgaacgccgacctgcccatcgccaccgccagcgccgacgtggccgccgacatcgccaagtacaccagcaagatgatggacgccatcaagggcaccatgaccgagatctacaacgacctgagcaagaacaccaccggcagcaccatcgccgagatcagaagactgagaatcgagatcgagaagctgcagtggctgcaccagcaggagctgagcgagatgaagcacaacctggagctgaccatggccgagatgagacagagcctggagcaggagagagacagactgatcgccgaggtgaagaagcagctggagctggagaagcagcaggccgtggacgagaccaagaagaagcagtggtgcgccaactgcaagaaggaggccatcttctactgctgctggaacaccagctactgcgactacccctgccagcaggcccactggcccgagcacatgaagagctgcacccagagcgccaccgccccccagcaggaggccgacgccgaggtgaacaccgagaccctgaacaagagcagccagggcagcagcagcagcacccagagcgcccccagcgagaccgccagcgccagcaaggagaaggagaccagcgccgagaagagcaaggagagcggcagcaccctggacctgagcggcagcagagagacccccagcagcatcctgctgggcagcaaccagggcagcgtgagcaagagatgcgacaagcagcccgcctacgcccccaccaccaccgaccaccagccccaccccaactaccccgcccagaagtaccacagcagaagcaacaagagcagctggagcagcagcgacgagaagagaggcagcaccagaagcgaccacaacaccagcaccagcaccaagagcctgctgcccaaggagagcagactggacaccttctgggactag

SEQ ID NO: 11209 - DNA, 3726 bp, Artificial Sequence
  Description of Artificial Sequence: Synthetic coding sequence
atggtgttcctggaggagttcgaggccagaagctgcctggccgaggaggagatcaagaccgagcaggaggtggtggagggcatggacatcagcaccagaagcaaggaccccggcagcgccgagagaaccgcccagaagagaaagttccccagccccccccacagcagcaacggccacagcccccaggacaccagcaccagccccatcaagaagaagaagaagcccggcctgctgaacagcaacaacaaggagcagagcgagctgagacacggccccttctactacatgaagcagcccctgaccaccgaccccgtggacgtggtgccccaggacggcagaaacgacttctactgctgggtgtgccacagagagggccaggtgctgtgctgcgagctgtgccccagagtgtaccacgccaagtgcctgagactgaccagcgagcccgagggcgactggttctgccccgagtgcgagaagatcaccgtggccgagtgcatcgagacccagagcaaggccatgaccatgctgaccatcgagcagctgagctacctgctgaagttcgccatccagaagatgaagcagcccggcaccgacgccttccagaagcccgtgcccctggagcagcaccccgactacgccgagtacatcttccaccccatggacctgtgcaccctggagaagaacgccaagaagaagatgtacggctgcaccgaggccttcctggccgacgccaagtggatcctgcacaactgcatcatctacaacggcggcaaccacaagctgacccagatcgccaaggtggtgatcaagatctgcgagcacgagatgaacgagatcgaggtgtgccccgagtgctacctggccgcctgccagaagagagacaactggttctgcgagccctgcagcaacccccaccccctggtgtgggccaagctgaagggcttccccttctggcccgccaaggccctgagagacaaggacggccaggtggacgccagattcttcggccagcacgacagagcctgggtgcccatcaacaactgctacctgatgagcaaggagatccccttcagcgtgaagaagaccaagagcatcttcaacagcgccatgcaggagatggaggtgtacgtggagaacatcagaagaaagttcggcgtgttcaactacagccccttcagaaccccctacacccccaacagccagtaccagatgctgctggaccccaccaaccccagcgccggcaccgccaagatcgacaagcaggagaaggtgaagctgaacttcgacatgaccgccagccccaagatcctgatgagcaagcccgtgctgagcggcggcaccggcagaagaatcagcctgagcgacatgcccagaagccccatgagcaccaacagcagcgtgcacaccggcagcgacgtggagcaggacgccgagaagaaggccaccagcagccacttcagcgccagcgaggagagcatggacttcctggacaagagcaccgccagccccgccagcaccaagaccggccaggccggcagcctgagcggcagccccaagcccttcagcccccagctgagcgcccccatcaccaccaagaccgacaagaccagcaccaccggcagcatcctgaacctgaacctggacagaagcaaggccgagatggacctgaaggagctgagcgagagcgtgcagcagcagagcacccccgtgcccctgatcagccccaagagacagatcagaagcagattccagctgaacctggacaagaccatcgagagctgcaaggcccagctgggcatcaacgagatcagcgaggacgtgtacaccgccgtggagcacagcgacagcgaggacagcgagaagagcgacagcagcgacagcgagtacatcagcgacgacgagcagaagagcaagaacgagcccgaggacaccgaggacaaggagggctgccagatggacaaggagcccagcgccgtgaagaagaagcccaagcccaccaaccccgtggagatcaaggaggagctgaagagcaccagccccgccagcgagaaggccgaccccggcgccgtgaaggacaaggccagccccgagcccgagaaggacttcagcgagaaggccaagcccagcccccaccccatcaaggacaagctgaagggcaaggacgagaccgacagccccaccgtgcacctgggcctggacagcgacagcgagagcgagctggtgatcgacctgggcgaggaccacagcggcagagagggcagaaagaacaagaaggagcccaaggagcccagccccaagcaggacgtggtgggcaagaccccccccagcaccaccgtgggcagccacagcccccccgagacccccgtgctgaccagaagcagcgcccagaccagcgccgccggcgccaccgccaccaccagcaccagcagcaccgtgaccgtgaccgcccccgcccccgccgccaccggcagccccgtgaagaagcagagacccctgctgcccaaggagaccgcccccgccgtgcagagagtggtgtggaacagcagcagcaagttccagaccagcagccagaagtggcacatgcagaagatgcagagacagcagcagcagcagcagcagcagaaccagcagcagcagccccagagcagccagggcaccagataccagaccagacaggccgtgaaggccgtgcagcagaaggagatcacccagagccccagcaccagcaccatcaccctggtgaccagcacccagagcagccccctggtgaccagcagcggcagcatgagcaccctggtgagcagcgtgaacgccgacctgcccatcgccaccgccagcgccgacgtggccgccgacatcgccaagtacaccagcaagatgatggacgccatcaagggcaccatgaccgagatctacaacgacctgagcaagaacaccaccggcagcaccatcgccgagatcagaagactgagaatcgagatcgagaagctgcagtggctgcaccagcaggagctgagcgagatgaagcacaacctggagctgaccatggccgagatgagacagagcctggagcaggagagagacagactgatcgccgaggtgaagaagcagctggagctggagaagcagcaggccgtggacgagaccaagaagaagcagtggtgcgccaactgcaagaaggaggccatcttctactgctgctggaacaccagctactgcgactacccctgccagcaggcccactggcccgagcacatgaagagctgcacccagagcgccaccgccccccagcaggaggccgacgccgaggtgaacaccgagaccctgaacaagagcagccagggcagcagcagcagcacccagagcgcccccagcgagaccgccagcgccagcaaggagaaggagaccagcgccgagaagagcaaggagagcggcagcaccctggacctgagcggcagcagagagacccccagcagcatcctgctgggcagcaaccagggcagcgtgagcaagagatgcgacaagcagcccgcctacgcccccaccaccaccgaccaccagccccaccccaactaccccgcccagaagtaccacagcagaagcaacaagagcagctggagcagcagcgacgagaagagaggcagcaccagaagcgaccacaacaccagcaccagcaccaagagcctgctgcccaaggagagcagactggacaccttctgggactag

SEQ ID NO: 11210 - DNA, 3405 bp, Artificial Sequence
  Description of Artificial Sequence: Synthetic coding sequence
atgcacccccagagcctggccgaggaggagatcaagaccgagcaggaggtggtggagggcatggacatcagcaccagaagcaaggaccccggcagcgccgagagaaccgcccagaagagaaagttccccagccccccccacagcagcaacggccacagcccccaggacaccagcaccagccccatcaagaagaagaagaagcccggcctgctgaacagcaacaacaaggagcaggacggcagaaacgacttctactgctgggtgtgccacagagagggccaggtgctgtgctgcgagctgtgccccagagtgtaccacgccaagtgcctgagactgaccagcgagcccgagggcgactggttctgccccgagtgcgagaagatcaccgtggccgagtgcatcgagacccagagcaaggccatgaccatgctgaccatcgagcagctgagctacctgctgaagttcgccatccagaagatgaagcagcccggcaccgacgccttccagaagcccgtgcccctggagcagcaccccgactacgccgagtacatcttccaccccatggacctgtgcaccctggagaagaacgccaagaagaagatgtacggctgcaccgaggccttcctggccgacgccaagtggatcctgcacaactgcatcatctacaacggcggcaaccacaagctgacccagatcgccaaggtggtgatcaagatctgcgagcacgagatgaacgagatcgaggtgtgccccgagtgctacctggccgcctgccagaagagagacaactggttctgcgagccctgcagcaacccccaccccctggtgtgggccaagctgaagggcttccccttctggcccgccaaggccctgagagacaaggacggccaggtggacgccagattcttcggccagcacgacagagcctgggtgcccatcaacaactgctacctgatgagcaaggagatccccttcagcgtgaagaagaccaagagcatcttcaacagcgccatgcaggagatggaggtgtacgtggagaacatcagaagaaagttcggcgtgttcaactacagccccttcagaaccccctacacccccaacagccagtaccagatgctgctggaccccaccaaccccagcgccggcaccgccaagatcgacaagcaggagaaggtgaagctgaacttcgacatgaccgccagccccaagatcctgatgagcaagcccgtgctgagcggcggcaccggcagaagaatcagcctgagcgacatgcccagaagccccatgagcaccaacagcagcgtgcacaccggcagcgacgtggagcaggacgccgagaagaaggccaccagcagccacttcagcgccagcgaggagagcatggacttcctggacaagagcaccgacagaagcaaggccgagatggacctgaaggagctgagcgagagcgtgcagcagcagagcacccccgtgcccctgatcagccccaagagacagatcagaagcagattccagctgaacctggacaagaccatcgagagctgcaaggcccagctgggcatcaacgagatcagcgaggacgtgtacaccgccgtggagcacagcgacagcgaggacagcgagaagagcgacagcagcgacagcgagtacatcagcgacgacgagcagaagagcaagaacgagcccgaggacaccgaggacaaggagggctgccagatggacaaggagcccagcgccgtgaagaagaagcccaagcccaccaaccccgtggagatcaaggaggagctgaagagcaccagccccgccagcgagaaggccgaccccggcgccgtgaaggacaaggccagccccgagcccgagaaggacttcagcgagaaggccaagcccagcccccaccccatcaaggacaagctgaagggcaaggacgagaccgacagccccaccgtgcacctgggcctggacagcgacagcgagagcgagctggtgatcgacctgggcgaggaccacagcggcagagagggcagaaagaacaagaaggagcccaaggagcccagccccaagcaggacgtggtgggcaagaccccccccagcaccaccgtgggcagccacagcccccccgagacccccgtgctgaccagaagcagcgcccagaccagcgccgccggcgccaccgccaccaccagcaccagcagcaccgtgaccgtgaccgcccccgcccccgccgccaccggcagccccgtgaagaagcagagacccctgctgcccaaggagaccgcccccgccgtgcagagagtggtgtggaacagcagcagcaagttccagaccagcagccagaagtggcacatgcagaagatgcagagacagcagcagcagcagcagcagcagaaccagcagcagcagccccagagcagccagggcaccagataccagaccagacaggccgtgaaggccgtgcagcagaaggagatcacccagagccccagcaccagcaccatcaccctggtgaccagcacccagagcagccccctggtgaccagcagcggcagcatgagcaccctggtgagcagcgtgaacgccgacctgcccatcgccaccgccagcgccgacgtggccgccgacatcgccaagtacaccagcaagatgatggacgccatcaagggcaccatgaccgagatctacaacgacctgagcaagaacaccaccggcagcaccatcgccgagatcagaagactgagaatcgagatcgagaagctgcagtggctgcaccagcaggagctgagcgagatgaagcacaacctggagctgaccatggccgagatgagacagagcctggagcaggagagagacagactgatcgccgaggtgaagaagcagctggagctggagaagcagcaggccgtggacgagaccaagaagaagcagtggtgcgccaactgcaagaaggaggccatcttctactgctgctggaacaccagctactgcgactacccctgccagcaggcccactggcccgagcacatgaagagctgcacccagagcgccaccgccccccagcaggaggccgacgccgaggtgaacaccgagaccctgaacaagagcagccagggcagcagcagcagcacccagagcgcccccagcgagaccgccagcgccagcaaggagaaggagaccagcgccgagaagagcaaggagagcggcagcaccctggacctgagcggcagcagagagacccccagcagcatcctgctgggcagcaaccagggcagcgaccacagcagaagcaacaagagcagctggagcagcagcgacgagaagagaggcagcaccagaagcgaccacaacaccagcaccagcaccaagagcctgctgcccaaggagagcagactggacaccttctgggactag

SEQ ID NO: 11211 - DNA, 2805 bp, Artificial Sequence
  Description of Artificial Sequence: Synthetic coding sequence
atggaggagagaagaccccacctggacgccagacccagaaacagccacaccaaccacagaggccccgtggacggcgagctgccccccagagccagaaaccaggccaacaacccccccgccaacgccctgagaggcggcgccagccaccccggcagacaccccagagccaacaaccaccccgccgcctactggcagagagaggagagattcagagccatgggcagaaacccccaccagggcagaagaaaccaggagggccacgccagcgacgaggccagagaccagagacacgaccaggagaacgacaccagatggagaaacggcaaccaggactgcagaaacagaagacccccctggagcaacgacaacttccagcagtggagaaccccccaccagaagcccaccgagcagccccagcaggccaagaagctgggctacaagttcctggagagcctgctgcagaaggaccccagcgaggtggtgatcaccctggccaccagcctgggcctgaaggagctgctgagccacagcagcatgaagagcaacttcctggagctgatctgccaggtgctgagaaaggcctgcagcagcaagatggacagacagagcgtgctgcacgtgctgggcatcctgaagaacagcaagttcctgaaggtgtgcctgcccgcctacgtggtgggcatgatcaccgagcccatccccgacatcagaaaccagtaccccgagcacatcagcaacatcatcagcctgctgcaggacctggtgagcgtgttccccgccagcagcgtgcaggagaccagcatgctggtgagcctgctgcccaccagcctgaacgccctgagagccagcggcgtggacatcgaggaggagaccgagaagaacctggagaaggtgcagaccatcatcgagcacctgcaggagaagagaagagagggcaccctgagagtggacacctacaccctggtgcagcccgaggccgaggaccacgtggagagctacagaaccatgcccatctaccccacctacaacgaggtgcacctggacgagagacccttcctgagacccaacatcatcagcggcaagtacgacagcaccgccatctacctggacacccacttcagactgctgagagaggacttcgtgagacccctgagagagggcatcctggagctgctgcagagcttcgaggaccagggcctgagaaagagaaagttcgacgacatcagaatctacttcgacaccagaatcatcacccccatgtgcagcagcagcggcatcgtgtacaaggtgcagttcgacaccaagcccctgaagttcgtgagatggcagaacagcaagagactgctgtacggcagcctggtgtgcatgagcaaggacaacttcgagaccttcctgttcgccaccgtgagcaacagagagcaggaggacctgtgcagaggcatcgtgcagctgtgcttcaacgagcagagccagcagctgctggccgaggtgcagcccagcgacagcttcctgatggtggagaccaccgcctacttcgaggcctacagacacgtgctggagggcctgcaggaggtgcaggaggaggacgtgcccttccagagaaacatcgtggagtgcaacagccacgtgaaggagcccagatacctgctgatgggcggcagatacgacttcacccccctgatcgagaaccccagcgccaccggcgagttcctgagaaacgtggagggcctgagacaccccagaatcaacgtgctggaccccggccagtggcccagcaaggaggccctgaagctggacgacagccagatggaggccctgcagttcgccctgaccagagagctggccatcatccagggcccccccggcaccggcaagacctacgtgggcctgaagatcgtgcaggccctgctgaccaacgagagcgtgtggcagatcagcctgcagaagttccccatcctggtggtgtgctacaccaaccacgccctggaccagttcctggagggcatctacaactgccagaagaccagcatcgtgagagtgggcggcagaagcaacagcgagatcctgaagcagttcaccctgagagagctgagaaacaagagagagttcagaagaaacctgcccatgcacctgagaagagcctacatgagcatcatgacccagatgaaggagagcgagcaggagctgcacgagggcgccaagaccctggagtgcaccatgagaggcgtgctgagagagcagtacctgcagaagtacatcagcccccagcactgggagagcctgatgaacggccccgtgcaggacagcgagtggatctgcttccagcactggaagcacagcatgatgctggagtggctgggcctgggcgtgggcagcttcacccagagcgtgagccccgccggccccgagaacaccgcccaggccgagggcgacgaggaggaggagggcgaggaggagagcagcctgatcgagatcgccgaggaggccgacctgatccaggccgacagagtgatcgaggaggaggaggtggtgagaccccagagaagaaagaaggaggagagcggcgccgaccaggagctggccaagatgctgctggccatgagactggaccactgcggcaccggcaccgccgccggccaggagcaggccaccggcgagtggcagacccagagaaaccagaagaagaagatgaagaagagagtgaaggacgagctgagaaagctgaacaccatgaccgccgccgaggccaacgagatcgaggacgtgtggcagctggacctgagcagcagatggcagctgtactag

SEQ ID NO: 11212 - DNA, 5757 bp, Artificial Sequence
  Description of Artificial Sequence: Synthetic coding sequence
atggaggagagaagaccccacctggacgccagacccagaaacagccacaccaaccacagaggccccgtggacggcgagctgccccccagagccagaaaccaggccaacaacccccccgccaacgccctgagaggcggcgccagccaccccggcagacaccccagagccaacaaccaccccgccgcctactggcagagagaggagagattcagagccatgggcagaaacccccaccagggcagaagaaaccaggagggccacgccagcgacgaggccagagaccagagacacgaccaggagaacgacaccagatggagaaacggcaaccaggactgcagaaacagaagacccccctggagcaacgacaacttccagcagtggagaaccccccaccagaagcccaccgagcagccccagcaggccaagaagctgggctacaagttcctggagagcctgctgcagaaggaccccagcgaggtggtgatcaccctggccaccagcctgggcctgaaggagctgctgagccacagcagcatgaagagcaacttcctggagctgatctgccaggtgctgagaaaggcctgcagcagcaagatggacagacagagcgtgctgcacgtgctgggcatcctgaagaacagcaagttcctgaaggtgtgcctgcccgcctacgtggtgggcatgatcaccgagcccatccccgacatcagaaaccagtaccccgagcacatcagcaacatcatcagcctgctgcaggacctggtgagcgtgttccccgccagcagcgtgcaggagaccagcatgctggtgagcctgctgcccaccagcctgaacgccctgagagccagcggcgtggacatcgaggaggagaccgagaagaacctggagaaggtgcagaccatcatcgagcacctgcaggagaagagaagagagggcaccctgagagtggacacctacaccctggtgcagcccgaggccgaggaccacgtggagagctacagaaccatgcccatctaccccacctacaacgaggtgcacctggacgagagacccttcctgagacccaacatcatcagcggcaagtacgacagcaccgccatctacctggacacccacttcagactgctgagagaggacttcgtgagacccctgagagagggcatcctggagctgctgcagagcttcgaggaccagggcctgagaaagagaaagttcgacgacatcagaatctacttcgacaccagaatcatcacccccatgtgcagcagcagcggcatcgtgtacaaggtgcagttcgacaccaagcccctgaagttcgtgagatggcagaacagcaagagactgctgtacggcagcctggtgtgcatgagcaaggacaacttcgagaccttcctgttcgccaccgtgagcaacagagagcaggaggacctgtgcagaggcatcgtgcagctgtgcttcaacgagcagagccagcagctgctggccgaggtgcagcccagcgacagcttcctgatggtggagaccaccgcctacttcgaggcctacagacacgtgctggagggcctgcaggaggtgcaggaggaggacgtgcccttccagagaaacatcgtggagtgcaacagccacgtgaaggagcccagatacctgctgatgggcggcagatacgacttcacccccctgatcgagaaccccagcgccaccggcgagttcctgagaaacgtggagggcctgagacaccccagaatcaacgtgctggaccccggccagtggcccagcaaggaggccctgaagctggacgacagccagatggaggccctgcagttcgccctgaccagagagctggccatcatccagggcccccccggcaccggcaagacctacgtgggcctgaagatcgtgcaggccctgctgaccaacgagagcgtgtggcagatcagcctgcagaagttccccatcctggtggtgtgctacaccaaccacgccctggaccagttcctggagggcatctacaactgccagaagaccagcatcgtgagagtgggcggcagaagcaacagcgagatcctgaagcagttcaccctgagagagctgagaaacaagagagagttcagaagaaacctgcccatgcacctgagaagagcctacatgagcatcatgacccagatgaaggagagcgagcaggagctgcacgagggcgccaagaccctggagtgcaccatgagaggcgtgctgagagagcagtacctgcagaagtacatcagcccccagcactgggagagcctgatgaacggccccgtgcaggacagcgagtggatctgcttccagcactggaagcacagcatgatgctggagtggctgggcctgggcgtgggcagcttcacccagagcgtgagccccgccggccccgagaacaccgcccaggccgagggcgacgaggaggaggagggcgaggaggagagcagcctgatcgagatcgccgaggaggccgacctgatccaggccgacagagtgatcgaggaggaggaggtggtgagaccccagagaagaaagaaggaggagagcggcgccgaccaggagctggccaagatgctgctggccatgagactggaccactgcggcaccggcaccgccgccggccaggagcaggccaccggcgagtggcagacccagagaaaccagaagaagaagatgaagaagagagtgaaggacgagctgagaaagctgaacaccatgaccgccgccgaggccaacgagatcgaggacgtgtggcagctggacctgagcagcagatggcagctgtacagactgtggctgcagctgtaccaggccgacaccagaagaaagatcctgagctacgagagacagtacagaaccagcgccgagagaatggccgagctgagactgcaggaggacctgcacatcctgaaggacgcccaggtggtgggcatgaccaccaccggcgccgccaagtacagacagatcctgcagaaggtggagcccagaatcgtgatcgtggaggaggccgccgaggtgctggaggcccacaccatcgccaccctgagcaaggcctgccagcacctgatcctgatcggcgaccaccagcagctgagacccagcgccaacgtgtacgacctggccaagaacttcaacctggaggtgagcctgttcgagagactggtgaaggtgaacatccccttcgtgagactgaactaccagcacagaatgtgccccgagatcgccagactgctgaccccccacatctaccaggacctggagaaccaccccagcgtgctgaagtacgagaagatcaagggcgtgagcagcaacctgttcttcgtggagcacaacttccccgagcaggagatccaggagggcaagagccaccagaaccagcacgaggcccacttcgtggtggagctgtgcaagtacttcctgtgccaggagtacctgcccagccagatcaccatcctgaccacctacaccggccagctgttctgcctgagaaagctgatgcccgccaagaccttcgccggcgtgagagtgcacgtggtggacaagtaccagggcgaggagaacgacatcatcctgctgagcctggtgagaagcaaccaggagggcaaggtgggcttcctgcagatcagcaacagaatctgcgtggccctgagcagagccaagaagggcatgtactgcatcggcaacatgcagatgctggccaaggtgcccctgtggagcaagatcatccacaccctgagagagaacaaccagatcggccccatgctgagactgtgctgccagaaccaccccgagacccacaccctggtgagcaaggccagcgacttccagaaggtgcccgagggcggctgcagcctgccctgcgagttcagactgggctgcggccacgtgtgcaccagagcctgccacccctacgacagcagccacaaggagttccagtgcatgaagccctgccagaaggtgatctgccaggagggccacagatgccccctggtgtgcttccaggagtgccagccctgccaggtgaaggtgcccaagaccatccccagatgcggccacgagcagatggtgccctgcagcgtgcccgagagcgacttctgctgccaggagccctgcagcaagagcctgagatgcggccacagatgcagccacccctgcggcgaggactgcgtgcagctgtgcagcgagatggtgaccatcaagctgaagtgcggccacagccagcccgtgaagtgcggccacgtggagggcctgctgtacggcggcctgctggtgaagtgcaccaccaagtgcggcaccatcctggactgcggccacccctgccccggcagctgccacagctgcttcgagggcagattccacgagagatgccagcagccctgcaagagactgctgatctgcagccacaagtgccaggagccctgcatcggcgagtgccccccctgccagagaacctgccagaacagatgcgtgcacagccagtgcaagaagaagtgcggcgagctgtgcagcccctgcgtggagccctgcgtgtggagatgccagcactaccagtgcaccaagctgtgcagcgagccctgcaacagacccccctgctacgtgccctgcaccaagctgctggtgtgcggccacccctgcatcggcctgtgcggcgagccctgccccaagaagtgcagaatctgccacatggacgaggtgacccagatcttcttcggcttcgaggacgagcccgacgccagattcgtgcagctggaggactgcagccacatcttcgaggtgcaggccctggacagatacatgaacgagcagaaggacgacgaggtggccatcagactgaaggtgtgccccatctgccaggtgcccatcagaaagaacctgagatacggcaccagcatcaagcagagactggaggagatcgagatcatcaaggagaagatccagggcagcgccggcgagatcgccaccagccaggagagactgaaggccctgctggagagaaagagcctgctgcaccagctgctgcccgaggacttcctgatgctgaaggagaagctggcccagaagaacctgagcgtgaaggacctgggcctggtggagaactacatcagcttctacgaccacctggccagcctgtgggacagcctgaagaagatgcacgtgctggaggagaagagagtgagaaccagactggagcaggtgcacgagtggctggccaagaagagactgagcttcaccagccaggagctgagcgacctgagaagcgagatccagagactgacctacctggtgaacctgctgaccagatacaagatcgccgagaagaaggtgaaggacagcatcgccgtggaggtgtacagcgtgcagaacatcctggagaagacctgcaagttcacccaggaggacgagcagctggtgcaggagaagatggaggccctgaaggccaccctgccctgcagcggcctgggcatcagcgaggaggagagagtgcagatcgtgagcgccatcggctaccccagaggccactggttcaagtgcagaaacggccacatctacgtgatcggcgactgcggcggcgccatggagagaggcacctgccccgactgcaaggaggtgatcggcggcaccaaccacaccctggagagaagcaaccagctggccagcgagatggacggcgcccagcacgccgcctggagcgacaccgccaacaacctgatgaacttcgaggagatccagggcatgatgtag

SEQ ID NO: 11213 - DNA, 3813 bp, Artificial Sequence
  Description of Artificial Sequence: Synthetic coding sequence
atggaggagagaagaccccacctggacgccagacccagaaacagccacaccaaccacagaggccccgtggacggcgagctgccccccagagccagaaaccaggccaacaacccccccgccaacgccctgagaggcggcgccagccaccccggcagacaccccagagccaacaaccaccccgccgcctactggcagagagaggagagattcagagccatgggcagaaacccccaccagggcagaagaaaccaggagggccacgccagcgacgaggccagagaccagagacacgaccaggagaacgacaccagatggagaaacggcaaccaggactgcagaaacagaagacccccctggagcaacgacaacttccagcagtggagaaccccccaccagaagcccaccgagcagccccagcaggccaagaagctgggctacaagttcctggagagcctgctgcagaaggaccccagcgaggtggtgatcaccctggccaccagcctgggcctgaaggagctgctgagccacagcagcatgaagagcaacttcctggagctgatctgccaggtgctgagaaaggcctgcagcagcaagatggacagacagagcgtgctgcacgtgctgggcatcctgaagaacagcaagttcctgaaggtgtgcctgcccgcctacgtggtgggcatgatcaccgagcccatccccgacatcagaaaccagtaccccgagcacatcagcaacatcatcagcctgctgcaggacctggtgagcgtgttccccgccagcagcgtgcaggagaccagcatgctggtgagcctgctgcccaccagcctgaacgccctgagagccagcggcgtggacatcgaggaggagaccgagaagaacctggagaaggtgcagaccatcatcgagcacctgcaggagaagagaagagagggcaccctgagagtggacacctacaccctggtgcagcccgaggccgaggaccacgtggagagctacagaaccatgcccatctaccccacctacaacgaggtgcacctggacgagagacccttcctgagacccaacatcatcagcggcaagtacgacagcaccgccatctacctggacacccacttcagactgctgagagaggacttcgtgagacccctgagagagggcatcctggagctgctgcagagcttcgaggaccagggcctgagaaagagaaagttcgacgacatcagaatctacttcgacaccagaatcatcacccccatgtgcagcagcagcggcatcgtgtacaaggtgcagttcgacaccaagcccctgaagttcgtgagatggcagaacagcaagagactgctgtacggcagcctggtgtgcatgagcaaggacaacttcgagaccttcctgttcgccaccgtgagcaacagagagcaggaggacctgtgcagaggcatcgtgcagctgtgcttcaacgagcagagccagcagctgctggccgaggtgcagcccagcgacagcttcctgatggtggagaccaccgcctacttcgaggcctacagacacgtgctggagggcctgcaggaggtgcaggaggaggacgtgcccttccagagaaacatcgtggagtgcaacagccacgtgaaggagcccagatacctgctgatgggcggcagatacgacttcacccccctgatcgagaaccccagcgccaccggcgagttcctgagaaacgtggagggcctgagacaccccagaatcaacgtgctggaccccggccagtggcccagcaaggaggccctgaagctggacgacagccagatggaggccctgcagttcgccctgaccagagagctggccatcatccagggcccccccggcaccggcaagacctacgtgggcctgaagatcgtgcaggccctgctgaccaacgagagcgtgtggcagatcagcctgcagaagttccccatcctggtggtgtgctacaccaaccacgccctggaccagttcctggagggcatctacaactgccagaagaccagcatcgtgagagtgggcggcagaagcaacagcgagatcctgaagcagttcaccctgagagagctgagaaacaagagagagttcagaagaaacctgcccatgcacctgagaagagcctacatgagcatcatgacccagatgaaggagagcgagcaggagctgcacgagggcgccaagaccctggagtgcaccatgagaggcgtgctgagagagcagtacctgcagaagtacatcagcccccagcactgggagagcctgatgaacggccccgtgcaggacagcgagtggatctgcttccagcactggaagcacagcatgatgctggagtggctgggcctgggcgtgggcagcttcacccagagcgtgagccccgccggccccgagaacaccgcccaggccgagggcgacgaggaggaggagggcgaggaggagagcagcctgatcgagatcgccgaggaggccgacctgatccaggccgacagagtgatcgaggaggaggaggtggtgagaccccagagaagaaagaaggaggagagcggcgccgaccaggagctggccaagatgctgctggccatgagactggaccactgcggcaccggcaccgccgccggccaggagcaggccaccggcgagtggcagacccagagaaaccagaagaagaagatgaagaagagagtgaaggacgagctgagaaagctgaacaccatgaccgccgccgaggccaacgagatcgaggacgtgtggcagctggacctgagcagcagatggcagctgtacagactgtggctgcagctgtaccaggccgacaccagaagaaagatcctgagctacgagagacagtacagaaccagcgccgagagaatggccgagctgagactgcaggaggacctgcacatcctgaaggacgcccaggtggtgggcatgaccaccaccggcgccgccaagtacagacagatcctgcagaaggtggagcccagaatcgtgatcgtggaggaggccgccgaggtgctggaggcccacaccatcgccaccctgagcaaggcctgccagcacctgatcctgatcggcgaccaccagcagctgagacccagcgccaacgtgtacgacctggccaagaacttcaacctggaggtgagcctgttcgagagactggtgaaggtgaacatccccttcgtgagactgaactaccagcacagaatgtgccccgagatcgccagactgctgaccccccacatctaccaggacctggagaaccaccccagcgtgctgaagtacgagaagatcaaggccaagagcaacagctgcagagccctggccaccggcatgagaagaaagcacaagatcagcggcatgatcctgagcttcttcaagctgaccatcagaagcgccagattccagctgctgctgagcggcagctggaccaccgccagcttccccttcagcagaagcagattcgccgtgctgatctgcagagacaacaagagaatgcccgccgtgaagcccgtgagcaccaacaccggcagccacggcctgcagatgcccggcgccctgatgggcgagaccttccagaagggcagcaccagcagagacgccgccgcctgcctgctgagcagcctggtgaacaagatcccccccagaagcctgacctgggccagcgactgctgcatcagcttcagcagcgccagcagctgcagaaccgcctacaccagcttcagcatcttcagcatcctgagcagaaacctgagaatgaccagccagtgggagaagatcaagagaatctacaagtag

SEQ ID NO: 11214 - DNA, 5757 bp, Artificial Sequence; identical to SEQ ID NO: 11212
  Description of Artificial Sequence: Synthetic coding sequence

SEQ ID NO: 11215 - DNA, 2748 bp, Artificial Sequence
  Description of Artificial Sequence: Synthetic coding sequence
atggaggagagaagaccccacctggacgccagacccagaaacagccacaccaaccacagaggccccgtggacggcgagctgccccccagagccagaaaccaggccaacaacccccccgccaacgccctgagaggcggcgccagccaccccggcagacaccccagagccaacaaccaccccgccgcctactggcagagagaggagagattcagagccatgggcagaaacccccaccagggcagaagaaaccaggagggccacgccagcgacgaggccagagaccagagacacgaccaggagaacgacaccagatggagaaacggcaaccaggactgcagaaacagaagacccccctggagcaacgacaacttccagcagtggagaaccccccaccagaagcccaccgagcagccccagcaggccaagaagctgggctacaagttcctggagagcctgctgcagaaggaccccagcgaggtggtgatcaccctggccaccagcctgggcctgaaggagctgctgagccacagcagcatgaagagcaacttcctggagctgatctgccaggtgctgagaaaggcctgcagcagcaagatggacagacagagcgtgctgcacgtgctgggcatcctgaagaacagcaagttcctgaaggtgtgcctgcccgcctacgtggtgggcatgatcaccgagcccatccccgacatcagaaaccagtaccccgagcacatcagcaacatcatcagcctgctgcaggacctggtgagcgtgttccccgccagcagcgtgcaggagaccagcatgctggtgagcctgctgcccaccagcctgaacgccctgagagccagcggcgtggacatcgaggaggagaccgagaagaacctggagaaggtgcagaccatcatcgagcacctgcaggagaagagaagagagggcaccctgagagtggacacctacaccctggtgcagcccgaggccgaggaccacgtggagagctacagaaccatgcccatctaccccacctacaacgaggtgcacctggacgagagacccttcctgagacccaacatcatcagcggcaagtacgacagcaccgccatctacctggacacccacttcagactgctgagagaggacttcgtgagacccctgagagagggcatcctggagctgctgcagagcttcgaggaccagggcctgagaaagagaaagttcgacgacatcagaatctacttcgacaccagaatcatcacccccatgtgcagcagcagcggcatcgtgtacaaggtgcagttcgacaccaagcccctgaagttcgtgagatggcagaacagcaagagactgctgtacggcagcctggtgtgcatgagcaaggacaacttcgagaccttcctgttcgccaccgtgagcaacagagagcaggaggacctgtgcagaggcatcgtgcagctgtgcttcaacgagcagagccagcagctgctggccgaggtgcagcccagcgacagcttcctgatggtggagaccaccgcctacttcgaggcctacagacacgtgctggagggcctgcaggaggtgcaggaggaggacgtgcccttccagagaaacatcgtggagtgcaacagccacgtgaaggagcccagatacctgctgatgggcggcagatacgacttcacccccctgatcgagaaccccagcgccaccggcgagttcctgagaaacgtggagggcctgagacaccccagaatcaacgtgctggaccccggccagtggcccagcaaggaggccctgaagctggacgacagccagatggaggccctgcagttcgccctgaccagagagctggccatcatccagggcccccccggcaccggcaagacctacgtgggcctgaagatcgtgcaggccctgctgaccaacgagagcgtgtggcagatcagcctgcagaagttccccatcctggtggtgtgctacaccaaccacgccctggaccagttcctggagggcatctacaactgccagaagaccagcatcgtgagagtgggcggcagaagcaacagcgagatcctgaagcagttcaccctgagagagctgagaaacaagagagagttcagaagaaacctgcccatgcacctgagaagagcctacatgagcatcatgacccagatgaaggagagcgagcaggagctgcacgagggcgccaagaccctggagtgcaccatgagaggcgtgctgagagagcagtacctgcagaagtacatcagcccccagcactgggagagcctgatgaacggccccgtgcaggacagcgagtggatctgcttccagcactggaagcacagcatgatgctggagtggctgggcctgggcgtgggcagcttcacccagagcgtgagccccgccggccccgagaacaccgcccaggccgagggcgacgaggaggaggagggcgaggaggagagcagcctgatcgagatcgccgaggaggccgacctgatccaggccgacagagtgatcgaggaggaggaggtggtgagaccccagagaagaaagaaggaggagagcggcgccgaccaggagctggccaagatgctgctggccatgagactggaccactgcggcaccggcaccgccgccggccaggagcaggccaccggcgagtggcagacccagagaaaccagaagaagaagatgaagaagagagagaaggaggagaagaaggagagagagaagagaagaaagaagaagtag

SEQ ID NO: 11216 - DNA, 2124 bp, Artificial Sequence
  Description of Artificial Sequence: Synthetic coding sequence
agcaagatggacagacagagcgtgctgcacgtgctgggcatcctgaagaacagcaagttcctgaaggtgtgcctgcccgcctacgtggtgggcatgatcaccgagcccatccccgacatcagaaaccagtaccccgagcacatcagcaacatcatcagcctgctgcaggacctggtgagcgtgttccccgccagcagcgtgcaggagaccagcatgctggtgagcctgctgcccaccagcctgaacgccctgagagccagcggcgtggacatcgaggaggagaccgagaagaacctggagaaggtgcagaccatcatcgagcacctgcaggagaagagaagagagggcaccctgagagtggacacctacaccctggtgcagcccgaggccgaggaccacgtggagagctacagaaccatgcccatctaccccacctacaacgaggtgcacctggacgagagacccttcctgagacccaacatcatcagcggcaagtacgacagcaccgccatctacctggacacccacttcagactgctgagagaggacttcgtgagacccctgagagagggcatcctggagctgctgcagagcttcgaggaccagggcctgagaaagagaaagttcgacgacatcagaatctacttcgacaccagaatcatcacccccatgtgcagcagcagcggcatcgtgtacaaggtgcagttcgacaccaagcccctgaagttcgtgagatggcagaacagcaagagactgctgtacggcagcctggtgtgcatgagcaaggacaacttcgagaccttcctgttcgccaccgtgagcaacagagagcaggaggacctgtgcagaggcatcgtgcagctgtgcttcaacgagcagagccagcagctgctggccgaggtgcagcccagcgacagcttcctgatggtggagaccaccgcctacttcgaggcctacagacacgtgctggagggcctgcaggaggtgcaggaggaggacgtgcccttccagagaaacatcgtggagtgcaacagccacgtgaaggagcccagatacctgctgatgggcggcagatacgacttcacccccctgatcgagaaccccagcgccaccggcgagttcctgagaaacgtggagggcctgagacaccccagaatcaacgtgctggaccccggccagtggcccagcaaggaggccctgaagctggacgacagccagatggaggccctgcagttcgccctgaccagagagctggccatcatccagggcccccccggcaccggcaagacctacgtgggcctgaagatcgtgcaggccctgctgaccaacgagagcgtgtggcagatcagcctgcagaagttccccatcctggtggtgtgctacaccaaccacgccctggaccagttcctggagggcatctacaactgccagaagaccagcatcgtgagagtgggcggcagaagcaacagcgagatcctgaagcagttcaccctgagagagctgagaaacaagagagagttcagaagaaacctgcccatgcacctgagaagagcctacatgagcatcatgacccagatgaaggagagcgagcaggagctgcacgagggcgccaagaccctggagtgcaccatgagaggcgtgctgagagagcagtacctgcagaagtacatcagcccccagcactgggagagcctgatgaacggccccgtgcaggacagcgagtggatctgcttccagcactggaagcacagcatgatgctggagtggctgggcctgggcgtgggcagcttcacccagagcgtgagccccgccggccccgagaacaccgcccaggccgagggcgacgaggaggaggagggcgaggaggagagcagcctgatcgagatcgccgaggaggccgacctgatccaggccgacagagtgatcgaggaggaggaggtggtgagaccccagagaagaaagaaggaggagagcggcgccgaccaggagctggccaagatgctgctggccatgagactggaccactgcggcaccggcaccgccgccggccaggagcaggccaccggcgagtggcagaccgtgccctgcctggtgctgatgagcgccgaccccgcccagccctag

SEQ ID NO: 11217 - DNA, 186 bp, Artificial Sequence
  Description of Artificial Sequence: Synthetic coding sequence
atggaggagagaagaccccacctggacgccagacccagaaacagccacaccaaccacagaggccccgtggacggcgagctgccccccagagccgagatcatgcccctgcacagcagcctgggcgacagaagcaagaccctgagccagaagaagaagagcttcttcctggtgctggcccccacctag

SEQ ID NO: 11218 - DNA, 963 bp, Artificial Sequence
  Description of Artificial Sequence: Synthetic coding sequence
atgagcaccaagaacttcagagtgagcgacggcgactggatctgccccgacaagaagtgcggcaacgtgaacttcgccagaagaaccagctgcaacagatgcggcagagagaagaccaccgaggccaagatgatgaaggccggcggcaccgagatcggcaagaccctggccgagaagagcagaggcctgttcagcgccaacgactggcagtgcaagacctgcagcaacgtgaactgggccagaagaagcgagtgcaacatgtgcaacacccccaagtacgccaagctggaggagagaaccggctacggcggcggcttcaacgagagagagaacgtggagtacatcgagagagaggagagcgacggcgagtacgacgagttcggcagaaagaagaagaagtacagaggcaaggccgtgggccccgccagcatcctgaaggaggtggaggacaaggagagcgagggcgaggaggaggacgaggacgaggacctgagcaagtacaagctggacgaggacgaggacgaggacgacgccgacctgagcaagtacaacctggacgccagcgaggaggaggacagcaacaagaagaagagcaacagaagaagcagaagcaagagcagaagcagccacagcagaagcagcagcagaagcagcagccccagcagcagcagaagcagaagcagaagcagaagcagaagcagcagcagcagccagagcagaagcagaagcagcagcagagagagaagcagaagcagaggcagcaagagcagaagcagcagcagaagccacagaggcagcagcagccccagaaagagaagctacagcagcagcagcagcagccccgagagaaacagaaagagaagcagaagcagaagcagcagcagcggcgacagaaagaagagaagaaccagaagcagaagccccgagagccaggtgatcggcgagaacaccaagcagccctag

SEQ ID NO: 11219 - DNA, 993 bp, Artificial Sequence
  Description of Artificial Sequence: Synthetic coding sequence
atgagcaccaagaacttcagagtgagcgacggcgactggatctgccccgacaagaagtgcggcaacgtgaacttcgccagaagaaccagctgcaacagatgcggcagagagaagaccaccgaggccaagatgatgaaggccggcggcaccgagatcggcaagaccctggccgagaagagcagaggcctgttcagcgccaacgactggcagtgcaagacctgcagcaacgtgaactgggccagaagaagcgagtgcaacatgtgcaacacccccaagtacgccaagctggaggagagaaccggctacggcggcggcttcaacgagagagagaacgtggagtacatcgagagagaggagagcgacggcgagtacgacgagttcggcagaaagaagaagaagtacagaggcaaggccgtgggccccgccagcatcctgaaggaggtggaggacaaggagagcgagggcgaggaggaggacgaggacgaggacctgagcaagtacaagctggacgaggacgaggacgaggacgacgccgacctgagcaagtacaacctggacgccagcgaggaggaggacagcaacaagaagaagagcaacagaagaagcagaagcaagagcagaagcagccacagcagaagcagcagcagaagcagcagccccagcagcagcagaagcagaagcagaagcagaagcagaagcagcagcagcagccagagcagaagcagaagcagcagcagagagagaagcagaagcagaggcagcaagagcagaagcagcagcagaagccacagaggcagcagcagccccagaaagagaagctacagcagcagcagcagcagccccgagagaaacagaaagagaagcagaagcagaagcagcagcagcggcgacagaaagaagagaagaaccagaagcagaagccccgagagaagacacagaagcagcagcggcagcagccacagcggcagcagaagcagcagcaagaagaagtag

SEQ ID NO: 11220 - DNA, 1458 bp, Artificial Sequence
  Description of Artificial Sequence: Synthetic coding sequence
atgctggagagactgaaggccccctggagcgccgccctgcagagaaagtacttcgacctgggcatctggaccgcccccatcagccccatggccctgaccatgctgaacggcctgctgatcaaggacagcagcccccccatgctgctgcaccaggtgaacaagaccgcccagctggacaccttcaactaccagagctgcttcatgcagagcgtgttcgaccacttccccgagatcctgttcatccacagaacctacaaccccagaggcaaggtgctgtacaccttcctggtggacggccccagagtgcagctggagggccacctggccagagccgtgtacttcgccatccccgccaaggaggacaccgagggcctggcccagatgttccaggtgttcaagaagttcaaccccgcctgggagagagtgtgcaccatcctggtggacccccacttcctgcccctgcccatcctggccatggagttccccaccgccgaggtgctgctgagcgccttccacatctgcaagttcctgcaggccaagttctaccagctgagcctggagagacccgtggagagactgctgctgaccagcctgcagagcaccatgtgcagcgccaccgccggcaacctgagaaagctgtacaccctgctgagcaactgcatcccccccgccaagctgcccgagctgcacagccactggctgctgaacgacagaatctggctggcccacagatggagaagcagagccgagagcagccactacttccagagcctggaggtgaccacccacatcctgagccagttcttcggcaccacccccagcgagaagcagggcatggccagcctgttcagatacatgcagcagaacagcgccgacaaggccaacttcaaccagggcctgtgcgcccagaacaaccacgcccccagcgacaccatccccgagagccccaagctggagcagctggtggagagccacatccagcacagcctgaacgccatctgcaccggccccgccgcccagctgtgcctgggcgagctggccgtggtgcagaagagcacccacctgatcggcagcggcagcgagaagatgaacatccagatcctggaggacacccacaaggtgcagccccagccccccgccagctgcagctgctacttcaaccaggccttccacctgccctgcagacacatcctggccatgctgagcgccagaagacaggtgctgcagcccgacatgctgcccgcccagtggaccgccggctgcgccaccagcctggacagcatcctgggcagcaagtggagcgagaccctggacaagcacctggccgtgacccacctgaccgaggaggtgggccagctgctgcagcactgcaccaaggaggagttcgagagaagatacagcaccctgagagagctggccgacagctggatcggcccctacgagcaggtgcagctgtag

SEQ ID NO: 11221 - DNA, 1458 bp, Artificial Sequence; identical to SEQ ID NO: 11220
  Description of Artificial Sequence: Synthetic coding sequence

SEQ ID NO: 11222 - DNA, 423 bp, Artificial Sequence
  Description of Artificial Sequence: Synthetic coding sequence
atggccgtggtgctgcccgccgtggtggaggagctgctgagcgagatggccgccgccgtgcaggagagcgccagaatccccgacgagtacctgctgagcctgaagttcctgttcggcagcagcgccacccaggccctggacctggtggacagacagagcatcaccctgatcagcagccccagcggcagaagagtgtaccaggtgctgggcagcagcagcaagacctacacctgcctggccagctgccactactgcagctgccccgccttcgccttcagcgtgctgagaaagagcgacagcatcctgtgcaagcacctgctggccgtgtacctgagccaggtgatgagaacctgccagcagctgagcgtgagcgacaagcagctgaccgacatcctgctgatggagaagaagcaggaggcctag

SEQ ID NO: 11223 - DNA, 423 bp, Artificial Sequence; identical to SEQ ID NO: 11222
  Description of Artificial Sequence: Synthetic coding sequence

SEQ ID NO: 11224 - DNA, 1230 bp, Artificial Sequence
  Description of Artificial Sequence: Synthetic coding sequence
atgatcgacctgtggctgtacagctaccagagactgctgcagaccatcgccgtgctggaggcccagagaagccaggccgtgcaggacctggagagcctgggcagacaccagagagaggccctgaagaaccccatcggcttcgtggagaagctgcagaagaaggccgacatcggcctgccctacccccagagagtggtgcagctgcccgagatcgtgtgggaccagtacacccacagcctgggcaacttcgagagagagttcaagaacagaaagagacacaccagaagagtgaagctggtgttcgacaaggtgggcctgcccgccagacccaagagccccctggaccccaagaaggacggcgagagcctgagctacagcatgctgcccctgagcgacggccccgagggcagcagcagcagaccccagatgatcagaggcagactgtgcgacgacaccaagcccgagaccttcaaccagctgtggaccgtggaggagcagaagaagctggagcagctgctgatcaagtacccccccgaggaggtggagagcagaagatggcagaagatcgccgacgagctgggcaacagaaccgccaagcaggtggccagcagagtgcagaagtacttcatcaagctgaccaaggccggcatccccgtgcccggcagaacccccaacctgtacatctacagcaagaagagcagcaccagcagaagacagcaccccctgaacaagcacctgttcaagcccagcaccttcatgaccagccacgagccccccgtgtacatggacgaggacgacgacagaagctgcttccacagccacatgaacaccgccgtggaggacgccagcgacgacgagagcatccccatcatgtacagaaacctgcccgagtacaaggagctgctgcagttcaagaagctgaagaagcagaagctgcagcagatgcaggccgagagcggcttcgtgcagcacgtgggcttcaagtgcgacaactgcggcatcgagcccatccagggcgtgagatggcactgccaggactgcccccccgagatgagcctggacttctgcgacagctgcagcgactgcctgcacgagaccgacatccacaaggaggaccaccagctggagcccatctacagaagcgagaccttcctggacagagactactgcgtgagccagggcaccagctacaactacctggaccccaactacttccccgccaacagatag

SEQ ID NO: 11225 - DNA, 2712 bp, Artificial Sequence
  Description of Artificial Sequence: Synthetic coding sequence
atggccgccagcagaagcaccagagtgaccagaagcaccgtgggcctgaacggcctggacgagagcttctgcggcagaaccctgagaaacagaagcatcgcccaccccgaggagatcagcagcaacagccaggtgagaagcagaagccccaagaagagacccgagcccgtgcccatccagaagggcaacaacaacggcagaaccaccgacctgaagcagcagagcaccagagagagctgggtgagccccagaaagagaggcctgagcagcagcgagaaggacaacatcgagagacaggccatcgagaactgcgagagaagacagaccgagcccgtgagccccgtgctgaagagaatcaagagatgcctgagaagcgaggcccccaacagcagcgaggaggacagccccatcaagagcgacaaggagagcgtggagcagagaagcaccgtggtggacaacgacgccgacttccagggcaccaagagagcctgcagatgcctgatcctggacgactgcgagaagagagagatcaagaaggtgaacgtgagcgaggagggccccctgaacagcgccgtggtggaggagatcaccggctacctggccgtgaacggcgtggacgacagcgacagcgccgtgatcaactgcgacgactgccagcccgacggcaacaccaagcagaacagcatcggcagctacgtgctgcaggagaagagcgtggccgagaacggcgacaccgacacccagaccagcatgttcctggacagcagaaaggaggacagctacatcgaccacaaggtgccctgcaccgacagccaggtgcaggtgaagctggaggaccacaagatcgtgaccgcctgcctgcccgtggagcacgtgaaccagctgaccaccgagcccgccaccggccccttcagcgagacccagagcagcctgagagacagcgaggaggaggtggacgtggtgggcgacagcagcgccagcaaggagcagtgcaaggagaacaccaacaacgagctggacaccagcctggagagcatgcccgccagcggcgagcccgagcccagccccgtgctggactgcgtgagcgcccagatgatgagcctgagcgagccccaggagcacagatacaccctgagaaccagccccagaagagccgcccccaccagaggcagccccaccaagaacagcagcccctacagagagaacggccagttcgaggagaacaacctgagccccaacgagaccaacgccaccgtgagcgacaacgtgagccagagccccaccaaccccggcgagatcagccagaacgagaagggcatctgctgcgacagccagaacaacggcagcgagggcgtgagcaagccccccagcgaggccagactgaacatcggccacctgcccagcgccaaggagagcgccagccagcacatcaccgaggaggaggacgacgaccccgacgtgtactacttcgagagcgaccacgtggccctgaagcacaacaaggactaccagagactgctgcagaccatcgccgtgctggaggcccagagaagccaggccgtgcaggacctggagagcctgggcagacaccagagagaggccctgaagaaccccatcggcttcgtggagaagctgcagaagaaggccgacatcggcctgccctacccccagagagtggtgcagctgcccgagatcgtgtgggaccagtacacccacagcctgggcaacttcgagagagagttcaagaacagaaagagacacaccagaagagtgaagctggtgttcgacaaggtgggcctgcccgccagacccaagagccccctggaccccaagaaggacggcgagagcctgagctacagcatgctgcccctgagcgacggccccgagggcagcagcagcagaccccagatgatcagaggcagactgtgcgacgacaccaagcccgagaccttcaaccagctgtggaccgtggaggagcagaagaagctggagcagctgctgatcaagtacccccccgaggaggtggagagcagaagatggcagaagatcgccgacgagctgggcaacagaaccgccaagcaggtggccagcagagtgcagaagtacttcatcaagctgaccaaggccggcatccccgtgcccggcagaacccccaacctgtacatctacagcaagaagagcagcaccagcagaagacagcaccccctgaacaagcacctgttcaagcccagcaccttcatgaccagccacgagccccccgtgtacatggacgaggacgacgacagaagctgcttccacagccacatgaacaccgccgtggaggacgccagcgacgacgagagcatccccatcatgtacagaaacctgcccgagtacaaggagctgctgcagttcaagaagctgaagaagcagaagctgcagcagatgcaggccgagagcggcttcgtgcagcacgtgggcttcaagtgcgacaactgcggcatcgagcccatccagggcgtgagatggcactgccaggactgcccccccgagatgagcctggacttctgcgacagctgcagcgactgcctgcacgagaccgacatccacaaggaggaccaccagctggagcccatctacagaagcgagaccttcctggacagagactactgcgtgagccagggcaccagctacaactacctggaccccaactacttccccgccaacagatag

SEQ ID NO: 11226 - DNA, 111 bp, Artificial Sequence
  Description of Artificial Sequence: Synthetic coding sequence
atggccgccagcagaagcaccagagtgaccagaagcaccgtgggcctgaacggcctggacgagagcttctgcggcagaaccctgagaaacagaagcatcgcccacccctag

SEQ ID NO: 11227 - DNA, 177 bp, Artificial Sequence
  Description of Artificial Sequence: Synthetic coding sequence
atggccgccagcagaagcaccagagtgaccagaagcaccgtgggcctgaacggcctggacgagagcttctgcggcagaaccctgagaaacagaagcatcgcccaccccgaggagatcagcagcaacagccaggtgagaagcagaagccccaagaagagacccgagcccgtgccctag

SEQ ID NO: 11228 - DNA, 381 bp, Artificial Sequence
  Description of Artificial Sequence: Synthetic coding sequence
atgagcgtgatggacctggccaacacctgcagcagcttccagagcgacctggacttctgcagcgactgcggcagcgtgctgcccctgcccggcgcccaggacaccgtgacctgcatcagatgcggcttcaacatcaacgtgagagacttcgagggcaaggtggtgaagaccagcgtggtgttccaccagctgggcaccgccatgcccatgagcgtggaggagggccccgagtgccagggccccgtggtggacagaagatgccccagatgcggccacgagggcatggcctaccacaccagacagatgagaagcgccgacgagggccagaccgtgttctacacctgcaccaactgcaagttccaggagaaggaggacagctag

SEQ ID NO: 11229 - DNA, 381 bp, Artificial Sequence; identical to SEQ ID NO: 11228
  Description of Artificial Sequence: Synthetic coding sequence

SEQ ID NO: 11230 - DNA, 381 bp, Artificial Sequence; identical to SEQ ID NO: 11228
  Description of Artificial Sequence: Synthetic coding sequence

SEQ ID NO: 11231 - DNA, 381 bp, Artificial Sequence; identical to SEQ ID NO: 11228
  Description of Artificial Sequence: Synthetic coding sequence

SEQ ID NO: 11232 - DNA, 381 bp, Artificial Sequence; identical to SEQ ID NO: 11228
  Description of Artificial Sequence: Synthetic coding sequence

SEQ ID NO: 11233 - DNA, 381 bp, Artificial Sequence; identical to SEQ ID NO: 11228
  Description of Artificial Sequence: Synthetic coding sequence

SEQ ID NO: 11234 - DNA, 381 bp, Artificial Sequence; identical to SEQ ID NO: 11228
  Description of Artificial Sequence: Synthetic coding sequence

SEQ ID NO: 11235 - DNA, 381 bp, Artificial Sequence; identical to SEQ ID NO: 11228
  Description of Artificial Sequence: Synthetic coding sequence

SEQ ID NO: 11236 - DNA, 381 bp, Artificial Sequence; identical to SEQ ID NO: 11228
  Description of Artificial Sequence: Synthetic coding sequence

SEQ ID NO: 11237 - DNA, 381 bp, Artificial Sequence; identical to SEQ ID NO: 11228
  Description of Artificial Sequence: Synthetic coding sequence

SEQ ID NO: 11238 - DNA, 381 bp, Artificial Sequence; identical to SEQ ID NO: 11228
  Description of Artificial Sequence: Synthetic coding sequence

SEQ ID NO: 11239 - DNA, 381 bp, Artificial Sequence; identical to SEQ ID NO: 11228
  Description of Artificial Sequence: Synthetic coding sequence

SEQ ID NO: 11240 - DNA, 381 bp, Artificial Sequence; identical to SEQ ID NO: 11228
  Description of Artificial Sequence: Synthetic coding sequence

SEQ ID NO: 11241 - DNA, 381 bp, Artificial Sequence; identical to SEQ ID NO: 11228
  Description of Artificial Sequence: Synthetic coding sequence

SEQ ID NO: 11242 - DNA, 381 bp, Artificial Sequence; identical to SEQ ID NO: 11228
  Description of Artificial Sequence: Synthetic coding sequence

SEQ ID NO: 11243 - DNA, 381 bp, Artificial Sequence; identical to SEQ ID NO: 11228
  Description of Artificial Sequence: Synthetic coding sequence

SEQ ID NO: 11244 - DNA, 381 bp, Artificial Sequence; identical to SEQ ID NO: 11228
  Description of Artificial Sequence: Synthetic coding sequence

SEQ ID NO: 11245 - DNA, 381 bp, Artificial Sequence; identical to SEQ ID NO: 11228
  Description of Artificial Sequence: Synthetic coding sequence

SEQ ID NO: 11246 - DNA, 381 bp, Artificial Sequence; identical to SEQ ID NO: 11228
  Description of Artificial Sequence: Synthetic coding sequence

SEQ ID NO: 11247 - DNA, 381 bp, Artificial Sequence; identical to SEQ ID NO: 11228
  Description of Artificial Sequence: Synthetic coding sequence

SEQ ID NO: 11248 - DNA, 381 bp, Artificial Sequence; identical to SEQ ID NO: 11228
  Description of Artificial Sequence: Synthetic coding sequence

SEQ ID NO: 11249 - DNA, 381 bp, Artificial Sequence; identical to SEQ ID NO: 11228
  Description of Artificial Sequence: Synthetic coding sequence

SEQ ID NO: 11250 - DNA, 381 bp, Artificial Sequence; identical to SEQ ID NO: 11228
  Description of Artificial Sequence: Synthetic coding sequence

SEQ ID NO: 11251 - DNA, 381 bp, Artificial Sequence; identical to SEQ ID NO: 11228
  Description of Artificial Sequence: Synthetic coding sequence

SEQ ID NO: 11252 - DNA, 381 bp, Artificial Sequence; identical to SEQ ID NO: 11228
  Description of Artificial Sequence: Synthetic coding sequence

SEQ ID NO: 11253 - DNA, 381 bp, Artificial Sequence; identical to SEQ ID NO: 11228
  Description of Artificial Sequence: Synthetic coding sequence

SEQ ID NO: 11254 - DNA, 381 bp, Artificial Sequence; identical to SEQ ID NO: 11228
  Description of Artificial Sequence: Synthetic coding sequence

SEQ ID NO: 11255 - DNA, 381 bp, Artificial Sequence; identical to SEQ ID NO: 11228
  Description of Artificial Sequence: Synthetic coding sequence

SEQ ID NO: 11256 - DNA, 381 bp, Artificial Sequence; identical to SEQ ID NO: 11228
  Description of Artificial Sequence: Synthetic coding sequence

SEQ ID NO: 11257 - DNA, 381 bp, Artificial Sequence; identical to SEQ ID NO: 11228
  Description of Artificial Sequence: Synthetic coding sequence

SEQ ID NO: 11258 - DNA, 381 bp, Artificial Sequence; identical to SEQ ID NO: 11228
  Description of Artificial Sequence: Synthetic coding sequence

SEQ ID NO: 11259 - DNA, 381 bp, Artificial Sequence; identical to SEQ ID NO: 11228
  Description of Artificial Sequence: Synthetic coding sequence

SEQ ID NO: 11260 - DNA, 2133 bp, Artificial Sequence
  Description of Artificial Sequence: Synthetic coding sequence
atggacctgcccgccctgctgcccgcccccaccgccagaggcggccagcacggcggcggccccggccccctgagaagagcccccgcccccctgggcgccagccccgccagaagaagactgctgctggtgagaggccccgaggacggcggccccggcgccagacccggcgaggccagcggccccagccccccccccgccgaggacgacagcgacggcgacagcttcctggtgctgctggaggtgccccacggcggcgccgccgccgaggccgccggcagccaggaggccgagcccggcagcagagtgaacctggccagcagacccgagcagggccccagcggccccgccgccccccccggccccggcgtggcccccgccggcgccgtgaccatcagcagccaggacctgctggtgagactggacagaggcgtgctggccctgagcgccccccccggccccgccaccgccggcgccgccgcccccagaagagccccccaggccagcggccccagcacccccggctacagatgccccgagccccagtgcgccctggccttcgccaagaagcaccagctgaaggtgcacctgctgacccacggcggcggccagggcagaagacccttcaagtgccccctggagggctgcggctgggccttcaccaccagctacaagctgaagagacacctgcagagccacgacaagctgagacccttcggctgccccgtgggcggctgcggcaagaagttcaccaccgtgtacaacctgaaggcccacatgaagggccacgagcaggagagcctgttcaagtgcgaggtgtgcgccgagagattccccacccacgccaagctgagcagccaccagagaagccacttcgagcccgagagaccctacaagtgcgacttccccggctgcgagaagaccttcatcaccgtgagcgccctgttcagccacaacagagcccacttcagagagcaggagctgttcagctgcagcttccccggctgcagcaagcagtacgacaaggcctgcagactgaagatccacctgagaagccacaccggcgagagacccttcatctgcgacagcgacagctgcggctggaccttcaccagcatgagcaagctgctgagacacagaagaaagcacgacgacgacagaagattcacctgccccgtggagggctgcggcaagagcttcaccagagccgagcacctgaagggccacagcatcacccacctgggcaccaagcccttcgagtgccccgtggagggctgctgcgccagattcagcgccagaagcagcctgtacatccacagcaagaagcacgtgcaggacgtgggcgcccccaagagcagatgccccgtgagcacctgcaacagactgttcaccagcaagcacagcatgaaggcccacatggtgagacagcacagcagaagacaggacctgctgccccagctggaggcccccagcagcctgacccccagcagcgagctgagcagccccggccagagcgagctgaccaacatggacctggccgccctgttcagcgacacccccgccaacgccagcggcagcgccggcggcagcgacgaggccctgaacagcggcatcctgaccatcgacgtgaccagcgtgagcagcagcctgggcggcaacctgcccgccaacaacagcagcctgggccccatggagcccctggtgctggtggcccacagcgacatcccccccagcctggacagccccctggtgctgggcaccgccgccaccgtgctgcagcagggcagcttcagcgtggacgacgtgcagaccgtgagcgccggcgccctgggctgcctggtggccctgcccatgaagaacctgagcgacgaccccctggccctgaccagcaacagcaacctggccgcccacatcaccacccccaccagcagcagcacccccagagagaacgccagcgtgcccgagctgctggcccccatcaaggtggagcccgacagccccagcagacccggcgccgtgggccagcaggagggcagccacggcctgccccagagcaccctgcccagccccgccgagcagcacggcgcccaggacaccgagctgagcgccggcaccggcaacttctacctggtgtag

SEQ ID NO: 11261 - DNA, 2577 bp, Artificial Sequence
  Description of Artificial Sequence: Synthetic coding sequence
atggacctgcccgccctgctgcccgcccccaccgccagaggcggccagcacggcggcggccccggccccctgagaagagcccccgcccccctgggcgccagccccgccagaagaagactgctgctggtgagaggccccgaggacggcggccccggcgccagacccggcgaggccagcggccccagccccccccccgccgaggacgacagcgacggcgacagcttcctggtgctgctggaggtgccccacggcggcgccgccgccgaggccgccggcagccaggaggccgagcccggcagcagagtgaacctggccagcagacccgagcagggccccagcggccccgccgccccccccggccccggcgtggcccccgccggcgccgtgaccatcagcagccaggacctgctggtgagactggacagaggcgtgctggccctgagcgccccccccggccccgccaccgccggcgccgccgcccccagaagagccccccaggccagcggccccagcacccccggctacagatgccccgagccccagtgcgccctggccttcgccaagaagcaccagctgaaggtgcacctgctgacccacggcggcggccagggcagaagacccttcaagtgccccctggagggctgcggctgggccttcaccaccagctacaagctgaagagacacctgcagagccacgacaagctgagacccttcggctgccccgtgggcggctgcggcaagaagttcaccaccgtgtacaacctgaaggcccacatgaagggccacgagcaggagagcctgttcaagtgcgaggtgtgcgccgagagattccccacccacgccaagctgagcagccaccagagaagccacttcgagcccgagagaccctacaagtgcgacttccccggctgcgagaagaccttcatcaccgtgagcgccctgttcagccacaacagagcccacttcagagagcaggagctgttcagctgcagcttccccggctgcagcaagcagtacgacaaggcctgcagactgaagatccacctgagaagccacaccggcgagagacccttcatctgcgacagcgacagctgcggctggaccttcaccagcatgagcaagctgctgagacacagaagaaagcacgacgacgacagaagattcacctgccccgtggagggctgcggcaagagcttcaccagagccgagcacctgaagggccacagcatcacccacctgggcaccaagcccttcgagtgccccgtggagggctgctgcgccagattcagcgccagaagcagcctgtacatccacagcaagaagcacgtgcaggacgtgggcgcccccaagagcagatgccccgtgagcacctgcaacagactgttcaccagcaagcacagcatgaaggcccacatggtgagacagcacagcagaagacaggacctgctgccccagctggaggcccccagcagcctgacccccagcagcgagctgagcagccccggccagagcgagctgaccaacatggacctggccgccctgttcagcgacacccccgccaacgccagcggcagcgccggcggcagcgacgaggccctgaacagcggcatcctgaccatcgacgtgaccagcgtgagcagcagcctgggcggcaacctgcccgccaacaacagcagcctgggccccatggagcccctggtgctggtggcccacagcgacatcccccccagcctggacagccccctggtgctgggcaccgccgccaccgtgctgcagcagggcagcttcagcgtggacgacgtgcagaccgtgagcgccggcgccctgggctgcctggtggccctgcccatgaagaacctgagcgacgaccccctggccctgaccagcaacagcaacctggccgcccacatcaccacccccaccagcagcagcacccccagagagaacgccagcgtgcccgagctgctggcccccatcaaggtggagcccgacagccccagcagacccggcgccgtgggccagcaggagggcagccacggcctgccccagagcaccctgcccagccccgccgagcagcacggcgcccaggacaccgagctgagcgccggcaccggcaacttctacctggagagcggcggcagcgccagaaccgactacagagccatccagctggccaaggagaagaagcagagaggcgccggcagcaacgccggcgccagccagagcacccagagaaagatcaaggagggcaagatgagccccccccacttccacgccagccagaacagctggctgtgcggcagcctggtggtgcccagcggcggcagacccggccccgcccccgccgccggcgtgcagtgcggcgcccagggcgtgcaggtgcagctggtgcaggacgaccccagcggcgagggcgtgctgcccagcgccagaggccccgccaccttcctgcccttcctgaccgtggacctgcccgtgtacgtgctgcaggaggtgctgcccagcagcggcggccccgccggccccgaggccacccagttccccggcagcaccatcaacctgcaggacctgcagtag

SEQ ID NO: 11262 - DNA, 546 bp, Artificial Sequence
  Description of Artificial Sequence: Synthetic coding sequence
atgatggataacagagggaattcctcacttccagataagctcccaatttttccggatagtgctagactcccactgaccaggagtttctatttggagcccatggtgacgtttcacgtccaccctgaagcccctgtttccagcccctactcagaagaactgcctcgtctcccctttccatcggatagtctgattctggggaattatagtgagccttgcccattttcattccccatgccctacccgaactatcgcggatgtgaatattcatacggccccgcctttaccagaaagaggaatgagagggaacggcagagggtgaagtgcgtcaacgaggggtatgcacagctccgtcatcacttgccagaagagtatctcgaaaaacgtttaagcaaggtggaaaccctgagagctgcgatcaaatacatcaactacctccagtccctcctttacccagataaagccgaaacgaaaaataaccccggtaaggtctcaagcatgatcgctaccacctctcaccacgcagaccctatgttcaggattgtgtag

SEQ ID NO: 11263 - DNA, 546 bp, Artificial Sequence
  Description of Artificial Sequence: Synthetic coding sequence
atgatggataaccggggaaacagcagccttccagacaaactccctattttcccggattccgcaagacttccgctgacccggagcttttatctggagccaatggtgacttttcacgttcatccagaagctcctgtttccagcccttattccgaagagctgccccgcctgccctttcccagtgatagtctcatacttggcaattatagcgagccttgccctttttcttttccaatgccatatccgaattaccgcggatgcgagtactcgtacggccctgcatttactcgaaagagaaatgagagggagagacagagagtgaagtgcgttaacgaaggatacgcacagttacgtcatcatctgcctgaggagtaccttgaaaagaggctgtctaaggtggagacactgcgagccgcaataaagtacatcaactatctgcagagcctactgtaccccgataaagccgagaccaagaataatcccggtaaagtgagcagtatgattgccactacttcacaccacgcagatccaatgtttcgcatcgtctag

SEQ ID NO: 11264 - DNA, 522 bp, Artificial Sequence
  Description of Artificial Sequence: Synthetic coding sequence
atgatggagacaagaaagcccgcggagcgtctcgccctgccctacagtttacggacggcccccctgggcgtccccggcaccctccctggcctcccaaggcgcgatccactacgtgtggctctgcgcctggacgctgcctgttgggagtgggcacggtcgggctgcgctaggggctggcagtacctcccagttcctctggatagcgctttcgagcccgcgtttcttaggaaacgaaatgaacgcgagaggcagagggtaaggtgcgttaatgaaggctatgctcgactccgagaccaccttccacgcgagttagctgacaaaaggctgagcaaggtggagaccttgcgcgcggctattgactacattaagcacctccaagagctgctcgagagacaggcctgggggcttgagggggcagcaggggctgtgccacagagacgcgcggagtgtaacagcgacggggaaagcaaagcctcgtccgccccaagcccatcttcagagcccgaggagggcggtagttag

SEQ ID NO: 11265 - DNA, 819 bp, Artificial Sequence
  Description of Artificial Sequence: Synthetic coding sequence
atggaggccgaagagtcagagaaggctgcaacagaacaggaacccctggagggcacagagcaaaccctggatgcagaggaggagcaggaggaatctgaagaggccgcatgtgggtcaaagaagcgcgtagtacccggtatagtatacttggggcacatcccccctcggttccggccactacatgtgagaaatttgttgagcgcttacggcgaagtgggacgggtgtttttccaggccgaggacaggtttgtaagacggaaaaagaaggcagccgctgctgcaggcggaaaaaaaagatcgtatacaaaggactataccgagggatgggttgagttcagagataagcgtatcgcgaagagagtggcggccagtctacacaatacccccatgggtgcccggcgccggagccccttccgttacgacttatggaacttgaaatatctgcaccgatttacttggtcacatttaagcgaacacctagccttcgagaggcaagtccggcgccagagacttcgggccgaagtggcccaagcaaaaagggaaaccgacttctatttgcaatccgtagagcgcgggcagagatttctagctgcggatggagaccctgcacgacctgacggtagttggacattcgcccagcgcccgaccgaacaggaattgagagccagaaaagcagctcggccgggaggcagagaacgcgcccgcctggccactgcgcaggataaagcccggagcaataagggccttcttgcaaggatctttggggctcctccaccaagtgagagcatggaaggcccgagtctggtgcgggatagctag

SEQ ID NO: 11266 - DNA, 3396 bp, Artificial Sequence
  Description of Artificial Sequence: Synthetic coding sequence
atgttccagatccctgtggaaaacttagataacatccgaaaggtgcggaaaaaggtcaagggcatcctggtcgacatcggcctggacagctgcaaggagttgcttaaggacttaaaaggcttcgatcctggcgagaagtatttccacaacaccagttggggggatgtttctttgtgggagccctccgggaagaaagtccggtacagaaccaaaccctactgctgcgggctgtgcaaatactcgaccaaagttcttactagcttcaagaaccacctgcacagatatcatgaagatgaaatcgatcaggaactcgtgatcccctgccctaattgtgtctttgcaagccagccaaaggtcgtcggaaggcattttagaatgttccatgcccctgtacgtaaagttcagaactacactgtgaacattctaggtgagacaaagagcagtcgatctgacgttatatctttcacgtgcctgaagtgcaacttcagtaataccctttattattccatgaaaaagcacgttctcgtggcacacttccactatctgattaatagctacttcggacttcgcaccgaagaaatgggcgaacagccaaagacaaatgatacagttagtatcgaaaagatcccacctcccgacaagtattattgcaagaagtgtaacgccaatgcatcaagccaggatgcccttatgtatcacattctgacttctgatatccatcgggacttggagaataagttgcggagtgtcataagcgaacatatcaaacgaacaggacttctgaagcagactcacatagcccctaaaccggcagcacacctcgcagctcctgccaacggaagcgccccatccgccccggcccaacccccctgtttccacctggctcttccgcagaactccccctcacccgccgctggtcagccagtgaccgttgcacaaggcgcccccgggagcctcacccacagccccccagctgccggacagtcccatatgacacttgtgtcaagccctcttcctgtggggcagaactccctgactttacagccccctgcaccacagcctgtctttctcagccacggagttccccttcatcagtccgtgaatccacctgtgctgccactctctcaacccgtaggacccgtaaataagagcgtcggtacctctgtgctcccaattaatcagactgtgaggcccggagtcctgcctctgactcaacccgtggggccaatcaatagaccagtgggaccaggggtactgcccgtcagcccctccgttaccccaggggtgctgcaagccgtgtcccccggggtgctgtccgtatccagagctgttccctcaggggtgctgcctgccggacagatgacgccagccggacagatgacacctgcgggagtcataccaggccagacggcgacgtctggggtccttcccactgggcagatggttcagagcggcgtactgcctgttggacagaccgccccatcccgcgtcctgccacctggacagaccgcaccgctgcgcgtgatctccgccggacaggtggttccatccggcctactcagtcccaaccagaccgtctcttcgtccgctgtagtcccagttaatcagggggtgaatagcggagtgttacagctgtcacaaccagtagtgtctggcgtgcttccagttggacagcccgtccggccaggggtgctgcaactgaatcagacagtgggtactaacattctcccggtaaaccagccagttcgccctggggcaagccagaatacaacttttctcacctcaggatctattctgagacagctgatcccaacggggaagcaggtgaatggcatacctacatacaccctggcccccgtgagcgtgacactgccagtgcccccagggggactagccactgtcgctcccccacagatgcccatccagctgctcccatctggagctgcggcccccatggcaggctccatgccaggcatgccatctcctccagtactcgtgaacgctgctcagtcagtcttcgtgcaggccagctcaagcgcagcagatacaaaccaggtgctcaaacaggcaaagcaatggaagacatgccccgtatgcaacgagctgttccccagtaacgtctatcaggtgcatatggaagtggcccacaagcatagcgagagcaagtcaggggagaaactcgagcccgaaaaacttgcagcctgcgcaccgttcttgaagtggatgagagaaaaaaccgttagatgtttgtcttgcaaatgtctggtatcggaagaggagttgattcaccacctccttatgcatggattggggtgcttgttttgtccttgtaccttccatgacataaagggtctgtccgagcactctagaaatagacacctgggtaaaaaaaagctgccaatggattattcaaatagaggcttccaactcgacgttgatgcgaacgggaatcttctctttcctcacctggacttcattacaatccttcccaaggagaagttaggcgagagagaagtctacctcgcgatcctcgccggcattcacagcaagagtttggtaccagtgtatgtaaaggttaggcctcaagcggagggcacccccggtagcaccggcaagagggtgtcaacatgcccattctgttttgggccctttgtcacgacagaggcctacgaactccatctgaaagagcgtcaccacattatgcctacagtgcacacagtgttgaaatctcccgcatttaagtgcattcattgctgcggggtgtatactggcaacatgaccctggctgccatagcagttcacttagtgcgctgccggtcagctccgaaggatagtagttcagacttgcaagcccagccaggcttcatacataattctgaactcctgctggtatcaggtgaggtcatgcacgactcaagcttcagtgttaagaggaaacttcccgatgggcatttgggagccgaagaccagcgccacggtgaggaacagcctcccatactgaacgcggacgctgcccctgggcctgagaaggtaactagcgtggtgcccttcaagcgccagaggaacgagtcacggacggaaggccccatcgtcaaggatgaggccctgcagatcctggcccttgacccaaagaaatatgaaggtagatcgtacgaagagaagaagcagttcctgaaggactatttccacaaaaagccatacccctctaagaaagaaattgagttgctgagtagtctcttctgggtgtggaagatcgatgtggcgtcgttttttggaaaacgcaggtacatctgcatgaaggcaatcaaaaaccacaagccatccgtactccttggtttcgatatgtcagaactaaagaatgtgaagcaccggttgaatttcgaatacgagccctag

SEQ ID NO: 11267 - DNA, 516 bp, Artificial Sequence
  Description of Artificial Sequence: Synthetic coding sequence
atgttccagattccggtggaaaatctcgataatattcggaaggtcagaaagaaagtgaaaggcatcctggttgacattgggcttgactcatgtaaagaactgctgaaggacctgaagggctttgatccaggtgaaaagtattttcacaatacgtcttggggggacgtgtcactatgggagccctcagggaagaaagtcaggtacagaacaaagccttactgttgtggcctgtgcaaatactccactaaagtcctcacgtcctttaagaaccacctgcatcggtatcacgaagatgagatcgaccaagaactcgtcatcccctgtccaaactgcgtttttgcgagccagccgaaagtggttggcagacattttcggatgttccacgcccctgtccggaaggtgcagaactacaccgtgaacatcctcggtgaaaccaagtctagtcggagcgatgtgattagctttacgtgcctgaagtgcaatttcagcaacacactgtattactcaatgaaatag

SEQ ID NO: 11268 - DNA, 1512 bp, Artificial Sequence
  Description of Artificial Sequence: Synthetic coding sequence
atggcagccgctattactgacatggccgacctggaggaactgtctcgcctgtcccccctcccgcccggaagtccaggatctgcggcccgcgggagggccgagcctccagaggaggaggaggaggaggaagaagaggaagaggaggcagaggctgaggctgtcgctgcactgctcctgaacggtggctctgggggcggtggcggaggcgggggcggtggggttggcggtggcgaagctgagaccatgtcagaaccatcccctgagtcagcctcacaggccggcgaagatgaagatgaggaggaggacgatgaagaagaggaggacgagtccagcagttccgggggaggcgaggaggagtcctctgccgaaagcctcgttggctctagcggcggatcgagtagtgacgagacacgttccctctcccctggtgcagcttcctctagcagcggcgacggagacgggaaggaagggttggaagaaccaaaaggcccacggggctcgcagggtggcggcggaggtggaagcagtagttcatctgtggtatctagcggtggcgatgagggctatggcacggggggcggggggtcgtcagctaccagtggcggaagacggggatcgctagaaatgtccagtgacggtgaacctctgagcagaatggacagtgaagactcaatctcatcaaccatcatggatgtggatagcactataagctcaggccgatcaacacccgcaatgatgaacggccagggctcaaccacctcatctagcaaaaatatagcctataactgttgctgggaccaatgccaggcatgttttaattcttcccccgacctggccgaccatatacgctccatccacgtggacggacaacgcggcggagtgttcgtctgcctctggaaaggatgcaaggtctataatacccctagcacaagtcagtcctggctgcagcgccacatgttgacacatagcggagacaaaccttttaaatgcgtggttggtggctgtaatgcctcattcgcatcacagggtggtctcgcccggcacgtgccgacacacttttcccagcagaattcctcaaaggtgagctctcagccaaaggccaaagaggaatctccaagtaaagcagggatgaacaagagacggaagctgaaaaacaagcgccgccgctcactccctaggccacacgactttttcgatgcacagaccctggacgccatcagacatcgggcaatctgctttaatttgtccgcgcatatagaaagtctaggaaaaggacactcagtggtgtttcatagcacagtgattgcaaagagaaaggaggattcaggcaagatcaaacttttgctgcactggatgcctgaagacattttaccagatgtgtgggtcaatgaaagtgagcgccaccagttgaagaccaaggttgtgcacctgagtaagctgccgaaagataccgctctccttctggatcccaacatatatcggaccatgcctcaaaagagactaaagcgctag

SEQ ID NO: 11269 - DNA, 906 bp, Artificial Sequence
  Description of Artificial Sequence: Synthetic coding sequence
atgtacaccagacgatacagttctatatcatccactattatggacgtggactccactatctcgtccggacgcagcacccctgccatgatgaacggacaggggtctactacctccagtagcaagaacattgcatataattgttgttgggatcagtgtcaggcctgtttcaatagcagcccagacttagccgaccacatccgatctattcatgtagacggccaaaggggaggagtgttcgtatgcctttggaaggggtgtaaggtatacaacaccccatctacttctcaatcttggctccagcgccatatgttgacacactccggggataagcccttcaaatgcgttgtcggaggatgtaatgccagtttcgcttcacaaggtggattggcccgccacgtgccaacacatttctctcagcaaaattccagtaaggtctctagccagcctaaagcgaaggaagagagccccagcaaagcaggtatgaataaacggcggaagttgaagaataaaagacgaagatctttgccccggcctcatgacttttttgatgcacaaacactggacgcgatccggcacagggctatatgcttcaatttgagcgctcacattgagagcctgggtaagggccactccgtcgtgttccacagcacggtgatcgccaaaaggaaggaagatagcggcaaaataaagctgctgctgcactggatgccagaagacatactgccggatgtctgggtgaatgagagcgagagacaccagctgaagacaaaggtcgtgcatctgtcaaaactgcccaaggatactgccttacttctcgaccccaacatctaccggaccatgccacagaagcggcttaaaagaaccctgatccgaaaggtgttcaatttgtatctttccaaacagtag

SEQ ID NO: 11270 - DNA, 1554 bp, Artificial Sequence
  Description of Artificial Sequence: Synthetic coding sequence
atggctgccgccatcacggatatggctgacctggaagagttgtctaggcttagccctttgcctccagggagccccggctccgcagccagggggcgcgccgaaccccctgaggaagaggaggaagaggaagaagaagaggaggaggctgaagcggaagccgtggcggccctgctcttgaatggcggtagtgggggcggcggcgggggcggcggtggaggcgtcggcggcggagaagctgaaactatgtctgaaccaagcccagagtccgctagccaggcaggggaggatgaggatgaggaagaggatgacgaggaggaggaagatgaaagtagcagcagcgggggcggcgaggaggaatccagtgcagaaagcctggtgggcagctctggtggctcctcttccgacgagacacggagtctttcacctggcgccgctagcagttcctctggcgacggcgacggcaaggaaggcctcgaagaacctaaaggtccacgcggatcgcaggggggcggcggcgggggctccagttcgtcgagtgtcgtgtccagcggcggagatgagggatacggcaccggaggtggaggttcgtcggccacgtccggaggaagaagaggatcattagaaatgagcagcgatggagaacccctgagtagaatggactccgaggactcaatttcatcaacaataatggatgtggactccaccatatcctccggccggagtactcccgctatgatgaatggccaaggaagtaccacaagttccagtaaaaacatcgcttacaactgctgctgggatcagtgccaagcatgcttcaattcaagcccggacctcgctgaccacatccgctcaattcacgtagacgggcaaaggggaggcgtgttcgtttgtctctggaaggggtgcaaagtgtataataccccctccacatcccagtcttggctccagcgacacatgttaacacactctggagacaaacccttcaaatgtgtggtgggaggctgcaacgcaagctttgctagccagggcggtctagcgagacatgtgccaactcacttctcccagcagaacagcagtaaagtgagcagccagccaaaagccaaggaggagtccccctctaaagccggcatgaacaagcgccgcaaactcaaaaacaagcgcagacgatccctccccaggccgcatgatttcttcgatgcgcaaaccctggacgccattcgacacagagcaatttgctttaatttgtccgcccacatcgagtctctgggtaagggtcatagcgtggtgttccacagtaccgtgatcgccaaacgcaaagaggattccggtaagatcaaattactgctccactggatgcccgaagatatattgcctgacgtgtgggtgaacgagagcgaacgtcaccagctgaagactaaggttgtacacctctctaagcttcctaaggacaccgcactgttactcgatccaaatatttatcggactatgccacagaagaggcttaaaaggaccctcataagaaaagtcttcaacctctatctgagtaaacaatag

SEQ ID NO: 11271 - DNA, 1314 bp, Artificial Sequence
  Description of Artificial Sequence: Synthetic coding sequence
atggctgcggccataacggatatggcagacctggaagagctgagtcgcctgagtcctttgcctcccggctccccaggaagtgctgcaaggggccgggctgagccccccgaggaggaagaggaggatgagagtagctcgtccgggggcggggaggaggaatccagtgctgagtctctcgtcggcagttccggcgggagctccagtgatgagaccagatctctctctcctggcgctgcttcatcaagttcgggagatggcgatggtaaggagggcctggaggagcccaaggggcccaggggatcacagggaggaggcggggggggatcatccagctctagtgtggttagcagcggtggtgacgagggctacgggaccgggggcgggggcagctccgccacgtcaggcggcagacgtggctcactagagatgagctcagacggagagcctctaagcaggatggatagtgaggattctatcagttctactattatggatgtggattctaccatctcttccggtaggagcacccctgccatgatgaacggacagggcagtacaacctcatcatcaaaaaacatagcgtacaactgttgctgggaccaatgccaggcctgtttcaatagctctccggaccttgccgaccacattcggagcatacacgtggacgggcaacggggcggtgtgtttgtttgcctttggaagggctgtaaggtttataacactccatctacttcccagagctggcttcaacggcatatgctgacacactctggagataagccattcaaatgcgttgtgggtggatgtaacgcctcgttcgcctcccaaggcggcttggcccggcacgtccctacacatttctcccagcagaattcctctaaagtgtccagccagcccaaggccaaagaagaatctccttcaaaagccggaatgaataaacggagaaaactcaaaaataagcgcaggcgttcactaccacgccctcacgacttcttcgatgcacagactctggacgcaatcagacatagggcaatctgttttaatttgagtgcccatatcgaaagtctgggaaaggggcattccgtcgtttttcatagtaccgtgatcgcaaagagaaaggaggatagcggaaagattaaattactcttgcattggatgccggaagacattctgcccgatgtctgggttaacgagtctgagcggcatcagttgaagacgaaggtcgtgcacctgagcaagttgcccaaggacacagctttactcctggatcctaatatctaccggaccatgccgcagaaacgcttaaaaagatag

SEQ ID NO: 11272 - DNA, 3681 bp, Artificial Sequence
  Description of Artificial Sequence: Synthetic coding sequence
atggactctttcgacctagccctgttacaagagtgggatctcgagagcctttgtgtatatgagccagacagaaacgccctgcgaaggaaggaaagggagcggcggaaccaggagactcagcaggacgacggtactttcaacagctcttactctctcttttccgagccctataagacaaataagggagacgaactgagcaaccggatacagaacacattgggcaattacgacgaaatgaaggactttttaacagatcgctctaatcagtcacacttagtcggagttcccaagcccggagtgccacagacccccgtgaacaagattgacgagcactttgtggctgacagtcgcgcacagaaccaaccgtcaagtatatgtagtaccaccacctccacaccagcggccgttcctgtgcaacagtcaaaacgcggcaccatgggatggcagaaagcaggacaccccccctctgacggacagcagagagctactcagcagggctccttgcgcaccctgcttggcgatggggtaggccggcaacagccgcgcgcaaaacaggtgtgcaatgtggaggttggcttgcaaacacaggagaggccccctgcaatggccgcaaagcacagcagcagtggtcactgcgtccagaatttcccccctagtttggccagcaagccatctctggtacaacagaaacctacagcctacgttaggccaatggacggccaggatcaagcaccggatgagagtcccaagttgaaatcctcaagtgagacgtccgtgcactgtacatcataccgtggcgttcctgctagtaagccggaaccagccagggctaaagctaaactgtcaaaattttccattcccaagcagggcgaagagtctcgatcaggtgaaaccaacagttgtgtggaggaaattatacgcgagatgacctggctgccaccactttccgccattcaggctccagggaaggtggagccaaccaaatttccttttcctaacaaagattcacaattagtgagctccggtcacaataacccgaaaaagggtgacgccgaacccgagtcgccggacagtgggacatcaaacaccagtatgctggaggatgatctcaagctgagcagcgacgaggaagagaacgaacagcaggccgcccagcggaccgccttgagggcccttagcgattctgctgttgttcagcagcctaactgccggaccagtgtaccgtcttcgaagggtagttccagtagctcctcttccggctcatcgagcagctcttcagactcggaatctagcagcggatctgattctgagacagaatcgtcttcctcggaaagcgaaggctccaagccaccccacttttcctctcctgaagctgaaccagcttccagtaacaagtggcagctggacaagtggctcaataaagtgaaccctcataaaccccccattctgattcaaaacgagtcccacgggtccgaaagcaatcagtactacaatcccgtcaaagaagatgtacaggattgcggaaaggttcccgatgtgtgccagccctccctcagagagaaagaaatcaagagcacatgtaaggaggaacagagaccgcgaaccgcaaacaaagcaccaggtagtaaaggcgtaaagcagaaatcccctccagcggctgtggctgtggctgtgagtgcagccgctcccccgccggcagtcccatgcgccccggccgagaacgctccagcccccgcacggcgttcagcgggtaaaaagcccacaaggaggactgagcgcacaagtgccggcgatggggcaaactgtcaccgccccgaagaacccgctgccgccgatgctctaggcacatccgtggttgtcccccctgagcccacgaaaacccggccttgtggaaacaatagagcctcccatcgcaaagaactgcggagttcagtcacatgcgaaaagcgcaggacccgcggactgagtcgcatcgtgcctaaatcaaaagagttcattgagactgagtcaagtagctcttcctcaagctcggatagtgacctggagtcagagcaggaggagtatcctctcagcaaagctcagacagttgcagcctcagcaagttcgggaaatgaccaacgcctgaaagaagcggcggccaacggtggctccggccctcgggccccagtaggatccatcaacgctcggaccaccagcgatatcgccaaggaactggaagagcagttttacacccttgttccttttggccgaaatgaactgctgtcgcctcttaaggacagcgatgaaatacgctctctgtgggtcaagattgatttgacgctgctgtcccggataccagaacatttacctcaggagccaggagtgcttagtgcgcccgccaccaaagacagcgagagcgctcctccaagtcacacgagcgacacgcccgcggagaaggcccttcctaagtccaaaaggaagcgcaaatgcgataacgaggacgattacagggagatcaaaaaaagtcagggcgagaaagacagctcctctagactcgctacctctacatccaacacactgtctgcaaatcattgcaacatgaatatcaacagtgtggccatccctatcaacaagaatgagaagatgttacgatctcctatctctcctcttagcgacgcctccaagcacaaatacacctcggaagacctcacaagcagctccaggcccaacggcaacagcttattcacctctgcaagttcctccaagaagcctaaggctgattcccagttgcaacctcacgggggggatttgacgaaggccgcccacaataacagtgagaatatcccgctccacaaatctcggccacaaaccaagccgtggtcccctggcagtaatgggcatcgggattgtaagagacagaagcttgtgttcgacgatatgcctcgctccgccgattatttcatgcaagaagccaaacgcatgaagcacaaagctgacgccatggtagaaaaatttgggaaagcacttaactacgccgaagcggccctgagtttcatagagtgcggtaacgccatggagcagggtccaatggaatctaagtcaccctatactatgtacagcgagacggtcgaactgatccggtacgctatgcgcctaaagacacacagtggacctaatgctacccctgaggataagcagctcgccgccttgtgttataggtgtctcgcccttttgtattggcgtatgttccggcttaaaagggaccacgccgtgaagtatagcaaagcccttatcgattacttcaagaacagttcaaaggctgcccaggctccaagcccctggggcgcctccgggaagagtaccggaaccccctccccgatgtctcccaacccgagcccagcgtccagcgtagggtctcagggcagtctaagtaacgcttccgctctgtctccatccacgatcgtctctatcccccagcgaatccaccagatggcagccaaccacgtgagcatcaccaattcgattcttcactcctacgactactgggaaatggcagacaatttggctaaggaaaatcgggaatttttcaatgatcttgacctcctgatgggcccagtgaccttacactcttcaatggaacatctggtccagtattcacaacaggggctgcactggctgcggaactcggctcacttgagttag

SEQ ID NO: 11273 - DNA, 3756 bp, Artificial Sequence
  Description of Artificial Sequence: Synthetic coding sequence
atggatagttttgatttagccctcctgcaagaatgggatctagagtcactatggggtgaggatattctgaaccagaggaacgacagtttggtggtcgagtttcagagcagtgcctctagatgcaggtcggtgtacgagccagaccgcaatgcactgcgacggaaagagagagagcgccggaaccaagaaactcagcaggatgacggcaccttcaattcctcctattccctgttctcagagccgtacaaaaccaacaagggtgacgagttaagcaatcggattcagaacacacttgggaattacgacgaaatgaaggattttctcacggaccgatcaaaccagtcacatctcgtgggagtacctaaacctggtgtcccacagaccccagtgaacaagattgatgaacacttcgtggcagatagtagagcccagaatcagcccagttcaatctgctcaactacaaccagtacacccgccgcagtcccagttcagcagtccaagcgaggaacaatgggttggcagaaggccggtcaccctccatcagatgggcaacaacgggcaactcagcagggtagcttgaggacattgttaggcgatggcgtgggccggcagcagccccgggccaagcaagtttgcaacgttgaagtgggactccagacgcaagaaaggcccccggcaatggctgccaagcactcgagttcaggccattgtgttcaaaactttcccccttctctggcctcaaagccgtcactggtacagcaaaaaccaaccgcatatgtccgtcccatggacgggcaggatcaggccccggatgaatcgcccaagctcaagtcctcttcagagacgtctgtccattgcaccagctatagaggtgtgcccgcatcaaaacccgagcctgcccgagccaaggccaagctgagtaagttctctataccaaagcaaggtgaggaatcgcggagtggggaaaccaactcctgcgtggaagaaatcatccgggagatgacttggctgccacctttgagcgctatccaagcccctggcaaggttgaaccaactaagtttccgttccctaataaagactcgcagctggtgagctctgggcataataatcccaaaaagggagacgcagagcctgagtcacctgacagcggcacgagtaacacgtcaatgctggaagatgacttgaaacttagttccgacgaagaagagaatgaacagcaggcagcccaacgtaccgctcttcgggccctgtcggactctgccgtggtgcagcagcctaattgcagaaccagcgttccaagctccaaaggctctagttcaagtagcagttcgggatcttcaagctcttcttcggactctgagtcatccagcgggtccgatagcgagactgagagttcctcgtcagaatctgaaggctctaaaccccctcatttctcttctcccgaggccgagccagcctcctctaacaagtggcaactagacaagtggcttaataaggtgaatccccacaagccccccatccttattcaaaacgagtctcatggaagtgagtctaaccagtactacaatcccgtaaaggaggacgttcaggactgcggcaaagtgcccgatgtgtgccagccctctttacgggaaaaggagattaaatctacatgtaaggaggagcagaggccacgcacagcgaataaggccccaggttcaaagggcgtaaagcagaagtcaccacctgcagccgtcgccgtggccgttagcgctgccgccccgccacccgcagtgccatgtgcgcccgccgagaatgctccggccccagcccggcgctcggccggaaagaaaccaaccaggcgcacagagcgaaccagcgcaggcgacggggccaattgccaccggcccgaagagcccgccgccgccgacgcacttgggacctccgtggtcgtccctccagagccaacgaagactcggccttgcgggaataacagagcctctcaccgcaaggaattgcgatcatccgtgacttgcgagaagaggagaacccggggactcagccggatcgttccgaaaagcaaagagttcatagagaccgagtcaagcagctcctcaagttccagcgactcggacctggaaagcgagcaagaagaataccctttatctaaagctcagaccgtcgccgccagtgcgtcatccgggaatgaccaacgactcaaagaggcagctgccaatggtggtagtgggccaagagcccccgtcggaagtatcaatgcccgtactacgagtgacattgctaaagaactggaggaacagttctacactctggtacccttcggcaggaacgagttgctcagccctctcaaagattctgatgaaatacgctccctttgggtcaagattgatctgaccctgttgagccgaattccagaacatctgcctcaggagccaggggttttgtctgcccctgcaactaaggactctgagagcgcccccccttcacatacgagcgacaccccagctgagaaggccctgcccaagagtaaacggaaacgtaaatgcgataatgaggacgattatcgcgagattaagaaatctcagggagagaaagacagcagttctcgcctggctaccagcacttcgaatacactgtccgctaaccattgcaatatgaacattaattcagtggccattcccatcaataaaaatgagaagatgttacgtagtcccatctcacccctcagcgacgcgtctaaacacaagtatacttctgaagatttaacttctagcagcaggcctaatggtaattctcttttcacatctgcatcctccagcaaaaaaccaaaggcggactcccaactgcagcctcatggaggggacctaaccaaggcggcacataacaactccgaaaatatccctctgcacaaatcccgcccccagacaaaaccttggtcgcccggtagtaacggccatcgcgattgcaagagacaaaagctcgtgttcgacgatatgccgcggagcgctgactatttcatgcaagaggccaagcgcatgaagcataaagccgatgcgatggtcgagaaatttgggaaagccttaaactatgctgaagccgcacttagctttatcgagtgcggtaatgccatggagcagggtcctatggagtccaaaagcccttatacgatgtatagcgagacggtggagttaatccgttacgccatgcggctaaagacgcatagcggccccaacgccacacccgaggacaagcaactggccgccctctgctaccgatgcctcgcgctgttgtactggaggatgttcaggctcaaacgggatcacgcagtgaaatatagcaaggctctaatcgactattttaaaaatagtagtaaggccgctcaggccccaagtccatggggtgcttctgggaagtccacaggcactccttctcccatgagtcctaaccctagcccggcgtcaagcgtgggttcccaggggtctcttagtaacgctagcgccttgtcacccagtaccatagtttccattccccagaggatacaccaaatggccgccaaccatgtgtctatcacaaacagcattttgcactcatatgattactgggagatggccgacaatttggccaaagaaaatcgagagttcttcaacgatcttgacctcctgatgggtcctgttacccttcattcttccatggaacacctggtgcagtatagccagcaagggttgcactggcttcggaatagcgctcacctctcctag

SEQ ID NO: 11274 - DNA, 3681 bp, Artificial Sequence
  Description of Artificial Sequence: Synthetic coding sequence
atggacagtttcgacctggctctccttcaggaatgggatctggaatccctgtgtgtgtatgagcctgatcgaaatgcacttcggcggaaggaacgagagagaaggaaccaggagacccagcaggacgacgggacattcaacagctcttactctttgttctccgaaccatacaagaccaacaagggggatgaactgagtaatcgcatccaaaacactttgggtaactatgatgagatgaaagactttttgacagatagatcaaatcaatcacatctggtcggcgtgcccaagcccggcgtcccccagacacctgttaataagatcgacgaacattttgtggcggattccagggcacaaaatcaaccatctagcatctgctccacaaccacttccacaccagctgcggtgcccgtacagcaatccaagcgggggacaatgggctggcagaaggcagggcatccccccagcgacggacaacagcgcgccacccagcaagggagcctgaggaccctgttaggggatggcgttggaaggcaacagcctcgcgcgaagcaagtgtgcaacgtggaagttgggctccagactcaggagagacctccagctatggcagcgaagcattcaagttctggacactgtgtgcagaactttcccccttcccttgcttctaagccttctttagttcagcagaagcccactgcatatgttcggcccatggacgggcaggatcaggcccctgacgagtccccgaagttaaagagtagttccgaaacaagtgtgcactgtaccagttacaggggagtccctgcatctaaaccagagccagccagggctaaggccaaactctctaagttttcgattcccaaacagggagaggaatcaagatccggagagaccaattcttgtgttgaggaaatcattcgggagatgacctggcttcccccgctgagcgcaatacaggcccccgggaaggtggaacctactaagttcccattcccaaataaagactcccagttggtatcaagcggccataataatcccaagaagggagacgccgagccggaatcacctgactccggaacatccaacacatctatgctggaagacgacttgaagctcagcagcgacgaggaggagaacgaacagcaggcagcacagcgtacggccctgcgggcactgtctgacagcgctgtagtgcaacagccgaattgccgaacctccgtcccttctagtaagggcagctcatccagctcttcgagcggatctagttcttctagcagcgactccgagtcgtcctcaggaagtgattcggagacagagtcctcctcatctgagtctgaagggagcaagccaccgcatttttcatctccagaggccgagccggcatcatccaacaaatggcaattggacaagtggttgaacaaggttaacccccacaagcccccaatacttatccagaacgaaagtcatgggagtgagtcaaaccagtattacaatcccgttaaggaagatgtgcaggactgcggtaaggtccctgatgtgtgccaaccttctcttcgagaaaaggaaatcaagtctacctgcaaagaagaacaacgaccaagaaccgctaataaggccccgggttcaaagggtgttaaacagaagtcccctccggctgctgtggcagtagcggtgagtgcagccgcacctcctccagctgtcccatgcgcccccgcggagaacgcacccgctccagcacggagatctgctggcaagaagccaacgcggagaactgaacggacgtctgcaggagacggcgctaactgccacagacccgaagagccagcagctgcagatgctctcgggacttctgtcgttgtccccccagaaccaacaaagacgcgtccttgtggcaacaacagggcctcccaccgtaaggagctgcgctcatctgtcacctgtgagaagcgtcggacaaggggattatcccgaatagtgcctaaatccaaggagtttatcgagaccgagtccagttcctcaagttctagttctgacagcgatttagagtctgaacaggaggagtaccccctgtccaaagctcagaccgtcgccgcgagtgccagttccggaaatgatcagcgcctgaaagaggcggccgccaatggggggtcagggcccagagcccccgtgggcagcattaatgctcgtacgactagcgatattgccaaagaattagaggagcaattctacactctcgtcccctttgggcggaacgaattactgagtccgctgaaggactcggacgagatccggtctttatgggtaaagattgatttaacactgttatccaggattcctgagcacctgcctcaggaacctggtgttctctcagctcctgccaccaaagacagtgaaagcgccccaccttcccatacctcagacacaccagctgagaaagcactgcccaagtcaaagagaaaaaggaagtgtgataatgaggacgattaccgtgagattaaaaaatcccagggggaaaaggattctagttctcggttagcaacctctacaagcaatacactcagtgcaaatcactgtaacatgaatatcaacagcgtcgctatcccgattaacaaaaatgagaagatgttaagatccccaatctcgcctctttccgacgccagcaaacacaagtacacttctgaagatctgacaagttcctctaggcctaacggcaacagtctgtttacaagcgcttcctccagtaagaaacccaaggcagacagtcaactccagcctcatggcggagatcttaccaaggcggcccacaacaattcagagaacatcccattacataaatctcgtccccagacgaagccgtggtccccaggttctaacgggcaccgagactgcaaaagacaaaaattggtgttcgacgacatgccaagatctgctgactatttcatgcaggaggcgaaacgcatgaaacataaggccgacgctatggtggagaaatttggtaaggcacttaactatgcagaggctgccctgtctttcatagagtgtggaaacgctatggagcagggtcccatggagagtaagtctccctacacgatgtattccgaaacagttgaactgatcagatatgccatgcgactgaagacccatagtggacccaacgcaacaccggaagataaacagttggcagcgctctgttacaggtgcctggctctgctgtactggcggatgttccgtctgaagagggatcacgcagtgaagtacagcaaggccctcattgactactttaagaactctagtaaggccgctcaagctcctagcccctggggtgcgagcgggaagtctacaggcacgcccagtcctatgtcacccaatcccagtcccgccagctccgttgggagccaagggtccctgtctaatgcttccgccctgtcaccgtctacaattgtatccatccctcagaggattcaccagatggccgctaatcacgtgtccatcaccaactcaatcctgcactcatatgattactgggagatggcggacaatctggctaaggagaacagagagttcttcaacgacctcgacctactcatgggcccggtgactctccattcctccatggagcacttagttcagtattctcagcaggggttacactggctacgaaactctgctcatcttagctag

SEQ ID NO: 11275 - DNA, 300 bp, Artificial Sequence
  Description of Artificial Sequence: Synthetic coding sequence
atggactcgttcgacttggccctgctgcaggagtgggacctggagtctctgtgcgtgtatgaacctgatcggaacgcccttaggcgcaaagaaagagagagaagaaaccaagaaactcagcaggacgacgggaccttcaactcatcgtattctctattctcggagccctacaagactaataagggagatgagctgagcaacaggatccagaacacccttggcaactacgatgagatgaaggatttcctgaccgacagatctaaccagtcgcacctggtaggggtgccaaagccaggctag

SEQ ID NO: 11276 - DNA, 468 bp, Artificial Sequence
  Description of Artificial Sequence: Synthetic coding sequence
atggacagctttgacttagcccttcttcaggagtgggacttggagtccttgtgcgtctacgaacccgaccggaatgcactgcgccgaaaggagcgcgagagaaggaatcaggaaacacaacaagatgacgggactttcaattcatcgtactctctgttttctgaaccttataaaaccaacaaaggtgatgagctctctaatagaattcaaaacactctgggcaattacgacgagatgaaggactttttgactgatcgatctaatcaatcgcatttggtgggggtgccaaaaccaggagtgccgcaaacaccggttaataaaatagacgagcactttgtagcagacagcagggcccagaaccagccttccagcatctgcagcacaaccacttcaacaccagctgctgtgccagtgcaacaaagtaagcgaggtacgatgggatggcagaaagccgggcacccgccatag

SEQ ID NO: 11277 - DNA, 345 bp, Artificial Sequence
  Description of Artificial Sequence: Synthetic coding sequence
atggatagctttgatctggcactcctacaagaatgggacctggagagcctgtgtgtgtatgagcctgacagaaacgccctcaggcgcaaagagcgggagagacgcaatcaggaaacacagcaggatgacggaacgtttaatagcagctatagtttattttctgaaccctacaaaaccaacaaaggcgatgagctgtcaaataggatccagaacactctgggcaattacgatgaaatgaaggacttcctaacggaccgatccaaccagagtcacctggtgggggtaccaaagcctggagtaccacagaccccagttaacaagatcgatgaacatttcgtcgcttag

SEQ ID NO: 11278 - DNA, 54 bp, Artificial Sequence
  Description of Artificial Sequence: Synthetic coding sequence
atggatagcttcgatttagccctgctacaagaatgggacttagagagcctgtag

SEQ ID NO: 11279 - DNA, 486 bp, Artificial Sequence
  Description of Artificial Sequence: Synthetic coding sequence
atggatagctttgatttggcactgctccaggagtgggatctagagtcactgtgtgtctatgaacccgatagaaacgctctgcgacggaaagagagggagcgccggaatcaggagactcaacaggatgatggcacattcaacagctcatattctctgttcagcgaaccttacaagaccaataaaggcgatgaactgtccaacagaatccagaacacactgggaaactatgatgagatgaaggattttttgactgatagatctaatcagtctcatttggtaggggtgcctaagcctggcgtcccccagactcccgtaaataagattgatgaacactttgttgctgattccagagcccagaaccagccttcctccatatgtagtaccaccacttccactccagccgctgtgcctgttcagcagagcaagaggggtaccatgggctggcaaaaggctggacatccaccctcagacggccagcagcgctag

SEQ ID NO: 11280 - DNA, 2346 bp, Artificial Sequence
  Description of Artificial Sequence: Synthetic coding sequence
atggacagtttcgatctcgcgttactccaggaatgggacctggagagtctatggggagaggacattctgaaccagcggaatgacagcctggtggtggagttccagtctagcgcttctcggtgccggagcgtgtatgagccagaccggaatgcactgcgacggaaggaaagagagagaaggaatcaggaaacgcagcaggacgatggcacctttaattcttcctactccctgttttctgaaccttacaagacgaataagggggacgagctcagtaacagaatccaaaataccttaggcaactatgacgaaatgaaagacttcttgacggaccgatctaaccagagccacctggtaggcgtgcccaagccaggtgtgccccaaactccagtcaacaaaatcgatgagcatttcgtcgcggattctagggctcagaaccagccctcgtcaatctgcagtacaaccactagtactcctgctgccgtgcccgttcagcaatcgaaacgtgggacgatggggtggcagaaagccggacatccaccatcagatggccagcagagagctacacagcagggctcccttaggacgctgctgggtgacggagtggggcgccagcaaccccgcgcaaaacaagtatgtaatgttgaggtcggcctccagacgcaagagcgtcccccagccatggccgcaaagcattcgtcatccggccattgcgttcagaactttccacccagcctggcatccaaaccctctctggtgcagcagaagcccactgcatacgtccgccctatggacggacaggaccaggcccctgacgagtctccaaagcttaagagcagctctgagacaagtgtgcactgcacaagctatcggggcgtccctgctagtaaacccgaacctgcgagggcaaaagctaagcttagcaagttctccatcccgaagcagggcgaggaatcccggtcaggagaaaccaattcgtgcgtggaggaaatcattcgtgaaatgacatggctcccacctctgtcagcaatccaggcacctggaaaggtagagccaacaaaattcccattccctaacaaggacagtcagctggtcagcagcgggcataacaacccaaagaaaggcgacgcagagccagagtctcccgacagcgggacttccaatacctccatgctggaggatgacctgaagctgtcttcggatgaagaagaaaacgagcaacaagccgcccagagaaccgccctgagggcactgtctgatagcgccgttgtgcagcagcccaactgccgaacgagcgtccccagctccaagggcagttccagctcctctagcagcggttccagtagctcctcttcagatagcgagtcgtcttcgggatccgactccgagaccgaatctagttcttccgagagtgagggaagcaagcctccccatttcagctcccctgaagccgagccggcctcaagtaataaatggcaactggacaagtggttgaacaaggtgaatccacacaaacctccaatcctaatccagaatgaatcacatggcagtgaaagtaaccagtactacaaccccgtgaaagaggatgtccaagactgcgggaaggtgccagatgtatgtcaaccctctctgcgggagaaggagataaagtcaacctgtaaagaggaacagagacctcgaaccgccaataaggcacccgggagcaaaggtgtgaaacagaaaagtccccctgccgccgtagccgtggctgtgagtgccgccgctccaccccctgcagtcccctgcgcacccgccgaaaacgccccagctcctgccaggcggagtgctggtaagaagccgactcgcagaacagaaagaacttccgcgggggacggcgcaaattgtcatagacccgaggaaccagctgcagcagacgccctgggcacatccgtcgtggtgccgcccgaaccaacgaagactagaccatgtgggaacaatcgtgcatctcatcggaaggagttacgcagtagtgtgacctgcgaaaaacgacgcacccgcgggttgagtagaatcgttcccaaaagtaaagagttcattgaaacagagagctctagctccagctcatcttctgatagtgatcttgagagcgaacaggaagagtaccccctctctaaggctcaaacagtggctgccagtgcctcctcaggaaacgatcaacgactgaaagaggctgcagcgaatggcggctccggcccaagggcacctgttggatcaatcaatgcgcgcactaccagcgacatcgcaaaggagctagaggaacagttttacacgctcgtgcctctggccggcactaacttctcccctctgtag

SEQ ID NO: 11281 - DNA, 2610 bp, Artificial Sequence
  Description of Artificial Sequence: Synthetic coding sequence
atggacagtttcgatctcgcgctgcttcaggaatgggatctagaatcactgtgcgtgtacgagcccgatcgcaacgctctgcgccggaaggagcgggaacgtcgaaatcaggaaactcagcaggacgatggcactttcaacagttcttacagtttgttcagcgaaccatacaaaaccaataaaggagatgagctctccaatcggatacagaacaccctggggaactacgacgagatgaaggactttctgacggaccgatccaatcagtctcacctggtcggcgtgccaaagccgggagtgccacagacacccgtgaacaagattgatgagcactttgtcgccgacagcagagcacagaatcagcccagcagcatctgctcaaccactaccagtacacccgcagctgtacccgtccagcaatccaagcgcggtaccatgggctggcaaaaagcaggacatccgccctcggatgggcagcaaagagcgactcagcagggctcattaagaactctgctaggcgacggcgtagggaggcagcagcccagagctaagcaagtctgcaacgtggaagtgggcctacagacccaggagagacctcctgctatggccgcgaagcactcatcttccggacattgcgttcagaacttccccccaagcctggcatctaagccgtccctggtgcagcagaaaccaaccgcttacgtgcgaccaatggacggccaggaccaagcccctgatgaatctcccaagcttaagtctagttccgagacctctgtacactgtacatcttacaggggagtgccggcctccaagcctgagccagcccgcgcaaaggctaaactgagcaagtttagtatacccaagcagggggaagagagccgctcaggggaaactaatagctgcgtcgaagagattatccgggagatgacgtggctcccccccctcagtgcaatacaggcacccggcaaagtcgaaccgaccaagttcccattccccaataaagactctcagctcgtgtctagcgggcacaataatcctaagaagggggacgctgagccagagtcacccgacagtggcacctctaacacatccatgctggaagacgatctgaaattatccagcgacgaagaagagaacgagcagcaggctgctcagagaaccgccctccgtgcactaagtgactccgccgtagtccagcaaccaaattgtcgcacgtctgtgccaagctccaaaggatcctctagtagttccagctccgggagtagtagttcctcctctgactcggagtcgtctagcggctctgactctgaaacagaatcctcctcttcagagtcagagggcagtaagcccccacacttctcctctcctgaagctgagccagcttcaagcaacaaatggcagctggataagtggctcaacaaggtgaacccacataaaccccccatcctgattcaaaatgaatcccatggttcagaaagcaaccaatattacaatcccgtgaaggaagacgtgcaggactgcggcaaagtgccggatgtgtgtcagccttccctgagagagaaagaaatcaagagcacttgcaaggaggagcaacggccccgaacagcaaacaaggcccccggcagtaagggtgttaaacagaagagccctccggcagctgtggccgtggcagtgagcgcagccgctcccccgcctgcggtaccctgcgctccagctgaaaatgccccagcccctgcccgcaggtccgcagggaagaagcctacgagacgtactgagcgcacaagcgccggcgatggggccaactgccaccgcccggaggagcctgccgccgctgacgctctcggcaccagtgtagtcgtccctccagaacctaccaagacccgtccctgcggaaacaatcgcgcatcccataggaaggagctaaggtcaagcgtcacctgcgagaagagacggaccagaggactgagccgcattgtgcccaagtctaaggagtttatcgagacagagagctcctcttcatcttcaagctctgattcagatctggaatccgagcaggaggagtatcccctgtccaaggcgcagaccgtggcggcctccgcttcttctggaaatgatcaacgacttaaggaagctgccgctaacggcgggtccggaccaagggctcccgtgggatcaatcaatgcacgcactaccagcgacatagctaaggagctggaggaacagttctacaccctggtgcctttcggccgaaatgaactgttgtcacctctcaaagactctgatgaaattagaagtctgtgggtcaagatagacctgacactgctgagcaggatcccagagcatcttccccaggagcccggcgtgctgtccgctcccgcaaccaaggatagcgaatcagcccccccttcccacaccagcgatactccagccgagaaggcgttgcctaagtctaagaggaaacggaaatgtgacaatgaggatgactatcgagagatcaagaagagccagggggaaaaagattctagttcccgcctcgctacatcaacctctaatacccttagtgctaaccactgtaatatgaatatcaacagcatgcaactgcccatctag

SEQ ID NO: 11282 - DNA, 390 bp, Artificial Sequence
  Description of Artificial Sequence: Synthetic coding sequence
atggacagtttcgatcttgccttgctgcaggagtgggatctggagtctttgtgcgtgtacgaacccgacaggaacgcattgcgcagaaaggaacgagaacgaaggaatcaggagactcagcaggatgacggtacatttaactcttcttactcgttattcagcgagccatacaagaccaataaaggcgatgaactcagcaatcgcatccaaaatactctgggcaattatgacgaaatgaaggatttcctgaccgacagaagcaaccagtctcacctggtcggcgtccctaaacccggtgtgcctcagacaccagtgaataagattgatgagcattttgtggctgattcccgcgcccagaatcaaccctcgagtatttgctccactacatag

SEQ ID NO: 11283 - DNA, 3066 bp, Artificial Sequence
  Description of Artificial Sequence: Synthetic coding sequence
atgaccttgagactggatgcaggcggcatacccagcctcgccccaagggtttatatctccggctccccatctcaacgatttttgccccgcaagaggaacaaaggagaatccgcagggcgggactccctgctggccggtagcgcaaggtttggctccaggggagaagcccaactgcagggctccgagttgttatcccgcaattcaggagagtctctagtcagaatcagaagctgcgggcaggaacttattacctgcctatccaggcccgaaaccggtggaaagttcgaggtcgatacccaacggcccgtatgccctccctcgcgggcacgggctgcccgagcctccgcggccgccgtggccgccgccgccacactcacaccccccacaatggactcctttgacttggccctgcttcaggagtgggatctggaaagtctgtggggggaggatatactcaatcaacggaacgacagcctcgtggtggagttccagtcttccgcgtctaggtgccgctctgtgtatgaaccggatcggaacgcactgcgtagaaaagagcgcgaaagaagaaatcaagagacccagcaggacgacggcacctttaattcctcctactctttattttctgagccgtacaagaccaataaaggcgatgagctgagcaaccgcatccagaatacattgggaaattacgacgagatgaaggatttccttaccgaccgtagcaaccagtcacacctggtcggggtacctaaaccgggtgtgccacagacccccgtgaataaaatagacgagcacttcgtcgccgattcccgcgcccagaaccagcccagctccatttgtagcaccactacctccactcccgccgccgtacccgtgcaacaatcaaagcgaggcaccatggggtggcagaaggctggacaccccccatccgatggacagcaaagagctacgcagcagggttccctcaggaccctactcggcgacggggtgggccggcagcagcccagggcgaagcaggtctgcaatgtggaagtcggactgcagacgcaggaaaggcctccggccatggccgcgaagcactcatcctccggacactgtgtacagaatttcccgcctagcctggcttcaaaaccaagcctggtgcagcaaaaaccaaccgcctacgtacgaccaatggatggccaggaccaggccccagatgagtccccgaaactgaagtcttctagcgagaccagtgtgcactgcacctcctataggggtgtgccagccagcaaacctgaacccgctcgggctaaggcaaaattaagcaaattcagcatcccgaaacagggagaggaatctagatccggtgaaaccaattcatgtgtggaagaaatcattcgggaaatgacatggcttccgcctttgtcagccatccaagccccgggcaaggtggaaccgactaagtttccattcccgaacaaagattcacaattagtgtcttctggacacaacaaccccaaaaaaggcgacgcggagccggagagcccagactccggcacaagtaacacctctatgctggaagacgatctgaaactgagttcagatgaagaggaaaatgagcaggcggcacagaggacagcccttagagcactgagtgatagcgccgtggtacagcagcccaactgccggacaagtgtgccctccagcaaaggatcctcctccagttccagctccggcagctcatcatcatcaagtgattctgagtcaagtagcgggagcgacagtgagactgaatcctctagctcggagtccgagggttcgaaaccccctcatttttcatctcccgaggctgagccagcctctagcaacaaatggcagctggacaagtggctgaataaggtaaacccacataaaccacctatactgatacaaaatgagtcccacgggagcgaaagcaaccagtactacaaccccgtcaaagaggacgttcaagactgtggcaaagtgccagacgtgtgccaaccatcattacgcgagaaagagattaaaagtacttgcaaagaagagcagagaccccggaccgctaataaggctccaggttccaagggcgtgaaacagaagagcccccctgctgcggtggccgtggccgtctcagcagcggcacctcctcccgctgtaccctgtgctcctgctgagaatgctccagcccccgcaaggcgatctgccgggaaaaaaccaactcgccggactgagagaacatcagcgggcgatggggccaactgccatcgacccgaagaacctgcggccgctgacgccttaggtacttccgtggtcgtgccccccgagccaaccaagacccggccttgtggtaacaatagggcctctcaccgtaaagagctacgcagctcagtcacttgcgaaaaacgtcgtacacgtggcctgtctcggatagtgcccaagtccaaggaatttatcgaaacagagtcctcaagcagctcctcatcctcagacagtgatctggagtctgagcaggaggaataccctctatcaaaagctcagaccgtggctgcgagtgcctcctccgggaacgatcagagattaaaggaggcagctgcgaatggcggtagtggtccgcgggcacctgtcggatccatcaatgcacgtacaacatctgatattgccaaagagctggaagaacagttttacacactggtccctttcggccgaaatgaactgctgtcaccacttaaagactcagacgaaatcagaagtctgtgggtcaaaattgatctgaccctgctgagtcgcatacccgagcacctaccccaggagccgggtgtccttagtgctccggccacaaaggacagcgaatctgcgcccccatcacatacatcagatactcctgcagagaaagccctgccaaagtctaaacgcaaaaggaagtgtgacaatgaggatgattatagggaaatcaaaaagtcacagggggagaaggactcaagcagccggctcgctacaagcactagcaataccctgtcggctaaccactgtaacatgaacataaactcactgagtcttccctag

SEQ ID NO: 11284 - DNA, 17388 bp, Artificial Sequence
  Description of Artificial Sequence: Synthetic coding sequence
atgtgtgactgttttcacatggtgctccctacctggccgggcacacctggtagtgtgagcggccggcagctgcagcccggcgaacctggagctgaaaccgaggatgaccactcagtaactgaggggccagcggacgaaggcattaggccgcgcccacaagggagtagtcctgtgtatgaatacacaacagaggcggccgactttggcctgcaggaagacgcaccaggccgacagggatccgcaggaaggagacggagttggtggaagcgcgattcaggggactccaggaccttcttccgcatgagccggcccgaggccgtgcaggaagctactgaggtcacattgaagaccgaggtggaagctggggcttccggttacagtgtgacaggaggcggtgatcagggtatcttcgtgaagcaagttttgaaggacagctcagctgcgaaactctttaatcttagagagggcgatcagctgttgtctaccaccgtgttcttcgaaaacatcaagtacgaagatgctctcaaaattctccagtacagcgagccctataaggtgcagttcaagattcgcagacagcttcccgctccccaggacgaggaatgggcttcctctgacgcccagcacggaccgcagggcaaggagaaggaagacactgacgtggctgacgggtgccgggaaacacctactaagacactggagggcgacggtgaccaggaacgccttattagcaagccacgtgtgggcaggggccggcagagccaacgcgaaagactctcctggcctaaattccagagcataaagtcgaagcggggacccggaccgcaacgatctcacagtagtagcgaggcatacgagcctagagacgcccacgacgtctcccctacgtctacagacaccgaggctcaattgactgtggagcgacaggagcagaaggccggtcccggcagccaaagacggaggaagttcctgaatctgcgtttcagaacgggaagcggccaaggcccatcttcaaccggccagccgggaagaggattccagagtggcgtggggcgtgccggcgtactggaagagctggggccatggggagattccctagaggagacaggcgcggcaacaggctccaggcgggaggagcgggccgaacaggatagggaagtaatgccagcccaatcaatgccgttgccaaccgagttaggcgatccacgcctttgtgagggcacgcctcaggagggagggcttcgagccgccaggctccacggcaagactctggaaggccaagcccaggaaactgctgtggctcagcgaaaacctcgggctcagccgacccctgggatgtcgcgcgagggtgaaggcgagggtcttcagtcgctagaaattggcattgcccggctgtcactgcgggacaccacagaaggcggaacccaaattggtcctcctgagatcagagtacgggtacacgatcttaaaacacctaaattcgcgttcagtaccgagaaggagccagagagagagcggcggttatcaacaccccagcgcggcaagcgtcaggacgccagcagtaaggcaggcaccggacttaagggcgaggaggttgagggcgccgggtggatgcctggacgcgagccaacgacacacgcagaggcccagggggacgagggcgatggggaggaaggccttcagagaacccggatcacagaggagcaggataagggaagggaggatacagagggccagatcaggatgcccaagttcaagatcccaagtctgggctggagcccatccaagcacaccaagactggccgcgaaaaggcaacagaggatacggagcagggaagggagggcgaagccactgcgactgccgacaggcgcgagcaaaggaggaccgaagagggattaaaagacaaagaggacagcgactcgatgacaaacaccacaaagatccagctgatccacgacgagaaacggctgaaaaaggaacaaatcctaaccgagaaagaggttgcaaccaaagactcaaagtttaaaatgcctaagtttaaaatgcccctgttcggcgcttccgcccccggcaagagtatggaggcttccgtggacgtgagcgcccctaaagtcgaagctgatgtttcactgctcagcatgcagggcgacctcaagacaacagacctgagtgtgcagacaccgtcggcagacctagaagtgcaggacggtcaagtggatgtgaaactgcccgagggcccactaccagagggcgcttccctgaagggccacctcccgaaagtgcagcggccttcactgaagatgcccaaggtcgatctcaaaggtcctaagctggatctcaaaggcccaaaggccgaagttacagccccagacgttaagatgagcctgagttctatggaagtcgatgttcaagcacctcgcgccaaacttgacggcgcccgcctcgagggcgacctgtcgctcgctgacaaagaagtgacagcaaaagatagtaaattcaaaatgccaaaattcaaaatgccttccttcggcgtctcggccccaggcaagagcatggaagatagtgtggatgtgagtgcccctaaggtggaagccgacgtcagcctgtcttcaatgcagggcgacctgaaggccacagacttgtcgatccagcctccatccgcagacttggaggtgcaggctgggcaggtcgatgtgaagctgccagaaggccctgtgccagagggggccggtcctaaggtgcatctacctaaagttgaaatgccctccttcaagatgcctaaagtggacctcaagggtccgcagattgatgtcaaggggccgaagttggatttgaaaggcccaaaggctgaggtcacagccccagacggcgaagtgagtctaccttccatggaagtagatgtgcaggcccagaaggccaaactggatggcgcctggctggagggggacctatccttggccgacaaggacgtgacagcaaaagattccaagtttaagatgcctaaatttaaaatgccatcttttggcgtgagcgctccaggaaaaagcattaaggcactcgttgacgtgtctgcgcccaaagtcgaagccgacctgagcctgccgagcatgcagggggatttaaagacaaccgatctttccatccagcctgcaagtacagacctgaaggtccaggccgaccaggtcgatgttaagctgcccgaaggacacctgcctgaaggggcaggcctgaaaggacatctgccaaaagtggaaatgccgagctttaagatgcctaaagtggccttgaaaggtccccaggtggatgttaaaggtcccaagctcgacttgaagagcccgaaggctgaagttaccgctcctgatgtcgaagtatcactgccatccgtggaagtggatgttgaagcacctggcgccaagctggacagcgcccgactggaaggggagttgagtctcgccgacaaagacgtaactgccaaggactcaagattcaagatgccaaagttcaagatgccgagtttcggtgcttcagctcccgggaagagtattgaagctagtgtggatgtctccgcacccaaggtggaagccgatgtatccctgccctcaatgcagggggacctgaagaccactgacttgtcgatccagcctcccagcgctgatctagaggttcacgctgggcaagtggatgtgaagttgttagaagggcacgtccctgaaggcgctgggttcaaagggcatctgccaaaggtgcagatgccctcgctcaaaatgccaaaggtggaccttaagggccctcaggttgaagtgaggggccccaagctcgatttaaagggacacaaagctgaggtgacagcccatgaagtggctgtgtctctcccttcagtggaggttgatatgcaagcaccaggagcaaaactagatggcgcccagctagacggcgacctgtctcttgccgacaaagacgtcacagcaaaggattctaagtttaagatgcccaaatttaaaatgcctagtttcggggttagtgcccctggaaagtccattgaggctagcgtcgatctgagtgctcccaaggtggaagcagacatgagtctcccaagcatgcagggagatctgaagaccactgatctgtccatccagccaccctcaacagatttggagttgcaggctggccagctggatgtgaaactcccggagggtcctgtacctgaaggcgctggcttgaagggacacctgcctaaactacagatgccgagctttaaagtacccaaggttgacctgaaaggcccggagatcgacatcaagggaccaaagctggatctgaaggatcctaaagttgaagtcaccgccccggacgttgaagtgagcctgccaagcgtcgaggtggacgtcgaggcccccggggccaaactggacggaggccggctggaggaggacatgagtctggcggataaggatctaaccaccaaagacagtaagtttaagatgccaaaattcaaaatgccatcctttggggtgagcgcccccggcaagagtattgaagcaagcgtagacgtatctgcccccaaggttgaggccgatgtgagcttgccatctatgcaaggggatctgaaagctaccgacctgtctatccagccaccttccgccgacctggaggtgcaggccggccaggttgatgtgaaactgcctgaaggaccagtgtcagaaggggcgggtcttaagggccatctgccgaaagtacagatgccttccttcaagatgcctaaagtggatctgaaaggaccccagatcgatgtgaagggccccaaactcgatcttaaaggtcccaaggttgaagtgacagcacctgacgtgaagatgtcccttagctcaatggaagttgacgtgcaggctcctcgagccaaactggacggggctcagctggagggcgatctatcgttggccgacaaggccgtgacagctaaggacagcaagttcaaaatgccgaagtttaagatgccaagcttcggcgtaagcgcaccaggaaagagcattgaggcaagcgtcgacgtgagcgagcccaaagttgaagcggatgtaagcttgccaagcatgcaaggcgatctcaagaccacggatcttagcatccagagcccctctgccgatttagaggtacaggccggtcaagtaaatgtcaagttgcctgaggggcccctaccagagggagccggattcaagggccaccttcccaaggtacagatgccttcactaaaaatgccaaaggttgctctgaaaggtccacagatggatgtgaaaggccccaagcttgatctcaaggggcccaaggctgaagttatggcccccgacgtggaagtgtcgctcccttctgtggaggtagatgtggaggcacccggcgcgaagctggatagtgtgcggctcgaaggagatctgagcttggcagataaagatgtgaccgccaaggactccaaatttaagatgcctaaattcaaaatgccatccttcggggttagcgccccaggcaagtcaatcgaggcatccgtggatgtaagcgcccccaaggtcgaggcagaggtatctctacctagcatgcagggagacttaaagacaacagacctgtgcatcccactacccagtgccgatctcgtcgtccaagctggacaagtggatatgaagttgcctgaaggccaagtgcccgaaggagcaggtctcaagggccacctgccgaaagtggatatgccatccttcaagatgcccaaagtggacctgaaaggcccccagaccgacgtgaagggagctaaactagacctgaaaggccctaaggctgaagttacggcacctgacgtcgaggtgtctctgccttctatggaagtggatgtgcaggcacagaaagccaagctggacggcgccaggcttgagggcgatctgtctctggctgataaagacatgacagccaaggattcgaagttcaagatgccaaaatttaagatgcctagtttcggcgtgtcagcgccggggcggtctatcgaggccagtgtggacgtgccggcccccaaggtcgaagccgacgtgagcctgccaagcatgcagggcgatctcaagacaactgacctgtctatccagcctcctagcgctgacctgaaagtccaaaccgggcaagtggatgtcaagctgcctgaagggcacgtgccagaaggtgccggactaaagggccacctgcctaaggttgagatgcctagtctcaaaatgcccaaggttgacctcaaaggaccccaggtggacataaaggggccgaaactggacttgaaggacccgaaggttgagatgagagttccggacgtggaagtatccctaccaagcatggaggtcgacgttcaggcccccagggctaagttagattcagcacatctgcagggagacttgacactggccaacaaagacctcactaccaaggactccaaatttaagatgcccaagttcaaaatgccatcttttggggttagtgcccctggcaaaagtatcgaagcaagtgtcgatgtgagtccaccaaaggtcgaagctgacatgtctcttccctcaatgcagggcgatcttaaaaccaccgacctgtccatacagcctctgagtgccgatgttaaggttcaggcaggccaagtcgatgtgaagctgcttgaaggcccagtcccagaggaagttggtctgaaggggcatctcccaaagttgcaaatgccaagctttaaagtgcccaaggttgatctgaaaggacctgagatcgatattaaaggtcctaagttagatctgaaggatcctaaggtagaagtgacagcccccgatgtcgaagtgtcactgccgtctgtggaagtagacgtcaaggctccaggggccaagctggacggcgctagactggagggagatatgagtctcgctgataaggacgtgacagccaaggacagcaaatttaagatgccaaaatttaaaatgctgtcatttggcgtttccgcattaggcaagagcattgaagcctccgctgacgtgtcagccctgaaggtggaggcagatgtgagcttacccagcatgcagggggatttaaaaacaactgaccttagcgttcaacccccatccgccgatctagaggtgcaggccgggcaggtcgatgtcaaattgccagagggccccgttccggagggggccgggctcaagggccacctgccaaaactgcaaatgccctcattcaaaatgccaaaggtcgatttaaaagggccacaaattgatgtgaagggccctaaactagatctgaagggccctaaaactgatgtgatggcgcccgatgttgaagtttcacaaccttccgttgaggtggatgttgaggccccgggtgctaaactggatggcgcctggctggaaggtgacctttctgtggccgacaaggacgtaactactaaagactcaaggttcaagattcccaaattcaagatgccttctttcggcgtgtctgcgcccggcaagtccatcgaggctagcgttgatgtcagcgctccaaaggtcgaagccgatggaagtctgtcaagtatgcagggagatcttaaggctacagatctttcaattcagcctccctccgcagacctcgaggttcaggcaggccaggttgacgttaaattgccggaggggcccgttcctgagggcgccgggctgaagggacaccttcccaaagtccagatgccatccttcaaaatgccagagatggacctgaaggggcctcaacttgacgttaagggcccaaagttggacctcaaaggacccaaagccgaggtaacagctccggatgtcgagatgagcctgtcatctatggaagtagacgtgcaggcaccccgggccaaactggatggagcacgactcgagggggacctttctcttgccgataaaggcgtaacagccaaggactctaaattcaagatgccgaagttcaagatgccgtccttcagggtgtcagccccaggggaaagtattgaggccctggtggatgtctctgaactcaaagtagaggccgatatgtccctgccctctatgcagggagaccttaagactacagacatctccatccagcccccatcggcacagctcgaggtccaggcaggacaggtcgacgtgaagttacctgaggggcatgtccccgaaggcgcaggacttaagggtcatctgccaaaactgcagatgccctccttcaagatgccagaggtggatcttaaaggtcctcagatcgacgtgaagggtcccaatgtggatctgaagggtccaaaagcagaggtgacagcgcctgatgttaaaatgtctctctcctccatggaagttgacgtgcaggccccccgagctaaactggacggcgcccggctggagggcgatctgtctcttgcagataaaggtatgacagcaaaagattctaagtttaaaatgcccaagtttaagatgcccagtttcggagtgagtgcaccaggaaagagcattgaagcaagcgtcgacgtgtccgaactgaaggtggaagctgacggatctttcccttccatgcaaggcgacctgaagaccactgacatccggatacagccgcctagtgcacaactcgaagtgcaagcaggtcaagtcgacgtcaaactgcccgagggccacgtgcccgagggtgccgggctgaagggacatctgccaaaagtgcagatgccctctttcaagatgccgaaggtcgacttgaagggccctcagatcgatgtaaagggacctaagctcgacctgaaaggcccaaaagctgaggtgaccgcccccgatgtagaggtttctctgccttcagtggaggtggacgttgaagcccccagagcaaaactggacggtgctcggctagagggtgacctcagtctcgccgacaaggacgttaccgccaaagactctaaatttaagatgcccaagttcaagatgccttcttttggtgtgtccgctcccgggaagagcatcgaggtttctgttgacgtttcagctccaaaagttgaagcagaagtgtccttgccttctatgcagggggatctcaagacaaccgacatcagcattgaacccccaagcgcccagctggaagttcaagcaggtcaagtggatctaaaacttcccgagggccatgtcccagagggagccggcctgaagggacatctgccgaaactccagatgccatcattcaagatgccgaaggtggaccggaaagggccgcagattgatgtcaagggccctaagctggacttgaaggggcctaagactgatgtgactgctcctgacgtggaggtcagccaacctggcatggaagttgatgtagaggctcctggggcaaagctggacggcgcccgtctcgaaggcgatttgagcttggctgacaaagatgtgactgccaaggatagcaagttcaagatgcctaagttcaagatgccaagcttcggtgtctctgcaccaggcaagtccatcgaagtcctcgtggacgtgagcgcccctaaggtcgaagctgacctctctctaccaagtatgcaaggcgacctcaaaaataccgacatcagcatagagcctccctctgcccaactggaagtgcaggctggccaggtggacgtgaagttacccgaaggtcacgttctggaaggggccgggctgaaggggcacctgcccaagcttcagatgccctcatttaagatgccgaaagtggatcgcaagggtccacagatcgacattaaaggaccaaaactcgatttgaaaggacctaagatggacgtcactgctcctgatgtggaggtcagccaacccagtatggaagtggacgtcgaagccccaggcgcaaagttggatggcgctcggctcgagggcgatctatcactggcagacaaagacgtgactgcgaaggatagtaaattcaaaatgcctaagttcaagatgcctagctaccgggcatccgcaccagggaaatccattcaggccagtgtagatgtcagcgctccgaaagcagaggcagacgtgagtcttcctagtatgcagggcgacttgaaaactacagatctcagcatacaactgccaagcgtcgatctggaggtccaggcaggccaggtggacgtgaagctccctgaagggcacgttcccgaaggagctggcttaaaaggccatctcccgaaggtcgagatgccaagttttaaaatgcctaaagtagatctaaagagcccccaggtcgatatcaagggaccaaagctggacctgaaggtgcccaaggcagaggtgacagtccccgacgttgaagtgagcctcccgtctgtggaagtagatgttcaggccccccgagctaaattagacggcgctcgtctggagggggacctcagcctggcagagaaagatgttactgccaaggactctaaatttaaaatgccaaagtttaaaatgccgtcattcggcgttagcgcccccggacgaagcattgaagcatctctggacgtctctgctcccaaagtggaagccgatgttagcttgtcgagcatgcagggggacctcaaggccactgacctcagcattcaaccaccttctgcggacctagaggtccaggctgtgcaagtggacgtggagctgctggagggccccgtccctgagggagctgggctgaaagggcatctgccaaaagtggaaatgcccagcctgaagaccccaaaggtagatctcaaaggacctcagatcgacgtgaagggccccaagctcgatctcaaggggcctaaggccgaggtccgcgtccccgacgttgaagttagcctaccaagcgtcgaagtcgacgttcaggccccgaaagcaaagctcgatgcaggaagactggagggcgatctcagcttagctgacaaggatgttacagctaaagacagcaagttcaaaatgcccaaattcaaaatgcccagctttagggtcagcgcgcccggcaaaagtatggaggcgtcggtggacgtgtcagcacccaaagtagaagcagatgtatccctgccttcaatgcagggagacctgaagactaccgacttgtcgatccaacctcccagcgctgacctgaaagtgcaggccggtcagatggacgtgaaattgcctgagggacaggtgcctgaaggggcggggctcaaagagcatctccctaaagtggagatgccctctctgaaaatgccaaaagtggatttaaaggggccacaggtggatataaagggccctaaattagacctgaaggtttctaaagccgaggtgacagcccccgacgtcgaggtctccctccccagcgtggaagtggatgtacaggcacctagagccaaactggactctgcacagctcgagggagacctgagcctggctgataaggacgtaacggccaaagattcgaagtttaagatgcctaagttcaaaatgcccagcttcggagttagcgctcccgggaagtccatcgaggcatccgttcacgtttcggcccctaaggtggaggccgacgtctccctgccatcaatgcagggggatttaaaaaccaccgaccttagcatccagccccatagcgccgatctgacagtccaggcccgacaggttgacatgaagctcttggagggacacgtgcctgaggaagcaggactgaaaggtcacctcccaaaggtccagatgccatctttcaaaatgccaaaggtcgatctgaagggtcctgaaatagacattaaaggacccaagcttgatctgaaggacccgaaggttgaggttaccgcgccggacgtggaggtgtcactgccgtctgttgaggttgatgtagaggcaccaggtgcgaagcttgacggtgctcgtttggaaggagacctctcactcgccgacaaagatatgaccgcaaaggatagcaagtttaagatgcctaaattcaagatgccaagctttggagtgtctgctccgggcaagtcaatggaggcctctgtggacgtgacagccccaaaagtggaggcagacgtatctctgccctccatgcagggcgacctcaaggctactgatttatctgtccagccaccctcagcggatctagaggtacaggccggacaggtcgacgttaagctgccggaaggccccgtccctgagggagcatccctgaaaggacatctgccaaaagtgcagatgcccagtttcaagatgccaaaagttgatctgaaggggccccaaatcgacgttaagggccctaaactggacctcaagggaccgaaagcagaggttactgcccctgacgttaaaatgtcgctaagctcgatggaggttgatgtccaggctccacgcgccaagctcgacggagtgcaactggaaggcgacctgagtttagccgacaaagatgtaactgcgaaagactcaaagttcaagatgcctaagttcaagatgccaagctttggggtgagcgcccccggaaagagcatggaggcatccgtggatgtctccgagctcaaggctaaagctgacgtcagtctgccctctatgcagggggacttgaaaaccaccgacctctccattcagagtccttcagctgacctggaagtccaagcagggcaggttgatgttaaactaccagagggtccactgccaaaaggagccggcctcaaggggcacctcccaaaggttcagatgccatgcctgaagatgccaaaagtggctcttaaggggccgcaggtagacgtgaagggaccgaaactggacctgaagggaccaaaagctgacgtgatgaccccggtggtggaagtctcactgcctagtatggaggttgacgtggaggctcctggcgctaagttggatagcgtgaggctcgaaggcgatctgtcgttagctgacaaggacatgaccgccaaggacagtaagttcaagatgcctaagtttaagatgccatcttttggcgtgagcgctcctggcaagtcaatcgaagcttcactggacgtgtccgccctaaaggttgaggctgacgtatctctgccctccatgcagggggaccttaaaaccacccatctgtccatccaacccccttcagcagacctcgaggtccaggccggtcaagaggacgtaaaactgccagaggggcctgtacacgagggcgctggacttaaaggccatttgccaaagttgcagatgcccagtttcaaagtgccgaaggtggatttgaaaggaccccagatcgatgttaacgtgccaaagctggacctgaaaggtcccaaggtggaggtcacttcacctaatttagatgtttctcttccctcaatggaagtggatatccaggccccaggggctaagctcgactctactcgcctcgaaggcgacctctcattagccgacaaagatgtgacagccaaggacagtaaatttaagatgccgaagtttaagatgccctcttttggtatgctctctcctggtaaatccattgaggtgtctgttgatgtgtctgctccgaagatggaggcagacatgagcatcccttcaatgcagggtgatctgaaaactacggacctccggatccaggctccttctgctgatctggaagtccaagccggacaagtcgatctcaagctgcctgagggccatatgcccgaggtggccggcctaaaaggtcacctccccaaagtggagatgccgtcttttaaaatgcctaaagtggacctgaaaggtccacaggtggatgtgaagggccctaaactcgatctgaagggacctaaggcagaggtgatggctcccgacgtagaggtgtctttgcccagtgtcgagaccgacgtgcaggctccgggatccatgctagatggcgcccgactggagggcgatctctctctcgcccatgaagacgttgcagggaaagatagcaagttccaggggcccaagctgagcactagcggctttgagtggtccagtaaaaaggtctctatgagcagtagtgagattgaaggaaacgttacatttcacgaaaaaacatctacatttcctattgtggagagcgttgtacacgagggagacctgcacgatccatcgagagatggcaacttaggactggcagtcggagaagtcggcatggactctaagtttaaaaagctccactttaaggtgcccaaggtgagcttctcttccaccaagacgcccaaggacagtctggtgccaggagctaaaagctccatcggactgtcaacaatcccgctgtcatcctccgagtgtagctcttttgagctgcagcaggtttctgcctgctctgaacctagtatgcaaatgccaaaggtgggcttcgccgggttcccatccagccggcttgatctgaccggccctcactttgagtcctctattctttcaccctgtgaggacgtgacactcaccaagtaccaagtgactgtcccgagagctgctctggctccagaattggcgctggagatccctagcgggagccaggccgacatcccattaccaaaaacggagtgctcaactgacttgcagccacctgaaggagtgcctacgtcccaggccgagtctcacagtgggccgctgaatagcatgatccccgtttcgcttggtcaggtgagcttccctaaattttacaagccgaagttcgttttttctgtgccccagatggcagtccccgagggagacttgcacgctgccgtgggggcccctgtcatgagccccttgagtcccggggagagagtgcagtgtcctcttccatctactcaactgccctctcctggtacgtgcgtctctcagggtcccgaggaactcgtcgcttcattacagacatctgtggttgcacctggggaggcccctagtgaagacgctgatcatgagggaaaaggaagccctcttaagatgccaaagattaagcttccttccttccgatggagtccaaaaaaagaaaccgggcctaaagtggatcccgaatgtagcgtggaagactccaagctttcactagttttggataaagacgaggtggcacctcagtctgcaatacacatggaccttcccccagagagagacggcgaaaagggccgatctacaaaacccggtttcgcaatgcctaagctggctctgcccaaaatgaaggcctccaagagcggagtgtccctcccacagcgcgatgtggatccgagcctcagcagtgccacggccggcggatctttccaggacaccgaaaaggcctcctcagatggagggagagggggattgggcgccacagccagcgccacggggtctgagggcgtaaatttgcacagaccccaggtgcacattccctccctcgggttcgcaaaacccgaccttcggtcttccaaggccaaggtggaagtatcacagcccgaagctgatcttccactcccaaaacacgacctgtccacggagggagattctcgcggatgcggcctaggggatgttcccgtatctcaaccatgtggtgaaggcattgcccctaccccagaggaccccctgcaacctagctgtcgcaaacctgacgcagaagtgctgactgtggaaagcccagaggaagaggctatgactaaatattctcaggaatcctggttcaagatgcccaaatttagaatgccctcgctccgaagatcatttagagatcgtggcggagcagggaaattggaggtcgcccaaacacaggctcccgccgcgacagggggggaagccgcggccaaggtaaaggagtttctcgtgagcggttcaaacgttgaagctgcgatgtctctgcaactgcctgaagccgacgccgaagttactgccagcgagtccaaaagctcgaccgacattctgcgctgtgacctggattcaactggacttaagctacatctgagcaccgccggcatgaccggagatgaactgtccacgtccgaggtgcgcatccatccctctaagggtccccttccatttcagatgcccggtatgcgccttcccgagacccaggttctcccaggggaaatcgacgagaccccgttgagcaaacctgggcacgacctcgcctcaatggaggacaaaactgagaagtggtcctcgcaacccgaagggcccctaaaactgaaggccagttctacagacatgcccagccagatcagtgtggtcaacgtggatcaactgtgggaggattcggtgcttacagtcaagtttccgaaacttatggttccaagattctccttcccagcaccttccagtgaggacgatgtgttcatccctacggtgcgtgaggtccaatgccccgaagccaacattgataccgcactgtgtaaggaatctccaggcctgtggggtgctagcattctcaaggctggcgcgggagtgcctggggagcagcccgtcgacctgaatctccctcttgaagcaccaccgatctcaaaagtgcgcgtgcacatccagggagcccaggtcgaatctcaggaagtgactattcactccatcgttacaccagagtttgtcgaccttagtgtgcctagaacatttagcacacagatcgtgagggagagcgagatccccacctctgaaatccagaccccaagctacggcttttcgttgctaaaggtcaagattcccgagcctcacacccaggccagagtgtacactactatgacacaacactcacggacccaagagggaaccgaagaggctccgattcaggcaacaccaggcgtggatagcattagcggcgaccttcagccagataccggagagccttttgaaatgatttccagttcggttaatgtgctaggacagcagacactgacatttgaagtcccttcaggtcaccagctggctgattcttgctctgatgaagaaccagcagaaatcctagaatttccacctgacgactcccaggaggccaccacacctctcgcggacgaaggtagggctccaaaagacaaacctgagtctaaaaaaagcggacttctgtggttctggctgccaaatataggattttcatcatctgtggacgagacaggagttgatagtaagaatgatgtccagaggtccgctccgatccagacccaaccagaggcccggcctgaggccgagctgcccaagaaacaggaaaaagccggatggtttagattccccaagttaggcttcagttcctctccgactaagaagtctaagtccaccgaggacggcgccgagctggaggaacaaaaacttcaagaagagaccattacgttcttcgatgctcgggaaagcttttcgccagaggagaaggaagaaggagagttgattgggcctgtggggacaggactggattcacgtgtgatggttacatccgctgctaggactgagttaattctgcctgagcaggatagaaaggcagatgacgagagtaaaggttccgggctggggcccaatgaggggtag

SEQ ID NO: 11285 - DNA, 237 bp, Artificial Sequence
  Description of Artificial Sequence: Synthetic coding sequence
atgggtcagggacaacaagcaatgtgtcacgaggccttaagccacatctgggtaccttttgatctgaagcgatggttgctgtacaccttctgtaattggttcgacgttacctttcagttgcagctgtgtatcctcaggacattgaagcgtttttgccggagcatcctgtacaatctaaaagaccggaagacattttggctgccccaggcctacctgagctttctcttgatacaatag

SEQ ID NO: 11286 - DNA, 579 bp, Artificial Sequence
  Description of Artificial Sequence: Synthetic coding sequence
atggcatgtggggccaccctgaaaaggccgatggaattcgaggccgccctcttgagccctggaagccccaagaggcggcgttgcgctcctctgcctggaccaacccctgggcttcgtccgccagatgctgagccacctccccctttccaaacccagacccccccccaatcactccagcaacctgccccccccggaagtgagcgccgattgcccacaccggagcagatctttcagaatattaaacaggaatattccaggtatcagaggtggagacatctagaggtggtattaaatcagtcagaagcatgcgcgtcggaaagtcaacctcacagcagcgccttgacagcgcctagtagcccaggttcaagctggatgaaaaaagaccagcctacctttacactgcggcaggtaggtataatctgcgaaagattgcttaaagattacgaggataaaattcgagaggagtatgagcagatcctgaacacaaagctggccgaacaatacgagtccttcgtcaaatttacacatgaccagattatgcggaggtacggcaccagacccacgtcttacgtaagttag

SEQ ID NO: 11287 - DNA, 444 bp, Artificial Sequence
  Description of Artificial Sequence: Synthetic coding sequence
atggcttgtggcgctacacttaaacgtcccatggagttcgaggccgcactcctgtcacccggcagccctaaacgcaggaggtgcgcacctctgccggggccgactcccggcctgcggcccccggacgcggaacccccgcccccgttccaaacacagaccccgccacagagcttgcaacaacctgctccaccgggatcggaacgtaggctgcctactcccgagcagatttttcagaatattaaacaggagtattcacgctaccagagatggagacacttggaggtggtactgaaccagtccgaggcttgcgcttctgagagccagcctcacagctctgccctcaccgccccgtcatctccagagcaatatgagagtttcgtcaaatttacccacgatcagatcatgcggcgttacggaactagacccacgagctatgttagttag

SEQ ID NO: 11288 - DNA, 612 bp, Artificial Sequence
  Description of Artificial Sequence: Synthetic coding sequence
atggcatgtggggcgacactcaagagaaccctcgacttcgaccctctcttgagcccagcttcacccaagagaagacgttgcgctccgctgtcagctcctacatcggccgccgcttctcccctgagcgctgcagctgccactgctgcctcattctcagccgcagctgccagcccgcagaaatacttaaggatggagccttctccctttggagacgtgagttcaaggctcaccacagagcagatcctctacaacattaagcaggagtacaaaagaatgcagaagagacgccatctggagacttcattccaacagactgacccctgctgcacctctgacgcacagccccacgcatttctcctgagcgggcccgcctccccagggacgagttcggccgcctctagtccgctgaagaaggagcagcccctttttacgctccgccaggtgggaatgatatgcgagaggctgctgaaggaacgcgaagagaaggtgcgggaagaatacgaggagatactaaatacaaaactggctgagcagtacgatgcctttgtaaaatttacccatgatcagatcatgaggagatatggagagcagcctgccagttacgtgtcctag

SEQ ID NO: 11289 - DNA, 5724 bp, Artificial Sequence
  Description of Artificial Sequence: Synthetic coding sequence
atggaggtggcgtggttggtgtacgtgctagggcagcaacccttagccaggcagggcgaaggccagtcaagactggtgcccggccgaggtctcgtcctgtggttgcctggtctgcctcgctccagccctagctggcccgccgttgacttagccccgctcgcccccgccaggccccgcggacctctcatctgtcatacaggacatgagcaggctggccgcgagccaggccccggcagctctacaaagggtcctgtcctgcacgatcaggacacccggtgtgcattccttcccagaccacccgggcccctgcaaaccaggcggtattgccgtcaccagggaagacaaggctcaggtctgggcgctgggcctggggctggtacttgggcacccgcaccacccggcgtttcgaaacctaggtgccccggccgggcaagaccaggggaaggacaacagcaggtgactacagctcgacccccggccattaaccggggcgcacgccaaccgcgagccggagcagccgcagcgggcaggggtcccggagccggggcatggagaacaggagaggccgctgcctccgcagggcccgcggtcggagaaggcggagctatgggctcccgaagagcaccctcccgtgggtggggggctggtggccggtctggtgccggcggtgatggagaagatgacggacccgtgtggatccctagccctgcaagccgctcttaccttctctccgtgcgacccgagacctcgctctcatccaatcgcctgagtcacccttcatcaggtagatcaacattttgctcaattattgctcagctgaccgaagagacccaacccctcttcgaaactaccctcaagagtaggtcagtgtccgaagacagcgacgtacgatttacttgcatcgtgaccggctatcccgagcctgaggtaacctggtacaaggatgacactgaactggatcgatattgtggacttcccaagtacgaaattacccatcaaggtaatagacacacccttcaattgtacagatgccgagaagaagacgcggccatttaccaagcttcagcacagaatagcaaggggatcgtgtcttgctctggcgttctggaagtgggaactatgacggagtataagatacaccagcggtggtttgcgaagttgaaaaggaaggccgctgccaagctgcgagagatcgaacagtcctggaaacatgaaaaggctgtcccaggggaggtggacactctgagaaaattgtctccggacagattccagcgcaagaggcggctctcaggagcccaagctccaggtccttctgtgcctacccgcgaacccgaaggtggtaccctggccgcttggcaggaaggagagacagaaaccgcgcagcacagtggcctcggcctcatcaactccttcgcctcgggtgaggtgacaaccaatggagaggccgcccctgaaaatggggaagatggagaacacgggctgcttacttatatctgtgacgctatggaactgggcccacagcgcgcactgaaagaagagtcgggagccaaaaagaaaaagaaggacgaagagagtaaacagggactgagaaaaccggagctggaaaaggccgctcagagtcggagatcatcagagaattgcattccatccagcgacgagcccgattcgtgtggaacccagggtcctgtcggggttgagcaggtccagacccaaccgagagggcgagccgccagaggccccggctcgtccggcaccgactccacacgcaagccagcttccgctgtggggaccccggataaagcccagaaagcacccggtccaggcccgggacaggaagtctacttttcactcaaggatatgtatctggaaaatactcaggcagttcgccccctgggagaggagggcccgcagactctgagcgtgagggcccccggcgagtcacctaagggcaaagccccccttcgagccagaagcgaaggagtgccgggcgcccccgggcagccaactcactccctgactcctcagcctacacgtccatttaatagaaagagatttgcaccgcctaagccaaaaggcgaggccacaactgactcaaagcccatctccagtctgtctcaggccccagaatgcggagcccaatccctggggaaagctccaccccaagcatctgtccaggtgcctactccccccgccagacgacgccacgggacacgcgactctactcttcagggacaggccggtcacaggacaccaggagaagtgctcgagtgtcagaccaccacagccccgaccatgtcagccagctcctccagcgacgtggcctcaatcggagtaagtacatccggatctcagggaattattgaacctatggacatggagacacaggaggacggaaggacctcagctaatcagcgaactggcagcaagaagaatgtacaggcagacggcaaaatccaagtcgacggcagaactcggggtgacggaactcagacggcgcagcgtactagggccgatcggaaaacccaggtcgatgcaggcactcaggaaagcaagcgtccccagtcagataggtctgcccagaaaggaatgatgacgcagggaagagccgaaacacaactcgagacaactcaggctggagagaaaattcaggaagacaggaaggctcaggctgacaagggaacacaggaggatcgaaggatgcagggagagaaaggcatgcaaggtgagaagggaacccaatccgaaggcagtgctcctactgcaatggagggccagtcagagcaggaggtggccacctcccttgggcctccttctcggacacctaagctgccccctacggcgggcccgagagctcccctcaacatagagtgttttgtccaaactccggagggatcctgcttccctaaaaaaccaggttgccttccaaggtcagaagaggccgtggttaccgccagccgaaaccatgagcaaaccgtacttggacccctgagcggaaacctcatgttgcctgcacagccccctcacgaaggctcggtggaacaggtgggcggggaacggtgcagggggccacaaagctctggtcctgtggaggccaagcaagaagattcaccttttcagtgcccgaaagaggagcggcccggcggggtgccatgtatggaccagggaggctgtccgctggccggactgagccaggaggttcctacgatgccctccttgcctggaaccggcctgacagcctccccaaaggcaggcccctgctcaacccccactagccaacacggcagcaccgcaaccttcctgccctctgaggatcaggtgctcatgtcaagtgcacctacgctccacctggggctcggaacgccaacacagtcccacccgcctgaaacaatggcaacatcttccgaaggtgcctgcgctcaggtaccagacgtagaaggacgaacccctggacccaggagttgtgatccaggcttaatcgactccctgaagaattacttactgcttcttttaaagctgtcgagtacagagacaagcggggctggcggggaatcacaagtaggtgccgctacgggggggctcgtgccgtcagccacattgactcccactgtcgaagttgcagggctatctcctcggacctcacgcagaatcttagagagagtcgagaacaatcacctcgttcagagcgcgcaaacccttctcctaagtccctgtacttcacggcgccttaccgggttactagatcgggaagtgcaggctggtagacaggcattagcagctgctcgaggctcttggggacctgggcccagctcactgacagtgccagcgatcgtggtagacgaagaggatccaggactggcgtcagagggagcctcagagggcgaaggcgaagtcagtcccgaaggccccgggctcctgggcgcaagccaagagagctccatggctgggagactaggcgaagcgggtggacaagcggcccctggacagggcccttccgcagaatccatagcccaagaaccatcccaagaagagaaattccccggcgaggcactgaccggtctgccagccgccacaccagaagagttggccttgggcgcccgcaggaaacgctttttgcctaaggtgagggcagccggcgacggcgaggcaaccacacccgaagaaagagaatctccaactgtgtccccaaggggcccccgcaagagcctcgtgcctggctcccctggtactcccggccgggaacgccggagccccactcagggacgcaaggcctccatgctcgaggtgcctcgggcagaagaggaactggccgctggtgatttgggccctagcccaaaggccgggggactggacactgaggtggcccttgacgagggaaaacaggaaaccttggccaaaccacgtaaagcaaaagacctcctcaaggcacctcaggtgatccgcaagattagagttgagcaattccccgacgcctccggatctttgaaactgtggtgccagttttttaacattctgtcggacagcgtgttgacctgggccaaagaccagcgccctgttggtgaagttggacgctcagccggtgacgagggccctgcagccttggctatcgtacaggctagccctgtggactgtggggtctacaggtgtaccattcacaatgagcatggcagcgcctccacagatttttgcctcagcccggaggtgctttccggtttcatttctcgtgaagaaggtgaggtcggtgaagagatcgagatgacccccatggtctttgctaaaggccttgctgacagcggctgttggggtgataaactgttcggccgcctggtgagcgaggagctgcggggcggcggttacggttgcggattacgcaaagcaagccaggctaaggtaatttacgggctcgagccaatattcgaatccggccgcacatgcatcatcaaggtgagtagcctgctggtcttcggccccagtagcgagacatctctggtgggtcggaattatgatgtcacaattcaaggctgcaagattcagaatatgagcagagagtattgcaagattttcgccgccgaggcgagagccgcccctgggtttggcgaggtgcctgaaatcatacccctgtacttgatctatagacctgcaaacaatatcccttatgcaacccttgaagaggatctgggaaaacccctggagtcctattgtagccgcgaatgggggtgtgccgaagctccaaccgcgagtggctcttctgaagctatgcagaaatgtcagacgtttcaacactggctataccaatggaccaatgggagtttcctggtgactgatctggcaggcgtcgattggaagatgacagatgtgcagatcgcgactaagctgcggggttatcaaggtctgaaagaatcatgcttccccgcactccttgacaggttcgcctccagccatcagtgtaacgcgtactgtgagctgttggggctgactccactcaagggccctgaagctgcacaccctcaggcgaaggcaaagggaagtaaatcacccagtgcaggaaggaaaggctctcagctgtctccccagccccaaaagaagggcctgcccagcccccagggcactcgtaaatctgctccgtcctccaaagcgacacctcaagcatccgagcccgttaccactcagcttctaggtcagccccctacacaggaagaaggctccaaagcccaaggaatgagatag

SEQ ID NO: 11290 - DNA, 225 bp, Artificial Sequence
  Description of Artificial Sequence: Synthetic coding sequence
atggattctgaggtgcaacgcgacggcaggatactcgatctcattgatgatgcctggcgcgaagacaaattgccatacgaggatgtggcgatcccccttaatgagctgcccgaaccagagcaggacaatggaggcaccactgagagcgtaaaagagcaagaaatgaaatggactgacctcgcactgcagtacctccacgaaaacgtccctcctatcggaaattag

SEQ ID NO: 11291 - DNA, 225 bp, Artificial Sequence
  Description of Artificial Sequence: Synthetic coding sequence
atggattctgaagtccagcgagatgggcgtattttggaccttatagacgatgcgtggagagaagacaaacttccctacgaggatgtcgccatcccattaaatgagctgcccgaaccggaacaggataacggaggcaccacggaaagtgtgaaagagcaggagatgaaatggactgatctggcactgcagtatttacacgagaatgttccgccaatcggaaattag

SEQ ID NO: 11292 - DNA, 225 bp, Artificial Sequence
  Description of Artificial Sequence: Synthetic coding sequence
atggattcagaggtacagagggatggtagaattctggacctgatcgacgatgcctggcgcgaggacaagctgccctatgaagacgtggccatcccactcaacgaacttccagaacctgagcaggataatggtgggaccacagagtccgttaaggagcaggagatgaaatggacagatctggctctacagtatctgcatgagaatgtccccccaattggtaattag

SEQ ID NO: 11293 - DNA, 225 bp, Artificial Sequence
  Description of Artificial Sequence: Synthetic coding sequence
atggatagcgaagtccagagggacggccgaatcctcgatctgatcgacgatgcctggcgagaagataaactgccatatgaggacgtggcgatacctcttaacgaacttcccgagcctgaacaagacaatggaggcacaacagaaagtgtcaaagaacaagagatgaagtggacagatttagcacttcagtacctgcatgagaacgtcccccctattggcaattag

SEQ ID NO: 11294 - DNA, 1848 bp, Artificial Sequence
  Description of Artificial Sequence: Synthetic coding sequence
atgtgttccgaagcgcgcctcgctcggcgcctccgtgacgccttacgcgaggaggaaccgtgggcagtggaagaactgctgaggtgcggagctgaccccaacttggtactagaagacggcgccgcagccgtgcaccttgcagcaggtgcccgtcatccacggggattgagatgtctgggagctttacttcggcaggggggggaccccaatgcccgtagcgtcgaggctcttactccactgcacgttgccgccgcatggggctgtaggagagggctggaactccttctaagccagggggcagacccagcactccgggaccaggatgggctgcggccccttgacttggccctgcaacagggccacctagaatgtgccagggtgctgcaggacctggatactagaacacgtacacgaacacgtatcggagctgaaactcaggagccagagcctgctccaggcactcccggattgagtggtccaacagacgaaacgttagactctatcgctcttcagaagcagccgtgccggggggacaatagggacatcgggcttgaagccgaccccggtcccccatccttgcccgtgcctctggagaccgtagacaaacacgggtcttctgcgagccccccgggacactgggactactcttccgatgcgagctttgtgaccgctgtggaggtgtccggggcagaggacccagcttccgacacaccgccatgggcaggctctctgcccccaacgaggcagggactgctgcacgtagtgcacgccaatcagagggtccctcgcagtcagggtactgaggcggaactgaatgccaggctgcaggcactgaccctaactccgcctaatgcggctggtttccaatcaagtccttcatccatgcctcttctcgatcgatcgcccgcgcacagtccccccaggacacccacacccggagcttccgattgtcactgcctgtgggagcaccagacttctatcgactccgatatggccactttgtggctcacggaggatgaagcaagctcgacgggagggcgcgagcccgtggggccatgcaggcatttaccggtgtctacggtgagcgatctcgaactgttaaaagggctccgggccctgggagagaaccctcacccaatcaccccgttcaccagacagctataccatcaacagctggaagaggctcaaatcgctcctgggccagaattctccggccactcgctggaactggcagccgcgcttcgcactggatgtattcctgacgtgcaggccgacgaggatgccctcgcacagcaatttgaacagccagatcctgcacgtcgatggcgtgaaggcgtagtcaagtctagttttacctacttgctgctggatcctagggagactcaggacctgccagcacgcgccttctctcttaccccggcagaaagactgcaaactttcatcagggcaatattctatgtcggcaaaggaactcgcgctcgcccgtacgtgcacctctgggaggcgttggggcaccacggtagatcaaggaagcaaccccaccaggcatgtcccaaagttcggcagattctagatatttgggctagtggatgcggcgtagtaagtctgcattgcttccagcacgtggtagctgtcgaagcctatacacgtgaagcctgcattgtagaggccttgggaattcaaacactcaccaaccagaaacagggccactgctacggcgtcgtggcaggctggcctccagcacggcgcaggcggcttggcgtgcatctgctgcacagagcgctgctagttttccttgctgaaggcgaacgccagttgcatccccaagacattcaggcacgcggttag

SEQ ID NO: 11295 - DNA, 1320 bp, Artificial Sequence
  Description of Artificial Sequence: Synthetic coding sequence
atgtggaccccagtaaggaggggagcggcatggcttgggaccctactgggccctggtgaaggtccccctgaacctcgaggcggcgctgcccacgcccataaacctcccgcaggaagccgaaagagtaccgaccaggctgtgagattcggcccctcacaggggatgtgctctgaagcaaggctcgcccggcggctgagggatgcattgagagaagaggaaccgtgggctgtggaagaattgctgagatgcggggctgaccctaacctggtgcttgaagatggggctgctgcggtgcacctggctgcaggggcgagacatcctcgaggcttgcgatgcttaggggcgttgcttcggcagggaggagatcctaatgcacgctctgtcgaggctcttacccctttacacgtggcagctgcatgggggtgcaggcggggccttgagctgctgctgtcacagggcgcagacccggctctcagagatcaggacggcttaaggccactggatctagcccttcagcagggtcacctggagtgcgccagggtgctgcaagatctcgatactcgcactcgcacgcggacaagaataggcgcagaaacccaggagccggaacccgcccccgggactccaggtctgagcggtcctaccgatgaaaccttggatagtatcgcgctgcagaaacagccatgtcgcggtgacaatcgagatatcggcctggaagcagatccaggcccaccatccttgccagtgcctttagagacggtcgacaaacacgggtcttccgcttccccacccgggcattgggactattctagcgacgctagctttgttaccgccgtcgaagtgagtggtgccgaggaccccgccagtgacacgccaccttgggccggaagcctaccccccacacgccaaggcctgctccatgttgtgcacgcaaatcagcgcgtcccaagaagtcaaggtaccgaagccgagctcaatgcacgcctacaggccctcactctcactccccccaacgctgcgggtttccaatcttcccccagtagtatgccactactagacagatctcccgcccatagcccaccaagaacccctactcccggcgcatcagattgtcattgcctttgggaacaccagactagcatagatagcgacatggcgacactgtggttgaccgaagacgaggcctcttccacaggaggacgcgagccagttggaccgtgccggcatctgcccgtctctacagtttcagatctcgaattactcaaaggcctcagggctctaggccggctgagaacgtgtcagccggaaccgtcacattag

SEQ ID NO: 11296 - DNA, 1821 bp, Artificial Sequence
  Description of Artificial Sequence: Synthetic coding sequence
atgtgctctgaagcccgtctagcacgacgactccgagatgctctccgtgaggaagagccatgggccgtggaagagttgcttcggtgtggagcagaccccaatttggtgctagaggatggggcggcagccgtgcacttagcggctggcgcacgtcatccacgcggactgaggtgcttaggggcccttttacgacaaggtggggacccgaacgctcgctctgttgaagcactcacacccctgcatgtggccgctgcttgggggtgccgacgagggctggagctgctcctgagccaaggagccgatccggctctgcgcgatcaagacggattgagacctctggatctggctttgcagcagggacatctcgagtgcgccagagttctgcaagatctggacactcggacacgtacacgtacccgaattggggcggaaacccaggaaccagaacctgccccggggacacccggactctccggacctacggatgaaacgttggactctattgcccttcaaaagcagccttgcaggggtgacaatagagacatcgggctagaagccgatcctgggccaccatccctgccagtcccacttgaaaccgtggataagcacggaagcagcgcgtcccctcccgggcattgggattatagcagcgacgcctcgtttgtgactgcagtcgaggtcagtggtgctgaggatcccgccagcgatacgcctccctgggcggggtctctgccccctacaaggcagggcctgttgcatgtggtccacgcaaatcagcgagtgccacggagccaaggcaccgaggccgagctgaacgcccggctgcaggccttgacgttgaccccgcctaacgctgcgggtttccaatcaagcccgtcttcgatgccattgttggatcgttccccagctcactcaccaccccgtacaccaactcctggggcgtcagactgccattgcctgtgggaacaccaaacttccatcgacagtgacatggcgacactttggctcaccgaagacgaggcatcttcaactggcggtagggagcctgtcgggccgtgccggcatttgcccgtctccacggtatctgacctggagttattaaaggggctccgcgccctaggacccgaattttctggacactcattggaattggcggcagcactacgcaccgggtgtatccctgatgtgcaggcagatgaggatgcactggcccagcagttcgagcaaccagaccccgcccgtagatggagagagggcgtcgtgaagtcaagttttacctacctgctgctcgatcccagggaaacacaagacctgccagcaagggcctttagccttacgcctgccgaacgactccaaacttttatccgcgccatcttctatgtgggaaaaggaactagagcccgcccatacgtacatctatgggaggccctgggacaccatggcagaagccgcaagcagggcagccgccgaagccccactagaagcaagggcacagccatggaatggtggcaggccggacacctgttggttgcgggcgcatggggttgcacttgctgtactgtgcctagtctgagttcctggctcaaggcttctgactcatttattcctcgcacttccagaccaggggctgaatgttggggcgtgggacatccggcctggggggagatgtttgaatgttccagttgccctatgttgaccgccgcccccatttctgggttccgccgaggagtgtgtgtgtgtgtttgtgtgtgcgtctgcgtctgtgtttgcgtgtgtgtgtgcgtttgccgcgaacacccgggacggtcccctccggggtag

SEQ ID NO: 11297 - DNA, 1848 bp, Artificial Sequence
  Description of Artificial Sequence: Synthetic coding sequence
atgtgcagtgaggcccgactggcccggagactaagagacgccttgcgcgaggaggagccatgggcggtcgaggagttgctgcgatgcggggctgatcccaacctcgtcttagaggacggcgctgccgctgtgcatcttgccgctggggcgaggcacccccgaggattgaggtgtctaggagccctgcttaggcaaggcggtgacccaaatgcgcgtagcgtagaagccttgactcccctccatgtggccgcagcatggggatgccggaggggtctggagcttctgctgtcccagggagctgatcccgcactgagagatcaggacggactgcgaccccttgatctggcactgcaacagggccatttagagtgtgcccgggttcttcaggacctcgacactcgcacccgcactcgtacacgaataggcgccgagacacaagaaccagagcccgccccgggcaccccaggcctgtctgggccgaccgatgagaccctggacagtatcgccctgcagaaacaaccatgtaggggggacaaccgcgacattggtctggaagctgaccctggaccaccctcacttccggtaccattggagacagttgataagcatggtagtagtgcgtccccccctggacactgggattactcttctgatgcaagtttcgtcaccgcagtcgaggtgtcaggggcagaagacccagcttcggacacgcctccttgggctggaagcctcccacctactcggcagggcttgcttcacgtagttcacgccaaccagagagtgccccgctcgcaggggaccgaagccgagttgaacgcccgtctgcaggcgctgacccttactccccccaacgctgctggattccagagttcacccagctccatgcctctactcgaccggagcccggcgcatagcccacctagaacacctaccccgggcgctagtgattgccactgcctatgggaacaccagacgtccattgacagcgatatggccaccttgtggctaactgaggacgaagcctccagcaccggaggcagagagcccgtggggccatgccggcacctccctgtgtcgactgtgtcagacctagagctgctcaaaggactgcgggccctgggggagaacccccaccccatcacacctttcacaaggcagctctaccaccaacagcttgaagaagcgcagatcgctcccggtccggagttctctggccattcgctggagctggctgccgcgcttcgcacgggatgtatccccgacgttcaagctgacgaagacgcgctcgcacagcagttcgagcagcccgatcccgctcgtaggtggcgtgaaggcgtggttaagtcatcattcacctaccttctcctcgaccctagggagacccaggacctccctgctagggcctttagcttaactcctgcagaacgcctacagactttcatccgagccatcttctatgtcgggaaaggcactcgggctaggccctacgtgcacttatgggaggctctcgggcaccacggacggtcaagaaagcaacctcaccaggcctgtccaaaagttcgacagatcctagatatctgggccagtgggtgcggcgtggtgagtctacattgttttcagcacgtcgtggctgtggaagcctatacgagggaggcatgcattgtagaggctttgggcatccagactctgactaaccaaaaacagggccattgttacggcgtggtagcaggatggcctccggctaggagacgaaggctgggggtgcaccttctacacagagctttgctcgtcttcctcgccgaaggcgaacgccaactccacccccaagacatccaggctcggggttag

SEQ ID NO: 11298 - DNA, 720 bp, Artificial Sequence
  Description of Artificial Sequence: Synthetic coding sequence
atggaaaaggaaaaaggcaatgacgacgggatcccggaccaggagaatagccttgatttcagcgaacattttaatcagctggaactactggaaactcatgggcatctgattccaacgggcacccaaagtctctgggttgggaactctgatgaggacgaagaacaggatgataagaatgaggaatggtatcggctccaggaaaagaaaatggaaaaggatccctccagactactgctgtgggccgctgagaagaaccggctcactacggtccgaaggctgctgtctgagaaggccacccacgtgaacactagagacgaggatgaatacaccccccttcatcgagccgcctattctggacaccttgacatcgtccaggagcttatagcgcaaggagctgacgtgcatgcggtgaccgtggacggctggactccactgcacagcgcctgtaagtggaataacacaagggtggccagctttctgttacaacatgatgctgacattaacgcacagacaaagggactgttgacccctttgcatctggcagccggtaatcgggattcgaaagataccctcgagttgcttctgatgaatagatacgtaaaaccggggctcaaaaacaatctcgaagagaccgctttcgatattgctcgaaggacttccatctatcactacctgtttgagatagtcgaaggttgcacgaacagcagcccccagtcctag

SEQ ID NO: 11299 - DNA, 720 bp, Artificial Sequence
  Description of Artificial Sequence: Synthetic coding sequence
atggagaaagagaagggcaacgatgatggtatccccgatcaggagaactctttggatttttcagagcattttaatcaactggagctgctggagacacatggacatctgatccctacaggtacacaatcgctgtgggtgggcaatagtgatgaagacgaggagcaggatgataaaaatgaggaatggtacaggctgcaggagaaaaagatggagaaagatcctagccgcctgctcctctgggcggcggagaaaaaccgcctgacaacagttcgacgactcctgagcgagaaagccacccatgtgaatactcgtgacgaggatgagtacactccgctgcaccgcgctgcgtactccggtcatctggacattgtgcaggagctgatagcccagggggctgacgttcatgcggtgacagtcgacggctggacccccctccatagtgcttgcaagtggaataatactcgggtcgccagctttctgttacaacatgatgcagacatcaatgctcagacaaagggattactgacgccgctgcacttagccgcgggcaatagagacagtaaggatacacttgagctgctgttaatgaataggtacgttaaaccaggcctgaagaacaacctggaagagaccgccttcgatattgcgaggaggacttctatctatcattacctctttgaaattgtcgagggctgcacgaattcttccccccagtcttag

SEQ ID NO: 11300 - DNA, 4458 bp, Artificial Sequence
  Description of Artificial Sequence: Synthetic coding sequence
atggccgctcccgctcagcccaaaaagattgtggctcctaccgtcagccaaattaatgccgaatttgtcacccagctggcgtgcaaatattgggccccccatatcaagaagaagagtccctttgatatcaaggtgatagaggatatctacgaaaaggagatcgttaagtctcgttttgcaattagaaagataatgttgttggagttttcccagtatctggagaattacctgtggatgaactattcccctgaggtgtcatccaaagcgtacctcatgtcaatctgttgcatggtaaatgaaaagtttcgggaaaacgtcccggcgtgggaaatttttaagaagaaaccagatcatttcccctttttctttaaacacatcttgaaagccgccctagctgaaactgatggtgagttttcattgcacgaacagaccgtcttgcttctcttcctggatcactgctttaatagccttgaggtggacctaattcggagccaggtgcaacagctgatttcgctgccgatgtggatgggcctgcagttggccagactcgagctggaattgaagaagaccccgaagctgagaaaattctggaacttaatcaaaaagaatgatgaaaagatggaccccgaagctagagaacaggcataccaggagcggcggtttctgtcccagctgattcagaagttcatcagtgtccttaagtccgtccccctgtctgagcctgtaaccatggataaggtgcactactgtgaaagattcatagaactgatgatcgacctggaggccttgcttccaacaagacgctggttcaacactatacttgacgattcccacttgcttgtccactgctatctgtctaacctcgttcgacgggaggaagacggacaccttttttctcagcttttggacatgctaaaattttatacaggattcgagatcaacgaccaaacaggcaatgcccttacggaaaatgaaatgacaacgatacattacgaccggatcacatcgctgcagcgcgcagccttcgcacactttcccgagctttacgacttcgctttgagtaatgtagctgaagtagataccagggaaagcctggtaaaattcttcggtccactctcatccaatactctccaccaagtggcatcttacctatgtttgctcccaacgctgcctaaaaatgaggacactactttcgataaggagttcctgctcgaacttttagtgagtcggcatgaacgcaggatcagccagatacaacagctgaaccagatgccgctgtaccccaccgagaaaatcatttgggatgagaatatcgtgcctacggaatattactccggcgaaggatgtttggcgttgcctaagctgaacttacagtttttgaccctgcatgattatctgctccgaaattttaacctgtttcgactcgaatcaacatatgagatccgacaggacatcgaggacagtgtatcaagaatgaagccctggcagagcgaatacggcggcgttgtttttggtgggtgggctcggatggctcaaccaatagttgccttcaccgtggtcgaggtggccaaaccaaacatcggcgagaattggccgacaagggtgagggccgacgtgacgattaatcttaatgtacgggaccacatcaaagatgagtgggaggggctccgaaagcacgacgtttgctttttaatcaccgtcagacccacaaaaccctacggaacgaaattcgaccgacgccgacctttcatcgagcaggtgggcctggtgtacgtcagaggctgcgagattcagggcatgctggatgacaaggggcgtgtgattgaggacgggcctgagccgcgacctaatttgcgcggggagtctcgcacgtttcgcgtgtttctggatcccaaccagtaccaacaagatatgacaaacacaatccaaaatggtgctgaggatgtgtatgagacttttaatataattatgcgacgcaaacctaaagagaacaacttcaaggctgttctcgaaaccatacgcaatcttatgaacaccgactgtgtcgtgccggactggttgcacgatatcatactgggctatggagatcctagctctgcacactactccaagatgcctaaccagatcgcaactctggactttaacgatacatttctgtccatcgaacatctgaaagctagcttccccggtcacaatgtgaaggtgactgtggaagatcctgcgctgcaaattccacccttcagaatcacattccctgtgcggtcaggcaaaggcaaaaagagaaaagacgcggacgttgaagatgaggataccgaggaggccaagacactgatcgtcgaaccacacgtgattccgaatcgcggcccttacccctacaaccaaccaaagaggaataccatacagtttacccatacacaaatcgaggcgatacgcgccggaatgcagcctgggcttacaatggttgtggggcctccggggaccgggaagaccgacgttgcagtgcagatcatttcaaacatctatcataacttcccagagcagagaaccctaatcgtgacccactcaaatcaagctttaaaccagctttttgagaagatcatggcactggatattgatgagagacatctgctgcggctcgggcatggagaggaggagttagaaactgaaaaggatttttctcgctatggacgcgtcaattatgtgcttgcccgacggattgagctgctagaggaggtgaaaaggttacagaaaagtttgggtgtgcctggtgacgccagttacacctgcgaaacagccggctatttctttctgtaccaggtgatgtccagatgggaagagtacatctcaaaggttaaaaacaaagggtctactctgccggatgttactgaggtgagtactttttttccttttcacgagtacttcgccaatgcaccccagccaatattcaagggacggtcttacgaagaggatatggagatcgctgagggttgttttaggcatattaagaagatcttcactcaactcgaggaatttagagcctccgagcttctacgctcgggcctggaccgctcaaagtacctgctcgttaaggaagcaaagatcatcgcaatgacgtgtactcacgccgcactaaaacgtcacgatttggtgaaacttggcttcaagtatgacaacatactcatggaggaagctgcccaaatcctggagatcgagacattcattccgttgctcctgcagaaccctcaggacggtttcagcaggttgaagcgctggataatgatcggcgaccaccaccagcttcccccagtcattaagaacatggcattccaaaagtatagtaatatggagcagtccctcttcacccgttttgttagagtgggggtgccaaccgtcgaccttgacgcacagggtcgggcccgcgcaagcctctgcaacctgtacaactggaggtacaagaacctcggcaatctccctcatgtgcagttgctgcctgaattctccaccgccaacgctggactactctatgactttcagctgatcaacgtcgaggactttcagggggtcggtgaatctgaacccaatccttacttctaccagaatctaggggaggccgaatatgtagttgccctttttatgtatatgtgtctccttggctatccagccgataaaatctccatcttaactacatataatggccagaagcaccttatacgagacatcatcaataggaggtgcgggaataaccctctgattggaaggcccaataaagttacgacagtggaccggttccagggccagcagaacgattacattctgcttagcctggtacggactagagcagttggtcacttacgcgacgtgcgtagattggtggtcgccatgtcaagagctaggctcggcctgtacatctttgccagagtctcattgttccaaaattgttttgaacttacacccgcctttagccagctaaccgcgaggccacttcacctgcatatcatccccaccgaaccattccctactacgcggaaaaatggagaaagacctagtcatgaggttcagattataaagaatatgccacagatggcaaacttcgtctataacatgtacatgcacctcatacagaccacacaccactaccaccagacactactccaactgccacctgcaatggtggaagagggcgaggaagttcaaaaccaggaaaccgagctggaaactgaggaggaggcgatgaccgtgcaggccgatattataccttctcccactgacacgagctgccgtcaggaaactcctgccttccagacagacacaactcctagcgagactggggcgacatcgaccccagaggccattcccgctttgagcgagactactccaacagttgtgggggctgtgtctgcccctgcggaagctaacacaccccaagatgccactagtgcgcccgaagagaccaagtag

SEQ ID NO: 11301 - DNA, 1083 bp, Artificial Sequence
  Description of Artificial Sequence: Synthetic coding sequence
atgcagatcattcgtcacagtgaacagaccctgaaaaccgctcttataagcaaaaatccggtgctcgtgtctcagtatgagaagctgaacgctggtgagcagagactcatgaacgaggctttccagcctgcatctgatctctttggacctatcacactgcattctccgagtgactggattaccagtcacccagaggcacctcaagactttgagcagttcttctcagatccctacagaaagactccatcccccaacaagagatccatatatatccagtctatcggtagcctggggaacacccgcatcatcagcgaagaatatatcaaatggttaaccggctactgtaaagcctacttctatgggctcagagtgaaacttctggagcctgtgcctgtttcagtcactcgatgtagctttcgggttaacgaaaacactcacaatctccagatccatgcaggcgacatcctcaagttccttaagaagaaaaagcccgaagacgccttttgcgtggtcggaattactatgattgatctctacccgagggattcttggaatttcgtctttgggcaggcttctctaactgacggcgttggcatcttctcattcgcccggtacggatccgatttttactctatgcattacaagggaaaggtcaagaagttgaaaaagactagcagcagcgattactccatttttgacaattattacatccccgaaataacctctgtgttactccttaggagttgtaaaaccctaacacatgagatcggacacatatttgggcttcggcactgccagtggctcgcttgcctaatgcagggctccaatcatctggaagaagcagaccgtcggcccttgaatctgtgtcccatttgcctgcataaacttcagtgcgctgttggctttagtatcgtggaaagatacaaagctctggtcagatggatcgatgatgaatcatcggataccccaggtgccactcccgagcactcacatgaggacaacggaaacctccctaaaccggttgaggcctttaaagagtggaaggagtggattatcaaatgtctggccgtgcttcaaaaatag

SEQ ID NO: 11302 - DNA, 2172 bp, Artificial Sequence
  Description of Artificial Sequence: Synthetic coding sequence
atggcagagtacaccaggttgcataatgccctggcgctgatcaggttaagaaatcctcctgtgaacgcaattagcactactctgctgagggacattaaggaggggcttcagaaggccgtgatcgaccacacgatcaaagctatagtcatttgtggcgcagaagggaagttctctgcaggagccgacatacggggtttctcagcaccccggacatttggccttacacttgggcacgtcgttgatgagatccagaggaacgaaaagcctgtagttgccgcaattcaggggatggcattcggcggtgggctcgagctggctttggggtgccactatcggatcgctcatgccgaggcccaggtgggactgcccgaggtcaccctgggacttctgcccggagcgcgtggcacccaactcctgcccaggctgactggcgttcccgccgcattggatctcataaccagcggtagacggatacttgctgacgaggcgctgaagttaggcatccttgacaaagttgtcaactcagaccccgtcgaggaggccattagatttgcccaacgggtaagtgaccagcctctggagtctagacgtctgtgcaacaagccaatccagagcctgcccaatatggattccatcttctccgaagctctgctgaaaatgcgtcgacagcatcctggctgtttagcacaggaagcatgtgtccgagcggtgcaggcggctgttcaatacccatatgaagtgggcatcaagaaggaggaagagctgtttctgtaccttctgcagtcggggcaggctagagccctgcaatacgcattctttgcggagaggaaggcgaacaaatggagtactccatccggagcttcatggaaaacggccagcgctcgtccggtgtccagcgtgggcgttgtgggcctaggaacgatggggagaggcattgtgatttcattcgcaagagcacgcattcccgttatcgcagtcgactccgataagaatcaactggctactgcaaacaaaatgattacctctgtgcttgaaaaggaagccagcaaaatgcaacagtccggccacccttggagcgggcccaagcctaggctcacgtccagcgtgaaggagctcggcggcgttgacctggtgatcgaagctgtatttgaagaaatgtctttgaagaagcaggtttttgctgaactgagcgcagtctgcaagccggaggctttcctgtgcacaaatacatctgcacttgatgtggatgagattgcctcttcaacagaccggccccacctggtaatcggaacccacttcttcagtcctgcgcacgtcatgaaactcctggaagtgatccccagtcagtactctagcccaaccaccattgcaacggtgatgaatttatctaaaaaaatcaagaagattggggtagtggtggggaactgttttggattcgtcggaaaccggatgctgaatccatactataaccaggcgtacttcttgttggaggagggatctaagccggaggaggtggaccaagtgttggaggaatttggttttaagatgggacccttcagggtgtccgacctcgccgggcttgatgttgggtggaaaagtcggaagggccagggcctgacaggacccactctgctgccgggcacacctgcccgcaagagaggcaaccgccgctactgtccaatacctgatgtgctatgcgaacttggacgattcggccagaaaacaggcaagggatggtatcaatacgataagcccctgggccgcattcacaaacctgatccgtggttgagtaagtttctttcgcgctacaggaaaacccaccatatagagcctcgcacaatctcccaggatgagatactggaaaggtgcttgtactcgctgattaacgaggccttcagaatcctcggcgaaggaatcgcggcatctcctgaacatattgatgtggtttacttgcacggatatggctggccacgccataaaggcggtccaatgttttacgcaagtactgtgggcttacctaccgtgctcgaaaagctgcagaaatactacaggcaaaatcccgatatcccacagctcgaaccaagtgattacctgaaaaaattggcctctcaggggaacccacctctgaaggaatggcagtctctggctggctctccctccagcaagctgtag

SEQ ID NO: 11303 - DNA, 1875 bp, Artificial Sequence
  Description of Artificial Sequence: Synthetic coding sequence
atgactcaggctgagaagggcgacactgaaaacggaaaggaaaagggcggtgaaaaggagaaggaacagcgtggcgtaaaacggcccatagtgccggctcttgttcccgagagcctgcaggagcagatccagtccaacttcatcatcgttatccatcccggttccaccacactgaggatcggtagagctacagacacgctcccggcctcaataccccatgtgatagcccggcgccacaagcagcagggacaacccctgtacaaggacagctggttgttgagggaaggtctcaataagccagaatcaaacgagcagaggcaaaatggccttaaaatggtggaccaggctatttggtcaaagaagatgtcaaacgggacgcgcagaattccagtgagtcctgagcaggcccggtcttataacaagcagatgcggccagcgatcctcgaccactgttctggaaacaaatggacaaacactagccaccatcctgagtacctagtgggagaggaagctctctacgtgaaccctctggactgctataatatccattggccaatacggagaggccagctcaacatccaccccggtcccgggggatcactcactgcggtgctcgctgacatagaggtgatctggtcccacgctattcaaaaatatttagagatcccactgaaggacctcaaatattaccgatgcatcctgctaatacccgatatatataataaacaacacgttaaggaactcgttaatatgatactcatgaaaatgggtttcagcggcattgtggttcatcaggagtcagtttgcgctacgtatggctccggtctctcttcgacatgcattgtggacgttggcgaccagaaaacatctgtgtgttgcgtggaggacggcgtgtcgcataggaacaccagattatgccttgcttacggcggatccgatgtgagcagatgtttctattggctgatgcagagagctggcttcccatacagagaatgccagctaaccaacaaaatggactgcttattgctgcagcacctcaaagaaacattttgccacctggaccaggatatctccggattgcaggaccatgaattccagatcagacaccccgattctccagccttgctctaccaattcagactgggcgacgaaaaactccaggcacccatggccctcttttatccggccaccttcgggatagttggacaaaaaatgactaccttacaacacaggtcacagggcgaccccgaggacccacacgacgagcactacctcttggccactcaatcgaaacaggagcaaagcgctaaggctacggctgaccggaaaagcgcttcaaagccaatcgggtttgaaggtgatttacgcggtcaatcatcagatctacctgaaaggctgcattcccaggaggtggacctgggatccgctcagggcgacggtcttatggctggaaacgatagtgaggaggccctcacagctttgatgagcagaaagacagctataagcctcttcgaaggcaaggctcttggcctcgacaaagctatcctgcatagtattgactgctgctcatccgatgatactaagaaaaaaatgtattcaagcattctggttgtaggtggcggcctgatgtttcacaaagctcaggaatttttgcaacaccgcatcctgaacaaaatgcccccctcctttcgtcgtattatcgagaacgtggacgtgatcacacggcctaaggacatggatccgcggctgatcgcatggaaaggaggtgctgtgttggcatgcttagacaccacacaggagctgtggatctaccagagggagtggcagcgtttcggcgtgcgaatgctgcgggagagggcagcatttgtctggtag

SEQ ID NO: 11304 - DNA, 2364 bp, Artificial Sequence
  Description of Artificial Sequence: Synthetic coding sequence
atggccgcaactaccgctaaccctgaaatgacctcggacgtaccgtccctagggcccgctattgcttctggtaatagcggccccggcatccagggaggaggggcaattgtgcagagggctataaagcggaggcctggactcgatttcgacgatgacggcgaggggaatagcaaattcctccgctgtgacgacgaccagatgagcaacgacaaggaacgtttcgctagatccgatgacgagcaatccagcgcagacaaggaaaggctggcacgagagaaccattccgagatagagcgccgacggaggaacaagatgacggcttatatcactgagctaagtgacatggtgccaacatgcagcgcattggctagaaaaccggataagttgaccatcctcagaatggcagtctcccacatgaagtccttacggggaactgggaatacttccacagacgggagctacaagccttcgtttctgacggaccaggagctgaaacacctgatcctcgaagcagccgatggcttcctattcatagtgagctgtgaaacagggcgcgtggtgtacgtatcagacagtgtgacccctgtgctaaaccagccgcaaagtgagtggttcggatccacactgtatgatcaagtccaccccgacgatgtggacaagctcagggagcagctcagtaccagtgagaacgcactgacgggcaggattttagacctgaagacagggaccgttaaaaaggaaggccagcagtccagtatgcggatgtgtatgggctcaaggcgcagctttatttgccggatgagatgtggctcttccagcgtggatcccgtgagtgtcaatcggctgtctttcgtacgaaataggtgccggaacggtttgggcagtgtgaaggatggagaacctcactttgtggtggtacactgtacaggctacattaaagcatggccgcccgccggggtcagcctgccagacgatgatcccgaggcgggtcagggctccaagttctgtctcgtcgccattggcaggttacaagttacgagctcgcctaattgcacagacatgagtaacgtctgccagcctaccgagttcatctctagacataatattgaaggcattttcactttcgtggatcacaggtgcgttgccacggtcgggtaccagccccaggagcttctgggcaaaaatatagtggaattttgtcatcccgaagaccagcagttgctgagggattcttttcaacaagtggtgaagctaaagggtcaagtcctttctgtgatgtttcgctttcgatcgaagaatcaggagtggttatggatgaggacatcttccttcacattccaaaacccctacagcgatgaaattgaatacatcatctgcaccaacacgaacgtcaagaattcaagccaggagccccgtcccacattgtctaacacaattcagcgccctcagttgggtcctacagccaatctgccattggagatgggatccggccaattggcgccccgccagcaacaacagcagactgagcttgatatggtcccaggcagagacggtctggcatcatataatcattcccaagtcgtccagccagttaccacgacggggccagaacatagtaagccgcttgagaagagcgatggcctgttcgctcaggacagagacccgagattcagcgagatctaccacaatataaacgccgatcagtcgaagggaatttctagtagtacagtgcccgcaacccagcaactcttctcacaaggcaacacattccccccaacccctagacccgcagagaacttcagtggacttgcacctcccgtcacaatagtgcagcccagcgcctcagccggccaaatgcttgctcagattagcagacattctaatccaacacagggcgccacaccgacttggactccgactactcgctctgggttcagcgcgcaacaagttgccacccaagccactgcgaaaactcgcacgagccagtttggggtcggatccttccagacccctagttctttttccagcatgtcgctccccggggctcccaccgcttctcctggtgccgccgcatacccctcacttactaatagaggtagcaatttcgccccggagaccggacagactgcgggtcagtttcagacaaggacggctgaaggagtgggggtttggccgcagtggcagggacagcagccccaccaccggtcgagctcctccgaacagcacgtgcaacagccccccgcacagcagcccggccagccggaggtatttcaagaaatgttgtctatgttaggcgatcagtcaaactcatacaacaatgaggagtttccagatctcactatgttcccccctttctccgaatag

SEQ ID NO: 11305 - DNA, 2370 bp, Artificial Sequence
  Description of Artificial Sequence: Synthetic coding sequence
atggcagccaccaccgcgaaccctgagatgaccagcgatgtgccctcgcttggcccagcaattgcctccgggaacagcgggccgggaattcagggcggaggtgctattgtccagcgagccatcaaaaggcggcctggcctagactttgacgacgacggcgagggtaattctaagttcctgagatgtgacgacgaccagatgtcaaatgacaaagagagatttgctcgctccgacgacgagcagtcgagcgccgataaggagaggctggcacgggaaaaccactcagaaatcgagagaagacggcgaaataagatgaccgcctacatcacagagctcagtgatatggtgcccacatgcagcgctttggcccggaagcctgataagctaaccatcctgaggatggctgtgtctcacatgaaatcactgagaggtactgggaatacctccactgatggcagctataagcccagcttcctgaccgatcaagagctgaaacacttgattctggaagccgcagacggctttctgtttattgtctcctgtgagacgggtcgcgtcgtttacgttagcgattccgtcacaccggtgttaaaccagccacaaagtgagtggttcggaagtacactttatgatcaagttcacccagatgacgtggataaattgcgggagcaactttcaacaagtgaaaacgcactgaccgggagaattctggatctcaaaacaggaacggtgaagaaggaaggccagcaatcgagcatgcgaatgtgcatggggtcacgaaggagcttcatttgccgcatgagatgcgggtcaagtagcgtcgatccagtgagcgttaataggctttcctttgtgaggaatagatgccggaacggcctgggtagtgtgaaggatggcgaacctcatttcgtggtggtgcattgtactggttatattaaagcttggcccccggcaggcgtgtctctcccggatgacgatcccgaagcggggcaaggatccaaattttgtctggttgcaattgggagattacaggttacttcttccccgaattgcaccgacatgtctaacgtttgccaacctacagagtttatttcacgacataatattgagggaatcttcacttttgtagaccatcgttgtgtagctaccgttgggtatcagccgcaagaacttctcgggaagaatatagtcgagttctgtcaccctgaggaccagcagctgctgcgtgattccttccagcaggttgtgaagctgaagggccaggtgctgtccgttatgtttaggttccgctcaaagaaccaagagtggctctggatgcgaacctcttcttttacctttcagaatccttattcagacgagatcgaatatatcatctgtacaaataccaacgtcaaaaacagctctcaagaaccacggcccactctaagtaacaccatccagaggccacagctggggcctacagccaacttaccactggagatgggcagcgggcagttggcaccaagacaacagcagcagcagacggagttggacatggtccccggcagggatggtctagcctcttacaaccacagccaggtggtgcagcccgttaccacgaccgggcccgaacattctaagcctctggaaaaaagtgatgggctctttgcgcaggacagggatcctagattcagtgagatctatcacaatattaacgcagaccagtcaaagggaatcagctccagcaccgtccccgcaacacagcagctgttctcccaggggaatacgtttcctcctaccccacggccggctgagaacttcaggaactctgggctcgcccccccggttacgatagtgcaaccctccgcaagcgcagggcagatgctggcacaaattagtaggcactcaaatcccacccaaggagcaaccccaacctggacccccacaacacgctctggattctcagcccaacaggtcgctacgcaagctaccgctaaaacacgcacgtctcaatttggagtagggtcctttcagactccgagctcattttctagcatgtccctccctggagcacctacagccagtcctggggctgcggcatatccctccctgacgaacagagggtccaattttgccccagaaaccgggcagactgccggacagttccagacccgtacagctgagggcgtgggagtgtggccacagtggcaaggccaacagcctcaccacagaagttccagcagtgagcagcacgtccaacagccacccgctcaacagcccggccagcccgaagtattccaagagatgctatccatgctgggtgatcaaagtaattcttataacaacgaagaatttcccgacctaaccatgtttccccccttcagcgaatag

SEQ ID NO: 11306 - DNA, 1767 bp, Artificial Sequence
  Description of Artificial Sequence: Synthetic coding sequence
atggccgctgaagaggaggcggcggccggggggaaagtgctgcgggaggaaaatcagtgtatcgcccctgtggtgagcagccgggtttcgccgggcacccggcctaccgctatgggttccttctccagccatatgaccgagtttcctcgcaagcggaaggggagtgacagtgacccatcacaggaagcacacagccagactgaaaagcggcgccgtgacaagatgaacaatctgatcgaagagttaagcgccatgatccctcaatgcaatccaatggcccgaaagcttgataagctcactgttcttagaatggctgtgcagcatcttcgctccttaaaagggttgacaaactcatacgtgggtagtaattacaggccatctttcctgcaggataatgagttgcgccacctgattttaaaaactgccgagggtttcctctttgtcgtaggttgcgagagaggaaagatactctttgtcagcaagtcagtgagcaaaatactcaattatgaccaagccagtctcaccgggcagagcctgtttgatttcttacatcctaaggacgtggccaaggtcaaggaacagctgtcttcttttgatatctctccacgcgagaagctcattgatgcgaagactgggctgcaggtccattccaacttacacgccggccggacgcgcgtgtactctggcagccggcgcagtttcttctgccgcatcaagagctgcaagatctccgtgaaggaggagcatgggtgtctacctaatagcaagaaaaaagagcaccgcaaattctacaccatccattgtacaggctacctgaggtcctggccaccaaacatcgtaggaatggaggaggaacgtaactccaaaaaggataacagtaatttcacttgtctggtggccattgggcggctgcagccatatatcgtacctcagaatagcggagaaattaacgtcaaaccaactgagtttattacgaggttcgcagtaaatggaaagtttgtgtacgtggatcagagggctacagccattttggggtacctgccgcaggaactgcttgggaccagctgttacgaatacttccatcaggatgaccataataacctgacagataagcataaggcagtgctgcagagcaaggagaagatcctgactgattcgtataagtttagggccaaagacggatcttttgtgacgctgaaatcccagtggttcagcttcaccaacccctggaccaaggagctggaatatatagttagcgtgaacacgctcgtgctggggcattcagaacctggagaagcctcctttctcccatgctcctctcagtcctctgaggaatcatccaggcaaagttgcatgtccgtgccaggcatgagcaccggtaccgtgctcggggctgggtccatcggtaccgacattgcaaatgagatcctggacctccagaggctgcagtccagtagctacctcgatgatagcagtccgactgggctgatgaaagatactcatactgtgaattgtcgcagcatgagcaacaaagagttatttcccccttcaccctctgaaatgggtgaattggaagcgactcgccagaatcagtcaactgtggccgtgcactcacatgaacccctcttatctgatggtgctcagctcgatttcgacgccctgtgtgacaacgacgacacagctatggccgcattcatgaattacctcgaggccgaaggaggtctcggagaccctggtgatttcagcgacattcagtggaccctgtag

SEQ ID NO: 11307 - DNA, 1911 bp, Artificial Sequence
  Description of Artificial Sequence: Synthetic coding sequence
atggccgctgaggaggaggcagccgctggcggtaaggtactccgtgaagagaaccagtgtatcgctcctgtggttagctccagagtatcccctggaaccaggcccactgcaatgggttcattcagctcacacatgaccgagtttcctcgtaagcgaaagggctctgactccgatcctagtcaatcaggaatcatgaccgaaaaagtggttgaaaagcttagccagaacccactcacatatctcctctccacccgtattgaaatcagtgcctcatctggatctcgtgtggaggacggagaacaccaggtgaaaatgaaggcatttcgcgaggcccacagtcagacggaaaagcgacgacgggacaaaatgaataacctcattgaagaactttctgccatgatccctcaatgcaaccctatggcccgaaaactagataaactcacagtcctgcgcatggctgttcagcacctcagatctctgaaaggtctgaccaattcttacgtaggtagtaattaccgaccgtctttcctacaggacaatgagctccgccatcttatacttaagacagccgagggttttctgttcgtggtgggttgcgaacgagggaaaattctgttcgtgagtaagtccgtatccaaaatcttaaactacgaccaagcaagcctgactggacagagtctctttgattttctgcaccctaaggatgtggcaaaggtgaaagaacagctttccagcttcgacatcagcccaagagagaagctcatagatgccaagactggactgcaggtgcactccaatctccatgcagggcgcactcgagtttattccggctctcgtagatcattcttctgtaggatcaaaagctgcaagatttcagttaaagaggagcatggttgcctccccaattctaagaaaaaggaacacaggaaattctacaccattcactgtaccgggtatctccgctcatggccacctaacatcgtgggcatggaggaggaacgaaattccaagaaggacaactctaatttcacttgcctggtggctataggcagattacagccttacatagtgccccagaacagcggcgaaattaacgtgaagccaactgaattcatcactcggttcgccgtgaacggcaagtttgtctacgttgaccagcgagccactgccatcctgggatacctcccgcaagagttgctcggcacctcttgttatgaatacttccatcaggacgaccataataacttaaccgacaaacacaaggcagtcctacagtctaaggaaaagatattgaccgactcatacaaatttagggccaaagacgggagctttgtgaccctcaagtcacagtggtttagttttactaatccctggacgaaggagctggaatacatcgtcagcgtgaacaccttggtgctcggacacagcgagcccggagaggcatcttttctgccatgtagttcacagtcgtcagaagagtcgagcagacagagctgcatgtccgtgcccggcatgagcactggcactgtgctcggagcaggctctatcggaaccgacattgctaatgagattctcgaccttcagcggctccagtcgtcctcttatctcgacgactcatctccaaccggcttgatgaaagatacgcataccgtgaattgccggagcatgagcaacaaggaactgttccccccatctccatctgagatgggggagctagaggccacacgccagaatcagagcacagtagccgttcatagtcacgagccactgctgtccgacggcgcccaactggactttgacgccctgtgcgacaacgacgacacagctatggctgcctttatgaactatctggaagccgagggcggcctcggagaccccggggacttcagcgatatccaatggaccctctag

SEQ ID NO: 11308 - DNA, 1869 bp, Artificial Sequence
  Description of Artificial Sequence: Synthetic coding sequence
atggccgcagaggaagaggccgcagcagggggaaaagtgctgagggaggagaaccagtgtattgcacccgtcgtgagtagtagagtctcgccaggaactcggcctaccgcgatggggtctttttctagccacatgaccgagttcccaagaaaacggaagggcagtgattccgatccaagtcagtctggaatcatgacagaaaaggtggtagagaaattatcccagaatcctcttacatatctgctctcgacgcgcattgaaatcagtgcgtcaagtgggtcccgggaagcccactctcagactgaaaagaggcggagagacaagatgaataaccttatcgaggaactaagtgccatgatcccccagtgtaatcccatggccagaaaactggataagctgaccgtccttaggatggccgtccagcacctgcgcagcctgaaaggactgaccaacagctacgttgggtccaactatcgcccaagctttctgcaggacaatgagctgagacacctgatcctcaaaactgcagaaggattcctcttcgtggtggggtgcgagagaggcaaaatcctcttcgtcagcaagtcagtcagtaaaatcctcaattatgatcaggctagcctgacgggccagtctctgtttgattttctgcatccaaaggatgtcgccaaggtcaaagaacaacttagttcctttgatattagcccaagagaaaagttaatcgacgccaagacaggtctgcaggtccatagtaacctccatgcaggccggactcgcgtgtacagtggatccagaaggagcttcttttgccgtattaaatcatgtaaaatatctgtcaaggaagagcatgggtgcctaccgaattccaagaaaaaggaacaccggaagttctataccattcactgcaccgggtacctccggtcttggcctccgaacattgtaggaatggaagaagaacgcaacagcaagaaggacaacagtaatttcacctgcctcgtggccattggaagactccaaccttacattgtcccacaaaattcaggcgaaattaacgtaaagcctaccgagttcattaccaggtttgctgtgaatggcaagtttgtgtatgttgaccagagggctaccgcaatcctggggtacttaccacaagagctgttgggaaccagttgctacgagtatttccaccaggacgatcacaataacctgactgataaacataaggccgttttgcagtctaaggagaagatcttgaccgattcatataagtttcgtgccaaggatggttccttcgtgacgctcaaatctcagtggtttagcttcaccaacccctggacaaaagagctggagtacatcgtctccgttaatactctcgtactcggtcactcggagcccggcgaagcgagctttctcccctgttcaagtcaatccagcgaagagtccagccggcagtcatgcatgagtgtgcctggcatgtccacggggactgtacttggtgcgggctctatcgggactgatatagcgaacgaaattttagacctgcagcggctgcagagctccagttatttagacgacagcagtcccaccggactgatgaaggacacacataccgtgaattgtagatcaatgtcgaataaggaactatttccaccatccccgtcggaaatgggggagttggaggctacccggcagaatcagagcactgttgcggtacactcccacgaaccgttgctgagtgacggtgcccaattggacttcgatgctttatgcgacaacgatgacacggcaatggcagcctttatgaattacctggaggctgaaggcggtctgggcgaccccggggatttttccgacatccagtggaccctatag

SEQ ID NO: 11309 - DNA, 1800 bp, Artificial Sequence
  Description of Artificial Sequence: Synthetic coding sequence
atggccgctgaggaggaggctgcagctggaggcgaggtcgccgggggcgaagccacagcacccggaaaagtcttgagagaagaaaaccagtgtatcgcaccagtcgtgagcagcagggtgtctcccgggactcgcccaaccgcaatggggagtttcagttcccatatgaccgaattcccgcgcaaacgaaaaggcagcgactccgatccgtcccaggaggcccactcccagacggagaagcgcagacgggacaagatgaataacttgattgaagagctctccgccatgattccacagtgcaaccctatggcccggaagctcgataaactcaccgtcctgcgcatggcagtgcagcacctgagatccctaaaaggattgaccaactcctacgtggggtcgaactaccgtcccagtttcctacaggataatgagctgcgccacctcattctgaagactgctgaaggttttttgttcgtcgttggctgtgagaggggcaagattctcttcgtgagcaaatctgtgtcaaaaattctcaattacgatcaggcatctcttaccggccaaagcctcttcgattttctgcatcctaaggatgtggctaaagtaaaggagcagcttagcagcttcgacattagtcctcgcgaaaaattgatcgacgctaagaccggcctgcaagtccattctaacctgcatgccggaaggacacgcgtatacagtggctctcgcaggtcttttttttgtcgaattaagtcctgcaagattagcgttaaagaggagcacggatgccttcctaattcgaaaaagaaagagcacagaaagttctatacaatccactgtaccggctatttaaggagctggccgcccaatatcgtgggcatggaagaggaacggaacagcaagaaagataactctaatttcacatgccttgtcgctatcggacgactgcagccttacatcgtgccccagaattctggagagatcaatgtcaaaccaaccgaatttattacccgcttcgcagtcaacggcaagttcgtatacgtagaccagcgggccactgcaattctgggatacctgccacaggagcttctcggcacatcatgttatgagtattttcaccaggacgaccacaataacctgactgacaagcataaggcagtgctgcaaagtaaggagaagatcctgacagattcttacaaatttcgtgctaaagacggttccttcgtaactctgaagagccagtggttcagcttcacaaacccttggacaaaggaactggaatacatagtctctgttaatacgcttgtgttgggacattcagaaccaggtgaggcatcctttcttccttgttcaagtcagagctccgaagagtctagccggcagagctgtatgagtgtccccgggatgtctactggcacagttttgggagctggtagtatcggcaccgacatcgccaacgaaatcctggacctgcagcgtctgcagagcagtagctacctcgacgattcttctcctaccggattgatgaaggacactcacaccgtgaactgccgcagcatgtctaacaaggagctgttccctccatccccgtccgagatgggggagttggaagccacaaggcagaaccagtctactgttgcagtacattcccatgaacccttgctgagcgatggcgcccaactcgactttgacgctctgtgtgataacgatgatacagccatggccgccttcatgaactacctagaggccgaaggggggctgggtgacccaggagatttctcggatatacagtggacgctttag

SEQ ID NO: 11310 - DNA, 1656 bp, Artificial Sequence
  Description of Artificial Sequence: Synthetic coding sequence
atgggatccttctcctcccacatgacggaatttccccggaagcgaaaagggtccgacagtgaccctagccaggaagcccacagtcagaccgagaaacggagaagggataagatgaacaatctcatcgaagagctgtcagctatgatccctcagtgtaacccgatggcgagaaagctcgataagctgacagttctccggatggccgttcagcacctgcgctcactcaagggtttaaccaacagctacgtgggttccaactacagaccttcgttcctgcaagacaatgagctgagacatctcatactgaagacagccgaaggcttcctgttcgtcgtggggtgcgaacgtggtaagattttattcgtctccaagtccgtgtccaagatcctgaattacgaccaggcatctctcacaggacagtcattgtttgattttttacatcctaaggatgttgcaaaagtgaaagagcaattgtcaagttttgatattagccctcgcgagaagctaatagacgccaagactggattgcaggttcactccaatctccatgcgggtcgcacaagagtctactctggtagccgcagatcgtttttttgccggatcaagtcatgcaaaatctctgtcaaggaagaacacgggtgtttgcccaacagcaagaagaaggagcacagaaaattttacacaatccattgcacaggatatctgcgcagctggccccccaacatagtgggaatggaggaagaacgtaatagcaaaaaggataactccaacttcacctgcttggtagccattgggcgacttcaaccttacatcgtgcctcaaaactccggcgagattaacgttaagccaaccgaattcataacacgattcgccgtaaatgggaagtttgtctacgtggaccagagagccactgcaatcctcggatatctgccacaggaacttctgggcacatcttgttatgaatatttccatcaggacgatcacaacaacctcacagataagcataaggctgtgctgcagtctaaggagaaaatattaaccgacagctacaaattcagagctaaagacggatcctttgtcaccctgaagtcccagtggttctcatttactaatccctggaccaaggaattagagtatatcgtttccgtgaacacgctcgtgttaggacacagcgagccaggagaagcaagcttccttccttgtagttcccagtcatcagaagaatcgtctcgacagtcatgtatgtcagtgccaggaatgtccacggggacagtattaggcgctggttcgatagggactgacatcgcgaatgaaatcctggatttacagcgccttcagtcctctagttacctggacgattcgagccctactggtctgatgaaggatacacacaccgtaaattgcaggtcgatgagcaataaggaattgtttcccccctcccccagcgaaatgggggagcttgaggccacccggcagaaccagtctacagtcgccgttcactcccacgagcccttactctccgacggggctcaactggatttcgatgctctttgcgacaacgatgacacggcaatggctgcgttcatgaactacctcgaggcagagggggggctaggcgatcccggagacttctctgatatccagtggactttatag

SEQ ID NO: 11311 - DNA, 1809 bp, Artificial Sequence
  Description of Artificial Sequence: Synthetic coding sequence
atggcagccgaggaggaagcagccgctggagggaaagtcctgagggaagaaaatcagtgcatcgcaccagtggttagcagccgcgtgtctcccggcacgaggccaacagcgatgggctctttttccagtcacatgactgagtttcccaggaagcgcaaggggtctgactctgacccaagtcaggtggaggacggggagcaccaggtcaagatgaaagccttcagagaggctcacagccaaactgagaagcgcagaagggacaagatgaataaccttattgaggaactgagtgcaatgatacctcagtgtaatccaatggcgcgaaagctggataagctaaccgtgctgagaatggctgtccagcacctgcgatccctcaagggcctgaccaacagctatgtgggatcaaactatcggccctcttttctgcaggataatgagcttcgccaccttatactgaagaccgctgaaggttttttattcgtggtgggctgcgagcgcggtaaaatcttattcgtttccaagagcgtgtctaaaatcctcaattatgaccaggcctccctgaccggacagtctctctttgacttcctccatcctaaagacgtggccaaggtgaaagagcaactgtcttcttttgatataagtccacgcgagaagctgatcgacgccaagacaggcctgcaggtgcactccaacctccacgcaggacgtacacgcgtatacagtggatcacggaggtcattcttttgtcgaataaagagctgtaaaatatccgtcaaggaggagcacgggtgtctgcccaatagcaaaaaaaaagagcaccgcaaattctataccatccactgtactggctacttgcgctcatggccgcctaacatagtgggcatggaggaagagcgtaatagcaaaaaggataacagtaactttacatgccttgttgcaattggccgtttacagccctacatcgtgcctcagaatagcggtgaaattaacgtcaaaccaacagagttcataacccgcttcgctgtaaacgggaaattcgtttatgttgatcagcgcgccacagccatcctgggatatctcccccaagaactccttggaacatcttgctacgagtatttccaccaggacgaccacaacaatcttacagataaacacaaagctgtgcttcagtcaaaggagaaaattttaaccgatagttacaagtttagagccaaagacggctcgttcgtgaccctcaaatctcagtggtttagctttacgaacccgtggaccaaggagctggagtatatcgtgagcgttaacaccctagtattaggacactctgagcctggtgaggccagctttctcccttgttcatctcagtccagcgaggagtctagcaggcagagttgtatgtcagttccgggcatgagcaccggcaccgtgctaggagccggctctattggcaccgacatcgccaatgagatcctggacttgcagagactgcagagcagctcttatctcgacgatagctcgcccacaggactgatgaaggacacccatacagtcaactgccggtctatgtccaacaaagaattgttcccaccatcccccagcgaaatgggcgaactggaagcaacacgacagaatcagtctacagtggccgtgcatagccatgaacccctgttgagtgacggagctcaattagatttcgatgcattatgtgacaacgacgacaccgcaatggctgcctttatgaattacctggaggccgaggggggcctgggggaccctggcgacttttcagatatccaatggaccctctag

SEQ ID NO: 11312 - DNA, 6858 bp, Artificial Sequence
  Description of Artificial Sequence: Synthetic coding sequence
atggctgcccaggtggcccccgctgcagcctcgtcactaggaaacccaccccccccccccccttcagaactgaagaaagccgagcagcagcagcgagaagaggccggaggcgaggctgcggccgccgctgctgctgaaagaggagaaatgaaggccgccgccggccaggagtctgagggccctgcggtagggccgccccagcccctcggcaaggagctgcaggacggggcagagagcaatggcggaggggggggcggtggcgccggatccgggggtggtcccggggctgagccagacctcaagaactcaaatggcaacgcgggtcctcggccagcactgaacaataaccttactgagcctccaggaggagggggcggcggtagctcggacggggtcggggctccaccccattctgcagcagcagcactgcctcctcccgcgtacggattcggacagccttatggacgtagtcccagtgctgtggcggccgcagcagccgccgtgtttcaccagcaacacggcggccagcagtctcccggcctggctgccctccagtctggaggcggcggaggcctcgagccctatgccggtccccagcagaattcacacgatcacggctttccgaaccaccagtacaactcgtattaccctaataggtccgcgtacccacctccagcccccgcatacgccctgtccagcccgcgcggcggcacaccaggctccggtgctgccgcagcagcaggctccaaaccccctcccagttcctctgccagcgcaagtagcagcagcagctcgttcgcccagcagcggttcggggctatgggaggaggaggcccttccgcagcgggcggcggcaccccccaacccacggcgacacccacactcaatcagctgctgacttcaccaagttctgcccggggctaccaggggtaccctggcggagactactcaggtggcccccaagatggcggtgctggaaaagggccagcggacatggcctctcagtgctggggcgccgctgctgccgccgccgccgcggctgcagctagcggcggggctcagcagagatcccaccatgcaccaatgtctcccggctcatcaggtggcggtggccagccactagcaagaaccccacagcccagtagtcccatggatcagatgggtaaaatgcgcccacagccctatggcggaacaaacccgtactcacagcagcagggccccccttctgggccccaacagggtcacggctatcctggccagccatacggatcacaaactccccagagataccccatgactatgcagggccgagcacagagcgccatggggggactcagctatacccagcagatcccgccatatggtcagcaaggcccttccgggtatggacagcagggccagactccctattataaccagcagtccccccatccacagcagcaacagcccccctacagccagcagccaccttctcaaactccacacgcccagccgtcctatcagcaacaacctcagtctcaaccaccccagttgcagtcttcacagcccccgtactcccagcagccgagtcagccaccacaccagcaatctcccgccccatatccctcacagcaaagcacgacacagcagcatccccagtctcagccgccttactcccagcctcaggcccaatccccttatcagcagcaacagccccagcagcccgcacccagtactctgtcacagcaggcagcttatccccaaccacagtcacagcaatctcaacaaaccgcctatagccagcagcgctttccaccccctcaggagctttcccaggacagctttggctcacaggcctcatccgcgccatcgatgacctcatcaaaagggggccaggaagatatgaacctgtccctgcaatcaaggccttcttctctgcctgacctgtctggatccattgatgacctcccaatggggactgaaggggcgttgagccccggagtgtctacctcgggaatcagttcgtcccagggagagcagtctaaccccgcgcagagccctttttcaccacacacctctcctcacctgcccggaatccggggcccctctccatccccagtcgggtctccagcctctgttgcacagagccgcagcgggcctctcagccccgcagctgtgcctggcaaccagatgcctccaaggccaccctccgggcagagcgattcaatcatgcatccttccatgaaccagtcttctatcgcccaggacagaggatacatgcagcgcaatccacagatgccccagtattcttcaccccagcctggctctgccctaagtccccgtcagcctagcggcggacagatccatacagggatgggcagctatcagcaaaactcaatggggtcctatggcccgcagggcggacagtacggcccacagggaggctaccctaggcaacctaattataatgctctcccaaacgctaattacccctccgccggaatggccggggggatcaacccgatgggcgccggagggcagatgcatggacagcccggaatccccccatacgggacccttcctccaggacgcatgtcacatgcatcaatgggtaatcggccttatggtccaaacatggccaatatgcctcctcaagtgggttctggaatgtgcccccctccgggcgggatgaatcgaaagacccaggaaacagccgtagccatgcatgtagccgccaactccatccaaaatagacctcctgggtacccgaatatgaaccaaggcgggatgatgggtactggccccccttatgggcaagggattaacagtatggctgggatgatcaatccccaaggacccccgtattctatgggcggtacaatggccaataatagcgctgggatggcagccagccctgagatgatgggtctcggtgacgtgaagctgacgcctgcaaccaaaatgaacaacaaggccgacggaacccctaaaactgagtccaagtctaagaagtcctctagttctactacaactaatgagaagataaccaagctgtatgagttggggggtgagcctgagcggaagatgtgggtggaccgatacctcgcatttactgaggaaaaggcaatgggaatgacaaacctgcctgcagtgggccggaagcccttagacctgtataggttatatgtgagtgtgaaggagattggagggctgactcaagtgaacaaaaataagaaatggagagagctagccactaacctgaatgtcgggacctcctcttcagcagcttctagtctcaagaagcagtatattcagtgtctctatgcctttgaatgcaaaattgagcggggagaagaccctccgccagacatttttgccgccgctgactcgaagaagagccagccaaaaatccagccccccagccccgctgggtccggcagcatgcagggaccgcaaaccccccagagcacctcgtccagcatggccgaggggggggacctgaaacctcccactccggcctctaccccacacagccagattccaccgctgcctggcatgagccgttcgaactccgttggcatacaggacgcttttaatgacggctccgattccactttccagaagagaaattccatgactccaaacccaggatatcagcccagcatgaatacaagcgacatgatggggcgtatgagctacgagccaaacaaggatccctacggttccatgcgaaaagcgcccgggagcgacccattcatgtcttccggacagggtccaaatggtgggatgggtgatccttattctcgagcagccggaccgggactgggaaacgtggccatgggaccccggcagcattatccgtatggcggcccttacgaccgagtgagaacagagcccgggatcggcccagagggcaacatgtccaccggcgcaccgcagcccaatctaatgccgtcgaatcctgactcaggcatgtacagcccttctaggtacccacctcagcaacaacagcagcaacagcaacgccacgattcctacggcaatcagttcagtacccaaggaacaccctctgggtccccatttccatcccagcagaccaccatgtaccagcagcaacaacaaaactacaaaagacctatggatggcacatacggccctcccgctaagcgacacgaaggcgaaatgtattccgttccatattctacaggccaaggccagccccagcagcagcagctgccaccagcccagccccagcctgcttcccagcaacaggcagcgcagcctagtccacagcaggacgtgtataaccaatacgggaacgcctacccagcaaccgccacggccgctacggaaagaagacccgcaggtgggccccaaaaccagtttccatttcagtttggacgggacagggtgtccgcccctcctggaaccaatgctcagcagaacatgcccccccagatgatgggaggccccatccaggccagcgccgaggtggcgcagcagggaactatgtggcaggggagaaatgacatgacttataactatgcaaataggcagtccaccggcagtgcccctcagggccccgcctaccatggggtgaataggaccgatgagatgttacatacggaccagcgggccaatcacgaaggaagttggcctagccatggtacccgccagccaccgtacgggccctccgctcctgtcccccccatgactcgtccaccccctagcaactaccagcccccgccctccatgcagaatcacatcccacaggtgtcatcccccgcccctcttccaaggcctatggaaaaccggacaagtccgtctaaaagtccgttcttacattccggtatgaaaatgcagaaagccggtccacccgtgcctgcctcacacatcgcaccggctcccgtacagccgcctatgatcaggcgcgatatcactttccctccaggctcagtggaagccacacagccagtgctgaagcagaggcgaagattgacaatgaaagacatcggaacccctgaggcctggcgtgtcatgatgtccctcaaatcagggctactggccgagtctacctgggctctagacacgataaatatccttctgtatgatgacaattcaatcatgaccttcaacctctcacagctcccagggttgctggagcttctggtcgagtatttccgacgctgcctcattgagatctttggcattttgaaagagtatgaggtgggcgaccccggccagcggacccttctggaccccggacgcttttccaaggtgagtagtcctgcccccatggaaggaggagaggaggaggaggagctactgggccctaagttggaagaagaagaggaggaggaggtagtggaaaatgatgaggaaatcgccttttcaggcaaggataagcctgctagtgagaactcagaagaaaaactcatctcaaagtttgacaagttgccggtcaagatcgtccagaaaaatgacccctttgtcgtcgactgctccgataaactgggcagagtccaagaatttgacagtgggctgctgcattggcgtattggaggcggcgatacaacagagcacatacagacccacttcgagagcaagactgagctgctaccatcccggcctcatgcaccatgtcctccggcccctagaaaacatgtgactacagctgaagggaccccaggcacaactgaccaggaaggcccacctcctgacgggccacctgagaagcgcatcactgccactatggatgacatgttatccactcgttcatccactctcaccgaggatggcgcgaaatcatccgaagccataaaagagtcttcaaagtttcctttcggtatctctcccgcccagagccacaggaatataaaaattctggaggacgagccgcactctaaagatgaaacacccctttgcaccctgctcgactggcaggactcattagccaagcgttgtgtctgcgtttccaatactatcagatcactgagtttcgtcccaggtaatgattttgagatgtctaaacaccccggtctgttgcttatcctgggaaaacttatcctgcttcaccacaagcaccccgagcgtaagcaagcccctttgacttacgaaaaggaggaggagcaggatcagggagttagttgtaacaaagtcgaatggtggtgggactgtctggagatgcttagggagaataccctggtcacactggccaatatcagcggacagttggatctgtcaccttaccccgaaagcatctgccttccagtcttagacggcctgctgcactgggccgtttgcccatctgccgaggcccaggaccctttcagcacactgggaccaaacgctgtcctcagccctcaacgactcgtgttggaaaccctgtctaagctgtctatacaagacaacaacgtggaccttatccttgccaccccgcccttttcccggctggaaaaactatactctactatggtccgctttctctccgatagaaagaaccctgtgtgtagagagatggcagtggtgttacttgccaatctggcacaaggagactctctggccgccagggctatagccgtccaaaaagggagtatcgggaacctactgggctttcttgaagattctcttgccgctacacagttccagcagagccaagcctctctgctccacatgcagaatcctccttttgagcccacttctgtcgatatgatgcgacgtgcagccagggccttgctggcactggcgaaggtggatgaaaatcacagcgagtttaccctgtacgagtcccgactgcttgatatctccgtctccccactgatgaattcacttgtttctcaggtgatctgcgatgtgctgtttctaattgggcagtcgtag

SEQ ID NO: 11313 - DNA, 5709 bp, Artificial Sequence
  Description of Artificial Sequence: Synthetic coding sequence
atggatcagatgggcaaaatgcgtcctcaaccttacggtggcaccaatccatattctcagcaacagggacccccatccggtcctcagcagggccatggctaccccggtcagccatacggatcgcagacaccccaacgatacccaatgacaatgcagggcagggcccagtcagccatgggtggattgtcgtacacccaacagatcccaccctacggtcagcagggaccctcaggctacggccagcaggggcagactccatactacaaccaacaatctccgcatccccagcagcaacagcccccctattcccagcagccccctagtcagacaccacatgcccagcccagctaccaacagcaaccccaatcccaaccgccacagctgcagtcttcccagcctccctattcacagcaaccatcacagccacctcaccagcagtccccggccccatacccttcacagcaatccactacccagcagcacccacaaagtcaacctccctactcacagcctcaggcccagtctccctaccagcaacaacaaccacagcaacccgcacctagcaccttgagtcagcaggctgcttatccccagcctcaatcccaacagtcgcagcagacggcctacagccagcagcggttccccccaccccaagagctgagccaagacagctttggcagccaggctagttccgccccctccatgacgtcatccaagggggggcaagaggacatgaatctctccctgcagagccgcccaagttctctgcctgacctgagtgggagcattgacgacctcccaatgggcacagagggagcactctctcccggcgtctctacatcggggatatcctccagccagggtgaacagtccaatcctgcgcagagcccctttagcccacacaccagcccccatctgccaggaatccggggccccagtccatcacccgtaggcagtccagctagcgtagctcagtctcgaagtggccctctgtctcccgctgccgtccctggaaatcagatgccgcctagaccacctagtggacaatctgactccatcatgcatccgtctatgaatcagtcctctattgcccaggatcgggggtacatgcagagaaatcctcaaatgccccagtacagctctccccagccaggcagcgccctgtctcctagacagccctctggcgggcagatccacactggaatgggttcttaccaacaaaattcaatggggtcctatggccctcagggaggccagtacggaccacagggagggtatccccgtcagccgaattacaacgctctgcctaatgcgaactatccttctgccggcatggctgggggaattaatccaatgggggcagggggccagatgcatggccagcctggaattcctccctacgggaccctgcctcctgggcgcatgagccacgccagtatggggaaccggccatacgggcctaatatggcgaatatgcccccccaggtaggctccggaatgtgtcctcctccgggaggtatgaaccggaagacccaagagacggccgttgccatgcacgttgctgctaactcgattcagaaccgccctccaggttacccgaacatgaaccaaggtggaatgatgggtaccggccctccctatggacaagggatcaatagcatggcaggcatgattaacccccagggccctccttattcgatggggggcaccatggcaaataactctgccggcatggccgcgagccctgaaatgatgggtctgggcgacgttaaacttacacccgccacaaagatgaataacaaggccgacggcacgcccaagacggaatcaaagtctaagaagtccagcagtagcacaaccaccaatgaaaagatcaccaagctgtacgaactaggcggcgagcctgaacggaagatgtgggtggaccgatatttggctttcactgaagaaaaggctatgggcatgacgaatctgcccgccgtaggtcggaagcctcttgatctctacaggctgtatgtgagcgtgaaggaaataggaggcctaactcaggttaacaagaataagaagtggcgggaactggctacaaatcttaacgttgggacctctagttcagccgccagcagtttgaagaaacagtatatccagtgcttgtacgcattcgagtgcaagattgagagaggagaggaccccccacctgacatttttgcggccgcagacagcaaaaaaagtcagcccaaaattcaaccacccagccccgccgggagcgggtcgatgcagggtccacaaacaccacaaagcacctcctcctccatggctgagggcggggacttgaaaccacctacacctgccagtacacctcactcgcagatcccccccctgccaggcatgtctcggagtaattccgtcgggatccaagatgctttcaatgacgggtccgattcaacatttcagaaacgcaattccatgacccctaaccctggctatcagccatccatgaatacaagcgacatgatgggcagaatgtcttatgagcccaataaggatccctatgggagtatgagaaaggctccagggagtgatcctttcatgtcttccggccagggacctaatggtggaatgggagatccgtattcaagagccgccggacccggattaggaaacgtggccatgggacctcggcagcactacccttacggaggtccatacgatagggtgcggacggagccagggataggacccgaaggtaatatgagtacaggggcccctcagcctaatctgatgccatctaatcccgattcaggcatgtatagccccagtaggtacccccctcaacagcagcagcagcagcaacaaaggcatgactcgtacggcaaccagttctcaacccagggcactcctagcgggtctccatttccttctcagcagactaccatgtaccagcagcaacagcagaattacaagagaccgatggatggcacctacggtcctccggcaaaaaggcacgagggggaaatgtactccgtgccctactccacagggcaaggccagcctcaacagcaacaactccccccggcgcaaccccagcccgccagccagcagcaggctgctcagccttctcctcagcaggacgtgtacaaccagtatggtaatgcttaccccgcaacagctaccgctgctaccgagaggaggccagccggtgggccacaaaatcagtttcccttccagttcggaagagaccgtgtttccgctccccccgggaccaatgcccagcagaatatgcctccgcaaatgatggggggcccaatccaggccagcgccgaggtggctcagcaaggcaccatgtggcaggggcggaatgatatgacttataactacgccaataggcagtccaccgggagcgccccacaggggcctgcttaccatggtgttaataggaccgacgagatgttacacactgaccagagggccaaccacgagggttcttggccgtcccacggaacacgtcagcctccatatggcccgtcagctcccgtcccaccaatgaccaggcctcctcctagcaactatcaacccccgccttcgatgcagaatcacattcctcaagtgtcctcccccgctcctctgccaagaccaatggagaatcgaacgtcgcctagtaagagtcccttcctgcactcaggcatgaagatgcagaaggctggtcctcctgtcccagcctcccatattgcaccggccccagtgcaaccaccaatgattagaagagacatcactttccctccaggatctgtagaggccacacaacctgtgctgaaacagagaagacggctgacaatgaaggatattggcacccccgaagcgtggcgcgttatgatgtcactaaagagcggattactggctgagagcacgtgggctcttgacaccattaacatcttactgtatgatgataattcgattatgacctttaatctgtcccagctacctggactccttgagctgcttgtcgaatattttaggcggtgtctcatcgagatcttcggaatcctaaaggagtatgaagtaggagatcccggccagaggacactcctagatccagggagatttagcaaagtgagtagtccagctccaatggagggaggcgaggaagaggaggaacttctgggaccaaagcttgaagaagaggaagaagaggaggtcgtagaaaacgatgaggaaattgccttctctggaaaagacaagccggcttcagagaactccgaggaaaaactgatatccaaattcgataagctccctgtcaagattgttcagaaaaatgatcccttcgttgttgactgcagtgacaagctggggcgagtgcaagagttcgattctggacttctgcactggcgcattggcggtggggacaccacggagcacattcagactcacttcgaaagcaagaccgagctgttgccatcaagaccccacgccccctgccctccggccccccggaaacacgttaccacagccgaaggaacaccggggacaactgatcaggaggggccccctccagatggtcctcctgaaaagaggatcacagctacgatggatgacatgctttcgaccaggagctccacactgacagaagatggcgcaaagtccagtgaagcaattaaagagagctcaaagttccccttcggcatttctcctgctcaatcacataggaacattaagatacttgaagacgagccccactcaaaggatgagactccactgtgcacactgctggattggcaagattctctggcaaagaggtgtgtgtgcgtgtctaacaccataaggagcctctcctttgtcccaggcaatgactttgagatgtccaagcacccggggctgttactgatcctgggaaagctgattctgctgcaccacaagcacccagagagaaagcaggctcccctcacctatgagaaagaagaggaacaggatcagggagtgagctgcaacaaggttgaatggtggtgggattgtctggaaatgctaagagaaaacactctagtgacactggcgaatatatctggacagttggatctgagcccataccctgagagcatctgtcttcctgtgctggacggtctgctgcactgggccgtgtgtccaagcgccgaagcccaggatcctttttccacactgggaccaaatgctgtgctgtcaccgcagcggctcgtgctggaaacactttccaagctaagtatccaagataataatgtagaccttatcttggctaccccacccttctcaaggctggagaaactatacagcacaatggtcaggtttctgtccgataggaaaaatcccgtctgccgcgagatggccgtcgtgctcctggccaatctggctcagggtgactccctggcagcccgcgctattgccgttcaaaaagggtcaataggcaacctcttaggatttctcgaagacagtttggcagcgacccagtttcagcagtctcaagccagtctgttacatatgcaaaacccgccctttgaaccaacctcggtcgacatgatgcggcgcgccgcccgtgcgctccttgccttagctaaggtcgacgagaatcattccgaattcaccctatatgagagtagactcttagatatcagcgtttcgccgttaatgaactcactggtcagtcaggttatatgtgatgtgctgtttctaattggacagtcttag

SEQ ID NO: 11314 - DNA, 6207 bp, Artificial Sequence
  Description of Artificial Sequence: Synthetic coding sequence
atggccgcccaggtggcccccgctgcagcctcctcactgggaaaccctccaccccctccaccgagtgagctgaaaaaggcagagcagcaacagcgggaagaggctggcggcgaggctgccgccgctgcagccgccgagcgcggggagatgaaggctgcagcaggccaggagtctgaaggtcctgcagtaggtcctcctcagcccctgggcaaggagctacaagatggagccgaaagtaacggaggaggagggggcggcggagctggctctggtggcggtccaggggcagagcctgatctgaagaactctaatggcaacgctggccctaggccagccctgaataataacttgacagaaccgcctggaggaggcggtggcgggagttctgatggggtgggagcccctccccactcagctgccgctgcgctcccacccccggcatacggtttcggacagccatatggacggtctcccagcgcagtcgccgcagccgccgccgccgtgtttcaccagcagcacggcggccaacagagtcctgggttagccgcgttgcagtccggcggcggcggcggtctggagccatatgccgggccccaacagaacagccatgatcatggattccccaatcaccagtataactcatattaccccaaccggagtgcttacccccccccggcccccgcctatgccctcagctcacctcgtggcggtacaccaggatctggggcagccgcagccgccggatccaaacctccgcctagctcttccgcatcagccagtagttcaagttcgtccttcgcccagcagaggtttggtgcgatgggcgggggtggaccatcggccgctggcggcggtacacctcagcccacagcgacccccacgctgaatcagctgttgacttctccaagttcagcacgcggctatcaggggtaccctgggggagactatagtgggggaccacaggacggtggagccggaaaagggcctgccgatatggccagtcagtgttggggagctgccgccgcagctgccgccgctgctgctgcctccgggggtgcacagcagaggagccatcacgctcctatgagccctggcagctctggcggaggtgggcagcccctggccagaacaccccagccaagctccccaatggatcagatgggtaaaatgagaccacaaccttacggagggaccaatccatatagtcagcaacaaggaccccccagcggcccccagcagggccacgggtacccaggacaaccctacgggagtcagaccccacagcgctacccaatgacaatgcagggacgagcccagtcggccatgggcggtctgtcttacacccagcagatacccccctacggccagcagggcccctcgggctatggccagcaaggacagaccccctactataatcaacagtctccccatccccagcagcagcagcctccatatagccaacagccaccgagccaaacacctcatgcacagcccagctaccagcagcagccacagagtcaacccccacagctgcaaagctctcagcccccctacagtcagcaaccatcccaacctcctcaccagcagtcgcctgctccgtacccctcacagcagtccacaacgcagcagcatcctcaaagtcagccaccctactcgcagcctcaggcccaatcaccgtatcagcagcagcaaccccaacagccggcaccatctacactgtctcaacaggccgcctacccacagccacagtcacagcagtcacagcagacggcgtattcccagcagcggtttcctccccctcaggaattaagccaggattcattcggctcacaggcgtcctcagcaccttccatgacttcatctaagggagggcaagaggatatgaacttgtccttgcaatccagaccgtcatcacttccagatctgtcagggtcgatcgatgacttgcccatggggactgaaggcgctctgagccctggagtgtcgacatcagggatttcaagcagccaaggcgaacagtctaatcccgcacagtcccccttctctccacacacatcaccccatctccccggtattcgaggaccgagcccaagtccagttgggtcacccgctagcgtcgcccagtcgagatccgggcccttaagtccagcagctgtgcccggcaaccagatgcccccccgcccgccaagcggacagtcagactctattatgcatccgtctatgaaccaatcctcaattgcacaagaccgggggtatatgcaacgaaacccccaaatgccgcagtactccagtcctcagcctggctccgctctctcacctcgtcagcccagcggcggtcagatccatactggcatgggtagctatcaacagaactccatgggatcttacggaccccagggtggccagtacgggccccaggggggctatcctcggcagccaaattacaacgccctccccaatgcaaactatccctccgcaggcatggccggaggcatcaatcctatgggcgccggagggcagatgcatggacagcctggaattcctccctacggaacactgccacccgggcgcatgagtcatgcttctatgggcaatcgcccctacgggccgaacatggccaatatgccccctcaagtaggcagtggcatgtgtcccccacctggcggcatgaaccgcaagactcaggaaaccgccgtagccatgcacgtggcagccaactctattcagaatcggcctccgggttatcctaacatgaatcagggaggtatgatggggacagggccgccctatgggcagggcatcaattctatggctgggatgattaacccccagggcccaccctactccatgggaggaactatggcaaacaattcggccggcatggccgcttcccccgagatgatgggcctgggagacgtgaaattaactccggctaccaagatgaataacaaggctgatggcactccaaaaaccgaaagcaagagcaagaaatcaagcagttccactaccactaatgagaaaataacaaaactctatgagttaggtggggaacctgagcgcaagatgtgggtagataggtatctagcattcacagaagagaaagcaatgggcatgactaatctgccggctgtggggaggaagccactggatctgtacaggctgtacgtctcagttaaggaaatcgggggcctcacccaagtcaacaagaacaagaaatggcgggagctcgcaactaacctgaatgtgggtactagttcctcggccgcctcgagtctgaaaaaacagtatatccagtgcttatacgcattcgaatgcaaaatcgagcgcggcgaggacccaccgccagacatctttgctgcggcggactcaaaaaagtcgcaacctaagatccagccaccgtctccggcaggtagtggcagcatgcagggtccacaaaccccccagtccactagctcatctatggcagagggcggagacctcaagccaccaaccccggcaagcacccctcacagccagatcccacccctgcccggaatgtcgcgctctaacagcgtgggcattcaggatgccttcaatgacggctcggattcaacatttcaaaaaagaaatagtatgacccccaaccctggttatcagcccagtatgaacacctctgacatgatgggccggatgtcgtacgagccaaacaaggacccctacgggtcaatgaggaaggcccctggcagcgatcctttcatgtcctctgggcagggacccaatggcggaatgggggatccttactcccgcgctgcgggcccgggcctgggaaacgtcgcaatgggcccaagacagcattacccttatggggggccttacgacagagtccgtactgaacctggaattggaccggagggcaacatgtccacaggggcaccgcagcctaacctgatgccctccaacccagattccggaatgtactctccatcaaggtaccctcctcagcaacagcagcagcagcagcagcggcacgactcttatgggaaccagttcagcacgcagggaaccccctcaggctccccttttccgtcacaacagaccactatgtatcagcagcagcagcaggtgtctagcccagcccccctcccccgccctatggagaatcgtacatcaccttctaagtcgccatttctgcattctggcatgaaaatgcagaaggcaggcccccccgtaccagcaagccacattgccccggccccagtccagccacctatgataagaagggatatcacttttccgccaggatctgttgaggctactcaacctgtgctgaagcagagacgtaggcttaccatgaaagatatcggtacccccgaggcttggcgggttatgatgagtctcaaatctgggctcctggcagaatccacatgggcactggatactataaacatactcctgtacgacgataactctataatgaccttcaatctctcccaacttcccggactgctagaattacttgtcgaatattttcggcggtgcctgattgagatatttggaattcttaaggaatatgaagttggggacccagggcagcgtactctattggacccgggtcgattcagtaaggtctcgtccccggctcctatggagggcggggaagaggaagaggaacttctgggtcctaagctggaggaggaggaagaagaagaagtcgtagagaacgacgaagaaatcgccttcagtggcaaggacaagcctgcctcagagaactcagaagaaaagctcatttccaagttcgacaagctgcctgtgaaaatcgtccagaagaatgatcctttcgtggtcgattgctcggataaactcggtagagttcaagaattcgattctggactcctccattggcgcatcggtggcggggataccacggaacacatccaaacgcacttcgagtccaagaccgagctcctgccctccaggccgcacgcaccctgtccgcctgctcccagaaagcatgtgactacagcggaagggactccagggacgaccgatcaagaggggccgcccccggacggacctccggaaaaaagaattacagccacgatggatgatatgctgtccactaggtcttctaccctgacagaggacggcgctaagtccagcgaggccatcaaagaatcaagcaaattcccctttggcatctctcccgcccaaagccataggaacatcaagatccttgaggatgagcctcacagtaaggatgagacaccattatgtacattactcgactggcaggactccctcgctaaacggtgtgtctgcgtgagcaacacgatcagatccttatcattcgtgccagggaatgattttgagatgtcgaagcatccgggcttactcctgattctggggaaactgatactccttcaccataagcacccagagcggaagcaggccccactcacgtatgagaaggaggaagaacaggaccagggcgtgagctgcaataaagtggagtggtggtgggattgcctggaaatgctgagagaaaatacactggtgactttggcgaacattagcggccagctggatttatccccttatccagagagcatttgcctccccgtactggacggtcttctccactgggctgtctgcccaagcgcagaggcgcaagaccctttctcgacattgggtcctaatgcagttctgtcaccacagcggttggttttagagacactgtctaagctcagcatccaggataataacgtggacttaatccttgctacgcctccattcagcaggctcgagaagttatacagtacgatggttcggttcctctcggatcgtaagaatcccgtctgccgcgaaatggctgtagtcctgctggccaatctggcccagggcgattccctggccgcaagggctatagctgtccagaaaggctccattggtaatctgctcggattcttagaagatagcctcgccgccacccagttccaacaatctcaagcgtctctgctgcacatgcagaatcctcccttcgagccaacaagcgtcgacatgatgagaagagccgccagggccctgctcgccctggctaaagtggacgaaaatcacagtgagttcaccctatatgagagccggctcctcgatatttccgttagccccctcatgaactcactggtgtcccaagtcatatgcgatgtactgtttctgatcggtcagagttag

SEQ ID NO: 11315 - DNA, 1842 bp, Artificial Sequence
  Description of Artificial Sequence: Synthetic coding sequence
atgatgtcactgaagtctggactcctagctgaatcaacatgggccctggacaccatcaatatcctcctgtatgacgacaactcaatcatgaccttcaacctgagccagctgcctggactgctggagttactggtggaatacttcaggaggtgcctcatcgaaatttttggtatcctgaaagaatatgaggtcggagaccccggtcaacgcaccttgttggaccccggccgatttagtaaagtatcctcgccggctccaatggaggggggcgaggaggaagaggaactcctgggtccgaagctagaggaggaagaagaggaggaagtggtggaaaatgatgaggaaatcgcatttagcggcaaggacaagcctgccagcgaaaactcagaagaaaagctgatctctaaattcgataagcttcccgttaagatcgtacagaagaacgacccttttgtggtggactgcagcgacaaactgggacgagttcaggagttcgactccggattacttcactggagaattggtggcggggatacaaccgaacatatccaaacccatttcgagtctaagacagaactgctgccatcacggccgcacgctccatgcccaccagccccacgaaagcacgttacgacggcagaagggaccccgggcaccacggaccaggaagggccaccccccgacgggccaccagagaagcgaatcaccgccaccatggacgacatgctgtccacacgtagcagtactcttacagaggatggtgccaagtccagcgaagccatcaaggagtccagcaagtttcccttcggtattagccctgcccagtcccaccggaatatcaagatcctcgaagacgagccccattccaaagacgagacacccctctgtactctgttagattggcaggatagcctggctaaacgttgcgtgtgtgtaagcaacactattagaagtctcagttttgtgcctggcaatgacttcgaaatgtccaagcatccaggcttgctgttaatactcggcaagctgatcctgctccaccataagcaccccgagcgtaaacaggcacccctcacttacgagaaagaagaggaacaggatcagggggtttcttgcaacaaggtcgagtggtggtgggattgtctggaaatgttaagggagaatactcttgtcacgctggcaaacatatcagggcagctggacctttccccttacccagagagtatctgcctcccggtgctggatggcctgttgcattgggcggtgtgtccctctgctgaagcccaggacccgttctcaaccctgggtcctaatgccgttctcagcccccagcgcttagtgctcgaaacattgtcaaagctgtccattcaggataacaacgttgatctgattctggccactccaccgttttcccgattggagaaattgtatagcacaatggtacggttcctcagcgaccgcaaaaatcctgtgtgtagggagatggcggtagtgttgctcgccaatctggcccaaggcgactccctggctgcccgggccatcgcggttcagaagggtagcattgggaatctgctgggttttctggaagactcccttgctgcgacccagttccagcagtcccaggcatcgttgttacacatgcagaaccctccgttcgagcctacctccgtggacatgatgaggcgcgcggcacgggcccttctcgccctggcgaaagtggatgagaaccactcagaattcaccctatacgagtcacgtcttctcgacataagcgtcagtccactgatgaactctctcgtcagccaggtaatctgtgatgtcctctttctgatcggccagagttag

SEQ ID NO: 11316 - DNA, 6696 bp, Artificial Sequence
  Description of Artificial Sequence: Synthetic coding sequence
atggaaactggccttcttcccaatcacaaactcaagactgttggggaggcccccgccgctcccccccatcaacagcatcaccaccatcaccacgcccatcatcatcaccatcacgcccatcacctgcaccatcatcacgcgcttcagcagcagttaaaccaatttcagcagcagcaacagcagcagcaacaacagcagcaacaacagcagcagcagcagcacccaatcagcaataataatagccttggcggagccggggggggagcccctcagccaggtcccgacatggaacaaccgcagcatggaggagccaaagacagtgcggccggcggacaggcggaccctcctggaccaccactgctgtcaaaaccaggagacgaagatgatgcgcctccgaaaatgggagagcccgccgggggtaggtacgagcacccgggactgggtgctctggggacacagcagccgccagtggcagtccctggcgggggaggcggtccagcagctgttcccgagtttaacaactattatggaagtgccgcacctgcttcaggcggccctggagggcgggctgggccctgttttgaccagcacggcggtcagcaatcccccggcatgggcatgatgcatagcgccagcgctgctgcagcgggcgccccagggtctatggaccctctacagaattcccatgaaggataccccaacagccaatgcaatcattaccctgggtattctagaccaggggccggtggcggggggggaggtggcggcggcgggggcggaggatcaggcggaggaggaggcggcggtggcgctggtgctggaggcgctggggcgggcgccgttgccgccgcagctgccgcagccgctgcggctgccgggggcggcggcggcggagggtacggtggttcctctgccgggtacggagtcctcagctcccctcgccagcaaggcggcggcatgatgatggggccaggcggcggtggagccgcatctctgtccaaagcggctgctggctcagctgctggtggattccagcgcttcgcaggtcagaatcagcacccatctggagcaactccaacattgaatcagttactcacctcgccttctcctatgatgcgaagctatggcgggtcctatccagaatactcaagcccgagtgcacctccacctcctccttcccagccgcagtctcaagccgcggccgcaggcgcagccgccggcggccaacaagccgccgctggaatggggttgggaaaggatatgggcgcacagtatgcggccgcgagcccagcgtgggctgcggctcagcaacgatcacatcccgccatgagccccggcaccccgggcccaacaatggggagatcacagggctcacctatggatccaatggtgatgaaacgcccacagctctacggtatgggatccaatcctcattcacagccacaacaatcttccccctaccctggcggatcctatggaccacccggcccacagagataccccattgggattcaggggcggacccctggtgccatggcgggcatgcaatacccccagcagcagatgccaccgcaatatggtcagcagggggtgagcgggtactgccagcaggggcagcagccttactactcccagcagcctcagcctccacaccttcctccccaggcccagtatttgccttcacaatcacaacagcgctaccagccacagcaggacatgagtcaggaagggtacggcacacggagtcagccacccctggcccccgggaaacctaaccacgaagatctgaatctcattcagcaagagcgacctagtagcctgcccgatctgtccggcagcatagatgatttgcctacaggcacggaggccaccttgtcctctgctgtctctgcaagcggttcgacaagctcccagggcgaccagtccaatccagcccagagtcctttcagtccacacgcttcaccgcatctgagcagtattcccgggggcccaagccctagccccgtcgggtccccagtcggatctaaccagtcccgtagtgggcccatttccccagcgagcatccccgggtctcagatgcctccacaacctcctgggagccagtcagagagcagcagccaccctgccctgagccagtcccctatgccacaggaacgcgggtttatggcgggcacgcaacgcaaccctcagatggctcaatatggacctcagcaaacgggaccctcaatgtcacctcacccgtctccgggggggcagatgcatgcgggtatcagttcctttcagcagtccaactcatccggcacatatggaccacagatgtctcagtatgggccacagggaaactatagccgacccccagcctatagtggtgtaccctccgcctcttacagtggccctgggcccggaatgggaatcagcgcgaacaatcagatgcacgggcagggcccctcacaaccttgcggcgcagtccctctcggccgtatgccaagtgcaggaatgcagaacagaccgttcccaggcaacatgtcaagcatgaccccctcatctccgggaatgtctcagcagggggggcccggaatgggacctcctatgcctactgtgaaccgcaaagcccaggaagctgcggcggcagtgatgcaggccgccgccaatagtgctcaaagtaggcaggggtcctttccaggtatgaaccagagcggattgatggcctctagtagcccctactcccaaccaatgaataatagttcaagccttatgaatacgcaggctcccccctattcaatggcccccgctatggtgaattcgagcgcagcaagcgtcgggcttgccgatatgatgtctcccggtgaatccaaactgcctctgcctttaaaggccgatgggaaagaagagggcaccccacagcccgaatccaagtccaaggatagctattcttcacagggaatatcccagccccccacgcccggaaacctcccggtgcccagcccaatgtccccttcaagcgcaagcattagctcattccatggcgatgagagcgactccattagtagtcccggctggcctaagactccaagctcacccaagtctagcagctctactactacgggcgagaagataacgaaagtgtatgagcttggcaacgagcctgagcgcaagctttgggtcgaccgctacctgacattcatggaggagcgcgggagccccgtctccagcctgccagcggtaggcaagaagccactggacttattccggctctatgtgtgcgttaaggagatagggggcctggcacaggttaataaaaacaagaaatggcgggaactggctacgaatctgaacgtcggcacgagctcctctgccgcctcatcacttaagaagcaatacatccagtacttatttgcgtttgagtgcaaaattgaaagaggcgaggaaccaccacctgaagttttcagcaccggcgacactaagaagcagccgaaactgcagccaccaagcccagccaactccgggagtctgcaaggtcctcagacaccacagtcaacgggttctaactccatggccgaggtccccggcgacctgaagccacctacgccagccagtaccccacacggtcagatgaccccaatgcaaggtggccgttcaagcacaatttctgtacatgaccccttttctgacgtgtccgacagctcattccctaagcgcaactcaatgactcccaacgctccctatcagcagggaatgagcatgccagatgtgatgggccgaatgccatacgaaccaaataaagatccattcggcgggatgcggaaagtgccagggtcttctgagccatttatgacccaaggccaaatgcctaactcctctatgcaggacatgtataatcagtcgccatcgggcgccatgagcaacctcggaatgggccagagacaacagttcccatacggagcctcatatgaccgtcgtcatgagccatacggccagcagtatcctggtcagggccctcccagtgggcagcctccgtatggggggcaccagcccggactgtacccacaacagcctaattacaaacgacacatggacggcatgtatggccccccggccaagaggcatgaaggagatatgtacaatatgcagtattcgagccagcaacaggagatgtacaaccagtatgggggcagctacagtggtcccgacaggcggcccatccagggccagtacccctacccttactctcgagaacggatgcagggtccagggcagattcagacccacgggattccgccccagatgatgggcggtccactccagagttctagctccgaaggccctcagcaaaatatgtgggccgctagaaatgatatgccttatccctatcagaataggcaggggccagggggtccaacccaggctcccccctaccccggtatgaaccgcaccgacgacatgatggtacccgaccagcgtattaaccatgagagccaatggcccagccacgtgtcccagaggcagccctatatgtccagtagtgcctcaatgcagccaattacgcgccccccccaacccagctaccagactcccccatccctgccaaatcatatatcgcgggcccctagtcctgcctcttttcagcgctctcttgagaatagaatgtctccctctaagagtccttttctaccctccatgaagatgcagaaggtcatgcccacagtgcccaccagtcaggtgacagggcctccaccacagcctccccctattagacgcgaaatcacatttccccctggatccgtggaggcatcacagccagtgctgaagcaaagacgcaagataacttccaaggatatcgtgaccccagaggcctggagagtcatgatgtctctgaagtctggactgctggcagagtccacttgggctcttgatacaataaacatacttttgtatgacgattctactgttgccaccttcaatctttcccagctttcaggatttctggagttgctcgttgaatacttcagaaaatgccttattgatatattcggaatcctcatggagtatgaggttggcgatccctcgcagaaggccttagatcacaacgctgccagaaaggatgactctcaatctctcgccgacgacagcgggaaagaggaggaggatgctgagtgcatcgacgatgatgaagaagatgaagaagatgaagaagaggacagcgaaaaaacggagtccgatgagaaatcaagcatcgccctcactgccccagatgccgctgccgaccctaaagaaaaacccaagcaggcatcaaaattcgacaaactgccaatcaagattgtaaagaagaacaatctttttgtagtggatagatccgacaagttgggcagagtgcaggagtttaacagtggcttgctccactggcaacttgggggaggagacaccacagaacacatccagacgcatttcgaatccaagatggagattcctcccagaagaagacccccgccaccattaagttctgcagggaggaagaaggaacaggaaggcaagggagattccgaagagcagcaggagaagtccattatcgccactatagacgatgtcttgagcgccagacccggcgcactgcccgaagatgccaaccctggccctcaaaccgagagctctaagttccctttcggaatccagcaagctaaatcccacaggaacattaagcttctggaggacgagcctcgaagcagggacgagacccccctctgtacaatcgcacactggcaggatagcctcgccaaaagatgcatttgtgtgtccaatatagtgcgaagcctatcattcgtaccaggcaacgatgccgagatgagcaagcaccctggacttgtcctaatcctggggaaactgattctgctgcaccatgaacacccagagaggaaaagagccccgcagacttacgaaaaggaagaagacgaggacaagggcgtggcctgctccaaagacgaatggtggtgggactgtctggaggtgctcagggataatacactagttacactggctaatattagcggacagctcgaccttagcgcatacaccgaatccatttgcctccctatattggacggactccttcattggatggtctgcccctcagcggaagctcaagacccgttccccacggtcggcccaaattcagtgctctctccgcagagactggtgctcgaaacattgtgtaagctgtcaatccaagacaacaatgtggatctgattttagccacaccacccttctcgcgacaggagaagttttatgccacactggtacgttatgtgggagacaggaagaatcccgtgtgtagagagatgagtatggctctgctgtccaatttagctcaaggcgacgctttggcggcccgtgcgattgccgtgcaaaaggggagcattggaaatctaatctcattcctggaggatggtgtgactatggcccaatatcaacagtcccagcacaatctgatgcatatgcagccacctcctctcgagccgccaagcgttgatatgatgtgccgggccgcaaaggccctattggcaatggccagggttgacgagaaccgaagcgagttcctcctgcatgagggcagactgttggacatcagcataagcgccgttttaaactcactagtcgcgagcgtaatatgcgatgtgttgtttcagatcggacagctgtag

SEQ ID NO: 11317 - DNA, 6750 bp, Artificial Sequence
  Description of Artificial Sequence: Synthetic coding sequence
atggcccacaatgctggggcagccgccgctgccggtacccactctgcgaagtcgggagggtctgaagctgccctgaaagaaggcggcagcgccgctgccctgagttcatccagctcgagttccgctgccgccgctgccgcttcaagctcctccagttcaggtccagggtcagccatggaaacgggacttctcccgaatcacaagctcaagacagtgggggaagcaccggctgctccaccccaccaacagcaccatcaccatcaccatgctcaccaccatcaccaccatgcgcaccatctgcatcaccaccacgcgttgcagcagcagcttaaccagtttcagcagcagcagcaacagcagcaacagcaacagcaacagcagcagcagcagcagcatcccatctcaaataacaacagtctgggcggagctggcggcggggcaccccagcctggtcctgacatggagcagcctcagcatggcggggcgaaagacagcgcagctggcggacaggcagatccacccggtccaccactgttgagcaagcctggcgatgaagacgacgcccctcccaaaatgggggagcccgcaggcggtcgctacgaacaccccgggttgggggcactgggtacccaacagcctccagtcgccgtgccaggaggcggaggaggacccgccgctgttcccgaatttaataattactacgggagcgccgcccccgctagtggcggccccggtggacgtgcggggccttgctttgatcagcatggggggcagcagtctcccggaatgggtatgatgcacagcgcctctgctgctgccgctggcgccccaggatcgatggaccccctgcagaatagccatgaaggctatcctaattctcaatgtaatcattatccagggtactctaggcctggagcgggaggaggcggaggggggggcggtggcggagggggcggctcagggggaggaggcggagggggaggcgctggggctgggggtgcaggagccggcgctgtggcagccgcagctgccgccgcagcagctgccgcgggtggaggaggcggtggaggatacgggggttcctccgcaggctacggcgtactgtcctctcccagacagcagggcggcgggatgatgatgggcccgggagggggcggggctgcatccctctctaaagccgccgcaggctccgccgctggcggttttcaaaggttcgccggacagaatcagcatccatcaggagctacgccaacgctcaatcagctgctcacttccccctcaccaatgatgcggtcttacggtggatcctatcccgagtattcctcaccaagtgctcccccacctcccccttcccagccacagtcacaggccgccgccgcaggggcggctgcaggagggcagcaggccgccgccggaatgggtcttggcaaggatatgggcgcacagtacgcagccgcctcccctgcgtgggctgccgcacagcagcgaagccaccctgcgatgtctccaggaacccccggccccacaatgggaagatctcagggaagtccaatggatccaatggtgatgaagcggccgcagctgtacggaatggggtctaacccgcacagccagcctcagcagagttccccgtaccctggtggttcctatggcccgcctggtcctcagcgctacccgataggcatacaaggacgcacacccggggctatggctggcatgcagtatccgcagcagcaggactccggcgatgccacgtggaaagagactttctggttgatgccccctcagtatggtcagcagggagtcagcggatactgccaacagggccagcaaccgtactactcgcagcaaccacagcccccgcacctccctccccaggctcagtacctcccctcacagagtcagcagaggtatcagccccagcaggatatgagtcaggagggatacggcacacgatctcagcccccactcgcccccggcaagcctaatcacgaggacctcaatcttatccaacaagaacgcccatcctccctgcctgatctctccgggagcatcgatgatttacctacaggtaccgaggctaccctgagcagcgcagtgtctgctagcgggtccacctcttcacagggtgaccagagcaacccagcacagtcaccattcagcccccacgccagcccccacctctcctcaatccccggcggacccagtccttccccagtgggctcacctgtcggatccaatcagtctcgcagcggcccaattagcccagcctctatccccgggtcccagatgccccctcagccacctggaagccagtcagagagctccagccaccctgctctgtcccagtcgcctatgccccaggagagaggatttatggcgggtacacaacggaacccacagatggcacagtatggaccccaacagacaggacctagtatgagcccgcaccctagccccggcggccaaatgcacgcaggcatctcttccttccagcaatctaactccagcggcacatacggaccacagatgagccagtacggcccacaggggaattattcacgccctcctgcctactccggagtgcctagcgcaagctactctggacccgggccaggcatgggcatatctgcaaataaccagatgcatggccaaggcccttcccaaccctgcggtgccgtgcccctgggcaggatgccgtcagccggcatgcagaacaggccgtttcctggcaatatgtcctcaatgacgccatcatctcccggtatgtcccagcaggggggcccgggcatgggacccccaatgcccaccgttaaccggaaggcccaagaggcagcggcagcagtcatgcaagccgcagccaatagcgcacaatcccgccaggggtcctttccaggaatgaatcagagcggccttatggcttctagttcgccctactcacagcctatgaataatagttcctcactcatgaatactcaggcacctccttattcaatggctccagccatggtcaacagcagcgccgcttctgtggggctggcagacatgatgtcccctggggaatccaagctaccattgcccctcaaggctgatgggaaggaagaaggcacaccgcaacccgaatcaaagtctaaaaaatcctccagctctacaacaaccggggaaaaaattactaaagtgtacgaactcggcaacgagcccgagagaaagctttgggttgaccggtatctcacttttatggaggaacgggggtcgccagtctcttccctcccagccgtcggaaaaaaacctttggacctcttcaggttgtatgtatgcgtcaaagaaatcggcggcctcgctcaggtcaataagaataaaaagtggcgcgagcttgccacaaatctgaacgtaggaaccagtagttcggctgccagctcgctgaaaaagcaatacatccagtacttatttgcatttgagtgtaagatcgagagaggcgaggaacccccccctgaggttttcagtaccggcgacactaagaagcagccgaagctgcaaccaccaagtcccgcaaactctggcagcttgcagggaccccaaacgcctcagtcgaccggctcgaatagtatggcggaagtgccaggcgacctcaagccacccacgcccgcatcaacacctcacggacagatgaccccaatgcagggaggcagaagctctaccatcagcgtgcacgatcctttcagcgatgtttcagactccagttttcccaagagaaatagtatgacaccaaacgcaccctaccagcagggaatgagtatgcccgatgtgatgggccggatgccctacgagcctaataaggaccctttcggcggtatgagaaaagtgccgggatcaagcgaacccttcatgacacaaggtcagatgcctaacagcagtatgcaggatatgtacaatcagagcccaagtggagccatgagtaatctaggcatggggcagagacagcagttcccctacggcgcttcctacgacagacgccatgagccatatgggcagcagtaccccgggcagggtccacccagcggacaacctccctacggaggccaccaacccggcctttaccctcagcagcccaattataaacgccacatggatggaatgtacggtccacccgccaagcgccacgaaggagatatgtataacatgcagtattccagccagcaacaagaaatgtataaccaatatggagggagttattctggcccagatcggcgcccgattcaaggtcagtacccctacccatattcccgggagcggatgcaaggacctgggcaaatacagactcatggaatcccacctcagatgatggggggccctcttcagagcagttctagcgaaggacctcagcagaacatgtgggcagcacggaatgatatgccttatccataccagaaccgccagggccccgggggtcccacccaggcccccccctatccaggtatgaataggaccgatgacatgatggtccccgaccagcggattaaccatgagagccagtggccatctcacgtatctcagagacagccttacatgtcttccagcgcctcaatgcaacctattacccgccctccccagccctcctaccagacacccccaagtctccccaatcacatttccagggcaccaagccctgcctcgttccagcgttctctggaaaatcgtatgtctccgagtaagtctccatttctgcctagcatgaaaatgcaaaaggtgatgccaaccgtccccacctcacaagttaccggccccccccctcagccccctccaatcaggagggaaattacgtttcccccaggctccgtagaggcctcccagccagtgctgaagcagcggcggaagataacgagtaaggacatcgtcacacccgaggcttggagagtgatgatgagtctgaaatcgggactgcttgcggagtctacttgggcactagacacaattaacatcctgctttatgacgatagtaccgtggcaacctttaacctgagccagctcagtggcttcctggaactgctggtggagtatttccggaaatgtttgattgacatatttgggatactgatggagtacgaggttggcgatccgagtcagaaagcccttgaccacaatgctgctcgcaaggatgactcgcaatcattagctgacgacagtgggaaagaggaggaagacgccgagtgtatcgatgatgacgaggaggatgaggaggatgaggaagaagatagtgaaaagactgagtccgatgagaaaagtagcatcgcactcaccgcacctgatgcagccgccgacccaaaggaaaagccaaagcaagcgtcaaagtttgacaaactgccaatcaaaatcgtgaaaaaaaataatctgtttgtggtggataggtcagacaaactcggcagggtccaagagtttaattccgggctactgcattggcaactaggggggggtgacaccactgaacacattcagacccactttgagagtaagatggagatccccccccggcggcgaccaccaccacccctgtcatccgccggaaggaagaaagaacaggagggtaagggggactcggaagagcagcaggagaagtccattattgccaccattgatgatgtgctgagcgctcggccgggcgcgttacctgaagacgcaaaccccggcccccagaccgaatctagcaagttccccttcggaatccagcaggctaagagtcatagaaacattaagctgctggaagacgaaccccgttcacgggatgagactccattgtgcactatcgcccactggcaggatagcttggctaagagatgtatatgcgtctctaatattgttaggagcttgtcatttgttcctggtaacgatgctgagatgtccaaacatcccggtcttgttctgattctgggtaagttaatcctccttcatcacgaacacccagagaggaaacgcgcgcctcagacttacgaaaaggaggaggacgaagataaaggtgtcgcatgtagcaaggatgagtggtggtgggactgcctggaggttctacgagacaataccttagtgaccttggctaacattagtggtcagctggacctgagcgcctatactgagagcatctgcctcccgatcctggacggtctgctacactggatggtgtgcccatccgccgaagctcaggacccattccccaccgtggggcccaattctgttctgtcccctcagagactcgtgcttgagactttgtgtaaactgtcaatccaggataataatgtcgacctcattttggcgacccccccattcagccgccaggagaagttctacgcaacattggtgaggtacgtcggtgacaggaagaatcccgtttgcagggagatgagtatggccctgctgtctaatctggcgcagggtgatgccctggctgctagggccatcgccgtgcagaaagggtctataggaaacttgatcagttttttagaggatggtgtcacaatggcgcagtatcaacaatctcagcacaaccttatgcacatgcagcctcccccactggagccaccctcggtggatatgatgtgtcgcgcggccaaagctttgttggcaatggcacgagtagacgagaataggagcgaatttctcttgcacgaaggacgcctgcttgatatttctatcagcgctgttctgaatagtctcgtcgcctctgtaatatgcgatgtcctctttcagatcggccagctgtag

SEQ ID NO: 11318 - DNA, 6711 bp, Artificial Sequence
  Description of Artificial Sequence: Synthetic coding sequence
atggcccataacgctggagctgccgccgctgcgggaacccactccgctaagtcgggaggcagtgaagctgccctaaaagagggaggctcagcagctgccctctccagcagctcctcgtcgagtgccgctgccgctgccgcttcatctagttccagcagcggccccgggagtgccatggaaacaggtctcctcccaaaccataagctgaaaaccgtgggggaggccccagctgccccaccccaccagcaacatcatcaccaccatcacgcccaccaccatcaccaccacgcccatcatctgcaccaccatcacgccctgcagcagcagctcaaccagttccagcaacagcagcagcagcagcaacaacagcagcagcagcagcagcaacagcaacacccgatcagcaacaacaactctctgggaggcgccggcgggggggccccacagcccggccccgacatggaacaaccacaacacggaggagccaaggactccgcggcggggggccaagccgatccacctgggccaccgttactcagtaagcctggtgacgaggacgatgcgcctcccaagatgggggagcctgcaggaggcagatatgaacaccctggattaggagcactgggaacccaacagccccctgtggctgttccgggagggggcggcgggcctgcagctgtgccagaatttaacaattattatggatctgccgcgcccgcctcaggcgggcccggagggcgtgcaggaccttgttttgaccagcatggcggacagcagtctccggggatgggcatgatgcatagtgcaagcgccgccgctgcaggcgctcccggttccatggatccactccagaactcccacgaggggtatcctaactctcaatgcaatcattacccaggttactcgagacccggagctggcggaggaggcggagggggaggcggcgggggtggaggcagcggaggaggaggcgggggggggggagcaggggcgggaggggccggggcaggagcagtcgccgcggccgctgctgccgcagcggccgcagctgggggagggggaggcgggggctacggaggttccagcgccggctatggcgtgctttcatcccctcggcaacagggtggcgggatgatgatgggccccggcggagggggcgccgcaagcctgagtaaggccgctgccggctcagcagcaggtggatttcagcggtttgctggtcagaatcagcatccctctggcgctacacctacccttaaccaattgttgacttccccaagccccatgatgagatcctacggcgggtcatatcctgagtactccagcccatcagctccacccccccctccttcccagccgcaaagccaggcggcagccgccggtgctgccgctggtggacaacaggctgccgcaggcatgggtctggggaaggacatgggcgcccagtacgccgccgccagccccgcatgggctgcagcgcagcagcggtcccaccccgcgatgagccctggtactccgggtcccacaatgggccgttctcagggttccccgatggaccccatggtgatgaaaaggcctcagttgtatggtatggggagcaacccccattcacaaccgcagcagagtagtccctacccaggcgggagctatggaccgccaggaccccaacgctaccccatcggcattcaaggtaggaccccgggggccatggccggaatgcagtaccctcagcagcaaatgcctccacagtatggccagcaaggcgtttctggatattgtcagcaaggccagcagccgtattactcacaacagccccaacctcctcatttacctcctcaggcccaatacctcccctctcagtcacagcagcgataccagcctcagcaggacatgagccaggaaggctacggcaccagatcacaacctcccctcgcacctggtaagccaaaccacgaggacctcaatcttatccagcaagagcgaccatcttcgctgcccgacctcagcggatccatcgatgaccttcctacaggcacagaagccacccttagctcagctgtgtccgcttctggatccacaagcagtcagggcgaccagtctaaccccgcccagtcgcctttctcccctcatgccagccctcacttgtcttcgattcccggagggccatcgcccagtccagtaggctcgcccgtgggaagcaaccagagtcggtcaggccctatttcaccagcctccataccaggttctcagatgcctcctcagcccccaggctctcagagcgaatcatctagccacccggccttgagccagtcacccatgccccaggagcggggcttcatggccggtactcaacggaatcctcagatggcacagtatggccctcaacagacaggcccgagcatgtcaccacatccgtcccctggtggccagatgcacgctggcatctcttcatttcagcagtcaaactccagcggcacttatgggcctcagatgtcccaatatggtcctcaggggaactatagccgcccaccagcatactcaggggtgcctagcgcctcctactcaggcccagggcccggcatgggaatctccgccaataatcagatgcatggacagggtccaagccagccctgtggtgccgtccctcttggacgaatgcctagcgccggcatgcagaacagaccattcccaggcaatatgtcctcaatgaccccttcatccccaggaatgtcccagcaggggggccctggcatgggccctccgatgccaacagtcaatcggaaagcccaggaagcggccgctgcagtcatgcaagctgctgctaactctgcccagagccgacagggcagttttcctggaatgaatcagtcaggattaatggcgagctcgagcccttactctcagcctatgaacaacagttcctccttaatgaatacccaggctcctccatactccatggccccagctatggtgaatagctctgcagcgtccgtgggcctggctgacatgatgtcacctggggaatctaagctccccctgcccctcaaagcggacggtaaggaagaaggtactccgcagcctgagtccaagtctaaaaagtctagctcctcgaccactactggcgagaaaatcacaaaggtgtacgaattgggtaatgaaccagagcgaaaactgtgggtagatcgctacctcacatttatggaagagcgcggcagtccagtttcctctctacccgccgtcggcaagaagcctttggacctttttaggctgtatgtttgcgtcaaggagattggagggcttgcgcaggttaacaagaataagaaatggcgtgaactcgcaaccaatctgaacgtcggaacctccagctctgctgccagctccttaaaaaagcagtacatccaatacctattcgcctttgagtgcaagattgaacggggcgaagagccacccccagaagtgttttcaacaggtgataccaaaaagcagcccaaattgcaacctccttctcccgctaactccggaagtcttcaggggccccaaactcctcagtcaactggctcaaactcaatggccgaggttcccggtgatttgaagccacctacccccgcaagcaccccccatggccagatgaccccaatgcaagggggcaggagttccacaatcagtgttcacgatccattttccgacgtttctgattctagctttcccaagcggaatagtatgacgcctaacgctccataccaacagggcatgtcaatgccggacgttatggggcggatgccctacgagcctaacaaagaccccttcggcggaatgcgtaaggtgcccggctcctcagaacccttcatgacccaaggccagatgcctaactcatccatgcaggacatgtacaaccagtcaccttcaggggccatgagtaacctaggcatgggtcaacgccagcaattcccatacggagcttcctatgaccgtagacacgaaccatatggacagcagtatccagggcagggtccgccttccgggcaaccaccctatgggggtcaccagcccggcctgtacccccaacagcctaactacaagaggcacatggatggcatgtacgggccgcccgcgaaacgccatgagggtgacatgtataatatgcagtactcctcacaacagcaagagatgtacaaccagtacggcggttcgtatagtggccctgaccgccgacccattcaggggcagtacccgtatccctacagcagggaaagaatgcaaggccctgggcagatacagactcacggaatccccccgcagatgatgggtggcccactgcagagttcttcatctgagggcccgcagcagaatatgtgggctgcacgcaacgacatgccctacccttatcagaacaggcagggcccaggtggccctactcaagctcctccgtatccaggtatgaatagaacagatgatatgatggtacccgaccagcggatcaaccatgaaagccagtggccaagccacgtctctcagcgccaaccatatatgtccagtagtgcctcaatgcaacccattactaggccaccacagcctagttaccagaccccaccgtccctccccaaccatatcagccgcgctccgagtcctgctagctttcaaagatctctggagaatagaatgtcccccagcaagtcccctttcctgccgtccatgaagatgcagaaagttatgccaactgtgcccaccagtcaggtgactggtccccctcctcagccgcctcccatccggcgtgagattacgttcccgccaggctccgtcgaagcaagtcagccagtgttaaaacagagacgcaagataactagcaaagatatcgtgactccggaagcctggagagtcatgatgtcactgaagagcggtctcctggctgagagtacatgggcactagacactatcaatattctactctacgatgatagcacagtggctacattcaacctaagtcaattatcgggtttcctagaactcctcgtcgagtattttcggaaatgtctgatagacatctttggaatactgatggaatacgaagtgggtgaccccagccagaaagctctcgatcataatgctgcccggaaagatgacagccaatccttggcggatgacagcggaaaggaggaagaagacgcagaatgcattgacgatgacgaggaggacgaagaggacgaggaggaagactcagagaaaacagagtctgatgagaagagttcaatcgccctcacggctcccgacgcagcagccgacccaaaggagaaacctaaacaggcttccaaattcgacaagttacccattaagattgtgaaaaaaaataatttatttgtcgtggatcggtccgataaacttggcagggtccaagagttcaattcagggttactgcactggcaactgggcggaggagatacgaccgaacatatacagactcatttcgagtcaaaaatggaaattcccccccgtaggcgcccgccaccgcccttgtcatccgcaggcagaaagaaagagcaggaaggaaaaggcgatagcgaggagcagcaggagaaaagtattattgcaaccattgacgatgtgctgagcgctcgcccaggcgccctcccagaagatgctaatcccggtccacagacggagtcatccaagttcccctttggtatacagcaagcgaagtcccataggaatatcaaactattggaagatgaaccacgttcaagggacgaaacccctctgtgcactatcgcccactggcaggactctctggccaagagatgcatttgcgtgtctaacattgtgcggagcttaagcttcgtgccaggaaatgacgcagagatgagcaaacatcctggactggtgctgatcctcggcaagctgatcctgctgcaccatgagcaccctgagcgtaagcgtgcccctcaaacctacgagaaagaagaggacgaggataagggggtcgcgtgcagcaaggatgagtggtggtgggactgtcttgaggtgctaagagataatacccttgtgacccttgcgaatatcagcgggcagctggatctctccgcgtacactgaaagcatttgtctgcctattctggacggactgctccattggatggtatgcccatcagcagaggcacaggatccgttcccaacagtgggtcccaattccgtgctgtcaccccagaggttggttctcgagactctctgcaaattatctattcaggataataacgttgacctgattctggccacacccccgttcagccgccaggagaagttctacgccaccctggtgcgctacgtgggggaccgcaaaaatccagtgtgccgggaaatgagcatggccctcttgtcaaatctcgcgcagggcgacgcacttgccgcccgcgccattgcagtccagaagggcagtataggtaacctcatcagctttttagaggacggggtgacgatggcccagtatcagcagagccagcataacttaatgcatatgcaacctcctccattagagccacccagtgtagatatgatgtgtcgcgctgccaaggctctgcttgcgatggccagggtggacgagaaccggtcagaattcctcctccacgagggcaggttactggacatcagtattagtgccgtgctgaactcattggtcgctagtgtgatatgtgatgtgcttttccagatcggccagctctag

SEQ ID NO: 11319 - DNA, 2172 bp, Artificial Sequence
  Description of Artificial Sequence: Synthetic coding sequence
atgccaccgcagtatggacagcaaggagtgagtggatactgtcagcaagggcagcaaccatattacagtcaacagccccagcctccacacctgccccctcaagctcaatatctcccatcccaatcccaacaaagataccaaccacagcaagatatgagccaggagggatatggtactcgctcccagcccccgctggccccaggtaaaccgaatcacgaggatttgaatcttatccagcaagaaaggcccagttctctgcctgatctgagcggaagcattgatgacctgccaacaggcaccgaagcgaccctgtcgtcggcagtgagcgcgtccggatcgacctcctctcagggggaccagtcgaaccccgctcaatcccccttctccccccacgcctccccccatttgtcctcgattccgggaggccctagtccaagcccagtgggcagcccggtggggtccaatcagagcaggagcggaccaataagccctgcgagcatcccagggagtcagatgccgccccaaccacctggctctcaatcggagtcctcatcccatccggcattgagtcagtcacccatgccccaggagcggggcacgcaacgaaacccccagatggcccagtacggtccacagcagactgggccgtccatgagcccacacccgagtccaggcggacagatgcacgcagggatcagctcattccagcagtctaacagctccgggacttacgggccccagatgtctcagtacggacctcagggaaactatagccggcctcccgcttactcaggcgtgccttcggcctcttattcaggcccaggtcccgggatgggaataagtgccaataatcaaatgcacggccagggacctagtcaaccttgtggggcagtgcccctgggtcggatgccttcagcaggaatgcagaatcggccgtttcctggtaacatgtcttccatgaccccgtcatcccctggcatgagccaacaagggggtcctgggatgggcccgcccatgccgactgtaaaccgaaaagcgcaggaggctgctgcggcagtaatgcaggcagccgcaaactccgcccaatcccgccagggtagtttccctggaatgaatcagagcggacttatggccagttctagcccctattcccagccgatgaacaactcttcgtcactgatgaatacacaagcccctccatactcaatggcccccgctatggtcaattccagcgcggcttctgtcggtcttgcagacatgatgtcccccggcgaaagcaagcttccactgccactgaaggccgacgggaaagaagaggggacccctcagcctgagtctaaaagtaaagatagttacagtagccagggtatatctcagcccccaactccagggaaccttcctgtcccctctccaatgtcgcctagctctgcatctatcagctcctttcacggggacgagtcagattctatcagctcccctggatggccaaaaaccccatccagccccaaatctagcagcagcaccaccacgggagagaaaatcaccaaggtgtatgaactaggaaacgagcccgagagaaagctgtgggtggaccggtacctgactttcatggaagaacgggggtctccggtgtcaagtcttccagccgtaggcaaaaaaccactggatcttttccgattgtacgtttgtgttaaggagatcggcgggctagctcaggtgaacaagaacaaaaagtggcgcgaattggctactaacctgaacgtgggcacatccagcagtgctgcatctagtcttaaaaagcagtacatccaatacctctttgccttcgaatgtaagattgaacgcggagaggagccacccccggaggtcttcagcactggggacacaaagaagcagcccaaattgcagcctccctccccagtagtccagatggagccacgggcctgtgacactgggggtagcggcagaaaagcatcttggagcaggcctgctcctcgagctcgcgcaggtggaagcagacacactcaggcttctggcggccgacgtcagagacatcctggactccagaagccgctagactccctcccgcctacgcagcaagtggcctcccctatcccagttccctcactcggcaaggtctcggggaatatcttcgtggttaaggggaaatag

SEQ ID NO: 11320 - DNA, 6870 bp, Artificial Sequence
  Description of Artificial Sequence: Synthetic coding sequence
atggcacacaacgccggagcagccgcggcagccggaacacatagcgccaagagtggcggatctgaggcagcgcttaaggagggcggctccgccgccgcgctctcctcgagctcttctagcagtgccgccgccgccgctgcatccagctccagttccagtggccccggcagcgcaatggagaccggcctgctcccgaaccacaagctgaaaacggtcggcgaagccccggctgctcccccgcatcagcaacaccatcatcaccaccatgctcatcatcatcaccatcacgcacatcatctgcatcaccaccatgcactgcaacagcagctgaaccagttccagcagcagcagcagcagcagcagcaacagcagcagcaacaacagcagcagcagcaccccatcagcaacaataacagtctgggaggtgctggtggaggagcacctcagcccggcccagacatggaacagccccaacatgggggtgcaaaagatagcgctgcaggcggacaagcagacccgcctggacctcccctgctctcaaaacctggcgacgaagacgacgcgcctcctaaaatgggcgaacctgccggaggacggtacgagcatcctgggctgggggccttgggcacccagcagccacctgtagctgtgccaggtggtggcgggggccccgcagccgttccagagttcaataactactacgggtccgccgctcctgcttcaggaggaccaggcggcagagctgggccctgttttgaccaacacggaggacagcagtctcccggtatgggcatgatgcattctgccagtgcagctgccgctggtgcccccggtagtatggaccccctccagaattcccacgaaggatacccaaatagccagtgtaatcattaccctgggtacagtcgccccggcgcaggtggcgggggaggtggcggcggtggggggggtggcgggtcagggggagggggtggcggcggcggtgcaggcgccgggggggccggggccggtgccgtggcagccgcggctgctgcagctgccgccgctgcgggcgggggcggcggcggcggctatggcgggtcctcagccggctatggagtgctctcttccccccgtcagcaaggaggcggaatgatgatgggccccggaggaggaggcgccgcaagcctgtcaaaggctgccgccggcagcgctgctggtggcttccagcggtttgccggacagaatcagcacccatctggagccacacctacactgaaccagcttctcacatctccgagtcccatgatgagaagttacggtggatcatatcctgaatattcttctccgtcagcacctcctccaccaccatctcagccacagtctcaggccgcagcggcaggcgctgctgctggcgggcaacaggctgccgccgggatgggactaggtaaggatatgggagctcagtacgccgccgcttccccagcctgggctgccgcacagcagcgctctcacccggcgatgtcaccgggcacaccaggtccgaccatgggaaggagccagggttccccaatggacccgatggtcatgaagaggccacagctctacggcatggggagcaatcctcactcccaaccgcagcagagtagcccttatcccgggggctcatacggccccccggggccacaacgttatcctatcggcattcagggccggacccctggtgccatggccggcatgcaatacccccagcagcagatgcctccccagtacggtcagcagggtgtgtcaggttactgccaacagggccagcaaccctactacagccaacagccccagcctccccacctgcccccacaagcgcaatatctcccttcccagtcccaacagcggtatcagccacagcaggatatgagtcaagagggctatggcacccgcagccaaccccccctggcacccggcaaaccaaaccatgaggatctgaatctgatccaacaggagcggccctctagtcttccagacctgagcgggtctattgatgatctgcccaccggaaccgaagccactctctcatccgccgtctccgcgtctggatcaaccagcagccagggcgaccagagtaatcccgcgcaaagcccattttcccctcacgctagccctcatctttctagtatacctgggggtcctagcccgagccctgttggcagcccagtgggaagtaatcagagcagatcagggccaatctcccccgctagtattcccgggagtcaaatgccacctcagcccccaggctcacagagtgagtcctccagccacccagcgctgtcccagtctcccatgccccaggagaggggatttatggctggcactcaacggaatccacagatggcccagtacggtccgcagcagactggccccagcatgtctcctcatccatcacccggcgggcagatgcatgctggaattagctcctttcagcagagtaactcttcagggacctatggccctcagatgagccagtatggccctcagggaaattactctagacctcctgcctactcaggggttccaagtgcatcttactccggaccgggcccaggcatgggcatctctgctaataatcagatgcacgggcagggaccaagtcagccttgtggtgccgtgcccttaggcagaatgccgtccgctgggatgcaaaacagaccattccccggcaatatgtcaagtatgacaccaagctcccctggcatgtcccagcagggcggtcccggtatggggccccctatgccgaccgtgaaccggaaagcacaggaagccgcagccgctgtgatgcaggcagcagccaactcagcccagtctcgacaaggatcctttcccggtatgaaccaatctggcctaatggcaagttccagtccgtactctcagcccatgaataatagttcttctttgatgaatacacaggctcccccctactctatggctcccgcaatggtgaattcttcggccgccagcgtcggcctggcggatatgatgagtccaggggagtccaaactgcccctgcccttgaaggccgacggtaaagaagaaggcacaccacagcctgaatcaaagtctaaggactcttacagttcccagggaatctctcagccccctaccccagggaacttgccagttccgtctccaatgtctccttcttccgcttctatctcttcattccatggcgatgagtcagatagtatttcctcaccaggctggcccaaaaccccctcgagccctaaatctagcagtagtaccactaccggcgagaagataacaaaagtttatgagttgggcaacgaacctgagcgcaagctttgggtggacaggtacctgacatttatggaggaacggggcagccccgtatcatctctaccagcagtcggaaaaaaaccactggatctgtttaggctctatgtctgtgtaaaagagatcggcggcctcgcccaagtgaataaaaacaagaagtggcgcgagttagccactaatctcaatgtcggcacctccagcagcgcagcctccagtctcaaaaagcagtacattcagtacctctttgcttttgaatgcaaaattgagcggggagaagaaccaccccccgaggtcttctccacgggcgataccaagaagcaacccaaactacagccaccttctccagccaattctggctcacttcagggccctcagacaccccaatccaccggtagcaactcaatggccgaggtgcccggtgacctcaagcctccaacacccgcatcaacaccacacggacagatgacaccgatgcagggaggcagaagctcaaccatttctgtccacgacccctttagtgatgtttccgactcctccttcccgaagcgtaactctatgaccccaaacgcgccgtaccagcagggcatgagcatgcccgatgtaatgggcagaatgccctacgaaccaaataaagatccattcggtggcatgcggaaggtgcccggctcttcagagcccttcatgacacagggccagatgcccaactcgtcaatgcaggacatgtacaatcagtcaccaagcggagcgatgtcaaatctcggaatggggcaacgccagcagttcccatacggcgcctcatacgaccggaggcacgaaccttacggtcagcagtatcccggccaaggccccccttcaggtcagcctccttacggcgggcaccagcctggtctgtatccacagcagcccaattataagcgacatatggacggcatgtatggcccacccgccaaaagacatgagggcgacatgtataatatgcagtacagctctcagcagcaggagatgtataaccagtacggaggctcctacagtggccccgacagaaggccgatccaggggcaatacccatacccctactctcgagagcggatgcagggaccagggcaaatccaaacccatggcatccctccacaaatgatggggggcccactacaatccagctcttcagagggtcctcagcagaacatgtgggctgcccggaatgatatgccctatccctaccagaacagacagggcccaggaggtccaacccaagccccaccgtaccccgggatgaatcgcacagacgatatgatggtgcccgatcagaggattaatcacgagtcccaatggccaagtcacgtcagccagcgtcaaccttacatgtcctccagtgcatcaatgcaaccaataactcgtccaccgcagccttcgtaccagactccacctagtctacctaatcacatctcccgcgccccaagtcctgctagcttccagaggtcactagagaataggatgtcgccgtctaaatcccctttccttccttctatgaaaatgcagaaggtaatgccaacagttcccacatcgcaagtcacaggcccccccccccagcccccaccaatccggcgggaaatcacattcccccctggctctgtcgaggcatcgcagccggtgctgaaacaaagaaggaaaatcacgagtaaagacattgtcactcccgaagcctggagagtgatgatgtcactcaagagcggccttctggccgaaagtacttgggcgctggacactattaatatcctcctgtacgatgattcaaccgtggcgactttcaatttaagtcaactctcggggtttctggagcttcttgtggagtatttccggaaatgcctgattgacatctttggcatactaatggaatacgaggtaggagacccttcacagaaggccctggaccataatgcagcgcggaaagacgattcacagtccttagccgatgattcaggcaaggaggaggaggatgccgaatgcatagacgatgacgaggaggacgaagaagacgaagaggaagactcagagaagaccgagtcagacgaaaagtcgtccatcgctttaaccgcacccgacgcagcggctgacccgaaggaaaaacccaagcaagcctccaaatttgacaagctgcctattaagatcgtgaaaaagaacaacctgttcgttgtggataggagtgataagttgggaagagtacaggagttcaattccgggctgctccactggcagctgggcggcggagacaccactgaacacattcagacccacttcgagtcaaagatggagatccctcctaggcgccgcccaccacccccattgtcctccgccggaagaaagaaggaacaggagggtaaaggcgattctgaggagcagcaggagaagtctattatagccacaattgacgatgtcctgagtgccaggccaggggctctgcccgaggatgctaatccagggccacagaccgagagtagtaaatttcccttcggaatccagcaagccaagagccaccgtaacattaaactgttagaggacgaacctaggagtcgtgacgagaccccgctctgcacaattgcgcactggcaggattctctggccaaaaggtgtatttgtgtatccaatattgtgcggtcactcagcttcgtgccaggcaacgacgccgagatgagcaagcacccgggtctggtgctcatcctgggaaagctcatcctcttgcaccacgaacaccccgaacgcaagagagcccctcagacttatgagaaagaagaggatgaggacaagggcgtcgcgtgttctaaagacgaatggtggtgggactgccttgaggtgctgcgcgacaacacccttgtgactcttgccaacatatccggccagctggacttaagcgcctacacagagagtatctgcctacccatactggacggcttgctgcactggatggtatgcccaagcgccgaagcccaggatccttttccaactgtgggacccaacagtgtgttgtcgccccagaggctggtcctcgagactctctgtaaattgtcgattcaggataacaatgttgaccttattctggccacaccacccttcagccgacaggagaagttttacgcaacgctcgtgcgatacgtgggagaccgtaagaatcccgtttgcagagaaatgtccatggccctgctttctaacctcgcccagggtgacgctctggcagctagggctatcgctgtccaaaaaggttccattggcaacctcatttctttcttagaggacggcgtgacaatggctcagtaccaacaatcacagcataacctgatgcacatgcagccgccacctttggagcctccgagcgtggacatgatgtgtagagctgctaaagcgctcctcgcaatggcacgagtggacgagaatcggagtgaattcctcttgcacgaaggccggcttctggatatttccatctcggccgttttgaacagcctggtggcaagcgtgatttgcgacgttttatttcaaattggccaattgtag

SEQ ID NO: 11321 - DNA, 822 bp, Artificial Sequence
  Description of Artificial Sequence: Synthetic coding sequence
gccgccgttatgcaggctgctgctaattcagcacaatctaggcaagggagcttccctggcatgaaccagagcggcctgatggcatccagtagtccatacagccagccgatgaataattctagttccctgatgaacacccaggctccaccatattctatggcccccgcgatggttaactcatccgcagcgagcgtgggactggccgacatgatgtcccccggcgagagtaagctgccattgcccttgaaggctgacggtaaagaggagggaaccccacagcccgagagcaagtctaagaaatcatcatcctctacaacaaccggagagaagataacaaaggtctacgagctgggaaatgaacctgagcgcaagctgtgggttgaccgatatctcacgtttatggaggaacgtggctccccggtgagctctttgccagctgtgggtaagaaaccgctggatctgttccggctgtacgtctgcgtcaaggaaatcggcggactggcccaggtgaacaaaaataaaaagtggcgtgagctggcaacaaatctcaatgttggcacatcatcatccgctgcatcatcattgaagaaacagtacatacagtacttatttgcatttgagtgcaagatcgagcgcggggaagagccaccacctgaagtgttcagcacaggggacacaaaaaagcagcccaagttgcaaccacccagccctggcaagtggcggaggtgctcccattggcctaggaaggcacaggctccagggttaggtggatccggcaaggtggtctctcagagcggacagcaggggacttgggacttctag

SEQ ID NO: 11322 - DNA, 1053 bp, Artificial Sequence
  Description of Artificial Sequence: Synthetic coding sequence
atgtcccaggaaggctacggaaccaggagccagcccccgctggcccccggcaaacctaaccacgaagatctaaacctgatccaacaagagcggccctcctctttgccagtcgaagtactggccagtgaagacgcggctttcgggctgaaagatctttcgggttccatagacgacctcccaaccggcacagaggctaccttgtcaagcgcggtgagcgcgtctggcagcaccagttcgcagggggaccagtcaaaccctgctcagtcccctttctctcctcacgcatcaccgcacttgagttctatccccggagggccatcaccctccccagtggggtcccccgtggggagcaatcagagccgctcaggtccgattagccctgcatccatcccaggttcccagatgcctccccaaccgcccggttctcagtctgagagttccagtcacccagctctgagtcaaagtccaatgccccaagaacggggttttatggccggtacacagagaaaccctcagatggcacaatatggcccgcagcaaaccggcccctctatgagccctcatccaagtcctggcgggcagatgcatgcgggcatctcgagttttcagcagtctaatagtagcggcacctatggcccacaaatgtcccagtatgggccacaggggaactatagcaggcctcctgcatatagcggcgtgcctagtgcttcctactctggacccggcccaggtatgggcatctcagccaacaaccaaatgcatggtcagggccccagtcagccctgcggcgcggttccgctgggtaggatgcccagcgctggcatgcagaatagaccatttccgggaaacatgagttctatgacaccttcttcacctggtatgtcacagcaagggggaccaggtatgggaccacctatgccgacagttaatagaaaagcccaagaggctgcagctgccgtcatgcaggcggctgccaattctgcccagtcgaggtacgctacacaagagcatgctcctggaaggtacgccgtctgcctgccagtcacaacgtag

SEQ ID NO: 11323 - DNA, 5508 bp, Artificial Sequence
  Description of Artificial Sequence: Synthetic coding sequence
atggccaatagcaccgggaaagctccgcccgatgaaagacgcaaaggcctcgccttcctagacgaactgcgccagtttcaccattccaggggttccccattcaaaaagatccctgccgtcggagggaaagagttggatcttcatggcctatacactagggtcaccactctgggcggcttcgctaaagtgagtgagaaaaatcaatggggggagatcgtggaggagttcaattttcctcgatcctgctcaaacgctgcattcgccctcaagcagtactaccttcggtacctcgaaaaatatgagaaggtacaccatttcggggaagatgacgacgaagttccacctgggaatcccaagccccaactacccattggagccataccctcatcttacaattatcagcaacattcagtatcagattacctgcgtcagtcctatggactctccatggactttaactctcctaatgactacaataaactcgtgctctctctgctcagcggactgccaaacgaggtcgattttgccatcaacgtctgtaccctgctcagcaacgagtcgaaacacgtcatgcagctggaaaaggaccctaagatcatcaccctgctgttggcaaacgccggagtatttgacgataccctcggaagcttttctactgtgtttggggaggagtggaaagaaaaaacagatagagactttgtcaagttttggaaggatattgtggatgacaatgaggtcagagacctgattagtgacaggaataagagccatgaaggcacatccggggaatggatctgggaatctctgttccatcccccgcggaagctgggcattaatgacatagaaggtcagagagtgttgcagattgctgtgatcctaaggaatctgtcttttgaagagggcaacgtgaagctgctggcagctaacagaacttgtctcaggtttcttctgctatctgcccattcccattttatttcactgcgccagctcgggttggatacactcggcaacattgctgcggaattgcttctggaccctgtggatttcaaaacaactcacctgatgttccacactgtgacgaagtgcctgatgtcccgggatagatttttgaagatgcgagggatggaaatccttggaaacttgtgcaaggcggaggataacggcgtattaatctgtgaatatgtggaccaggactcataccgggagattatctgtcacctgaccctgccggatgtcttactggtgatatcgaccctcgaggtgttgtacatgttgactgaaatgggggacgtcgcttgcaccaagatcgccaaggtggagaagtctatcgatatgttagtctgtctcgtctcaatggacattcaaatgtttgggcctgacgcccttgcagctgtaaagctcattgaacacccatcaagtagccaccagatgttgtccgaaatccgtcctcaagcaatcgagcaggtgcagacacagacacacgtggcttctgcgcccgcttcgcgagcagtggtcgcccagcacgtggcgcccccacccgggatcgtggagatcgattcggaaaaattcgcatgtcaatggcttaacgcacatttcgaagttaacccagactgcagcgtctctcgggcagagatgtattcagagtatctgagtacctgttccaagctagcacgaggggggatcttaacgtcgaccggcttttacaaatgcttgagaactgtgttcccaaatcacactgtgaaacgggtggaagactcttcatctaacgggcaagctcatatccatgtggtaggggtcaagcggcgggcaattcctctgcccatccaaatgtattaccagcaacagccagtgtccactagcgtcgtcagggtggattccgtgcccgacgtgagtcccgccccgtcgcctgcaggaatcccccatggtagtcagaccatcgggaatcatttccaaagaactcctgttgcgaatcaaagctccaatctgacagcaacccagatgtcttttccagtgcagggggttcataccgttgcacaaacagtgagcagaattccccagaacccatccccacatacacaccagcagcagaacgcccctgtgaccgttattcagtctaaggctcccattccctgtgaagtggtgaaggccaccgtgatacagaatagtatcccacagaccggggtccctgtgagcattgcggtgggcggcggacctccccagtctagtgtagtgcagaaccactctacaggacctcagcctgtaactgtggtgaattctcagaccctactccaccacccatctgtgataccccagcagagccccctccatactgtggttccagggcaaatcccttcaggcacccctgtaacagtcatccagcaggcagtgccacagagccatatgtttgggcgcgtccagaatatacccgcctgcacgtccaccgtttctcaggggcagcaattgattaccaccagcccgcaaccagtgcagactagttcccagcagacctccgccggctctcagtcacaggatactgtgatcatcgcgcctcctcaatatgttacaacttccgctagtaatattgtttcggctactagtgtccagaacttccaggttgctaccggccagatggtgaccatcgctggagtcccgagcccacaggcaagcagagtaggtttccagaatatcgctccgaagcccttgcctagccagcaggtgtcctccacagtggtccagcagccgatccagcaaccgcagcagccaacacagcagagcgtggtaatcgtaagccaacccgcccaacaaggacagacatatgctcctgccatacaccagatcgtgctcgctaatcccgcagctctgcccgcaggtcagacagtgcaactgaccgggcagccaaatataaccccatcatcatcaccctccccggtaccagctacaaataaccaggtgcctacagctatgagttctagctccaccccccagtcacagggtcctcctcccactgtaagtcagatgttaagtgtgaagcgccaacagcagcagcagcattcgccagcaccccctccgcagcaggtccaggtccaggtgcagcagccacagcaagttcagatgcaagtccaaccccagcagagcaatgcgggcgtgggtcagccagccagcggtgagtctagcctgatcaaacagctcctgctaccgaagagggggccctcgacacctggaggtaaattgatcctgcccgctccccagattccacctcctaataacgctcgcgctcctagccctcaggttgtttatcaagtagctagcaatcaagccgcaggcttcggggttcagggacaaactccagcccagcagctgctggtggggcagcaaaacgtacaactcgtacccagcgccatgccaccatcaggcggcgtccagacggtcccaatctccaacttgcagatcctgccgggccccctgattagtaattctcccgccaccatcttccagggaacaagcgggaatcaggtcacgatcaccgtggtacccaatacaagttttgctccagccactgtgtcccaagggaacgcaactcaattaatcgcacccgcaggcataacaatgtctgggacgcagacaggtgtggggcttccagtccaaaccctgcctgctacccaggcctctcctgccgggcaatcatcatgcacaacagccacgccaccgttcaaaggggacaagattatctgccaaaaggaggaagaagccaaggaggccaccggacttcacgtccacgagcggaaaattgaggtgatggagaatcccagctgtaggcggggggccaccaacacgagcaatggcgacacaaaggagaatgagatgcacgtaggctctctcctgaatggcagaaagtattccgattctagcctgccgccgtcgaacagtggtaagattcagtcggagacaaaccagtgctctttgatctccaatgggcctagtctggagctgggtgaaaatggagctagtggcaagcagaattccgaacagattgatatgcaggatattaagagtgatctgcggaaaccccttgtgaatggcatttgtgactttgacaaaggcgacggttctcatttgtccaaaaatatcccgaaccataagacttctaaccacgtggggaacggggaaatctcgccaatggagccgcagggcactctcgatatcactcagcaggacaccgctaaaggagaccaactggaaagaatttctaatggacccgttcttaccttgggcgggagcagcgtcagcagcatccaagaagcgtctaacgcagccacccagcagttcagcggtaccgacctcctcaatggcccattggccagcagtctgaattccgatgtgccacagcagcgcccctcagtggtggtgtcccctcactccacgactagcgtaatccaaggccaccaaataattgcagttcccgacagcggctctaaagtttcccatagccccgccctgagttccgatgtgcgcagcacaaatggtaccgctgagtgtaaaaccgtaaaacggcctgctgaggacaccgacagagagaccgtggcagggatccctaacaaggtcggggtgcgtattgtcaccatttctgacccgaacaacgccggttgcagcgcaacaatggtggcagtccctgctggcgcagatccttccacggtggcaaaagttgctattgaaagcgccgtccagcagaagcagcaacacccccctacatacgtccaaaacgttgtgcctcaaaatacacccatgcccccgagtcccgcagttcaagtgcaggggcagccaaattcctcccagccctccccattcagcggttcgtcccagcctggcgatccgatgaggaaacctggacagaatttcatgtgtttatggcagtcttgtaagaagtggtttcagaccccttcccaggtcttttaccatgcagccactgaacacggcgggaaggacgtttatccagggcagtgcttgtgggaaggctgcgaaccctttcagcggcagcgctttagctttattactcacctgcaggacaagcattgctccaaggacgctctgctagccggactcaagcaagatgaaccaggacaggcagggtcgcagaagtcatcaactaagcagcccaccgtgggcgggacgtcctcaaccccgagagctcagaaggcgattgtgaaccatccttcagcagctctgatggccctgaggcggggatcccggaacctggtctttcgcgatttcaccgacgaaaaagaaggaccaattactaagcacatccgtctcactgcagctctgattctgaagaatattggtaagtactctgagtgtgggcggagactgctgaagaggcacgagaataatctgtcagtccttgccatatcaaatatggaggcttcctccaccctcgctaaatgtctgtacgagctgaacttcaccgtgcagtctaaagagcaggagaaggacagcgagatgctacagtag

SEQ ID NO: 11324 - DNA, 2859 bp, Artificial Sequence
  Description of Artificial Sequence: Synthetic coding sequence
atgatgatgcggtaccaccaggcaatacaatcccacagcttcctgctggtgcaatttcacctccctaccatcacctctaacacggtatgtcggatcatctgtgttaaggttatgggctgtccgtggacacttattcgccagatgatcattatcaactggtgcttccactgctatctagattcacaaatgaagtggactctgttgctcacatatgccttgtcctatcagatgaaagcgtctacaagctgtaacctcaagaagatactgaagtcttctccagtgccagcaaccaataatcaagtgccgaccgcaatgtctagcagctctacgccacagagtcaaggcccccctccgacagtaagtcagatgttgtccgtgaaacgccagcagcaacaacagcatagcccggcaccacccccccagcaggtccaagtgcaggtccaacaaccacagcaggtgcagatgcaggtccagccccagcagagcaacgccggtgttggacagcctgcttcaggtgaatcttcactcatcaaacagttgctcctcccaaagcgcggaccaagtacacctggcgggaaactcattctgccagccccacagatcccccctccgaataacgccagagccccttcaccacaggttgtgtaccaggtggcatcaaatcaagctgccgggttcggggtgcagggacagacacccgctcagcaactcctggtgggacagcagaatgtgcaacttgtgcccagtgctatgccaccatcagggggcgtgcaaaccgtgccgatcagtaatctacagattctgcccggacctctaattagcaattcaccggccacgatcttccaggggacctccggcaatcaagttaccatcaccgtcgtcccaaatacctcatttgctccagcaactgtcagccaaggtaatgccacccagctgatagcccctgctggcatcactatgtcaggcactcaaacaggggtgggtctgcccgtacagacgctgccagcaacacaggcatctcccgccggccagtcgtcttgcacaactgcgacacctccatttaaaggtgacaagatcatttgccagaaggaagaagaagctaaggaggccaccggcttgcacgtgcacgagcggaagattgaggtcatggaaaacccctcatgtcgacgtggggccaccaatacctctaatggtgacacaaaggaaaacgaaatgcacgtggggagcctactaaacggtcgcaagtattcagacagttcactcccgcctagtaatagtggtaagatccagtcagagactaatcaatgctccctgatttcaaacggccctagtctggaattgggtgagaatggcgcttccggcaaacagaatagtgagcaaattgatatgcaagacatcaagtccgatctgagaaaacccctggttaatggtatctgcgacttcgacaagggcgacggatcacacctttccaagaatatccctaaccacaagacctctaaccatgtcggcaacggtgaaataagtcctatggaaccacaaggtaccctggatataacacagcaggacaccgctaagggagaccagctggagcgcatctctaacgggccagtcctgacactggggggcagcagcgtgtctagcatccaggaagccagcaacgccgctactcagcagttctcgggaacagaccttctgaacggacccttggcgtcttccctgaacagcgatgtgcctcaacaacgcccctctgtggtagtcagtcctcatagtacaactagcgtgatacagggtcaccaaatcatcgccgtgcccgattcaggctccaaggtgtctcacagccctgcactgagctccgatgtcaggtcgacgaacggaacagcggaatgtaagaccgtgaaaagaccggctgaggacaccgatagggaaactgtcgccggtatcccaaacaaggtgggagtcagaatagtcactatctcagatcctaacaatgcaggatgcagcgccaccatggtggctgtacccgccggagcagaccccagcaccgttgcaaaagttgcgattgaatctgccgtccagcagaagcaacaacatcctccaacctacgtccagaacgtggtcccgcagaacacacctatgcctccaagccctgccgtgcaggtacaaggacagcccaactcttcccaacctagcccttttagcgggtcttcccaaccaggtgacccaatgaggaaacccggacagaatttcatgtgtctctggcaatcgtgcaagaagtggtttcagacacctagccaggtcttctatcatgctgctactgaacacggcggcaaggacgtgtatccgggccagtgcctgtgggagggatgcgaaccttttcaacgccagcggttctccttcatcacgcacctgcaggataaacattgctcaaaggatgctcttctggcgggattgaagcaggacgagcccggccaagcaggctcgcagaaatcttctactaagcaacctactgttggcggcactagtagtacccctagggcccaaaaggccatcgtgaaccacccaagcgcagccctgatggctctcagaagggggtcacgcaatctggtatttagagactttaccgatgaaaaagaagggccaataaccaaacatatcagactgaccgcagcactgattcttaaaaatatcggcaaatatagcgagtgcgggcgaagactgctaaaacgtcacgaaaacaacctctctgtcctggcaatcagcaacatggaagcctcttctactcttgctaagtgcctctacgaacttaatttcacggtccagagcaaggaacaggaaaaagactctgaaatgttacagtag

SEQ ID NO: 11325 - DNA, 4338 bp, Artificial Sequence
  Description of Artificial Sequence: Synthetic coding sequence
atgcgcggcatggaaatccttggcaacctatgtaaagctgaggacaatggagtgctcatctgcgagtatgtcgatcaagattcatatagagagatcatctgtcacctgaccctgcccgatgtgctacttgtgatctccactctggaagtcctctacatgctgacggagatgggtgacgtggcctgcacaaagattgccaaggtcgaaaagtccatagccgctgtcaagctgatcgagcacccaagctcatcacatcagatgctcagtgaaatcagacctcaggccattgaacaggttcaaacgcagacacacgtcgcttccgctcctgcatccagggcggtcgtggctcagcatgtggcgccaccgcctggtattgtggaaattgattcggaaaaatttgcctgtcagtggctgaatgcccacttcgaggtgaaccctgactgttctgtaagccgcgcagaaatgtacagtgaatatttatcaacttgctcaaagctagctcgtggaggcattttaacctcaaccgggttttacaagtgcctgcgcactgttttccctaaccacacagtgaaaagagtggaagactcttcgagtaacggtcaggcccacatccacgtagtgggggttaagcgccgtgctattcctctgccaattcagatgtactaccaacagcagccagtatcaacttctgttgtccgcgtcgattccgtgccagacgtatccccagcgccatcccccgccggaatccctcacggttcccagaccatcggcaatcacttccagagaactccagttgctaaccagtcatccaatctcaccgccacccagatgtcattccccgtccaaggggtgcacacggtggcccagaccgtctccaggattccccagaatccgtcacctcacacacaccagcagcagaacgcgcccgtgacagtgatccaatctaaagcccctatcccctgtgaagtggtcaaagctacagtgattcagaacagcattcctcagactggcgtgcccgtcagtatcgccgtgggcggcgggccaccccagtcaagtgtggtgcagaaccattccacgggcccccaaccggtgaccgtagtaaactcacagacactccttcaccatccctccgtcatcccacagcagtcgcccctgcacacagtcgtccccgggcagattccatctggaacaccagtcacagtgatccagcaggccgtgccccagtcacatatgttcggtcgcgtccagaatattccggcctgtacctctaccgtttcacaggggcaacagcttatcacgacgtcccctcaacccgtgcagacttctagccagcagacatcagccggcagtcagtcccaggacacggttattattgcccctccacagtacgttaccacgagtgcctccaatatcgtatcggccacgagtgtacaaaactttcaggttgccacaggccagatggtcaccatcgccggggtcccctctcctcaagccagtcgggttgggttccagaatattgctccaaaacctctccctagccagcaggtcagttccactgttgtacagcagccaatccagcagcctcagcagcccacccagcagtctgtggtcatcgtgtctcagccggctcaacagggacaaacatacgcgcctgccatccatcagattgtgttggccaaccccgctgcgctgcctgcggggcagactgtgcagctgaccggccagcctaacattaccccctcttctagcccaagccctgttccggcgaccaataatcaggtaccaaccgccatgtcttcttcatcaaccccccagagccagggaccgccccccacagtgagccagatgctgtctgtgaaacgtcaacagcagcagcaacactctcccgctcccccccctcagcaagtccaggtccaggttcagcagcctcagcaggtccagatgcaggttcagccgcagcagtctaatgcaggcgtgggacagcctgcatcgggcgagtcttcactcatcaaacagctgctcctcccaaagagaggcccatctacgcccggcggaaagctcattttgcccgctccccagattccccccccaaacaacgcccgcgctcccagtccccaggtggtgtatcaggtggctagcaaccaggctgcaggatttggggtgcagggtcagacacctgcccagcagctgttggttggacaacagaatgtccaactcgtcccgagcgcaatgcctcctagcggcggagttcagactgtgcccatctccaatctgcaaattctgccaggccccctgattagcaatagcccagccaccatcttccaaggaacaagtggaaaccaggtgaccatcactgttgttccaaacactagctttgctccagctacggtgtcacaaggcaatgccacccagctgatcgccccagctggcattacaatgtctgggactcagacaggagtgggcctcccggttcagacattacctgccacacaagcttccccagcaggccagagtagctgcacgacagctacccctcctttcaagggtgataagattatttgccagaaagaagaggaagccaaggaggcaactggtctgcacgtgcacgaacgcaagatagaggttatggaaaacccatcttgcaggaggggagcaacgaacacctctaacggtgatacgaaggagaatgaaatgcacgttggtagcctgcttaacggccgcaagtattcggattcatcgctcccaccctccaatagtggcaaaatccagagcgaaacgaatcagtgttcccttatcagcaatggaccgagcctcgagcttggtgagaatggggcctccggcaagcagaatagcgaacagatagatatgcaggacatcaagtccgatttacgcaagccacttgtcaacggcatctgtgatttcgataaaggggacggttcacatttgagcaaaaatatcccaaaccacaaaacgtcgaatcacgtgggcaacggcgagatcagccctatggaacctcagggaactttggacattactcaacaggacaccgctaaaggggatcaactggagaggatttccaacggaccagttttgacactcgggggaagttccgtcagtagcattcaggaagcatccaacgcggccacacagcagttctccgggacagacctgcttaacgggcccttagcaagcagcctaaacagcgatgtgccgcagcagcgaccgtccgtagtcgtcagtccacatagtactacgtctgtgatccagggccaccaaataatcgcagttcccgactcaggctccaaggtctcccacagtccagccctgtcatccgacgtgcgctctacgaacggcacagccgagtgcaagaccgtaaagcgaccagccgaggataccgaccgtgaaacggtcgcagggatacctaataaagtgggagtcaggatcgtcaccatcagtgaccccaacaatgctggctgtagcgcaacaatggtcgccgttcccgcgggagccgacccatcaacggtcgcgaaagtggccattgagtccgcagtgcagcagaaacagcaacacccgcctacctatgtgcagaacgtcgttcctcaaaatacccctatgccgccctcccctgcagtccaggtccaagggcagcctaatagttctcagcccagccctttctcaggctcatcacaacccggggacccaatgcgcaagccaggtcaaaatttcatgtgtctttggcagagctgcaaaaaatggtttcaaaccccgagccaggtgttttatcatgccgcaaccgagcacggcggaaaggatgtctacccggggcagtgtctctgggagggctgtgagccatttcagcgacagcgcttttcattcatcacccacctacaagacaaacactgctctaaggatgctcttctggccggcctgaaacaggatgaaccgggtcaagctgggtcacagaaaagttccacaaagcagcccacggtcggaggcaccagctcaacaccgcgggcacagaaggcaatagttaaccaccccagcgctgcgttaatggcactgaggcggggctccagaaatttggtgtttcgcgacttcaccgacgaaaaggaggggccaatcaccaaacacattagactgaccgcagccctgattttaaagaatattgggaagtatagtgagtgcggacgtagattactgaagcgacacgaaaataatctgtctgtgctcgccatatccaatatggaggcatcatcaaccctcgcgaaatgtctttatgagttgaattttaccgtccagagcaaagagcaggagaaagacagtgagatgctccagtag

SEQ ID NO: 11326 - DNA, 2859 bp, Artificial Sequence
  Description of Artificial Sequence: Synthetic coding sequence
atgatgatgaggtaccaccaggcgatccagtcccattctttccttctcgtacagtttcatctccctactatcacctccaacactgtgtgtcgtataatctgcgtcaaggtcatgggctgcccatggaccctgattcgtcagatgattattattaactggtgtttccattgttacctagatagtcagatgaagtggacactgctgctgacatatgcattaagctatcagatgaaggccagtacatcctgcaatttgaagaaaattctcaaatcatcacctgtcccagccaccaataaccaggtgccaaccgcgatgtcctcctctagtaccccgcagtctcagggaccacctcctactgtatcacaaatgctgtcggttaaacgacaacagcaacagcaacattctccagcaccaccaccgcagcaggtccaggtgcaagtccagcaaccacagcaggtgcagatgcaagtgcagcctcagcagtctaatgcaggtgttggccagcccgccagcggcgagtcttctctgatcaaacagttactgttgcctaaacgcggacctagcactccaggcgggaaactgattctccccgcacctcaaataccgccccctaataacgccagggccccgagcccacaggtggtgtatcaggttgcgtcaaaccaggccgccggattcggagtgcagggacagacccccgcgcagcagcttttggtggggcagcagaacgtccaactagtaccatcagcaatgcctccgagcggcggggtccagactgtgccgatcagcaatcttcagattttaccaggtcctcttatctcaaattccccggctaccatttttcagggtacttcaggcaatcaggtaaccattaccgtcgtgcccaatacgtcattcgcacctgccaccgtgtcccagggaaatgccactcagttaatcgccccagctgggatcaccatgtctgggactcagaccggggtggggctgcccgtgcaaaccctgcctgcaactcaagcttcccctgcagggcagtcttcatgcacgactgcgacgcccccattcaagggggacaagataatttgtcagaaggaagaggaagccaaagaggccactggtttacacgtgcacgagcggaaaatcgaggtgatggaaaacccgtcttgcagaaggggagccacgaatacttcaaacggagatacaaaggaaaatgagatgcacgtggggtcactcttaaatgggcgtaaatactctgattcctctctcccgccatccaattccggaaagatccaatctgagactaaccagtgttccctgatttctaatggacctagcctcgaactcggagagaacggcgcctcaggaaagcaaaatagtgagcagatcgatatgcaggatattaaaagcgatctgaggaagcccctcgtcaatggcatttgtgacttcgataagggtgacgggtctcacctgtctaagaatattccgaatcacaagacctccaatcatgtcggtaacggagaaatatcaccaatggagccccagggcacacttgatatcactcagcaggatacagccaagggcgatcagctggagagaatctccaatggacctgtccttactttaggtggaagctccgtctcatcaatccaggaggccagcaatgctgccacacagcaattttcagggaccgatctcctgaacggaccacttgcatctagcctcaatagcgatgtcccgcaacagagacccagcgttgtcgtgagcccacattccaccacttctgtcatccagggccaccagattatcgcagtgccggactcaggatcaaaagtgtcccatagccccgccctctcatctgacgtgaggagtactaatggaactgcagagtgtaagaccgtcaaaagacctgcagaagacacggaccgggagaccgtggcgggcatcccaaacaaggtcggagtgaggatagtgacaatctccgatcccaacaacgctgggtgtagtgcaaccatggtcgccgtgccggccggcgccgacccttccacagtcgctaaggtcgctatcgaatccgctgtgcaacagaaacagcaacatccccccacatacgtgcagaacgtggtcccacaaaacacccccatgccaccgtctcccgccgtgcaggtccagggccaacccaattcgtctcagccttcccctttttccggttccagtcagcctggagaccccatgaggaagccgggccagaactttatgtgcctttggcagtcttgcaaaaagtggttccagaccccctctcaagtgttttatcacgccgctactgaacacggcggaaaagacgtgtaccccgggcagtgcctatgggagggctgtgagccctttcagaggcagcgattcagttttattacccacctgcaggataagcactgtagtaaagacgcgcttttagcaggcttgaagcaagatgagcctgggcaggccggctcccagaagtcttctacgaaacagcccaccgtgggaggcacatctagtaccccaagggctcaaaaggcaattgtgaatcatccgtctgcggccctgatggcactgcgtcgcggctcccggaatctagttttccgcgattttaccgatgagaaagaaggcccaatcactaagcacatacgccttacagccgcgttgatcctgaaaaatatcgggaaatactctgagtgcggccgaagactgcttaagcgacatgagaacaacctgtccgtacttgctatctcgaacatggaggcgagcagtacactggcgaagtgcttgtacgagctgaattttaccgtgcaatctaaggagcaggaaaaggattccgaaatgctccagtag

SEQ ID NO: 11327 - DNA, 1044 bp, Artificial Sequence
  Description of Artificial Sequence: Synthetic coding sequence
atgaagatggaagaaatgagcttgtccggcctggataactctaagctggaagccattgcacaggagatttacgctgacttagttgaggattcttgtctcgggttttgctttgaggtacacagagcagtcaaatgtggatacttcttcttggacgacactgaccccgactcaatgaaggactttgagatcgtggatcagcctggcctggatatcttcggccaggtgtttaatcaatggaaaagtaaggagtgtgtgtgccctaactgtagtcgaagcatcgctgctagccggtttgcaccccacctggagaaatgcttaggcatgggacggaatagcagccgtatcgccaatagacgtatcgccaattctaataatatgaacaagtccgagagtgatcaagaggataatgacgacatcaacgacaatgactggtcctacggatccgaaaagaaagcaaagaaacggaaatcagataaaaaccctaactcaccaaggaggtcaaagagcctgaagcataaaaacggtgaattgtcaaattctgacccattcaagtacaacaacagcacagggatcagctacgagaccttgggccccgaagagctcagatctctgctcacaacacagtgtggagtgatttctgaacacacgaagaagatgtgtactaggagcctgaggtgtccgcagcacacagacgaacaacgccgcaccgtgcgcatttacttcctgggcccatctgccgttctccccgaagtagaaagttccctggacaacgactcattcgacatgactgacagccaggcactcatctccagactgcagtgggatggctcctccgatctcagtccttccgactccggttccagtaagacatccgagaaccagggatggggactgggcaccaactcctctgaatctcgcaaaaccaagaagaagaagtcgcacctgagcctggtaggaaccgccagcggattgggttcaaacaagaagaagaagcctaaacctcccgcgccacccactccgtccatttatgatgatatcaactag

SEQ ID NO: 11328 - DNA, 1065 bp, Artificial Sequence
  Description of Artificial Sequence: Synthetic coding sequence
atgaaaatggaggagatgagtttatccggactcgataactccaaacttgaagcaatcgctcaagagatttacgccgatctggtagaggactcatgtctcgggttctgtttcgaggtgcaccgcgccgtgaagtgtggttattttttcctggatgacaccgatcccgattctatgaaagatttcgagattgttgaccagcctggcctggacatcttcggccaggtgtttaatcaatggaagagcaaagaatgcgtgtgtcccaactgctctcgtagcatcgccgcttcaaggtttgctcctcacctggaaaagtgtttagggatggggcgaaactcttcacgcatagcaaaccgacgcatcgcaaacagcaacaacatgaataagtcagagtcggaccaagaagacaacgacgacatcaatgacaatgactggagttacgggagcgaaaaaaaggctaagaaaaggaaatccgataaactgtggtatctgccgtttcaaaacccaaactctcctcgccgctcaaagagcctcaagcacaagaacggtgagctcagcaatagcgacccctttaagtacaataacagcacggggattagctacgaaactctcggccccgaagaactgcggtctttattgaccacccaatgtggcgttatctctgaacacacaaagaaaatgtgcacacgctcccttcgctgcccccagcataccgacgagcaacgacggacggtccgcatttactttctggggccaagcgctgtactgcctgaagttgagagcagtcttgataatgatagctttgatatgacagattctcaagcactcatatcacgtcttcagtgggatggttcatctgatctgagtccctctgacagtggatcttcaaagaccagcgaaaaccagggctggggccttggaaccaactcttctgaatcccgcaagaccaaaaagaaaaaaagccacctctccctcgtaggcacagcatctggccttggtagtaataagaaaaagaagcccaaaccccctgctcctcccacacccagcatatatgacgatatcaattag

SEQ ID NO: 11329 - DNA, 390 bp, Artificial Sequence
  Description of Artificial Sequence: Synthetic coding sequence
atgtgcactcggtccttaaggtgtccccagcataccgacgagcaacgaagaacagtacgcatatatttcctggggcccagcgctgtgctgccagaagtagaatcttccctagataacgattctttcgacatgactgattctcaggccctgataagccggttgcaatgggacgggagtagcgatttgtctcctagcgactcgggaagttccaagaccagtgagaaccaaggttggggactggggaccaatagtagtgagagcagaaaaaccaaaaaaaaaaagtcgcacctatccctggtgggcacagccagcgggctgggttccaacaaaaaaaaaaagcccaaaccaccagctccacccactccttcgatttacgatgatatcaattag

SEQ ID NO: 11330 - DNA, 5031 bp, Artificial Sequence
  Description of Artificial Sequence: Synthetic coding sequence
atgggcttactggggatcctgtgtttccttattttcttagggaaaacatggggtcaggaacagacctacgtgatatctgctccgaagatctttcgcgtgggcgctagcgaaaacatagtcattcaggtatacgggtatactgaggcctttgatgccacaatatcaatcaaatcctaccccgacaaaaagttctcttattcctccgggcacgtgcacctgagcagcgaaaataagttccagaatagtgcaatcttaacaatccagccaaagcaactgccagggggtcagaaccccgtgtcatacgtttatctggaagtggtatcgaaacatttctccaagtccaagcggatgcctatcacctacgacaacggttttctgtttatccacacggataagcccgtctacacaccagaccagtctgtgaaggttcgcgtttactcactgaacgatgatctgaagcctgctaaaagggagaccgtcctgacgtttatcgatcctgaggggagtgaggtggatatggttgaggagatagatcacattgggattatcagctttccagactttaagatacccagtaatccccggtatggaatgtggactatcaaggcaaagtacaaagaagacttcagcacaactggcaccgcctactttgaggtcaaggagtacgtgctccctcactttagtgtcagcatcgagccagaatataatttcatcgggtacaagaattttaagaatttcgagatcactatcaaggctcggtacttctataataaagtggttacggaggccgacgtgtacattaccttcggcatacgagaagatttgaaggatgaccagaaggaaatgatgcagacagctatgcagaatacgatgctgattaacggtatcgcacaggtgacatttgatagcgagacagcagttaaggaactgagttactacagtttggaagacctgaacaacaagtacttgtacatcgcggtgacagttattgagtctaccgggggatttagcgaggaagcagagatccctgggataaaatacgtgctgtcaccgtacaagcttaatctggtggctacacctctgttcctcaaacctggaattccttaccctataaaggtacaggtgaaagatagcctcgatcagctggtgggaggcgtgccagtgactcttaatgctcagaccatcgatgtcaatcaggaaacaagcgaccttgatccttcgaagtctgtcacccgtgtcgatgatggcgtggccagcttcgtgctgaatttgccttctggcgttaccgtattggaattcaacgtgaaaactgacgctcctgatctgcctgaagaaaatcaggccagagaaggatacagagctattgcatacagtagtctgtctcagtcctacctgtacatcgattggaccgataaccacaaggccctgctcgtaggagaacatctgaacataatcgtgacacccaagtcgccatacattgacaaaattacacactataactacctcatactcagtaaaggcaagataattcacttcggcacaagggaaaagttttctgatgcttcttatcaatccatcaacattccggtcacacagaatatggtgcctagttcccggctcctcgtttattacattgttaccggggaacagactgccgaactggtctctgattcagtctggctcaatatcgaagagaaatgcgggaaccagctccaggtacatctgtcaccagacgctgacgcatacagccccggccagaccgtgtccctgaacatggctacaggcatggactcctgggtggccctggccgcagtggatagtgctgtgtatggcgtgcaacgtggcgctaaaaaaccactagagagggtgtttcagttcttagaaaagtccgaccttgggtgtggagcaggaggcggcttaaataatgccaatgtgtttcatctggcggggttgactttcctgacgaacgctaatgcagatgactcccaggaaaatgatgagccttgtaaggaaatcctgaggcctagaaggacattacagaaaaagatagaggaaatcgccgccaagtacaagcattccgtcgtcaagaagtgttgctacgacggggcctgcgtcaacaatgacgagacctgcgagcagagggccgcccggatatcactgggaccacggtgcatcaaggcatttaccgaatgctgtgtcgtcgcttcccagcttagggctaatattagccataaggacatgcagctgggaaggttgcatatgaagacgcttctacccgtcagcaagcccgaaatcagaagctatttcccggagtcatggttatgggaggtacacctagtgcctcgccggaaacagttacagttcgccttgcctgactccctgactacctgggaaattcaaggcgtgggaatctcgaatacaggcatttgcgtagcggataccgtcaaggccaaagtctttaaggacgtgttcctcgagatgaatatcccttactcagtggtacgtggcgaacagatacaattgaagggcaccgtgtacaattacagaacctctggaatgcagttttgtgttaagatgtctgccgttgaggggatctgcactagcgaaagcccagttattgatcaccaaggaacgaaaagttctaagtgtgtgcgccagaaggtggaggggagttcctcacatttggtgacttttacagtgctgccactcgaaatcggcctgcacaacattaatttttccctggaaacttggtttggcaaagagattctggttaagacactgagagttgtgccagagggcgttaagagggaatcctactctggcgtgacccttgatcccagaggcatttacgggacgatcagtaggagaaaggagttcccctatcgaatcccactcgacctggtgccgaagactgagatcaaacgcattctctcagtcaagggattactggtgggggagatcctaagtgcagtgttatcccaggagggcattaacatcttgacccatctgcctaagggaagcgcagaggcagaactgatgtctgtggttcccgtcttttatgtatttcactacctagagactggcaatcattggaacatctttcactcagatcctctgatcgaaaagcagaaattgaaaaagaaacttaaagaaggcatgctgagcatcatgagttaccgcaacgccgactattcttactccgtatggaaaggaggctcggccagtacttggctaacagccttcgccctccgggtcctaggacaggttaacaaatacgtcgaacagaaccagaattctatttgtaattccctactctggctggtggaaaactaccagctggacaacggtagtttcaaggagaactcacagtatcagccaataaagctccaaggcactctacctgtggaggctcgggagaacagcctgtacctaacagcctttacagtgattggaattagaaaagcgttcgacatttgtccccttgttaaaattgatactgctctcataaaagccgacaacttcctgctggagaacacactgcccgcacagtcaacattcactttggctatcagtgcctacgccctctcacttggggacaagacccacccccaattccgaagcatcgtgtcagcccttaagcgcgaagccttggtaaagggtaatcctccaatttaccggttctggaaagataaccttcagcacaaagattcatcagtgcccaatacagggactgcacgtatggtggaaacaactgcctacgcactgctcacgagtttaaacctgaaagacatcaactacgtgaaccctgtgatcaaatggctcagcgaggaacagagatacggtggcggtttttactccacacaagacacaattaatgcaatcgagggactgaccgaatactctctcctcgtgaagcagttaagattgtcgatggatatagacgtttcttataagcacaagggggccctccacaactataagatgactgacaagaacttcttaggcaggcccgtggaggtactcctcaacgacgatctcatcgtgagtaccggcttcggctccgggctggctacggtccacgtcacaacagtcgtccataagacttccacaagtgaagaggtttgtagcttctacctgaagatagatacacaggatatcgaggctagccactaccgcgggtacggcaactccgactacaaaagaattgtggcgtgcgcttcgtacaaaccatcccgagaagaatcctctagcggaagcagccacgccgtcatggatatcagccttcccacaggtatctcagccaatgaggaggatctgaaagccctggtggagggagtagaccagctgttcaccgattaccagatcaaggacggtcatgtgatcctgcaactgaactccataccaagcagtgactttctgtgtgtgagattccgcattttcgagctgttcgaggtggggttcctgtctcctgccacattcactgtgtacgagtatcaccgtcctgataagcaatgtaccatgttttatagtacctctaacattaagatccagaaagtgtgcgagggagctgcctgtaagtgcgtcgaggcggattgtggacaaatgcaagaagagctggatcttaccataagcgctgagacccggaagcagacggcttgcaagcccgaaatcgcatatgcttataaagtgtcgattactagcatcacagtggagaatgtatttgtcaagtacaaagcaactctcctcgatatatacaagacaggagaggcggttgcagagaaggatagtgagatcacgttcattaaaaaagtgacttgcacaaatgcagaactggtcaaaggacgacaatatcttatcatgggcaaggaggctctgcagattaaatataatttttctttccgctacatctatcctcttgattcgctgacgtggatcgagtactggcctagagacactacttgcagtagctgtcaggctttcctggccaacctcgacgagttcgccgaagacattttcctgaacggttgctag

SEQ ID NO: 11331 - DNA, 4320 bp, Artificial Sequence
  Description of Artificial Sequence: Synthetic coding sequence
atggcctccagtgagaccgagatccgatgggcagaacctggattgggaaaagggccgcagcggcggcgttgggcctgggccgaggacaagagagacgttgatagatcatccagccagagctgggaagaggaacgtctgtttcccaacgctacaagcccagagcttctggaggattttcgactggcgcagcaacatctgccccccttagagtgggatccgcacccacagccggacggccatcaggactctgagtctggtgagactagcggtgaggaggccgaagctgaagacgtggattcccccgccagctctcacgagcctctagcgtggctaccacagcaaggccggcagttggatatgaccgaagaggaacccgatggtactctcgggagcctagaggtagaggaagccggcgagtcatcatccaggttgggttacgaagcaggtctgagcctggagggccacggcaacactagcccaatggccttggggcacggacaagcaagaggttgggtcgcaagcggcgaacaggcatctggcgacaagcttagcgagcatagcgaagttaacccttcagttgaacttagcccagccagatcctggtcctcaggcaccgtgtcactggatcacccttctgactccttagatagtacctgggagggagaaacggacggaccccagccaacagctcttgctgaaaccctgccagaagggcccagtcaccatctcttaagccctgatggaaggacagggggctccgtggcgcgggcaacccccatggaatttcaagattcttccgctccgccagctcaatccccccagcacgccaccgacaggtggaggagagagacgactagattcttctgcccgcagcctaaagagcatatctggaagcagactaagacctcccccaaaccgctaccgagtaggttcatcggatccatctcgccactgaacccccagccccggccaactcgccaagggaggcctcttccccggcagggagctacactcgccggaagatcttcgtcgaacgctcctaagtatggtagaggacagctgaattaccccttaccagactttagtaaagtggggccgcgggttcgcttccccaaggacgagtcttaccgccctcctaagtcacgatcacataatagaaagccccaagcgccggcccgccccttaattttcaagtccccggccgaaatcgtccaggaagttctactcagttcgggtgaggccgccctggccaaagatactccaccggcccaccccatcaccagagtgccacaggaattccagacccccgaacaggcaaccgagctcgtgcatcaactccaggaggattatcataggctccttacaaaatatgccgaagctgagaacactatcgaccagttgcggcttggcgccaaggtaaatttgttttctgaccccccacagcctaatcactctatccacaccggaatggtgccacagggcactaaggtgttaagcttcacaataccacaaccgcgctctgcagagtggtggccgggtcccgcagaggatccccaggcatccgccgctagcggatggccctccgcgcggggtgacctttctccgtctagtctgacctcgatgccaaccctcggctggctgcccgagaatagggatatttccgaggaccagagttccgcagagcagacacaagccctcgcttcccaggcatcacagttcctcgccaaagtagagtctttcgaacggttaatccaggccggaagattgatgccccaggaccaggtaaagggcttccaaagactgaaggcagcccatgcagccctcgaagaagaatacctaaaagcctgcagggagcaacatcccgcccaacctctggccgggtctaaggggacccccggccgttttgacccgcgccgggaactggaggccgaaatataccgcctcggcagttgcctggaggaattgaaagagcacattgaccagacccaacaggaacctgagcctcccgggtcggatagtgcgctggatagcacgccagccctgccctgtctgcaccagcctactcacctccctgctccttccggccaggctcctatgcccgctataaagacttcatgcccagaacctgcaaccacaaccgctgctgcaagcaccggaccctgccccctccacgtgaacgttgaggtctccagtggtaactccgaggtggaggaccggccccaagacccactcgcccggctcagacacaaagagctgcagatggagcaggtgtatcacggtttgatggaaaggtacctgagcgtcaaaagcctgccagaagccatgaggatggaggaagaagaggagggcgaggaagaggaggaggaggaaggcgggggcgattccctggaagttgacggggtcgcggccacaccgggtaaagcagaagcgacgcgcgtgctgcctcgccagtgccctgttcaggccgaaaaatcccacggagcccctttggaggaagccaccgaaaagatggtgagtatgaaaccaccaggtttccaggcaagcctagcaagagatggtcacatgagcggcttgggcaaggcagaggcggcaccccctggcccaggagtacctccccatccacctggcaccaagagcgccgcatctcaccagtcatccatgacaagtttagagggatctggaatctccgaacggcttccccagaagcccttacaccggggtggtggcccacatctggaggagacatggatggcgagcccagaaaccgactctgggtttgtgggctcagaaacttctcgagtctcgcccctaacccaaaccccggagcatagactctcacacatcagtacggccggaacattggctcaacccttcgccgcttctgtacctagggacggcgcgtcttatccgaaggccagaggctccctgatccctcgacgggcaacagagccctcaaccccccgatcacaagcacagaggtacctgtcttctccctctgggcccctcagacagcgagcccccaattttagcctggagcgcacactggccgcagaaatggccgtgccaggatctgagtttgaaggccataaacggatttcagaacagccgcttccaaacaaaactatttctcctccacctgcccccgccccagccgctgcccctctgccatgtggccccacggaaaccatcccttcctttttgttaactcgggccggaagagatcaagcaatttgcgagctgcaggaagaagtaagtcggcttcggttgcggctagaggacagcctgcaccaacctttacagggttctcccactcgtcccgcttcggcctttgatcgccccgcgagaacaagaggacgcccagccgattcaccagccacatggggatcccattacggtagtaaatccactgaaaggctccctggggagcctcgcggagaggagcagatagtcccccctggcagacagagggctaggtccagcagtgtaccccgcgaagtgttgaggctgagtctcagtagcgagagcgagctcccatcacttccactgttctccgagaagtctaaaacgaccaaagatagccctcaggctgcaagagatggcaagaggggcgtgggaagcgccggctggcccgaccgggtgacattcagaggtcaatataccgggcatgagtatcacgtgctatccccaaaggctgttcccaagggtaacggcacagtgtcttgcccacattgcaggccgataaggacccaggatgcaggaggggcagtgactggagatccacttggcccaccacctgccgacactctgcagtgtccgctctgtggtcaggtgggtagtccacccgaggcagacggtcccggcagcgcaacctcaggagccgagaaggctactaccagaagaaaggctagctcaaccccgtctcccaagcagcgcagtaagcaggccggcagctcaccgcggcctcctccggggttgtggtatctagcaaccgcccctcccgcaccagcaccaccggccttcgcttatatatcatccgtgcctattatgccgtacccacctgctgccgtgtactatgcacccgcagggcccacgagcgcccaaccagccgccaagtggcctccaactgcaagtccccctcccgccaggcgccatcggcattctattcagttagacttgggggacctcgaggagctgaacaaggcactgagccgcgccgttcaagccgctgaaagcgtgcgatccacaactcggcaaatgcggtcttcactgtcagccgaccttagacaagctcactctttaagaggatcctgtctgttctag

SEQ ID NO: 11332 - DNA, 2496 bp, Artificial Sequence
  Description of Artificial Sequence: Synthetic coding sequence
atggcaagcagcgaaaccgagattcgctgggccgagcccggactcggtaaggggccccagagacggagatgggcgtgggctgaggacaaacgagatgtcgatagatcgtcatctcaatcgtgggaggaggagaggttattcccaaacgcgaccagccctgaactgctggaggactttagactcgcccaacaacatcttccccccctggagtgggacccacatcctcagcccgacgggcatcaagatagtgagagcggggagacctcgggtgaagaagctgaagctgaggatgtcgacagcccggcttcctctcacgagccgctagcttggctgccacagcagggccggcagctggacatgacagaagaggagccagatggcactctgggaagtcttgaagtggaggaagcaggcgaatcctcctcacggctggggtatgaagccgggctttccctagaagggcacggcaacactagtcctatggccttaggacatggacaggcccgcgggtgggtcgcatctggagaacaggcaagcggagataagctgtccgagcattctgaggtaaacccaagcgtggagctctcccctgcgcgtagctggagttccggtacagtgtctcttgaccatccctccgattccctggattctacttgggaaggcgagacggacggaccacagcctaccgccctcgcagagaccctccctgaggggccatcccaccacttgctcagcccagacggccgcactggggggagcgtggcccgtgccacccccatggaattccaagattccagcgctccacccgcccagtccccacagcacgccacggatagatggaggagggagactacgcgcttcttctgcccccaacctaaagagcacatctggaaacagactaagacctcaccaaagcctctgccgagtaggtttatagggagcatctcaccactgaatccacaacctagacccaccagacagggccggcccctccctcgccagggcgcgaccctcgctggccgttcctcatccaatgccccaaagtacggtcgaggccagttaaactacccgctacccgatttctccaaggtgggtccccgcgtgaggttcccgaaagacgagagctatagaccacccaaatcccgtagccataatcgaaagccccaagccccagctcgaccactgatcttcaaatccccagctgaaatcgttcaggaggtgcttctgtctagcggcgaggcagcgctcgcgaaagatacgccacccgctcaccccatcacccgcgtcccccaggaatttcagacaccagaacaggccactgagctcgttcaccagctgcaagaggattatcatagattgctcacgaagtatgccgaagccgagaatactattgaccaattaagactgggagcgaaagtgaaccttttctctgatcccccgcagcctaatcactctattcatacagggatggttccgcagggcacaaaagtgctgagttttactatcccccagcccagaagtgccgagtggtggcctggccccgcagaggatcctcaggcaagtgcggcttcaggctggcctagcgccaggggagacctctccccctcttccttgacaagcatgccaaccctcgggtggctacctgaaaatcgggatatctctgaggatcagtcttctgccgaacagacacaagcgctcgctagccaggcttcacagttccttgccaaggtggaaagtttcgagcggttgattcaagccggccgtctgatgccacaggatcaggtgaaggggtttcagagactaaaggcagcccacgccgctcttgaggaagaatatttgaaagcatgtcgggagcagcacccagcgcagcctctcgcgggctccaagggcactcccgggcgctttgatccacgtagggagctcgaagcagaaatctaccgcctcggatcttgtcttgaggagctgaaggagcacatcgaccaaacccagcaggagcccgaaccccctgggtctgacagcgctttggattcgacccctgccctcccctgcctgcatcagcccactcacctgccagctccatctggccaggctcccatgcctgcaattaaaacgagctgtcccgaacctgctaccaccaccgcagcagctagtactgggccatgccccctccacgtgaatgtagaggtgtctagtggaaacagtgaggtggaggacagacctcaagatcctctggctcgactgcggcataaggagctccagatggaacaggtctatcatgggttgatggagagatacctcagcgtgaagagccttcctgaggccatgagaatggaggaggaagaggagggtgaggaagaggaggaggaggagggcgggggggactctctagaggtggatggagtggctgcaacccccggtaaagctgaagcaactcgagtgctgccccggcagtgccccgtgcaggcggagaaatcccacggagcccctctggaatag

SEQ ID NO: 11333 - DNA, 1218 bp, Artificial Sequence
  Description of Artificial Sequence: Synthetic coding sequence
ctaaacctgtgtctgtcaatctttcttaccccagcctgttaccatcattgtcggcgccagcactggcctctcccgatcgctaggaagtgtggcgcggtaccggggtcggagttcgaggggcacaaaaggatctctgaacaaccactaccgaataagacgatttctcctccccctgcccctgcacccgcagctgctcctttgccctgcggtccaacggaaactattcctagcttcttgttgacaagggcagggcgtgaccaggccatttgcgagctccaagaagaggttagcagactgcgcctgcgtctggaggattctctgcaccagcctctgcagggatccccaacccggcctgcctctgctttcgatcggccagcgagaacccgaggaagaccagctgatagtccagctacatggggatcccattacggttcaaagtctacggagcggctgcctggggaaccgcgaggggaggagcagatcgtcccgcctggcaggcagcgggcccgaagctctagcgtcccaagggaggttctccgactcagcctgtccagcgagagcgagctcccatcactccctctcttcagcgagaagagcaagaccaccaaggattccccgcaggctgccagggatggcaaacgaggagtgggctcagccggctggccagatcgggtcacctttcgaggacagtataccgggcatgagtatcatgttctgctaagacggtcacagaaagccatggcacagagccccgtccctacagccggccccctgggaccccgcatgcgcgtcgtcttatcgcagggcacgcactgggaccgccttcctctgatccctttcagcgtcccgtgcgtggtgaagctcggtttgccgcaacgccaaatggtgcaggctcaacctcctctgggccaacgcaggccacccagaggtgaaaaacacctccagctgcccgccccctccaggggtgccagtaggcgcggaagacgacacgcccaccccccggactgcggaatttggcagcagcgcccccagcatcaaccccttcagccacttcctacttccccgcggttcccatcttgcctcatccacctgcccttgtgtactatgaggctgcaagatctgccccaacccaatcagcttcctagcggtcgtccacagccactgcctcaccagcctggggatacagggaccccctcaagtagcacatgggctacctag

SEQ ID NO: 11334 - DNA, 4077 bp, Artificial Sequence
  Description of Artificial Sequence: Synthetic coding sequence
atgctgaggtcagaatggcctgtgttccccgaagctgaagccgaagatgtcgattcccccgcaagcagccacgagcccctagcctggcttccccaacagggcaggcagctggacatgaccgaagaagagcctgacggcacactgggatctctggaagtcgaagaggctggtgaaagctctagccgcctaggctacgaggctggactgtctctcgaggggcatgggaatacgagtccgatggcccttggacacggccaagccagaggatgggtggccagtggcgagcaggccagcggagacaaactttctgagcattcagaagtgaatccatctgtcgagctctcccccgctcgcagttggtcgagcggaactgtcagcctggaccaccctagcgattcgcttgacagcacctgggaaggggagactgacggtcctcaaccgaccgcactggctgagactcttcccgagggtccttcccatcatctgctgagccctgacggaagaacggggggatccgtggcccgcgccaccccaatggagttccaggacagctccgccccaccagcacagtcgcctcaacatgcaacggaccggtggcgcagagagaccactagatttttctgcccccagcctaaggaacacatctggaaacagactaagactagccctaaacccctgccgagccgatttataggaagcatttctcctctgaacccacagcctcgtcctaccagacaggggagaccccttccccggcagggagctacgctggctggcaggtcaagctccaacgctccgaagtatggccgggggcagctaaattaccctctccccgacttttctaaagtgggaccgcgggttcgctttccaaaggatgagtcgtaccgcccacccaaatcacgtagccataacaggaagccacaggcacctgcacgccctttgatattcaaaagcccggccgagatagtacaagaggtgttactgagtagtggggaggccgctctagccaaagacactccgccagcacaccccatcactagggtcccccaagagtttcagactccagaacaggccaccgaactggtacaccagctgcaggaggactatcaccgattgctcaccaagtacgccgaggctgagaatacgatcgatcagcttaggctcggcgccaaggtgaatctgttttcagatcctccacagccgaaccacagtatccatacggggatggtgcctcaggggacgaaagtgctgtcattcacaataccacagccccgttctgcggaatggtggccgggtcctgctgaggatcctcaggcgagtgctgcatccgggtggccatcagctaggggcgacctctccccctcctccctgacatccatgccgacactcggctggctgccagagaatcgcgatatcagcgaggaccagtcttccgccgagcagacacaggcactggccagccaagcaagtcaatttttagccaaagtagaaagcttcgagagattaatacaggctggccggctgatgcctcaggatcaggtgaagggctttcagaggcttaaggccgcccatgcggccctggaagaagagtacctgaaggcgtgtcgggaacaacatcctgcccaaccccttgcggggagcaaaggaacacccggccggtttgacccgaggcgggaacttgaggccgagatttaccgcttagggagctgcctggaagagttaaaggagcatatcgaccagacccaacaggagccagaaccacctggcagtgattctgcactagactcaacacccgccctgccctgtctgcatcagccgacacacctccctgccccgtcgggacaggcccctatgccggccatcaagaccagctgtccagaaccagcaaccacaacagccgccgcatcaaccgggccatgccctctgcacgtgaacgtggaggttagcagcgggaattcagaggtggaggacagaccacaggatcctttggctcgattgcgtcataaggagctccaaatggagcaggtgtaccacggattgatggagcggtacctatcagtgaagagtcttcccgaggcaatgcgcatggaggaagaagaagagggagaagaggaagaggaagaagagggaggaggagatagcctggaagtggacggagtggctgccactcctggtaaggcagaggccacaagagtcctgcctagacagtgccctgttcaagcagagaagtcacacggtgcacctttagaagaggccaccgaaaaaatggtgtctatgaaacctcccggatttcaagcttcactggctagggacggtcatatgtccggcctaggcaaagctgaagccgccccgcccggacctggagtcccacctcacccccccggtactaaatcagccgcatctcaccagtcctcaatgacctcactggaaggtagcgggataagcgagcgactgcctcagaagcctctgcacagagggggcggacctcatctggaggagacctggatggcctcccccgagacagatagcggattcgtgggttctgaaacgtctcgcgtgtcacccctgacgcagacacctgagcatcgtctgtcacacatctccactgccggcaccctcgctcagccttttgcagcctccgtgccccgcgacggtgcttcctaccctaaggccaggggctccctgatcccgcgtcgtgctaccgagccatccacaccgaggagccaggctcagaggtatctgtcgagtccctccggacctctgagacagcgcgccccaaatttttcactggagcgaaccttggccgctgagatggccgtgcccgggagcgaatttgagggtcataagcgaattagcgagcagccattacctaataaaacaatatcacccccacccgcccccgcacccgcggctgcccccttgccgtgtggacccacagaaaccatcccgtcatttttgctcacccgagctggtcgggatcaggccatctgtgagctccaggaggaggtcagcaggctgcgacttagactggaggatagtcttcatcagccactccagggcagcccaacacgacctgcttctgctttcgacaggcccgctagaactcgtggccggcctgccgattctccagccacttggggatctcactatgggtccaaatccacggaacggcttcctggagagccccgaggtgaggaacagatcgtgccacctggaaggcagcgcgcccggtcctcttctgtgcctcgggaagtgctgcgcctctctctatcctccgagtcagaactgccctccctgccgctgttcagcgagaagagcaaaacaacgaaagattcaccccaggccgccagggacggaaaaagaggtgtgggaagcgccggttggccggaccgggttacgttccggggacagtacacaggtcatgagtatcacgtgctgagcccaaaagccgtgccgaaaggcaacggaactgtgtcttgcccccactgtcggccaattcgtacacaggacgcaggtggagccgtcaccggggacccactcggccctccgcctgcagatacattgcagtgccctctctgcggacaagttggctctcctccagaggctgacgggccaggtagtgcgacatccggggctgaaaaagcaaccaccaggaggaaagcctcttccactcctagccccaagcagagaagcaaacaggctggatcctccccccggcctcccccgggactgtggtatctggctaccgctccccctgcccccgcccctcctgccttcgcctatatctctagcgtccccattatgccctatcccccagccgcggtctattacgcaccagctggaccgaccagcgcacaacccgctgccaagtggcctccaactgcctctccaccccctgcgcgtaggcacaggcacagcattcaactggatcttggggatcttgaggagctgaataaagccctgagccgggccgttcaagcagctgaaagcgtgagatcaacgaccagacagatgcgctcttccctgtcagctgatctccgccaggctcacagcctgcgcgggtcttgtcttttctag

SEQ ID NO: 11335 - DNA, 1155 bp, Artificial Sequence
  Description of Artificial Sequence: Synthetic coding sequence
atgtccgcaggaggcggtacacgtgggtattcgcctcggagcccaggtgcaacctcacaggcgatatgtgagcttcaggaagaagtcagccgccttcgccttcgactcgaggattcactgcatcaacccttgcagggttctcctactcgaccagcctccgcattcgacaggccagccagaaccaggggccgtccagccgattcccccgccacctggggatctcactatggatcaaaatctactgagcgattaccgggcgaaccgcgcggtgaagagcagatcgtacctcccggaagacagagagcacgaagttcctccgtgcctcgggaagtcctccgactgtctcttagtagcgagtctgagttgcccagcttgcccctgttttcagaaaagagtaagacaaccaaggacagcccacaagcggcacgagacggcaagcggggcgtaggaagtgcgggttggcctgacagagtcacttttcgtgggcagtataccgggcatgagtatcacgtgctcagtcctaaggccgtcccaaagggcaacggaacggttagctgcccccactgccgtcctattagaactcaggatgctgggggcgcggtgactggcgaccccttgggaccacccccagctgatactcttcagtgccccctgtgcggccaggtcggaagcccacctgaggctgacggcccaggatctgcaacatccggcgcggaaaaggccacgactaggcgtaaagctagcagcaccccatctcccaagcagcgaagtaaacaggctgggtcttcgccgaggcctcctcctggcctgtggtacctggccaccgccccacccgctccagccccacctgcctttgcttacatttctagtgtccccatcatgccgtatccccccgcggctgtgtactatgcccctgccgggcccacatccgcgcagcctgcagccaagtggccgcctacggcttctccaccacctgctcgcaggcacaggcattcaatacagctggatttgggtgatctggaagaattgaacaaagccctcagtcgagccgtgcaggcagcagagtccgtgagatccacgacccggcagatgcgctcaagcctgagcgccgacctgcgccaagcacactctctcagggggtcctgcctcttttag

SEQ ID NO: 11336 - DNA, 4320 bp, Artificial Sequence
  Description of Artificial Sequence: Synthetic coding sequence
atggcgagcagcgagactgagatccggtgggccgagccaggcctcgggaaggggccccaacgacggcgttgggcttgggcagaagacaaaagggatgtggaccgcagctcgtcccaatcctgggaggaagagcgattgttcccaaacgcaacatctccggagcttttagaggactttcgccttgcacaacagcacctccccccgctcgaatgggacccccacccgcagcccgacggccatcaggattctgagtccggcgaaaccagcggtgaagaagctgaggctgaggacgtagacagtcctgctagtagtcacgagccactggcatggctgccccagcaggggaggcagctggatatgaccgaagaagagcctgacggaactctgggttccctggaggtagaggaagccggcgagagctcatcccggcttggatatgaggccggactgtccttggaagggcacgggaatacctcaccgatggccttggggcatggccaggcaaggggctgggttgcaagtggggaacaggcctccggcgacaaactgtcggaacatagtgaggtgaatccaagcgtagaacttagtcccgctaggtcctggagtagcggcaccgtatccctggatcatccttcagacagcttagattccacttgggaaggcgagactgacggtccacagccaacagcactggcagagaccctccctgaaggtccctcccatcacttgctttcccctgatggccgcactggaggatccgtggcacgggcaactcctatggaattccaggactcctctgctcctcccgctcagtctccccagcacgcaacagatagatggaggcgtgaaaccactcgcttcttctgtccacaacccaaagagcatatttggaaacagacaaaaacttcccccaagcccctgccaagcaggtttattggtagtattagcccactgaacccgcagccaagaccgaccagacagggcagacccctaccgcggcaaggggccactctcgccgggagaagctccagcaatgcccctaagtacggcaggggacaactgaattatcccctgcctgacttttctaaggtgggcccacgtgttcgcttccctaaggacgagtcctatcgaccacccaaatctcgcagccataacagaaagccacaggcaccggcacgtcctctgattttcaaatctcctgccgagatcgtacaggaagtgctgttatctagtggtgaggcagcccttgctaaggacacccctcctgcacatcccataactcgagtacctcaagaatttcagacacctgagcaggctacggaacttgttcaccagttacaggaggactaccatcggctacttaccaagtatgccgaagccgagaataccatcgatcagctccgtttgggtgctaaagtgaacctattcagcgacccgccccaaccaaaccacagcatccacaccgggatggtgccccaggggactaaggtgctctccttcacaattccccaaccccgatctgccgaatggtggccgggaccagctgaggaccctcaggcaagcgcagcttcgggctggccgtctgctcgtggcgacctgtcccccagctctttgacttctatgcccaccctgggatggctgccagagaacagggacatatccgaagatcagagcagtgctgaacagacccaggcccttgcatcacaggcgagccaatttcttgccaaggtagaatcctttgaacgcctaatacaggccggccgcttaatgccccaggaccaagtgaaaggtttccagcgtctgaaagccgcccatgcagctctcgaagaagagtatctgaaagcttgcagggagcagcatccagctcaaccacttgcaggtagcaagggcacaccaggtcgattcgatccccgtcgggaactggaagccgagatctatcgactgggatcttgtctcgaagaattgaaagagcatattgaccaaacccagcaggagccagagccacccggatctgacagcgctttggacagcacccccgcactgccatgcctgcatcagcctacacacctgcctgccccatccggccaagccccaatgcctgccatcaagactagctgtcccgaaccagccaccaccaccgccgctgcctctacaggcccctgcccactgcacgtcaatgtcgaagtgagtagcggaaatagcgaggtagaggacagacctcaggatcctctggctagactgcgacataaagaactgcagatggaacaagtgtaccacggcctgatggagcgttacctcagcgttaaatctttacccgaggcaatgagaatggaggaggaggaggagggcgaggaagaggaggaggaggaaggaggcggagacagcctcgaagtggacggcgtggcagctacaccgggcaaagcagaagctacgcgggttctgccccgccaatgcccagtgcaagcggaaaaaagccatggggcaccccttgaggaagccactgaaaagatggtctctatgaaaccgcctggatttcaggcaagcctggcccgagacgggcacatgagtgggcttggcaaggccgaggccgcaccacctggtccgggtgtacctcctcaccctcccggtaccaaaagcgccgcttcacaccagtcctccatgacttctctggaaggctccggtataagcgagcgtctgccccagaaaccccttcaccgtggcgggggcccacacctggaggagacctggatggctagccctgaaaccgacagcggatttgtcggaagcgagacgtcccgcgttagtcctctcacacagacaccagagcatcgattatcccatatttccacggctggaacccttgcccaaccctttgctgctagcgttccacgggatggtgccagctaccccaaagctcggggcagcctgatccccagacgggcaaccgagccctctacacctcgatcccaggctcagagatatctgagctccccgtctggtcctttgcgccagcgcgctcctaactttagcctagagcgtaccctggccgccgagatggccgtcccagggagcgagttcgagggtcacaagcgaattagcgagcagcccttgccaaataagacaataagtcctcccccagccccagccccagccgccgcgcccctgccttgcgggcctaccgagactattccctccttcctcctcactagagccggccgcgatcaggctatctgcgagctgcaggaggaggtgtcccggttgcggctgaggctggaagatagccttcatcagcctctgcagggatcccccacacgaccagccagcgctttcgaccgaccggcacgaaccaggggaagaccagcagacagcccagctacatggggttcacattatggcagtaagagcacggagcggttacctggcgagccgcgaggggaagagcagattgtgcctcccggacggcagagagctcggtcatccagcgtgcccagagaagtgttacgtctcagtctctcatctgagagcgaactgccttccctgcctctcttctctgagaagagcaagacaactaaggacagcccacaggctgctagagacggcaagaggggtgttggctctgcagggtggcccgaccgcgtgaccttcagagggcagtatactggccatgagtaccatgttttatcgcctaaggccgtccctaagggcaacggaacagttagttgcccacactgtcgtcccatccggactcaggacgccggaggggccgtgacaggcgacccacttggtccccctcccgcagacaccctccaatgtccactctgcggtcaggtcgggagccccccagaggccgacgggccgggctctgccacgtcaggcgcagagaaggccacaacccgccgaaaggcatccagcacaccatcccccaagcaacgaagtaagcaagctggttcctcaccccggcctccgcctggcctgtggtacctagcaactgctcctcccgccccagcccctcccgcatttgcctacatctctagcgtgcctattatgccgtatccacctgcagctgtctactatgcccccgccgggccaacttctgcccagccagccgcaaagtggcccccgactgccagtccccctcctgcacgcagacatcgccactccatacaattagacctgggcgatctggaagaattgaacaaggcattatcacgcgccgttcaagcggcggagtcagtgcgcagcactacgcgccagatgaggagctccctgagtgctgacctgcggcaggcccattctctcagaggctcttgcctattctag

SEQ ID NO: 11337 - DNA, 1719 bp, Artificial Sequence
  Description of Artificial Sequence: Synthetic coding sequence
atggccagcagcgagacagagattcgctgggccgagccagggctcggtaaggggccacagaggagaagatgggcgtgggccgaagacaagagagatgtggacaggtcttcaagccagtcttgggaggaggagcgactgttccctaacgccacctcgccggagctgcttgaggatttccgcctcgcgcaacagcacttgccccccctggaatgggaccctcatccacagccggatgggcaccaggactcagaaagtggagaaacatcaggggaggaagcggaagccgaggatgtggattcccccgctagcagccacgagccattggcctggttaccacagcagggtcgccagttggatatgaccgaagaagagccagatgggacccttggcagtctggaggtggaagaggcgggggaatcaagttccagactgggatatgaagcagggctgagcttggaaggacacggtaacacgtcaccaatggcgcttgggcatggtcaagctcgtggttgggtggcaagcggtgagcaagctagtggagacaaactcagtgagcatagcgaggtgaacccctctgtggaactgagtcccgccaggtcctggagctcaggaacagtgtcactggaccacccttccgactccctggactccacctgggagggagaaaccgacggaccccagcctaccgcccttgctgagaccctgcctgagggccctagtcaccacctcctgagtcccgacggccggacgggtggctcagtcgctagagccacccccatggaattccaggattcaagcgctccgccagcacagtcccctcagcacgccactgataggtggcgccgggagaccacccgctttttctgtccgcagccaaaggaacacatttggaaacagacaaaaacctctcccaagccactgccgtcaaggttcatagggtccatcagtccacttaacccgcaaccaaggcccacccgacagggtcgcccccttccaagacaaggcgccactctagccgggcgcagctcaagcaatgcaccaaagtacgggagggggcagttgaactatcccctgccagacttcagcaaggtcgggcccagggtaaggtttcctaaggacgagagttaccgcccccccaagtctagatcccacaatcgcaagccacaggcccccgctaggccactcatattcaaatcacccgctgagatcgtccaggaagtgctgctgtcctctggtgaagcagcccttgctaaagacaccccgcccgctcaccctatcacacgggtgccacaggaatttcagacgccagaacaggccaccgaactcgttcatcagctccaagtgagtggaacccatgggtgcggatgcgtgacgaaagcccctgtgggcctggggtggagattaatcggcgttggccggcccggggtcgaggccggctggggcggtgaagcgtgggaccgggcttggctcggttgggaagccctgggcaggaggctggtaggatggggggggttgggatggagactggcaagagtgggcagccccggaatggaggccagtggcgtcggccgacccggtgtgggctctcctggcgttgagccaggaggagttggtagacccggcgtggaggccggatgggggcgtaaaccttgggataggggatggtggggaggtgaggcatggggtgggggatggttggggcaggaggcactgggctag

SEQ ID NO: 11338 - DNA, 2016 bp, Artificial Sequence
  Description of Artificial Sequence: Synthetic coding sequence
cccggatttggtaccaagaatagtcaggctggtcctctaaagctggggcggcaggatggaggaggagcccgggagagggcagcgcagggcgatgtggacaggtcttcctcccagtcatgggaggaagagcgactttttcctaacgccacgagccctgaactgctggaagactttcgcggacctgcagctcccgccgcccccggtgtagggccaaccccggccgcacgctgggcctcagggtttagagtgaggcgtgactttggacgtcgcaccggcggatctgtggctcgggccacacccatggaattccaagattcgtctgccccccccgcccaaagccctcagcacgctactgaccgatggcgcagggagaccacgcgctttttttgtccacaacccaaagagcacatctggaaacagaccaagacttcccccaagcctcttccttctcgttttatcggctcaatcagtccactgaacccccagccaaggccaactcgccagggccggcccctcccgcggcagggagccacccttgctggaagatcgagtagcaacgccccaaaatacgggcggggccaactgaattacccactccccgatttctcaaaggtcggacccagggtgaggttccccaaggatgaatcttacagacctcccaaatctagatcacacaaccgcaagccgcaggcccccgccagaccgctgatcttcaagagccccgccgagattgtgcaagaggtgctgttgagttccggcgaagccgcccttgccaaggacactcctccagcccatccaatcaccagagtgcctcaggagttccaaactccggaacaagcgaccgagttggttcatcagctgcaggaggactaccaccggctcctgacaaagtacgctgaagccgagaacaccatagatcagctgagactgggagctaaggtgaatcttttctccgacccgccccagccaaatcattccattcataccggaatggtgcctcagggtacaaaagtgctgagcttcactatcccccaaccacgaagtgcggaatggtggcctgggccagccgaggaccctcaggctagcgcagcctctggttggccaagcgcccgaggcgacctgagcccctccagcttaaccagtatgccgacactagggtggctgccggagaatagggacatttcagaggaccaaagttctgctgagcaaacccaggccttagcgagccaagctagtcaattcttggcaaaggtcgagagtttcgagagattaattcaggccggaaggcttatgcctcaggaccaggtcaagggcttccagcgtctaaaggctgctcatgcagcccttgaggaggagtacctgaaggcttgccgcgaacagcacccggcccagcccctggcagggagtaagggcactcccgggcgatttgacccaaggagagaacttgaggccgagatttatcggcttggatcctgcctggaagaactgaaggaacatatcgatcagacccagcaagagcccgaaccccctggcagcgactccgcccttgattccacgcccgccctgccgtgtctccaccagcccacccacctccctgccccgagtggacaagctcccatgcctgcgattaaaacgtcttgtccggaacccgccacaactactgccgccgcctcaacgggcccatgtcccttacacgtgaacgtcgaggtcagctcaggcaattcagaagtggaggatcggccacaggatcctctggcccgtcttcgccataaggagctgcagatggagcaagtgtaccacgggttgatggagaggtatctcagtgttaaatccttaccagaggccatgcgaatggaggaagaggaggagggcgaggaagaggaagaggaggagggaggtggggacagtctggaggttgacggggtggccgctacaccaggcaaagcagaagcgacaagagtactgcctaggcaatgtcccgtgcaggcagaaaagagccatggagcccctttgtag

SEQ ID NO: 11339 - DNA, 2472 bp, Artificial Sequence
  Description of Artificial Sequence: Synthetic coding sequence
atggcggctagcgaggctgctgccgccgccggatcagccgcgctggccgccggggccagggcagtgccagcagctactacaggagccgcagcagcagcctcagggccatgggtaccacctggccctagactccgggggtctagacctagacctgcaggtgccacacagcaacccgccgtccccgcacctcctgctggagaattaatccagcccagcgtctctgagctgtctagagctgtccggaccaacatcctgtgcaccgtaaggggatgtggcaagatcctgcctaacagccccgccctcaacatgcatttagtgaaaagccaccgcttacaggatggtatcgtcaatcccactattcgcaaggaccttaaaaccggccccaaattttactgctgccccattgagggatgtcccagaggacctgagcgacccttttcacagttttcactggtcaagcagcacttcatgaaaatgcatgccgagaagaaacataagtgcagtaaatgttctaacagttacggcaccgagtgggacttgaagcgccacgccgaagattgcgggaagaccttccgctgtacctgcggatgcccgtatgcatcacgcaccgcattgcagtcccatatctataggactggacacgaaattcccgccgaacacagggatcccccttccaagaagcgcaaaatggagaactgtgcccagaaccagaaactaagcaacaagacaatcgaatcactcaataatcagcctattccccgtcccgacactcaggaattagaagcgtcggagattaaactggagcccagcttcgaggattcgtgcggctctaacacggacaaacagacattgactaccccccccagatatcctcagaaactcctactgccaaagcccaaagttgccctagtgaaacttcccgtcatgcaattcagcgttatgcctgtgtttgtgccaaccgctgactcctccgcacagcctgtggtactaggtgtggatcagggcagtgccaccggcgccgtgcaccttatgcctttgagcgtcggtaccttaattttgggcttggactccgaagcctgcagcctaaaagagtcccttccactatttaaaatcgcgaatccaattgcaggcgagcccataagcactggagtgcaggttaactttggcaagtccccctctaatccactgcaggaattgggcaatacctgccaaaaaaacagcatttcctctataaacgtgcagacggacctgtcctacgcttcccagaacttcattccttcggctcagtgggcaactgcggattcaagtgtctcatcctgctcacagaccgacctgtcttttgactcccaggtgtccctccccatcagcgtgcacacccagacgtttctcccaagttcaaaggtaacatcaagcatcgctgcccagaccgacgcctttatggatacctgtttccaaagcgggggcgtttctcgggagacacaaacttctgggattgaatctcctacggacgatcatgtccaaatggatcaggccgggatgtgtggcgatatctttgagtcagtccacagcagttacaacgtggccacagggaacattatcagcaatagcttagtggccgaaactgtaacccacagcctgctaccacagaatgagccaaaaacgctgaaccaggacatcgaaaaaagcgcccccatcataaacttcagtgcgcagaatagcatgctcccatcccagaatatgaccgacaaccagacccaaacaatcgatctgttgtctgacctggaaaacatcctgtcttctaacctgcccgctcagaccttggatcacagatccttattgagcgacacaaatcctggcccagatacacagctgcccagtggcccggcacagaacccgggcatcgactttgatatcgaggagttctttagcgcttctaacatccagacccaaacagaggagagcgaactttctaccatgacaactgaaccagtccttgaaagccttgacatcgaaacccaaaccgatttcctgctggctgatacatccgctcaatcttacggttgccgcggaaactctaattttctggggctggagatgtttgatacacagacccagaccgatcttaattttttcctcgattccagcccccacctgcccctgggcagtatcctcaagcacagtagtttttcggtctctacagattcatcggacaccgaaacacagaccgagggagtgagtactgcaaagaatatcccggcactcgagagcaaggtccaacttaattcgaccgaaactcagaccatgtcctctggatttgaaactctgggatctctgttctttacatctaatgaaacccagaccgcaatggatgatttcttgctggctgacctggcttggaataccatggagtcccaattctctagtgtggagacgcagacatctgccgagccgcacactgtctctaacttctag

SEQ ID NO: 11340 - DNA, 1785 bp, Artificial Sequence
  Description of Artificial Sequence: Synthetic coding sequence
atggagaactgcgctcagaaccagaaattgtcaaataagaccatcgaaagtctgaataatcaacccattcctagaccagacacacaggaattggaagcctctgagattaagcttgaacctagtttcgaggacagctgtggatcaaataccgataaacaaactctgaccactcctcctcggtatccccagaaactgctcctccctaaacccaaagtggctcttgtcaagttgccggtgatgcagttctctgtcatgcctgtattcgtgccgacagctgacagctcagctcagcctgtagtactgggcgtcgatcaaggcagtgcgactggtgctgtgcatctgatgcccctgtccgtcggtactctaatacttggactggattccgaagcctgttcgctgaaagagtcactgccgctgtttaagatcgccaaccccatcgctggcgagccgattagtactggcgttcaggtgaacttcggcaagagtccctcgaacccgctccaggagctgggaaatacttgccagaagaattccatatcttctatcaatgtccagacggatctgagctacgcttctcaaaacttcatcccctccgcccagtgggccaccgccgacagcagcgtcagctcatgcagccagacagacctatccttcgacagtcaggtgtccctaccaatttccgtgcacactcagacgttcctccctagctcgaaggtaaccagctctatcgccgcccagaccgacgcttttatggatacctgtttccagagtggtggtgtatcccgggagacccagacttcgggtatcgagagcccaaccgacgatcatgtccagatggatcaggcgggcatgtgcggtgatatctttgagtcagtgcattcctcctacaacgtggccaccgggaatataatcagtaacagcttagtggccgagacagttactcattccttacttccacaaaatgagcctaagaccctaaaccaggacatcgagaaatctgcacccattattaacttttccgcacagaattcgatgttgccgagtcaaaatatgaccgacaaccagactcagaccatagacctactgtccgacctggagaacatactttcatcgaatttacccgcacagaccttagatcatcggtcactgctcagcgacacaaaccccggccccgatacccaactgcccagcgggccagcccagaatccgggtatcgattttgatatcgaggaattcttctccgccagtaatattcaaacccaaacagaggagagcgagctttctacaatgacgacagagccagtgctcgagagcctcgacattgaaacccaaaccgatttccttctggcagacacctcagcccagtcctatggctgtcgcgggaacagtaacttcctggggctggaaatgttcgacacccagacccagaccgatttaaattttttccttgattcttcacctcacctgccactaggctctattctgaagcactcttcctttagcgtgagcactgacagttccgatactgagacccaaactgagggggtcagcactgctaagaacatccctgccttagagagtaaagtgcagctcaactcaactgagactcagaccatgtctagtgggttcgagacactggggtcactattcttcacatccaacgagacacaaacagccatggacgattttctgctcgccgaccttgcgtggaataccatggagtctcagttctcttcggtggagacccaaaccagcgccgagccacatacagtgtccaacttttag

SEQ ID NO: 11341 - DNA, 966 bp, Artificial Sequence
  Description of Artificial Sequence: Synthetic coding sequence
atgaaacacattcctgtgttagaggacggtccatggaaaacggtctgtgttaaggaactgaatggactgaaaaaattgaaacggaagggcaaagagccagcccgacgggctaatgggtataaaacctttcggcttgatctcgaagcccctgagcccagggcagtggctacaaacggcctacgtgaccgtacccaccggttacagcccgtccctgtacccgtgcccgtgccagtgcctgtagcccctgcagttcctcctaggggtggcacagacacggctggtgagagaggtggctcgcgcgcaccagaagtctcagacgctaggaagaggtgttttgcccttggagccgtaggacccgggctacccacaccccccccgcctccaccacctgcaccccagtcacaggctcccggagggccagaagcacagccttttcgggagccgggtttgcggcctagaatacttttatgtgccccacctgcacggcctgcccctagcgccccacccgcgccacctgctcctcccgagtcaaccgtgcgacctgccccacctacaaggccaggcgagtctagttacagcagcattagccacgttatttacaacaaccaccaggattcgagcgcatcccccagaaagcggcccggcgaggctactgctgcatccagcgagattaaagcactgcagcagacacggaggctgctggccaacgccagagagcgtactagggtccacacaattagcgcagcattcgaggctctccggaagcaagtcccgtgttattcgtacggccagaagcttagtaagctggcgatcctccggattgcatgcaattacatactctccctagccagattagccgatctcgactacagcgccgaccactcaaatctctcttttagtgaatgcgtgcagcggtgtaccagaactctgcaagcggagggccgggccaagaagcgaaaagagtag

SEQ ID NO: 11342 - DNA, 1164 bp, Artificial Sequence
  Description of Artificial Sequence: Synthetic coding sequence
atgaccatggaaggggcgtcaggttcctctttcggtattgataccatattaagctccgctagcagcgggtccccggggatgatgaatggggatttccgcccactgggcgaagctcgaactgccgattttcgatcccaggcgacaccctctccctgctctgaaattgacacagtgggcaccgccccaagcagtccaatcagtgtgaccatggaaccgcctgaaccacatttagttgcagacgccacacagcatcatcaccacctacaccattcacagcagcccccaccaccagccgccgcaccgacccaatccctgcagcctctaccccagcaacagcagccattacccccccagcaaccaccgcccccaccaccccagcagctcggctccgccgcaagcgcgccccggacctccacctccagctttctgatcaaagacatcctcggagattctaaacctttggccgcttgcgctccatattctacctcagtcagcagcccccaccatacaccgaaacaagagtctaatgccgtgcacgagtcctttagacccaagctcgaacaggaagactcaaagacaaagcttgacaaaagagaggactcacaaagtgatattaagtgccacggcacgaaggaggaaggggatagggaaattacatctagcagggagtcgccccccgtgagagcaaaaaagccacggaaggctagaactgctttctcagatcatcagcttaatcagttagaaagatcattcgagcgccagaagtacttaagcgttcaggataggatggatctggcagcagcgctaaacctaacagacactcaggtgaagacgtggtaccagaacaggcggaccaagtggaagaggcagaccgctgtgggcctcgaattacttgctgaggccggtaattattccgccctgcaacggatgttcccttctccctatttctaccatccctccctgctgggctccatggactccaccacagctgccgctgctgccgcagccatgtactcgtctatgtaccggacaccccccgccccacatccccagttgcaaaggcccttggtgcctagggtcctgattcacgggctcggcccaggaggtcagcctgcattaaatcccctgagcagtccaatccctgggacacctcaccccagatag

SEQ ID NO: 11343 - DNA, 321 bp, Artificial Sequence
  Description of Artificial Sequence: Synthetic coding sequence
atgatgactctggtccctcgcgcaaggactagggctgggcaggaccattacagccacccatgtcctcggttctcgcaggttctgctgacagagggcatcatgacatactgtctcactaagaacctgtcagacgtcaacattctccacagactgctgaaaaatggaaatgtgaggaataccctcctgcaaagcaaggtggggctcctgacatactatgttaagttgtaccctggcgaggtaaccctccttactagaccctccatccagatgcggctctgctgtattactggcagcgtgtcgagaccacgctcccaaaagtag

SEQ ID NO: 11344 - DNA, 321 bp, Artificial Sequence
  Description of Artificial Sequence: Synthetic coding sequence
atgatgacactagtacctagggctagaacccgggcgggtcaagaccactattcacatccctgcccccgctttagccaggtcctgttgactgaagggatcatgacttactgtctaacaaagaacctcagcgacgtcaacatactgcacaggctgcttaagaacggaaacgtgcggaacactctgctccagtctaaggttgggctcctgacatattatgtaaaactgtatccgggggaggtgacattactgacacggccatcaattcagatgcgcctctgttgcataacaggatctgtgtctagaccaagatcacagaagtag

SEQ ID NO: 11345 - DNA, 570 bp, Artificial Sequence
  Description of Artificial Sequence: Synthetic coding sequence
atgaaaactaagaatcgcccaccacgccgtcgtgcccctgtgcaggacaccgaagcaactccgggagaagggacccctgatggatccctgcccaaccccggtcccgagcctgccaagggactgcggtctaggcctgctcgggcagctgctcgtgcacctggcgaagggagaaggagaagaccagggcctagcggtcctggcggtcgcagggacagcagcatccagaggaggctggagtccaatgagagagagaggcagaggatgcacaagttaaataatgcatttcaagcattacgggaagtgatcccacatgtcagagccgataaaaaactctcaaaaatcgagacactcaccctggctaaaaactatatcaagagcctgaccgctaccatcctgaccatgtcttcttccagactgcccgggctggaggggcccgggcccaagctttaccagcactaccagcaacagcaacaggtagcaggtggggctctgggagccacagaagcccagccacagggccatttgcagcggtactcaacccaaattcactcctttagagaggggacctag

SEQ ID NO: 11346 - DNA, 708 bp, Artificial Sequence
  Description of Artificial Sequence: Synthetic coding sequence
atgctgagaggtgctcccggcttggggctaaccgcgaggaagggcgctgaggatagcgccgaggatttgggcgggccttgccccgagcctggaggggattctggcgtgcttggagctaacggagccagttgtagtagaggagaagccgaggaacctgctgggagacgtcgggcaaggcccgtcagatcaaaggctcgtcgaatggcagctaatgtgagggaacgcaaacgcatcctggactacaacgaagcattcaacgccctccgtcgggcattgagacacgatttgggaggtaaaagactgtccaaaatcgctacactaaggagagcaatccaccgtatcgccgccttgagcctggtactgcgcgcatcgccggctccccgtggcccttgtggtcaccttgaatgccacggtccagccgccaggggagatacaggagacacaggcgctagccctccaccacccgcaggaccaagtctggcaaggcctgacgccgctcggcccagtgtgccttctgcaccacggtgtgctagttgtccacctcatgctcccctggcaaggccttctgcggtggcagagggaccagggctggcacaggcttctggtggctcctggcgcaggtgtccaggggcctcctctgcaggtcctccaccatggcccaggggatatctgcgctcggctcccggaatgggacacccccgaagctag

SEQ ID NO: 11347 - DNA, 825 bp, Artificial Sequence
  Description of Artificial Sequence: Synthetic coding sequence
atgcatctttgtggaggaaacggcctgctgacgcaaacggacccaaaggaacagcagcggcagctgaagaaacaaaagaacagggctgccgcccagagatcccggcaaaagcatacagataaggccgacgccttgcatcagcagcacgagtccctggaaaaggataacctcgccctgcgaaaggagatccagtcactgcaagccgaactggcttggtggtcacggacactgcacgtccacgaacggctttgcccgatggactgtgcatcctgtagcgctccagggttattaggatgctgggatcaagcggagggtctgttgggcccaggcccacaagggcaacatggatgccgcgagcagttagaactatttcagacacccggcagttgttatcctgcacagccactcagccctggcccacaaccgcacgactctccatctctcctgcaatgtccgttaccatcattatccctgggacctgccgttgtagctgagcccccagtgcagttgtccccatcaccgctgttgttcgcatctcacacgggaagctcactgcagggcagctcaagcaagctaagcgcccttcagccatcactcaccgcccaaaccgcgcctcctcagcctctcgagttagaacatcccactaggggcaaacttggatcaagccccgataatcctagctcagcgctcggccttgcccggctccagtcaagagagcacaagcccgctctcagcgctgcgacctggcaagggcttgtggttgaccctagtcctcatcctttgctggcctttccactgctctcctcagcccaggtacatttttag

SEQ ID NO: 11348 - DNA, 2031 bp, Artificial Sequence
  Description of Artificial Sequence: Synthetic coding sequence
atgaagaaattctctaggatgcctaaatctgagggggggagcggcgggggcgccgcagggggtggggcgggcggtgccggagcaggtgctggctgcgggtcgggagggtcttctgtaggcgttcgagtttttgccgtgggcagacaccaggtgacgctcgaggagagcctcgcggagggcggattctctacggttttcctggtccggacccacggcgggatccggtgtgcccttaaacgtatgtacgtgaataatatgcccgatctaaatgtgtgcaagagggagataacaattatgaaagagctatctggacacaagaacatagtcggctatttggactgcgccgtaaattctatttccgacaatgtctgggaggtgctgatcttgatggaatactgcagggctggacaggtcgtgaatcagatgaacaagaagctgcagacaggcttcacagagccggaggtcctccagattttctgcgatacatgcgaagctgttgccagactgcatcagtgcaagactcctatcatccatcgcgatctgaaagttgagaatatccttctgaacgatggcgggaactacgtgctgtgcgactttggaagtgcaacaaataaattcttaaatccccagaaggacggcgtgaatgtagtcgaggaggagataaagaagtacacaaccctctcctatagagctcccgagatgattaatctgtacggcgggaagcctatcaccaccaaagccgatatttgggcgttgggctgcctattatacaaactgtgctttttcaccctcccatttggagaatcacaggtcgccatttgtgacgggaacttcaccatcccagataacagccgatattctagaaacatccattgcttgataagatttatgttggagccagatcccgagcaccggcctgacatctttcaggtgtcttacttcgccttcaaatttgccaagaaagactgccctgttagtaacattaataaatgttgtaaacagctgttgcgacacggtgctcttctgactgagatcctgctttttctccagctttttctgaacatgacggcttctgaggccgctgcgcgcaaaagccagatcaaagcacgtattaccgacacaatcggcccaactgagacctctatcgccccccgtcaaagacctaaggccaactctgcgacgaccgccacgccgagcgttttgaccattcagtcatcagctacacctgttaaggttcttgcccccggtgagtttgggaaccatcggcccaaaggggctctccgcccaggaaatggaccggagattctcctcggacagggacccccccagcagcccccccagcaacatcgcgtgctccagcaattgcagcagggagactggcggctccaacaactgcatctgcagcacaggcatccacatcagcagcaacagcagcagcagcagcaacaacagcagcagcagcagcaacaacaacagcagcaacagcagcagcagcagcagcatcatcatcaccaccatcatcatctgctgcaggatgcatatatgcagcagtatcagcacgccacccagcagcagcaaatgctgcagcagcaattcctgatgcactccgtgtaccagccacagccctcagcctctcagtatccaactatgatgccccagtatcaacaggctttctttcaacagcaaatgctggctcagcatcagccgtcacaacagcaggcttccccagaatatttaacctctcctcaagagttcagcccagcattagtatcctatacctcaagtctccccgctcaggttggaaccatcatggatagcagctatagcgctaataggtccgtggccgacaaggaagcgatcgccaattttaccaaccagaaaaacatttcaaacccccccgacatgtccgggtggaatccattcggcgaggacaactttagtaagctcacagaagaggaactgctcgaccgcgaattcgatttactgcggagttctaaaggtcacctcaaagcatattttgctagccagtag

SEQ ID NO: 11349 - DNA, 3486 bp, Artificial Sequence
  Description of Artificial Sequence: Synthetic coding sequence
atgaagaaattctcgcggatgccgaagagcgagggcggctccggggggggggcagcgggcgggggggcagggggtgcaggggcaggcgccggctgtggctccggaggttcctccgtcggggtacgcgtgttcgcagtcggccggcaccaagtgacccttgaagagagcttagctgaagggggtttttccaccgtgtttcttgttcgcacgcacgggggcatccgctgtgcactcaaaagaatgtatgtaaataatatgccagacctaaacgtttgtaaacgcgagattaccattatgaaggaactctctggccataagaacatcgtcggatacctcgactgtgccgtgaattctatttcagacaatgtctgggaggtgctgatcctgatggagtactgtagggcagggcaggtggttaatcaaatgaacaaaaaactgcaaaccggatttactgagcctgaggtgctccagatcttctgcgacacctgcgaggccgttgcaaggcttcaccagtgcaagacaccaataatccacagggacctgaaggttgagaatatactgttaaacgatggtgggaattacgtgctctgcgacttcggcagcgcgacaaataaattcctaaatccccagaaagatggcgtgaacgtggtggaagaagaaataaagaaatatacaaccctgagttatcgggcgccagagatgataaacctgtatggtgggaaacctattactaccaaggccgacatttgggctttgggctgcctcctctacaaactctgcttctttaccctaccgtttggcgagagccaggtcgccatctgcgatggcaatttcactattcctgataactcccgctatagccgtaatatccattgcctgattcgattcatgcttgaaccagaccccgagcaccggccagatatttttcaagtgagctacttcgcatttaaattcgcaaaaaaagactgtccagtttcaaacataaataactcttccatcccctccgcccttcctgagcccatgactgcctccgaggccgccgcacgaaaaagccagatcaaagccagaattaccgataccattggccctactgaaacatccattgcaccacgacagagaccaaaggccaattcggcaactaccgcaacaccctctgtactcactatccagtctagcgctacaccagtcaaggtcctagcacctggggaatttggcaaccaccgccctaagggagccctgagacctggtaacggaccagagatcctattaggccagggccctccacaacagccccctcaacagcaccgtgttcttcagcagttgcagcaaggagactggagactgcagcaactgcatctacagcacaggcatccacaccagcagcaacaacagcagcaacagcagcagcaacaacagcagcagcaacagcagcagcagcagcagcagcagcagcaacagcaccaccaccaccatcaccaccatctgctgcaggatgcatacatgcagcaatatcaacatgcaacccaacagcagcaaatgctccaacagcagttccttatgcactccgtttatcagcctcaaccgtccgcctcacagtatccgactatgatgccgcagtatcagcaggccttcttccaacaacaaatgctcgcgcagcatcagccctctcaacagcaggcttcgccggagtacctgactagccctcaggagttctcccctgctctggtgtcctacaccagttccctgcccgctcaagtaggcaccattatggatagcagctattccgccaaccggtctgtggctgataaggaggcaattgccaatttcaccaatcagaaaaacatttctaaccccccagatatgtccgggtggaacccgtttggagaagataacttttccaagcttactgaagaagaactcctcgacagggaattcgacctgctgcggtctaaccggctggaggaacgagccagttccgacaaaaacgttgacagtctctctgccccccacaaccaccccccagaagatcctttcggctctgtgcctttcatctcacatagcggctctcccgagaagaaggccgagcattcgtccataaatcaggaaaatggcacagctaatcccattaaaaatggcaagacctccccagccagtaaggaccagagaacaggaaaaaaaaccagtgtccagggccaggtgcagaagggtaacgacgagagcgaatcagacttcgaatccgatccacctagtccaaagagcagcgaagaagaggaacaggatgatgaggaagtgctgcaaggagagcaaggcgattttaacgatgacgacaccgaaccagaaaacctgggccacagaccgttgttgatggacagcgaagatgaggaagaagaagagaaacactccagcgactctgattatgaacaagccaaagcaaagtactctgacatgagctcagtatatcgcgatcggagcgggtctggcccaacgcaggaccttaatactattctgcttaccagcgcccaactcagctctgatgttgcggtcgaaacgcccaagcaggaatttgacgtgttcggcgcggttccgttcttcgccgtgagggcccagcagccacagcaggaaaaaaacgaaaaaaacctgccacagcaccgttttcctgccgccggtctcgagcaggaagagttcgacgtattcactaaagcccctttcagtaaaaaagtgaatgttcaagagtgccacgccgtggggcctgaagctcatacaatccctgggtacccgaagagcgttgatgtgtttggttctaccccatttcagccgttcctgacaagcacatccaagagcgaaagtaatgaggacttattcggactggttcctttcgacgaaattacaggaagccagcagcaaaaggtgaagcagaggtcactgcagaagctttcatctagacagaggcggaccaagcaggatatgtccaaatcaaacggcaagcggcatcacggaacacctaccagtaccaaaaagacgctgaagcctacctatcgaacaccagagagagcaaggaggcacaaaaaagtggggcggcgcgactcccagtcttccaacgaatttctgacgatctctgactccaaggagaacatttcagtcgccctgactgatggaaaagatcgggggaacgttcttcagccagaagagtctttactagatccattcggagctaagcccttccatagccccgatctctcatggcaccccccacaccaggggctttccgacattagagctgatcataatactgtgctgcccggacgacctcgacaaaacagtcttcacgggtctttccacagcgcggacgtgttgaagatggacgatttcggagctgtgccattcacagagctggtcgtccagagcatcactccacaccagagccagcagagccagcctgtggaattggaccctttcggggctgcccctttcccctcaaaacagtag

SEQ ID NO: 11350 - DNA, 1989 bp, Artificial Sequence
  Description of Artificial Sequence: Synthetic coding sequence
atgaagaagtttagtcggatgccgaagagtgagggggggagcggaggaggcgcagcagggggaggggctggcggggccggggcaggcgcggggtgtgggagtggcggcagcagcgtgggtgtgagggtatttgccgtcggccgccaccaggtgaccctggaagagagcctcgcagagggaggctttagcacggtcttcctggtgcggacgcatggcggcatcaggtgtgccctcaaaaggatgtacgttaataatatgcctgatttgaatgtgtgtaaacgagaaattaccatcatgaaagaactcagcggtcacaagaatatcgtgggctatctggactgtgccgtgaacagcatcagtgataatgtgtgggaggtcctcatcctgatggaatattgtagagctgggcaggtggtaaatcaaatgaataagaagctgcagacagggtttacagaacccgaggtcctgcaaatcttctgcgatacgtgcgaggcggtggctaggcttcatcagtgcaagacacccataattcatcgggaccttaaggtggagaatatactactgaacgatgggggtaattatgtgctgtgtgactttggttctgcgactaataagtttctgaatcctcagaaagatggcgtgaatgtggttgaggaggagatcaagaagtacactaccttgtcttatagggctccagaaatgatcaatctgtacggtggcaaaccaatcaccaccaaagcagatatttgggcactgggctgcctactctacaagctgtgtttttttacgcttcctttcggggagtctcaggtggccatctgtgatggaaacttcactatcccagataactcacgatactctcgcaacattcattgtctgatcaggtttatgttggagcctgatccagaacaccggccagacatcttccaggtctcctactttgcctttaaattcgcgaaaaaggattgcccggtttccaacattaacaattcctccataccttctgcacttccagagcccatgacggcaagcgaggctgccgcacgaaagtcacaaataaaggccaggataactgatacaatcggaccgacagaaacctctatcgcccctcgccagcgccctaaagccaactccgctacaaccgcaaccccttccgtgctgaccatccagtcatccgcaacgcctgtgaaagtcctcgcacccggcgaatttggtaaccataggcccaaaggagccctccgcccgggcaatggccccgaaatccttctgggacaaggtcctccgcaacagcctccgcaacagcaccgggtcttgcagcagctccagcagggcgactggaggttacaacagctccatctgcaacacagacacccccaccaacagcaacaacagcagcagcaacaacagcagcagcagcagcagcaacagcaacaacagcagcagcaacagcagcagcaacaccaccaccaccaccatcatcatcttctgcaggacgcatatatgcagcaataccagcacgccacacagcaacagcagatgttgcagcagcagtttctcatgcactcggtgtaccaaccgcagccatcagccagccagtatcccaccatgatgccacagtatcagcaggctttttttcagcagcagatgctggcccaacatcagccaagccaacagcaagcatcccccgagtacctgacaagcccgcaagagttttcacccgctctcgtctcttatactagctccctgcctgcacaggtgggaacaatcatggattccagctattcagccaatcgcagcgtcgccgacaaggaagcaatagccaatttcaccaatcagaaaaacatcagtaaccctccagacatgtcagggtggaatccattcggcgaggataacttctccaagttgaccgaagaggaattactggaccgggagtttgatctgcttcgctcatctaagggccatctgaaagcttactttgcttcccagtag

SEQ ID NO: 11351 - DNA, 3849 bp, Artificial Sequence
  Description of Artificial Sequence: Synthetic coding sequence
atggaagccaaggatcagaaaaagcatcggaagaagaatagcggacctaaagccgccaaaaagaagaagcgcctccttcaggatctgcagctgggagacgaagaggatgcaagaaagcgaaaccctaaggcctttgccgttcaaagcgccgttcgcatggctagaagttttcatcgaacccaggatttgaagacaaagaagcatcatatccccgttgtggatcgaacccccctggaaccccctcccattgtggtcgtggtcatggggcctcctaaggttggcaagtcgactcttatccagtgtctgatccgaaatttcacacggcagaagcttacagagataagaggacccgtgactatcgtcagtggtaagaagaggcgattgaccataatcgagtgcggttgtgacattaatatgatgatcgacctggccaaggtcgcagatcttgtgctgatgttaatcgacgcttccttcggttttgaaatggaaaccttcgaatttctgaatatctgccaggtccacgggtttcctaagatcatgggggtgttgacccacctcgactcgtttaagcacaacaaacagctcaaaaagacaaaaaagcgcttgaagcatcggttctggacagaggtgtatcctggggcaaagctgttttacctgtccggcatggtccatggagagtaccaaaaccaggaaattcacaatctgggccggtttataacggtcatgaaatttagacctttgacttggcagacaagtcacccttatatattagcagatcgaatggaggatttaacaaacccagaggacatacggactaatatcaaatgcgatcgcaaggtgtccctgtacgggtacctgcggggggctcacttgaaaaataagtcacagattcacatgcccggtgtgggtgatttcgctgtgtccgacataagcttcctcccagatccttgtgccctccctgagcaacagaaaaagcgttgtctgaatgaaaaagagaaactcgtgtatgctcccctgtctggcgtgggcggagtcctgtacgataaggatgccgtctatgttgatctcggtgggtctcatgtgttccaggacgaggtggggccaactcacgagctcgtacagtctctgattagtacgcactccactattgatgccaagatggcatcttctcgggttactctgttctccgatagcaaaccactcggcagcgaggacatcgacaatcaagggctgatgatgcctaaggaggagaagcaaatggatctcaacacggggcggatgagacggaaggccatttttggtgacgaggacgagagcggggattctgacgacgaagaggacgatgaaatgtcagaagatgatgggctggagaatggttcaagcgacgaagaggctgaagaagaggaaaacgctgagatgactgatcaatatatggccgtgaagggaatcaaaaggaggaaactggagttagaggaggactcagaaatggatctgccggccttcgccgacagcgacgacgatcttgagaggtcgtccgccgaagaaggcgaagccgaggaagcggatgagtctagtgaggaggaagattgtaccgcgggtgagaaaggcatcagcggatcaaaagccgcgggggagggttcaaaggcaggattaagccctgcaaattgccagagcgatcgtgtcaaccttgagaagagcctcctgatgaaaaaggctgccctgcctactttcgatagcggccattgcacagcggaggaagtatttgcctcagaggacgagtccgaggagtcctcgagcctgagcgctgaggaggaggattcagagaacgaagaagcaattaggaaaaaattaagtaaaccgagccaggtctcctccggtcaaaagttgggaccccagaactttattgacgagacatctgatatagagaatcttcttaaggaggaagaagactacaaggaagagaacaatgacagcaaggagactagcggcgctcttaaatggaaagaggacttgtcaagaaaggccgcagaggcctttctcaggcagcagcaggccgctcccaacctgcgcaaattaatctacgggacagttaccgaggacaacgaagaagaggacgatgacacgctcgaagaactggggggcctatttcgggtgaatcagcccgaccgggaatgcaaacacaaggcagatagcctcgactgcagccggtttctcgtggaagctccacatgattgggatctggaagaggtgatgaatagcatcagagactgctttgtgaccgggaaatgggaggacgataaagatgccgccaaggtgttggccgaggacgaagaactgtacggcgacttcgaggacctggagactggtgacgtgcataagggaaaatctgggccaaatacccagaacgaagatatcgaaaaagaagtgaaggaggagattgatcccgatgaagaagagtccgccaagaaaaagcacctggataaaaagagaaagctcaaggagatgtttgatgccgaatacgatgagggagaaagtacatatttcgacgatctcaaaggagaaatgcagaagcaagcccagttgaaccgagccgagtttgaggatcaggacgatgaggccagagtgcaatacgagggtttcaggcccggcatgtacgtccgtatcgagattgagaacgttccgtgcgagttcgtacaaaactttgacccacactatcccataattcttggcggcctgggtaatagcgaaggcaacgtcggctatgttcagatgcgccttaagaaacacaggtggtacaagaagatccttaagtctcgcgatcccatcatcttttcggtcggctggagacgattccagaccattccactttactacatcgaagatcataacggacgacagaggctgctgaagtacaccccccaacatatgcattgtggagccgcattttggggaccaattacaccacagggcaccgggttcctggccatacaaagcgtgtcgggtataatgcccgacttccgcatcgctgccaccggcgtggttctggacctggataaaagcattaaaattgtcaaaaaactcaagctgacaggcttcccatataagatatttaaaaatacttccttcataaaaggaatgttcaattcagctctcgaagtcgcaaagttcgagggagccgtgataagaacagtgtcaggaattagaggccaaattaagaaagcgctgagagcaccagagggggcattccgggcttccttcgaggacaaattgctcatgtcagacatcgtcttcatgcgcacatggtaccctgtgagcattcccgcattttacaatcccgtcactagcctgctgaaaccagtgggggagaaagatacctggagcgggatgcgtaccacaggtcaactgcgattagctcacggggtacggttaaaggcgaacaaagattcattatacaagcccatattgcgccagaagaagcatttcaactctctgcatattccaaaagccctgcagaaagccttgccattcaaaaataaacccaagactcaggccaaggccgggaaggtgccgaaagacaggcgtagaccagccgtaatccgcgaaccccatgagagaaagattctcgcactgttagacgctttgtccaccgtccacagtcagaagatgaagaaagcgaaagagcagcggcacctccacaacaaggagcatttcagggccaagcagaaagaggaagaggagaaactgaagcggcagaaggatttacggaagaaactattcaggatccaaggtcagaaggaacggcgtaaccagaagtcttctctgaaaggggccgaggggcaactgcaatag

SEQ ID NO: 11352 - DNA, 909 bp, Artificial Sequence
  Description of Artificial Sequence: Synthetic coding sequence
atggtctcttaccacaagcaggcatgtgaaataccaccgactgtgaaccccaggaaaaagttgtgggcgttcccgagcgacagcagcagggatctgccaagcccaaagaaggctaagactgaggagatgccccaactcaactttggaatggccgatcccactcagatgggcggtcttagcatgttgctcctggctggcgagcacgccctcgggactccagaggtgtcttctgggacctgccgtcctgatgtgagcgaatctccggaactgcggcagaagagccctctcttccagttcgccgagatcagttccagcacaagccatagcgacgcttccacgaaacagtgtcagacctctgcactgtttcaatttgcagaaatcagctcaaatacttcacaactgggcggggcagaacccgtcaaacgatgcggcaaatccgcactctttcaactggccgagatgtgtttggcaagcgaggggatgaagatggaggaaagtaagctaattaaggcaaaggaatccgatggcgggcggatcaaagaactggaaaagggcaaggaggaaaaagagatcaaaatggagaaaacggacgaaaccagactgcagaaagaggccgagtttgaaaaaagcgccaaggagaacctgagagatagtaaggaactgagaaactttgaggcacttcagattgatgacatcatggcaatcaagatggaagacccaaaagaaatcagaaaggaggagctggaggaggaccacaagtgctcccatttcccagactttagctactccgcctcctcaaaaatcattatttctgatgtgccctctcggaaggatcatatgtgccacccacacggcattatgattattgaggaccccgcagctcttaacaagcctgagaagctaaaatag

SEQ ID NO: 11353 - DNA, 2826 bp, Artificial Sequence
  Description of Artificial Sequence: Synthetic coding sequence
atgaagggtagcaatcgcaataaagaccattccgcagagggcgagggcgtgggaaagagaccaaagcgtaaatgtttgcagtggcaccccctcctggcaaagaagctcctcgactttagtgaagaagaggaggaggaggatgaagaagaagacatcgacaaggtgcagctactgggggccgatggactggaacaggacgtcggcgagacagaagacgacgagtcccctgaacaacgggctagacgccccatgaatgctttccttttattttgcaaacgacacagaagcctggttagacaagagcaccccaggctcgacaaccgcggagctaccaaaattctcgctgactggtgggctgttctcgaccccaaggagaaacaaaagtataccgatatggccaaggagtacaaggatgcctttatgaaagcaaatccgggatataaatggtgcccaacgacaaataagccggtcaaatccccaaccccaactgtcaaccccaggaagaagctttgggcattcccgtccgacagctctagggatctgccgtcgcctaagaaagccaagactgaggagatgccacagctcaatttcggtatggctgatccaacacagatggggggcctgtcaatgttgttgttagctggcgaacacgccctggggacccccgaagtcagttctggaacctgtcgtccagatgtttctgagtcaccagaactgcgccagaaatcccctctcttccagttcgcagaaatctcatcttcgacctcacactcggacgccagtaccaagcagtgccagacctcggccctctttcagtttgccgaaatcagcagcaacacatcccaactggggggggcggaacccgtaaaaaggtgtggaaagtctgcccttttccagcttgctgaaatgtgcctggcaagtgaaggtatgaaaatggaagagagtaagctcatcaaggccaaggaaagcgacgggggaaggataaaggagcttgagaagggcaaggaagaaaaggagatcaaaatggagaaaaccgacgaaacaaggttacaaaaggaggcagagttcgaaaaaagtgcaaaagaaaatcttcgagactcaaaggaactgagaaacttcgaggccctacagatagatgatattatggccatcaagatggaggatcccaaagaaatcagaaaagaggagttggaggaggaccacaaatgtagccattttcccgatttcagctactcagcgagcagtaagataattatctccgatgttcctagtaggaaagatcacatgtgtcatccccacggcatcatgatcattgaggatcccgccgctctgaacaagcccgaaaaactcaaaaagaagaagaaaaagagtaaaatggaccggcatgggaacgacaaatcaactcctaaaaagacttgcaagaagagacagagttctgaaagtgacattgagtctgtgatttatactattgaggctgtcgcaaagggcgactgggggatcgagaaactgggcgacacaccacggaagaaggtgcgcaccagctcatccggtaaaggctcaatcttagatgcaaaacctcccaaaaagaaagtgaagagccgtgagaagaaaatgagcaaagaaaagagctccgacacaaccaaggagagcagacctccggacttcatttcgatctctgcaagcaaaaacatcagcggagagactccagaagggatcaaagccgaacctctcactccaatggaggacgccttgccacctagcctgtccggacaggcaaagcccgaggatagcgactgccaccggaaaattgagacttgcgggtcccggaaaagtgaaaggagttgcaagggcgccttatacaagactctcgtctccgaagggatgctgacctcgctgcgcgcaaatgtggatagagggaaaagaagctcagggaagggcaactcaagcgatcacgaaggctgttggaacgaagaatcctggacattttctcaatccggcacatccggcagcaaaaagttcaaaaagacaaaaccgaaagaagattgcctcctcggatccgctaagcttgatgaagagtttgagaaaaagtttaatagtttgccccagtacagccccgtaaccttcgaccggaaatgcgtaccagtgccccgcaagaaaaagaaaacagggaacgtgagttccgagccaaccaagaccagtaaaggtccatttcagtcacagaagaagaacttgtttcataagatcgtgtccaaatacaagcataagaaggaaaagcccaacgttcctgagaaagggagcggagataaatggagtaacaaacaactgttccttgatgccatccaccccactgaagctatcttttcggaggaccggaacacgatggaacctgtccataaagtgaaaaatatccccagtatttttaatactcccgaaccaacaaccacacaggagcccctggtgggctcacaaaagagaaaggcacggaagaccaagatcacccacctcgtgaggacagctgacggaagagtgagtcccgcagggggaacactagacgataaacccaaagaacagctgcagcgctctctccccaaagccaccgagacagattgcaatgataaatgctcgcacaatacagaggtgggggaaaccagaagttccactcctgagatgcccgcagtgtccgcatttttctcgctcgccgcactggctgaggttgccgctatggaaaacgtgcaccggggacagcgttctacccctctgacccatgacggacagccgaaagagatgcctcaggccccagtgctaatatcttgcgccgatcagtag

SEQ ID NO: 11354 - DNA, 1347 bp, Artificial Sequence
  Description of Artificial Sequence: Synthetic coding sequence
atgaagggttctaaccggaacaaggaccatagcgccgagggtgaaggggtgggaaagaggccgaaacgtaagtgcttacagtggcacccactgctggccaaaaaacttctggatttctccgaggaggaagaagaggaggacgaggaggaagacattgacaaagtgcagctgctgggtgctgacggcctggagcaggacgttggcgaaaccgaagatgatgaatcaccagagcaaagggcccggaggcccatgaacgcgttcttacttttctgcaaaagacatcggtcgctggtacgacaggaacatccacgtttggacaaccgcggagctacaaaaatcctggcagactggtgggccgtcctggacccaaaggagaagcagaaatacacggacatggccaaggaatataaggacgcattcatgaaggctaatcccggatataagtggtgtccaacgaccaataaaccagtaaaatctcctactcctactgtaaatcccaggaagaagctgtgggcttttcccagcgactcttccagggatctgccaagccccaaaaaggccaagacggaggagatgcctcagcttaactttggcatggctgatcccacacagatgggcggactgagtatgcttctccttgccggagagcatgccttggggacccccgaagtgtcctccgggacttgccggcccgacgtgagtgagagccccgaactcaggcagaagtctcctctgttccagtttgccgagatctcctcaagtacctcgcatagcgacgcaagcacgaagcagtgtcagactagtgccctctttcaattcgctgaaatctcttctaacacgtctcagctgggaggcgctgaacctgtgaagcgttgcgggaaaagtgcgctctttcagctagcagagatgtgcctggcatctgagggcatgaagatggaggagagtaagcttataaaggcaaaagaaagtgatggggggcggataaaggagttggagaaggggaaggaggagaaggaaatcaagatggagaagactgacgagaccaggttgcaaaaagaagccgaatttgaaaagtccgcaaaagagaatttaagggacagcaaagaactgaggaatttcgaggctttacagattgatgatatcatggccatcaaaatggaagaccccaaagagatccgtaaggaggagcttgaggaggatcacaagtgcagccactttccagacttttcttacagcgccagtagcaaaattatcattagtgatgtcccgtcccgtaaggatcacatgtgccaccctcacggaatcatgattatcgaggacccagccgcactcaataagcccgagtag

SEQ ID NO: 11355 - DNA, 2736 bp, Artificial Sequence
  Description of Artificial Sequence: Synthetic coding sequence
atgaagggaagtaaccgcaacaaggatcattctgccgagggggagggagttgggaagcggcctaagcggaaatgtctgcagtggcaccctcttttggcaaaaaaacttctggactttagcgaggaagaggaggaagaggatgaagaggaagatattgacaaggtgcaactgctgggcgctgatgggttagaacaggatgttggtgagactgaagacgacgagagtccagagcagcgggctcggcgaccgatgaacgcctttctcctcttttgcaagaggcaccgctccctggttagacaagagcatccacggcttgataacagaggagcaaccaaaatactggctgattggtgggcggtgttagaccccaaggaaaaacaaaagtacactgacatggctaaggaatacaaagacgcgtttatgaaggctaaccccgggtacaaatggtgccctacaacgaataaaccggtaaaaagccccacccccacagtgaatcctcgcaagaaactatgggccttccctagcgattcgagcagggacctccctagccccaaaaaagcgaaaaccgaggaaatgccccagctgaattttgggatggctgacccgacccagatggggggtcttagcatgctgctgctcgctggcgaacatgctcttggaacaccggaggtctcctcaggaacatgtcgccccgatgtaagtgagagccccgagctgcggcagaagagtcctttgtttcagtttgcagaaatcagttcaagcacttcacattctgacgctagcactaaacagtgtcagacatcagccttgttccagttcgcagagatatcatcgaacacatcccagctcggcggtgccgaacccgtcaagcggtgcggtaagtctgccctcttccaactcgctgagatgtgtttagcctctgagggtatgaagatggaagaatcgaagcttatcaaagccaaggagagtgatggaggacgcattaaagagctcgaaaagggaaaagaggaaaaagagatcaagatggaaaagaccgacgaaacgagactccagaaggaagctgaatttgagaaatccgcaaaggaaaacttacgagatagcaaggaactgcggaattttgaagcattacagattgatgacattatggccattaagatggaagatccaaaggagatccggaaggaagagctggaggaagatcataagtgcagccacttcccagacttttcatacagtgcctcaagtaagattatcatatcggatgttccgagcaggaaggaccatatgtgccacccccacggtataatgattatagaggatcccgccgccctgaacaaacctgagaagctcaagaagaagaagaaaaagagcaagatggatcgccatggcaacgacaagtccacgcctaaaaaaacgtgtaagaagaggcagtctagcgagtctgatattgagtcggttatctacaccattgaagcagtggccaaaggagactggggaatagaaaaactgggggatactccgagaaagaaagtccgcacgtcttctagtgggaaagggagcattctcgatgcaaaaccaccgaagaaaaaagttaagtcgagagaaaagaagatgtcaaaagagaaaagttctgacactactaaagagagccggcctcccgatttcatctcaatctctgctagtaaaaatatatccggcgaaactcccgaaggtattaaggctgaacccctaacccccatggaagatgccttgccaccatcactctccggccaggccaagcccgaggattcggactgtcaccggaagatagaaacatgtggttctcgcaagtcagagcgtagttgcaaaggggcattgtataaaactctggtttcagagggtatgctgacatctctgcgagccaacgtggaccgcggaaaaagaagttccggcaaaggaaacagctctgaccacgagggttgctggaatgaggaatcttggacatttagccagtccggaaccagtggatccaagaagttcaagaagacaaagcccaaggaagattgcctgctaggttcagccaagctggacgaggagttcgaaaagaagttcaattctctccctcagtattcacccgtgactttcgaccgcaagtgtgttcctgtgccacgaaagaaaaagaagaccggaaatgtctctagtgagccaaccaaaactagtaagggatcgggagataaatggtcgaataaacaactttttctcgacgcaatccacccaactgaggccatattcagcgaggaccgcaatactatggagcctgtgcataaagtgaaaaacatcccatctatctttaataccccagagcctactaccacacaggagcccctcgtggggtcgcagaagcggaaagccaggaagaccaagattacccacttggtccggacagccgatggccgtgtttctcccgctgggggtacactcgacgacaagcccaaagagcaactgcagaggtcgttaccaaaggctacagagactgactgtaacgacaagtgctcccataacacagaagtcggtgagaccaggtcaagtacaccggaaatgccggctgtgtcagcattcttctcactcgccgcgctggccgaagtggctgctatggaaaacgtgcacagaggacaacgcagcacccctttaacccacgatggacaacccaaggaaatgccacaagccccagtattgattagctgtgcggaccaatag

SEQ ID NO: 11356 - DNA, 450 bp, Artificial Sequence
  Description of Artificial Sequence: Synthetic coding sequence
atgaaaggatctaataggaataaggaccactcagcagagggggagggtgtgggtaagaggccgaagcgcaagtgtttacagtggcacccgcttttggcgaaaaaacttcttgatttcagcgaggaagaggaggaagaagatgaggaggaagacattgataaggtgcagctcttaggagcggacggacttgaacaggacgtcggcgaaaccgaggatgatgaaagtcctgaacagagagcaaggagaccaatgaacgcattcctgcttttctgtaagcgacatcgatctttagtgcggcaggagcatccacgcctagataacagaggggcaacaaagatactggcggactggtgggcagtcttggacccaaaagagaagcagaaatatactgatatggcaaaagaatacaaggacgcgttcatgaaagccaacccgggttacaagtggtag

SEQ ID NO: 11357 - DNA, 2736 bp, Artificial Sequence
  Description of Artificial Sequence: Synthetic coding sequence
atgaagggttctaatcgtaataaggaccattcagcagagggagagggtgttggaaaacgacccaagcgtaaatgcctacagtggcaccctctgctggctaagaagctattagacttcagcgaagaggaggaggaagaggatgaagaagaagatatagataaggtccagctactgggagccgacggtctggagcaagacgtgggcgagacagaggacgatgaatcacccgagcagcgggcgaggaggcccatgaacgccttcttgcttttctgcaaaagacatcgtagtcttgtgaggcaagagcaccccaggctcgacaatcgtggcgctaccaaaattctggccgactggtgggccgttctggatccaaaagaaaaacagaagtatactgatatggcaaaagaatacaaggacgcgtttatgaaggccaatccggggtacaagtggtgtcccacgactaataagcccgtgaaatcacctaccccaacagttaaccctcgcaagaagctgtgggccttcccatccgattcgagccgtgatctacccagtccaaagaaggctaaaaccgaggagatgcctcagctaaatttcggtatggccgacccgactcaaatgggaggcctgtccatgctcttactcgccggcgagcacgcgctcggaacaccggaagtctccagcgggacctgtcgccctgatgtgtcagaatcacctgaacttcggcaaaagagcccccttttccagtttgctgagatctcgtcgtccacctcccattccgacgcctctaccaagcagtgccagaccagcgcattgttccagtttgccgagatctcaagcaatactagtcagttgggtggcgcggagccagtcaagcggtgcggaaagagtgcgctcttccaactcgcggagatgtgtcttgcttctgagggaatgaagatggaggagagcaagctgattaaggctaaggaaagtgatggagggagaatcaaggagttggagaagggcaaggaggagaaggagattaagatggagaagacagatgagacccgtctgcagaaggaagcggaatttgaaaaatcagctaaggaaaacttaagagactccaaggagctccgcaacttcgaggcactgcagattgacgacatcatggctatcaaaatggaagacccaaaggaaatccgaaaagaggagttggaggaagatcataagtgcagtcattttccagacttctcctactctgcctctagcaagatcattatctccgatgttccctccaggaaggaccacatgtgtcacccacacggaatcatgatcattgaagatcccgccgctctgaacaagcccgaaaaattgaaaaagaagaaaaaaaaaagtaaaatggacagacatggaaacgataagtctactcccaaaaagacttgtaagaaacgccagtccagcgagagcgacatcgagtccgttatctataccatagaggccgtagcgaagggggattggggcattgaaaagctcggggacactccacggaagaaggtccgcaccagctcgtctggcaagggcagtattttagatgctaagcctccgaagaaaaaggtcaagtctcgagaaaagaagatgagcaaagagaagagcagcgacaccactaaagaaagtcgccccccagacttcatctccatttcagcctcgaaaaacatctccggcgagacgccagaggggattaaggcagaaccgctgactcccatggaagacgctctaccccccagcctgagcggacaggcaaagccagaagattcggactgccacaggaagatcgaaacatgtggctcgcggaaatccgaacgcagttgtaaaggggcattgtataaaactctcgtctcagagggaatgctgacgtcgctcagagccaatgtggacaggggaaaacgctcgagtggtaaaggcaacagctctgatcacgaaggttgctggaatgaggagtcctggacattttcccagagcggcaccagcgggagcaagaagttcaagaagacaaaacccaaggaagattgcctgctggggtccgccaagttggacgaggaatttgagaagaagtttaattcactgcctcagtatagcccagtgacatttgataggaagtgcgtacctgtgcctcgcaaaaagaagaaaacaggcaacgtttcaagtgaaccaacaaaaacatccaaagggagtggtgacaaatggagcaacaagcagctgttcctggacgccatacaccccacagaggcaatcttctcagaggatcgcaacaccatggaacccgtccacaaagtgaagaacatacctagtatcttcaacacacccgagcccaccacgacgcaggagcctttggtaggaagccagaagaggaaagcccgcaaaaccaagatcacacaccttgtgcgcactgcagacggccgagtgagccctgctggcgggaccctggatgataaaccaaaggagcaactgcaaagatccctccccaaggctactgaaactgactgtaacgacaagtgtagccataacaccgaagttggcgagacccgcagctccaccccagaaatgccagccgtgagtgccttctttagcttggcggctcttgccgaggtcgctgctatggaaaatgtccatcgtggtcaaaggtccacccctcttactcacgacggtcaaccaaaggaaatgccccaagctccagttctgatcagttgtgcagaccagtag

SEQ ID NO: 11358 - DNA, 75 bp, Artificial Sequence
  Description of Artificial Sequence: Synthetic coding sequence
atgaaaggctccaatcggaataaagatcacagcgctgagggcgaaggcgtcggcaagaggcccaagaggaaatag

SEQ ID NO: 11359 - DNA, 582 bp, Artificial Sequence
  Description of Artificial Sequence: Synthetic coding sequence
atgaagggaagcaatcggaataaggatcactctgcggaaggagagggagtgggcaagcgaccaaaacgcaagtgcctgcagtggcaccctctcctggcaaaaaaacttctggactttagcgaggaagaggaagaggaagatgaagaggaggatatcgataaggtgcagctcctcggcgctgacggcttagagcaagatgtgggcgagacggaggacgacgaatcgcccgaacagcgcgcaagaaggcccatgaacgcatttttgttattttgtaagagacatagatctttagtgagacaggaacatcccaggctggacaacagaggcgccacaaagattctggcagattggtgggctgttttggaccctaaagaaaagcaaaagtatacagatatggcgaaggaatataaggacgccttcatgaaagcaaaccctggctacaagtggtgccctaccaccaacaaaccggtcaagagcccaacacccacagtgaatcccagaaagaagctctgggctttcccatcagatagtagccgggatctgccatccccaaagaaggcaaagaccgaagaaatgccgtag

SEQ ID NO: 11360 - DNA, 501 bp, Artificial Sequence
  Description of Artificial Sequence: Synthetic coding sequence
atgaaaggttctaaccggaataaagatcactccgcagagggagagggcgttggcaagagacccaaaagaaagtgtctgcagtggcaccctcttttagctaaaaagcttcttgacttctcagaggaggaggaagaggaggatgaagaggaggacatcgacaaagttcagttgctgggtgccgacggacttgagcaggatgttggagagacggaagacgacgagagccccgagcagagagccaggcgccctatgaatgcatttctgctgttctgtaaaagacacagatctctggtacggcaggagcacccacgacttgacaacaggggagccaccaagattctggccgactggtgggcggtactcgaccctaaggagaaacaaaagtacaccgatatggccaaggagtataaggacgcctttatgaaagccaaccctggttataagtggtgtcctaccacaaacaagcccgtcaaatctccaacgcccactgttaacccgtag

SEQ ID NO: 11361 - DNA, 312 bp, Artificial Sequence
  Description of Artificial Sequence: Synthetic coding sequence
atgaaaggttccaaccgcaataaggatcactctgcagaaggagagggagtaggcaagcggcccaagagaaagtgcctgcagtggcaccctctgctcgctaagaagctgcttgacttctccgaggaggaggaggaggaggacgaagaagaggatatcgacaaagtccagctcctcggtgcagacggcctggagcaggatgtgggggaaacagaggacgatgaatcccccgagcagcgcgcgagaagaccaatgaatgcctttctgctcttttgtaagcgccatagatcactcgtcaggcaagaacatccctag

SEQ ID NO: 11362 - DNA, 480 bp, Artificial Sequence
  Description of Artificial Sequence: Synthetic coding sequence
atgaaagggtcaaataggaataaggatcatagcgcggaaggcgagggcgttggaaaacgacctaagaggaaatgcctccaatggcatcctcttcttgctaaaaaacttctcgacttctcagaggaagaggaggaggaggacgaggaggaagatatcgacaaagtgcagctgctcggggcagacgggttggagcaagatgtgggcgagactgaagatgatgagagccccgagcagcgcgctaggagacccatgaacgcttttttactcttctgtaagagacaccggtccctggtgcgtcaggagcatcctaggctggacaataggggtgctactaaaattctcgccgactggtgggccgtcttggaccccaaagaaaagcaaaaatacactgatatggcaaaggagtacaaggacgcgtttatgaaggccaacccgggctacaaatggtgcccaactactaacaagcccgtcaagagctag

SEQ ID NO: 11363 - DNA, 345 bp, Artificial Sequence
  Description of Artificial Sequence: Synthetic coding sequence
atgaagggatcgaacaggaacaaggatcacagcgcagagggcgagggggtgggcaagaggccgaagcgaaaatgtctgcagtggcacccattgctggccaaaaagcttttggatttttctgaagaagaggaagaagaagacgaagaggaggacatcgacaaagtgcagttgctgggcgccgatggactggagcaggatgttggagagaccgaagatgatgagtctccggagcagcgcgctcgccgccctatgaatgccttcctgttgttctgcaaacgccatcggtccctcgtaagacaagaacatccccgactggacaaccgaggggccaccaaaatcttgtag

SEQ ID NO: 11364 - DNA, 435 bp, Artificial Sequence
  Description of Artificial Sequence: Synthetic coding sequence
atgaaaggtagtaataggaacaaggaccacagcgccgaaggggaaggggtcggcaagaggccgaaaaggaagtgtctccagtggcacccgctcctcgcgaagaagctgctggatttttcagaagaagaggaagaggaggatgaggaagaagatatcgacaaggtacagcttcttggtgccgacgggctggagcaagacgtcggtgaaaccgaggacgacgagtcacccgaacagcgcgcccgacggccaatgaacgccttcctgctgttctgtaaaaggcataggtcacttgtgcgccaggagcaccccagacttgacaaccgtggagcaactaagattctggccgattggtgggccgtgctagacccaaaagagaaacagaagtacaccgatatggcgaaggagtacaaagacgccttcatgaaagctaactag

SEQ ID NO: 11365 - DNA, 42 bp, Artificial Sequence
  Description of Artificial Sequence: Synthetic coding sequence
atgaagggctcaaaccgcaataaagaccactccgccgagtag

SEQ ID NO: 11366 - DNA, 618 bp, Artificial Sequence
  Description of Artificial Sequence: Synthetic coding sequence
atgaaggggtcgaaccgtaataaggatcattcagctgaaggggagggcgttggaaaacgtccaaagagaaaatgccttcagtggcacccgctgctggccaagaaacttctggatttctccgaagaggaagaggaggaggatgaagaggaggatatcgataaggtgcagttgcttggcgcggacggcttagaacaggacgtgggtgagacagaggatgatgaatcccctgagcagcgtgcaagacgacccatgaatgccttcctgctcttttgtaagaggcatcgcagcctcgttcgtcaggagcaccctcgactggataatagaggcgccacaaaaatactggcagattggtgggctgttctcgatcccaaggaaaagcagaagtacacagacatggcaaaggagtataaagacgcctttatgaaagccaaccctggatataagtggtgccctaccacaaataaaccagttaagagtcccacaccgaccgtcaatccaagaaagaagctgtgggcttttcccagcgatagctctcgcgatctgcctagcccaaaaaaagctaaaacagaggagatgcctcagctgaattttgggatggctgatcctacccagatgtag

SEQ ID NO: 11367 - DNA, 216 bp, Artificial Sequence
  Description of Artificial Sequence: Synthetic coding sequence
atgaagggctcgaataggaataaagaccactcggccgagggtgaaggtgtgggaaagaggcccaagaggaaatgtctgcaatggcacccgctattggcaaagaagctccttgactttagtgaagaggaagaggaagaagatgaggaggaggacattgacaaggtgcagctcttgggtgccgacggtctggagcaggatgtcggagagacagaatag

SEQ ID NO: 11368 - DNA, 258 bp, Artificial Sequence
  Description of Artificial Sequence: Synthetic coding sequence
atgaaaggctctaaccggaataaggaccactctgccgagggggagggagtgggcaagagacctaagagaaaatgcctgcagtggcacccactgctggccaagaagcttctggactttagcgaggaggaggaggaagaggacgaggaggaggatatcgacaaggtgcagttgcttggagccgatggacttgagcaggacgttggtgagaccgaggatgacgagtctcccgagcagagagcccgccgccctatgaattag

SEQ ID NO: 11369 - DNA, 297 bp, Artificial Sequence
  Description of Artificial Sequence: Synthetic coding sequence
atgaagggaagcaatcgcaacaaagaccattctgccgagggagaaggggtgggcaagaggcctaaacggaagtgcctccagtggcaccctctgcttgccaagaaactcttggacttctccgaagaggaggaagaagaagatgaggaggaagatattgataaggtccagctgctaggggctgatggcctggagcaggacgtaggtgagaccgaagatgacgaaagtcccgagcagcgggcgaggaggccaatgaatgcctttctgcttttctgtaagcgtcaccgtagcctggtgtag

SEQ ID NO: 11370 - DNA, 2466 bp, Artificial Sequence
  Description of Artificial Sequence: Synthetic coding sequence
atggatcctgagtgcgcccagttgctccccgctttgtgtgctgtgctcgttgatccgagacagccagtagccgacgatacctgcctggagaagcttctcgactggttcaagactgttaccgagggcgaaagctccgttgtcctcctccaagagcacccttgcttagtggaactgttatctcacgtgttaaaggtgcaggatttgtcaagcggtgtgctgtcgttcagtttaaggctggctggaacattcgccgcccaggaaaattgtttccagtatctgcagcagggcgaacttttgcctgggctatttggggaaccaggtccccttgggagagcaacttgggccgtcccaacggtacggtctggttggatccagggcctgcggtctttggcacaacatccctccgcgctgagatttctagcagatcacggtgccgttgacacaatcttcagtctgcagggggattccagcctgttcgtagctagtgccgccagccagctgcttgtacacgtgctggcactgagtatgagaggcggcgcagagggccagccctgcctcccgggaggggattggcccgcatgtgcccagaaaatcatggaccacgtcgaagagtcgctgtgctcagccgcaactcccaaagttacacaggctctgaatgtgttgacgacaactttcgggcgttgtcaaagcccttggaccgaagcactttgggtacgactgagtcccagggtagcttgcctgctagaacgggatcctatccccgcggctcactcctttgttgatctgctactgtgtgtggcccggtcaccagtgttctcgagctcagatgggtcactttgggagaccgtggcgagggcactgtcatgtctcggaccaacacacatgggcccccttgcactgggaatcctgaagctagaacattgcccccaggccctgagaacccaggcttttcaggttctgctgcaacctctggcctgcgttctgaaagctaccgtgcaggctcctggccctcccggcttactcgacgggactgctgatgacgcgactaccgtcgatacattgctggcttccaagagttcatgtgcaggactgctgtgccgcacgctggctcacctcgaagaactgcagcccctccctcagaggcctagcccttggccacaagcttccttgttaggcgccacagtgactgtactgcggttatgtgatggctcagcggccccagcctcatcagttgggggccacctgtgtggcacccttgccgggtgcgtgcgggtgcaacgggccgctctcgactttctcggaactctaagccaggggacgggcccccaggaactcgtaacgcaggccttagccgtgctgctggagtgtctcgaaagtcccggatcctctccaacagtcctgaagaaggcttttcaggctacactacggtggcttctgtcatcccccaaaaccccagggtgctctgacctaggccctctgataccacagttcttacgggagctgttcccagtgctgcagaaacgactgtgtcatccttgttgggaggtccgggattccgccttggagttcctgactcagctatcccggcattggggaggacaggcggacttcagatgtgccctcctggcaagtgaagttccccagttggcgctgcaacttcttcaggaccccgaaagctatgtgagagcttctgctgttacggcaatggggcaactgagctctcaggggctccacgctcccacttcccctgagcacgccgaagcacgacagtctctgttcctcgagctactccatatcctgagcgttgatagcgagggcttcccacgcagggccgtcatgcaggtcttcacagaatggctgcgcgatggccacgcggacgccgcacaggacaccgagcaattcgttgctacagtgctccaagcggccagtagggacctggattgggaagtgagggctcaggggctagagctcgcactagtgtttttgggccagactctcgggcctccgcggacccactgcccttacgcagttgctctgccagaggtagcgccggcccagccgctgactgaggcacttcgggcgctttgtcacgtaggattgttcgattttgcattctgtgcgttatttgactgtgatcggccagtcgctcagaagtcctgcgatctcttgttattcctacgggacaagattgcgagttactcctccttgcgggaagcacgcggcagccctaatacagcttcagccgaagctacactgccccgctggcgcgcgggagaacaggctcaacccccaggcgatcaagagcccgaggccgtgctggcaatgctaaggagcttagatctcgagggcctgagaagcacattggcggagagtagcgatcatgtcgagaaatccccccagagtctactccaggacatgctggccaccggcgggtttctgcaaggcgacgaagcagattgctactag

SEQ ID NO: 11371 - DNA, 720 bp, Artificial Sequence
  Description of Artificial Sequence: Synthetic coding sequence
atggccaagccttgtggggtccggctttcaggggaggctcgcaagcaggtcgaagtattccgccagaacctgttccaggaggctgaagaattcctataccggttccttccccagaagatcatctacctcaatcagctgctgcaggaagatagcttaaacgtggccgacttgacctcactgcgtgctccccttgacatccctatccccgatccgcccccaaaggacgatgagatggaaaccgacaagcaggagaagaaagaagttcataagtgcggattcctcccagggaacgaaaaagtgctgtcactcctggcgcttgtgaagcctgaagtttggaccctgaaagaaaagtgtattttagtgattacctggatccagcatctgatccccaagatcgaggacggcaatgattttggggttgctattcaagagaaggtgctggaaagggtcaacgccgttaagacaaaagtggaagctttccagactaccattagcaaatatttcagcgaaagaggggacgccgtggcaaaggcttcgaaggaaacccatgtgatggattaccgggccctcgtccacgaaagagatgaggccgcttatggggagttgcgcgctatggtgttagacctgcgggccttctacgcagagttataccacatcatctcatcaaacttggaaaagatcgtcaaccctaagggcgaggaaaaaccaagtatgtattag

SEQ ID NO: 11372 - DNA, 828 bp, Artificial Sequence
  Description of Artificial Sequence: Synthetic coding sequence
atggatgacgaggattgcgaaagaaggagaatggagtgcctggacgagatgagcaacctggagaaacagtttaccgacctgaaggatcaactctataaggagagactttctcaggtggacgccaaactgcaggaggtcattgcaggaaaagcacctgagtaccttgagccactggctactctgcaagagaacatgcagatccggactaaagtggcaggcatttaccgggagctttgccttgaatctgttaaaaataagtacgagtgcgaaatccaggccagtcgccaacattgcgagtccgagaagcttctgctgtatgacacggtacagtctgagctggaggagaagattcgaagactcgaagaagacaggcactccatcgacatcacatcagagctttggaacgatgaattacaatctcgaaaaaaacggaaagatcccttttccccagataaaaaaaaacctgttgtggttagcggtccatatattgtgtacatgttgcaggatctggacatcctggaagactggacaaccatccggaaagccatggcaacgctcggccctcacagagtgaagaccgaacctccagtcaaactggaaaagcacctccatagcgcacgctccgaagagggaaggctgtattatgacggcgaatggtacattaggggccagaccatttgtatcgataaaaaagacgagtgccccacttccgccgtcattactacgatcaatcacgatgaagtctggtttaagcggccagacgggtctaagagtaaattatatattagccagctccagaaaggcaagtattctataaaacatagttag

SEQ ID NO: 11373 - DNA, 1614 bp, Artificial Sequence
  Description of Artificial Sequence: Synthetic coding sequence
atgggcgctaccggtgcagccgaaccacttcagagtgttctgtgggtgaaacagcaacgatgtgctgtgagcctcgagcccgctcgagcacttctgcggtggtggaggtctccagggcccggcgctggcgcacctggcgccgacgcatgtagtgtaccagtatccgagatcatcgccgttgaggaaacggatgtgcacggaaagcaccagggctcaggcaaatggcagaagatggaaaaaccctacgccttcacagtccactgcgttaagcgcgcgcggcgtcaccgttggaagtgggcacaagtcacattctggtgcccggaggagcagctctgtcatctgtggctgcagactctacgagagatgctcgagaaactgacaagtcgccccaagcaccttctggtgtttataaacccttttggcggcaagggccagggtaagcgtatctacgaaagaaaggtggcccctctctttacactagcgtcaattacgaccgacattatcgtcacggagcatgctaaccaagcaaaggagactctgtatgagatcaatatcgacaagtacgacgggattgtctgcgtgggcggcgacggcatgttctcagaggtgctgcacggcctgataggccgcacccaacggtctgcgggagtggaccagaatcaccctagggccgtgctggtaccctcatcactgaggatcgggatcatcccagctgggagtaccgactgcgtctgctatagcactgtgggcacaagtgatgcggagacctccgccttgcacatagtcgtcggggactcactcgccatggacgtctcaagcgtccatcacaactccaccctgctgcgatatagcgtgtccctgctcgggtacggcttctacggagacataattaaggatagcgagaagaagagatggctcggcctcgctcgctatgattttagcggactgaagacttttctgtctcaccactgttacgaaggcacagtcagctttttgcctgcgcagcacacagttggttcccctcgggataggaaaccctgtagggcgggttgcttcgtttgtcgacagtccaagcaacagttggaggaagaacagaagaaggctctatatggactggaggccgcagaggacgtcgaagagtggcaggtggtttgcggcaaattcctggctatcaatgcgacaaacatgtcttgcgcatgtcgacggtccccacgaggactttctccagcggcccacctgggggatgggagctctgacctgatcctgattagaaaatgcagccggttcaatttcctgcggtttttgataagacacaccaatcagcaggaccagttcgattttacctttgttgaggtttatagagtcaagaaattccagtttacatccaagcacatggaagacgaggatagcgacttgaaagagggtggaaaaaaacgctttgggcatatatgtagctctcacccgtcttgttgttgcacagtttctaatagctcctggaactgtgatggcgaggtgctccactctccagctatcgaggttagggtgcactgtcagttggtccgcttattcgctaggggtatagaagagaaccccaagccggactcccacagttag

SEQ ID NO: 11374 - DNA, 2355 bp, Artificial Sequence
  Description of Artificial Sequence: Synthetic coding sequence
atgcagtccaggaaatgtcttaagcgggattgtgaccagcaggcagatggtttgtgccggttcggatcattcgattgctttagatccagtcgccgtagctcctccaccacccgtgcatggactagcgcttctagaacacgaacttcagaccggcttaacaggattgcgaaccaggtggctattcagcgaaaaaaacaattcgtggagagagcccactcctactggctgctgaaacgtctgtccaggaacggtgctccattactaagacggcttcagtcttcactgcagtcacagcggagctctcaacagcgggagaacgatgaggaaatgaaggccgccaaggaaaagctgaaatattggcaacgcctccggcacgacctagaaagggctcgcctgctcatcgaactgctgcgaaagcgggaaaaattgaaacgggaacaagtgaaggtggagcaggtagcaatggaattgcgccttaccccattaactgtcctgctgaggagtgtgctcgatcaactgcaggataaggaccctgcgcggattttcgcccaaccagtgtctctcaaagaagttcccgactacctggatcacatcaaacaccctatggacttcgctactatgaggaagcgtctggaggcacagggctataaaaatctgcatgagttcgaggaggacttcgatcttataatagataattgtatgaaatacaatgcgagagatacggtgttctaccgcgccgcggttaggttaagggaccagggcggggtggttctgcgacaagccaggcgcgaggttgatagtatcgggttagaagaagcttccggcatgcatctcccagaaaggcccgcggcagccccccgccggccattctcctgggaggatgtggacaggcttctggatccggccaatcgagctcatctcggactcgaggagcagctgagggaactgctagatatgctcgatctgacctgcgctatgaaatccagcggcagccgttccaaacgcgctaagctcctgaagaaagagatcgcgcttctgaggaacaaactcagccagcagcattcgcagcccttgccgactggcccgggtttggaagggttcgaagaggacggagctgccctcggtcctgaggcaggagaggaaggcgataagagtccacctaagcttgagccaagcgacgctctacccttgccaagcaattcagagacaaactctgaaccacctacgttgaaaccagtagagctgaatcctgaacagtcgaaactattcaagcgggtgacgttcgacaatgaaagtcactctgcctgcacgcagagcgcactggtgtcagggcggccacctgagcccaccagggcttcatctggcgacgtgccggccgccgcggctagtgcagttgcggaacctgccagcgatgtcaatcggagaacctctgtcctgttttgtaagagcaagtctgtgagcccgccaaaaagcgctaaaaacaccgaaacacaaccaacaagtccccagctgggaactaaaacctttctgtcggtagtccttcctcgtctcgagactctcctacagcctagaaaacggagccgtagcacatgtggcgactcggaggttgaagaggagagtccagggaaacgacttgatgccggcttaaccaacgggttcggcggtgccagaagcgagcaagaaccgggtggcggtctggggcgtaaagccactccaaggcgacgctgcgccagcgagtcttcgatatcctcttctaacagccctctgtgtgactccagctttaatgctcccaaatgcggacgaggaaaaccagccctggtgagacggcacacgctggaggatcgatctgagttgatatcctgcatcgagaacggcaactacgctaaagccgcaagaattgcggccgaagtgggacagtcctctatgtggatctcgacagacgcagctgcttccgtcctggaaccgctaaaggtggtttgggccaagtgctcaggatatcccagctaccctgctcttatcattgatcctaaaatgccgagggttcctgggcatcacaacggggttacgatacctgctccacctctcgacgttctgaagatcggcgaacacatgcagacaaaatcagacgagaagctgtttttagtgcttttcttcgacaataaacggtcttggcagtggctgcctaagtcaaagatggtgcccctcggaattgacgagactattgacaaactgaaaatgatggaagggagaaatagcagtattagaaaagctgtcagaattgcgttcgaccgggctatgaaccacctgagcagagtccacggagagcccacctccgacttgtctgatatagactag

SEQ ID NO: 11375 - DNA, 3177 bp, Artificial Sequence
  Description of Artificial Sequence: Synthetic coding sequence
atgagacggaagggcaggtgccaccgcggcagcgcggcaagacatccatccagtccctgtagtgttaaacactcccctacaagggaaacactcacatatgcacaggcccaaaggatggtcgaaattgaaattgagggtcgactgcataggatttccatcttcgatccactcgaaataattctggaggatgatcttacagctcaggagatgtccgagtgcaacagcaacaaagaaaacagtgagcggccgcccgtctgccttaggacaaaaaggcataagaataacagggtgaaaaagaagaatgaggccctcccatcagcacatggaacacccgccagcgcctctgccctccccgagcccaaggtgcgaatagtcgaatattccccgcccagtgctcctcggagaccacctgtgtactataaattcatcgaaaagagtgcggaagagttagacaacgaggtcgaatatgatatggacgaggaggattacgcatggctggagatcgtgaatgagaaacgaaagggcgactgcgtacctgcagtatcccagagtatgtttgagttcctgatggatcgcttcgagaaggagagccattgtgaaaatcagaagcagggcgaacagcagtcactgattgatgaggatgcagtgtgctgcatttgtatggatggagagtgccaaaattccaacgtgatattattctgcgatatgtgtaatctggccgtgcatcaggaatgttatggggtgccatacattcctgaggggcaatggctttgtcgccactgtctccagtcacgggctcggcctgccgattgcgttttgtgccctaacaagggcggggctttcaagaaaaccgatgacgaccgttggggtcatgtggtctgtgcattgtggatacccgaagtagggtttgctaatacagtgttcatcgaaccgattgacggcgtcaggaacattccacccgccagatggaagctgacctgttacctctgcaaacagaagggcgtaggcgcctgtattcaatgccacaaggcaaattgctatacagcattccatgtgacgtgcgcacagaaggccggcctctatatgaaaatggagccggtgaaagagctgacaggcggcggcacaaccttcagtgttcgtaagaccgcttattgtgacgtacatacaccccctgggtgtacacgccgcccactcaacatctacggcgatgtagaaatgaaaaatggcgtgtgcaggaaggaatcctcggtaaaaaccgtgaggtcaacttcaaaggtaagaaagaaagctaaaaaggcaaaaaaggcactggcggaaccctgcgcggtgctgccaacagtttgcgccccttacattccacctcagaggctgaatcggattgccaaccaggttgctatccagaggaaaaagcagtttgtggaacgagctcactcttattggctgctcaagagactgtcgagaaacggggcccctctgctgcggagactccagtccagtctgcagtctcagaggtcttcccagcaaagagaaaacgacgaggagatgaaagccgctaaggagaaactcaaatattggcagaggctgagacatgacctggaaagagctcgcctgttgatagaacttctacgcaagcgtgagaaactcaagagagaacaggtcaaggtggaacaggtggccatggagctgcggttaactcccctgacagtgctacttcgatcagtactcgatcagttacaagacaaggaccctgcaaggattttcgctcagcccgtgtctcttaaagaggttccagactaccttgatcacataaaacaccccatggacttcgccactatgcggaagcggcttgaagcccagggctacaagaacctgcacgaatttgaagaggacttcgacctcatcatagacaactgcatgaagtataacgccagagacacggtgttttatcgcgccgcggttagactgcgagatcagggtggtgtggttcttaggcaagctcgaagggaagtcgattctattggcctggaagaagcctctggcatgcatttaccagagaggccagctgccgcaccccgccggcctttttcatgggaagatgtggaccgattgctggaccccgcaaatagagcacatctgggactggaggaacaactacgggagctactagatatgctggatttaacgtgcgctatgaagagtagcggaagccgaagtaagcgtgccaagctcctcaaaaaggagattgcattgctgagaaataagctcagtcagcaacattcgcaaccattacccaccggccccgggctggaggggtttgaagaagatggtgcagctctgggcccggaggctggcgaagaagtgctcccgcggctggaaaccctgctgcagcccaggaaaagatctcgtagcacgtgcggcgacagcgaggttgaagaggagagcccgggaaagagactagacgctggactgaccaatgggtttggaggtgcccgaagcgagcaggaaccaggtggtggactcgggcgcaaagcaactcctagacggaggtgtgcatctgaatctagcatatcttccagcaattcacccctctgtgactcttcctttaacgctcctaagtgcggcaggggaaaacccgctctagttagacgccacacactcgaggacagatccgagttgatctcttgtatagagaacgggaactacgccaaggccgcgcgtattgcagctgaggtgggacagtctagcatgtggattagcacagacgcagccgcttctgtgctcgagcccttgaaggtggtttgggccaagtgcagtggctatccaagttaccctgcactgattattgacccaaaaatgccccgggtgcccggacaccataacggggtgactattcctgctccgcccctggatgtgctgaaaattggagagcacatgcaaacaaaatccgacgaaaaactatttctggtcctcttttttgataataaaaggtcctggcaatggctccccaagtctaagatggttcctctggggattgatgagacaatagacaagctcaaaatgatggaggggcgaaactcatcaatcagaaaagcagtcaggatagcctttgaccgcgctatgaaccacttgagccgggtgcacggggagcctacgtccgatttgtccgatatcgattag

SEQ ID NO: 11376 - DNA, 1950 bp, Artificial Sequence
  Description of Artificial Sequence: Synthetic coding sequence
atgaaagccgccaaggaaaagctcaaaagagagcaggtcaaagttgagcaggtggccatggagctgcggttaaccccactcactgtacttctccgctccgtcctggaccaacttcaagacaaggatccagctcgcatttttgcgcaaccagtctcgttgaaggaggtaccggattacctggatcacattaaacacccaatggacttcgcaacaatgcggaagcgactggaagcccaagggtacaaaaaccttcatgaattcgaggaggactttgatctgattatagacaactgcatgaagtacaatgcacgggacactgtgttctaccgagccgcagtgcgcttacgggatcaaggcggcgttgtgttgcgccaggctagaagggaagttgatagcatcggtctagaggaggcctcaggaatgcacttgccggagcgccccgcagcggcaccgagacgtcccttctcatgggaggacgtggataggctgctcgacccagccaacagagctcatctcggactagaggaacagctacgcgagctccttgacatgctcgacctgacttgtgccatgaagtcctccgggagccgtagcaagcgcgccaagttactaaagaaagagatcgcactgcttagaaacaaactgtctcagcaacattcacagcctcttcctactggacctgggctggagggattcgaggaagacggggccgcccttgggccggaagccggtgaggaaggtgataaatccccgcccaagctcgagccaagcgatgcgctccccttgccatcaaactccgaaacaaacagcgaacctccaactcttaaacccgtggagctgaatcccgaacagtcaaaactctttaagcgcgtgaccttcgataatgagtcccactcggcctgcacccagtccgccttagtgagtggcagacctcccgagcctacccgcgcatcctccggagacgtgcccgcagcagctgctagtgctgtagcagaacctgcctccgatgtcaaccggcgaacgagcgttctattctgcaaaagcaagagcgtgtctcctcccaaaagcgccaaaaacactgaaactcagcctaccagcccgcaactgggcaccaagactttcctgagtgtggttctgccaagactggaaacccttctgcaaccccgaaaacgctccaggtccacttgcggggactctgaggtagaggaagaatctccagggaaacgactcgatgccggcctcacgaatgggttcgggggcgcgaggagtgagcaggagcccggggggggcctgggacgcaaagccacccctaggcgtcgatgcgcctctgaatcatcaatttcttcaagcaactcccctctttgtgactcaagctttaacgcccccaagtgcggtaggggcaagccggccctggtgcgtcggcacaccctggaggatcgctccgaattgatttcgtgtattgagaacggaaattacgccaaggccgcccggatcgccgctgaagtcggtcagtcctccatgtggattagtactgatgctgcagctagcgtactggaacctttgaaggtggtgtgggctaagtgctctggttatccatcatatccagcactgattatcgaccccaaaatgcctagagtgccggggcatcacaacggagtgacaatacctgctccacctttggacgttcttaaaattggggaacatatgcagacaaagtccgatgagaagttgttcctggtattgttcttcgataataaaaggagctggcagtggctccctaagtccaagatggtccctctgggcatagacgaaactatcgataaactgaagatgatggaggggcgtaactcttctattaggaaggctgttcgcattgccttcgatcgcgccatgaaccatctatcaagggttcacggcgaaccgacaagcgacttatctgacatagattag

SEQ ID NO: 11377 - DNA, 2988 bp, Artificial Sequence
  Description of Artificial Sequence: Synthetic coding sequence
atgcgccgaaaggggcggtgccaccgaggcagcgcagcgagacacccaagcagcccttgttcggtgaagcatagccccaccagggagactttgacctatgcccaggcccagcgtatggttgaaattgaaattgaggggcggctccacaggataagcatcttcgacccactcgagatcattctagaagacgacctgacggcacaggagatgagcgagtgcaactcaaacaaggagaactctgagcggccgcccgtctgtctcagaacaaaacgacacaagaacaatcgagtaaaaaagaaaaacgaggctttgcccagcgcccacggaacccctgccagcgcgtcggcccttccagagccaaaagtcaggatagtggaatacagcccaccttccgccccacgcaggccacctgtctattataaattcattgagaagagcgcagaggagctggacaacgaggtggagtatgacatggatgaggaggattatgcctggctcgagattgtcaacgagaagcgcaaaggcgattgtgtgccagcagtgagccaaagcatgttcgagtttctgatggatcgatttgaaaaggaatcacattgtgaaaatcagaagcagggagagcaacagtccctgattgatgaggatgctgtgtgctgtatctgtatggatggtgaatgccagaatagtaacgttattcttttctgcgacatgtgcaacctggcggtgcaccaagaatgctatggcgtgccctacatccctgaaggtcagtggctgtgtcgacattgtctccaatcgcgggcacgcccagccgattgcgtgctctgccctaacaagggtggggccttcaagaaaaccgacgacgatcggtgggggcacgtggtatgtgcactctggattcctgaggtaggcttcgccaacaccgtcttcatagaacctatcgacggcgtccgtaatattccaccagctcggtggaagttgacatgctacctgtgtaagcagaaaggtgtgggcgcgtgtatccagtgccataaagcaaactgctataccgccttccacgtaacatgcgcgcagaaggctgggctctacatgaagatggaacccgtaaaagagctgacaggagggggtaccacattctccgttcgcaagactgcttattgtgacgtccatacaccacccggctgtacacgaaggccccttaatatctatggagacgtggagatgaagaatggtgtatgccgcaaagagtcgtcagttaagacggtaaggtccacctctaaggtacgcaaaaaggccaagaaagcaaaaaaggcactcgcggagccatgcgccgtcctaccgactgtttgcgcaccctatattccacctcagcgcttgaatagaatagctaaccaggtcgcgatccagcgcaaaaaacaatttgtggaacgcgcccactcctactggttactcaagcgcctttccaggaatggagcccctctgctgaggcggctgcagtctagccttcaaagccagagatcctcgcagcagcgagagaacgatgaggagatgaaggccgctaaagagaagttgaaatactggcaacgcctgcgtcatgatctagagcgtgcacggctcctgatagagctgctacgtaagagggaaaagctgaaaagagagcaggtcaaggtggaacaagtcgccatggaactgaggcttacacctctgaccgttcttctccgatctgtcctcgatcagctacaagataaggatcctgctcgaatatttgcgcagcccgtgagcctcaaagaagtgcctgattacctggaccatataaaacaccctatggacttcgccacgatgcgcaaacggctcgaggcccagggttacaagaatctccacgagttcgaagaagacttcgatctgattatcgataattgcatgaagtataacgcccgggacactgtgttctacagagctgctgtgaggctacgcgatcaggggggagttgtcttacgccaggcccgacgtgaagtggatagcatcggcctggaggaagcttccggaatgcacttacctgaacgcccggccgcagcgccccggaggcccttttcgtgggaagatgtggaccgactcctcgaccccgccaatagggcccatctaggcctggaggaacagcttcgggagctactggacatgctcgatctgacgtgtgcaatgaaaagcagcggtagtagatccaagagggcaaaacttctgaagaaggagatcgccctcctgcggaataagttgtcacagcagcactctcagcccctacccactggcccaggactcgaagggttcgaagaggacggtgctgctctgggaccggaggccggagaggagggcgacaagtctcccccaaaactcgagccctccgatgccttgccccttccgagcaattcggaaacaaatagcgagccaccaactctcaaaccagttgagctgaatccagaacagagtaaactcttcaagagggtgactttcgataacgaaagccactccgcctgtacacagtccgctctggttagtggccgccctccagagccaactcgggcctctagcggggacgtacccgctgccgcagccagtgccgtggcagaacccgccagtgacgtaaaccgccgcactagcgtcttgttctgtaaaagtaaatcttcatttagggggtggcgattgttttgtagtcaagggaagggaaggggagcccacgcagaaacccccaggtggcggaggtcgccccaggagtctgcctggacgcaagtctcaccaacagcgctgggcgtacgcggtgcttcaaggtccagggccgcggcatggggcggaaggccccatccagacgacgcagtgcccccaagtccagctagcccacctgctacagcccggagcgctacacgggctttgatgaggcccaatgtgggaggggccaatcgcctgctttgtgacgggactcgttggcgcaccgctgtgagctag

SEQ ID NO: 11378 - DNA, 2241 bp, Artificial Sequence
  Description of Artificial Sequence: Synthetic coding sequence
atgaagatggaacccgtgaaagagctgactggaggtggcaccactttctcagtgaggaaaaccgcctactgtgacgttcataccccccctgggtgcactaggcgtccacttaacatctacggggacgttgaaatgaaaaatggggtttgtagaaaggagtccagcgtgaagaccgtgcgctctacttcgaaggtgcgcaagaaggccaaaaaggccaagaaggcactcgctgaaccttgtgccgtcctgcctactgtttgtgcgccgtatattccaccccagcgtttcattaggatgcagtcacgcaaatgcctcaagcgagactgtgaccagcaggctgatggcctttgtcgatttgggtcattcgactgtttccggagtagtcgaaggagtagttcaaccacgcgcgcgtggaccagcgctagccggaccagaacaagcgaccgcctcaatcgaatcgccaatcaagtggccatccagaggaaaaaacagttcgtggagcgtgcacattcatactggctccttaaacgcctttcccgaaatggagccccattgttacgaaggctgcaatcatccttacaaagtcagagatcgagtcagcagagagaaaatgatgaagagatgaaagcggccaaggagaaactgaaatattggcaacggctgcgtcacgacctggaacgcgccaggttgctgatagagctcctccgaaagcgggagaagctcaaaagggagcaggtgaaggttgagcaggtggccatggaactccgccttaccccgctgaccgtgctccttcgatcagtgctggaccagctgcaagacaaggatcccgcgcggatctttgcacagcccgtgcctgactatctcgaccatataaagcaccccatggacttcgccaccatgcggaagcggctagaggcccaaggttataaaaacctccacgagttcgaagaggattttgatctgatcatcgataactgtatgaaatataatgctagggatacggtgttctacagggcggcggtccgcctcagggatcagggcggagtcgtgcttagacaggccagaagggaggtcgactctattggactggaagaggccagtgggatgcacttgcctgaaaggccagcagccgctcctcggcggcccttcagttgggaagatgtcgaccgcctgctcgatccggctaatagagcacatctgggattagaggagcagctgagagagctactggatatgctggacctgacctgcgccatgaagagctcggggtctagaagcaagcgggccaagctcctgaagaaggagatagcactgctccgaaacaaacttagtcagcagcacagtcagccactgccaaccggtccaggtttggaggggtttgaggaagatggtgccgcactgggccccgaggctggggaggaggttctcccaaggcttgaaactctcctccagcctaggaagaggtcacgatcaacctgcggagacagcgaggttgaagaagagagccctggtaaaagactggacgccgggttgaccaacgggttcggtggcgccagatccgagcaagaacctggcggtgggctcggcagaaaagccactccgcggagacggtgtgcgtctgaaagtagtatatcaagctcaaatagccctctctgtgattccagcttcaatgctcctaagtgtggcagaggaaagcccgcgcttgtgcggcgccatactctggaagatagatcagagctcatttcatgcattgagaacggtaattacgctaaagccgcaagaattgccgctgaagtggggcagtcctctatgtggatcagcactgatgcggccgcaagcgtgttggagccattgaaggttgtatgggctaaatgttccgggtacccgagctaccccgcccttatcatagatccgaagatgcctagggtcccgggccatcacaacggagtgaccattcccgcaccaccactggatgtcctaaaaatcggagagcatatgcagacgaagtctgatgaaaaactgtttctggtgctttttttcgataataaacggtcatggcagtggctgcccaagtccaagatggtccccctagggatcgacgaaacgatagacaagctgaagatgatggaagggcgaaattcgtcaattcgcaaggcggttaggatcgctttcgatagggccatgaatcacctgagtagggtgcacggcgagccaacctcagacctgagcgatatagactag

SEQ ID NO: 11379 - DNA, 2181 bp, Artificial Sequence
  Description of Artificial Sequence: Synthetic coding sequence
atgtccactgctacgacagtggctcctgctggcatccctgccacccccggccctgtgaacccccctccgccagaggtaagcaaccccagcaaacctggtagaaagactaaccagcttcagtatatgcaaaacgttgtcgtcaagactctctggaaacaccaatttgcttggccattctatcagccagttgacgccatcaaactcaacctccctgattaccacaagatcattaagaaccccatggacatggggactattaaaaaaagactggaaaacaactattactggtccgctagcgagtgcatgcaagattttaacaccatgttcacgaattgctatatttacaataagcccaccgacgacattgttctcatggcccaggccctggaaaagatcttcctccaaaaggttgcccagatgccccaagaggaggtggaactattgccacctgcacccaaaggcaagggccggaaaccagcagcaggtgcacagtctgcaggcacccagcaagtggctgcagttagctcagtatcccctgctacccctttccagtcggtgcccccaaccgtgagtcagacgcccgttattgccgcaacacctgtgccaaccattactgccaatgtcacttccgtccctgtcccgcccgctgccgcgccgccccctcccgcaacccccatagtgcctgtggtgcccccgacccctccggtggttaagaagaagggagttaaacgaaaggcagacacaacaacccccaccacctccgccatcacggcttcccgaagtgaaagtccgcctcctctgtccgaccccaagcaggctaaggttgtggcccggagggagtcgggaggacgcccaataaaaccccctaaaaaagacctcgaggacggagaggtgccccagcacgccgggaagaaaggcaagctgagtgagcacctacgatattgtgattccatattgcgagagatgctctcaaaaaagcatgcagcgtatgcttggcctttttacaaacccgttgatgccgaagcattggagctccacgactatcacgatattataaagcatcctatggacctgagtacggtgaagagaaagatggacggaagggaatacccagacgcccaggggtttgctgcagacgtgagattaatgttttctaactgttataagtataaccctccagaccacgaggtggtggccatggcccggaaacttcaggacgtgttcgagatgaggttcgctaaaatgccagacgagcccgtggaagcacctgcactccccgctcccgcagcgccaatggtcagtaaaggcgctgagtcttcacgctcgtcggaagagagcagctccgattccggcagctccgactctgaggaggagcgggcgaccagactcgccgagctgcaagaacagcttaaggcggtacatgagcagctggccgcgctgtctcaagcaccagtgaacaaacccaaaaagaagaaagagaaaaaggagaaggaaaagaaaaagaaggacaaggagaaagagaaagagaagcacaaggtcaaagctgaagaagagaagaaagcgaaagtcgctcccccagccaagcaagctcagcaaaaaaaggcacccgccaaaaaggcaaatagcaccaccactgcaggccgacagctgaagaagggaggaaaacaggctagtgccagctacgatagcgaggaggaagaagagggcctgccaatgtcatatgacgagaagaggcagctgagtctggatataaacaggctgcctggcgagaaactgggtcgagtggtgcatatcatacagtcccgcgaaccttccttacgagacagcaatcccgacgaaattgagattgatttcgagacattgaagcccacaacactgcgagagctggagcgctatgtcaagagctgccttcagaagaaacaaaggaaaccattctctgcgtctggaaagaaacaggccgctaagagcaaggaggagctggcccaggagaaaaagaaagaactcgagaagcggctgcaggacgtgtcgggtcaactgtcctcctcaaaaaagccagcgcgcaaggagaaacctggaagcgccccgtccggaggtccctctcggctgagtagcagctcttcctccgagtctggaagcagctcttcctccgggagctcctccgacagttccgattctgaatag

SEQ ID NO: 11380 - DNA, 1671 bp, Artificial Sequence
  Description of Artificial Sequence: Synthetic coding sequence
atgagtactgctacgaccgtcgctccagctgggatccccgcgacacccggccctgtgaaccctccaccaccagaagtttcaaacccatccaaacccggaagaaagaccaatcagctgcagtatatgcagaacgttgtggtgaagacgctatggaaacatcagttcgcttggcccttttatcagcctgtggatgctattaaattgaacctgcccgactaccacaaaataatcaaaaatcccatggatatggggaccatcaagaaacgcttggaaaacaactattattggtctgcctctgaatgtatgcaggactttaataccatgttcacaaattgttacatctacaataagccgaccgatgacatagtgttgatggcccaggctctcgaaaagatcttcctccagaaggtggcccaaatgccgcaagaggaggtagaattgctcccccctgcgcccaaaggaaagggtcgcaaacctgctgccggtgctcagtcagctggaacccagcaggttgcagcagttagttctgttagtcccgctaccccgtttcagagcgtgcctcctacagtcagccaaacccccgtaatagcggccacgcctgtgccaacgattaccgccaatgtgacctccgtgccggtgccacccgcagccgcgcctccaccaccggccactcccattgttccagtcgtacctcccacaccaccagttgttaaaaagaagggcgtcaaaaggaaagccgataccaccacaccgaccacaagcgctatcacagctagccggagtgagtcccctccccctctcagtgatcccaaacaggctaaggttgtggctcgtcgagaatccggcggtcgccctataaagccacctaaaaaggacctcgaggatggcgaagttccacaacatgctggcaaaaaggggaaactcagcgaacatctgagatattgtgactccatcctgcgggagatgctttcaaagaaacacgccgcatatgcatggccattctataagccggtggatgcggaggctctggagcttcacgattatcatgatattatcaaacatcccatggacctatctacagtgaaaaggaagatggatggtagggaatacccggacgctcagggatttgcagccgatgtgagactgatgttctctaattgctacaagtacaaccctccagatcacgaggtggtagcaatggccaggaaactgcaggatgtgtttgaaatgcgctttgctaaaatgcccgatgaacctgttgaagcccccgcactgcccgcccccgccgccccaatggtgtcaaaaggcgcagagtcatcacgcagcagtgaggagtctagttcggatagtggaagttctgattcagaagaggaacgggccacaaggctggccgaattgcaggagcagctgaaggccgtgcacgagcagctggccgccctgagtcaagcgccagtgaataaaccgaagaaaaagaaggagaaaaaagaaaaggagaaaaaaaagaaagataaagaaaaggaaaaggagaagcataaagtaaaagcagaagaggagaagaaagcgaaggttgcgcctcctgccaaacaagcccagcagaaaaaagcccccgccaagaaggccaatagtacaactaccgccgggagagatcactttctcacatgcggcgtgtag

SEQ ID NO: 11381 - DNA, 1671 bp, Artificial Sequence
  Description of Artificial Sequence: Synthetic coding sequence
atgagtactgccactactgttgcaccagccgggatacctgctaccccgggtcctgtgaaccctccacctcctgaagtgtccaacccttctaaaccggggcgtaagacaaaccaactacagtacatgcagaacgtggtagtcaaaaccctgtggaaacaccagttcgcatggccattctatcagcccgtagacgcaatcaagctaaacctgcctgactatcataagattatcaaaaaccccatggacatgggtactattaaaaagcggttggagaacaattactactggtcagccagcgaatgtatgcaagatttcaatactatgttcacaaattgttatatctacaataaacctactgatgatatcgtgctgatggcccaggctctggagaagatatttctccagaaagttgcccaaatgcctcaggaagaggttgagcttttgccgcccgctcccaaagggaaaggcagaaagcccgccgccggcgcgcagtctgcaggaactcagcaggttgccgccgtgagtagcgtatcaccagccacgccattccagtccgtgccccctaccgtgagtcaaacgcccgttatcgctgccacccccgtgccaacaattacggcgaacgtgacttccgtccctgttccaccggcagcagccccacctcctcccgctacccccattgtgccagtggttcctcccacccctccggttgtaaagaagaagggggtcaaacgcaaggccgatacaactacccctacgacatcagccatcaccgcaagtcggagcgagtcgcccccacccctgagcgaccccaagcaggcaaaggtcgtggccaggagagagtcaggtggaaggccaattaagccaccaaagaaagatcttgaagacggggaggttccgcagcacgcgggaaaaaaaggtaaactgtctgaacatctgcgttactgtgatagtattctgcgtgaaatgctatctaaaaagcacgccgcttatgcctggcctttttataaaccagtggacgctgaggcacttgagctgcatgactatcacgatatcatcaaacacccgatggacctgagcactgtgaagagaaaaatggacggcagggaatatccggatgcacaaggtttcgctgccgatgtcagactgatgttttccaattgctacaagtacaacccacccgatcacgaggtggtcgcaatggccaggaaactgcaggacgtgtttgagatgcgctttgccaagatgccggatgaaccggtagaggctcccgccctgcccgcccccgctgcacccatggtttccaagggcgctgagagttcacgatccagcgaggagagcagctcggactctgggtcctctgacagcgaggaggaacgggcgacccggctggctgaactgcaggaacagctgaaagccgtacacgagcaactggccgccctctcacaggcccccgttaacaagccaaaaaaaaagaaagaaaagaaagagaaagagaaaaaaaaaaaggataaagaaaaggaaaaggagaagcacaaggtcaaggcagaagaggagaagaaggccaaagtggcaccacccgccaaacaagcccagcagaaaaaggcccccgctaagaaggcaaactcaaccaccaccgcaggccgggaccattttttgacatgcggagtctag

SEQ ID NO: 11382 - DNA, 225 bp, Artificial Sequence
  Description of Artificial Sequence: Synthetic coding sequence
atgagcacagccaccaccgtggcccccgctgggattcccgccacaccgggcccagtgaatcccccccctcctgaagtctccaatccttccaaacctggtcgcaagaccaaccagcttcagtacatgcagaatgttgtggttaagacactgtggaagcaccagtttgcctggcctttttaccagcctgtggatgcaattaaactgaatctcccggattaccactag

SEQ ID NO: 11383 - DNA, 63 bp, Artificial Sequence
  Description of Artificial Sequence: Synthetic coding sequence
atgagtactgccaccacagtggctccagccgggattccagctacccccggcccggtgaattag

SEQ ID NO: 11384 - DNA, 1218 bp, Artificial Sequence
  Description of Artificial Sequence: Synthetic coding sequence
atgctgagtaaaaagcacgcggcttatgcatggcctttctacaagccagttgatgcagaagcccttgagctgcatgactaccacgacataatcaaacaccctatggacttaagtaccgtgaaaaggaagatggatggaagagagtatcctgacgcacagggcttcgctgccgatgtgcggcttatgttcagcaattgttacaaatataacccgccagaccatgaggtcgtggctatggcccgcaaattacaagatgtctttgagatgcgtttcgccaagatgccagacgaacccgtggaggctccggctcttcccgcacctgctgcccctatggtgagcaaaggagccgaatcctcgcgatcctccgaagagagctctagtgattctggttcctctgactctgaggaggaacgcgcgactaggctggctgagctgcaggagcagctgaaggcagtgcacgagcaactggccgcactgtctcaggcacccgtgaacaaacctaaaaagaagaaggagaagaaggaaaaagagaaaaaaaaaaaggataaagaaaaggaaaaggaaaagcacaaggtgaaagcggaagaggaaaagaaggctaaggttgcaccccccgccaaacaggcacagcagaagaaggcaccagccaaaaaagctaactcaaccaccaccgccggccggcaactaaagaagggcggcaaacaggcttctgccagctatgacagtgaagaggaggaagaaggattaccaatgagttacgatgaaaaaagacagctgagtctcgacatcaataggctacctggagagaaacttgggagggtggtgcatatcatccagagccgtgaaccttctcttcgggatagtaatcccgacgaaatagagattgattttgagactctcaagcccaccacactccgagaattagaaaggtacgtaaaaagctgtttgcaaaagaagcagcgcaagccctttagcgcctctggtaagaagcaggcggccaagagcaaggaagaattggctcaggagaagaagaaggagcttgagaagcgcctccaagatgtctctggccaactgtctagttcaaaaaagccggcccggaaagagaagcctgggtctgccccctcagggggccccagtcgcctgtcttcttccagcagcagtgagtccggctcctcatcttcttcgggatcgagcagcgactctagcgattccgaatag

SEQ ID NO: 11385 - DNA, 1062 bp, Artificial Sequence
  Description of Artificial Sequence: Synthetic coding sequence
atggcagcaacaaaacggaagcgtcgcggtggctttgcagtccaggcaaaaaaacccaaaaggaacgagatagatgccgaaccccccgcaaagcgccacgctacggccgaggaggtagaggaagaggagcgcgaccggatcccgggaccggtgtgcaagggaaaatggaaaaacaaagagcggattctcatcttttcctctagaggtatcaactttcgcaccagacacttgatgcaggacctgcgcatgctcatgcctcattcgaaggcagatactaaaatggacagaaaagacaagctgtttgtgattaatgaggtgtgtgagatgaagaactgcaacaagtgcatttatttcgaagccaagaaaaagcaggacctctacatgtggctgtctaatagcccacacgggccatccgcgaaattcctggtccaaaacattcatacacttgcagaactgaaaatgaccggcaattgcctcaaaggctcccgtccattactgagcttcgatccggcctttgacgaacttccccattatgctctgctgaaagaactccttattcagattttttccaccccaaggtatcacccaaagtcccagccctttgtagatcatgtgtttacctttacaattctcgacaaccgcatctggttcaggaactttcagattatcgaagaagacgcggctcttgtggaaatcggccctcggttcgtactgaaccttataaagatcttccagggctccttcggcggacctaccctgtacgagaatcctcactaccagtctccgaacatgcatcggcgggttatccgaagtattaccgccgccaaatatcgtgaaaaacagcaagtcaaagacgttcagaaactgcgaaaaaaggagccgaaaacgttgctgccgcacgaccccactgccgatgtcttcgtcacaccggccgaagagaagcccattgaaatccagtgggtgaaaccagaacctaaagtggacctgaaagccagaaagaaacggatatataaacggcagcgcaaaatgaagcaacggatggattccggaaaaactaagtag

SEQ ID NO: 11386 - DNA, 1428 bp, Artificial Sequence
  Description of Artificial Sequence: Synthetic coding sequence
atggcaggcagaccacacccttacgacggaaattctagtgacccggaaaactgggaccgcaaactccactctcgcccgcggaaactgtataaacactcatcgactagcagccggatcgcgaaaggaggagtggatcataccaaaatgtccctgcacggggccagtggtggccacgaacggagccgggacagaaggcggagtagtgatcgctcccgggactcatcccacgaaaggacagagagtcagctcactccttgcatcaggaatgtgacatctccgacaagacagcatcacgtggagcgcgaaaaggaccactctagctctagaccgtccagcccccgtccacagaaggcatcaccaaatggctccattagctccgcgggaaatagttcccgcaatagctcacagtcctcctccgatggttcttgcaagaccgcaggtgagatggtctttgtttacgaaaatgctaaagagggagcccgtaacatcagaacaagtgagagagttacactgatagttgataatacccggtttgtcgtcgatccatctatctttacagctcagcctaacaccatgctggggcgcatgtttgggtcaggtcgcgagcataacttcacacgccccaacgagaaaggagaatacgaggtggctgaaggaataggaagcacagtctttagagcgattctggattattataagactggtattatccgatgtcccgacggcattagcatccccgaactgcgagaagcttgtgactatctatgtatctcctttgagtattctacaataaaatgtcgggacctgagcgctctcatgcatgaactgagcaatgatggcgcaagacggcagtttgaattttatctggaggaaatgattttgccgctcatggtggccagcgcccagtcgggagagcgggaatgccacatcgtcgtgctaactgacgatgatgtagtcgattgggacgaagaatatcccccacagatgggcgaggaatatagccaaattatttatagcacgaagctgtacagatttttcaagtatatagagaatcgtgatgttgccaaatcagtgttgaaagagcggggtctcaaaaagatacggctaggaatcgaaggatatcctacatacaaggagaaagtgaagaaacgtcccgggggtcgaccggaagtaatctacaattatgtgcagagacccttcatacgaatgtcgtgggaaaaggaagagggcaaaagcagacacgtggactttcagtgcgtgaagagcaagtcaatcacaaatttagccgccgcagccgccgatattccccaggatcagctagtggttatgcatcctaccccgcaggtggacgagttggatatcctgccaattcacccaccctctggcaatagcgacctggacccggatgcccagaatcctatgctctag

SEQ ID NO: 11387 - DNA, 195 bp, Artificial Sequence
  Description of Artificial Sequence: Synthetic coding sequence
atggccgggcggccacacccctatgatggtaattcctccgatcccgaaaattgggatagaaagcttcactccaggccaaggaagttgtataagcactcatcaacgtcatcccgcatagcgaagggcggggtggatcatactaagatgtccctgcatggcgctagcgggggacacgagcgaagcagggaccgttag

SEQ ID NO: 11388 - DNA, 201 bp, Artificial Sequence
  Description of Artificial Sequence: Synthetic coding sequence
atggcaggacgcccccacccatacgacgggaactctagcgaccccgagaattgggatcggaagctacactcgagacctcgaaagctctacaaacatagtagcactagttcccggattgctaagggaggtgtggatcacaccaaaatgtctttgcatggagcctccggaggacacgaacgctcgagggatcgcaggcggtag

SEQ ID NO: 11389 - DNA, 1137 bp, Artificial Sequence
  Description of Artificial Sequence: Synthetic coding sequence
atggccaggtgcggtgagggatccgcagcccccatggtactactaggcagtgccggggtctgctctaagggcctgcagagaaagggcccttgcgaacgccgccgactcaaagctactgtgagtgagcaactcagccaggatctactgagattactgagagaggagttccacaccgacgtgactttttctgttggctgcaccttatttaaagcccacaaggcggtgttattggctagggtgcctgatttttacttccataccatcgggcagactagtaattcccttactaatcaagagcccatcgccgttgagaacgtagaggctctggaatttcgcaccttcctgcagataatttacagcagcaaccgcaatattaaaaactacgaagaggaaatcctccgaaaaaagatcatggaaattggaatatcacagaaacagctggatattagctttccaaagtgtgaaaattccagcgattgcagcttgcagaaacacgaaattcctgaggacatctctgaccgtgacgacgatttcatcagcaacgacaattacgaccttgagcccgcttctgaactcggcgaggacttgttgaagctgtacgtgaagccctgctgccccgatattgacatcttcgttgatggcaagcgttttaaagcacacagagccatcctttcagcccgttcatcgtactttgccgccatgctctctggatgctgggctgagagcagtcaggagtacgtcaccctgcagggtattagtcatgtggagctaaacgtgatgatgcactttatttatggtggaacgctcgacataccagataaaaccaatgtggggcaaattttgaacatggctgacatgtacggcttggaaggattaaaagaggtcgccatctatatccttagacgcgactactgcaattttttccaaaagccagtccctcgcacactgaccagcattctggaatgtctgattatcgcccatagtgttggcgttgaatccctgtttgccgattgcatgaagtggattgtgaagcatttcgctaggttctggtctgaacggagcttcgctaacatcccaccggagatccagaagtcctgcttaaacatgctgatccaatccttggtcagcatcacttag

SEQ ID NO: 11390 - DNA, 918 bp, Artificial Sequence
  Description of Artificial Sequence: Synthetic coding sequence
atggcccgatgtggtgagggatccgccgctcctatggtgttactaggatctgctggggtttgcagcaagggtctgcagagaaagggtccctgcgaaaggcgacgcttaaaagcaacagtgtccgagcagctctctcaagatctgttacgactgttgagagaagagtttcataccgatgtcacgtttagcgtcgggtgcacgctatttaaggcgcataaggcagtacttctggctagagttccagatttttatttccataccatcggccaaactagtaactcactcacgaaccaagagcctatagcagtggaaaatgttgaagccctcgagttccggactttcctccagatcatttacagctctaaccggaacatcaagaactacgaagaggagattcttcggaagaaaattatggaaatcggcatctcacagaaacagctggacatcagctttcccaaatgcgaaaactcctctgactgctcacttcagaagcatgaaatcccagaggacatttctgacagggatgacgacttcatctctaatgacaattatgacctggagcctgccagtgaactgggagaagatctgctgaaactctacgtgaagccctgctgtccggacatagatatcttcgttgatggcaagcggtttaaagctcaccgcgccatactgtccgcccgttcgagctacttcgcagctatgctgtccggatgttgggcagagtcctcccaggagtatgttactttgcagggcatctcacacgtggagttgaatgtgatgatgcattttatctacgggggaacacttgatattcccgacaagacaaatgttggatacgtgtttctgtttaataacctgaaatacaagcgcgtgcgcttttgtttcgtcgagctttgctgtaaggtccttatgaaatag

SEQ ID NO: 11391 - DNA, 852 bp, Artificial Sequence
  Description of Artificial Sequence: Synthetic coding sequence
atggccagatgtggtgaaggttctgcggcccccatggtgttgctgggatccgccggggtctgctctaaggggctccaaagaaaaggtccatgcgaaagacgccggctgaaggctaccgtgtccgagcaactttctcaggatctccttagactccttcgtgaagagtttcatacagatgtgaccttttctgtcggttgcactctgttcaaagcacacaaagctgtcctcctggcgagggtgcctgacttctatttccacactattggacagacttcgaactcactgacaaaccaggagccgattgcggtcgaaaatgtagaggcgctggaatttcggaccttcctacagataatttatagcagcaataggaacatcaagaactacgaggaagagatccttcgtaagaagattatggaaatcggcatcagccagaagcagctcgatatctcttttccaaagtgcgaaaacagcagtgactgctctctgcagaaacacgagatacccgaagatatctccgaccgcgacgacgacttcatctccaacgacaattatgatctggagcccgctagcgaactgggcgaggacctcctcaagttgtatgtcaaaccatgttgccccgacatcgacattttcgtggatggcaagcggtttaaggctcatagggctatactcagcgcccggtctagctacttcgcggccatgctgagcggttgctgggccgagtcatctcaggaatacgtgaccctgcagggtatcagtcatgtggagttgaatgtcatgatgcacttcatttacgggggcactcttgacatcccagacaaaactaacgtgggcttattccccgaacactag

SEQ ID NO: 11392 - DNA, 360 bp, Artificial Sequence
  Description of Artificial Sequence: Synthetic coding sequence
atggcagggttgatgactatagttacatccctgctgtttctgggcgtgtgtgcccaccatattattccaacagggagtgtcgtgatcccatccccgtgttgtatgttttttgtgtcaaagcgaattcccgaaaacagggtggtgtcctatcaattatcctcacggagcacctgtctcaaggccggtgtgatctttaccacaaagaagggacagcagttttgcggtgacccgaaacaggaatgggtccagcggtacatgaaaaacctagacgccaagcagaaaaaggcaagcccacgggcgagggcagttgcagtgaagggccctgtccagcgctatccaggcaaccagaccacctgttag

SEQ ID NO: 11393 - DNA, 435 bp, Artificial Sequence
  Description of Artificial Sequence: Synthetic coding sequence
atgccaaaagtcaagcggtctaggaaggccccccctgatggttgggagctgatagagcccactctcgatgagctggatcagaagatgagagaagctgagaccgaacctcacgaaggaaagcggaaagtcgaatccctgtggcccattttccggattcaccatcagaagaccagatatatcttcgatttgttttacaagcgcaaggcaatctcccgggaactttacgaatattgtatcaaggaaggctatgccgataagaacctgatagccaagtggaagaagcaaggctatgagaacctgtgctgcttgaggtgcattcaaacgagagatactaactttggcactaattgcatctgcagggtcccaaaatccaaactggaggtgggccgaattatcgaatgtactcactgtggctgtcgcggttgcagcggttag

SEQ ID NO: 11394 - DNA, 312 bp, Artificial Sequence
  Description of Artificial Sequence: Synthetic coding sequence
atgcccaaagtcaaaagatcccgcaaggctccacccgacgggtgggaactcatcgaaccaaccctagacgaactggatcagaaaatgagggaagagctttatgaatactgtattaaggaggggtacgccgacaagaatctgatcgctaagtggaaaaagcaggggtacgaaaatctctgttgtcttcggtgcatacagactcgcgacactaatttcgggactaactgcatctgcagggtgcctaaatccaagctcgaagttggacggataatcgaatgcacccactgcggttgtcgaggctgcagcggatag

SEQ ID NO: 11395 - DNA, 1527 bp, Artificial Sequence
  Description of Artificial Sequence: Synthetic coding sequence
atgatttacgaggagtctaaaatgaatctggaacaagaaaggcctttcgtgtgcagtgcccccgggtgttcacaacgatttccaactgaggaccatctgatgatccatcggcacaagcacgaaatgaccctcaagttcccatctataaaaaccgataatatgttgtctgaccaaactcctactccaacaaggttcctgaaaaattgcgaggaggtgggactgtttagtgagcttgactgctccctggagcatgaatttcggaaggcacaggaggaggagtcttctaagcgcaatattagtatgcataacgcggtgggtggcgcgatgacaggtccgggaacccatcagctctcaagtgcgcggctcccaaaccacgacaccaacgtcgttattcagcaggcgatgccatcccctcagtctagctccgttatcactcaggctccttccacaaacagacagattggtccagtgccaggaagcttgagctccttattacatctgcacaacaggcaacggcaacctatgcctgccagcatgccgggcacactaccaaatccgactatgcccggatcttccgcagtactgatgccaatggagcggcaaatgtccgtgaactcaagtatcatgggtatgcagggccctaacttgtcgaacccttgtgcctctccacaggtacaacccatgcacagtgaggccaagatgaggctcaaagcagctttaacacaccacccagcggctatgtccaatggaaacatgaacaccatggggcatatgatggagatgatggggtcgcgccaagatcagacaccacaccaccatatgcactcacacccccatcagcaccagacacttcctccccaccacccatatccccaccagcatcagcaccccgcccaccacccacatccccagcctcatcaccagcagaatcatccacatcatcactcccacagccaccttcatgcccacccggcccatcatcaaacttcccctcacccacccctgcacaccggcaaccaagcgcaggtgagcccagcaacccagcaaatgcagccgacacagactattcaaccccctcagccaacaggtggtcgacgacggcgcgttgtggacgaggatccagacgaaagaagaagaaagtttctggagcggaatagggcggcagccacccggtgcaggcaaaaaaggaaggtgtgggttatgagcctagaaaagaaggccgaagagctgactcagacaaatatgcagcttcaaaacgaggtaagcatgctgaaaaacgaggtagctcaactcaaacagctgttactcactcacaaagactgcccaatcactgcaatgcagaaagagtctcaaggttatttgagccccgaaagctccccccctgcctcaccagtccccgcctgctctcagcagcaggttatccaacataacactattacgactagttcctctgttagcgaagttgttggatccagcacgttaagccaactcactacacatagaactgatctcaacccaatcctgtag

SEQ ID NO: 11396 - DNA, 1110 bp, Artificial Sequence
  Description of Artificial Sequence: Synthetic coding sequence
atgttctgcacaagcggaggaaactctgccagcgtgatgtctatgaggcccgtccccgggagcctatcctcattactgcacctccataaccgccagaggcagcccatgccagcctctatgcctggtactttgccgaatcccacaatgccagggtcttcggccgtgctgatgccaatggaaaggcaaatgagcgtaaatagtagcattatgggtatgcagggccccaacctgtccaatccttgcgcaagtcctcaggtgcaacctatgcatagtgaggctaaaatgcggctcaaagccgcactgactcaccaccctgcggctatgagtaacggtaacatgaacactatgggccatatgatggagatgatgggctcaaggcaggatcaaaccccccatcatcacatgcactctcatcctcaccaacatcaaacacttccaccccatcacccctaccctcaccagcaccagcaccccgctcatcatcctcacccacagccccatcaccagcagaaccaccctcaccaccacagtcacagccacctacacgcccatcctgcacaccatcagacttctccccatcctccactccatacgggtaaccaggcacaggtaagccccgcaacgcaacagatgcagcctacccaaacaatccagccgccgcagccaacaggggggaggagacggagggtggttgacgaagaccctgacgaacggcgccgcaagttcctcgaaagaaacagagccgcggccacacgttgcaggcagaaacgtaaagtgtgggtcatgagtcttgagaaaaaggctgaagaattaacacagactaatatgcagctccagaacgaagtaagcatgctgaaaaatgaagttgcccaactgaaacagctgctgttgacacacaaggattgcccaattactgccatgcagaaagaatcacagggctatctctcgccggagtccagtccgcccgcatccccagtgcccgcatgttctcaacagcaggtgattcagcacaatactataacaacctcgtctagtgtgtccgaagtcgtcggttcaagcaccctgtcccagctcacaactcatagaaccgacctgaaccccatactgtag

SEQ ID NO: 11397 - DNA, 1428 bp, Artificial Sequence
  Description of Artificial Sequence: Synthetic coding sequence
atgatccaccgccacaagcacgaaatgaccttgaagttcccctccattaagactgacaacatgttgtctgaccagacaccgactccaacccgcttccttaagaattgcgaggaggtgggcctgttttcggaactggactgctctctcgaacacgagttccgcaaagctcaggaggaggagtcctcaaagcggaatatatccatgcacaacgctgtgggtggtgccatgaccggacccggcacacaccagctctcaagcgccaggctgcccaatcatgatacaaatgtggtaatacagcaggctatgccgagtccccagtcctctagtgtgattacccaggctccctcaaccaaccgacagatcggccctgtccctggttccctttcctcacttctgcacctccataacaggcaaaggcagcctatgcctgcgagtatgcccggcaccctgccaaaccctaccatgcctggaagctctgcagtgttaatgccaatggaacgccagatgtctgttaactcttcaatcatggggatgcaaggtcctaaccttagtaatccatgtgcttcccctcaggtacagccaatgcacagcgaggctaaaatgcgcctaaaggctgctctaacacaccatccagcagctatgagcaatgggaatatgaacactatgggccatatgatggaaatgatggggtctcgacaggaccagactccacatcatcacatgcactctcatccccaccagcaccagacactccctcctcatcacccgtacccacatcagcaccagcaccctgcccaccatcctcacccccagcctcaccatcagcagaaccacccccaccaccacagtcacagccaccttcatgcgcacccagcacaccaccagactagcccacacccccctcttcataccgggaaccaggcgcaggtgagcccggccacacagcagatgcagcccacccagaccatccagcctccgcagcccacagggggcagacgccggagggtggtggatgaggatccagatgagaggagacggaaatttctcgaaaggaatcgtgccgctgccactcgctgtcggcagaagaggaaagtgtgggtcatgtcgttggagaaaaaggctgaagagctgacgcagaccaacatgcaactacaaaatgaagtttcaatgttgaaaaacgaagttgcccagctgaaacaactgcttctcacccacaaggattgcccaatcactgccatgcagaaggagagccagggttacctgtcaccagagagcagccctcccgcaagtccagttccagcatgcagccagcagcaggtgatccagcacaacaccatcaccacgagtagctctgtatcggaggtggtaggtagctctacacttagccaattgaccacccatcggaccgatctgaaccccattttgtag

SEQ ID NO: 11398 - DNA, 1506 bp, Artificial Sequence
  Description of Artificial Sequence: Synthetic coding sequence
atgaatttagagcaggaacgaccctttgtctgcagtgcacccggctgttctcagcgttttccaacagaggatcatttgatgattcacaggcataagcacgaaatgacactgaaattcccctcaattaaaaccgacaatatgctgtcagaccagacaccaaccccgaccagatttcttaagaactgtgaggaagtgggactcttttcagagctggattgcagcttagagcatgagtttagaaaggcccaggaagaggaaagctctaagaggaacattagcatgcacaatgccgtcgggggcgcaatgaccgggcccgggacacatcagctgtcgtcagcgcgtctgccaaatcatgacacaaacgtcgtcattcagcaggcgatgcctagcccacagagctcatccgtgatcacccaggctccatctaccaaccggcagatcggtcctgtgcctggatcactcagcagcctgctccatctccataaccggcaaaggcagccgatgcccgcatccatgcctgggactctgcccaatccaactatgcctggctcctccgccgtcctcatgcctatggaacgccagatgtccgttaatagtagtatcatggggatgcagggtcctaacttaagcaacccttgcgcttctcctcaggtgcagcctatgcactcagaagctaaaatgagactgaaagcggcactgacgcatcacccagctgcgatgagtaatggtaacatgaacacgatgggtcacatgatggagatgatgggaagtaggcaggatcagacgcctcatcaccacatgcactcgcacccacatcagcatcagacccttccgcctcaccatccatatcctcaccagcaccagcaccctgcccaccatccacatcctcagccccatcaccagcaaaaccatccacaccatcactcgcacagccatctgcatgcccatccggcccatcatcagacatcaccacacccaccactgcatacagggaatcaggctcaagttagccccgccacacagcaaatgcaaccaacgcagacaatacagccccctcagcccactggaggccgacgacgcagagtagtggacgaagacccggatgaacgccgtcgaaagtttctggagaggaaccgcgccgctgcaaccagatgtcgtcaaaagcgcaaggtctgggtgatgtcgctcgaaaagaaggcggaggagctcacccagactaatatgcagctgcagaacgaagtgtctatgcttaagaacgaggttgctcaactcaagcagctgctccttacacataaagactgtcccattacggccatgcagaaggagagccaagggtatttgtctccagagagctcccctcccgccagccctgtccccgcatgttcccaacaacaggtcatccagcataataccatcaccacttcttcgagcgtgtccgaggtggtcggctctagtactctgtcccagttaaccacccataggactgatctgaatcctatcctctag

SEQ ID NO: 11399 - DNA, 1428 bp, Artificial Sequence
  Description of Artificial Sequence: Synthetic coding sequence
atgatccaccgccataaacacgagatgaccctcaaatttccttctatcaaaaccgacaatatgctcagcgaccagacccccacaccaaccaggttccttaagaactgtgaggaggtgggactttttagtgagttagactgttccctcgaacacgaattcagaaaagcccaagaagaggaatcgtccaagcggaacatatccatgcacaacgcagtcggtggtgcaatgaccgggcccgggacccatcagctttcatcggcccggcttccaaatcatgacacaaacgtcgtgatccagcaagccatgccatctccccagagctcatccgtcattacacaggcgcctagcacaaaccgccagatcggtcctgttccaggatccctatcttctctgctgcacttgcataaccgtcaacgtcagccaatgccagcaagcatgccaggcactctgcctaaccctactatgcctggatcctctgccgttttaatgccgatggagcgccaaatgagtgtgaacagttcgattatgggtatgcaaggacccaacttgagtaacccctgtgcaagcccacaagtccagcccatgcactccgaagctaaaatgaggctgaaagctgcgcttacccatcacccagctgcaatgagcaacggcaatatgaatactatgggccacatgatggagatgatgggctccagacaggatcaaacacctcatcatcacatgcactcccacccccaccagcaccagaccctgcccccccaccacccgtacccccaccagcatcaacatcccgcccaccaccctcatccacagccccaccaccaacagaaccatccacatcatcacagccattctcacttgcacgcacaccctgcgcaccatcagacttctccccatccgcctctccacacaggcaatcaagcccaggtgagccccgccacacagcagatgcaacccacacagaccatccaacccccccagcccactggcggccggcggagacgggtagtcgatgaggaccccgacgagcggaggagaaagtttcttgaaaggaatcgagccgccgctactcgctgcagacagaagaggaaagtatgggttatgtcacttgaaaagaaggccgaggaactgacccagacaaatatgcagttgcaaaacgaggtgagtatgctcaagaacgaggtggcccagctgaagcagttgctcctaacgcataaggactgtcctattactgctatgcaaaaagagtctcagggatatctctcccctgaaagttcaccacccgcatcgcctgtgccagcatgctcacagcaacaggtgatccagcataataccattaccacaagctcaagtgttagtgaggtggtcggttcatctacattgtctcaactgactactcacaggacggatttaaaccctatactgtag

SEQ ID NO: 11400 - DNA, 348 bp, Artificial Sequence
  Description of Artificial Sequence: Synthetic coding sequence
atgaacctcgagcaagaacgaccattcgtgtgctcagcccctggctgtagccagcgtttcccaaccgaggaccatttgatgatacatcgacataagcacgagatgactctcaaatttccgagcatcaaaaccgataatatgttatcagatcagacacctacccctacccggttcctaaaaaattgtgaggaggtggggctgttctccgagctcgattgcagtctggagcatgagtttcgtaaagctcaggaggaggaatcgagcaagcgcaacattagtatgcacaatgccgtcggcggcgctatgaccgggcctggcacacaccagctgtccagcgcccggctgtag

SEQ ID NO: 11401 - DNA, 453 bp, Artificial Sequence
  Description of Artificial Sequence: Synthetic coding sequence
atgtcgaagatctcccaacagaactctacacccggagttaatggaatcagcgttattcacacgcaggcccacgctagcggactacagcaggttccgcagctagtgcctgcaggtcccggcggcggcggtaaggcagtcgcaccctccaaacaatccaagaagagttccccaatggataggaactcagatgagtatcggcagagaagagaaagaaataatatggccgtgaaaaaaagcagactgaaaagcaaacaaaaagcacaagatacactgcagcgggtcaaccaactcaaagaggagaacgaacgactggaggctaaaatcaaactgctaacgaaagaattatctgtacttaaagacctgtttctcgagcacgctcacaacttagctgacaacgtccagtctatttcaactgagaacacaaccgccgacggggataacgccgggcaatag

SEQ ID NO: 11402 - DNA, 1509 bp, Artificial Sequence
  Description of Artificial Sequence: Synthetic coding sequence
atggaaacgctgcaggaatccctgaacacacttctcaagcagctggaggaggagaaaaagaccctggaatcgcaggtgaagtactatgctctcaaactggagcaagaaagcaaggcgtaccagaagatcaataacgagcgcaggacgtaccttgccgaaatgtcgcagggctcagggctgcaccaagtttcgaagaggcagcaggtggatcagcttccccgcatgcaggagaacctggtaaaaacgctgcttttgaaggaggaactcgacccgctcaaggccaaaatcgatatcctcttggtcggtgatgtgaccgtaggatacttggccgacacagtacagaaactatttgcaaacatcgctgaggtgacgatcaccatttctgataccaaggaagcagctgcactgctggatgattgtatttttaatatggtgctcttaaaggtgcccagtagtctgagtgccgaggagctggaagcaattaagctgattaggttcggcaaaaaaaaaaacacccacagcctttttgtattcataatcccagaaaatttcaaaggctgtataagcggacacggaatggatatagctctgacggagcctctaaccatggagaaaatgagcaatgtcgtgaaatattggaccacctgtccaagtaataccgtaaaaacagagaacgccacggggccagaggagcttgggctgccgctccagagatcctatagtgagcacctaggatactttcctacagacctgtttgcttgtagtgaaagcttgaggaacggcaatggcttagagctgaatgcatccctatccgagttcgagaagaacaaaaaaatttcactcctgcacagctctaaagagaagctgaggagagaacggatcaagtattgctgtgagcaactcagaactttgcttccatacgtgaagggacgcaagaatgacgcagcatccgtgttagaggcgacagtggactacgtgaaatacatccgtgaaaagatttcgccagctgtcatggcacaaattacagaggcccttcagtccaatatgcgcttctgtaagaaacagcagacccccatcgagctctcattgcctggcaccgttatggctcaaagggaaaatagtgtcatgagcacgtacagccctgaacggggactgcagttcctgactaacacttgctggaacgggtgctccactccagatgcagaaagcagtctagatgaggcggtgagagtaccctcctcctccgcctccgagaacgctattggggatccctataagacacacatctcatcggccgccctgtcactgaattctctgcataccgtgaggtattactcaaaggtaacgccatcctacgacgcaacagctgtgaccaaccagaatatcagtatacacttacctagtgccatgcctccggtgtctaagctgcttcccagacattgcacttctggcctgggacaaacatgcaccacccaccccaattgtctgcagcaattttgggcctattag

SEQ ID NO: 11403 - DNA, 1533 bp, Artificial Sequence
  Description of Artificial Sequence: Synthetic coding sequence
atggaggaacctcaagccggagatgccgctaggttttcctgtccccccaacttcacagccaagcctcctgcaagcgagagccccaggtttagcctagaagctctgacaggcccagataccgagctgtggctgatacaggcccccgcggactttgcacccgaatgtttcaacggccgacacgtccctctgtccgggagccagattgtgaagggcaagctggccggcaagcgacaccgctaccgcgtgctgagctcatgtccgcaggccggcgaagcgacactgttggctccctcaaccgaagctggcggtgggctgacatgcgccagcgccccccaaggaactctcaggattcttgaaggaccacagcaatcactatcaggaagccctctgcaacccattcctgctagcccccccccccagatacccccgggcctacggcctagattctgcgcctttggcggcaacccgcctgtgacggggccaaggtcggccttagcaccaaacttgttaacgagcgggaaaaaaaaaaaggaaatgcaggtgacagaagcgcccgtcacccaagaagctgttaatggacatggtgcactcgaagtagatatggccctcgggtcacctgagatggacgtgagaaagaaaaagaagaagaagaatcaacagcttaaggaacccgaggctgctggcccagtgggtactgagcccaccgttgaaacactggagccactgggcgtgctgtttcccagtacgacaaaaaagcgcaagaaacccaaaggaaaggagactttcgaacccgaagataagacagtgaaacaggaacagatcaacacagagccactggaagatacggttttgagccctaccaaaaaacgcaagagacagaagggcacagagggaatggagcctgaagagggagtcaccgtggagagccagccccaggtgaaggtggaacccctcgaagaagccattccgctccctcccactaaaaaaaggaaaaaggagaagggccagatggccatgatggagccgggcactgaagccatggaaccagtcgaaccagaaatgaaacccctcgagagcccgggcggcactatggcgcctcagcaacctgaaggcgctaagcctcaagcccaagcagcacttgccgcccccaaaaagaaaaccaagaaggaaaaacagcaggatgccactgtggaacctgaaaccgaagtggtgggacccgagctgcctgatgacctggagccgcaggcggcaccaactagcactaagaagaaaaagaagaagaaagagagaggacacacagtgactgagccaattcagcctctggaacctgaactgcctggtgaaggccagccagaagcacgggcaacccccggaagcacaaagaaacgcaagaagcagtcccaggaatctaggatgcctgagactgtgccgcaggaggagatgcccgggcctccattgaactccgagagtggtgaagaagccccgactggacgggacaaaaagcggaagcaacagcaacagcagccagtgtag

SEQ ID NO: 11404 - DNA, 1446 bp, Artificial Sequence
  Description of Artificial Sequence: Synthetic coding sequence
atgcgccactcgaagcggacccactgtcctgattgggacagccgtgaatcatggggccatgagtcatacagaggcagccataagcgcaaaaggcgctctcacagtagcacccaggaaaaccgccactgcaagccacaccaccagttcaaggaaagcgactgccattatttggaggccagatccctgaacgagagggattacagagaccgcagatacgttgacgagtaccgtaacgactactgcgagggctacgtccctaggcactatcaccgggacatcgaaagcgggtaccggattcattgtagtaaatcctctgtgcgctcgagacgcagttctcctaaacgaaaaagaaacagacactgctcatcacatcaaagccgcagcaaaagtcacaggagaaagcgctcaagatccattgaggacgacgaggagggacacttgatttgtcaatcaggcgatgtcttgagggccagatacgaaattgtggatacgctcggagagggcgctttcggcaaagtggtggagtgcatcgatcacgggatggacggcatgcacgtggcagtaaaaatcgtaaagaatgtggggaggtatcgtgaagccgcgaggagcgaaattcaggtcctcgagcatttaaattcaacggatccaaatagcgttttcagatgtgttcagatgttggaatggtttgatcatcatggacacgtgtgcatagtctttgagctactgggtctgtctacttatgattttatcaaggaaaattcttttctgccttttcaaattgatcatatcagacagatggcatatcaaatctgtcaaagtataaattttttgcaccacaataagctcacccacacagatcttaagcccgagaatatactctttgtcaagagcgactacgtggtgaagtacaattccaagatgaagcgtgatgaacgcacgcttaagaacactgatataaaggttgttgatttcgggtccgccacttacgacgacgaacaccactccactcttgtgtcaacaagacattatagagcccccgaggtgattctagcactaggatggtcgcaaccctgtgacgtctggtccatcggatgcatcttaatcgagtattacctgggatttacagtgttccagactcacgatagcaaagagcacctggccatgatggagcggatactcggaccaataccccagcacatgattcagaagactaggaaaagaaagtacttccatcacaatcagctcgactgggacgagcactcctctgccgggcggtacgttcgcaggagatgtaagcctcttaaggagttcatgctttgtcatgacgaggagcacgaaaaactcttcgacctggtgcggaggatgctggaatatgaccccacccaaagaatcacactggacgaagcactccaacacccattcttcgacttacttaagaaaaaatag

SEQ ID NO: 11405 - DNA, 165 bp, Artificial Sequence
  Description of Artificial Sequence: Synthetic coding sequence
atgaggcacagtaagcgcacccactgtcctgattgggatagccgagagtcttgggggcacgaatcctaccgtggatcgcacaaacggaagcgacgctcccactcttccacacaggagaaccgccactgtaaacctcatcatcaattcaaagagtcagactggtag

SEQ ID NO: 11406 - DNA, 162 bp, Artificial Sequence
  Description of Artificial Sequence: Synthetic coding sequence
atgcgacatagcaagaggacacactgcccagactgggacagcagagaatcctgggggcacgagagttatcgtgggagtcacaaacggaaacgtcgctcgcactcctcaactcaggagaaccgacactgtaagcctcatcatcagtttaaagagtccgattag

SEQ ID NO: 11407 - DNA, 432 bp, Artificial Sequence
  Description of Artificial Sequence: Synthetic coding sequence
atgcgacattctaaacggacccattgtcccgactgggatagtcgagaatcttgggggcatgagagctacaggggctcccacaaaaggaaaaggaggagccactcttccactcaggagaatagacattgcaagccgcaccatcagtttaaggagagcgattgccattatctggaagctagatccttgaacgagagagattaccgagatagacgttacgtggatgagtatcggaatgattactgcgagggatacgtgccccgccattaccatagggatatcgagagcggctatcgcattcattgcagcaagtcctctgtgagaagccggagatcatcacccaagcgtaaacggaaccgtcactgctcttcacaccagtctcggtcaatgaagtcatggaccctgtgggtcaaagagcccctggccaagctttag

SEQ ID NO: 11408 - DNA, 270 bp, Artificial Sequence
  Description of Artificial Sequence: Synthetic coding sequence
atgcgccactcgaaaagaactcactgtccagattgggacagccgcgagagttgggggcatgaaagctatcgcgggtcccataagcggaaaagacgctcacatagttccacacaagaaaatagacattgcaagccacatcaccaatttaaggagagcgattggacatgcgtggatattaagacaaacgccctcacactgattcggctggggtatctgaagggctatagcgagatcttcactggtcactccgtggatatcctaaagaactag

SEQ ID NO: 11409 - DNA, 1122 bp, Artificial Sequence
  Description of Artificial Sequence: Synthetic coding sequence
atgcgacatagcaagcgcactcactgtccagactgggattcaagggaatcctggggtcacgaatcttataggggcagccataagcgtaagaggaggagtcatagctcaacacaggagaatcggcactgcaaacctcaccaccagttcaaggaatctgattgccattatctggaggcccgcagccttaatgagcgcgactacagggacaggaggtatgtagacgagtacaggaacgactactgcgaagggtacgtgccaagacattaccatcgggacatagaaagtggatatcgaatccactgttccaaaagctcagtgcgttcacgaagatctagtccaaagagaaagcgaaaccgccattgttcatcgcaccagtcccgatccaaatcgcaccgtcgcaaacggagtaggagtatcgaagatgatgaggaaggccatttaatctgccagtccggagatgtgctcagagcaaggtatgagatcgttgatacccttggagaaggggcttttggcaaagtagtagaatgtatagatcatggaatggatggaatgcacgtggctgtgaagatcgtcaagaatgtcggacgttatcgcgaggcagcaagatcagagatccaggtgctggagcatttgaactctaccgatccgaattccgttttcaggtgtgtgcagatgcttgagtggtttgatcaccacggtcatgtgtgcatagtctttgagctactgggactctctacctatgacttcattaaggagaactcctttctgcccttccagatcgatcacattcggcagatggcttatcagatatgccaatccattaatttcctccaccacaacaagctaacccacactgacctgaaaccagagaacatactgttcgtaaaatccgactacgtggttaagtacaattccaaaatgaaacgagatgagcactcctctgccggacggtatgtgcgaagacgctgtaaacctcttaaagaattcatgctttgccacgatgaagagcatgaaaaactttttgatcttgtaaggaggatgctggagtacgatccaacgcaacggattacactggatgaagcgctgcagcatcccttcttcgaccttttaaagaagaaatag

SEQ ID NO: 11410 - DNA, 2613 bp, Artificial Sequence
  Description of Artificial Sequence: Synthetic coding sequence
atgtttagccaacagcaacagcaacagctgcagcagcaacagcagcagctccagcagctgcaacaacaacagcttcagcagcagcaactgcagcagcaacaactgctgcagttgcaacagttgctgcagcagtctccaccacaggcgccactcccaatggccgtctctcggggtctgcctccccaacaaccacagcagccattgctgaacctgcaagggactaattctgcttccctcttgaacggaagcatgcttcagagggctctcttactccagcaattgcagggactcgaccagtttgccatgccacccgccacctacgacaccgccggtctgactatgccgacggccactctggggaacctgaggggctacgggatggcgtcccctggtctcgccgctccttccctgacacctccccagctcgccaccccaaacctgcagcagttcttccctcaggctacgcgccagtcattgttgggacctccacctgtcggggtgcctatgaacccctcccaattcaacttgtccggaaggaaccctcagaagcaggcacgcaccagctcctctacaacccctaatagaaaagactcttcgtcgcaaactatgcctgtggaggataaaagtgatccgcccgagggcagtgaggaagccgctgagccgcgaatggatacaccagaagaccaggatttgcccccttgtcctgaagacatagccaaggagaagagaaccccagccccagaacccgagccatgtgaggcctcagaacttcctgctaaacgcctacgaagttcagaggaacctaccgagaaggagcccccaggccagctgcaggttaaggcgcagccgcaggctcgcatgacggtgcccaagcagacccagactcctgacctgctccccgaagctctggaagcccaggtcctccccagattccaacccagggtgctgcaggtgcaagcgcaggtgcagtctcaaacacagcctcgtatcccttctacagatactcaggtacagccgaagcttcagaaacaggctcaaacgcagacaagccctgaacacctggtgctgcagcagaagcaggtccagccccagctccaacaagaggcggagccacagaagcaagtgcagccccaggtgcagcctcaggcccatagccagggccctagacaagtgcaactgcaacaggaagccgagccgctcaagcaggtgcagccacaggtgcatacgcaggcacagccctctgtgcaaccccaggagcaccctcccgctcaagtctccgtgcagccacccgagcagacccatgagcagccccacacgcagcctcaagtgtctcttttggcaccagaacagacacctgtggtagtacatgtgtgcggactcgagatgccccccgatgccgtcgaggctggcgggggtatggaaaagaccctccctgaaccagtcggcactcaggtgtcaatggaagagattcagaatgaaagcgcttgtggcttagacgtcggcgaatgtgagaatagggcaagggagatgcctggtgtctggggggctggcgggtctcttaaagtgactattctccagtcttcagactcacgtgccttctctacagtgccactgaccccagttccacggcccagcgactccgtatcatcaactccagctgcgacatcaaccccttccaagcaggctctacagtttttttgttacatctgtaaagcttcatgtagctcccagcaggagttccaggaccatatgtccgaacctcaacaccagcagcgccttggtgagatccagcatatgagccaggcttgcctactgtcactcctcccagtgccacgagacgtactagagaccgaggatgaggaacccccccccaggaggtggtgtaacacctgccagctttactatatgggcgatcttattcaacatcgccgcacacaggaccacaaaattgctaaacagtctctgaggcccttttgtacagtgtgcaaccggtactttaaaacaccccgaaagttcgtggagcacgtcaaatcccaggggcataaggacaaagccaaggaactaaagagcctagagaaagagatcgcaggccaagatgaagatcatttcataaccgtggatgcagtcgggtgtttcgagggggatgaagaagaagaggaggacgacgaggacgaggaggagatcgaagttgaagaggagctgtgtaagcaagttcggtccagagatatctctcgcgaggagtggaagggaagcgaaacttactctcctaacaccgcttacggagttgacttcctcgtcccggtgatgggatatatctgcaggatctgtcacaaattctatcactcgaattcgggcgcccagctgagtcattgcaagagtttaggtcactttgaaaatctacaaaagtacaaagcagccaagaacccgagtcctaccactagacctgtgtcccgacggtgcgcgatcaatgcgcgcaatgctctcacagccttgttcaccagtagcggtcggcctcccagccaacctaacacccaggataagacgccaagcaaggtcaccgcaagaccctcacagcccccactgccccgacgatccactcgcctgaaaacgtag

SEQ ID NO: 11411 - DNA, 759 bp, Artificial Sequence
  Description of Artificial Sequence: Synthetic coding sequence
atgttctctcagcaacagcaacaacagttgcagcagcagcaacagcagctccagcagctccagcaacagcagctccagcagcagcagcttcaacagcagcaactgttgcagctacagcagttgctccagcagtctccccctcaggcccctctccccatggccgtgtctcgcgggctgcctccgcagcagccccaacagcctctcctgaatctgcagggaacgaactctgccagtcttttgaacggtagcatgctacaacgggctctcctgctgcaacagctacagggtttagatcaatttgcgatgccacctgccacctatgatacagccgggctgacaatgccaactgccactctgggaaatctacgtggttacgggatggcgagtcctggattggctgcccctagcttaacaccaccacagctggcgacacctaatctgcaacagtttttcccacaggccactcgtcagtcacttctgggaccacctcctgtgggggttcccatgaacccctcccagtttaatttgagtggccgcaacccccagaagcaagcccgcacttcttcctccaccacccccaatcggaaggacagcagcagccagactatgcctgtggaggacaagagcgacccgccggaaggttctgaggaagccgccgaacctcgcatggatacccctgaagaccaggaccttcccccatgccccgaagacattgcgaaagagaagcgaacacccgcccccgagcccgagccatgctag

SEQ ID NO: 11412 - DNA, 2610 bp, Artificial Sequence
  Description of Artificial Sequence: Synthetic coding sequence
atgttcagccagcaacagcagcagcagttgcaacagcagcagcaacagctgcaacaactgcagcagcagcagctgcaacagcagcagttacagcaacagcagcttctgcagcttcaacagctcctgcagcagagtccaccacaggcccccctgcccatggcagtcagccgcggcctgcctccccagcagccacagcagcctctcctcaacctccagggcaccaatagtgcaagcttgctgaacggctcaatgctgcagcgggctctgctcttacagcagctccagggcaacctccggggttatgggatggcatctcccgggcttgccgctccgagtctaacgcctccccagctggctacccccaatttgcagcaattcttccctcaggctacaaggcagtccctgctcggacctcctcctgtaggtgttcctatgaacccgtcccagtttaacctgagtggccgcaacccacagaagcaggcacggacttctagcagtaccacacctaatagaaagactatgcccgtggaagacaaaagcgaccctcctgaaggctccgaagaagctgccgaacctcggatggacacccccgaggaccaggatctcccgccctgtcccgaggatatcgctaaggaaaagcgcacacccgcccccgagcccgagccatgcgaggcatcggagctgccagcgaaaagactgcgcagctccgaggaacccacagaaaaagaaccgcccggccagctccaggtcaaggcccagcctcaggctagaatgacagtgcccaaacagacccagacaccagacctactccctgaagcactggaagcacaggttctccctcgatttcaacccagggttctgcaggtgcaagctcaggtgcagtctcaaactcagccccgtatcccgtctacagacacccaagtccagccaaagctccagaagcaagcgcaaacgcagacctctcccgaacacttggtgctgcaacagaaacaggtgcaaccgcagctgcagcaggaggcagaaccccagaagcaggttcagccccaggtccaaccacaggcacattcccagggcccacggcaggtacagttgcagcaggaagcagaacccctcaaacaggtgcaaccgcaagtgcagccccaggcccacagccagccacctcgccaggtccagcttcaactgcaaaagcaggtgcagacccaaacgtatccgcaagtgcacacacaagcccagcccagtgtgcagccgcaggaacatcccccagcccaggtgtctgtccagcccccagagcagacccacgaacagccacacacccagcctcaggtttccctcctggcgcccgaacagaccccagttgttgtgcacgtgtgcggtctggagatgccccctgatgctgttgaggcgggtggcggtatggaaaaaactctccctgaaccagtgggaacacaggtgagcatggaggaaattcagaacgagtccgcctgtggcctagacgttggcgagtgtgagaatcgggcgcgcgaaatgcctggcgtgtggggcgctggtggctctctcaaggtgacgatcctgcagagttccgactcgcgcgctttttccaccgtccccttgacacctgtcccgcgcccatccgattcagttagctctactcccgccgccaccagcacaccatctaaacaggccctgcagtttttttgttacatatgtaaggcctcatgctctagtcaacaggaatttcaggaccacatgtcagaacctcaacatcagcagcgccttggggaaatacaacacatgagtcaggcctgcctgctgagcctgctgcccgtcccccgtgacgttttagaaaccgaggatgaggaacctcccccccggaggtggtgcaacacgtgtcaactttattacatgggtgacctgatccagcacagaaggactcaggaccacaaaattgcgaagcagtctctgcgccctttctgtacggtgtgcaatagatattttaagacaccccgaaagttcgtggagcacgtcaaaagtcaggggcacaaagacaaggcaaaggagctgaagtccctcgagaaggaaatcgccgggcaggacgaagatcattttatcacagtggacgctgtgggatgctttgagggggatgaggaagaagaggaagatgacgaggatgaagaggagatcgaggtcgaggaggagttgtgcaaacaggtgaggagccgagatataagccgggaagaatggaagggttctgagacatactcccctaatacagcatacggtgtcgattttctggtacctgtgatgggctacatatgccggatctgccataagttttatcattctaacagcggtgctcagctcagtcactgtaagtcattaggacatttcgaaaacctccagaagtataaagcggcaaaaaatccttcgcctactacccgccctgtttcccgaagatgtgccatcaatgcccgaaatgccttaaccgccctgttcacctcttcgggaaggccaccttctcagccaaacacccaagacaagacacccagcaaagtgacagctaggccgtctcaaccaccactcccgcgacgctcgacacgtctcaaaacatag

SEQ ID NO: 11413 - DNA, 2613 bp, Artificial Sequence
  Description of Artificial Sequence: Synthetic coding sequence
atgttctcccaacagcagcagcaacaacttcaacagcagcagcagcagttacagcaattgcagcagcaacagttgcagcagcagcaacttcagcaacagcagctgcttcagctgcagcagctcctccagcagagcccccctcaggcgcccctaccaatggcagtatcccgaggcctcccaccccaacaacctcaacaacctcttttgaacctgcaaggcacgaattccgccagtctgctcaacggctctatgcttcagagagcactcctgcttcaacagttacagggcctggatcagtttgccatgcccccagcaacctacgatacggcaggcttgacaatgcccacagccacgctcggaaatctgagagggtacggtatggcaagccctgggctggccgccccctctctcaccccgcctcagctggccacacctaatctgcagcaattctttcctcaggccacacgccaaagccttctggggcccccccccgtgggcgtgcccatgaatccatcacaattcaacctttcaggacggaatccacagaagcaggcccggactagtagctctacaaccccgaatcgcaaggactcgtccagtcagacaatgcctgtagaggacaaaagcgaccccccggaagggagcgaggaggcagcagaaccgcgcatggatacccctgaagatcaagacctccccccttgcccagaggatatcgcaaaggagaaacggacacctgcccccgagcccgagccctgtgaggcctcagagctccccgctaagcgcctgcggtcatcagaggaacctacagagaaggagccccctggacagctacaggtcaaggcccagccgcaggccagaatgacagtgcccaaacagactcagacacctgatcttctccccgaggcgctggaagcgcaagtactccccaggttccagcctagggtcctgcaggtgcaggcccaggtccagagtcagacgcagcctcgcataccatccacggatacacaggtacagcccaaactgcagaagcaggcccagacacaaacatcacccgagcatttggtgctgcagcagaaacaggtgcaaccgcagctgcagcaggaagctgaaccccagaagcaggtgcagccccaagtgcagccacaagcacactctcagggccccagacaagtgcagctgcagcaggaagcagagcccctcaaacaggtgcagccccaggtgcatacccaagcccagccaagcgtacagccacaggaacacccccccgcccaggtgagtgtgcagccccctgaacagacccacgagcagcctcacacccagcctcaagtgagtcttctggctcccgaacagacccccgtggtggtgcacgtttgtgggctagagatgccgccagatgccgtggaagcgggaggcgggatggagaagaccctgccagagcccgtgggtactcaagtatcaatggaagaaatccagaacgaaagcgcgtgtggactggatgtcggcgagtgtgaaaatcgagctcgcgagatgcccggggtctggggtgccggcgggtctttgaaggtcaccatactgcaatcttcggactctcgtgccttttccaccgtgcctctaacacccgtgcctcgcccgtctgactcggtaagcagcaccccggcggcaacatctactccatccaaacaagctttacagtttttttgttacatttgtaaggcttcttgttccagccagcaggagttccaggatcacatgtccgaaccccagcaccagcagcggctcggggaaatccagcatatgagccaggcttgtttgctgagtctactgccggttcccagggatgtcctggagacagaagacgaggaacctcccccaaggcgctggtgcaatacatgccagttgtattacatgggtgatctgattcagcatcgaagaacccaggatcataaaatagccaagcagtctctgagaccattctgcacggtctgcaaccgctactttaaaactcccagaaaattcgtggagcacgtgaagagccaggggcataaggataaagctaaagagctcaagtctcttgaaaaagagatcgccgggcaggacgaagaccatttcatcactgtggatgccgttgggtgcttcgagggcgacgaggaagaggaagaggacgacgaggacgaggaagaaattgaggttgaagaggagctgtgtaaacaggttcgctcacgagatatcagtcgcgaggaatggaagggtagtgagacatactctccaaacaccgcatacggcgtagactttctggttccagtcatggggtatatatgtcgtatctgccacaaattctaccactcaaattctggggctcagctctcgcattgtaagtctctgggacacttcgagaatctgcaaaaatacaaagctgcgaagaacccttctcctaccacgcgccctgtgtcccggcgctgtgccattaacgccaggaacgcgctcaccgctctgtttacctccagcgggcgacctccatctcagcccaatacccaggataaaactcctagcaaagtaacagctagaccttcacagccgcctttaccccggcgatccacacgcctcaaaacctag

SEQ ID NO: 11414 - DNA, 2697 bp, Artificial Sequence
  Description of Artificial Sequence: Synthetic coding sequence
atgttcagccagcaacagcagcagcagctccagcagcaacaacagcagctccagcaactgcaacagcagcaactccaacaacagcagttgcagcaacaacagcttttgcaattgcagcagctcctgcagcagagcccacctcaggcaccgctccccatggcagtctcaagaggcctcccaccacagcagccccagcagccactgctcaacctgcaggggaccaactccgcatcgctattgaatgggtctatgctgcagcgcgctctactgctgcagcagcttcagggattagatcagttcgccatgcccccagccacatacgacaccgccgggcttaccatgcccaccgcaacactcggtaaccttcgcggctatggcatggccagtcccggcctggcggctcccagccttacgcccccccagctggccacccccaatctgcagcagttttttccgcaagccactcgccaatcactactggggcctcctcctgtcggcgtccctatgaacccgagtcagtttaacctctccgggagaaacccacagaaacaagcccgcacatcatccagcacaacccctaatcgcaaggattcttccagtcagactatgcctgtggaggacaagtcagatccccccgaggggtccgaggaggctgcagaaccaaggatggacacccctgaagaccaggacttgccaccatgtcccgaggatatcgctaaggagaaaaggacacccgcccctgagcccgagccctgcgaagcaagcgagctgcctgccaagcgcctgagatcctcagaggaaccaacagagaaagaaccacctggacagttgcaagttaaagcccagccacaggctagaatgaccgtgccgaaacagactcagacccccgacttgcttccagaagccctcgaggcacaggtgctgcctcgtttccagcctcgagtcctgcaagtgcaggcccaggtgcaatcacagactcaaccacgcatcccgagtaccgacactcaagtgcagcccaagctccagaaacaggctcagacccagacctctcctgagcatctagttttacaacagaaacaggtgcagcctcagcttcagcaggaagcagagccacagaagcaagtccagccacaggtgcagccccaagcacattctcaggggccccgacaggtccagctgcagcaggaggcagagcccctgaagcaagtgcagccccaagtacaaccacaagcacattcccagccaccaaggcaagtgcaactccaactccagaagcaggtccagactcagacttatccccaggtgcacactcaggctcagccttctgtgcagcctcaggaacacccccctgcccaggtgagcgtccagccccccgaacagacacatgaacagccccatactcagcctcaagtatccttgctcgcacccgaacagactcccgtggtggtgcacgtgtgcggcctagaaatgccgcccgacgccgttgaggccggcgggggaatggaaaagactttgcctgagcctgtggggactcaggtgtctatggaagaaattcaaaatgagtctgcatgcggattagacgtcggagaatgtgagaatcgggcacgtgaaatgccgggtgtgtggggcgccggagggagtctgaaggtaacaattctccagtcatctgactctcgtgccttttctaccgtgccattgacaccagtcccccgtcctagcgattccgtatcatcaactcctgcagccactagcacaccgagcaagcaggctcttcaattcttctgttacatctgcaaagcttcatgctcttcccagcaggagtttcaagatcacatgtctgagccacaacatcaacagcggttgggcgagatacagcacatgtcacaggcttgtctgctttctctcctccccgttccacgcgacgtgttggaaaccgaggacgaggagcctccacctcggcgctggtgtaatacatgccaactttactatatgggggacctgatccaacaccgtaggactcaggaccacaagatagcaaaacagtcccttcggccattctgtaccgtgtgtaataggtactttaaaacacccagaaaattcgttgagcatgtaaagtcccaaggacacaaggataaggccaaggagctcaaaagtctggagaaggaaatcgccggtcaggacgaggaccactttatcacagtagatgcggtcggatgctttgagggagatgaagaagaggaggaggacgatgaagacgaggaggagatcgaagtggaggaggagctttgtaaacaggtacggtctagagatataagtagagaggaatggaaaggatccgaaacttattcaccaaataccgcctacggagtggactttcttgtccccgtaatggggtacatttgtcggatctgccacaaattctatcactccaactctggggcgcaactctctcactgcaaatcccttgggcacttcgaaaacttacagaaatacaaggctgctaagaatccgtctccgactacccgacctgtatcacgacgatgcgctattaatgccagaaatgccctaacggccttgtttactagtagtggcagacctccttctcagccaaacacccaggacaaaactcctagcaaggtgactgcgcgaccttctcaaccacctctgcctcgccgtagcacaaggcttaaaacatag

SEQ ID NO: 11415 - DNA, 1245 bp, Artificial Sequence
  Description of Artificial Sequence: Synthetic coding sequence
atgttcagccagcagcaacagcagcagcttcagcagcagcaacagcagctgcagcagctgcaacagcagcagttacagcagcagcagctgcagcaacagcaactattacaactccagcaactgctccagcagagtccccctcaagcaccactgccgatggctgtttcacggggcctccccccgcagcagcctcaacagccccttctgaatttgcaggggaccaactccgcatctctcctgaacgggagcatgctacagagagccctactgctgcaacaactgcagggcaacctgaggggttatggcatggcatccccaggattagctgccccgtccctcacaccgccccaactggctacccctaatctccaacaattttttcctcaagccacaaggcaatctctccttggacctccccccgttggtgtccccatgaacccgagtcaattcaacttatccggaaggaacccacagaaacaggcccgcacctcatcgtccacaaccccgaaccgcaaggactcgtcatcccagacaatgccagttgaggataaaagtgatccccctgagggatcagaagaggcagctgagccaagaatggatacaccagaagaccaagacctgcccccatgtccagaggacatcgccaaggagaagaggacccctgccccagaacctgagccatgtgaagcttctgagcttccagccaaacgcctgcgaagcagcgaggagcctaccgaaaaagaaccaccaggacaactgcaggtgaaagctcagccacaggctcgcatgaccgtcccaaagcagacacagaccccagacttgctgccagaagcactggaagcacaggtacttccccgctttcagccccgggtgctacaggtgcaggcacaggtgcaaagccaaacacagcccaggatccctagcacagatacacaagtgcagcctaaactccagaaacaggctcagacccagacctctcccgaacacctggtgctacagcaaaaacaggtgcagccacagctgcagcaggaagccgagccccagaagcaggtccagccgcaggtgcagccccaagcgcactcccaaggccctcgtcaagttcagctgcagcaagaagcagagcctctgaagcaggtgcaaccgcaggtccagccccaagctcatagtcagccccatcttccacaagttctttcgcagcagctgagaggcacagctctgcccttacaggtgcccgggccactctag

SEQ ID NO: 11416 - DNA, 2529 bp, Artificial Sequence
  Description of Artificial Sequence: Synthetic coding sequence
atgttctctcagcagcaacaacagcagctgcagcagcaacagcaacagttgcagcaactccagcagcagcaattgcaacagcagcagttgcagcagcagcagctgcttcaattacagcagcttctgcagcagtcccctccccaagctcccctgcccatggcggtgtctcggggactacccccccaacaaccgcaacagcctctactgaacctgcaaggcacaaattccgctagcctgctgaatggcagcatgctgcagcgcgccttgctcttacagcaactgcagggcttggatcagttcgccatgcctcccgccacctatgacaccgccggactgacaatgccaactgccaccctgggaaacctgaggggatacggaatggcaagcccaggactcgctgctccaagccttacgcctccacagctggcaacacccaacctacagcaatttttcccgcaagctacgcggcagtccctactcgggccacctccagtcggtgtacctatgaacccgtcccagtttaacttaagcggtaggaacccgcagaagcaggccagaacctctagttcgaccactccaaatcgaaaggattcctcatcccagacaatgcctgtcgaggataaatccgatcctcctgaggggagcgaggaggcagctgaaccacgtatggacactccagaggatcaggatctgcctccctgtcctgaagatattgccaaagagaagaggactcccgcccccgaacctgagccctgcgaggcctccgagctaccggccaagagactgagaagcagcgaggagccaaccgagaaagagcctcccggacagctgcaggttaaagcacagccccaggcccggatgaccgtgcccaaacaaacacagacccctgacctcttgcccgaagccctggaagctcaagtgctgcccaggttccagccccgggttcttcaagtccaagcccaggtccagtcacagactcaaccacgcatacccagcaccgacacgcaggtccagccgaaactgcaaaaacaagcccaaacacaaacctctcctgagcatctcgtgctccaacaaaagcaagtccaacctcagctgcaacaggaagccgaaccacagaagcaagtgcagccacaagtccacacccaggcccaacccagcgtccagccccaagagcaccctccagcacaggtttctgtgcagcctccagaacaaacccatgagcaacctcacactcagcctcaggtgagtttattagccccagagcagacgcctgttgtggttcacgtgtgcgggctcgagatgccccccgatgcagtggaagccggaggcggaatggagaagacgctccctgaacccgttggaacccaggtctctatggaagagatccaaaatgagtcagcctgtggtttggacgtaggggagtgcgaaaatagggctagggaaatgccgggcgtctggggcgcaggcggctccctaaaggtgaccattctccagtcgtctgacagcagggcattttccactgtccctctgaccccagtgcccagaccatcagactcagtgtccagcacaccggcagccacctcgacgccgtccaagcaggctctgcaattcttttgctacatctgcaaggccagctgctcaagtcagcaggagtttcaagaccacatgtctgaaccgcagcatcagcagaggctcggtgaaattcagcatatgtcccaggcctgtttgctcagcttgcttccagttcctcgcgacgttctggagacagaggacgaagaaccaccaccacgacggtggtgtaacacatgtcagctctattacatgggcgatctgatacagcaccgaaggactcaagatcataagatcgcgaaacaatcacttaggcctttttgtactgtgtgcaatcgctatttcaagacacctcggaaatttgttgaacacgttaaatctcagggacacaaagacaaggctaaggagttgaagagcttagaaaaggaaattgccggacaggacgaggaccactttatcaccgttgatgccgtgggttgcttcgagggagatgaagaagaagaagaagacgacgaggacgaagaggagatcgaggtggaagaggagctgtgtaagcaggtgaggagccgtgatatctctagggaagaatggaaggggtccgaaacctatagtcctaataccgcttacggagtcgacttccttgtgccggttatggggtatatctgtaggatctgccacaagttctatcattcaaattccggagcccagctctcacactgtaagagcctgggccatttcgagaatctccagaaatataaagcggcgaagaatcccagccctacgactcggcccgtcagccgccggtgtgccattaacgcgagaaacgcactaaccgcactattcacctcatctggccggcctccctctcagcccaacacccaagataagaccccctccaaggttacagcaaggccaagccagccccccctgcccaggagatccaccagacttaagacttag

SEQ ID NO: 11417 - DNA, 2457 bp, Artificial Sequence
  Description of Artificial Sequence: Synthetic coding sequence
atgttttcccaacaacaacaacagcaattgcagcaacagcagcagcagcttcagcagctacagcagcagcagctgcagcagcaacaactgcagcagcaacaattgctccaactgcagcaactgctgcaacagtcgccacctcaggcccctctgcccatggccgtgtctagggggctacctccacaacagccacagcagccactcttgaacttacagggcactaatagtgcgtccctgctcaacggaagcatgctgcagagagcgctcctgctccagcagctccaggggaatctgcgcggctatggtatggcaagcccaggactcgccgccccgtcccttacaccgcctcagcttgcaacgccaaacctccagcagttcttcccacaggctacccgccaatcactcctgggacctccaccagttggggtccccatgaatccatcacagtttaacctgagcgggagaaaccctcagaaacaggcaagaacatcttcatctactaccccgaatagaaaggattcgtcttctcaaacaatgccagtcgaggataagtccgacccgcctgagggctctgaggaagccgccgagcccagaatggatacgcctgaggatcaggacctgccaccctgccccgaagacatagccaaggaaaagagaacacccgcccctgaacccgagccttgtgaagccagcgaacttccagccaagcgcctgcgatctagcgaagagccaacggagaaggaacctccaggacaactgcaggtcaaagcacaaccccaagcaagaatgacggtgcccaagcagactcagacacctgacttgctgccagaagcccttgaagcccaagtgcttccccggttccaacccagagtcctgcaggtgcaggctcaggtccagagtcagactcaaccacgcatcccgtccaccgatacacaggtccagcccaaactgcagaagcaggcccagacccagacctccccagaacatctggtcctacagcaaaaacaggtgcagcctcagctccagcaagaagctgaaccccagaaacaggtgcagccacaggtacatacccaggcccagcccagtgtgcagcctcaggagcacccacccgctcaggtgtccgtgcaaccacccgaacagactcatgaacagccacacacacaaccgcaggtctcactgttggctccagagcaaaccccagtcgtggttcacgtgtgtggcctggagatgcccccagacgctgttgaagcaggcgggggtatggagaagacactccctgagcccgtgggtacgcaagtcagcatggaggagatacaaaacgagtcagcctgtgggttagacgtcggtgaatgcgaaaatcgcgctcgggagatgcctggggtctggggagccggcgggtccctgaaagtgacaattttgcagagctccgactcccgggcgttttccacagtgccacttacacctgtcccaaggcccagcgatagcgtaagtagcacccccgctgccacaagcaccccctccaaacaggccctgcagttcttctgttatatctgcaaggcctcctgttcatcacaacaggagttccaggaccatatgtcagagccacagcaccagcagcggctgggcgaaatccagcacatgtctcaggcctgcctgctatcattgctgcccgttccacgggacgtgctcgagaccgaggatgaggaaccccctcctcggcggtggtgtaatacttgtcagctgtattatatgggggatttgattcagcacaggagaacacaggaccataagatcgcgaagcagtccctaaggccgttctgcactgtgtgtaaccgttattttaaaaccccccgaaagtttgtggagcatgtgaagtcgcaagggcacaaggataaggcgaaggagctgaaatccctggagaaagagatagctggtcaagatgaagaccacttcatcacggttgacgcagtgggctgttttgagggagacgaagaggaggaggaggacgatgaagatgaagaggaaatcgaggttgaggaggagttatgcaaacaggtgcgtagccgggatatttcgagggaggagtggaagggctccgagacttattctcctaataccgcatatggagttgacttccttgtgcctgtgatgggatacatttgccggatctgccacaaattttaccattctaacagcggcgcacagctgtctcactgtaagtccctgggccatttcgaaaacctgcagaagtacaaagccgctaaaaacccttcaccaacaactagacccgtaagccgaagatgtgccattaacgctaggaatgccctcaccgccctgttcaccagttccggacggcccccatcacaaccaaacacccaagacaaaactcccagtaaggtgaccgctcgcccctctcaacctccgctgcctcgccgtagtacaaggctgaagacctag

SEQ ID NO: 11418 - DNA, 2697 bp, Artificial Sequence
  Description of Artificial Sequence: Synthetic coding sequence
atgttttctcagcagcagcagcagcagctgcagcagcagcaacaacagcttcagcagctccaacagcaacaactgcagcaacaacagctgcagcagcagcaactgctacagctgcagcagctgctgcagcagagtccccctcaggcgcctttaccaatggctgtctccagaggtttacctccacagcagccgcagcagccgctgcttaacctgcagggcacaaattctgctagcctgctcaatgggagtatgttacagcgcgctctcttgcttcaacagctgcaaggtctggaccaattcgcaatgcccccagccacttacgacacagcaggacttaccatgccaacggctacactaggcaatctgcgcggatacgggatggcttcccctggattagcagctccttctctgacacctccgcagctggcaactcctaacttgcagcagttctttccgcaggccacccggcaatctttattgggtcccccccccgttggagtgccgatgaacccatctcaatttaatttatctggccgcaacccacagaaacaggctaggaccagttcttctaccaccccgaatcgaaaggactcaagctcccagacaatgcctgtggaggacaagagcgacccccctgaagggtctgaagaagcagccgaaccaagaatggatacccctgaagaccaggacctgccaccttgtcctgaagacatcgccaaagagaagaggactccagcccccgagcccgaaccctgcgaagcctcagaactgcccgcaaaacgactcaggtcctctgaagaacccacagagaaggagccacccgggcaattgcaggtgaaggcccagcctcaggcaagaatgactgtgcctaaacaaactcagacccctgacctgctccctgaagcccttgaggcgcaggtgttgcctagatttcagccaagagttctgcaggtgcaggcacaggtccagtcccagactcagccaaggattccgagcaccgatactcaagtacaacctaagctccagaagcaggcacaaactcagacaagcccagagcacttagtgttgcagcagaaacaggtgcagccccagttacaacaggaagcagaaccgcagaaacaggtgcagcctcaggtgcagccccaggcccatagtcaaggcccccggcaagtccaactgcaacaagaggccgaacctcttaaacaggtccagccccaggtgcagccacaggcccactctcagccgccgagacaagtgcagttgcagttacagaagcaggtccaaacccagacatacccccaggtccacacacaagcacagcccagtgtccagccccaggaacaccctccggcacaggtcagcgttcagcctccggaacaaacccacgagcaaccacatactcaacctcaggtctctctgctggcccctgagcaaacacctgtggttgtgcacgtttgtggcctggagatgccgcctgatgcggtagaagccggaggtggtatggagaagactctcccagaacccgttgggactcaggtgagcatggaagagatccagaatgagtctgcatgcgggctggatgtgggagaatgtgagaatagggcacgggagatgcctggcgtgtggggcgctggcggtagcctcaaggttaccattctccaaagctcagactcaagagccttttctaccgtcccccttactcccgtaccacggcccagcgatagtgtgtcttcaacgccagccgcaacctcaactccatcaaagcaggccctgcagtttttttgctatatctgtaaagctagttgttcatctcagcaagagttccaggatcacatgagcgaaccccagcaccagcagaggctgggcgagatccagcacatgagccaggcttgtcttctatcattgcttccggtgccaagagacgtgttggagacggaagacgaggagccccctccgagaagatggtgcaatacatgtcagttgtactacatgggcgatttaattcagcatcgacgaacccaggatcataagatcgcaaaacagagcttgagacccttttgtacagtctgcaaccgttactttaagacacctagaaagttcgtggagcacgtaaagagtcagggccataaggacaaggcaaaggagctcaagagtctggagaaagagatcgcggggcaggatgaagaccactttattaccgtggacgcagtgggctgctttgaaggtgatgaggaagaggaagaagacgatgaggacgaggaggagatcgaggtcgaggaggagttgtgtaagcaagtcagatccagagacatcagcagagaggagtggaaaggctcagagacttacagtcctaacacagcctatggtgtggactttctggtccccgtcatggggtacatctgtcgcatttgccataaattctaccacagcaattccggcgcacaacttagtcactgcaagtcactgggccactttgagaacctgcagaagtataaagcagccaaaaacccatcacctacaacccggcctgtgtcacgtaggtgcgctattaatgctcggaatgctctgactgcactgtttacttcttcgggtcgtccccccagtcagcccaatacccaggataaaacaccttccaaagttactgcccggcctagccaaccccccctgcctcgtcgcagcacccgcctcaaaacctag

SEQ ID NO: 11419 - DNA, 2463 bp, Artificial Sequence
  Description of Artificial Sequence: Synthetic coding sequence
cccctgcctatggccgtttccagaggcctgccgccacaacagccacagcagccacttctcaatctccagggaacaaatagcgcctccctccttaatgggagtatgctgcagagagctctcctcctgcagcagctccagggaaacctgcgcggctatggaatggctagccccggcctggccgcccccagcctgacaccccctcagttggccactcccaatctgcaacagttttttccccaggccactcgacagtccttgctgggacctccaccagtaggagttcccatgaatccttctcaatttaacctgtcgggacgaaaccctcagaaacaggcaaggacgtcctcctcgaccacacccaacagaaagactatgccggtggaggacaaatctgaccctccagagggatctgaagaagccgctgagccacgtatggacacgccagaggatcaagacctgcctccttgcccagaagacattgctaaagagaaaaggaccccagctccagaacccgaaccatgcgaagcttccgagcttcctgccaagcggctcagatcgagcgaggagcctactgaaaaagagcctcctgggcaactgcaggtaaaggcacagccccaagcccgcatgaccgtaccaaagcagacccagacccccgacctcctccctgaggcactggaggctcaagtgctccctcggtttcagccaagggtgcttcaggtgcaggcccaagtgcagagtcagacccagccacggattccaagcaccgatacccaagtgcagcccaaactacagaagcaggcacagactcaaacgagtccggagcacttggtgctacagcaaaaacaggtccagccccagctccagcaggaagccgagccccagaaacaggtccaaccccaggtgcagcctcaggcacacagtcaaggcccgcgacaagtacagttacagcaggaggccgaaccattgaagcaggtgcagcctcaggtgcagccacaagcgcacagtcagccaccgcgccaagttcagctgcagctccagaagcaagtgcagacacagacctacccgcaggtccatacccaggctcaaccaagtgtgcaacctcaggagcacccaccggcccaggtctctgtccagccacccgaacaaacccacgaacaacctcacacacagccacaagtgtcgctgttagctccagagcaaactcccgtggtagtgcatgtttgtggattagaaatgcccccagacgcagtggaggccgggggtgggatggagaaaacgcttcctgaaccagtgggaacccaggttagcatggaggagattcagaatgagtcggcctgtgggttagacgttggcgagtgtgagaacagagcccgtgagatgccgggcgtctggggtgccggcggcagtctgaaggtcacaatcctgcaatctagcgactccagagcattctcaaccgtgcctctgacccctgtgccacgaccatcggacagcgtctcctcaacacccgcagctactagcactccttcgaaacaagccctgcaatttttctgctacatctgtaaggcttcctgctctagtcagcaagagttccaggatcatatgtccgagccccagcaccagcagcgattgggcgagatccagcacatgtcccaggcctgtctgctctccctactccccgtccctagggacgtgctggagacagaggacgaagagccaccgccccggcggtggtgcaacacatgtcaactgtattacatgggggatctgatccaacatagaaggacccaagatcacaagatcgctaagcagtctcttcgtcccttctgcacagtgtgtaaccggtattttaagacccctagaaaattcgttgagcatgtgaaatcccaaggccacaaagataaggcaaaagaactgaagtccctcgagaaggagattgccggtcaggacgaggatcacttcataaccgtggacgcggtgggatgtttcgaaggcgatgaagaggaggaggaagatgacgaggacgaagaggagattgaggtagaggaggagctgtgtaagcaggtacgctctcgtgatatctctcgggaagagtggaaaggctctgaaacgtattctccaaacacagcctacggtgtggacttcctcgtgcccgtgatgggctacatctgcaggatatgccataagttctatcatagcaacagtggcgcccagctcagtcactgtaaatcgttgggccactttgaaaacctgcagaaatataaagcagctaagaacccgtcccccaccacccgccccgtgtccagacgctgcgccatcaacgctagaaatgcactgaccgccctgttcacttcatcgggccgcccgccctcacagccaaatactcaggataaaaccccatccaaagttacagcccgccctagtcagccacccctgcccaggcggagtacccggcttaagacatag

SEQ ID NO: 11420 - DNA, 507 bp, Artificial Sequence
  Description of Artificial Sequence: Synthetic coding sequence
atgttctcccaacagcagcagcagcaactgcagcagcaacagcagcagcttcagcagctccagcagcagcagctccagcagcagcagttgcagcagcagcaactgttacagctacagcagctgctccaacagtcgcctccgcaagcaccgcttcctatggcagtgagcagaggtctgcccccacagcagccgcagcagcctctgctgaatctgcagggcaccaatagtgccagtcttctcaacggaagtatgttacagagagcgcttcttttgcagcaattgcaaggattggaccagtttgcgatgccccctgccacctacgacacagcgggccttacaatgccgaccgccacacttggaaacctccgaggatacgggatggcttccccggggttggcggcgccgagtctgactcccccacagttggcaactcccaatctgcaacagtttttccctcaggctacaaggcagagcctgctggggccgccgcccgtgggtgtgccatag

SEQ ID NO: 11421 - DNA, 2514 bp, Artificial Sequence
  Description of Artificial Sequence: Synthetic coding sequence
atgttttctcagcagcagcagcaacagctccaacagcagcagcaagcacctctgcccatggccgtctcaaggggactccccccgcagcagccccagcaacctctgctgaatctccagggaacaaattccgcctctttgttgaacggcagcatgctccaaagggctttgctgttgcagcagctgcagggactcgaccagtttgccatgccccccgcaacatacgatacagccggtttaactatgccaacagctactctgggaaatctccgaggatacggcatggcctccccaggcctggctgctccgagtctgactcctccgcagctcgccacaccaaatctacagcaattcttccctcaggccactcggcagtctctcctcggccccccacccgtcggagtgcccatgaacccctctcagtttaacttgagtggcagaaatccccagaagcaagcccgaactagttcaagcacaacccccaacagaaaagatagcagcagtcagaccatgcccgtggaagataagtcagacccacccgagggctctgaggaggccgcagaaccacggatggatacccccgaggaccaagatcttcccccatgtcctgaggatatcgccaaggaaaaaaggacacctgcccctgagcctgagccttgtgaagcctcagaattacccgccaagagattacgctcgtccgaagaaccgactgaaaaagaaccacctggccagctacaggtgaaagcccaaccacaggccagaatgacagtgcctaaacaaacccagacccccgacttgttgccagaagcccttgaggctcaggtgctgccgcggtttcagccacgagtgctgcaagtccaggctcaggtccaaagtcagactcagcctagaattccctcaacggacacccaagtgcagccaaaacttcaaaagcaggcccagacacagaccagcccagagcatcttgtgctgcagcagaagcaagtacagccccaactgcagcaagaagccgaaccgcagaaacaggtgcagcctcaggtgcagcctcaggcgcacagccaggggccccgccaggttcagctgcagcaggaggctgaaccactgaaacaggtgcagccacaggtgcacactcaagctcagccctccgtccagccacaagaacatccacctgcccaggtgtcagttcagcctcccgagcagacccacgaacagccgcatacccaaccgcaggtgtccctcttggcccctgaacagacacccgtggtggttcatgtttgcgggctggagatgccacccgacgctgtcgaggccgggggtggtatggagaagaccctgccggaacccgtcggcacacaggtaagcatggaggagattcagaacgaatctgcatgtggcttggatgtgggtgagtgtgagaatcgcgccagagagatgcctggcgtatggggcgctggaggctccttgaaagtgacaattctgcaaagctccgatagtcgggcattcagcactgtgccgctgacacccgtgccccggccaagcgattccgtcagcagtaccccagccgctactagcaccccgtcgaaacaggccctgcagttcttttgttacatctgtaaagccagttgttccagccaacaggagtttcaggatcacatgagcgaacctcagcatcaacagcgtctgggcgaaatccaacatatgagtcaggcctgcctgctgtctctgctgccggtgcctagggatgtcctagaaacagaggacgaagagcctcctccccgcagatggtgcaatacatgccagttatattacatgggggacctcattcaacataggcgcacacaagaccacaagatagccaagcagagcctcaggcctttttgcacagtctgcaaccgctacttcaagaccccaaggaagttcgtggagcatgtcaaaagccagggccacaaggacaaggctaaggaactgaaaagcctcgagaaggagattgctggtcaggatgaggaccacttcatcaccgtggacgccgtgggttgctttgagggagacgaggaggaggaggaggacgacgaagatgaagaggagatcgaggttgaagaggagctgtgtaagcaggtccgctccagagacatcagcagggaagagtggaagggctctgaaacatactcacctaatacagcttacggggtggatttcctggtgccggttatggggtacatttgccgcatctgccacaaattttatcactcaaattccggggcacagctttctcactgtaaatctctgggccattttgagaatcttcagaagtacaaggccgcgaaaaatccctctccaactacaagacccgtttctcgcagatgtgccatcaatgcaaggaacgcgttgaccgccctgtttacctcttctgggcggccgccttcccaacctaacacccaagataagacaccaagcaaagttactgcccgtcccagccaaccgcctcttccaaggcgctctaccagactaaagacctag

SEQ ID NO: 11422 - DNA, 2775 bp, Artificial Sequence
  Description of Artificial Sequence: Synthetic coding sequence
atgttcagtcaacagcaacagcagcagttacaacagcagcagcagcagctgcagcaacttcagcagcaacagcttcagcaacagcagttgcagcagcagcagttgctccagctgcagcaactgctccaacagtcccccccacaggctcctttaccaatggcagttagccggggcctgccgcctcaacagccacaacaacccctgttgaacctccagggaacaaattccgcctctttgcttaatggttcaatgctccagcgagccctgcttctgcagcaacttcagggcctggatcagtttgctatgcctccggctacatatgataccgcgggtctaacaatgccaactgcgactctggggaacttgagaggttacggcatggcgagccccgggctggccgccccctcactgacacccccccaactcgccactcccaacctgcagcaattctttccccaggctacccgacagtctctgcttgggccaccacccgtcggtgtgccgatgaatccctcccaatttaatttgagcggaaggaatcctcagaaacaggccaggacgtccagttccaccacccctaaccggaaggatagtagtagtcagacaatgccagtggaggataaaagtgatccacccgagggatcagaggaagccgccgagccgaggatggacacccctgaagatcaggacctcccaccttgtcctgaagacattgccaaggaaaaacgaacaccagcaccagagcccgagccatgtgaggctagtgaacttccggcaaagcgcctcagatccagcgaggaaccgactgagaaggaaccaccaggacagcttcaggtcaaggctcagccgcaggcccgcatgaccgtgcccaaacagacacagacacccgacttacttcccgaggcactggaggctcaggttctgcctcggtttcaacccagggtgcttcaagtgcaggcgcaagtgcaatctcaaacccaaccccgtattcctagtaccgacacacaagttcaaccaaagctgcagaaacaggctcagacacagacaagcccggagcacctggttctccagcagaagcaggtccagccacagctgcagcaggaagcagagccccagaaacaggtgcaaccacaggtacaaccacaggcgcactcccaagggcctaggcaggtccaactgcagcaagaggcagagccgttgaagcaagtccagcctcaagtgcagccccaggcacactcccagccgccccggcaggtccagctgcaactccagaagcaggtgcagacacagacctatccacaggtccatacccaggctcaacctagtgtgcagccccaggagcatccccccgctcaggtctccgtgcaacctccagagcaaacgcacgaacagcctcatacacagcctcaggtgagcctgctggcccctgaacaaacaccggtggtcgtccacgtctgcggattagaaatgccgcctgatgcggttgaggccgggggcggtatggagaaaactctgcctgagcccgtgggcacccaggtgtctatggaggagattcagaacgagtccgcctgcggcctcgacgtaggggagtgcgagaacagggctcgggagatgcctggggtctggggcgctggcggctctttaaaggtcaccattctccagtctagcgattcccgcgccttctccacagtaccccttacacctgtgccaaggccttccgacagcgtcagctccacgccagcagccacttccaccccctctaaacaggctctgcagtttttttgctatatctgcaaggcctcttgctcatcacaacaggagttccaggatcacatgtcagagcctcagcatcagcagcgcctgggggagattcagcacatgtcgcaagcatgcctcctcagtcttttgccagtgcccagggacgtcctggaaaccgaagatgaggaacccccccctaggagatggtgcaacacatgccaactctattatatgggagatcttattcagcacaggcgcactcaggaccataagcccccaaccccaagaagggacgtgttcgcacatgtgcctgtgcagggatggtccaccgctcggctggtcacagacatgatcgccaaacagtcactgaggcctttctgtacggtgtgtaacaggtattttaaaacacctcggaaatttgttgagcatgtaaagtctcaaggtcacaaggataaggccaaggagcttaagagcctggagaaggaaatcgccgggcaggacgaggatcatttcattactgtagatgctgtgggatgcttcgagggtgacgaggaagaggaggaggatgatgaagatgaagaagagatcgaggtggaagaggagctgtgtaagcaggttcgttcgcgggatatatcgcgcgaagagtggaaaggaagcgagacatacagccctaacacggcttacggagtcgacttcttggtgcccgtgatgggctacatttgtcgaatttgccacaaattctaccatagcaacagtggagcacagttgtcccattgtaagtcactggggcatttcgaaaacctacaaaagtataaggccgcaaaaaatcccagccctaccactaggcccgttagtcgcaggtgtgccatcaacgcaaggaacgccctcacagccctattcacgagttctggacgccccccctcgcagcccaatacgcaagacaaaacaccaagcaaggtcactgcgaggccctcgcagccacccttgcccagacgctccacccgtctcaaaacctag

SEQ ID NO: 11423 - DNA, 2394 bp, Artificial Sequence
  Description of Artificial Sequence: Synthetic coding sequence
atgcctcccgctacttacgatacagctggactaactatgccgacagccacccttggaaacttaagaggctatggcatggcaagccctgggttggcggctccaagcctcacccctcctcagttggctactcctaacctgcaacaattcttcccccaggccaccaggcaaagcctgcttggacctccgcctgttggtgtgccaatgaatccatctcaattcaatttatccggcagaaaccctcaaaagcaggcaagaacatcttccagcacgactccaaaccgtaaagactcttcctctcaaaccatgccagtggaagataagagtgatccccccgaaggcagcgaggaggccgcggagcctcgcatggacactcctgaggaccaggatctgccgccttgccctgaggacattgctaaagagaaacgcacaccagctcctgagccggagccatgtgaagcctccgaactacccgccaagagactgcgatcatctgaggagcccactgaaaaggagcccccaggccagcttcaggtgaaggcacagcctcaggctcggatgacggtgcccaagcagacccaaactcccgacctcctccccgaggccctcgaggcccaggttttacctcgcttccaaccccgggtcctccaggtgcaggctcaggtacagtctcagacccagccaaggataccaagcacggatactcaagtgcagcccaagttgcagaaacaggcgcagacgcagacatcacccgagcatttggtgctgcaacagaagcaggttcagccgcaattgcagcaggaagccgagccacaaaagcaggttcagccccaagtgcagccccaagcacactcccaaggacccaggcaggtgcagctgcagcaagaggcggagccccttaaacaagtccaacctcaggttcagccacaggcccactcacagccgcctcgtcaagtgcagttgcagcttcagaagcaggtccagacacagacctaccctcaggttcatacccaagcccagccaagcgttcagccccaggaacaccctcctgcgcaggtgagtgtgcagcctcccgagcagacgcatgaacagccccatacacagcctcaggtgtcactgctggcccccgagcagacacctgttgtggtccatgtctgtggtctggagatgcccccagacgcagttgaagcggggggtggcatggagaagaccctaccagagcccgttggaactcaagtgtccatggaagaaattcaaaacgagtccgcttgcggcctggacgtcggggagtgcgagaatcgcgctagggaaatgccaggtgtgtggggtgccggcggctctctgaaagtaaccattttgcaaagcagtgacagtagggcattcagcaccgtcccccttacacccgtgcctaggccaagcgacagcgtgagttccactcctgcagcaactagcaccccgtctaaacaggcgttgcagttcttctgctacatctgcaaagctagctgtagttcacagcaggaattccaagatcacatgtcagagccgcagcaccagcagcggctgggcgagatacagcatatgagccaggcctgcctcctgagcctgctgcccgtgccacgcgacgtgctggagactgaggatgaggaaccaccaccgcggcggtggtgcaacacatgccagctgtattacatgggtgatctgatccagcatcgccgaacacaggatcataagatagccaaacagtccttgagacctttctgcacagtttgcaaccgctacttcaagactcccagaaaatttgtggagcacgtaaaaagccaggggcataaggataaggccaaggaactgaaaagcctggaaaaagagattgctggccaggatgaagaccactttattacagttgatgctgtaggatgctttgagggcgatgaggaggaagaggaggacgatgaagatgaggaagaaatagaggttgaggaagagctttgtaagcaggtacgatccagggatatttcccgagaggagtggaagggatccgaaacctatagcccgaacactgcttacggcgtagattttttggtgccggtgatgggatacatctgtcggatctgtcacaagttttaccattcgaatagtggtgcccagttgagtcattgcaagtctttaggccacttcgagaaccttcaaaagtataaggctgccaaaaacccctcaccaaccacccgccctgtgtcccggcggtgcgcaataaatgctcgtaatgcactcactgctctgtttacctcaagtggccgacctcctagtcagccaaatacccaggataaaactccgtctaaggtgacggcccggccgtctcaacctcccttgcctaggcggtctaccagactaaagacctag

SEQ ID NO: 11424 - DNA, 1743 bp, Artificial Sequence
  Description of Artificial Sequence: Synthetic coding sequence
atggctcaagaagtcagcgagtacctgtcccagaatccacgcgtcgccgcctgggtcgaagcccttcggtgcgatggtgaaactgacaaacactggaggcaccggcgggacttcctgttaaggaatgccggcgacttggcaccagcaggcggagccgcgtcagcctccaccgacgaggcggctgacgccgaaagtggaacaaggaatagacagctgcaacagctgatctcttttagtatggcctgggctaaccacgtctttcttgggtgccgctacccccagaaagttatggacaaaatactgtctatggccgaagggattaaagttacagatgctccgacatacaccacccgcgacgaattagtagcgaaggtgaaaaagagagggatcagtagttctaacgaaggggtggaggagccttctaagaaacgcgtgatagagggaaagaattcctccgccgtggagcaggaccacgcaaagacgagcgccaaaacggaacgcgctagcgcacagcaggagaatagtagcacttgcataggcagcgccatcaaatccgaaagcgggaacagtgctaggtcctccggcataagctctcagaacagttcgacctcggatggggaccggtctgttagctctcagtcctcgtcaagcgtctcaagtcaagtgacaacagccggaagcggcaaggcaagtgaagcagaagcccccgacaagcacggaagcgcgagcttcgtttctctgcttaagtcttcagttaatagtcatatgactcagagtacagacagccggcagcagtctggttctccgaaaaaatctgctctggaagggtccagtgcaagcgcctcacagtcatcaagcgagattgaggtgccccttctgggttcgtcaggctcctctgaagtggaactccctctgcttagcagtaagcctagcagcgagactgcgagcagcggtttgacctcgaagacttcaagcgaggcttctgtctcttcctctgtcgccaagaacagctctagttccggcacaagcttgctaacgcccaagtcctcaagcagtaccaatacgagcttactgacatcaaagtcaacctcacaggtagccgcgtcgttgttggctagcaaaagttcttctcaaacctcaggcagcctcgttagcaagtctacttcactggcttctgtctctcagctcgcatcaaaatccagttctcagaccagcacatcgcagcttccgtccaaatcaacgtcccagagctccgagagctctgtgaagttctcttgcaagctgacgaacgaagatgtcaaacaaaaacagcctttctttaacaggctgtataagaccgtagcttggaaactggtggcagtcggcggcttctcccccaatgtcaatcatggagagctactaaacgctgcgatcgaagccctcaaggctactctggacgtgtttttcgtgccccttaaagaactggccgatctcccacagaataagagttcccaagaatcaatcgtttgtgaactgcgttgcaagagtgtctacctcggaacagggtgtggaaagtccaaggagaacgccaaggcagtcgcatctcgtgaggctctgaagctgttcctgaagaagaaagtggtggtgaagatttgtaaacggaagtatagagggtccgagattgaggatttggtactcttagacgaggaaagccgacctgtaaacctccctcccgctctaaaacacccgcaagagctcctgtag

SEQ ID NO: 11425 - DNA, 564 bp, Artificial Sequence
  Description of Artificial Sequence: Synthetic coding sequence
atgccaggtgagaggcccaccgatgccactgtgatcccttctgccaaacgcgagagaaaggccatcacactggatttgaagctggaggtgttgcgcaggttcgaagctggcgagaaactgtcacagattgcgaaggccttggacctagccatttccaccgttgctaccataagagactccaaagagaagattaaagccagctcccagattgccactccactgcgggccagtagactcacccgccatcgctctgcggtgatggagagcatggagcagctactctcattgtggctggaggaccagtcacagcctaatgccacattatccgccgcaatcgtccaggaaaaggccgagtttgacgatctccagagggagcacggggagggttctcaaacagagcggttccatgcaagccaaggctggctggtaagattcaaagagtgccactgcctgccccatttcaagatgaactctgccgccccatctaataaggacatgtacaccgagatgcttaagtctatcatagaggaaggtgagtacaccccccaagtctccctgacttag

SEQ ID NO: 11426 - DNA, 312 bp, Artificial Sequence
  Description of Artificial Sequence: Synthetic coding sequence
atggcattatcgacaattgtcagccaaagaaagcagataaaacgaaaggccccacgtggattcctgaagcgggtttttaaaagaaaaaagcctcagctgcgcctggagaagagtggggacctgctcgtcaggttccacccctttagcggatgggagtggggcacaggtgaagtgcatctgaattgcctcctgtttgtgcaccgcttggcagaggagagccggactaacgcctgcgcctctaagtgcagagtgattaacaaagaacacgtcctcgctgccgctaaggttatcctgaagaaatctcgtggctag

SEQ ID NO: 11427 - DNA, 204 bp, Artificial Sequence
  Description of Artificial Sequence: Synthetic coding sequence
atggccctcagtactatagtgagtcagaggaaacagatcaaaaggaaagctccgaggggctttctgaaacgggtgtttaaacgcaaaaaacctcaattgaggctggaaaagtcaggagatctcctcaagtcaccaggacaaactttggtccgcgtgaacgttgagtcgttgacaagaagtatgtactggcctcagcagagatag

SEQ ID NO: 11428 - DNA, 267 bp, Artificial Sequence
  Description of Artificial Sequence: Synthetic coding sequence
atggcacttagtaccatcgtcagccagaggaagcagataaagcgaaaggcacccaggggattcctaaaacgcgtatttaagcggaaaaagccacagctaaggctggagaagtccggtgatcttctggtccatctgaattgcttacttttcgtgcatcgactggccgaggaatctcgcaccaacgcctgtgccagcaagtgcagggtcattaataaggagcacgtattggccgctgcaaaagtgatccttaagaaatcacggggctag

SEQ ID NO: 11429 - DNA, 3846 bp, Artificial Sequence
  Description of Artificial Sequence: Synthetic coding sequence
atggtacgcaaaaagaaccccccgcttcgtaatgtggcgtctgaaggtgaaggtcagatcctcgagcccatcggtaccgagagcaaagtgtctggaaagaacaaggagttctcagcagaccagatgagcgaaaacaccgatcagagcgatgctgccgagttgaatcacaaggaagaacactctttgcacgtgcaagacccaagttccagcagcaagaaagatctcaagtctgctgtcctttctgagaaggctgggtttaattacgagtcccctagtaagggcgggaacttcccaagctttccacacgatgaggtgaccgaccgcaatatgctagcattttcctcaccggccgctgggggcgtgtgtgaacctctaaagagcccccaaagggcagaagccgatgatcctcaggatatggcctgtacccccagcggagatagcttagaaacgaaggaggaccagaaaatgtctcccaaagctacggaggagactggccaggcccaatcaggacaggcaaattgccagggactgagccctgttagtgtggcatccaagaacccacaagtcccatccgatggaggggttagattgaacaagtctaaaacagatctgttggtgaacgacaaccctgatcctgcacccctgtccccagaactgcaagatttcaagtgtaacatctgtggctatggctactatggaaatgacccgacagacctgatcaagcacttcagaaaatatcatctcggcttacacaaccgcacgcggcaagatgccgagttagactctaagatcctggcgctccacaatatggtgcagttctcccacagcaaagatttccagaaggtgaaccgcagcgttttttctggggtgctgcaagacatcaacagttcccgacccgtcttactgaatggtacctacgacgtgcaggtcacgtcgggtggtacattcataggcataggcagaaaaacgcccgactgccagggcaatactaaatacttccggtgtaaattctgcaactttacatacatgggcaattcgtctactgagctggagcagcacttcctgcaaacccaccctaataaaataaaagccagtctgccatcttcagaggttgcgaagccgtcggagaaaaactcaaacaagtcaatccccgcgctacagtcctccgatagtggggacctaggcaagtggcaggacaaaataactgttaaagcaggcgatgatacacccgttggttacagcgtccctattaaaccactcgacagcagtcgacagaatggaaccgaggcaaccagttactattggtgcaagttctgctccttcagctgtgagagtagctcatctcttaagcttctggaacactacggtaagcagcatggagccgtgcagtcaggggggctgaatcctgagctgaacgacaagttatctagaggctctgtgatcaatcaaaatgatctcgctaagagttctgaaggagagacaatgaccaagacagataagtcaagcagcggggctaagaaaaaagatttcagcagtaaaggggcagaggataacatggttactagctacaactgccagttttgtgattttaggtactcgaagagtcatgggcccgacgttattgtcgttggcccccttcttcgccactaccagcagcttcacaatattcacaagtgcacaatcaaacactgccccttttgtcctcgcggcctgtgctcacctgaaaaacatttaggggagattacatacccatttgcctgccgaaagagcaactgttctcattgcgctctgctcctgttgcatctctcgcccggcgccgccggctcgtcccgtgtgaaacaccagtgtcatcagtgctccttcaccacacctgacgttgatgtccttctgttccattacgaaagcgtgcatgagtcccaggcgagtgacgttaagcaggaggcaaaccatctccaaggatccgatggacagcaatcagtgaaagaaagcaaggaacacagttgtaccaagtgcgactttattacacaggtggaagaagagatttcacgccattacagacgagcacactcctgttataagtgtcgacagtgttctttcacggcagcggatacccagtcactgttggagcactttaataccgttcattgccaggaacaggatattaccaccgcaaacggggaagaagacgggcatgccatttcaacgatcaaggaggaacctaaaatagactttagagtgtacaacctgctcaccccagattccaagatgggagagcccgtatcagagagcgtcgtcaaacgagagaaactggaagaaaaggacggactgaaggaaaaagtgtggactgagtcatctagcgatgaccttaggaacgtgacctggaggggcgccgatattttgagaggcagcccttcatatacacaggcgagtctggggctcttgacccctgttagtggcacgcaggagcagacaaagaccctgcgggacagcccaaacgttgaggccgcccacttggctaggccgatatatggactcgccgtcgagaccaagggatttctacaaggagcccccgccggtggcgaaaagagcggagcattacctcagcaatacccggcgtctggcgagaacaagtccaaagacgagagtcagagcttgctgcgcaggagaagggggagtggtgtattctgcgcaaactgtctaacaaccaaaaccagcctttggcgtaaaaacgctaatggcgggtacgtgtgcaatgcatgcggtctgtaccagaagttgcattccacaccccgacctctcaatattatcaaacagaataatggagagcaaataattaggcgtcggacaaggaaacggctcaatcccgaagctctacaagccgaacagctcaacaaacagcagcgcggcagtaacgaggagcaggtgaacggatctccattggagcgtaggtccgaggaccaccttactgaatcccaccagcgagagatcccgctgccatccctgtcgaagtacgaggcccagggtagcctgaccaaaagtcactccgcacagcaacctgttttagtttcccagaccctagacatccataaacggatgcaaccactgcacatccagattaaatcgccacaagaatctaccggcgaccccggtaactcatcatccgtatctgaaggaaaaggtagctccgaacgcggtagccctatcgagaaatacatgcggcctgctaagcaccccaactattctccacctggcagcccaatcgaaaagtaccagtaccccttattcgggctgccttttgtacacaatgactttcaatcagaagcggactggctccgattttggtctaaatacaagctctcggttccaggaaatccacattacctgtcccatgtccccggcctgcccaatccctgtcagaattatgtgccctaccctacttttaatctgccaccccatttttccgcggtaggtagcgataacgatattcccctcgacctcgccatcaaacacagcaggcccggaccgacagctaacggagcgagcaaggagaagacaaaggctccacccaatgtcaaaaacgaaggacccctgaacgtggttaaaaccgaaaaggtggaccggtccacgcaggacgagttgagtacaaagtgcgtccactgcgggatcgttttcttggatgaggtgatgtacgccctccatatgagctgccacggcgactccggaccattccaatgttctatatgccaacacctgtgcactgataaatacgattttaccactcacatccagcgtggcctgcacagaaataatgcccaagtggagaaaaatggaaaacccaaagagtag

SEQ ID NO: 11430 - DNA, 2871 bp, Artificial Sequence
  Description of Artificial Sequence: Synthetic coding sequence
atgctggaggaactggagtgtggagctccaggagctcggggcgccgccaccgctatggactgcaaggaccggccggctttcccagtgaagaagctcattcaggcgaggttgcctttcaaaagactgaatctagtccctaaaggcaaggcagatgatatgtcagacgaccagggtaccagtgttcagagtaagtcccccgatctggaagcaagtctcgacaccctggagaacaattgccacgtgggttcagatatagatttccgcccaaagctagtgaatggcaagggaccccttgacaacttcctccggaatcgcatcgaaacgtcaattgggcagtccaccgtgataatcgatctgaccgaggactctaacgaacaacctgattctctcgtcgatcacaataagttaaacagcgaagcttccccatccagggaggctatcaatggtcagcgggaagacacaggcgaccagcagggccttcttaaagcaattcaaaacgacaaattggcatttccaggcgaaaccttatcagatatcccatgtaagacagaggaggaaggagtcggctgcgggggggccgggcggagaggagactcccaggagtgctcaccgcgcagctgccccgagctgactagcggacctcgtatgtgtcctcgtaaagaacaagattcctggagcgaggctggaggcattctctttaaaggcaaggttcctatggtggtgctccaagatatccttgctgtcagaccccctcaaatcaagtccctcccagcgaccccacagggtaagaatatgacacctgagtccgaggttttggagtctttccccgaggaggacagtgtactctcccactcgtctctatcgtccccgagttcaaccagctcaccagagggcccccctgcgccacctaaacagcattcgagcacttccccattccccaccagcacccccctaaggaggattaccaaaaaatttgtaaaaggatccacggagaagaataagttgagactgcagagggatcaggaacggttgggcaaacagctgaagctcagggcagagagagaggaaaaagaaaaactaaaggaggaggctaagcgcgccaaggaggaggcaaagaagaagaaagaggaagagaaggagctcaaggaaaaggaacgcagagagaaacgcgaaaaggatgaaaaggagaaagccgaaaagcaacggctaaaggaggaacggcgcaaggagcggcaagaggctttggaagctaaacttgaagagaagagaaaaaaggaggaggagaaaaggctcagggaggaagaaaagcggatcaaggcggagaaggccgagataactcgtttcttccagaaaccgaagacaccgcaggcaccaaaaaccctcgccggtagttgtggaaagttcgcaccatttgagatcaaggaacatatggtgctggcacccagaaggaggaccgccttccaccctgacctgtgcagtcagctggaccagctactccagcaacagagtggtgagtttagcttcctgaaggacctgaagggaagacagccacttcgatccggacccacccatgtctcgacgcgcaatgccgatatcttcaattccgatgtagtgatcgttgagcggggaaagggcgatggcgtgccagagaggagaaaattcggtagaatgaaactgttacagttttgcgagaatcacaggccagcatattggggcacctggaataagaagacggcattgataagggctagggacccctgggcccaggacacgaaactgcttgattacgaagtcgattcagatgaagagtgggaggaggaggagccaggcgaatctctgtcccactctgagggagatgacgacgacgatatgggcgaagatgaggacgaagatgacgggttttttgtgccacacggatatctatccgaagatgaaggtgttacagaggagtgcgcagaccccgagaatcacaaggtgaggcagaagctgaaggcaaaggagtgggacgaattcctcgccaaaggaaaaaggtttagagtcctgcaacccgtgaagattggctgtgtgtgggctgccgaccgcgactgcgccggtgatgatcttaaggttttacagcagttcgctgcctgtttcttggagaccttgcctgcacaggaagaacagaccccaaaggcttcgaagcgcgaacgcagagatgagcaaatcctcgctcaactgttgccgctcttgcacggaaatgtgaatgggtctaaggtgattatcagggaattccaggagcactgtagaaggggcttgttgtccaaccataccggatctccgaggtccccctcaactacctaccttcacacacctacaccttccgaggatgctgccatccctagcaagtcacggttgaaacgacttatctccgagaattccgtctacgagaaacggccagattttcggatgtgttggtacgtacacccccaggtgctgcagagctttcagcaggaacacctgcctgtgccctgtcaatggtcttatgtaacaagcgttccttccgcccctaaggaggatagcgggtccgtcccatcaacaggtccctctcaagggacacctatctcacttaaacgcaaatctgctgggagcatgtgtatcactcagtttatgaaaaagcggagacatgacggacagattggggcggaggacatggacggtttccaggctgacaccgaggaggaggaagaggaggagggagattgtatgatagttgatgttcctgatgcggcagaggtgcaggccccttgtggagcagcctccggcgctggcgggggagttggagttgacacgggaaaggccaccctgacatctagcccccttggggccagctag

SEQ ID NO: 11431 - DNA, 2250 bp, Artificial Sequence
  Description of Artificial Sequence: Synthetic coding sequence
atgctcgaggagcttgagtgcggggcccccggggctaggggggcggcaacagctatggactgcaaggatcgacccgcgttccctgtgaaaaagctcattcaagcccggctgcccttcaagaggttgaacctggtgcctaagggcaaggccgatgatatgtctgacgaccagggaacttccgttcagtcaaaaagcccagacctggaggctagcttggacacgttggaaaataactgtcacgtcgggtctgatatcgattttcggcccaaactggtgaatggaaagggcccactcgataacttcctgcgcaaccgcatcgagacaagcattggccagtctaccgtgataatagacctgacagaagattctaacgagcagccagacagtttggtggatcacaacaaattgaactccgaggctagtccctcgcgggaagcgattaatgggcagcgggaagatacaggtgatcaacagggattacttaaagctatacaaaacgataagttggcctttcctggggaaacactctctgacatcccttgtaagactgaggaggaaggcgtaggctgtggaggagctgggcgacggggcgattcacaggagtgttctccgcgttcatgcccggaactgacctctggcccccgtatgtgtccccggaaagaacaggattcctggtcagaggccggcgggattctcttcaaggggaaagtccccatggttgtgctgcaggacatcttggccgtcagaccacctcagatcaagtcactgccggctacaccccaggggaaaaatatgacccccgagtccgaggtccttgagagtttccctgaagaggactctgtgttgtctcactcctcccttagctcaccgtctagcacctcatcacccgagggtcctcctgctccacctaagcaacactcctcaacctctccatttccgacatccacacctttacgtcgaatcacaaagaagtttgtgaagggatctaccgaaaagaataagctacgccttcagagagaccaggaacggctcgggaaacagttgaagctgagggccgagagagaggagaaggaaaagttgaaggaagaagcgaagagggcaaaggaagaagccaagaagaagaaggaggaggagaaagagctgaaggaaaaggaacgccgcgaaaaacgcgagaaagacgaaaaggagaaagcagaaaagcagaggctgaaggaggaaaggcggaaagagcgtcaggaggccctagaagctaaactggaggaaaagagaaagaaagaggaggaaaagaggctgagggaagaggagaaacgcatcaaagcggaaaaagctgagataacacgtttctttcagaagccaaagacacctcaagcccccaaaaccctggcggggtcatgtgggaaatttgcaccatttgagatcaaagagcacatggtgttggccccgcgccgtaggaccgccttccatccagatttgtgtagtcagctggatcagctcttgcagcagcagtccggtgagttttccttccttaaggacctcaagggaagacagcctcttagaagtggccccactcatgtgtccacccgcaacgctgacatcttcaatagtgatgtggttatcgttgaacggggaaaaggtgatggcgtgccggaaaggcgaaaatttggtcggatgaagttgctacaattctgtgagaaccatagacctgcatattggggcacttggaataaaaagacggcgctgatccgagcgagggacccatgggcgcaggacaccaaactgctggactacgaggtggactctgatgaggagtgggaagaggaagaacctggagagtcattgtcccactccgaaggggatgacgatgacgacatgggcgaagatgaagacgaggacgatggattttttgtaccccatggatacctcagcgaggatgaaggagtgacggaagaatgtgccgatccggagaatcataaggttcgtcagaaactgaaagccaaggagtgggatgagttcctggctaaggggaaacgatttcgcgtgttacagccggtgaaaattgggtgcgtgtgggccgctgacagagattgcgccggggatgatctcaaggtactacaacagttcgctgctcactgggtgcaccctgagtcacgaggagatgtctgccggatgttacgcgttagtagcccccaatctcgatatctgaatagactgaattcatgtgttaaaagcacgctgagctgcttcacgtag

SEQ ID NO: 11432 - DNA, 2352 bp, Artificial Sequence
  Description of Artificial Sequence: Synthetic coding sequence
atgctcgaggaactggaatgcggggcccccggcgccagaggcgctgccacagccatggactgtaaagatagaccagctttccctgtaaagaagctcattcaggcacggctgccttttaagcgcctgaacctggtccccaaaggcaaagcggacgatatgtctgatgaccaaggaacgtctgtacagtctaaatctcctgacctggaggcgtcattggacactctggaaaacaactgccacgtgggctctgatattgacttcagaccaaagttggtaaatggaaaaggtccattagacaactttctgaggaaccgaatcgaaacaagcatcggccagtctactgtgattatcgacctcaccgaagactctaacgagcagcccgattcgctcgtcgatcataacaagcttaattcagaggcctcaccaagccgggaggctatcaatggccaaagggaggatactggcgatcaacaggggctgctgaaagcaatccagaatgacaagctcgctttccctggggagaccctgtctgacattccttgcaaaacagaagaggaaggggtgggctgcggtggtgccgggaggcgtggagattctcaggaatgtagcccccgctcctgccccgaattaacatccggaccgcgcatgtgccccagaaaggaacaggactcctggagcgaggcgggaggcatactgttcaagggtaaagtacccatggtggtgctccaggatatattagcagtccggccccctcagattaaaagcctccctgccaccccacagggaaagaatatgaccccagaatctgaggttctcgaatcattccccgaggaagacagcgtgctgagccacagtagtctgagctctccttcaagcacttctagcccagaagggcctccagctccgcctaaacagcattctagcacaagccccttccccacttccacccctttgcgaaggattacaaagaaattcgtgaagggtagcactgaaaagaataagctgagactccagagagaccaggagaggcttggcaaacagctgaaattgagagcagaacgtgaggaaaaggagaagctgaaagaagaggctaagagagctaaggaagaggccaagaagaaaaaggaagaagagaaggagctgaaggaaaaggagcgtcgcgaaaagagagaaaaagatgaaaaagaaaaagctgaaaaacagaggctcaaggaagaaaggcggaaagagagacaagaagcactggaggctaaactagaggaaaagagaaagaaagaggaagagaagagactgcgagaggaagaaaaaagaattaaggctgagaaagcagaaattaccagatttttccagaaacccaaaactccgcaggcgccaaaaacccttgccggctcttgcggtaagttcgcaccttttgagataaaggagcacatggtcctcgccccccggaggcgcaccgccttccatccggatttgtgcagtcaattagatcagctcctgcagcaacagtcaggggagttttctttcctaaaggacctgaagggtaggcaaccactcagatccggtcccacccacgtgagtaccagaaatgccgacatattcaattcagacgtggtaatcgtcgagcggggaaagggcgatggggtgcctgaaaggaggaaatttggccgaatgaagctcttacagttctgcgagaatcatcgccccgcatattggggaacctggaacaagaaaactgcccttattagagccagagatccctgggcacaagatacgaagcttctcgattatgaggtagacagtgacgaggaatgggaggaagaagagccaggggagagcctgtcgcattcagaaggcgatgatgatgatgatatgggagaagatgaagacgaggacgatgggttcttcgtgccccacgggtatttaagcgaggacgaaggcgttaccgaggagtgcgcagaccccgagaatcacaaagttcggcagaaactgaaggccaaagagtgggatgagtttctggcgaaaggaaagcgcttcagagtcctccagccagtgaaaatcggctgcgtgtgggctgcagatcgtgactgcgccggagacgaccttaaggtcctgcagcaatttgctgcatgtttcctggagactctgcctgcccaggaggaacagaccccaaaagccagtaagagggagaggcgcgatgagcagattctggcacagctgctgccactgttgcacggcaacgtgaacggatccaaggtgatcatccgggagtttcaggagcactgtcgacgaggcctcctcagtaatcacactggcaaggccactctgactagttcacctctgggagcctcttag

SEQ ID NO: 11433 - DNA, 519 bp, Artificial Sequence
  Description of Artificial Sequence: Synthetic coding sequence
atgacatcagcttctactaaagtcggcgagattttcagtgcagctggtgccgctttcacaaagctgggtgaattgaccatgcagctgcacccagttgccgactcctctcctgccggtgctaagtggactgagacggaaatcgaaatgcttagagcagccgtgaaaaggttcggtgatgacctcaatcacatttcttgtgtgatcaaagaaagaacagtagcccagattaaggccaccgttaaaagaaaggtgtacgaggactctggaataccgcttccagctgagagccctaagaaggggccaaaaaaagtcgcttctggagtattgtctcctccgccagcagctcctccgcctagcagctcttctgtcccggaagccgggggccctcctatcaagaagcaaaaagcagatgttacactatccgcactgaacgacagtgatgcgaactcagatgtagtagatatcgagggattgggcgagacaccccctgccaaaaagctgaactttgaccaggcctag

SEQ ID NO: 11434 - DNA, 579 bp, Artificial Sequence
  Description of Artificial Sequence: Synthetic coding sequence
atgacctctgcctccactaaggtgggtgagattttctccgctgcaggcgccgcctttacaaagttaggagagctgacaatgcagctgcaccctgtcgcggattcgtctccagccggtgcaaagtggaccgagaccgagatcgaaatgcttcgggccgcagtaaagagattcggtgatgacttgaaccatatctcttgtgtgatcaaagaaaggacagtggctcaaatcaaggccaccgtgaagagaaaagtatacgaagacagtgggatccctctgccagctgagtcccccaaaaagggtccaaagaaagttgctagcggcgtcctgtctcccccccccgccgcgcctcccccctctagctcatcagtgcctgaggcaggcggtcccccaattaaaaaacaaaaggcagacgttactctttctgccctgaacgattcagacgccaactccgacgtggtggatatagagggacttggcgaaacccctcccgccaagaaactgaacttcgaccaggactccctcactctggacagcggacttctgatgaccagtgccgatcccccacttttgagctgttag

SEQ ID NO: 11435 - DNA, 417 bp, Artificial Sequence
  Description of Artificial Sequence: Synthetic coding sequence
atgacgtccgcttccaccaaagtgggagagatcttctccgccgccggtgccgccttcaccaaattaggcgaacttacgatgcaattgcaccctgtagcagacagctctcctgctggagcacagattaaggcgaccgttaagcggaaggtgtacgaagatagcggcattccattaccagcagagagccctaaaaagggaccaaagaaagtggcctccggcgttctttcaccacctccagccgcaccccccccgagctcgtcttcagtgcccgaggcgggtggtccccctatcaagaagcagaaggcggacgtgacgctttctgccttgaatgactcagacgctaactccgatgtcgtcgacatcgaggggctgggcgaaaccccccccgcaaaaaaactgaactttgaccaggcatag

SEQ ID NO: 11436 - DNA, 306 bp, Artificial Sequence
  Description of Artificial Sequence: Synthetic coding sequence
atggcctcaaacaaaactactctgcagaaaatggggaaaaaacagaacggcaaatccaaaaaggtcgaggaggccgagccggaagaatttgtggtggaaaaggtgctcgacagacgcgtcgttaacgggaaggtagaatacttcctgaagtggaagggtttcaccgaaaagctggcaaagaagaagatggtccagaaagagaacctttacctaaccgtgaatctgatgactgccaaccagagacgaaaggaaatgctgctcaccaaccaggaagacctgcccgaagtgctgatcctaaaggagtag

SEQ ID NO: 11437 - DNA, 2049 bp, Artificial Sequence
  Description of Artificial Sequence: Synthetic coding sequence
atgacatgccccccaaccgggctctatgggcctgaggggatacttcctgccagaagaactttaaggccacaagggaagggacgctggcagcagctgtgggagactcctaccttgctgtgggaagcaccaaggctcggcttagatacagctcagggccttgagctgctttcattgctaggagcgctggtagcactcggtgcccttctgctgagccctctcagacaccctgtgatttatctgctgctctgggctgcttacctctcagcgtgccaggttggacaggtattcttgtacttccagtgggacagtctgcttcttgagacaggattcctggcggttcttgtggctccgctaaggcccgcttctcataggaaagaggccccgcagggccggcaggcaggcgcactgccacacgaagacctgccattctggctcgtcaggtggctgctgttccgacttatgtttgcttccggggtggtgaaactaactagccgctgtccggcctggtggggcctgacagccctaacctatcactacgagacccagtgtctgccaacacccgccgcgtggtttgcccaccatctcccagtctggctgcacaagctgtctgtcgtggccacttttcttatcgaaattgctgtaccccccctcttttttgcccccatcagacgccttcgcctggccgccttctactctcaggtgctgctgcaggttcttatcattataacaggtaattacaatttcttcaacctcatgacattggtgctcactaccgccttactcgacgaccagcatctggcagcagagcccggccatggctcacggaaaaagacggcaacctcctggcctaaagcgctgttagccacactgtcattactcctggagctcgcagtatacggtctgcttgcttatggcacggtgcactatttcggactcgaggtggactggcaacagcgcaccattcattcgcgcacaacattcacatttcatcagttctctcagtggttgaagactctgaccctgcccactgtgtggcttggcgtggccagcctcgtgtgggagctactgagcgctttgtggagatggacacaggtaaggggctggctaaggaagctgagtgctgtcgtgcaactgagcctcgtggggacagccacggtggctctcttcttaatctccctggtaccatactcctacgtcgagcctggaactcatggccgcctttggacaggtgcacatagactgtttggtgccgtcgagcatctgcaactggcaaactcttacggcctcttccgcaggatgacaggactgggtgggagacccgaggttgttctggagggaagctatgatggacatcattggacagagattgaatttatgtacaaaccagggaacttgtcccgtccgccccccgtggtggtgcctcaccagccccggttggattggcagatgtggtttgcagctcttgggcctcatactcactccccatggttcaccagcctcgtactgcgcctgctgcagggcaaagaacccgtcattcggctggttcagtcccaggtcgctaggtatccatttcacaagcagccccccacatacgtcagggcgcagcgctataaatattggttttcacagcctggcgaacagggccagtggtggcggcgccaatgggtcgaagaattctttccttctgtgtctcttggcgatccaacgctcgaaactctgttgcgccaatttggcttacaggagaagagccctcctcggacacgatcagctaatagcactttggctcaggctttgcactggactagaagtcagctctcccccctagaagctccagccttgctatggggcctgctgatggctgtgggcgctgttagattcgtgcaagccctgctggcaccctgttcactccggtcgagccccctggctccagttagtggggaaaagagacgcccggcctcacagaaagacagcggggcagcctccgagcaagcaacagcggcacctaatccctgctccagctcttcaaggacgacccgacggaagaaatag

SEQ ID NO: 11438 - DNA, 1239 bp, Artificial Sequence
  Description of Artificial Sequence: Synthetic coding sequence
atggaactctccgccgtgggcgagcgggtcttcgcagctgagtccatcatcaagcgcaggatccggaagggacgaattgagtatttggtgaagtggaaaggatgggccatcaagtattctacttgggagcccgaggaaaacatcttggacagccgcttaattgccgccttcgagcaaaaagagcgtgagagagaactgtatggaccaaagaaacgaggacccaagcccaagacatttctactcaaagctcgcgcccaggccgaagcattgcggatctctgatgtgcattttagcgtgaaaccatccgcctcggcatctagtcccaagctgcacagctctgctgcagtgcacaggttaaaaaaggatatccgtcgctgccaccggatgtcccggaggccactgcctcggcctgaccctcaagggggatcaccgggcctaaggccccctatcagccccttctcagagaccgtacgcattatcaaccggaaggtgaaaccaagagaaccaaagcgcaaccgcataatcctaaacttaaaagtgatcgataagggtgcaggcggaggaggagccggccagggcgccggcgcactcgcacggcccaaagtgcccagcagaaatagagtcatcgggaagagtaagaagttttccgagtcggttctccgcacgcagatccgtcacatgaaattcggtgcattcgcgctatacaagcccccaccagctcctttggtggctccttcgcccggcaaagcagaagccagtgcaccagggcccggactgctgctggccgccccagcagcaccctacgatgcacggagctcaggcagtagcggatgcccaagcccgaccccacagagctcagatccggatgatacgcccccaaagctcctgccggaaactgtatccccttctgccccaagctggcgggagcccgaggtgctggatctcagtctacctccagaatcagctgcgaccagtaagcgagctccacctgaagtcacagctgccgcagggcctgctcctccaacagcgcctgaacctgctggcgctagtagcgaacccgaagcgggcgattggcgacccgagatgtccccatgttcaaacgtggtggtcaccgacgtgaccagtaacctgctcacagtgactatcaaggaattttgtaatcccgaagatttcgaaaaagtcgccgctggtgtggccggggctgccggcggtgggggctctattggtgcctccaaatag

SEQ ID NO: 11439 - DNA, 1170 bp, Artificial Sequence
  Description of Artificial Sequence: Synthetic coding sequence
atggaactgtccgcagttggagagagagtttttgctgccgaagcactcctgaagcggcgcattagaaagggtcggatggagtatctcgtcaaatggaaagggtggtcacaaaaatacagcacatgggaacctgaagaaaatatcttagacgccagacttctggcggcatttgaagagagagaaagagagatggagctgtatggcccaaagaagagaggacctaagcccaaaacctttctccttaaggcgcaggcaaaagccaaggcaaaaacctatgagttccgaagcgattcagcacgtggaattaggattccgtaccccggcaggtcacctcaagatctagcaagcacttcgagagcgcgggaaggcttgcgcaatatggggctttcaccacccgccagcagcaccagtacctcctcaacttgtagagctgaagcaccaagggacagggaccgggatcgggatagagacagggagagggatcgcgaacgcgaacgcgagagggaacgggaaagggagagagagcgcgaacgcgaacgaggcacaagccgtgtagatgataagccttcatccccaggtgattcaagtaaaaagcgggggcccaagcctagaaaggagctgccggacccatcccagaggccccttggcgaacccagcgctgggctaggagaatacttgaagggacgaaagctggatgacacccctagcggcgcaggcaagttccccgccggccattcggtcattcagttagccaggcgacaggacagcgaccttgttcagtgcggcgtaacaagcccctcttccgccgaggccacaggaaaactggctgtcgacacatttcccgcacgcgtcatcaagcaccgtgccgcatttctcgaggccaaaggccagggagcacttgaccccaacggaactagagtcagacatgggagtgggccaccgtcttccggcggtggcctctatcgggatatgggcgcacaagggggccgaccctctttaattgccagaattcccgttgcccgcatcctcggtgatccggaggaagaatcctggagccctagcctgaccaatctggaaaaggttgtggtcaccgacgtaacctctaacttcctgacggtgacaataaaggagtctaatacagatcagggattctttaaggagaaaaggtag

SEQ ID NO: 11440 - DNA, 2469 bp, Artificial Sequence
  Description of Artificial Sequence: Synthetic coding sequence
atgaaaatgaaaatccagaaaaaggaaaaacagctatctaatctgaaagttctgaatcacagccctatgtccgatgcttccgttaacttcgactacaagagcccctctcctttcgattgttccacagatcaagaggaaaagattgaggacgtcgcttcccattgtctaccacaaaaggacctgtacactgccgaagaggaggctgctactctatttccccggaaaatgacctcccacaatgggatggaggactccggcggcggcggcaccggggtgaagaagaagcgcaagaaaaaggagccaggggatcaggagggcgcagctaaaggatcaaaggaccgagagccgaaaccgaagcgtaaacgagaacccaaagagcccaaggagccgcgcaaagctaaggagcccaaaaaggccaaggaacacaaagagcctaagcagaaggacggtgcaaagaaagcaagaaagcctcgagaggcaagtgggactaaggaagccaaggaaaagaggtcttgtacggactcagcggcgcgcaccaagtcgcgcaaagccagtaaagaacagggacccactcctgtcgaaaagaagaagaagggaaagcgcaagagtgaaacgacagtcgagagccttgagctggaccaaggtttgacaaaccccagcttgcgtagccccgaggaatccacagagtcaaccgactcccagaagcgtcgaagcggaagacaggtgaagcgcagaaagtataatgaagacctagactttaaagtcgttgacgacgatggcgagactatcgctgtgctaggcgcaggacgcacgtccgctctctctgcctcaaccctagcttggcaggccgaggagccccctgaggatgacgctaatataatagagaagattctcgcgagcaagaccgtccaagaagtccaccctggcgagcctccattcgatctcgaactgttctacgtgaagtacaggaatttttcctatctccactgcaagtgggctaccatggaggaactagagaaagatccgagaatcgctcagaagatcaagaggtttcgcaacaaacaagcacagatgaagcatatatttaccgagcccgatgaggatctcttcaaccctgattatgtagaggtggaccggattctagaggtggcacatacgaaagatgccgaaaccggcgaggaagtgacacactacctggttaagtggtgttcgctgccctacgaggaaagcacctgggaactcgaggaagatgttgatcctgccaaggtgaaagagttcgagtcactacaggtccttcccgagatcaaacacgtggagaggcccgcgagtgacagctggcaaaagctggagaaatctagggaatataagaacagcaatcaactgagggagtaccagctcgagggcatgaactggcttctcttcaattggtacaacagaaaaaattgtatcttggccgacgaaatgggcctgggcaaaactattcagtctattacgtttctttccgaaatttttcttagaggaatccacggaccatttcttattatcgccccactgtctaccatcaccaactgggagcgggaattcaggacctggaccgagatgaacgccatcgtgtaccacggatcacagatatctaggcaaatgatccagcagtatgagatggtgtaccgggatgcccaggggaatcctctgtcgggggtcttcaaattccacgtcgtcattaccaccttcgaaatgattcttgctgactgccccgatctgaaaaagatcttctggggtcggtggaaagacatattgacgcatgggcggttcaagtggcatctgaatgagaaagacatggaaatgatttgtcgtgccctcctagtctattgtgtgaaacattataagggagacgagaagatcaaatcctttatctgggaacttattacgccaactaaggacggacaggcccagactttacaaaatcactccggcctgtcagcacccgtacctagaggcagaaaagggaaaaagacaaagaatcaattattgatacccgagttgaaagatgccgattggctggccacatgcaatccagaggtcgtgctgcatgacgacggctataagaagcatctcaaacagcactgtaacaaggtgctgctgcgagtgcgaatgctctactacctgaaggccgagatactgggagaggctgccgagaaggcctttgaaggcagtccagcgcgtgaactcgatgtgcctctgcccgatatagattacatggaaattcctgttgactggtgggatgccgaagcggacaagtctctcctaatcggggttttcaaacacggctatgagcggtacaatgctatgagagccgatcctgccttgtgctttctggaaaaagtgggtatgccggatgagaagtccttaagtgctgaacagggggtgacagacggcactagtgatattcccgaacgccagcatagatag

SEQ ID NO: 11441 - DNA, 1122 bp, Artificial Sequence
  Description of Artificial Sequence: Synthetic coding sequence
atgtgccaatctcacatgattgggttctgtactagctcagtgaacgaggagaccgagactcagggcgaccagatttcctgtcctaatccgaccacactggtgttccgcacccagatctccagtctgccatccttgcagttgagcaatctgaaagttctgaaccactccccaatgtctgacgcctcggtcaacttcgactacaagtccccctccccctttgattgttccaccgatcaagaagagaagattgaagatgtggcgtcccactgtcttccacagaaagatctctataccgccgaagaagaagccgccacactgtttccccgtaagatgacttcccacaacgggatggaggattctggaggtggaggaactggagtgaaaaagaaacgaaaaaagaaggaacctggcgatcaggaaggcgccgcaaaagggagcaaggacagggaacctaagcccaagcgaaagagggaaccgaaagagccaaaggagccgaggaaggcgaaggagcctaaaaaagcaaaggaacataaggagcctaaacagaaggacggggcaaaaaaagcccgcaagccccgcgaggcctcaggtacaaaagaggctaaggagaaacggtcttgcaccgattccgccgcgaggaccaaatccagaaaggccagcaaggagcagggcccaaccccggtggaaaaaaaaaaaaaaggtaagcgcaaaagcgagactaccgtagaaagtctggaactggatcagggcctgactaatccgtcactccgatctcccgaagaatccacagaaagcacagatagccaaaagcggcgctccgggcggcaggttaaaagaaggaagtataacgaagaccttgatttcaaagtcgtcgacgacgatggagagaccatcgccgtgctgggcgccgggaggacctccgcactcagcgccagtacactggcttggcaggccgaagagccccccgaagatgatgcaaacatcattgagaagatcctggcaagtaagactgtacaagaagtacaccccggtgagccgccatttgatcttgagcttttctacgttaaatatagaaatctttacgtgtatctgaaatactcgctctatctcggctttatctag

SEQ ID NO: 11442 - DNA, 8148 bp, Artificial Sequence
  Description of Artificial Sequence: Synthetic coding sequence
atgaaaatgaagattcagaaaaaggagaagcagttgagcaacttaaaggttctgaatcactctcctatgagcgacgcctctgtcaactttgactataagagcccttcaccattcgactgctccacggatcaggaggagaaaatcgaagatgtggccagtcactgcctcccccagaaagatttgtacaccgctgaagaggaggccgccactctgtttccccgcaagatgacatcccataacggaatggaggattccggaggcggtgggaccggggtcaaaaagaaaagaaaaaaaaaggaacccggcgaccaggaaggcgccgcaaagggctcaaaggaccgagagcccaagcctaagaggaaacgagaaccaaaggagcctaaagaaccacggaaggccaaggaacctaagaaggctaaggaacacaaggagcccaaacagaaagacggcgccaaaaaggctcgaaagcctagagaggcaagcggaacaaaggaggccaaggaaaagcggtcgtgcactgattcggctgcacgcaccaagtcaagaaaagccagtaaggagcaggggcctaccccggtggagaaaaagaagaagggaaaaagaaaaagcgagacgacagtggagtctctcgaactcgaccaggggcttacaaacccgtctctgaggagccccgaggaatccaccgagtcaacggatagccagaagcgcagatcaggacgccaagtcaagcgcagaaagtataacgaggacctagatttcaaggtggtggacgatgacggagagacaattgcagttctgggcgcaggcagaacttcagctctgtccgcctcaactttggcgtggcaggcagaggagcctcccgaagacgatgccaacattatcgagaaaatattggccagtaagactgtacaagaggtccacccaggcgagccccctttcgacctcgagctcttctacgtgaaatatcggaatttcagttatttgcattgtaagtgggccacgatggaggagcttgaaaaagatccgagaatagcccagaaaattaaaagattccgcaacaaacaggcacagatgaagcacatttttacagaacccgatgaggacctcttcaatcccgactacgttgaggtcgaccggattctggaggttgcccacacgaaggatgcggagaccggagaggaggtcacccactatctggtgaagtggtgctcactcccctatgaggagagcacctgggagttggaagaggacgttgatcctgcaaaggtgaaagagtttgagtctttacaagtgttacccgagattaaacacgtcgagaggccagcatcagacagctggcagaagttggaaaaatcacgggagtacaaaaactcgaatcaactgagggaataccagctagagggcatgaattggctgcttttcaactggtataaccgtaaaaactgtattcttgccgacgaaatgggcctgggtaagacaatccagtcaatcacttttctttctgaaattttcctgaggggcattcacgggccatttttaattattgctcccctttcaactatcaccaactgggagcgtgaattcagaacatggacagaaatgaacgcaatagtctaccatgggagtcagataagtcggcaaatgattcagcagtacgaaatggtgtatagggatgctcaagggaacccactttctggagtatttaaattccacgtggtgataacaaccttcgaaatgattctcgccgactgtcccgaattgaaaaaaatccactggtcatgcgttatcattgatgaggcccaccgcctgaagaatcgcaattgcaagctcctggagggcctgaagctgatggccctcgagcacaaggtgctgctgacaggtacacccctccagaactcagtggaggaattgttttctctgttgaattttctcgagccctctcagtttccatctgagactgcatttctagaagagtttggcgatctcaaaaccgaagagcaagtgaaaaagctgcaatcaattctgaagcccatgatgctacgtagacttaaagatgatgttgagaagaacctcgcccccaagcaagagactataattgaagttgagctgactaatatccagaagaaatactatcgcgcaatccttgagaagaactttagttttctcaccaaaggggccaaccaacacaacatgcccaatctcatcaacacaatgatggagctgcgaaagtgctgcaaccatccttatctaataaacggagccgaggaaaagattctggaggacttcagaaagacccatagccccgacgcccccgacttccaacttcaggcgatgatccaggctgcgggaaaactggtgttgatagacaaactcctacccaagctcattgctggagggcataaggtgttgatctttagccagatggtgaggtgcctggatatactcgaggattatctgattcagcggcggtacacatacgagagaatagacggcagggtccgcggcaacttacgccaagccgcaatcgaccgattttgcaagccagatagcgatcggtttgtcttcctattgtgtactagggccggcgggttgggcatcaatctgacagccgcagacacttgcattattttcgactctgattggaacccgcagaacgaccttcaagctcaggcaaggtgtcataggatcgggcagtcaaaggccgtaaaggtttatcggctaatcaccagaaactcttatgagcgcgaaatgtttgataaggctagtctgaagcttggcctggacaaggcagtgctccaggacatcaatcgcaaaggcggcacaaatggagttcagcagctgagtaagatggaggtggaagacctgctgcgaaagggggcatatggtgctttaatggacgaggaagacgagggttccaagttttgtgaggaagatattgatcagatactgcagcggaggacgcacacaataactatccaaagcgagggtaaaggctccacctttgcaaaagcttcttttgtcgcatcaggaaacaggaccgatatctctctggacgacccaaatttttggcagaagtgggccaagatcgccgaactggacacagaagccaagaatgaaaaggaatctctcgtcatcgaccgccctcgtgtgagaaagcagaccaagcattacaattccttcgaagaggacgagttaatggagttctctgagcttgacagtgactccgatgagcgccctaccaggtctcggcgtttaaacgacaaagcacgcagatatcttcgagccgagtgcttccgtgtcgagaaaaatctgcttattttcggctggggtcggtggaaggacatcctcacgcacggtcgctttaaatggcacctgaatgaaaaggatatggagatgatctgccgtgcactgttggtgtattgcgtgaagcactacaaaggggacgagaagataaaatccttcatctgggagctgattacaccaactaaagatggtcaagcacagaccttacaaaatcatagcggcttgtccgctcctgtgccaagaggaagaaaagggaaaaaaactaaaaaccagctcctgattcccgaactgaaagacgccgactggctcgcgacatgtaatcctgaggtggtgctgcatgatgatgggtacaagaaacacctcaaacagcactgcaacaaagtactgttgcgggtgagaatgctgtattacctcaaggccgaaattttgggtgaagcagccgagaaagcctttgaaggcagcccggccagggagttagacgttcccctgcctgacatcgattatatggagattccggtggactggtgggatgcagaagctgataagtcattacttattggcgtttttaagcacggctacgagagatataacgccatgcgcgctgaccctgcactgtgttttcttgaaaaggtggggatgcccgacgagaagagtctcagcgcggagcagggggtcaccgacggtacctcagatatccccgagcggggaaacactgacaaggaggataacgctgaagacaaggttgatggactgcagaagcagactgagtcctcatccgacggcggcgatggtgtcttcagtgagaagaaggatgatagccgcgctgctcaggatggctctgatccagataagagcccctggccagtctcatccgcacttactgccagacttcgaagattagtgacggtctatcagagatgtaacaggaaggaactctgtaggcccgagatcttggggcccgggaatcagggctactgggtacaggaagagatgtttcggcgtacctccgagatggacctgatcaataaggaagcccagaagcggtggactagacgggagcaggccgacttctacagaacagtgtccagctttggagtggtatacgatcaggaaaagaagacttttgattggactcagttcaggatcatcagtcgactcgataaaaaaagcgatgagtcattagaacaatatttttacagcttcgttgcaatgtgtagaaacgtgtgtagacttccaacttggaaggatgggggtccaccagacaccacaatctacgtagaaccaatcactgaagaacgtgctgcccgcaccttgtatagaatcgaactcctccgaaaagtgcgggagcaggtactcaagtgtcctcagctgcacgaaagactccagttatgtcgcccctccctgtacctgcctgtctggtgggagtgtggcaagcatgatagggacctgttgattggcacggccaaacacggccttaataggaccgactgttatataatgaacgacccgcagctatcctttctggatgcttacagaaattatgcccagcacaaacgttcagggacccaagcaccgggtaacctctgttgcttgtatcagactaattctaagctttacgaatccctgacttactcccagatgtctagaactagcgaatcccttgaaaacgagccagagaacttagtccgggtggaatctagggatgatcacttgagccttcctgacgtgacatgcgaaaattttatatccaaggtccaggacgttatatctatcaaccacgacgagagcctgctgcccgagtcacttgagtcaatgatgtatggaaagaaggtgctgagtcaggagccttcctcatttcaagagagtcccagcaccaacaccgagagcagaaaggatgtaataacaatcagtatcagcaaggatggcaattgccagtccggtggtccagaggccgaaatcgccagcggtccaaccttcatgggctcattagaggccggaggcgtcgcacaagccaatataaagaacgggaagcatctgctgatgagcatcagcaaagaaggagagctctgctgcagtgaggccggccagaggcctgagaacattggtcaactcgaggctaagtgtttagcttcccctagcctgaatcccggcaatgagtccgggttcgtcgacatgtgttcgctttccgtgtgcgactctaaacgtaatctctctagcgaccaacagctcattgatctccttgaaaataaatccctggagtctaaacttattctgtcccaaaatcactccgacgaggaagaggaagaggaggagaatgaggaggagaatttggcgatggccgtgggcatgggagagagacccgaggtgttgcacctgactgagcctactaccaatattagccgcgagaaaaaccagggatttcaggatgagaccaagaagggatcattagaggtggccaatcagacccccggcctccagagagcatttccggcacctgcagcctgtcaatgccattgtaaacatatggagaggtggatgcacggcctggaaaatgatgagttcgaaatcgaaaagcccaaagcctatatcccggatctattcaaaagtaagacaaacacgatcgccatggagggggaaccaacggccatccccagccagcccttcaaggttaagcatgagttgctcaaagaaccatggaaagaatccgccgaaggccaaaacgtcttccccacttatcccttggaagggtcagaattgaagagcgaagacatggatttcgaaaacaaggatgactatgatagggacggtaactgccacagccaggactatcctggaaaatatagcgaagaagagagcaaatcaagcacttctggtattaccggcgacattggcgacgaactgcaggaggcgcgcgcgcccactatagcacagctgctgcaggaaaagactctctacagtttttctgagtggcctaaggaccgggtgattattaataggcttgataacatttgccacgtggtgttgaagggcaagtggccatcctcccaacagtacgagccctccggcacactgcccacccccgtcctcaccagctccgctggttcccgaacatccctaagcgagccagaggccgccgagcacagtttttcaaacggtgccgctctcgccgcccagattcacaaggaatcctttctggccccggtttttactaaggatgagcagaagcaccgccgaccctacgagttcgaggtcgagcgcgatgcgaaggccagagggctggagcagtttagtgccacccacggtcacacaccgatcatactgaacggctggcatggtgagagtgcgatggatctatcctgttcttcggaaggctctcctggtgcgacatcaccctttccagtgagcgcctccactcccaagatcggcgccatctcttcactgcaaggagctcttggaatggacttaagcggtatactgcaggctggattaattcaccccgttaccgggcaaattgtcaacgggtctctgagacgggacgacgcagccacgagacggcgccgaggcagacgcaagcatgtagagggaggcatggacctgatttttctgaaggaacaaactctgcaggccggaatacttgaggtgcacgaggacccagggcaggctactctatctaccacccacccagagggacctggtccggctacctcagcccccgagccagctacagccgcgtcaagccaggcagaaaagtcgattccaagcaagtctcttcttgactggctccgccagcaggcggactactcactggaggtccccggattcggggccaatttttcggacaaacctaaacagagaagacccaggtgtaaagaacctggcaagctggatgtgtcatccctgtccggggaagaaagagtgcctgcaattccaaaggaacccggtctccgcggtttcctcccggagaataaatttaatcacaccttggctgagcccattttgagagacacaggtccaaggcgaagaggaagacgacccagaagcgagctgttgaaggccccaagtatcgtagcggattctccttctggcatgggcccactgttcatgaacgggttgatcgccggaatggatctggtaggtctgcaaaatatgcgaaacatgccaggtattccccttacaggactggtgggattccctgcaggtttcgcaactatgcccacgggggaagaagtgaagtctacgttgtccatgctccccatgatgttgccaggaatggcagccgtaccccaaatgttcggagttggcggccttctcagccccccaatggcaacgacctgtactagcacggctcccgccagcctttcttccacgacaaagtctggtaccgcagtgaccgaaaagacagccgaagataaaccttccagtcacgatgtgaagaccgataccctggccgaagacaagccagggcctggcccattcagcgatcagtctgaacctgccatcactacatcaagccctgttgctttcaatccattcctgataccgggggtctccccaggactcatctatccctctatgtttttgtcccccggaatggggatggctctgcctgcaatgcagcaggccaggcatagcgagattgttgggctagagagtcagaaacggaaaaagaagaaaacaaagggagataatccgaacagccaccccgagcctgcaccttcctgcgagagagaaccctcaggcgatgagaactgcgccgaaccctccgcccctctgccggctgaacgggaacacggagcacaggccggtgagggagctctgaaggacagcaacaatgataccaattag

SEQ ID NO: 11443 - DNA, 450 bp, Artificial Sequence
  Description of Artificial Sequence: Synthetic coding sequence
atgaagatgaagatccagaagaaagaaaagcagctgtccaatcttaaggtgctgaaccatagccctatgtccgacgcgtccgttaatttcgactacaagagccccagtccatttgactgtagtaccgaccaggaggaaaaaattgaagacgtagcgtcacactgccttccccaaaaggatctgtacacggccgaagaggaagccgcgacactgtttccacgcaagatgacatcgcataacggaatggaagactcagggggcggtggaacaggtgtgaagaagaagaggaaaaagaaggagccaggggatcaggaaggcgccgcaaaggggtcaaaagatcgggagcctaaacctaaaaggaagcgcgagccaaaggaacctaaagagccgagaaaagcaaaagaacccaaaaaagcaaaagaacataaagagcccaaacagaaagattag

SEQ ID NO: 11444 - DNA, 1578 bp, Artificial Sequence
  Description of Artificial Sequence: Synthetic coding sequence
tgagccagcaaaaccgtccaggaagtgcacccaggcgaaccaccctttgaccttgaactcttttatgtcaaatatcggaacttttcgtacttgcattgcaaatgggccaccatggaggagctggagaaagatccaaggatagctcaaaagatcaaaaggttccgcaacaagcaggctcagatgaaacatatatttaccgagccagacgaggatcttttcaacccagattatgtggaggtcgatagaatcctcgaagttgctcacactaaagatgccgagactggcgaggaggttacccactatctggtgaaatggtgcagcctgccttatgaggagtccacttgggagctcgaagaagacgttgatcccgcgaaagtcaaggaattcgaatcactgcaagttctcccggagataaaacacgtcgagcgacccgccagcgacagttggcaaaagctagaaaagagccgcgaatataaaaacagcaatcagctgcgcgagtatcagttagagggtatgaactggctgctgtttaactggtacaataggaaaaattgcatccttgccgatgaaatggggcttgggaaaaccatccagtcaataacgtttttgagcgagatatttttgagaggaattcacggacccttcctgatcatcgctcccttatcaaccatcacgaactgggaaagggagtttaggacctggaccgaaatgaacgccattgtataccatgggagccagattagcagacagatgatccagcagtacgagatggtgtacagggacgcccagggaaacccactgtcaggcgtgttcaagtttcacgtcgtcattactacattcgagatgattttggccgattgcccagagctgaagaagattcactggggaagatggaaagatatcctgacacatggcaggttcaaatggcacttgaatgagaaggatatggagatgatatgcagagccctgttggtttattgcgtgaagcactacaaaggggatgaaaagatcaagagttttatttgggagctaataacccccaccaaggatggacaagcacagacactccagaaccactctgggctttccgcacctgttccgcgcgggcgaaaaggcaaaaagacaaaaaatcagcttctgatccctgagttaaaggatgccgattggctcgccacctgtaaccctgaggtggtcttgcatgacgacgggtacaagaagcacctaaaacagcactgtaataaagtgctcctccgcgttcggatgttgtattaccttaaggctgaaattctcggcgaggccgccgagaaagccttcgaaggctcccccgctcgagagctcgatgtgcctctgccggatatcgactacatggagataccagtcgactggtgggacgccgaagccgacaagtcactcctcataggtgtgtttaagcacggttatgagaggtacaacgctatgagggcagaccctgcactatgttttctcgagaaagtcggcatgcccgacgagaagtccctgagcgccgagcagggcgtaaccgatggcacgagcgatatccccgagcgccagcaccggtag

SEQ ID NO: 11445 - DNA, 1521 bp, Artificial Sequence
  Description of Artificial Sequence: Synthetic coding sequence
atggcctcaggcgacctgtatgaggtggagaggatcgtggacaaacggaagaataaaaaagggaaatgggagtatctgatacggtggaagggctatggaagtaccgaggatacctgggaacccgagcaccacctgctgcactgcgaggagttcattgatgagtttaatggcttacacatgtctaaggacaagcgtatcaagagcggaaaacaatctagcacctcgaaacttcttcgggactcccgaggtccgagcgtggaaaaactcagccacagaccatccgatcccggaaaaagcaaaggtacctcccataaacgaaaacgcattaatcctccgctggctaaacctaagaaaggctattctggaaaaccatccagcgggggggatagggcaaccaagacggtcagctacagaacaaccccgagcggtctccaaatcatgcccttgaaaaaaagtcaaaatggcatggagaacggcgatgctggctcagaaaaggatgagagacactttggaaacggctcccaccagcctggattagatctaaacgaccacgtgggcgaacaggacatgggcgagtgcgacgtgaaccacgcgacactagccgaaaacggactgggaagcgctttgactaacggcggactcaatttgcattcccctgtgaagaggaaattagaggccgaaaaggattacgtctttgacaagaggctgagatattcagtacggcaaaacgaaagtaactgtcggtttcgggacattgtggttcggaaggaagaggggttcactcacattctgttgagttctcagaccagtgataacaacgcattgaccccggaaattatgaaggaagtcaggcgggcactgtgcaacgcagccacagatgatagcaagctcctgctgttaagtgctgtgggatccgtgttctgttcaggattagattatagctacctcatagggcggctatcctccgatagacgcaaggaaagcactcggatcgcggaagccatcagagactttgtgaaggcttttattcagttcaaaaaaccaatagtcgtcgctattaatgggccagctttaggactcggtgcttccattctgcctctgtgtgacattgtgtgggcctctgaaaaggcttggttccaaactccttatgccacaattaggctgacaccagccggttgtagtagttacacgttcccacagattctcggagtggctctggccaacgagatgttgttctgcggccgcaaattaacagcgcaagaggcatgctcaagagggctggtgagccaggtgttttggccaacaacattttcacaggaagtgatgttaagagtaaaggaaatggcttcttgttccgcagttgtgctggaagagtccaagtgcctggtcagatccttcctgaagtctgtgctggaggacgtgaacgagaaagaatgcctcatgctgaaacagctgtggtcatcatctaaagggctcgacagcctgttcagctaccttcaggacaaaatatatgaagtctag

SEQ ID NO: 11446 - DNA, 1665 bp, Artificial Sequence
  Description of Artificial Sequence: Synthetic coding sequence
atggctagccaagagttcgaagtggaagccatcgtcgataaacggcaggacaagaacggaaacacacaatacttggtcaggtggaaaggctacgacaagcaggatgacacttgggagcccgagcagcatctgatgaactgtgaaaagtgcgtccatgacttcaacagacgacagactgagaaacaaaagaagctgacatggacaactacatctagaatattcagcaacaacgctcgacgaagaactagtagatctacaaaggcaaactattccaagaactctcccaagacccctgttacggacaaacaccacagaagtaagaatagaaagttgtttgcggcatctaaaaatgtgagacgcaaggcagcgagtattctttcagatacaaaaaatatggaaatcatcaactctactattgagactctggcacccgactctccgttcgatcacaaaacagtctccggatttcaaaagcttgagaaactcgatccaatcgcagcagaccagcaagatacagtggtgtttaaagtaacggaaggtaaattgctccgggaccctttgtcacgcccgggagctgagcagactgggattcaaaacaaaactcagattcatcccttgatgagtcagatgtctggctcagtgaccgcctcaatggccaccggttctgctacgcgcaaaggaatagtcgtgctgattgatcccctggccgctaatggaaccaccgacatgcatacttctgtgcctcgggtgaaaggcggtcagcgtaatattaccgacgattctcgggaccagccctttattaagaaaatgcacttcaccatacgcctgaccgagtcagcctccacctatcgcgacatcgtggtgaaaaaagaggacggattcacacagattgtcttgtccactcgctctaccgaaaagaatgcactgaacacagaggttattaaggagatagttaacgccctgaactcagccgctgctgatgactctaaactcgtgttattttccgcagcaggatcggtattttgctgcgggctggattttggctatttcgtgaagcatttgcggaacaataggaatacagctagcctcgagatggtcgacactatcaagaactttgtgaacacgttcattcagttcaagaagcccatcgtcgttagtgtcaatgggcccgctatcggcctgggcgcaagtatactgcccctgtgtgaccttgtgtgggcaaatgagaaggcatggttccagacaccttataccacatttggacaaagcccggacgggtgtagctccattacatttcctaagatgatgggaaaagccagcgctaatgaaatgctgattgctggtcgcaaactgacagcccgcgaagcatgcgccaaagggcttgtttcacaggttttcttaaccggtacgttcacacaggaggtaatgatccaaatcaaagagctggcctcctataatcctatcgtgttggaagaatgtaaagctctggtcaggtgcaatattaaactggaactggagcaggccaatgaaagagaatgtgaagtgctccgcaagatctggtcatccgcacagggaattgagtcaatgctgaaaattcctttgctcggttataaggccgcattccctcccagaaaaacccagaacgaccagcggtggtgtccatag

SEQ ID NO: 11447 - DNA, 1623 bp, Artificial Sequence
  Description of Artificial Sequence: Synthetic coding sequence
atggcatcacaggaattcgaagtagaggccatcgtcgacaaacgccaggacaaaaatggtaatacccagtacttagtcaggtggaagggctacgacaagcaagacgacacatgggaacctgaacagcatctgatgaattgcgagaaatgtgtgcatgatttcaatcgccggcagactgagaaacagaagaaactgacctggactaccacatcccgtatcttctcaaataatgctcgcagacggacgtcacggtccaccaaggccaactactcgaagaacagtcccaaaactcctgtgacagataagcatcaccgctctaagaacagaaagctgttcgcggcaagcaagaacgtacggcgcaaggccgccagtattctgagcgacactaaaaacatggagattatcaacagcaccatcgaaaccctggctcccgatagtccatttgatcacaagactgtgtcagggtttcagaaactggaaaaacttgaccccattgcagctgatcaacaggataccgtggtcttcaaagtgacagaaggcaaactgttgcgggaccccttaagccgtccaggcgccgaacagactggtatacagaataagacacagatccatccgctcatgtctcaaatgagcgggagcgttacagcatcaatggctactggtagcgctacacggaagggcatcgtggttctaatcgaccctctggcggcaaacggtacgaccgacatgcatacttctgtaccacgggtaaaggggggccagcggaatatcactgatgatagtcgcgaccagcccttcattaaaaagatgcacttcaccatcagactgaccgagagtgctagcacctatcgcgacattgtagtaaaaaaggaagatgggtttacccagatcgtactgtctacgcgcagcacggagaagaacgctcttaatacggaagtcatcaaagagatagtgaacgcactgaattctgcagcagctgatgattctaagttggtgcttttttctgcggctggaagcgtgttctgttgcgggctggacttcggctactttgtgaagcatttacggaacaaccggaatactgcctctctagagatggttgacacaatcaaaaattttgttaatacattcattcagttcaaaaaaccaattgtggtgagcgttaatggcccggcaattggcctaggcgcatccatcttgcctctttgcgacctggtttgggcaaatgaaaaggcctggtttcaaacaccctacacaaccttcggccagagcccggacggatgctcatcaataacatttcctaaaatgatgggcaaggcaagtgcaaacgagatgctgattgcgggaagaaaattgacagcgagagaagcatgcgccaagggtctggtgagtcaggtgtttctaaccggaacctttacacaggaggtcatgattcaaatcaaggaactggcctcttataaccccatcgtgctagaggaatgtaaggccctagtgcgctgtaacattaaactcgagctggagcaggcaaatgagcgtgaatgcgaagtgctgaggaaaatatggtcctcagctcaggggatcgagtccatgctcaaatacgtcgaaaacaaaatcgacgagttctag

SEQ ID NO: 11448 - DNA, 1626 bp, Artificial Sequence
  Description of Artificial Sequence: Synthetic coding sequence
atggcctcccaggagttcgaagtcgaagcaatcgtcgataagcgacaggacaaaaacggcaacacacagtacctagtccgttggaaaggttatgataaacaagacgacacctgggaaccggaacagcaccttatgaattgcgaaaaatgcgtccatgacttcaaccggcgccaaactgaaaaacaaaagaagcttacctggacaaccacatccagaatatttagtaataacgcacgccggcggacatctcggtcaactaaagcaaactactccaagaacagtccaaaaactccagtgaccgataagcaccatcggtccaagaattgcaaactttttgcggcctcaaaaaatgtgagaaggaaggccgcatcgaccctgagtgatacaaagaacatggagatcattaactcgaccatcgagacattggccccagacagccccttcgaccataagaaaaccgtcagtggtttccagaagctggagaagttggatcccattgctgctgaccagcaggatacagtggtctttaaggtgacggagggcaaactgcttagggatccactgtcccaccccggtgccgagcaaactgggattcagaataagacccagatgcacccactgatgagccagatgagcggatccgtgactgcatctatggctactggctctgctactcgaaaagggatcgttgtgcttatagatccactggctgccaatggcaccacagatatgcacacttcagttcctcgtgtcaaaggggggcagcggaacatcacagatgatagcaggggacagccttttatcaagaagatgcacttcaccatcagacttactgaaagcgcgataacctatcgcgacatcgtggtcaaaaaagaggatggtttcacacagatagtactttctacgcggagtacagagaagaatgccctgaacaccgaggtgatcaaggaaatggtcaatgcgttgaattccgctgccgctgacgactccaagttggtgctcttcagcgcagctggttccgttttctgctgcggtctcgattttggatactttgtgcggcacctaagaaacgacaggaacacggctagtcttgaaatggtcgacaccatcaagaatttcgtgaacactttcatccaattcaagaagcccatagtcgtgtctgtcaacgggcccgctatcggcttaggagcatccatcctccccctgtgtgatctcgtgtgggcaaatgagaaagcttggttccagacgccatatacaacctttggccaaagtcccgacgggtgttctagtataaccttcccgaaaatgatggggaaagcatcagcaaatgaaatgcttatcgccggcaggaaactgaccgctagagaagcctgcgccaagggcctcgtcagtcaggtttttttaaccgggacttttacacaggaggtgatgatccagatcaaggaactggctagctacaacgccattgtgctggaagaatgcaaagccctcgtccgctgcaatataaaacttgaactggaacaggctaacgagagagaatgcgaagttttacgcaagatatggagtagcgcccaaggtatcgagtcaatgttgaaatacgtggaaaataagatcgacgagttctag

SEQ ID NO: 11449 - DNA, 1668 bp, Artificial Sequence
  Description of Artificial Sequence: Synthetic coding sequence
atggcatcacaagagtttgaggtcgaggccattgtcgacaagcgacaagataagaacggcaacacccagtatctagtgaggtggaagggctacgacaaacaagatgacacatgggaacccgagcagcacctgatgaattgcgaaaaatgcgtacatgatttcaatcggagacaaaccgagaaacagaagaaactgacctggacgacgaccagcagaatcttctccaacaatgcccgccggcgaacctcacgctccacgaaagcaaactattccaaaaattcaccgaaaactcctgtgaccgacaagcaccaccgatccaagaattgtaagttgttcgccgcctctaagaatgtacggagaaaagcggcctcaaccctgtctgatacaaagaatatggagatcattaacagcactatagagacgctagctccagacagccccttcgatcataagaaaactgtaagcgggttccaaaagctggaaaagctcgatcctattgcagccgatcaacaggatacagtcgtatttaaggtaacggagggcaaactcttgagagacccactcagccacccaggcgcagagcagactggtatacagaacaagactcagatgcatcctctgatgagccagatgagcgggagcgtgactgcatctatggccacaggttccgcgacgcggaaaggcattgtggttctgattgatcccttggctgcaaacggaactacagacatgcacacgtccgtgccaagggtcaagggaggtcagagaaacattacggatgattcccgcgggcaaccctttataaaaaaaatgcattttacgatacgtctaaccgagtccgcaatcacttatagggatatagtggttaaaaaagaagatggcttcacacagatcgtgctctccacaagaagcacggaaaagaatgccctgaacactgaggtgatcaaggagatggttaacgccctgaattccgccgctgccgacgactccaaactggttcttttttcagcggcagggagtgttttctgctgcggacttgactttggctacttcgtacgtcatctccgcaacgacagaaacactgctagcctcgaaatggttgacacaatcaaaaatttcgttaatacctttatccagtttaagaaacctatcgtcgtcagcgtgaatggccccgccatcgggctgggggcttccatcctgccgttgtgcgacctggtatgggccaacgaaaaagcatggtttcagactccgtacacaacatttggacagagccctgatggctgctcctccatcaccttccccaaaatgatgggcaaggccagcgccaacgaaatgctgatcgcgggacggaaactgacagcccgggaggcatgtgcgaagggattagtgtcacaggtgttcctgacagggactttcacacaggaagtcatgatacagattaaggagctggcatcttataacgccattgtcctcgaagaatgcaaggccctggtgaggtgtaatatcaaactggagctagagcaggcaaacgagagggaatgtgaagtgttaagaaagatctggtcctccgctcaggggatagaaagtatgctcaagatccccctgttgggctataaggccgcatttcctccacgtaagacccagaacgaccagagatggtgtccctag

SEQ ID NO: 11450 - DNA, 423 bp, Artificial Sequence
  Description of Artificial Sequence: Synthetic coding sequence
ggacccccagaacaatccctactcctcacggaggcttggagttgggccagcaagaaaaaacagccccacctgttcagcggcgtgatagtcggtggccatctctggttgctaggcttttcacctggggctggaggcttctgcaccacactgccgccttcctttctgagggtggatgaccgggccacctcatcaacaaccgattctagccgcgctccctcaagtcccaggccgccagggagcacttctcactgcggaattagtacacgatgtacagagaggtgtctctgcgtcctccctctgaggacttcccaagtgcctgacgttatggctccacagcacgatcaggaaccaaaaaggcgcatgtacttcatttggttgggctggatacccagcgataagccttctcaactgactgagcggtag

SEQ ID NO: 11451 - DNA, 510 bp, Artificial Sequence
  Description of Artificial Sequence: Synthetic coding sequence
cctccggagcaaagcctgctgctcacagaggcttggagctgggcatccaagaaaaagcagcctcacctcttcagcggcgtaatcgttgggggacacttgtggctgttgggtttcagccccggcgctgggggtttttgtacaaccctacctccaagtttcttacgggtagacgacagggccaccagcagcactacagattccagtcgggctccctccagtccgcggcctcctggatccacttctcactgtggaatttcaacgcggtgcactgaacgttgcctttgtgtcttgccgctccgcacttcacaggtcccagatgtgatggcacctcagcacgaccaggagaaattccatgacctggcctactcatgtttaggtaagtccttttcaatgagtaaccaggacctttatgggtatagcacatccagccttgcgctcggactggcttggctttcctgggagaccaagaaaaagaatgttctgcacttagttggcctcgactctctgtag

SEQ ID NO: 11452 - DNA, 567 bp, Artificial Sequence
  Description of Artificial Sequence: Synthetic coding sequence
tgagcacagaggggccccggtaaagcaggactgactgggggaagggagagactggagagaggcgctagagccgccaggacggatcagcaccagcgcatccaagaggaggagagggacttgactggctctggcgacatttctccacctcagcaccctagcaggcactctttctccccgggtgcaggtgggttttgcactacactgccaccaagctttttgagagtggacgatagagcaacaagcagtacaactgatagcagtcgcgcacccagcagtcctcgacccccgggatccaccagccactgcgggatttcaactcgctgtaccgagagatgtctctgcgtgttaccacttagaacgtcacaagtccctgatgtcatggccccccagcatgatcaagagaagttccacgatctggcttacagctgcttagggaagtcattctctatgtctaaccaggacctgtacggctattcaacttcatcgcttgctctcggacttgcctggctgtcatgggagaccaagaagaagaatgtgcttcacctcgtcggcctggactctctgtag

SEQ ID NO: 11453 - DNA, 471 bp, Artificial Sequence
  Description of Artificial Sequence: Synthetic coding sequence
atgttcctgacagaggatctgatcacttttaacttgagaaatttccttctctttcaactttgggagtcatcattctctcctggcgccggggggttctgcacgaccttacccccttccttcttacgagtggatgatagagctacgagctccaccacggactcatctcgtgcaccttcctctccgagaccccccggaagcacctctcactgcggcatttctacacgctgcaccgagagatgcctctgtgtcctgcccctccggactagccaggtccccgacgtgatggctccgcagcatgaccaagagaagttccacgaccttgcctattcttgcctgggcaagtcattctccatgtctaaccaggatctctacgggtacagtactagctccctggccctgggtttggcatggttaagctgggaaactaagaagaagaatgtgcttcacttggtgggattagattccctgtag

SEQ ID NO: 11454 - DNA, 201 bp, Artificial Sequence
  Description of Artificial Sequence: Synthetic coding sequence
tgacagccccaggggcctccagaacagtcactgctgctgacggaggcttggtcatgggccagtaaaaaaaaacagcctcaccttttttctggcgttatcgtgggtggacacttgtggctgttgggacccaaacgccgtatgtatttcatctggcttggctggatcccgagcgataagccctctcagttgactgaacgttag

SEQ ID NO: 11455 - DNA, 3615 bp, Artificial Sequence
  Description of Artificial Sequence: Synthetic coding sequence
atgggcgatgcaaaggaggctggcgccgaagggcctccggcgggagctgccgcgcgaggagggctgtctctgctgtcgcagggcgagtccgaagaaagctccgcgcagggctccgcactgttcctcgggggtaatgaggtgaagagcagggctgtcgtaaaatactctagcgctccaccccggacagcctttgcccgcctagaggaaaaaacagatcttaaactcccgccagccaattggctccgggagtccgcgaaactcggtcccgccggaactactattcttggtaattcgaaaaagtccaaaccctttagctccttcggaatggcctacgacttcattgattctgttgggaacgatgttgacgtcgtcagtgattctgaaaatattaaaaagcttcttaagatcccctattccaagtctcatgtaagcatggctgtgcaccgtattgggaggaccttgttactggatgaactcgatattcaagaactgtttatgagaagttcacagaccggcgactggacttggctcaaagagttctaccaaaggctgatcgatcagaagtggcaaagaaaaaaaaagtctaaagagcactggtaccagaaagcaatccttagcaagtttctatattattctataaacggggatggcgccgcacaaccagtgtccagcactgccgaacaacaggaaagttcctcgtccgatcaaacgaacgattctgaaggtgcatcgtggcccgcgcctttcgagatgccaagttctgttagtgaggacccttctgcaagcagtcagggcctcaagaacgatttcgtgaggaacatcctctggacttttgaggacatccatatgttagtagggtccaatatgcccatattcggcggtggaagatatccggctgtatcactgaggctgagagacaacaacaagccaatcaatgttttgacaggtatcgactattggcttgacaacctcatctgcaatgtcccagaacttgtcatgtgtttccacgttaacgggattgtgcagaaatacgaaatgatcaaaactgaggagattcccaatcttgagaactccaatttctcaacaaaggtaatcaaggacattgcccagaacatactgtcattccttaaatcaaattgtacaaaggagggccatacatactggctatttaaggcgtcagggagtgatatcgtaaagctgtacgacctcacaacactatgtgaggaaaccgaggataaataccaaaatccctttactatgcctgtggccatcttgctgtacaaggtcgcatgcaacatgatgatgaagaaaaatcagaacaagaaacactatggcactattcggactctgctgctcaattgtctgaagctgctcgataaatccaggcatccccaaatcatagcatctgccaattacatgctttctgagctattccagcttgacgagcctaaaaaagaggagaacagtgaatcgccattgaatgaaaattctgacgagtcctacagtgaggaggaggaggaaatgccggacagcgatgaaaatgggagttatagtacctcttccgacccaagcgatgattctaaagctgtggcaatcattaaaagcgtgggagaactgagcgtgccggaaaagtacaagtccatccaccaaattaggccttcctgcgccttcccggtctgccatgacaccgaggagagatgtcgcctagttctcagctacgtcctggaggggttaaaaagcgtggactcatcaataaagaaagaatccgacctgcccgccgctgacccctccactcctattcccctgaagtacgaggacgagagcagtagaggcggtcctgagggcttggagaaacagatggccttatttctggataagatgggatctctacaaaagggtaactattcctcccagtctgggatgatccctggttcctggcagcataagatgaaattacagctgatcctgaaatctagcaaagcttattacgttctcagcgacgccgcaatgtccctccaaaaatatggacgtgcattgagatatatcaagcttgcactgcagagtcacgacacgtattgctgtctgtgtacgaatatgctgagtgaagtgcttctgtttctctcccaatacctcacattatgtggagatatacaactgatgttggcccaaaatgccaacaaccgcgctgcccatctggaggagttccactaccagacaaaagaggaccaagagatactacacagcctacaccgggagagctcatgccagggctttgcgtgggcaaccgacctgtcaactgacctcgagagccaactgtcggtcagttgcaagtgctacgaagccgcaaatgagattctccagttctccgatttgaagtcacaaaatcccgaacactacgtgcaagtgctcaagcggatgggtaacattcgaaatgagataggagtattctacatgaaccaggcagcagcactgcaatcggagaggctcgtaagtaaatctgtgtcagcagcggagcagcagctctggaagaagagctttagctgcttcgagaagggtatccacaattttgaaagtatcgaagacgccactaacgccgctctgcttctgtgcaacactgggagactcatgcgcatatgtgcccaggcccattgcggcgccggagatgagctgaagcgggagttctctccagaagagggtctgtactacaacaaagcaattgactattaccttaaagcgctgcgatcactgggcactagagatatccaccccgctgtatgggactcagtgaactgggaattatccacaacttatttcacaatggcgacactgcagcaagactacgctccactgtcaaggaaagctcaggagcagatagagaaagaggtttctgaagctatgatgaagtccttgaagtactgtgacgttgatagcgtctctgccagacagcccttgtgtcagtaccgcgccgctacaattcaccaccgcctcgcaagtatgtaccatagctgcttgagaaatcaggtgggggacgaacatttaagaaaacaacatcgcgtgctcgcagacctgcactactccaaagcagccaagctgttccagctgctcaaggacgcaccatgcgaattgctccgggtacagttggagcgggtcgcctttgccgaattccagatgacttcacagaattccaacgtcgggaagttgaaaacattatcgggagctctggacattatggtgcggacagagcacgcttttcagctgattcaaaaagaactgatcgaagagtttggccagcccaagtctggcgacgccgcagccgccgccgacgcttccccgagcctaaacagggaagaagtgatgaagctcctctccatattcgaatccagactcagcttcctgctcttgcagtctattaagcttctgagcagcaccaaaaagaagacctctaacaacatcgaggacgacaccattttaaagacgaataaacacatctattctcagctcctcagggctacggctaataagaccgccactctgctggaacgcattaatgttatcgtacacctcctcggtcagctggcagctggatccgccgcctctagcaacgctgtgcagtag

SEQ ID NO: 11456 - DNA, 3717 bp, Artificial Sequence
  Description of Artificial Sequence: Synthetic coding sequence
atgggcgatgctaaggaggccggggctgaaggccccccagccggcgctgctgccaggggcgggctcagcttgttaagccagggggagagcgaggagtccagcgctcaggggagcgccttatttctcggggggaatgaggtcaaatctcgggcagtggtgaaatacagctctgccccgccacggacggcgtttgccaggttagaggagaaaacagatctgaagctgccaccggcaaactggcttcgagagtccgctaagctcggccctgcaggcactaccatcttgggcaactccaagaaatccaaaccgttctcatcttttggcatggcttacgactttatcgacagcgttggcaacgacgtcgacgtggtttcagattccgaaaatattaagaaactgcttaagattccttattcaaagtcacacgtgtctatggcagtacacagaatcggcaggactctattacttgacgagttagacatccaggaactgtttatgcgctctagtcagaccggagactggacctggctcaaggagttttaccaaaggctgatcgatcagaagtggcagaggaaaaaaaagtctaaagagcactggtatcaaaaggccatcttatctaagtttttatactattccatcaatggcgatggtgccgctcagcccgtgtccagtactgccgagcaacaggaatccagctcatcagaccaaaccaacgattctgagggagccagctggcccgccccctttgagatgccatccagcgtttccgaggaccctagcgcaagcagccaggggtccgagcctttagagccaagctatattgtaggccacgtggcttccgcgccgaaggagcagaacttaataacgctgtttaatgatggagaacactctcagggtctcaaaaacgatttcgtccggaatatcttgtggacattcgaagacatccacatgctggtgggatccaatatgccaatatttggtggcgggcggtatccggcagtttcattaaggcttcgtgataacaacaaaccgataaacgtcctgaccggaattgattactggcttgataacctcatttgtaacgtgcctgagctggtgatgtgcttccacgttaacggcattgtccaaaaatatgagatgatcaaaaccgaggaaatacctaatctcgagaacagcaatttctctaccaaggtgatcaaggatattgcgcagaacatactctcgtttctgaagagcaattgtactaaggaagggcatacttactggctcttcaaggctagtgggagcgacatagtcaagctgtatgacttaactaccctctgcgaagagactgaagacaagtatcagaacccctttactatgcctgtggccatcttgctgtacaaggtggcgtgcaacatgatgatgaagaagaatcagaacaagaagcactatggcactatcaggactctgctcctgaactgtcttaagcttctcgataagagtaggcatcctcagatcatcgctagcgccaattacatgctgtcggagctgttccaactcgatgagcccaagaaagaagagaatagcgagtcccccctgaatgaaaatagcgatgaaagctattcagaggaggaagaggaaatgcctgactccgatgagaatgggtcttatagtacatcatcggacccaagtgacgacagcaaggccgtcgctatcatcaaatccgtcggagaactgagcgtgccagagaaatataagtccattcaccagattaggccctcttgcgccttccctgtctgtcacgacactgaagagagatgccgtttggtgctaagctacgtgctcgagggcttaaaaagcgttgattcaagcattaagaaggagtccgacctgcctgccgccgacccatctacacccatccctctgaagtatgaggacgagtccagtaggggtggccctgaggggctagagaagcaaatggcccttttcttggataaaatggggagcctgcagaagggcaactactcatcacagagcggcatgatacccggttcctggcagcacaaaatgaagctgcagttgatactgaagagctcaaaagcctattacgtgctgtcggatgctgctatgagcctacagaagtacggccgggcactgaggtatataaagcttgcgcttcagagccatgacacctattgctgtctctgtacgaatatgctttctgaagtgcttctgtttttatcccagtacctcacactatgcggagatatccagctcatgcttgcccagaatgcgaacaacagggcggcccatctcgaagaatttcactaccagactaaggaggaccaggagatcctacacagccttcaccgcgaatcctcttgtcagggttttgcatgggccactgatctctctacagaccttgaatcacagctcagcgtgagttgtaagtgctatgaagccgctaacgagatcctgcagttctccgacctgaagtctcagaatcctgagcattacgtacaggtcctgaaacgtatgggcaatattcgcaacgagatcggcgttttctacatgaaccaggccgctgccctgcagagcgaaaggctcgtctccaaatctgtgagcgccgctgaacagcagctgtggaagaaatccttttcttgcttcgagaaaggtatccataatttcgagagcattgaagacgctacgaacgctgccctgttattatgcaacacgggacgattgatgaggatatgcgcccaggctcattgcggggccggagatgagctgaagagagagttttctccggaggaaggcctttattacaataaggcaatcgattactacctaaaagcgctacgatcacttggcacacgcgacattcaccccgccgtatgggacagcgtgaactgggaactcagcaccacttatttcactatggccactttgcaacaggattacgcccccttgtcccgcaaggctcaagaacagatcgaaaaagaagtgagtgaagctatgatgaaaagtctgaaatactgtgatgtggactccgtgtctgcacgacaaccgctgtgccagtacagggccgccacaatccatcatcggctagcaagcatgtaccacagttgtctgagaaatcaagtgggcgacgagcacctccggaaacagcacagggtgttggctgaccttcactactccaaggccgccaaattgtttcagctgctgaaggacgcgccctgcgagctgttgagggtccagctggagcgagtcgcgttcgccgaattccagatgacttcacaaaatagcaacgtgggcaagctaaagacacttagtggcgcgctcgatataatggtgcgtactgagcacgcattccagcttatccagaaggaactcattgaagaatttgggcagccaaagagtggagatgccgcggccgccgccgacgcctctccttccctgaatagggaggaggttatgaagttgttgtctatatttgaatcccggctttcttttctcctacttcagagcatcaagttgctgtcgtccacaaaaaaaaagacctccaacaacattgaggatgatacaattttgaaaaccaataagcatatttactctcaactgttgagagctactgccaacaagacagctaccctgctggagcggattaacgtgatcgtgcatttactgggccaattggctgccgggtccgccgcctcctctaatgccgtccagtag

SEQ ID NO: 11457 - DNA, 954 bp, Artificial Sequence
  Description of Artificial Sequence: Synthetic coding sequence
agtatacaccagataagaccaagctgtgcattcccagtgtgtcacgacacagaagagcgatgtcgtctggttctaagctatgttctggaaggcttgaaaagtgtcgacagttctattaaaaaagagtccgacctacccgcggcagatccttccacgcccatccccctcaagtacgaggatgagtcaagtcgcggaggccccgagggcttagagaaacaaatggcactctttctggacaaaatggggagcttgcagaaaggtaactactccagtcagagtggcatgattcccgggtcgtggcagcacaagatgaaactgcagctgatactgaaatcatcgaaagcgtattacgtgctcagtgacgccgctatgtccttacagaaatatggtcgagcactccgctatatcaaactcgcattacagagtcacgatacatattgttgtctatgcaccaacatgctaagtgaggtcctgctctttcttagccagtacttgactctgtgcggagacatccagctgatgttagcacagaatgccaataacagggccgctcatctggaggaatttcactaccagaccaaagaggatcaagaaatcctgcacagcctccaccgggagtcaagctgccaaggagtgcctcaagcttggacgacgtggtttacggtgggcctgtgctccttggctcacgcatatctgtcaatccagaagcgggggcgaaatatccgggtgcttattttcgcgctgtatttatttatttactttctgcgcaggagctttgcactcgtcgcccaagctggcgtccaatggtgtaacctagggagtctaaagccccctccaccgggctttaagcaattctcatgcctgagcctgcccagttcttggaactatcgccatgcccccccctgcccagcttctcctccatggcccccaaaagtgctgggattacaggtctag

SEQ ID NO: 11458 - DNA, 2391 bp, Artificial Sequence
  Description of Artificial Sequence: Synthetic coding sequence
atgggggatgccaaagaagctggggccgaaggtccccctgcgggagcagccgcacggggcggtctctctcttctctcccagggcgaaagcgaggagtccagtgcccaaggatcggcactctttctcggcggcaatgaagtcaaaagcagagctgtcgttaagtattccagcgcccctccacgcacggctttcgctagactggaagagaagactgaccttaagctgccccccgcaaattggttgagggaatctgccaagttgggtcccgctggcaccacaatcctgggtaactctaagaaatccaagccattttcatctttcggcatggcctacgatttcatcgacagcgtcggaaatgacgtggacgtcgtctctgactccgagaacataaaaaaattactcaaaatcccctactcgaagagccacgtcagtatggccgttcaccggataggcaggactttgctgttagacgaactggatattcaggaactttttatgaggtcttcgcaaaccggcgattggacctggttgaaagagttttatcagcggctcattgaccaaaagtggcagcgcaagaaaaaatctaaagagcactggtaccagaaggccatcctgtctaagttcctgtactatagcatcaatggggacggggccgcccagccagtgtccagcaccgcggagcagcaagaatcgtccagtagtgaccagaccaatgattcggagggggcctcctggcccgctcctttcgaaatgccctcgtcagtatctgaggatcccagcgcaagctcccagggcagtgagcccctggaaccttcctacattgtgggccatgtggcttcagctccgaaagagcaaaatttgatcacacttttcaatgacggcgagcactctcagggactgaaaaacgatttcgtgcgcaacatactgtggacatttgaagacattcacatgcttgtcgggagtaacatgcccattttcggcggtgggcgttaccccgctgtgagcttacggttgagagacaataataagcctattaatgtgcttacaggcattgactactggctagataacttgatctgcaacgtgccggaactagtaatgtgcttccacgttaatggcattgttcaaaagtatgaaatgatcaaaactgaggagatcccaaatctggagaattcgaacttttccacgaaggtgatcaaggacatcgcccagaatattctgagcttcctcaagtcaaattgtactaaagagggacacacatattggttgttcaaggctagcggaagcgatatagttaagctttacgatctgaccaccttgtgtgaagaaacggaagataagtaccaaaacccatttacgatgcccgtggctatcctgctttacaaggtggcttgcaacatgatgatgaaaaaaaaccaaaataagaagcactacggaacaattaggacattgttactcaactgtctcaagctgctggacaagtcgaggcatccacagattatcgcttctgcaaactacatgctttccgagttatttcagctggacgaaccgaaaaaagaggaaaactcagaatctccattgaatgagaactccgacgagagctactccgaagaagaggaagagatgccagattcagacgagaatggtagttatagtaccagtagcgatccatctgacgactccaaagcagtagccatcatcaaaagtgtaggcgaactgtcagttccggaaaaatacaagtcaatccatcaaattcggccatcttgcgcgttccccgtctgtcatgacaccgaggagcgttgccggttggtgctctcttatgtgctggaaggactgaaatctgtggatagttcaattaaaaaagagtccgacctgcccgcagccgacccatccacccccattccactgaaatacgaagatgaatcaagcagaggcggacctgaaggcctggaaaagcagatggctctgtttttagataaaatggggagccttcagaaaggaaattattcaagccagtccggaatgatcccagggtcttggcagcacaaaatgaaactgcagctgatactgaagagctccaaagcatactacgtcttgagtgacgccgcaatgtcacttcagaaatatgggagggctttacgctatatcaagctggcattgcagagccatgacacctactgctgcctctgcacaaacatgttgtcagaggtgttgttgttccttagtcagtatctaacattgtgtggcgacatccagcttatgctggctcagaacgccaacaatagagcagcccatcttgaggaatttcactaccagaccaaggaggaccaggaaatcctgcatagccttcatcgcgagtctagttgtcaggtgttccggaagggagtgtag

SEQ ID NO: 11459 - DNA, 2490 bp, Artificial Sequence
  Description of Artificial Sequence: Synthetic coding sequence
atgggcgatctgaaatctggatttgaggaagtggatggggtccggcttgggtatcttatcattaaggggaaacagatgttcgcattgtcccaagtgttcacagacctcctgaagaatatacctcggaccacggtccataagcggatggaccatttaaaggttaaaaagcaccactgcgacctcgaggaattgaggaagttgaaggccataaattccattgccttccatgccgctaaatgcacgctaattagccgcgaggacgtggaagccctttacacaagctgcaaaactgaaagagtccttaaaaccaaaaggaggcgggtcgggagagctttggcaaccaaggcacccccacctgagcgggccgcagccgcatctccccggccagggttttggaaggacaaacatcaactgtggaggggcctgagcggcgccgcccgccccctcccaatttccgcccaatcccagaggcccggagctgcggcagccaggccagctgcacacctcccgcagatcttttccaaataccctggctctcactaccccgagattgttcgctccccttgcaaaccaccgttaaattatgagactgctccactacagggaaattacgttgcatttccatctgaccctgcctacttccggtccctcctgtgcagtaagcaccccgctgcggccgccgcggcggcggccgccgcagccgcggctgcggccgccggggccacatgtttggagcgatttcacttagtaaatggattctgtccccccccacaccaccaccatcaccatcaccatcaccatcatcatcaccatcatagggcccagcccccccagcagtctcaccatccacctcatcatcaccggccacagcctcacttggggagtttccccgagagttgcagctccgactctgaatcttctagctatagcgaccacgccgctaatgattccgatttcggctcctcattgtcctcctctagtaatagcgtgtcatccgaggaagaggaggaggagggcgaagaagaggaggaggaggaggaggaggaagggggatctggagcatccgattctagcgaagtctcgtctgaagaagaagattcatccaccgaaagtgacagttcctcgggaagtagccaggtttcagtgcaatcaatcagatttaggcgcacaagcttttgcaagcctccttccgtgcaggcccaggccaatttcttatatcacctagcctcagctgctgcagctacgaagccagctgcatttgaagacgccggtcggcttcctgacctgaagagcagcgtgaaggcagagagccctgcggagtggaacctgcagtcatgggcgcctaaggcttctcccgtatactgccccgcctcgctcgggagctgcttcgccgagattcgcaatgaccgggtgtccgagattacgttcccacactctgaaatcagcaacgctgtcaaaagaacagaccttactattaattgcctggccgagggtgcctcttcgccaagcccaaagacaaataacgcttttccgcagcagcggatattgcgcgaggcccgaaagtgtctgcagacaacacccaccacccattgcgccgacaacaataccattgccgccaggttcctcaataacgactcgtcaggagcagaagcgaattctgagaaatactccaagatcctgcactgccctgagtttgccacagacctgccaagctcccagacagaccctgaggtgaatgctgcaggagccgccgcaaccaaggccgagaacccttgcacagatacaggcgacaaaacactcccattcttacacaacataaagatcaaggtcgaggacagctcagccaacgaggagtatgagccccacctctttactaacaagctgaaatgtgagtgcaatgacacgaaaggcgagttttactccgtgacagagtccaaagaggaggatgccctgctaactactgcaaaggaggggttcgcctgtcccgagaaagagaccccatctctaaacccattagcccagtcacaaggcctaagttgcactttgggctccccaaagcccgaggacggagagtacaaattcggggcgagggtgaggaagaattatcgtactcttgtgctcggcaaacgccccgtcctgcaaacaccccccgttaaacctaatctgaaaagtgccagaagccccaggccaaccggcaaaactgagacgaacgaaggcaccttggacgactttaccgttatcaatagaaggaaaaaggtcgcttctaacgtggccagtgccgtgaagagaccgtttcactttatggctaactttccatgccccccttcgcttattatcggacgcgacggagacctttggccagcatattctctaaacaccaccaaggacagtcagacgccccataaagcacatcccatctggaagtggcagctggggggcagtgccattcccctgcccccatcccacaaatttcggaagtttaactcttag

SEQ ID NO: 11460 - DNA, 2727 bp, Artificial Sequence
  Description of Artificial Sequence: Synthetic coding sequence
atgggtgacctcaaatccggattcgaggaagtggacggtgtgcggctcggctatctgatcatcaagggtaagcagatgttcgcgcttagccaggtttttaccgacctgctgaaaaacatcccaagaacaaccgttcataaacggatggatcatctgaaggtcaagaagcaccattgcgatctcgaggagctgcgaaagctgaaagctattaattcgattgcttttcacgcagcaaaatgcactctgatcagcagagaggatgttgaagcactctacacttcatgtaagacggaaagagtgctgaaaactaagcgccgtagggtgggcagagcgttagccaccaaggcaccaccacccgagagagctgctgctgcatcacccagaccgggcttctggaaggacaagcaccaactgtggcgcggactgagcggggccgccagacccttgccgatatctgcccagagccaacggcctggagccgccgctgcccgacctgctgctcacctgccccaaattttctccaagtaccccggttcacactaccctgagattgtgcgctctccttgcaaacccccgctaaattatgagacagcccccctgcaagggaactatgtcgccttcccaagcgaccccgcttactttagatctttgctgtgttccaaacacccggccgccgcggccgctgcggctgccgctgcagccgcagctgccgcggcagccgcagctgcggcatattatcaggtttcagcagctggacctcaaccaaaagccgcagcgggcgcaggaggtccagggtctctgagctacagatgcaagcgcaagagaggcggcgctaaagattgtctacttgctccccacgctggggcccggcgcctcctgctgttgccgcgatcatataaggccaaggctgcagccgccgcggccgctgccgctgctgccgctgctgctgcagctggcgcaacatgtttggagagatttcacctggttaatgggttctgtccaccaccccaccaccaccaccatcaccatcaccatcatcaccaccaccaccacagagcacaaccgccccagcagagccaccatccccctcatcaccatcggcctcagcctcatctcgggagcttccccgagagttgttcttccgacagcgaaagctcgtcctactcagatcacgccgcgaacgactcagatttcggtagtagcctgagttctagttcgaattccgtgtcatccgaagaggaggaagaagaaggggaggaagaggaggaggaggaggaggaagaaggaggatcaggcgcatccgattcctcagaagtatcttccgaagaggaagatagtagtaccgagtccgactcttccagtggctctagtcaggtgtcagtgcagagcatacgcttccgcagaactagtttttgcaagcctcccagtgttcaggcccaggctaatttcctttatcaccttgcgagtgcagctgcggcaactaagcccgccgcattcgaggacgccggccgcctcccagatctgaaatcgtcggtgaaagccgagtccccagctgagtggaaccttcagagctgggccccgaaggcttcgcctgtgtactgccctgcatccctgggctcctgctttgctgaaattcggaacgatagggtgagtgagatcacatttcctcattccgagattagtaatgccgtgaagagaactgacctgaccattaattgcctagccgaaggagcctccagccctagtccgaaaacgaataatgcgttcccacaacagcggatcctgcgggaggctaggaaatgcctgcagaccaccccaaccacacattgcgccgataataatactattgccgccaggttcctgaacaatgacagctcgggcgccgaggccaactctgaaaaatactcgaaaattctgcattgccccgaatttgccacagatctgccctccagccagaccgaccctgaagtgaatgccgccggcgctgcagccactaaggcagagaacccatgtacagatactggagataagaccctaccttttctgcataatattaaaattaaagtggaggattctagcgccaacgaggaatacgagccccacctgtttacgaataaactgaagtgcgaatgtaacgacacgaagggggagttctacagcgtcaccgagagtaaggaagaagacgctcttctgactaccgccaaggaggggttcgcttgccccgagaaggagacacccagcttgaaccccctcgctcagtcacagggactttcctgcaccctcggctcccctaagccagaagacggggaatataagttcggagcccgagtgcggaaaaactaccggacactggtgctgggcaagcgacctgtgttgcaaacccctcccgtgaagccaaacctcaaaagtgcgcgctcacctcgcccaactggtaagaccgaaacaaatgaggggactctggatgatttcactgtgataaatcggcgaaagaaagtggcttcaaatgtcgcgtccgctgtgaagagaccatttcatttcatggccaattttccatgcccaccctccctgatcattggaagggacggtgatctgtggccggcttactcacttaacacgactaaggacagccagacgccccataaggctcatcccatatggaaatggcagttaggaggttctgcgataccgctcccgccgtctcacaaatttaggaagtttaattcctag

SEQ ID NO: 11461 - DNA, 453 bp, Artificial Sequence
  Description of Artificial Sequence: Synthetic coding sequence
atggctgccagccagtgcctctgctgtagtaaatttctatttcaaagacagaacctagcttgtttcctcactaacccacactgcgggtctctggtgaatgcagatgggcacggggaagtctggacggactggaataatatgtctaagttcttccaatatggttggcggtgcactacgaatgaaaacacctattcaaaccggacactgatgggaaattggaaccaggaacgctacgatctgagaaacattgtccagcctaaacctctgccttctcaatttggccactatttcgagacgacctatgatacgtcatataacaataaaatgcccttgtctactcatagattcaaacgtgagcctcattggttcccaggccaccaacccgaactagaccctccaagatataagtgtacagaaaagagtacatacatgaatagctacagtaagccatag

SEQ ID NO: 11462 - DNA, 948 bp, Artificial Sequence
  Description of Artificial Sequence: Synthetic coding sequence
atggcctgtgcggaattctcgtttcacgtaccctccctcgaggagctcgctggcgtgatgcagaaagggctcaaggacaatttcgctgacgtgcaggtttccgtggtcgactgtcccgatttgacgaaggagccctttacctttcctgtgaaaggaatttgtggcaagaccagaatcgccgaggtgggcggggtgccatacctgcttccacttgttaaccagaagaaggtttatgatctgaataaaatcgctaaagaaatcaagctgccgggcgccttcattttaggcgccggagccggtcccttccaaactcttgggttcaattccgaatttatgccggtaatccagaccgagagtgagcacaaaccaccagtcaatggatcctatttcgcccatgtgaatcctgccgatggcgggtgcctgcttgaaaaatactctgagaagtgtcatgacttccagtgtgctctattggctaacctgttcgcttcagaaggccaacccggaaaggtaattgaggttaaggccaaaagaagaaccggaccactgaacttcgttacctgcatgcgggagactctcgaaaagcactatggtaataagccgattggcatggggggcacctttatcatccagaagggaaaggttaaaagccatatcatgcccgcggagtttagcagctgccctctaaatagcgacgaggaagtcaataaatggttgcatttctacgaaatgaaagcacctctggtgtgcctccccgtctttgtgtcccgtgatcccggattcgacttgcggcttgaacacacgcatttttttagtcgacatggtgagggcggccattaccactatgatacgactcctgatatcgtggaatacctggggtactttcttcccgccgaatttctctatcgcattgatcaaccaaaagagactcattccatcgggagagattag

SEQ ID NO: 11463 - DNA, 948 bp, Artificial Sequence
  Description of Artificial Sequence: Synthetic coding sequence
atggcatgtgcggaatttagctttcatgtaccctctcttgaggaactggctggtgtgatgcagaaaggactgaaagataattttgcagacgtgcaggtctcagtcgtggactgccctgatctgactaaggagccattcaccttcccagttaagggtatttgcggaaaaacccggatagctgaggtcggcggggttccatacctgttacctttggttaaccagaaaaaagtgtacgatcttaacaaaattgcaaaagagatcaagttgccaggcgcttttattctcggcgccggagcggggccgtttcagaccctcggattcaacagtgagtttatgccagtgatccagaccgagtcggagcataaacccccagtcaatggttcctactttgctcatgttaaccccgccgatggcggatgcttgcttgagaaatacagtgaaaagtgccacgacttccagtgtgctctgctggccaatctcttcgcctctgagggccagcccggcaaagtgatagaagtaaaggccaagaggaggacgggaccactcaatttcgtcacgtgtatgcgcgagactctggaaaagcattatggcaacaagcctataggaatgggtggtacctttatcatccaaaaggggaaggttaaaagccacatcatgcctgccgagttttcctcatgtcccctgaactctgacgaggaggttaataagtggcttcacttttacgaaatgaaagctccgcttgtgtgtctgcccgtgtttgtgtcaagagatccaggattcgatctaagattggaacatacacacttcttttcacgccatggagagggaggccactatcattatgatacaacgccagacattgttgaatacttgggttacttcctcccagccgaatttttgtataggattgaccagccgaaggagacccattccattggccgcgactag

SEQ ID NO: 11464 - DNA, 891 bp, Artificial Sequence
  Description of Artificial Sequence: Synthetic coding sequence
atgcagaagggtctaaaggacaattttgccgacgtgcaggtgtctgtggtcgactgcccagaccttaccaaggagccattcaccttccctgttaagggaatctgtggtaagaccagaatcgcggaggtcggcggggtgccatacctgctgccgttagttaatcagaagaaggtgtatgacctcaacaaaatagcaaaggaaatcaagcttccaggggccttcatcctcggggcgggcgctggcccttttcaaactctgggatttaacagtgagttcatgcctgtaatacaaactgaaagcgagcacaaacccccagtgaatggttcatattttgcccacgtgaatccagcggatgggggctgtctccttgagaagtattctgaaaaatgtcacgatttccagtgcgccctgcttgctaacctgtttgctagcgagggccagccgggtaaggtaatcgaggtgaaggccaagcgccggacaggaccactcaattttgtgacttgcatgcgggagaccctggagaagcattacggtaacaaacccattgggatgggtggaacctttatcattcagaagggaaaggtcaaatctcacatcatgccggccgagttcagtagttgccccctgaactccgatgaagaggtgaacaaatggctccatttctacgaaatgaaagcgcccttggtctgcctgccggtcttcgtgtcccgcgatcccggcttcgatctgcgcttggagcacacccacttttttagccgccacggggaaggcggacactatcactacgacacgacccctgatatcgtggaatacctcggctactttctacctgccgagtttctttataggatcgaccagcctaaggagacccacagcatcggaagagattag

SEQ ID NO: 11465 - DNA, 450 bp, Artificial Sequence
  Description of Artificial Sequence: Synthetic coding sequence
atggcgtgcgctgaattctcattccacgtcccttctctcgaggagctggcgggcgtaatgcaaaagggccttaaggacaattttgcagacgtacaagtgtcagtcgttgactgccctgatctgacaaaggagccttttacatttcctgtgaagggaatctgtgggaagactagaatcgctgaagtcggaggcgttccatacctcttgccccttgtcaatcagaaaaaagtctacgatctgaataagatcgcgaaggaaatcaagcttccgggcgcttttatcctgggggcaggcgcaggcccctttcagacactgggttttaattctgaatttatgcctgtcattcaaacagagagcgagcataaaccacccgtgaacggctcttatttcgcacacgtcaacccagctgatggtggttgtctgcttgaaaagtattctgagaaatgctag

SEQ ID NO: 11466 - DNA, 234 bp, Artificial Sequence
  Description of Artificial Sequence: Synthetic coding sequence
atggcttgtgccgagttttcctttcatgtgcctagtcttgaggaactcgctggcgttatgcagaagggactgaaggacaatttcgctgatgtccaggtgagtgtcgtggattgcccagacctgaccaaggagccattcaccttccccgtaaaagggatctgtgggaaaactagaatcgccgaggtcggcggagtgccttacctcctaccactcgttaaccagaagaaggtctag

SEQ ID NO: 11467 - DNA, 516 bp, Artificial Sequence
  Description of Artificial Sequence: Synthetic coding sequence
atggcttgcgctgaattttctttccatgtgccttccctcgaggagctggctggggtgatgcagaaaggcctgaaggataatttcgcagacgttcaggtcagtgtggtcgactgcccggatctgactaaagaaccctttaccttcccggtcaaggggatctgcggaaagacgcgcatcgctgaggtcggcggtgtgccttacctcctgccactggtgaaccaaaaaaaagtgtatgacctcaacaaaatcgccaaggagattaagttacccggcgcgtttattctgggggcaggagccggaccattccagactctgggctttaatagcgagtttatgcccgtgatccagacggagtcagaacacaaaccccctgtgaacggatcttacttcgctcacgtcaaccccgccgacggtgggtgcttgctcgagaagtattcagagaagtgccacgatttccagtgtgccctgttagccaacctgttcgcttctgaggggcaacctggaaaggtcatctag

SEQ ID NO: 11468 - DNA, 948 bp, Artificial Sequence
  Description of Artificial Sequence: Synthetic coding sequence
atggcttgtgcagagttctcttttcatgtgccttctctggaggaactggccggcgtgatgcagaaaggcctgaaggataatttcgcggacgttcaggtgtccgttgtcgactgccctgaccttacgaaagagccatttacgtttccagtgaagggcatctgcgggaaaacgcgtattgcggaggtgggcggggtgccctatttactgcctctggtaaaccagaaaaaggtttatgacctcaataagattgccaaagagatcaaactccctggagcttttatacttggcgctggtgctggacccttccagacattaggattcaattccgagtttatgcctgtgattcaaacggagtctgagcacaagcccccggttaacggctcatatttcgctcacgtgaaccctgccgacggcgggtgcctgctggagaaatactctgagaagtgccatgactttcaatgtgctcttctggctaaccttttcgcaagcgagggccaacctggtaaggtcatagaggtgaaggctaagcggcgcaccgggccgctaaacttcgtgacctgtatgcgggaaaccctggagaaacactacgggaataaaccgattggtatgggaggtacatttattatccagaaaggcaaggttaagagccacatcatgcctgcagagttttctagctgtcccctgaactccgatgaggaagtgaataaatggttacacttctacgagatgaaggctcctcttgtgtgtctcccagtgttcgtgtcaagagatcccggctttgacttaagactcgagcacacacatttcttcagccggcacggcgaggggggtcactaccactacgataccacacctgacattgtggaatatctgggctatttcttgccagcggagtttctgtaccgcatcgatcaacctaaggagacacatagcatcggtcgcgactag

SEQ ID NO: 11469 - DNA, 798 bp, Artificial Sequence
  Description of Artificial Sequence: Synthetic coding sequence
atggcctgtgctgagttttcattccacgttccatccctggaagaactggccggcgtgatgcagaaggggctcaaggacaatttcgcggacgtccaggtaagcgtggtcgattgcccggatctaaccaaagagccatttacttttccagtgaaaggaatttgcggtaaaacacgcatagccgaggttggcggggttccatacctgctcccgctggttaaccaaaagaaagtttacgatctcaacaagattgcaaaggagataaagctaccgggagcctttatcctgggagccggggccggcccctttcagactctgggatttaactcagaatttatgcccgtcattcagacggagagtgagcacaaaccgcccgtgaatggtagctactttgcgcacgtcaaccccgctgatggtgggtgcctcctcgagaagtattcagagaagtgccacgacttccagtgcgcactcttggcaaacctcttcgcaagtgagggccagcccgggaaacccgccgaattcagcagttgcccgctgaactctgacgaggaggtaaataaatggctgcacttttatgaaatgaaagcgcccttagtgtgcttacccgtgttcgtctccagggatcctgggtttgacttgcgacttgagcacactcatttcttctcccggcacggagagggagggcattaccactatgacaccacgcccgacattgtcgaatatctgggctactttctacccgccgagtttttgtatcgaattgatcagcccaaagagactcactctatagggcgggattag

SEQ ID NO: 11470 - DNA, 291 bp, Artificial Sequence
  Description of Artificial Sequence: Synthetic coding sequence
atggcctgcgctgagtttagcttccatgtgccatcgctggaagagttggcaggtgtgatgcaaaagggcctgaaagacaactttgccgatgttcaggtctcagttgtcgactgccctgacctaactaaagagcctttcacatttcccgtaaagggtatttgcggcaagacaagaatcgccgaggtagggggggtcccatacttgctcccactggtgaaccagaagaaggtgtacgacctgaataaaatcgcaaaggaaattaagctccccggtgccttcattctcggatag

SEQ ID NO: 11471 - DNA, 720 bp, Artificial Sequence
  Description of Artificial Sequence: Synthetic coding sequence
atgcagaaaggccttaaggataactttgctgatgtacaggtgagtgtggtggactgccccgacctgaccaaggagccgttcacctttccggttaagggtatctgtggtaaaacccgcatcgccgaagttgggggagtcccttacctgctacctctggttaatcaaaagaaggtctatgatctgaacaaaatagcgaaggaaattaagctgcccggtgccttcattttgggcgcaggagctgggccatttcaaaccttaggatttaactccgaatttatgcctgtgatccaaaccgaatcagagcataaaccccctgtcaacgggtcgtatttcgcccacgtcaatcccgctgacggggggtgcctgctggagaaatattctgaaaaatgccacgacttccagtgcgcactccttgctaacctctttgcatcagagggacagcctggaaaagtcattgaggtgaaagccaaaagaagaacgggccctcttaactttgtcacctgcatgagagaaacgctcgagaaacactacgggaacaagcctatcggaatggggggtacattcattatacagaagggaaaggtgaagtcccacatcatgccagccgaattttcctcttgtcctcttaactcggacgaggaggtcaacaagtggctgcacttttacgaaatgaaagcccctctggtctgtcttcccgtcttcgtctccagagatccatag

SEQ ID NO: 11472 - DNA, 303 bp, Artificial Sequence
  Description of Artificial Sequence: Synthetic coding sequence
atggcatgcgccgagttctctttccatgtgccatcactcgaagagctggccggtgtcatgcagaaaggccttaaagataactttgctgacgtacaagtctctgtggtcgactgtccggatctgacaaaagagcccttcactttccccgtcaaaggaatttgcggaaaaaccaggatcgcggaagtgggaggagtgccttacctcctccccctcgtcaatcaaaaaaaggtgtatgacctgaacaagatcgcaaaggaaatcaagctgcctggcgcatttattctgggagccggcgccggctag

SEQ ID NO: 11473 - DNA, 891 bp, Artificial Sequence
  Description of Artificial Sequence: Synthetic coding sequence
atgcagaagggactgaaagataactttgcagacgtgcaggtgagtgttgttgattgcccagatctaaccaaggaacctttcacgtttccagtgaagggaatttgtggcaagaccagaatcgccgaagtcggtggtgtcccctacctgttgcccctggttaaccagaaaaaggtctacgatctcaacaagatcgcaaaggaaatcaagctgccaggcgcattcatcctgggcgcaggtgctggaccctttcaaaccctgggttttaactctgagtttatgcctgtcatccagactgaaagcgaacacaaaccccccgtgaacggttcctacttcgctcacgtgaaccctgcagatggcggatgtctgctggagaagtactccgagaagtgtcacgactttcagtgtgcgttactcgctaaccttttcgccagcgagggccagccgggaaaagtaattgaggtgaaggcaaaacgccgaacaggaccgctcaactttgtgacttgtatgagagagacactagagaaacactatggcaacaaacccattggcatgggaggaacattcattatccagaaaggcaaggtgaaaagccacatcatgcccgcagagttcagctcctgtcctctgaatagcgatgaagaagtaaacaaatggctgcacttctatgagatgaaagcgccactggtttgcctccccgtatttgtctctcgagatccaggcttcgacctgagactcgagcacacacacttcttctctcgtcatggcgaaggcggacactatcattacgacacgactcccgacattgtcgaatacctaggttatttcctgccggccgagttcctgtaccgcatcgaccagccaaaagaaacacattccatcggaagggattag

SEQ ID NO: 11474 - DNA, 1221 bp, Artificial Sequence
  Description of Artificial Sequence: Synthetic coding sequence
atgactcagacactggatactagagaagaccccctcaatctggggggcggtggtggcggaggctgtggatgtggctgggcccactcagcctctttatcctcctggagcagctgccatcggagacgcccaggtgcgcctgcttacaacagacctcatcgatactcacctaagaccgaatacggtcccccaagaaagcagccgaaacagcagcatgggcctggcttctggttccagccacctgtgtgtagtaactgggggtgttggggagggccatggcggccacccccacctggattttggaagtttccatgtcccgtgcaggttttccgcgtgtacggattacaccccttatgcttctgctgctgttcctgctggtctggttcttggaatccgggctgggtcaagccgccaggcagaaagaagcgttggggacggcgtggtcggggtctccggcatcaccctcggcatagctacccccgaagccctcccgccgatgtttctacactgccacgtcctgtgaaactgtacgagtggagggagccggggatgagagccccccccaacaccacacaattcattatgaatcagatctatgaggacatgagacagcaagagaaggtagagcggcagcaggaggccctccgagcgcagaaagcaacggtgtcgggtgaggcctcccctgcccgaagttccgggaatgacgctccgccaggcgggtccaaagaaacctggggactccaagaaacactgtacggttttgtgcagaacccgtcattggcattcagcccgaaccctgaagaaaaccagtcattggcaccgctcctggtcgaagaagaagaggaaaagaaaaatgacgacgaagaggagtatgatcaggaagtgtgcgacgcaaaggaagctagcgaagaagaggaggaagtggaagatgaggaggaagaggtcgaggacgaggaggaggaagaggtggaagaggcagagtacgtggaggagggcgaggaagaactcgaggaggaggaactggaggaagaagaggaggttttagaagagaatgagcaaaggggcgaggaatttcatcttcctctggagatgccgcttagtattttcgtggaggctgaggaaaaaagagaaaacttcatctcctgcacctttcttaacccggagcagattatacctaaagtgccccaggagtccctgttcatggcacaggattttaattgctag

SEQ ID NO: 11475 - DNA, 195 bp, Artificial Sequence
  Description of Artificial Sequence: Synthetic coding sequence
atgcccccgcggaaaaaaaggagacaaccttcacaaaaagctcctctgttgtttcaccagcagccgctggagggtcccaaacactcctgtgcgtcaactcagctacccatcacgcacactcgccaggtccccagcaagcctatcgaccactctaccatcacatcttgggttagccccgattttgataccgcctag

SEQ ID NO: 11476 - DNA, 717 bp, Artificial Sequence
  Description of Artificial Sequence: Synthetic coding sequence
atgccaccacgaaaaaaacgtaggcaaccttcccagaaggcccccctgctgtttcatcaacagccacttgagggcccgaaacacagttgtgcctctacacagctacctattacccatacacgccaggttccttcaaagccaatcgaccactccactatcactagctgggtcagccccgactttgacaccgctgctggctctctgtttccagcctatcagaagcaccaaaaccgtgcaaggcattccagcaggaaaccaaccacgagcaaattcccacacctgacctttgagtcacctcaatcgtcttcctcggagacactgggaatccccctgatccgagagtgtccatccgagagcgagaaggacgttagccggcgtcctttggtccccgttcttagtccacagtcctgtgggaatatgagcgtgcaagcactgcaatccttaccctacgtatttatacctccagacatccagactcccgaatcaagtagcgtgaaagaagaattaattccccaggatcaaaaagagaactctctgttatcctgcacattgcacactggaacacctaattccccagaacccggccccgtgctcgtcaaagatacccccgaggacaagtacggtattaaagtcacctggcgccgcagacagcatctgttagcctatctgagagaacgaggcaaactcagccgctcccagtttcttgttaaatcatag

SEQ ID NO: 11477 - DNA, 399 bp, Artificial Sequence
  Description of Artificial Sequence: Synthetic coding sequence
atgccaccgcgtaagaaaaggcggcagccatcccaaaaagcgccgttgctattccatcaacagcccctggaggggccaaaacattcatgtgcctcaactcagcttccgatcacccatacgagacaggtgccatccaagcccatcgatcacagcaccattacttcttgggttagtccggacttcgacactgctgcggggtctctctttccagcttaccagaaacatcagaacagggctagacattcgagcaggaagccaaccacgagcaagttccctcatctcacctttgagtcaccccagtccagctccagtgagacacttgggatcccactaatcagggaatgtccctccgagagtgaaaaggacgtctccagacggccactcgttcctgttctttag

SEQ ID NO: 11478 - DNA, 318 bp, Artificial Sequence
  Description of Artificial Sequence: Synthetic coding sequence
atgcctccacgcaaaaaacgccggcagccttctcaaaaagcacccttgctgtttcaccaacagccactagaaggacccaaacattcttgcgcatcaactcaactgccaatcacccatacaaggcaagttccctcaaagcccattgaccactctactattaccagctgggtcagcccagattttgacactgctgccggctcactctttcccgcctaccagaagcaccagaatcgcgctcgccacagtagccgtaaacccaccacgtctaaatttccacatttgacttttgaatctccccagagctcgtcttctgagtag

SEQ ID NO: 11479 - DNA, 3138 bp, Artificial Sequence
  Description of Artificial Sequence: Synthetic coding sequence
atgaaccttcaggcacaaccaaaggcgcagaacaagaggaaacgctgtctgttcggaggtcaggaaccggcacccaaagagcaaccaccgccacttcaacctccccagcaaagcatccgcgttaaggaggagcagtacctcggacacgagggccccggtggcgccgtgtctactagccaaccagtggaactgcctccaccttcaagtttggcactgcttaattctgtggtctacgggccagagcgcacctcggccgcaatgctctcacaacaggtggcttccgtaaaatggcctaattccgtgatggccccaggaagaggcccagagaggggagggggtggtggggtgagtgactctagttggcaacagcagcctggacagccccctccccactcaacatggaattgccactccctaagtctctactcagcaaccaaaggttctccacacccaggagtcggggtccctacatactacaaccaccctgaagcgctgaagagagaaaaggcagggggtccccagctagacaggtatgtgaggcccatgatgccgcagaaagtacagctcgaggtgggcagacctcaagcacctctcaacagttttcatgccgcaaagaagccaccaaatcaatcgttacccctgcagccctttcagctggccttcggccaccaggtgaatcgccaggtcttccgccaggggccacctcctcccaatcccgtcgctgccttccccccacagaagcaacagcagcagcagcaaccgcagcaacaacagcagcagcagcaggctgcactgccccaaatgcctttattcgagaatttctactctatgccacagcagccctctcagcagcctcaggacttcggattgcagcctgcaggccctctggggcagagtcacttggcccatcactccatggctccctatccctttccccccaatcctgacatgaatcctgaactgagaaaggcactactacaggattccgcgccccagcccgcactgcctcaagtccagattccattcccgaggaggagccggaggcttagcaaggaaggaattctgccaccgtccgcccttgatggggctggcacacagcccgggcaagaagccacaggcaatctttttttgcatcattggcccctgcaacagcccccacctggatcgttaggtcagccgcatcctgaggcattgggcttccctctcgaactgcgcgaatctcaattgctcccagacggggagcgattggctccaaatggcagagagcgcgaggcccccgcaatgggcagcgaagaaggcatgcgcgcggttagcacaggcgactgcggccaggtattgcgcggcggcgtcatacagagtactcgcaggaggaggagggctagtcaggaggcaaatctgcttactctagcacagaaggctgtggaactcgcgtctctgcagaacgctaaggacggatccgggagtgaagaaaaaaggaaatctgtgctggcctcaaccactaagtgcggagtggagttctcggaaccatctcttgcgactaagcgggcccgcgaggatagtggaatggttcctcttatcatccctgtgtccgtcccagtccgcaccgtggatcctacagaagcggcacaggcaggaggcctggatgaagacggaaaggggcccgaacaaaacccagccgagcacaagcccagcgtgatagtgacaaggcgtagaagcacaaggatccctggcacagatgcgcaggcccaggccgaagatatgaatgtgaagctggaaggagaaccatctgttcggaaaccaaagcagaggcccaggccagagcctttgatcattccaactaaggccggaaccttcattgctccaccagtatactctaatattaccccctatcagtctcatctgcgtagccctgttaggctcgccgaccacccttccgaaaggagctttgagctccccccgtatacgccccctcccatcctgagtcctgtgagggaaggatcagggctttattttaacgctatcatctctacctctaccatccctgcgcccccccccatcactcccaagtctgcccataggacgctgctgaggaccaactcggctgaagtcaccccacccgtgttgtccgttatgggcgaagcgaccccagtgagtattgaaccgcgaattaatgttggcagtcgatttcaggctgaaattccgcttatgcgagatagagctctagcagcagcagatccacacaaagccgaccttgtttggcaaccctgggaagatctcgaatcaagcagggaaaaacagcggcaggtggaagacttattgaccgccgcatgctcttctatcttccctggtgcggggacaaaccaggaactggctctgcattgtctgcacgagtctcggggcgacatccttgagacactgaacaagctcctgcttaagaagcctcttagaccccacaaccatcccctggcaacttatcactatacgggcagtgaccagtggaagatggccgaaaggaagcttttcaataaggggatcgcgatttacaaaaaagattttttccttgtgcagaaattaattcagaccaaaaccgttgcgcagtgtgtcgaattctactacacctataaaaaacaggtgaagattggacggaacggtacattgaccttcggtgacgtggacactagcgacgagaagagcgcccaggaggaggtcgaagtggacatcaagacatctcagaagttccccagagtacctttaccacggagggagagtccttcggaggagcgattggagccaaaacgggaggtcaaagagcctcgtaaagagggggaggaagaggtgccagaaatccaagagaaagaagaacaggaagagggccgtgaacgctcccgccgcgccgccgccgtgaaggcgacacagactctgcaggcaaatgaatcagcaagcgacatcctcattctaagatcccatgagagcaatgccccaggttccgccgggggtcaagcgtccgagaaaccacgcgaggggaccggcaaatcccggcgtgccttaccattttccgaaaaaaagaagaagacagagaccttttccaaaactcagaatcaggagaacacatttccatgtaaaaaatgcggtcggtag

SEQ ID NO: 11480 - DNA, 3138 bp, Artificial Sequence
  Description of Artificial Sequence: Synthetic coding sequence
atgaacctgcaggcacagcccaaggcacagaataagagaaagaggtgcctgttcggaggtcaagagcccgcacctaaggaacaacctcctcctctgcagcccccccagcagtctatacgagtgaaggaagagcaatacctcgggcatgagggtccgggcggagcagtcagcacatcccaacctgtagagttaccaccaccctcttcactcgcactacttaattcagtcgtgtacggaccagaaagaacctcagctgccatgctgtctcagcaggtggcgtcagtgaagtggcccaacagcgtgatggctcctggtcgtggccccgaacggggcgggggtgggggggtttcagactcttcttggcagcagcagcccggccagccaccaccccattccacgtggaactgccactccctatcactgtactccgcgacgaaagggagcccacacccaggggtaggcgttccaacgtactacaatcaccccgaggccctgaaacgagaaaaggccggcggcccacagctggaccgttatgttaggccgatgatgccccagaaggtgcagcttgaggtcggtagaccacaggcgcccctcaattccttccatgccgccaagaagccaccgaatcagtccttgccattgcagcccttccagctggccttcgggcaccaggttaacaggcaggtgttcagacaggggccaccaccgcctaaccccgtggccgctttcccacctcagaagcagcagcagcagcagcaacctcagcagcagcaacagcagcagcaggccgcattaccccagatgcccctgtttgagaatttttattcgatgccgcagcaaccaagccagcaacctcaggattttggtttgcagcccgccggaccgcttgggcagagccatctcgcccaccacagtatggctccttatcccttccccccaaatcccgacatgaaccccgagttgcgcaaggccctcctgcaggatagcgccccacagcccgctctgcctcaggtccagattcctttcccccggagaagcagaagactctctaaggaaggcattctgccgcctagcgcactcgacggggctggaacccagcctggccaggaggcaacgggaaatctcttcctgcatcattggccccttcagcaaccaccacccgggtcattgggccagccccacccagaggccctcggatttcccctggaactgcgcgagtctcaactactgcccgatggagaacggctggctcctaacggacgagaaagggaggcgcctgctatgggatccgaggaaggaatgcgcgctgtatccactggggattgtggccaggtccttcgggggggagtgattcagtctacccggcgaaggagacgcgccagccaagaggctaatctgttgaccctggcccaaaaagcagtggagcttgccagcctccagaacgctaaagatggtagcgggagcgaagaaaaaaggaagtcagtgctggcgagcactacaaagtgcggggtggagttcagtgagccatccctcgccacaaaacgggcccgcgaggattccggcatggtgcctcttatcatcccggtgtctgtaccggtgcgaaccgtggatcctaccgaggctgcccaggccggcggactggatgaggatggaaaagggccagaacaaaatccggcagagcataagccttcggttatcgtcactagacgccgatctactcgaattcctgggacggatgctcaagcgcaggcagaggatatgaacgtgaagctggagggggaaccctcagttcggaaacctaagcagcgaccacgacccgagccgctgataattccaactaaggcagggaccttcatcgctccccccgtctatagtaatattacaccataccagagccatctcagatcaccagtacgattagctgatcacccgtctgaacggagcttcgagctgcccccttacacacctccgcccatcctgtcacccgtgcgcgaaggctcgggactctacttcaatgctatcatctcaacttctactatacccgccccgccaccaattacgcctaaatctgcacacaggacgcttcttaggactaacagcgccgaagttacgccacctgtgctatccgttatgggtgaggcaaccccagtgtctatcgaaccgaggataaatgtggggtctcgcttccaggctgaaattcctctcatgagagaccgagccctggccgctgctgacccccacaaggctgatttggtttggcagccttgggaggacctcgagagcagcagggagaagcagcgtcaagttgaagaccttttgacggccgcttgtagtagcatctttccaggtgcaggcacgaaccaggagcttgctctgcattgtctgcatgagtcacggggtgacatcttagaaaccctgaacaagctattactgaagaaacccctgcgccctcacaatcatcctctggccacataccactacactggctcagatcagtggaaaatggctgaaagaaagcttttcaataagggcatcgcaatctacaagaaggatttttttttggtccagaagctgatacagaccaagactgttgcccagtgtgttgaattctactacacttataagaaacaggtcaaaatcggtaggaacggaacgctgacttttggagacgttgacaccagcgacgagaagagcgctcaggaggaggtggaggtggacatcaagacatctcagaaattcccaagggtgcctctcccaagacgggagagcccctccgaggaaagactcgagcctaagcgagaagttaaggagcccaggaaggagggggaagaggaggttccagagatccaggaaaaagaggagcaggaggaggggcgggaaagatctcgcagagctgctgccgtcaaagcgacacagacactgcaggccaacgagagtgcgtccgacatcttgatcctccgttctcatgagagcaatgctcccggctccgccgggggacaggcgagcgaaaaaccacgggagggaaccgggaaatcaaggagggccctaccattttccgagaaaaaaaagaaaaccgaaaccttttctaagacccagaatcaggagaatacctttccctgtaagaagtgcggccggtag

SEQ ID NO: 11481 - DNA, 201 bp, Artificial Sequence
  Description of Artificial Sequence: Synthetic coding sequence
atgaatctgcaggcacaacccaaggcgcaaaacaaacgcaaaaggtgccttttcggtggccaggaaccagcacctaaggaacaacccccacctctgcaaccaccccagcagagcattagagtcaaagaggaacagtacctagggcacgagggcccgggcggggcagtgagtacctcacagccggtggagctgccaccatag

SEQ ID NO: 11482 - DNA, 3138 bp, Artificial Sequence
  Description of Artificial Sequence: Synthetic coding sequence
atgaatctgcaagcgcagcctaaagcccaaaacaaaaggaagagatgtctttttgggggccaggagcccgctcctaaggaacagccacctcctttacagcccccccagcagtcgatccgagttaaagaagaacagtatctaggtcatgagggacctggaggggcggtgtctacttcccagccggtggagctgccgccgccaagtagcctggcactcctcaacagcgtcgtttatggaccagagagaaccagcgccgctatgttgagtcaacaggtcgccagcgtcaaatggccaaattctgtaatggcaccaggacgcggacccgaacggggcggtggagggggggtttccgatagtagctggcagcagcagcctgggcagccgcccccccatagcacctggaactgtcattcattatccctgtactcggcaaccaaaggcagccctcatcctggagtgggggtgccaacttactacaaccatccagaagccctgaagcgtgaaaaggcagggggtcctcagctggatcgttacgtgcgccccatgatgccccagaaagtgcagttagaggtgggaagacctcaggcccccctgaactcatttcacgcggcgaaaaagccaccgaatcagtcccttccactgcaacccttccaactcgctttcggccatcaagtgaataggcaggtgtttcgccagggaccaccgccgcctaatcctgtggccgctttccccccacagaagcaacagcagcagcagcagccgcagcagcagcagcaacagcaacaggcagctctcccacagatgcctctgtttgaaaacttttactccatgccacagcaaccatcacagcagccccaggattttggtttgcagccagctgggccacttggccaaagtcacctagcacaccattccatggccccctatcctttcccgccgaatcctgacatgaacccagaattacggaaggccttgctgcaggactctgctccgcagcccgctctgccccaagtccagatccccttcccgcgcagaagtcgcaggctgtccaaagaggggattctgcctcctagcgcgctcgatggggccggaacacagcctggccaggaagctaccggcaacctgtttttgcaccactggccactgcagcaaccaccacctggtagcctggggcagccacatcccgaggcactcggtttccccctggaattacgggaatcccagctgctccccgatggcgagcgactggcccccaatggccgcgaaagagaagcacccgctatgggatcagaggaaggaatgagagcggttagcacaggtgattgcggacaggtgttaagggggggggtcattcagagtacgcgcagaagacggagggcatctcaggaggctaatcttctgaccctggctcaaaaggctgtggagctcgcttccctgcagaatgccaaggatggcagcggaagcgaagagaagagaaaatctgtccttgcttccactactaagtgtggagtggaattttccgagcccagtttggcaacaaagcgggcccgcgaggattcagggatggttcccttgattattccagtgagcgtccccgtcaggacggttgaccccaccgaggctgcccaggctggcggcttggacgaggacggtaaagggccagaacagaaccccgccgagcacaaaccttcagtcatcgtgacccgacggcgttccactcgcatccccgggacagacgcgcaggcccaggccgaggacatgaacgtcaagctggaaggggagcccagcgtgcgaaagccaaagcagcgcccccggcccgagcccctgatcattccaaccaaggcgggcacgtttattgccccacctgtgtattccaatattacaccataccagtcccatctgagaagtcccgtgaggctggccgatcacccgagcgaaagaagtttcgagctgccgccttacacccccccccctatcctctcacccgttcgcgaggggtccggtctatatttcaatgccataattagcacaagtaccatcccagctccacctccaatcactcctaagagcgcacatcgcaccctcctgcgcacaaactcagccgaagtaacaccgcctgtactctctgtgatgggagaagcaactcccgtgtctatcgaaccccggattaatgtgggttcgagattccaggctgaaatccctctcatgagggatagggctctggctgcggccgatcctcacaaagccgatctggtgtggcagccatgggaagatctcgaatcctccagggaaaagcagcgacaggtcgaggatctgctcactgccgcatgctcaagcatatttcctggggctggcacaaaccaggaattagcacttcactgcttacatgaaagccgtggcgatatccttgagaccctgaacaaactgctgctcaagaaaccgcttcgccctcacaaccatcccttagctacatatcactacacaggaagtgaccagtggaagatggccgagcgtaagctgttcaacaagggtatagccatctacaaaaaagatttcttcctcgtgcagaagttgatccagaccaaaaccgtggcacaatgtgtggagttttactatacctacaaaaagcaggtgaagataggtaggaacggcactcttacttttggtgacgtggatacaagtgacgaaaaatccgcacaggaggaggtggaagtcgacatcaaaacgtcgcagaagtttccccgcgtacccctgccccgtagagagtcaccttctgaggaaagactggagccaaagcgagaagtgaaagaaccccggaaggagggcgaggaggaagtccccgagatccaggaaaaagaggagcaggaagagggccgtgagcggtccagacgggctgccgcggttaaagccacccagacattgcaggccaacgagtctgcctccgacatactgatccttagaagtcacgagagcaatgctccgggaagcgccggcggacaagcctctgagaaaccccgagaaggcactggtaagagcagaagagctttgccattttccgaaaagaaaaaaaaaacagaaacctttagtaagacacaaaaccaagaaaacacttttccatgcaagaagtgtggcagatag

SEQ ID NO: 11483 - DNA, 3060 bp, Artificial Sequence
  Description of Artificial Sequence: Synthetic coding sequence
atgaatctgcaagcccagcctaaggcgcagaacaagaggaagcgctgtctgtttggagggcaggagcctgctcccaaagagcagccacctcctctccagcctccccagcagagtattcgggtgaaagaagagcagtatctggggcacgagggacccgggggggcggtttccaccagccagcctgtagagctgccacccccatcttcattggctctgcttaactctgtagtctacgggccagaaaggacttccgccgccatgctctcccagcaagtggcatctgtgaagtggccgaattctgtaatggctcctggccgcggccccgagcgaggagggggcgggggagtttcggacagctcgtggcagcaacagccgggccagccccctcctcacagcacttggaactgccacagtctgtcgctctattcggcaaccaaaggtagccctcacccaggcgtcggggtgccaacatattacaaccacccagaggccctgaagagggaaaaagcgggaggtcctcagctagatcggtacgtgcgacccatgatgccacagaaagtgcagctggaggttgggcggccacaagccccactgaactctttccatgcagctaaaaagcccccgaatcagtcactgccattgcagccctttcaacttgcgtttggccaccaagtgaatcggcaggtttttagacaggggcccccaccccccaatcccgtggctgcttttcctcctcagaagcaacagcagcaacaacagcctcagcagcaacagcagcagcagcaagctgcccttcctcagatgccattatttgaaaatttctactccatgcctcagcagccttcacaacagccgcaggacttcgggcttcagcccgcaggcccgctaggacagtctcacctggcgcaccattcaatggccccttatccttttccccccaaccctgatatgaacccggaactgagaaaggccttgctacaggacagcgctccacagccagctctaccccaagtgcagatcccatttcctagacgctcccgcagacttagcaaagaaggtatactgccaccaagtgccttagatggtgctggcactcagccaggacaggaagccacggggaacctgtttttgcatcactggccactgcaacaacctcctcctggatccttgggacaacctcacccagaggccctgggcttcccccttgagttgcgtgagtcacaactgttgccggatggagaacggttagcacccaacgggcgggagcgtgaagcccccgctatgggttctgaggaaggcatgcgcgccgtttcaacaggtgattgtggtcaggtgctgcgcggaggcgtcattcagtcaacacgtcgaaggcgacgtgcttctcaggaagccaatctcctgaccctggctcagaaagctgtggagttagcctctctccaaaatgcaaaggatggttccgggtcagaggagaagcggaaaagcgtgctagccagtacgaccaagtgcggcgtcgagtttagcgagcctagcctggcaacgaaaagagcaagggaggatagtggtatggtgcccctgattataccggtcagcgttcccgtaaggactgtggaccccaccgaggctgcacaagccggtggcctggacgaagacggcaaaggccctgagcaaaacccagccgagcacaagccatccgtgattgtgacacgtcgtcgcagcactagaattcctgggactgatgctcaggcccaagccgaagatatgaatgttaagcttgagggggagccatccgtgcggaagccaaagcagaggccaaggccagagcccctgatcatccctacgaaggcgggcacctttatagccccccccgtgtactcgaatatcacaccttatcagtcccatctgaggagtccggtgcgactggcagaccatccaagcgaaagatcctttgagctgcccccctacacccccccacccattctcagcccagttcgggagggatcgggcctttatttcaacgccattattagcaccagcaccattccagctcctcctcctattacacccaagtcagcccataggactttactacgtacgaattccgctgaggtgactcctcccgtgttaagcgtgatgggcgaggcgacccccgtctcaatcgagcctagaattaatgtgggctccagatttcaggccgaaatccccttgatgcgagaccgggccttggcagcagcagacccccacaaggctgaccttgtgtggcagccctgggaagaccttgagtcatcccgtgagaagcagcgccaagtcgaggatttactgactgcagcctgtagttctatcttccctggggccggcacaaaccaggaacttgctctgcattgtttacacgagtccaggggggacatcctggagactctgaacaagctgttgctgaaaaagccactgcgccctcataaccaccccctggctacataccactacacaggtagcgatcagtggaagatggctgaacgaaaactgtttaataaggggattgccatttacaagaaagatttcttcttggtacagaagttaattcagaccaagacagtcgcgcaatgtgtcgaattttactatacctataagaagcaggtcaaaattgggaggaacggcaccctcacttttggggacgtagatacttccgatgagaaaagcgcccaggaggaagttgaggttgacatcaaaacatcccaaaaattcccaagggtaccgctgcctcggagagaaagtccaagtgaggaacggttggagccaaagagggaggtcaaagaacccagaaaagaaggcgaggaagaggtgccagaaattcaggagaaggaagaacaggaggaagggagggagagatccaggcgagctgccgccgtgaaggccacccaaactctgcaagcaaatgagtctgcatcagatattttgattctgcgcagtcatgaatctaacgctcctggttctgccggcggccaagcaagcgaaaaacctcgggagggcaccggtaaatccaggagagcattgccgttttcatag

SEQ ID NO: 11484 - DNA, 951 bp, Artificial Sequence
  Description of Artificial Sequence: Synthetic coding sequence
atggccgcaccggaagcaccccccctggaccgagtcttcagaactacgtggctgtctacagagtgtgactcccacccgttgcccccatcatatagaaagttcctgttcgagacccaggccgctgaccttgcaggtggaactaccgtggccgccgggaaccttctcaacgagagtgaaaaagactgcggccaggatagacgagctccgggtgtacaaccttgtcgcctggtgactatgacatccgttgtaaagaccgtctactccctgcaacctccctccgcgctgagtggcggacagcccgccgacactcagacgagagctacctcaaagtcgttgctgcccgttagaagcaaggaggtcgacgtgtctaaacagcttcatagcggggggccagaaaatgatgtgacaaaaattacaaagctgcggcgggaaaacgggcagatgaaagcgactgacacggctaccaggagaaacgttaggaagggctataagcccctgagtaaacagaaaagcgaagaggaactcaaggataaaaaccagttgttggaggcagtaaacaaacagcttcaccagaagctgactgaaacacaaggcgagctaaaggacttaacgcagaaagtagaactattggaaaagtttagggataactgcctcgccatcttggagtctaaggggctggatccagcactagggtcagaaacactggcttccaggcaggagtcaacaacggaccatatggactccatgctgcttcttgagacactgcaggaagagctgaaactgttcaacgagactgcaaagaagcagatggaagaactacaagcactgaaagttaagctggagatgaaggaagagcgcgtgcgctttttagaacaacaaacactgtgcaacaaccaggtcaatgatttgactacagccctgaaagagatggagcagctgttggaaatgtag

SEQ ID NO: 11485 - DNA, 861 bp, Artificial Sequence
  Description of Artificial Sequence: Synthetic coding sequence
atggcagctcccgaggctccccccctggatcgagtattcagaacaacatggctgtcgacagagtgcgacagccatcccctgcccccaagttatcgtaaattcttattcgaaacacaggccgcagacctggccggaggcaccacggtagccgccggaaacctcctaaatgagtcggagaaagactgtggtcaggatcggagagcccctggagtgcagccgtgtcgccttgtcaccatgacaagcgtggtaaaaaccgtgtattcgctccagccaccttctgccctctccggcggacaacccgctgatactcagactcgcgctactagtaaatccctccttcccgtccgttctaaggaagtggacgttagcaaacaactgcactctggaggaccagagaatgacgttaccaaaatcactaagttgaggagggaaaatggacaaatgaaggccacggacacagcaacacgtcgtaacgtaagaaaaggttacaaacccctgagcaagcagaagtccgaggaagagctgaaggacaagaatcaactgttggaggcagtgaacaagcagctacatcagaaactgaccgaaacccaaggagagctaaaggacctgactcagaaggtcgagcttctcgagaagtttagagataattgtctggccatactggagagcaagggtttggacccagccttgggtagtgaaacattagcatccagacaggagagtacgactgatcacatggattccatgctattgctcgagactctgcaagaggagctcaaactttttaatgaaactgccaagaagcagatggaggaacttcagatcgcgtggatgaaccatggtattctgcatcagatgtag

SEQ ID NO: 11486 - DNA, 726 bp, Artificial Sequence
  Description of Artificial Sequence: Synthetic coding sequence
atggctgctcctgaggcccctcctctggatcgagtttttcgcaccacttggctttccacagaatgcgactctcaccccttgccccccagctatcgaaagttcctcttcgagactcaggcggctgacctcgcaggtggaacgacagtggcagccggaaatctgctcaacgagtctgagaaagattgtggccaggaccggcgcgcccccggggtgcaaccctgccggctggtcaccatgaccagcgtcgtgaaaactgtatattcattgcagccgccatcagctctttctggcggccagccggcggacacccagaccagggcaaccagcaagtccctcctacctgtgagatcgaaggaagtggacgtttcaaagcagctgcatagcggggggccggaaaatgacgttactaagatcactaaactacgcagggagaacggccaaatgaaagcaactgatactgctactcggagaaatgtcaggaaaggctacaaacccctgtccaaacaaaagtctgaagaggaactcaaggataaaaaccagttgctggaggccgtgaataaacaattgcatcagaaacttaccgaaacccagggggagctgaaggatcttacacagaaagtcgaattactggagaagttccgcgataattgtctggcgatcctggaaagtaagggtctcgatcctgtcgccgtaaggaacttcgcacgcggggcagaggcattctag

SEQ ID NO: 11487 - DNA, 915 bp, Artificial Sequence
  Description of Artificial Sequence: Synthetic coding sequence
atggcaagtgagacgcacaatgtcaaaaagcgaaacttttgcaacaagattgaagaccacttcattgacctgccacggaaaaagatttctaacttcaccaacaagaacatgaaggaagtgaaaaagagccccaagcagctggccgcttatataaatagaacagtgggccaaaccgtcaagtcccctgacaaattgcggaaggtgatttataggagaaagaaagtccatcacccatttccaaatccttgttatcggaagaagcaatcgccagggtcgggaggctgcgacatggctaacaaagaaaacgagctggcttgtgcgggccacctacctgagaagcttcaccatgacagcaggacctacctagtcaattcttctgattctggttcatcccaaactgagtccccttcctccaaatatagcgggttcttttccgaggtctcccaggatcacgagacaatggcccaggtgcttttctctcggaacatgagactgaatgtggccctgacattctggcggaaaaggagcatttcagaactcgtcgcttacctgttacgcatcgaagatctcggggttgtggtggattgtctgcctgtcttgaccaattgtcttcaagaggagaagcagtacatcagcttaggatgttgcgttgatctgctgcccctggtcaagtcgcttctgaagagcaaattcgaagagtatgtaattgtcggcctgaactggctgcaggcagtgattaagcggtggtggagcgaattgtcctcaaagaccgaaatcatcaacgacggcaatattcaaatattgaaacaacagttatccggcctttgggagcaggagaaccacctcactctggttccggggtacactggaaacatagcaaaagatgtggacgcatatctcctccagctccattag

SEQ ID NO: 11488 - DNA, 537 bp, Artificial Sequence
  Description of Artificial Sequence: Synthetic coding sequence
atggccagcgagacccataatgtgaaaaagcgtaacttctgcaacaagatcgaagatcacttcatcgatcttcctcgcaagaagatatcaaattttacgaacaaaaatatgaaggaagtaaaaaagagcccgaaacaactggcagcctacatcaatagaaccgtcggtcagacagtgaagtctccagataagcttagaaaggtaatttacagaagaaagaaggttcatcacccctttcctaacccctgttatcgcaagaaacaaagtccaggttctggtgggtgcgacatggcaaacaaagaaaatgagctcgcatgcgccggacatctgcccgagaagctgcaccatgactctcgcacatacctggtcaattccagcgacagcgggagctcccaaacagaatctccctcttccaaatattcaggcttcttcagcgaggtatctcaagaccatgaaacaatggcacaggtgctgttttctagaaacatgcggcttaatgttgctctgacattctggcggaagaggtccatctcctag

SEQ ID NO: 11489 - DNA, 120 bp, Artificial Sequence
  Description of Artificial Sequence: Synthetic coding sequence
atggcatctgagacccataatgttaagaagagaaatttctgcaacaaaatcgaagatcattttattgacctgccacggaaaaaaataagtaatttcacaaacaaaaacatgaaggaatag

SEQ ID NO: 11490 - DNA, 225 bp, Artificial Sequence
  Description of Artificial Sequence: Synthetic coding sequence
atggcctccgagacgcataacgtgaaaaagcgcaatttctgcaacaaaatcgaagaccacttcatcgatttaccgcggaaaaagatttctaacttcaccaacaaaaacatgaaggaagtgaagaagagcccgaagcagcttgccgcatacatcaatcggacagttggccagacggttaagagccccgataaactcagaaaagtgatctaccgcaggaagaagtag

SEQ ID NO: 11491 - DNA, 534 bp, Artificial Sequence
  Description of Artificial Sequence: Synthetic coding sequence
atggcctccgagacccacaatgtcaaaaagagaaacttctgcaacaaaatcgaggaccattttattgatctccccagaaagaagattagcaattttaccaataaaaacatgaaagaggtgaagaagtccccgaagcaattagcagcttacattaatcggactgtgggccagacagtcaagagtccggacaaactgaggaaagtcatttaccgccggaagaaggtgcaccacccctttcctaacccatgctatagaaagaagcagtcaccaggcagcggaggttgcgacatggcaaataaggaaaacgagttggcctgcgctggacacctgccagagaagttacatcatgactcacgcacttatctcgtgaattcctcggacagcggcagcagccaaactgaaagcccaagctcaaaatactctgggttcttttccgaggttagtcaggatcatgagactatggctcaggtgctgttctcacggaatatgcgcctcaacgtggcactgacattttggaggaaacgcagtatctag

SEQ ID NO: 11492 - DNA, 1887 bp, Artificial Sequence
  Description of Artificial Sequence: Synthetic coding sequence
atgctcctggccaggatgaaccctcaggtccagcctgaaaacaacggtgctgatactggaccagaacaacccctccgtgcaaggaagacggccgagctgttggtggtaaaagaaaggaacggagtgcagtgccttctggccccccgggacggcgacgcccagcctcgggagacctggggcaagaaaatcgacttcctactgtcagtggtcgggttcgctgttgacctggctaacgtatggcgctttccctacttatgttataaaaacggaggaggggcattcctgataccgtacactcttttcttaattatagccggcatgcccttgttctacatggagctggcactcgggcagtacaatagagagggggccgctactgtctggaaaatttgcccattcttcaaaggggtgggctacgctgtgatcctcatagccctgtacgtcgggttttattataatgtgatcattgcctggtccttgtattacctattctctagctttacgttgaatttgccatggacagactgcgggcacacatggaactcacctaattgcacagacccaaaactgctgaacggcagcgttctgggcaatcacacaaagtactcaaagtataaattcactcccgctgccgaattctatgaaagaggcgtactccacttacacgagtcaagcgggattcatgacatagggctgcctcagtggcagctgctgttatgtctcatggttgtcgttatagttctctatttcagcctttggaagggtgtgaagacatcaggaaaggtggtttggattactgctacgctgccttacttcgtgttattcgtactgctggtacacggcgtgaccctgcccggagctagtaacggcatcaacgcctatctgcacatcgacttctatcgcctgaaggaggctaccgtatggatcgacgctgctacccagatttttttcagcctgggggctgggtttggcgtcctgatagcgttcgcgtcatacaataagtttgacaataactgttatcgtgatgcacttcttacctcaagcatcaattgcatcacgagctttgtgagtggattcgctatcttcagcattctcggatacatggcacatgagcacaaggtcaatattgaggacgtggcaaccgagggggccggcttagtgttcatcctttaccccgaggcaatctcaaccttgtctggttctactttctgggctgtagtctttttcgttatgctcctggccctgggcctggatagttccatgggggggatggaggcagtcattactgggctggccgatgacttccaggtattgaaacggcaccgcaaactcttcacattcggagttactttctcaaccttccttcttgcccttttctgcatcactaagggcggcatttacgtgttaaccttgcttgatacttttgccgctggcacgtcaattctttttgccgtcttaatggaggccatcggggtctcctggttctacggcgtggaccggttcagcaatgatatacagcagatgatgggattccggcctggcttgtactggcgcttatgctggaaattcgtttccccagcattcctgctcttcgtggtagttgtgtcaattatcaacttcaagcctctgacttatgacgactacattttccccccctgggcaaactgggtggggtggggaatcgcccttagtagcatggtattggtcccgatttacgtcatctacaagttcttatccacccagggatccctctgggagagactcgcctacggtatcaccccagaaaacgagcatcacttagtagctcagcgcgacattcgtcagttccaaatgaagactcggcaggggcgaaggagggcaactaactcctgccaaattagctgttag

SEQ ID NO: 11493 - DNA, 519 bp, Artificial Sequence
  Description of Artificial Sequence: Synthetic coding sequence
atgacatctgcaagcacgaaggtgggcgaaattttcagtgccgccggagccgccttcacaaagctgggcgagcttactatgcaactgcatcctgttgcggatagcagccctgcaggtgcaaagtggacggaaacagagattgagatgctgagggcagctgtgaagcgctttggcgacgacctgaatcacatcagttgtgtgatcaaggagcgcaccgtcgcccagattaaagctaccgtgaaacgaaaggtctacgaagactcgggcataccattgccagccgaaagccctaagaaagggcccaagaaggtcgctagtggggtgctgagccccccacccgccgcccctccgccctcttcctcctccgtgcctgaagctggggggcccccaattaaaaagcagaaggcagacgtcactctctccgccctcaatgattcagatgccaatagcgacgttgtcgatatcgagggcctcggtgagacccctcctgccaaaaagctgaactttgaccaggcgtag

SEQ ID NO: 11494 - DNA, 417 bp, Artificial Sequence
  Description of Artificial Sequence: Synthetic coding sequence
atgacttctgccagcaccaaggtcggggaaattttcagtgcggcgggggccgcgttcaccaaacttggggaactcaccatgcaacttcacccagtggctgactcaagccccgctggggcacagattaaggctacagttaagcgtaaggtttatgaagactctgggatccccttgcccgctgaatctccaaagaagggacccaagaaggtagcaagtggggtactgtccccccctccagctgcccccccaccctcctctagcagtgtgccagaggccggcggcccccccattaaaaaacagaaggctgacgtgaccctgagcgctctgaatgattcagacgctaactcggacgtcgtggacatagagggcctcggtgaaaccccacctgctaagaaactgaattttgatcaggcctag

SEQ ID NO: 11495 - DNA, 555 bp, Artificial Sequence
  Description of Artificial Sequence: Synthetic coding sequence
atggatttgcaggctgcaggtgcacaggcgcagggggccgctgagccgagcagagggccacccttaccgtctgcccgcggtgcgccaccttcacctgaggcaggcttcgccactgccgatcactctagccaagaacgtgagaccgaaaaagccatggacagacttgcccgcggaacacagtctattcccaatgactctcccgccaggggtgagggcacccattcagaagaggaaggatttgccatggatgaggaggatagtgacggcgaactaaacacctgggagctgtcagaaggcacaaactgcccacctaaagaacaacctggtgacctttttaatgaagattgggactcagagttgaaagcagaccagggaaatccctatgatgctgatgatatccaggagtcaatttcacaggaattgaagccttgggtatgttgcgcacctcaaggcgatatgatctacgatccgagctggcaccacccacctcccctaataccctattacagtaagatggtatttgaaacagggcaattcgacgatgctgaagattag

SEQ ID NO: 11496 - DNA, 519 bp, Artificial Sequence
  Description of Artificial Sequence: Synthetic coding sequence
atgggaggtgatgcaggtgatagagagccgggccctgcggcccggtcactgggcgaaggccaggccggattcgccacagctgaccactcttcacaggaacgcgaaacagagaaggcgatggatcggctggccagagggactcagagcatccctaacgattctccagcccgaggcgagggcacccattccgaggaagagggttttgctatggacgaagaggactccgacggggagctgaacacatgggaattgtccgaagggacaaattgcccaccaaaggagcagcccggcgatttgttcaacgaagactgggattccgaactcaaggccgaccaggggaacccctacgatgcagatgacatacaagaatccatttcccaagagttgaagccctgggtgtgctgcgcaccacagggggatatgatatatgatccaagttggcatcaccctccacccctaattccttattattccaagatggtgttcgagaccggccagttcgacgacgctgaggactag

SEQ ID NO: 11497 - DNA, 1956 bp, Artificial Sequence
  Description of Artificial Sequence: Synthetic coding sequence
atgggaccagcaagtcctgctgcccggggcctgtccaggagacctgggcagccccctctccctttgttgctgcccttgcttctgcttctgttaagagcacagcccgccatcggctcactcgccggcggcagcccaggcgctgcggaagctcccggctctgcacaggtggcaggtttgtgtggtaggctgactctgcatcgtgacctgagaaccggcaggtgggagccggacccccagcgcagcaggcgatgtctgcgagacccccaacgcgtactggagtattgcagacaaatgtaccccgaattacagattgctagagtcgagcaagcaacgcaggcgatccccatggaacgttggtgcggtgggtcaagatccggaagctgtgctcacccacaccatcaggtcgtccccttccgatgtctaccaggggaatttgtgtccgaggcactcttggtccctgaaggctgtcggttcctgcaccaggaacgtatggaccaatgcgagagcagtacgcgtcgtcaccaggaagctcaggaagcttgtagttctcaggggttaatcttgcatggctcgggaatgctgctgccctgcggcagtgatcgctttaggggcgtggagtatgtctgctgtccacctcctggaaccccagacccctctggcacagccgtgggcgatccgagcacccgctcttggccccccgggtccagggtggagggcgccgaggatgaggaagaggaagagtcttttccacaaccggtagacgattatttcgtggagcccccccaggctgaagaggaggaggagaccgtgccacctccgtcatctcacacgttggccgtggtagggaaggtaacccccactccccgacccaccgatggggtagacatatactttggaatgcctggggagatttccgaacacgaaggatttttacgggccaagatggatctggaggaacgccgcatgcgccagataaacgaggtaatgcgggagtgggctatggccgataatcaatcaaagaatctgccgaaggcggacagacaggccttaaacgaacattttcagtcaattctgcagaccttggaggagcaggtctcaggtgagagacagaggcttgtcgagacacatgccactagagtgatcgcactaattaacgaccagaggcgtgctgccctagaagggttcttggcggcactccaggccgacccgccccaagcggagcgtgtcctgctggcactgaggcggtatctccgcgctgaacagaaggagcagaggcatactctgcgacactatcaacacgtcgctgcggtggatcccgagaaagcccaacagatgcgctttcaggtgcatacgcatctgcaggtcatcgaagagagagtgaaccagtcactggggctgctcgaccagaacccccacttggcccaagagctgcggccccagatccaggagctgctgcacagcgaacacctgggcccctctgagctggaagctcctgcacctggtggcagctccgaggacaaaggtggactgcagccacctgactctaaggatgccgatacccccatgacacttccgaaaggtagcaccgagcaggatgcagcttctccggagaaagagaaaatgaatcccctggaacaatatgaaagaaaagttaacgccagcgttccgagaggatttccctttcatagttccgagatccagcgagacgaactggcgcccgctgggacaggggtttcacgagaagctgttagtgggctccttatcatgggagccgggggaggtagcttgatcgtcctgagcatgctcctcctgaggcggaaaaaaccttacggggctattagtcacggcgtcgtcgaggttgatccaatgcttactctcgaggaacagcagctaagagagctccagcggcacgggtacgagaatccgacatatagattccttgaggaacgaccctag

SEQ ID NO: 11498 - DNA, 2277 bp, Artificial Sequence
  Description of Artificial Sequence: Synthetic coding sequence
atgggccgggatacacggtcaagatctaggtcggctgggagaagaggccggcgccggcagtcacagtcagggagccgctcgcgttctcgcagccacggaaggagaaaccggcggagacgcgaggacgaaggacgccgcagaaggcgaaggagatcccgggagcggcggtccgactcagaggaggagcgctggcagcggagtggcatgcggtcgagatctccaccacggccaaagtggcattcaagggacggatcttctcagtctgatagcggagaggagcagtcacggggacagtgggccagaagacgccgtagagctaggagttggtcaccctcttcttctgcctccagctccgcaagtcccggccgtagtcagagtccgagggccgcagccgccgccctgagccaacagcagtctctgcaggaaaggctgcggctacgggaagagcgcaagcagcaagaggagctaatgaaagcctttgagacgccggaagaaaagagagcccgaagacttgctaaaaaagaagcaaaggagcgaaagaagcgggagaaaatgggatggggtgaagaatacatgggctatacaaacacggacaacccattcggcgacaacaacctgctggggactttcatttggaacaaagcacttgaaaagaagggcatctcccatctcgaagaaaaagaattgaaggagcggaataaaagaatacaggaagataacagactggaactccagaaagtaaaacaattaaggcttgagcgcgaacgagaaaaggcgatgagggagcaggagctcgaaatgctgcagcgagaaaaagaagctgagcatttcaagacgtgggaggagcaagaggacaacttccatctccaacaggcaaagttgcgctccaagatacgaatccgggacggtagagcgaagcccatcgatctccttgcgaagtatatttctgccgaagacgacgacctggcagtggaaatgcacgaaccatacacgtttttgaatggcctgacggtggccgacatggaggacctcctggaggatattcaggtctacatggagctcgagcagggcaagaacgccgacttttggcgtgacatgacaaccatcaccgaagatgaaatttccaagctccgtaaactcgaggcgagcggtaagggtcccggcgaaaggagggagggcgtcaacgcctccgtgagcagcgacgtgcagtccgtgtttaaaggaaaaacatacaaccaattgcaggtgatttttcagggcatcgagggaaagatccgggctggaggcccgaacctggatatgggatattgggagtctttgctacaacaactgcgagcccacatggccagggctcgcttaagagaaagacatcaggacgtgctcagacagaagctctacaagctgaagcaggagcagggggtagaatccgagcctctgtttccaattttgaagcaagaacctcagagtcctagcagaagcctggaacctgaggacgcggcaccaaccccgcctgggccctcttccgaaggtggccccgcagaagccgaggtggacggcgccacaccgaccgagggagatggggacggtgatggtgagggtgaaggcgaaggggaagcagtcttaatggaggaagacctgattcagcagtcactggacgattatgacgcgggccgttattcacctcgactcctgaccgcccacgaacttcccttagacgcgcacgtcctggagcctgatgaggatctccagagattacagctgtcgcgacagcaactccaggtgactggagacgcctcggagtcggctgaagacatattttttcggcgggctaaggaaggcatgggccaggatgaggcgcagttctctgttgagatgcctttgactggtaaagcttatctttgggctgataaatacagacctcgcaagcctagattctttaaccgcgttcacacggggtttgaatggaacaagtacaaccaaactcactacgactttgacaacccaccccccaaaatcgtccagggctataaatttaatattttctaccccgacctaatagacaaacgatctacccccgaatacttcctagaagcctgtgcggacaacaaggactttgcaattctcaggtttcacgcagggcccccttatgaggatatagccttcaagatcgtcaaccgggaatgggagtactcccaccgtcacgggtttcggtgccaattcgccaacggaatcttccaactctggttccactttaaacgctaccgctatcgtaggtag

SEQ ID NO: 11499 - DNA, 2277 bp, Artificial Sequence
  Description of Artificial Sequence: Synthetic coding sequence
atgggaagagatactcgctcaagaagccggagtgcggggaggaggggccgccgccgtcagtcacaaagcggtagtagatcccgctcaaggtcccatggtcgccgaaataggcgacggagggaggacgaaggcaggagacggcgaagaaggcgtagtcgggaaaggcgttctgactctgaggaagaacgctggcaacggagcggtatgaggagccgctctccgcctagaccaaagtggcactctcgcgacggtagctcccagtcagattcgggagaggaacagtccagggggcagtgggctaggcggcgcagaagagctcgtagttggtccccttcctctagtgcttctagctccgcaagcccgggcaggtcacagtcaccaagagcggccgcagcggctctgtctcaacagcagagcctgcaggagagacttagactgagggaagagagaaagcagcaggaggagctgatgaaagccttcgaaacccctgaggaaaaaagggcacgccgattggcaaagaaggaagctaaggaaaggaagaagcgcgaaaagatgggctggggagaggagtacatgggctataccaacaccgacaaccctttcggagacaacaacctacttggtacctttatttggaataaggccctcgaaaagaagggaattagtcatctggaggagaaagaactgaaagagagaaacaagcgcatccaagaggataaccggctggagctccaaaaagtgaaacagttgcgattagaacgcgaaagggaaaaagccatgcgggaacaggaactggagatgctgcagagggaaaaggaagcggaacattttaagacttgggaggaacaagaggacaacttccacctacagcaagcaaagctgcggtcgaaaatccggattcgtgatggaagagcgaagccaatagacctgttagctaagtatatttccgccgaagacgacgacctggcagtcgaaatgcatgagccttataccttcctcaatggtctaacggttgccgacatggaggacttactggaggacattcaggtatatatggagcttgaacagggcaaaaacgctgatttttggagagacatgacaacaattaccgaagatgagatttctaaactgcgcaagctggaggcatccggcaaaggcccaggcgagcgccgagaaggcgtcaatgcctcagtgtcctccgacgtgcaatctgtatttaagggcaaaacttataaccaactccaggtgatcttccaggggatcgaagggaaaatacgcgctggggggccgaacctggacatgggttattgggaatctctgctccaacagctcagggctcatatggctagagcccgcctgcgcgagaggcaccaggatgtgctgcgccaaaagctgtataaactgaagcaggagcagggggtggaatccgagcctctattccctattctgaaacaggagccccagtctccttctaggagcctggagccagaagatgccgcgcctacgcctcccggccctagcagtgagggcggtcccgcggaagccgaggttgacggggccacgcctacagagggagatggcgacggcgatggcgagggagagggcgagggggaggccgtactgatggaagaagatctgattcagcagtcgcttgatgactacgacgctggcagatatagccctagacttttgacagctcatgagctgccgctagatgcccatgtacttgagcccgacgaggatctccaaagactgcagttgagcagacagcagctgcaggtaaccggagatgccagtgaatccgcagaggatatcttttttcgccgagccaaggaaggcatgggacaggacgaggctcagtttagcgtggaaatgccacttacgggcaaggcttatctctgggcggacaaatatcgaccacgaaagccaagattctttaatagagtgcacacgggattcgaatggaacaaatataatcagacccactacgactttgataaccctcctccaaaaatcgtccaggggtataaattcaacatattttacccagacctgattgataagcgcagtacccctgagtatttcctggaggcctgcgcagataacaaggatttcgcaattctacggtttcatgccggtcctccttacgaagacatcgcatttaagattgttaatagggaatgggaatattcacatcgtcacgggttcagatgtcagttcgccaatggtatttttcaactgtggttccactttaaacggtacaggtaccgtcggtag

SEQ ID NO: 11500 - DNA, 792 bp, Artificial Sequence
  Description of Artificial Sequence: Synthetic coding sequence
atggggagggatacacgttcaagaagtagatctgccggacgacgtggaagaagacgccaatcccagagtggcagcaggagagggccgagccccttcccacgcagtgtgcatcagcctcgacaccttagaactaatccctgcgcccagggaagttgggtgaaggctggcccacctgtcaagcagctcagacttgaacgtgagcgcgaaaaggctatgcgagagcaggagctggaaatgctacaacgtgagaaggaggccgagcactttaagacctgggaggaacaagaagataacttccacttgcagcaggcaaaacttagaagtaagattcggatcagggacggacgggctaaacctatcgacctcctggccaagtacataagcgccgaggatgacgatctggctgtcgaaatgcacgagccatatacttttctgaatggactgacagtcgctgatatggaggaccttctcgaagacatccaggtgtacatggagttggagcagggaaagaacgccgatttttggcgggatatgactaccatcacagaagatgagatctccaagctgcgcaagctcgaagcgtctggtaagggacctggagagcgcagagaaggtgtcaatgcctccgtcagtagcgacgtacagtctgtgttcaagggcaagacttacaaccaactgcaggtgatctttcagggcatcgagggcaaaattagggccggtggtccaaatctggatatgggctattgggagtcgcttctacaacagctaagggcgcacatggccagagcttag

SEQ ID NO: 11501 - DNA, 321 bp, Artificial Sequence
  Description of Artificial Sequence: Synthetic coding sequence
atggagttcgatctgggagcagcccttgagcctaccagtcagaaacctggggtaggggcaggccatggaggcgaccctaaactgagcccacataaggtgcagggcaggagtgaagctggagccggcccaggacctaaacagggccaccattctagcagtgacagttcaagcagctccagtgactctgatacggacgtcaagtcccatgctgcggggagcaagcaacatgaaagcatccccggaaaagcaaaaaagccgaaggtgaaaaaaaaggagaaggggaaaaaagaaaaagggaagaagaaagaagcaccacactag

SEQ ID NO: 11502 - DNA, 543 bp, Artificial Sequence
  Description of Artificial Sequence: Synthetic coding sequence
atggctggcgtcaagtaccccggccaggatcctgtggacctcgacatttaccaatccagccacatggtggactaccaaccctaccgcaaacacaagtactcaagagtgacccctcaggagcaggctaaactggacgcgcaactccgtgataaagagttttaccgacccataccgaaccctaaccctaagctgaccgacgggtaccctgccttcaagaggcctcacatgactgctaaagacttggggctgcctgggttttttccctcccaggaacacgaggctaccagagaagacgaacgtaagttcacaagcacctgtcactttacctatcccgccagtcacgacctgcacctggctcaaggtgacccaaaccaggtgctccagtcagctgatttcccatgcttggtggacccaaagcaccagccagcagccgagatggccaagggttacctgctactacccggttgcccatgtctgcactgtcatatagtgaaagttccaatcctaaacaggtggggaccccttatgcctttttaccagtag

SEQ ID NO: 11503 - DNA, 1041 bp, Artificial Sequence
  Description of Artificial Sequence: Synthetic coding sequence
atggtgggaggcgggggaaagcgccggccaggaggtgaggggccgcagtgcgaaaaaaccacggatgttaagaagtcaaagttttgtgaagccgatgtcagctcagacctgcggaaggaagtggaaaatcattacaagttatctttacctgaagacttttaccacttctggaaattctgtgaggagctggaccctgaaaagccgtctgactctctgagcgcatccctgggactccagctggtaggtccgtatgacattctagctggcaaacataaaaccaaaaaaaagtccaccggtctgaatttcaacctgcactggcgcttctactatgacccacctgaattccagactataataattggtgacaacaaaacgcaatatcacatgggatattttagagacagtcctgatgaattcccggtgtatgtgggcatcaacgaagccaagaaaaattgcatcatcgtgcctaacggcgataacgttttcgccgctgtcaagctgtttctcaccaagaaactacgggaaattaccgacaagaaaaagattaacctgctcaagaacatcgacgagaaacttactgaggcagctcgtgagctgggctacagcctagagcaacggaccgtgaagatgaagcagagagacaagaaagttgtgacaaagactttccacggtgctggtctggtggtgccagtggataagaatgatgttgggtacagggagctacccgagaccgacgcggacctcaaacggatttgcaaaacaattgtcgaggcggcatctgatgaagagcgcctaaaggcattcgcacctatccaggagatgatgacctttgtgcagttcgccaacgatgaatgcgattacgggatggggctggagttaggtatggacctcttttgctatggctctcattatttccacaaggtggctgggcaacttctccccctcgcttataatctcctgaaacgcaatctttttgccgaaatcatagaggagcatctcgcgaacaggtctcaggagaatattgaccagcttgcggcctag

SEQ ID NO: 11504 - DNA, 780 bp, Artificial Sequence
  Description of Artificial Sequence: Synthetic coding sequence
atgcgtgatagacggggcccactagggacctgtctggcccaggtgcaacaggcgggaggcggcgactccgataaactgtcctgttcattgaagaaaaggatgccggagggtccctggcctgccgacgcgccttcatggatgaacaagcctgtagtggacgggaatagtcagtcagaggctctcagcctcgaaatgcgcaaggaccctagcggagcaggcctttggctccactccggaggcccagttctgccgtacgtgagggaaagtgtgaggcgcaatccggcaagtgccgccaccccatcaacagcggtgggactgtttcccgcacccactgagtgctttgcacgggtatcgtgcagcggagtggaagcactcggaagacgggactggttaggcggcgggccgagggccacagatggacaccgcggccaatgcccaaagggcgagccaagagtgagtagactgccacgccatcagaaggtgcctgagatgggcagctttcaggacgatcccccttccgcctttccaaagggcttgggatccgaactggagccagcgtgtctgcatagcatcctaagtgccactctccacgtttaccctgaggtgcttctttcggaagagactaagagaatctttttggatcgccttaaaccaatgtttagtaagcaaaccatcgagttcaaaaaaatgctcaagtcgactagtgatggcctacaaatcactttgggtcttcttgccctccagcctttcgaactcgccaacacattgtgtcatagctag

SEQ ID NO: 11505 - DNA, 363 bp, Artificial Sequence
  Description of Artificial Sequence: Synthetic coding sequence
atgagggaccggcgcggtcctcttgggacctgccttgcacaagtacagcaagcaggaggcggggacagcgataagttgagctgcagcctgaagaagaggatgcccgagggtccttggcccgctgacgcgccaagctggatgaacaaacccgtagttgatggaaattcccagagcgaagccctgagtctcgagatgcgtaaagacccctcaggagccggactttggttgcactccggagggccagttttaccctacgtgcgagagtcagtgagaaggaaccccgccagcgccgcgacaccaagtaccgccgtgggtttgttccctgctcctactgagtgtttcgctcgagtcagctgctcctag

SEQ ID NO: 11506 - DNA, 330 bp, Artificial Sequence
  Description of Artificial Sequence: Synthetic coding sequence
atgagggaccggcgaggcccccttgggacctgtctggcgcaagtccaacaggctggcggcggcgatagcgacaaactctcttgcagtctcaaaaaaaggatgcctgagggcccttggccagcagacgcgccatcatggatgaataaaccagtggtcgatgggaattcacagagtgaggcgttaagtctcgaaatgagaaaggatcccagcggcgccggactatggcttcacagcggcggtccagtgctgccgtacgtcagagagtctgtgagacgcaatcccgcctctgccgccacaccaagtaccgccgttgggctgtttccagcttag

SEQ ID NO: 11507 - DNA, 2391 bp, Artificial Sequence
  Description of Artificial Sequence: Synthetic coding sequence
atggcagagacaaaggatgtctttgggcaagagccacacccagtggaggatgacctctacaaggaacggacgcggaagcggaggaaaagcgacagggaccagagatttagagcctttccatccatggagcagtcagctctgaaagagtacgagaagctggaaagccgaacaaggagggtgctgtcaaacacctatcagaaacttatccagagcgtgttcttagatgatagcattccaaacggtgttaagtatctaatcaaccggctccttgcacttatcgaaaaaccgacagtggaccccatttacattgctctgttcgggtcaaccggtgccgggaaaagtagcctgattaacgcaatcatccagcaagccatgtttcttcctgtgagcggtgaatctatatgtacatcttgtatagtgcaggtgtcttctggctgttgcgtccagtatgaggccaaaatccatctgctgagtgatcaggaatggcgggaggagctaaaaaatctgacaaagctcctgcatagaacagaagagctcagcagggaggaggccgacgcttggaatcgagacgaagccgttgaagaggccacatggaaactacagatgatttatgggaatggcgctgaaagtaaaaattacgaagagttactgagggctaaaccaaaaaggaagattccaaccagtcgagttatcacactgaaagcggaggaagccgaagagctttccattaagttagacccatatataaggacacagaggcgggattgggatggcgaggcggccgagatgcgcatctggccacttataaagcatgtcgaggtgacattacctaaaagcgatctgattcccgaaggtgtggtgctagtggacattcctggcactggggacttcaactcaaaaagggatgagatgtggaagaagaccattgataagtgctctgtcatctgggtcatctccgacatcgaacgtgtgtccggcggacaggcccatgaggatctgctgaatgaatctattaaagcttgccagcgggggttctgccgagatgtcgccctcgtcgtcactaaaatggacaaactgcacttgccagagtacttgagggaagaaaggaagggctggcaggctattcaaagccaacgtgaggcggtgctcgaacgtaacgagatgattaagctacagaggacacggattcttaaggagaaactcaaacggaagctcccagcagattttaaagttctcgaggcttccgacctagtgtatacagtatccgcccaggaatactggcaacaggccctgctgaccgaggaagagactgagatccctaagctgcgagaatacataaggaagtccctgcttgacaagaaaaaacgcactgtgaccaaatatgttacagaggcattcggtctgttgttgctcactgattccttcaactccactcagaatcttccgaacgagcatttgcatatgagcgtcctgagacgcttcgccgaggaaaaggtggagctcctggagaaggccatcgcacagtgcttcgcatgcatggaacagcctttacaagaaggagtaagaaccgcacggaccagctacagatgcatccttagagcttgcctcgtcaggtccaagggcaaccaaggcttccatcaaacccttaaagctgtgtgcctgaagaacggtatctacgcttcacggacgcttgcccgcattgacttgaatgaagctctgacccaacctgtttacgatcagatagatccagtgtttggcagtattttcaggactggtaagccaacaggttctgctctaatgccacacatcgatgcttttaagcaatcactccaagagaagatgacagaaataggcattagatccggatggaaatatgattcttgtaaaaagaattttctgatccaggaaatcagcgcaatcctaggaggattagaagaccatatcctccggagaaaaagaaggatctacgagagtttgaccgcaagcgttcagagtgatctgaagctttgctacgaagaagctgcgcagatcactggcaaaaaggcatgcgagcgaatgaaagatgctataaggcggggcgtggatagacaagtggcggaaggaatgtttgagcgcgctcaagagcggatgcaacaccagttccagcagctgaaaaccggcatcgttgagaaagtaaagggaagcatcaccactatgctggcattagcaagtagtcaaggagatggcctatacaaggagttggccgacgttggatctgagtacaaggaaatggaaaaactacaccggagtctgagagaggtcgcggagaatgcacgtctgcgtaaagggatgcaggagttcctgcttagggcctccccatctaaggccggacccccgggcacaagcctttag

SEQ ID NO: 11508 - DNA, 2391 bp, Artificial Sequence
  Description of Artificial Sequence: Synthetic coding sequence
atggctgaaacaaaagacgttttcggtcaggaaccccatcccgtcgaggacgacctctacaaggagagaactcgtaagcgtcggaaaagcgatcgcgatcaaagatttagggctttcccatccatggagcagagtgctcttaaagagtacgaaaagctcgagtcgcggacccgtcgagtgctgtccaatacctatcagaagcttattcagagcgtgttcctggacgattcaatacctaacggtgtcaaatacctcatcaataggcttctggcgctgattgagaaaccaacggtggatcctatatacattgccctgttcggcagcacaggggccggtaaaagcagtctgatcaatgccattatccagcaggcaatgtttttgcccgtgagcggagaaagtatctgcaccagttgtatcgtccaggtcagctccggatgttgcgtccagtacgaagcaaagatccaccttctgagtgaccaggagtggcgagaggaacttaagaacctgactaaacttcttcaccggactgaagaactttcccgagaggaagcagatgcctggaaccgggacgaggcagtggaagaggcgacatggaaattgcagatgatctacggtaacggggcagaaagcaaaaactacgaagaattgctacgcgctaagccgaagcgcaaaattcccacaagccgggtgatcacactcaaagcagaggaggcggaagagctgtcgataaagttggacccatacataagaacgcaaagaagggattgggatggagaagcggcagaaatgcgcatctggccactgattaagcacgtggaggtgaccctgcctaagagtgacctcattccagagggggtggtgctggtggacattccaggaacaggggactttaattcaaaaagggacgagatgtggaagaaaactattgataagtgtagtgtgatctgggtcatatctgacatcgaacgggtcagcgggggccaggcgcacgaggacctgctaaatgaatccattaaagcctgtcaacgcggcttttgcagggatgtggcactcgtggtcacaaagatggacaaactgcatctgcccgagtatcttcgtgaaaggaaagctgggaaccaggcgattcaatcccagcgggaggccgtgctggaaaggaacgagatgattaagttacagcggacccgtattcttaaggaaaagctcaagcgtaagctaccggccgatttcaaggtgctggaagctagcgacctcgtgtacaccgtttccgcgcaagagtattggcaacaggctctcctgaccgaggaggagaccgagataccaaaactgcgggagtacatccggaaaagcctgcttgataagaagaagcgaaccgttacgaagtatgttaccgaggcctttggactcctcttgctgacagactctttcaattctacccagaatctgcccaacgagcatttacacatgtccgtcctcaggagatttgccgaggagaaggtagagctgttggaaaaagctattgcccaatgttttgcttgcatggagcagcccctgcaagagggtgttcggaccgcccgtacctcttaccgctgcatacttagagcatgtctcgtgcgcagcaagggtaatcaagggttccaccagaccctgaaggcagtttgtctcaagaacggcatctacgcaagccgcacgctggctcgcattgacctgaacgaggccctgactcagcctgtgtacgatcagattgacccagtgttcggctctatctttcgaactgggaaacccaccggctccgccctgatgccacacatcgacgcctttaaacagtccttacaggaaaaaatgaccgaaatcggcattcggtctgggtggaagtatgacagttgcaaaaaaaactttcttatccaggaaatctccgccattttggggggactcgaagatcatatccttagaagaaagcgcaggatatacgagtccctgacagcctctgttcagtcggacctaaagctgtgttatgaagaggctgcacagatcactggcaaaaaagcctgcgaacgcatgaaggacgctatcagacgcggtgttgatagacaggttgcggaagggatgtttgagagggctcaggagaggatgcagcaccagtttcagcaactcaagacaggcatcgtcgaaaaggtcaagggaagcattacgaccatgctggctctcgccagcagccagggtgatggactatacaaggaacttgcagacgtgggatcggagtacaaggaaatggagaagctgcataggagcttaagggaagttgctgaaaacgccaggctgcgtaaaggcatgcaagaattcttactgcgcgcctccccatctaaagccggccccccagggacctctctgtag

SEQ ID NO: 11509 - DNA, 3999 bp, Artificial Sequence
  Description of Artificial Sequence: Synthetic coding sequence
atgaccggagaggtgggctccgaggtccacctagaaatcaacgaccccaatgtgatcagccaagaggaggcggatagtccaagcgacagcggccagggaagttacgaaactatagggcccctcagcgaaggagattccgacgaggagatcttcgttagtaaaaaacttaaaaataggaaggtcctgcaggacagtgacagtgaaactgaggatactaatgcttcacccgagaagactacatacgactccgccgaagaggagaacaaggaaaacctttacgcagggaaaaacaccaaaataaagcggatttataagaccgtcgcagattccgacgagtcatatatggaaaagtcactctaccaagagaacctggaagctcaggtcaagccgtgtcttgagttgtcgctccagagcggaaattcaaccgactttaccacagatcgcaaaagctccaagaagcatatccatgacaaggaagggacggccgggaaggccaaagttaagtccaagcgacggctagagaaggaagagcggaaaatggagaagattcgacagcttaaaaagaaagagactaagaatcaggaggatgatgtagagcagccttttaatgatagcggatgtcttctggtggacaaggacttgtttgagactgggctcgaggacgaaaacaactctcccctggaggatgaagagtctctggagtcaatacgggctgccgttaagaataaggttaagaaacataagaagaaggaaccgtccctggagagcggggtgcacagcttcgaggaaggcagcgaactgagtaaggggaccacgcgcaaggaaagaaaggctgcccgcctgagcaaggaagctttaaagcaactacactccgaaactcagaggttaataagagagtccgccttgaacctgccttaccatatgccagagaataaaaccattcacgatttcttcaagagaaagcccagacctacctgtcatggaaacgctatggcacttctgaaatcctccaagtaccagagttcacaccataaggaaattatcgataccgctaacacaaccgaaatgaattccgaccatcactctaagggtagcgaacaaacaactggtgctgaaaatgaagttgaaaccaacgcattacccgtggtgtctaaggagactcagattattacggggagtgatgaatcatgccgtaaagatttagtgaaaaatgaagagctggagatccaggaaaagcagaagcagtcagatatccgaccttccccaggagacagcagtgtactgcagcaggaaagcaacttccttgggaacaatcatagcgaggaatgccaggtcgggggattggttgcattcgaaccccatgcactggaaggagaagggccgcagaatcctgaggagacggacgagaaagttgaagagccagagcagcagaataagagctcagcggtgggaccacccgaaaaggtgcgcaggtttaccctggaccggctcaagcagctcggggttgacgtttccattaagccccgccttggcgccgatgaggactccttcgtgattctcgaaccggagactaatagggagctagaagcactgaagcagcgattttggaagcacgcgaatcccgctgctaagcctagggctggacagactgtcaatgtgaacgttatcgtgaaggacatggggactgatggcaaggaggagctcaaagctgacgtggtcccagtaacactagcacccaagaaacttgatggggccagtcacacaaagcctggggaaaagcttcaggttctgaaggcaaagctgcaggaagcaatgaagcttagacgatttgaagaacggcaaaagcggcaggctcttttcaagctggacaacgaagatggatttgaagaagaggaggaggaagaggaagagatgacggacgaatcagaggaagacggtgaggagaaagtggaaaaggaggaaaaggaagaagagctggaggaggaagaggagaaagaagaggaggaagaagaagaaggaaatcaggaaactgctgagtttctcttatcctcggaagaaattgaaacgaaagatgaaaaggaaatggacaaagaaaacaacgatgggagtagcgagatcggtaaggctgtggggttcctgtcagttccaaagtccctctcatccgacagtaccctcctcctgttcaaggatagctcgtccaaaatgggatatttcccgaccgaggagaaaagcgaaaccgatgagaacagtggcaagcagccttccaaactagatgaggatgacagctgctctctcctgaccaaagagtcatcccacaactccagcttcgaattaattggctctaccattccttcctaccaaccgtgcaatcggcagaccggcaggggtacttccttttttcccacggccggaggttttcggagcccttcccctggcctatttagagcatcactggtgagcagcgcatctaagtctagcggaaagctttcagaaccgtcactcccgattgaggatagccaggatctttacaacgcgagtcccgagcccaagacactctttcttggggccggcgactttcagttttgccttgaagacgacactcagagccaattgctcgatgccgatggattcttgaatgtccggaatcatcggaaccaataccaggcattgaaacctaggctgccactagcttcaatggacgagaatgccatggacgccaacatggacgagttgcttgatctctgtactggaaagttcacatcgcaggctgagaaacaccttccaaggaagagcgacaagaaagagaatatggaggagctcttaaacctttgttcaggaaagttcacttcccaggatgcttcaacgcccgccagctccgagctgaacaagcaggaaaaggaaagctccatgggggaccctatggaggaggccctggccttgtgcagtggctccttcccaactgacaaggaagaggaggacgaggaggaggaattcggagattttagactcgtgtctaacgacaatgaattcgacagcgacgaggatgaacactcagattctggcaatgacttggcacttgaagaccatgaagacgatgacgaagaagagctgctgaaacgctccgaaaaactgaaacgacagatgcgcttaaggaaatatctggaagacgaagctgaagtttccggctccgacgtggggtcagaagacgagtacgacggggaagagattgacgagtatgaagaggatgtaattgatgaggtgctgccctccgatgaagagctccagtctcaaatcaagaagatacacatgaaaacaatgcttgacgatgataaaaggcagctgagactttatcaagagagatacctagcagacggtgatctgcatagtgacgggcctgggaggatgaggaagttccgctggaagaacattgacgatgccagccaaatggatctgtttcaccgggatagtgatgacgatcaaacagaggagcaacttgatgagtccgaggcccggtggcgaaaagagagaatcgaaagggagcagtggctgagggacatggcccagcaaggcaagattacagccgaagaagaggaagagattggagaggatagtcaatttatgatactggccaagaaggtgacagcaaaagccttgcaaaaaaatgcatcacgtcctatggtgatccaggagtccaagagtttgctgcggaaccccttcgaggctataaggcccggatccgcccagcaggtaaagaccggaagcctgttaaaccagccaaaggcggtccttcagaaattggccgctctctcagatcataaccctagcgcccctaggaatagccggaacttcgtgttccacactctgagcccagtcaaagccgaggccgcaaaggaaagttcaaagtcacagaagattcctgaaaaggatagcgactggcttacctggtccggcgcacccatccctggctttttcaggctgagttttgatccacatggatag

SEQ ID NO: 11510 - DNA, 4020 bp, Artificial Sequence
  Description of Artificial Sequence: Synthetic coding sequence
atgacgggagaagtggggtctgaggttcacctggagatcaacgatccaaacgtgatctcccaggaggaggcggatagtccttctgattcaggccagggctcatacgagactattgggcccctgtctgagggcgacagtgatgaagagattttcgtcagtaaaaagctgaaaaatagaaaagtactacaagatagcgacagtgaaaccgaagacacaaacgccagccccgaaaaaactacctacgactctgccgaggaagaaaataaggagaatttgtatgccggcaaaaacaccaaaattaagaggatttataagaccgtagcagattcagatgagagctacatggagaaatctttgtaccaggaaaacctcgaggctcaagtgaagccctgtctggagctgtctctgcagagcggcaactctaccgactttactactgatcgcaaatcctcaaaaaagcatatacacgacaaggagggtacagcgggaaaagctaaagtaaaatctaaacgccggctggagaaggaggaaagaaaaatggaaaagatccgccagctgaagaaaaaggagaccaagaaccaggaggacgatgtggagcaacctttcaacgattctggatgtctgctggtggataaagatctgttcgagaccggactcgaggacgaaaacaattccccacttgaggatgaggagagtctggaatcaataagggcagcagtcaaaaacaaagtgaagaagcacaaaaaaaaggaacccagcttagagtctggtgtgcactcctttgaagaaggtagtgaactgagcaagggaactacacgcaaggaaaggaaagctgcaaggctgagcaaagaagccctgaagcagctgcatagtgaaactcagagactcatcagagagtcagcccttaatctcccataccacatgcccgaaaacaaaaccattcacgacttctttaagagaaaacctaggcccacctgccacggtaacgcgatggctcttcttaagagcagcaagtatcagtcctcacaccacaaggagatcatagacacagccaacaccaccgagatgaactcagatcatcacagcaaaggaagcgagcagaccactggagccgagaatgaagtcgagaccaacgccctgcctgtcgtatcgaaagagacccaaattatcaccggaagcgacgagagctgcaggaaggacctggttaaaaatgaagagctggagattcaggagaagcaaaaacaatcggacattcgcccttcaccaggggactcttcagtgttgcagcaggagtctaattttctgggcaacaatcatagcgaggagtgtcaggtgggcggtcttgtagccttcgaaccccatgcactagaaggcgagggaccccaaaatcccgaagaaacagacgaaaaggtcgaggaacccgagcagcagaacaaaagcagcgctgtcggacccccggagaaagtaaggcgattcacattggataggcttaaacagctgggggtcgatgtgtcaattaagccgagattaggtgccgatgaggattcctttgtgatcctggaacctgaaaccaatagggaactcgaagccctaaaacagcggttttggaagcacgccaaccccgccgccaagccaagagctggacagaccgttaatgttaatgtcattgttaaggacatgggcaccgatggcaaagaagagctgaaggctgatgtcgtgcccgtaaccctcgcacccaagaaattggatggggcgtcccatacaaagccaggggagaagttgcaagtgctgaaagccaagcttcaggaagcgatgaagctccgcaggttcgaggagcgccagaagcgccaggccctgtttaagttagacaacgaagatggatttgaagaagaagaggaggaagaggaggagatgaccgacgagagcgaggaggatggcgaagaaaaagtggaaaaggaggaaaaggaagaggagctcgaagaagaggaggagaaagaagaggaggaagaagaagaaggtaatcaggagaccgccgaattcctgctctccagcgaagaaatcgaaaccaaggatgagaaggagatggacaaggaaaacaacgacggctcctcagagataggcaaagccgtcggtttcctctcagttccgaagtcgctatcttcagattccacactgcttctttttaaagattcaagcagcaaaatgggttacttccccactgaagagaagtctgaaacagatgagaattcaggcaaacaaccctccaagctggacgaagacgattcctgctctctcctcaccaaagagtccagccacaacagcagtttcgagcttatcggctctaccataccctcttaccagccatgtaacagacagacggggcggggcaccagtttcttccctactgccggaggttttcgatctccgtctcctggactgttccgcgcctccttagtgtcaagcgcgagcaaaagcagcggaaagctgtcagagccctccctgcccattgaggatagccaagatctctataacgcatcaccagagcctaaaactctcttcttaggggccggggacttccaattctgcctggaagacgatacacagagccagctgctggacgctgacggttttctgaacgtgagaaatcatagaaaccaataccaagcacttaaaccgcggcttcccctcgcgagcatggacgaaaatgccatggacgcaaatatggatgagttgcttgacctctgcacaggaaaatttacatcccaggctgaaaaacacctccctagaaaaagcgacaaaaaggagaacatggaagagttgctcaatctttgttccggtaaattcaccagtcaggacgcatccacaccggcctcttctgagctaaacaaacaggaaaaagagtcaagcatgggcgatcctatggaggaagcacttgccctctgttcgggaagctttcctacagataaagaagaggaagacgaggaggaagagtttggggactttaggctggtcagcaatgataacgagtttgattctgacgaggacgaacattcagacagcggtaatgacctggctctcgaggatcacgaggatgatgacgaggaggagttactcaaacgatctgagaagcttaaacgacagatgcgactacgcaagtatctggaagacgaggctgaggtgagtggaagtgacgtggggagcgaagacgagtatgacggggaagagattgacgaatacgaagaggacgtgatcgacgaagtgctaccatcagatgaggaattgcaatcgcaaataaaaaagatccacatgaagactatgctcgatgacgataagcgacagctgcgactctaccaggagcgctatctagctgatggagacctgcactccgatgggccaggtcgtatgaggaaatttaggtggaagaacatcgacgacgctagccaaatggacttatttcatagagatagtgacgacgatcaaaccgaggaacagctcgacgaatctgaagctcgttggaggaaagaacgtatcgaacgcgaacagtggcttagggatatggcacagcaggggaagattacagctgaggaggaagaagagatcggcgaggactctcagtttatgatcctggctaagaaggttacagccaaagcactacagaagaatgcatctcgcccaatggtcatacaggaaagcaaatccttgcttcgaaatccattcgaagctataaggcctggctcagctcagcaagtcaagaccggctccctgctgaaccaaccgaaggcagtcctgcagaaactggcagccctctccgaccataacccgtctgctcctcgcaatagtagaaatttcgtattccatactctatcccccgtcaaagccgaagccgctaaggagagctctaaatcccaagtgaagaagagagggccaagttttatgacctccccttcgcccaagcacctgaaaactgacgactccacgtcaggacttaccaggtcaatttttaagtacctcgagtcatag

SEQ ID NO: 11511 - DNA, 3828 bp, Artificial Sequence
  Description of Artificial Sequence: Synthetic coding sequence
atgacgggggaggtcgggtcagaggtccatctcgaaatcaatgatcctaatgtgatctcccaagaggaagcagacagcccaagtgacagcggtcagggctcgtacgaaaccatcggtcccctgagcgagggagactccgacgaggagatcttcgtctccaagaaacttaagaatcgaaaagtgctgcaggacagtgacagtgagaccgaggatacaaatgcaagccccgaaaagacgacttatgactcagctgaggaggaaaataaggaaaacctatatgccggcaagaacactaaaattaaaagaatctataagaccgttgccgacagcgatgagtcctatatggaaaagagcttataccaagaaaatttggaggctcaggtgaagccctgccttgagctgtctctgcaaagcggcaacagcacagattttaccaccgacagaaaatcaagtaagaagcacatacatgacaaagaaggaacagccggaaaggctaaggtgaaaagtaaaaggcggctagagaaagaggaaaggaaaatggagaaaattagacagctcaaaaagaaagagaccaagaaccaggaggatgacgtagaacagccgtttaatgacagcggttgtctgctcgttgacaaggaccttttcgaaacaggcttggaggacgaaaataacagccccctggaggatgaagagagcctggagtccataagggcggcagttaagaacaaggtaaagaagcataagaaaaaggaaccatctctggagtctggtgtacattcatttgaagaaggttctgaactctcaaagggtaccacgcgcaaggagcgaaaggccgcacgcctgtccaaagaggccttgaaacaacttcacagcgagactcagcggttgatcagggagtctgccctgaatctgccataccatatgccagagaataaaacgattcatgacttttttaagaggaagcctcggcctacctgccacggcaacgcaatggctcttttgaagtccagcaaatatcagtcctctcatcacaaagagataattgatacagccaatacaactgaaatgaacagcgatcaccactctaaggggtccgagcagactaccggcgccgaaaatgaggtcgagactaacgctctaccagtggttagcaaggaaactcagattataacagggtcagatgaatcatgcagaaaagatctcgtcaagaatgaggaactggagatacaagaaaaacagaaacagtctgatattcggccaagcccaggcgactcttctgtgctccaacaggagtcaaacttcttaggaaacaatcactcagaagagtgtcaggttggaggtctagttgctttcgagccgcatgcccttgaaggcgaaggtcctcaaaaccctgaagagaccgatgaaaaagtggaggagccagaacagcagaacaagagtagcgctgtgggcccacctgaaaaagttcgcaggtttactcttgatcggttaaaacaacttggggtggacgtgagcattaaacctcggctgggtgccgacgaagactcttttgtgatcctcgaacctgagacaaaccgcggagagaagctgcaggtgttgaaggccaagctccaggaagccatgaaactccggagattcgaggagagacagaagcgacaggccctgttcaaacttgacaacgaagacgggttcgaggaggaggaggaggaagaggaggaaatgacagatgaatcggaagaagacggtgaggagaaagtcgaaaaggaggagaaagaagaagagttagaggaggaggaagagaaggaagaggaagaggaggaggagggaaaccaagagactgcagagtttctcttgtcttcagaggaaatcgagacgaaagacgagaaggaaatggataaagaaaacaatgacggctctagcgagattggtaaggctgttggatttttgtccgtgcccaagtccttatcctcagattcaaccctgctactgtttaaagactcttcctcaaagatgggctatttcccaaccgaggagaagtctgagacagatgagaactctgggaaacagccgtctaaactcgatgaggatgactcatgtagcttactcaccaaagagtccagtcataatagcagtttcgaactgatcggcagcactatcccttcataccagccctgcaacagacagacaggccgtggcacatcttttttccccactgcaggcggcttccgtagcccctctccgggtctctttcgcgcatctctcgtgtcaagcgccagcaaaagtagtggcaagttgtctgagccttcactgcccattgaagattctcaggacctgtacaacgcctcacccgagcccaaaaccctgttcctgggagccggggactttcagttttgccttgaggacgatactcagtcacaacttttggatgcagatggatttctgaatgtgcgtaaccatcgcaaccagtatcaggccctcaaacctcgtctgccactcgcatcaatggacgaaaacgccatggacgcaaacatggacgaattgctcgacctgtgtacagggaagtttacctcccaggcagagaagcaccttccacggaagagtgacaaaaaagagaacatggaggagctgctgaacctctgttcggggaaattcacctcacaggacgcctccacacctgcatcatcggaactgaacaagcaagaaaaagaatctagcatgggcgaccccatggaggaagcactggctctctgttccggaagttttccaactgacaaagaagaagaggacgaagaagaggaatttggagatttccgcctagtatctaacgataacgagtttgattccgacgaggacgagcatagtgactcaggaaatgaccttgcactcgaggaccacgaggacgatgacgaggaggagctgctcaagcgctctgaaaaattaaaacgacaaatgaggctgaggaagtaccttgaggacgaggcagaggtgtccgggagtgacgtgggcagtgaagatgaatatgatggggaggaaatcgatgaatacgaagaggatgtgattgatgaggtgcttccttctgacgaagagctccagtctcagatcaaaaaaattcatatgaagacaatgctcgatgatgacaaacggcaattacgtctgtaccaggagcgctacctcgccgacggcgatctgcactcagatggacccggaagaatgcgcaaatttcggtggaaaaacatcgatgacgcatcccagatggatctgttccatcgcgattccgacgacgatcaaacagaagaacaactggatgagtcagaggcgcgctggcggaaggagcgaatcgaaagggaacagtggctccgcgacatggcccagcagggaaaaatcaccgctgaggaggaagaagaaattggagaggatagccagttcatgattctggctaagaaagtaaccgctaaggctctccagaaaaatgcatctcgtccaatggtaattcaggagagcaaatcactacttagaaacccttttgaggctataaggcctggcagcgcacagcaagtcaaaaccggatccctgctcaatcagcccaaggccgtgttgcagaagctggctgccctgtctgaccacaacccaagtgcgcctcgaaattctagaaattttgtatttcatactctcagccccgtgaaggctgaggccgctaaagagagtagtaagtcccaagtcaagaagcgtggcccttcttttatgacgtcacccagccccaagcacttgaagactgatgatagcaccagcggtttaacgagatccattttcaagtacctcgagtcatag

SEQ ID NO: 11512 - DNA, 1977 bp, Artificial Sequence
  Description of Artificial Sequence: Synthetic coding sequence
atgacaggcgaggtgggatccgaggttcacctagagatcaacgatccaaacgtgataagccaggaggaggccgacagtcccagcgactctggccagggaagctacgaaacaattgggcccctgagtgaaggagacagtgacgaggagatctttgtgagtaaaaagctcaagaatcggaaggtcctccaggatagcgactccgaaactgaggacaccaacgcttcccccgagaaaactacctatgacagcgctgaagaagagaataaagagaacctatacgcaggcaagaacacaaagataaagcggatttacaaaaccgtagcggacagtgatgaaagttatatggaaaagagtctttatcaggaaaatttggaggcccaggttaaaccttgtcttgagcttagccttcagagtggcaactccaccgactttacgacagacaggaaatcttctaagaagcacattcacgataaggaagggaccgctgggaaggcgaaagtcaaatcaaagaggagactggaaaaagaggaaagaaaaatggaaaaaatccggcagctcaagaaaaaagagacgaagaaccaggaggacgacgtggagcaacccttcaacgactcgggttgtcttctggtggataaggatctatttgaaaccgggctcgaggatgagaacaattccccactggaggatgaggagtccctggaatccattcgagcggccgtgaagaacaaggtgaaaaagcacaaaaaaaaggaaccctctctagaatccggagtgcactctttcgaagaagggagtgagctatccaaaggaacaaccagaaaggagagaaaagcagcccgcctctctaaagaagccctcaaacagttgcacagcgagacacagcgtctgatccgcgagagtgctctcaatctgccgtaccacatgccagaaaataaaacaattcatgatttctttaaacggaaacctagacccacctgccacggtaatgcgatggcactgctgaagtccagtaagtaccagtctagccatcataaggaaatcatcgacacggctaacaccaccgagatgaatagcgatcaccattctaaaggctcggaacagaccacgggagccgagaacgaagtcgaaacaaatgcccttcctgttgtctccaaggagacacaaattattacaggaagtgatgagagttgccggaaggatctggtcaagaacgaagaactggaaattcaggaaaagcagaagcagtccgatatcaggccttcccctggggattcaagcgtgcttcagcaagagtcaaatttcctgggtaacaaccattcagaagaatgtcaagtgggtggcctggtcgcctttgaaccccatgccctggagggggagggaccccagaatccagaagaaaccgacgaaaaagtcgaagaaccagagcagcagaacaagagttctgccgtgggccctccagaaaaggtacgtaggtttacgttggataggctaaagcaattgggggttgatgtttctatcaaacctcgcctcggcgccgacgaggattcttttgtcatactagagcctgagacaaaccgtgaattagaggctctgaagcaacggttttggaagcatgcaaatcctgccgccaagcctcgggccggtcaaacagtgaatgtcaatgtgatagtgaaagacatgggaaccgatggcaaagaagagctaaaggcagatgtagtcccagtcacactcgctccgaagaagctcgatggcgcgtcccacacaaagcctggggagaagttacaggtactcaaggccaaattacaggaagccatgaagcttagacgtttcgaggaacgtcaaaagcgacaggccctgttcaagctggacaatgaggacgggttcgaagaggaagaggaagaagaggaagaaatgaccgacgagtccgaagaagacggagaggagaagaaaaagaagaagaaaaagaagaaaaattag

SEQ ID NO: 11513 - DNA, 3393 bp, Artificial Sequence
  Description of Artificial Sequence: Synthetic coding sequence
atgaggtgtctggccccccggccagcgggtagctatctttcagagccccagggaagcagccagtgcgccacaatggagttaggacccctcgagggtgggtatctggagctacttaatagcgacgcagacccgctctgtttgtatcatttttacgaccagatggacctggctggcgaagaagaaattgaactgtattccgaacctgacactgatacaattaactgcgaccaattctctcgtctgctgtgcgatatggagggggatgaagaaaccagagaagcatacgccaacatcgcggagctggatcaatacgtgtttcaggacagccaattagaagggttgtcaaaggacatcttcaagcatatcgggccagatgaagtgattggagagagcatggagatgccggctgaagtcggccaaaaatcccagaagcgcccattcccagaggagcttcccgcagacctgaagcattggaagccagctgagccaccaaccgtcgtgacaggcagtctactggtgcggcccgtgtccgattgttcgacccttccttgtcttccactgccagctctatttaaccaggagcccgcttcaggccagatgagactggagaagacagaccagatccctatgcctttttccagctcctccctgtcttgcctgaatctgcccgagggtcccatccagttcgtcccaacaatatcaacactgccgcacggcctgtggcagatctccgaggccgggacaggcgtcagttctatttttatataccatggcgaggtcccccaagcctcccaagtgcctccaccatcagggtttacagtgcacgggttgcctactagccctgaccggccaggaagtacgtccccattcgctccatccgctacagatctaccttccatgcctgagcccgccctgacctcaagagcgaacatgactgagcacaaaaccagtccaacacagtgccctgcggctggcgaggtatctaacaagctgccgaagtggccagagcctgtggagcagttttaccggtcacttcaggatacctacggcgctgagccagccggcccagacgggatcctcgttgaggtggatcttgttcaggcccgcttggagagatcatcatctaaatcactcgagagagagcttgctaccccagactgggccgaacgtcaactcgctcaaggtgggctggccgaggttcttctagcggctaaagagcaccgacgcccccgtgagacgagggtcatagccgttctcgggaaagcaggacagggaaagagctactgggctggcgcggtctctagggcctgggcatgcggtaggttgccccaatacgatttcgtgttttctgtgccttgtcattgtcttaatcgacccggcgacgcttatggcctgcaggatttgctcttctccttggggcctcagccccttgtggcagcagacgaagtgttcagccacatccttaaaaggccagatagggtcctcctcattctcgatggattcgaggaactggaagcacaggacgggttcctccacagcacctgcggaccagcccccgctgagccctgctccctgcgtgggctgctggccgggctgtttcagaagaagctgctgagggggtgtacgttacttctgactgcacgcccaaggggacgcctggtgcagtcactcagcaaggctgatgcgctctttgagctctccggtttttcaatggaacaagcccaggcgtatgtgatgcgctatttcgagtcgtcaggaatgaccgagcatcaggaccgggccctaaccctcctgagagatcgcccgcttttactctcgcactctcacagtcctaccctttgccgagcagtctgtcagctgtcagaggcactcctggaattaggtgaagatgccaaactcccatctactctgacagggttatacgtcggcttgctaggtagagcggcactcgatagtcctcccggcgccttggccgaactcgccaagcttgcgtgggagttaggacgccggcaccagagcacactgcaggaggatcagttccccagcgcagatgtccgaacatgggccatggccaaaggcctcgttcagcaccctccacgagctgctgaaagcgaactagcttttccatcattcctgttacagtgttttctgggagctctgtggttggccttgtccggagagatcaaagataaagaactgccccagtatttggccctgacccccaggaaaaagagaccctatgacaattggttggagggggttcctcgatttctagctggcctgatattccagcccccagctaggtgcttaggggccctgctaggaccgtccgcggccgctagcgtggatcgcaagcagaaggtgttggctcgttacttaaagagacttcagcctggtacacttagagcacggcagttgcttgagctcctccattgcgctcacgaggccgaggaggccgggatttggcagcacgtggtccaggagctcccaggaagacttagcttcctgggcacgcgcttgaccccaccagatgcccacgtcctggggaaagcacttgaggcggccggtcaggacttttccctcgacctgcgttccactggcatctgcccttccggtttaggctcgctggtaggattaagctgcgtgactaggttccgagccgcgctctctgacacggtggccctgtgggagagcctccagcagcatggggagaccaaacttctccaggcagccgaagagaagttcaccattgagccatttaaggccaaatcgttgaaggacgtagaagatttgggaaagctggtgcagactcagaggacccgatcttcaagcgaagacaccgctggggagcttcctgccgtgagggatctgaaaaaactcgagttcgccctgggcccagtgtctggacctcaggccttccccaagttggttcggatcctcactgcctttagtagcttacagcatctggacttggatgctctcagcgagaacaagataggtgacgaaggggtctcacagctctctgcgaccttccctcagctgaagagtctggaaacactcaaccttagccagaacaacataaccgatctgggggcgtataagcttgcagaagctctgccctctctggctgctagcctcttgcgactttccctctataataactgcatatgcgacgtgggggccgaaagtctggccagggtgcttcctgatatggtctcgctcagggtgatggacgtgcagtataacaaatttactgctgcgggagcgcagcagctcgctgcctctctgcgacggtgcccccacgtggagacacttgcaatgtggactccgactataccattctccgtgcaggaacatctgcagcaacaggattctcggatctcgcttcgatag

SEQ ID NO: 11514 - DNA, 1641 bp, Artificial Sequence
  Description of Artificial Sequence: Synthetic coding sequence
atgcgctgcctggcccccagaccagccggatcctatctctcggaacctcagggatcttcgcagtgcgcaactatggagttaggtccactcgaaggtgggtatttggaattattgaacagcgatgcagatccgctgtgtctgtaccacttctatgaccagatggacctggccggagaggaagagatcgagctctattcagagcccgacactgataccatcaattgtgatcagttcagccggttattgtgcgacatggagggcgatgaagagactagagaagcctacgccaacattgcggagctggatcagtatgtgttccaggattctcagctggaggggttaagtaaagacatattcaagcacataggccccgacgaggtcatcggcgagtcaatggaaatgcctgccgaggtcggtcagaagtctcagaaacggccttttcctgaggagctcccagccgacttgaaacattggaagcccgtccctttttcaagctcatcactctcttgtctgaacctgccagagggcccaatccaattcgtgcctaccatctcaacacttccacatggcctgtggcaaatttcagaggcaggaacgggcgtgagcagcatcttcatataccatggcgaggtcccccaagccagtcaagttccaccaccctcagggttcacagtgcacggactacccacttctcctgaccgccccggtagtacatccccatttgctccttcagctaccgatctgccctctatgcccgagcccgccttaaccagtcgcgctaacatgaccgagcacaaaacaagccctacacaatgcccagcagctggggaggtctccaataaactgcccaagtggcctggactggcctggtccccttgtcttggactcagaccgagcctgcaccgagcagcactgagcgacactgtagctttatgggagagcctacagcagcacggggaaactaagctgctacaagctgccgaagagaaattcacaatcgaaccttttaaagctaagtcactcaaagatgttgaagatttggggaagcttgttcagactcagaggacccgaagcagttccgaagatacagcaggggaactgccagcagttagagatctgaagaaactggagtttgctctggggcccgtttccggcccccaggcattcccaaagctcgtgcgcatcctaacggctttttctagcttgcagcatctagacctcgacgctctgtcggaaaacaaaatcggcgacgagggcgtgtcccaactgtccgcaacctttcctcagcttaaatccttagaaacgctgaatctatctcagaataacatcactgatctgggagcctataaactggctgaagctctaccctcactggctgccagcttgctccgattatcactctataacaactgcatttgcgatgttggcgccgagtctctggctcgtgtgctgcccgacatggtgtcactgagggtcatggatgtgcagtacaacaaattcacagcagctggcgcacaacaattggccgcttcgcttcgccgatgcccccacgtggagactcttgctatgtggactcctactattccattttcagttcaggagcatctgcagcagcaggattcccgaatctcactgagatag

SEQ ID NO: 11515 - DNA, 2655 bp, Artificial Sequence
  Description of Artificial Sequence: Synthetic coding sequence
atgcgatgtctcgcccccagacccgccgggtcctacctgagcgagcctcagggcagctcacagtgtgcaactatggagctggggccattggaaggaggttacctcgagctgctgaactctgacgcggatcccttgtgcttataccacttttacgaccagatggatctcgcaggagaggaggagatcgaactgtactccgagcctgacaccgataccattaactgcgatcagttttccagactgttgtgcgacatggaaggtgacgaagagaccagagaggcttacgccaacatcgctgagctggaccaatatgttttccaagacagtcaactcgagggactttcgaaggacatcttcatcgaacacataggccctgacgaggtcatcggggagtcgatggagatgcctgccgaggttggccagaagagtcaaaagcggccattccctgaagagctgcctgccgaccttaagcattggaagccagtgccattttcctcctctagcctgtcatgtctcaacctacctgaaggccctatccaattcgttccgaccatcagcacccttcctcacgggctctggcagatttcagaggccggaacgggagtgtcaagtatctttatttatcacggggaggtgcctcaagcaagtcaagtgcctccgccgtccggctttaccgtgcatggactgccgaccagccctgacaggcccggaagcacgtccccttttgccccatcagccacagatctgcctagtatgcctgagcctgctctcacatcacgggcaaacatgacagagcataagacatcaccaacgcagtgcccagcagcgggtgaggtgtcaaataagctgcccaaatggccagagccggtagagcagttctatcggtcattgcaggacacctacggggccgaacccgctggtcctgatgggattttggtagaggtggacctggttcaggcccgtctggagagatcttcgagcaaatcactggagagagaactagccacccctgattgggccgagcggcagctggcacagggcggtctagctgaagtactgctagctgccaaggagcaccgccggccacgagaaacgcgggtcatcgctgtgttgggaaaagctggacagggtaaatcctactgggcaggtgccgtgtcacgcgcatgggcttgcgggagattgccgcaatatgactttgtgtttagcgtcccatgccactgcctcaaccgtcctggcgatgcatacggactgcaggacctcttgttctcactcgggccacagcccttagtcgctgccgacgaagtattttcgcatattctgaagcgccccgacagagtgctgctcattctcgatggttttgaagaactggaagcgcaggatgggttcctgcacagtacgtgtggacccgcccctgctgaaccctgcagcctgcgcggcttacttgcgggcctgttccagaagaagctgttacgcgggtgtacgctgctcctgacggcccgccccaggggacgcctcgtgcaatcccttagcaaagccgacgcacttttcgaactgagtggattttctatggagcaagcccaggcctacgtcatgcgttactttgaatccagcggtatgacagaacatcaggatagagcccttacattgttgcgcgaccgaccactgctgctgagccatagtcacagcccaacactgtgccgagccgtttgccaactgtctgaggctctgctggagctgggcgaagatgctaaactgccaagcacactcactggcctatacgtgggcctcttgggaagggcggcccttgatagcccgccaggagcattagcagaacttgccaaattagcttgggagcttggacgacggcatcaatccacactccaggaggaccagttcccgagtgctgacgtgagaacttgggctatggccaagggccttgttcagcatccccccagagctgctgaatccgagttagcctttccttcttttctgctgcaatgtttcctgggagccctatggctcgctctatccggagaaattaaagacaaagagctgccccaatacctggcactgaccccccggaaaaaacggccatacgataattggctcgagggggtcccccgattcctggccggcctgattttccagcctcccgcccgatgcctgggagcccttctcggccctagcgccgcggcttcggtggatcggaaacaaaaggttttagctagatacttgaagcgtctccagcccggcacgctgagagcacggcaactactggagctgctgcactgtgcacacgaggctgaagaggctggtatctggcagcacgtagtgcaggagctgcccggaaggttatcttttttgggcacaagactcacgccaccagatgcacacgttctcggtaaagccctcgaagctgcagggcaggacttctccttggacttacgctctaccggcatctgccccagcggacttggatccctggtcggactttcctgtgttacaagattccgttggggagaaggcctgggaagagatattctggtgttagggattaactgcggcctcggagcaaaaccctctgccctttggggatcattttcaatgcagtcttccagagttggtcaaaacgggttctcaccattcctgaggtag

SEQ ID NO: 11516 - DNA, 1062 bp, Artificial Sequence
  Description of Artificial Sequence: Synthetic coding sequence
atgaggtgcctggctccccgccccgcaggctcttacctatccgagccacagggaagctcccagtgcgctactatggagctgggtcctttggagggagggtacctagagttgctcaattcagatgccgaccctctttgcctctatcacttttacgaccagatggatctcgccggagaggaggagatcgaactgtactccgagcctgatactgacaccatcaattgcgaccaattttcgaggcttttgtgtgatatggaaggcgacgaggaaaccagagaagcctacgcgaacattgccgagctggaccaatacgtgtttcaggactcccagctggaaggtctgagcaaagacatttttaaacatataggtccagacgaggttattggtgagtctatggagatgcccgctgaggtgggacaaaagtcacagaagaggccatttcctgaggagctgcctgcagacttaaagcactggaagccagcagagccccccaccgtggttacggggtccctcctggtgcgccctgtgtcagactgcagcacactcccatgcctgcctttaccagccttgttcaatcaagaacccgctagcggccaaatgagactggaaaagacggaccagatccctatgccattttcttctagttcattgtcctgcttgaatttgccagaaggacctatacagtttgtgccaactatatccacactgccccatggcctttggcagatctcagaagccgggacaggagtgagttcaatatttatctatcatggtgaagttcctcaagccagccaggttccacccccgtctggctttactgtgcacggactgccaactagccctgatcgcccaggttctactagccctttcgctccttccgccacagatctgccatcgatgccggagcctgcgctgactagcagagctaatatgacggaacataagacctcacctacacagtgccctgcagccggggaggtgagtaacaaactgcctaagtggcctggaagagaagtcccgcggaaaactcaactggggtccagtctgctgtttggaacatag

SEQ ID NO: 11517 - DNA, 4332 bp, Artificial Sequence
  Description of Artificial Sequence: Synthetic coding sequence
atgtacgcggtgtacaaacaagcccatccaccaacaggcctcgaatttagtatgtactgcaactttttcaacaactctgaacgcaacctagtggtggccggtacatctcaactctacgtgtacagactgaatcgggatgctgaggctctcaccaagaacgaccgcagtaccgaaggcaaggcccacagagagaagcttgagctggctgcgagcttttcattcttcggaaatgtgatgagcatggccagcgtgcagttagccggagcaaagcgcgatgccctcctgctctctttcaaagacgccaagctcagcgtagtggagtacgaccctggaacccacgaccttaagactctcagcctgcactattttgaggagccggaattgcgggatggcttcgtgcagaatgtccacactcccagggttcgcgttgatccagatgggcggtgcgcagcaatgcttgtttacggtacaaggctggtagtcctcccctttcgacgggaatctttggccgaagaacacgaagggctcgtcggggagggtcagaggtcttcctttcttccaagctacatcatcgatgttcgcgcattagacgagaagctgctcaacattatcgatctacagttcctccatggttattatgaacctacactgcttatcctattcgagcccaatcaaacatggccaggtcgggtcgccgttcgccaggacacatgtagcattgttgcaatctctctgaacataacacagaaagtgcaccccgtgatctggagcctgacttcactcccgttcgactgtacccaggcactggccgtccccaagccaatcggcggagtggtcgtgtttgctgtcaattctctcctctacctaaatcagtcggttcccccatacggggttgcactcaattctctgacaactgggacgactgcctttcccctgaggacgcaggaaggcgtaaggattacactggactgcgctcaggccacttttatctcttacgacaagatggttattagcctgaaaggaggcgaaatttatgtgctcactctcattaccgacggaatgcgttctgtccgtgctttccatttcgacaaggcggcagccagcgtgctcaccacaagcatggtcactatggagcctggctacctcttcctgggaagccggctgggcaacagcctgttgcttaagtacacggagaagcttcaggaaccccccgcttccgccgtccgtgaagcggctgacaaagaagagcctcccagcaagaaaaagcgcgtggacgcaacagccggttggtctgctgctggtaaaagcgtaccccaggacgaggtcgatgagatagaggtctacggcagcgaggctcagtcaggcacccagctagcgacatatagttttgaggtgtgtgatagcattctgaacattggtccttgcgctaacgctgccgtgggggagccagccttcctgagcgaagagttccagaacagcccagagccagacttggagatcgtagtgtgcagtggacatgggaagaacggggccttatcggtgctacaaaagtcaattagaccccaagttgtcacaacattcgagctaccagggtgctatgatatgtggacagtcatcgcccctgtaagaaaagaagaagaagataatcctaaaggcgagggcactgaacaggagccatccaccacacctgaagctgatgatgatggcagacggcatggcttcctgatcctgtccagagaagactcgaccatgatcctccagaccgggcaggaaattatggaacttgacacaagtgggtttgccacgcagggccccacggtgttcgctggaaatataggtgataatagatacattgttcaggtgtctcccctcggtatccgcctgcttgagggtgttaatcaactgcactttatcccagttgatctgggcgccccgatcgtgcagtgtgcagttgctgacccctacgttgtgataatgtcagctgaaggtcatgtcacgatgttcttactgaagagcgattcatacggggggaggcaccacagactagccctccataaaccaccgttacatcaccagtctaaagtcattacattgtgtttgtatcgtgacctttcaggcatgtttactactgagagccgactcggcggcgcccgggatgagctgggaggacggagcggacccgaagcagagggcttgggcagtgagactagtcccactgtggatgacgaggaggaaatgctttacggggattctggatcactgttttccccttctaaagaggaggccagaagatccagccagccaccagccgatagagatcccgcccccttccgcgcggagcccacacactggtgcctattggtccgggaaaacggcacaatggaaatttatcagctaccagattggcgcctcgtgtttctggtaaagaattttcctgtgggccagagagtgctcgttgattcatcattcggccagccaaccacacaaggggaggcccggcgcgaagaagccactcgccagggtgaacttcctctggtgaaggaggtgctattggtggccttgggctctagacagtctcggccgtacctccttgtccacgttgaccaggaactcctcatctatgaagcctttccacatgattcacaactgggccagggcaatttaaaggtgaggttcaaaaaggttcctcacaatattaactttagggaaaaaaaacccaaaccgtccaaaaagaaggccgagggaggtggagctgaagagggagctggagctcgaggtcgagtcgctagatttagatattttgaagacatctatggatatagcggagtatttatctgcggaccttctccccactggctcttggttaccggccgtggagcgctcaggttgcacccaatggcaatcgatggccccgtagatagcttcgctcctttccataacgtgaattgtcctcgtggctttttgtatttcaacaggcaaggcgagctaagaatttccgttctcccagcatacctgagctatgacgccccctggcccgtgcgtaagatacccttgagatgcaccgcccattatgtagcttaccacgtcgagtcaaaggtgtatgccgtagccacgtccacaaataccccatgcgcccgaattccacgcatgaccggcgaggagaaggagtttgagacaattgaaagggatgaaagatacatccacccccaacaggaagccttctccatccagctcatcagtcctgtaagttgggaagctatccctaatgctcgtattgagctgcaagagtgggaacacgtgacgtgtatgaagactgttagtttgagaagcgaagaaactgtgtctggacttaagggatacgtggccgctggaacgtgcctaatgcagggtgaggaggttacgtgtcgcggacgcatcctcatcatggacgtcattgaggtggtcccggagcccggccaaccgctcacaaaaaataaattcaaagtattgtacgagaaagaacagaaaggaccggttaccgccctctgtcattgtaacgggcatcttgtgtctgctattggtcaaaagatcttcctgtggagtctgcgcgcttctgagctcactggtatggccttcattgatacacaactctacattcatcagatgattagtgtgaagaactttattctcgcagccgacgttatgaaatctatttccctgctccgataccaggaggaatcaaaaacactgagtctcgtctcacgcgatgctaaaccactggaggtttactctgttgattttatggtcgacaacgctcaactgggcttcctggtgtctgaccgggaccgaaacctgatggtgtacatgtacctgcctgaggctaaggaaagctttggggggatgcgcctgcttcggagagccgatttccatgtgggcgcacatgttaacacattttggagaacaccctgcagaggggctacagaaggactgagtaaaaagagcgtcgtgtgggagaataagcacattacgtggtttgccactctcgatggaggcattgggctgttgctccccatgcaagaaaaaacataccggcgcctgctgatgctgcagaatgccctcaccaccatgctccctcaccatgcaggcctgaacccccgagcatttcggatgctccatgtcgaccgcagaactcttcagaatgctgtgcgaaacgtgctggatggcgagctcttgaatcgctacctgtacttaagcaccatggagagatcggagctggcaaaaaagattggaacgaccccagacattatccttgacgatctgctagaaactgatcgagtgacagctcacttctag

SEQ ID NO: 11518 - DNA, 2349 bp, Artificial Sequence
  Description of Artificial Sequence: Synthetic coding sequence
atgacatctataataaagctaacaactctcagcggcgtgcaggaggagagtgcattatgctatttgctgcaggttgatgagttccggttcctcctggattgcgggtgggacgagcacttttccatggatatcatagactcattgcgaaagcatgtgcatcagatcgacgctgtattgctttctcaccctgaccccctgcacctcggagcgctcccatatgcagtcggaaagcttggccttaattgtgccatatatgcaactattcctgtttacaaaatgggtcagatgtttatgtatgatctctaccaatcaaggcacaatacagaggattttaccttgttcaccctcgatgacgtagacgcagctttcgacaaaatccagcagttaaaattcagtcagatcgtaaaccttaaaggaaagggccatggcttgtctatcactcctctcccagcgggacacatgattggtgggacaatctggaagattgtcaaggatggtgaagaggagattgtgtatgcagtggattttaatcacaaacgggaaattcatcttaacggatgtagcctcgaaatgctgtccaggccgtctcttctgatcaccgattcttttaatgctacttacgtgcagccacggcgcaaacagcgagacgagcagctgctgaccaacgttctcgaaacactgcggggagatgggaacgtgctgatcgccgtggacactgccggaagggtgctcgaattggcccaactgctggatcagatctggagaaccaaagatgcaggcctgggagtttactcactcgcacttctgaataacgtgtcctataatgtagtggagttttccaagtctcaagtggagtggatgtctgacaaattgatgagatgctttgaggataaacggaacaaccccttccaattccggcacctgtcgctctgtcacggcttaagcgacctggcccgggtgcctagcccaaaagtggttcttgcctcccagcccgacctggaatgcggcttcagcagggacctgtttattcagtggtgccaggacccaaagaatagcatcatcctgacctaccgcaccacccctgggactctggcaaggttcttgatcgacaatcctagtgaaaaaattacggaaatcgagctcagaaaacgcgtcaaacttgagggcaaagagctcgaggagtacctagagaaagaaaagctcaagaaagaggctgcaaagaagctggaacagtctaaggaagccgacatcgattcttcagacgaaagtgatattgaagaagatattgatcagccgtcggctcacaagacaaaacatgacctgatgatgaaaggtgaggggagtagaaaggggtcatttttcaagcaggccaagaagtcttaccccatgttcccagcccctgaggaacgaatcaagtgggacgagtatggcgagatcatcaagcctgaagactttctcgtgcccgaactccaggcaaccgaagaagaaaagtctaaactcgaaagcgggctgacgaacggcgacgagccaatggaccaggatctgagtgatgtgcctactaaatgcatctcaacaacggaaagtatcgagattaaggctagggttacctacatcgattatgagggacgatctgacggggactcaattaaaaagattattaaccagatgaaacccaggcagctgattatcgtgcacggaccacctgaagcttcccaggacctagccgaatgctgtcgagcttttgggggtaaggacatcaaggtgtatatgcctaagctgcatgaaacagtggacgcgactagtgaaactcacatctaccaggtcagactgaaagattctctggtgagctcactgcaattctgcaaagccaaggatgccgaactggcttggatcgacggtgtgttggacatgagagtttcgaaagtggacacaggagtcatcctcgaagagggtgagcttaaggatgacggagaagattccgagatgcaagtcgaggccccaagtgactcgagtgtgattgctcaacagaaggcaatgaagtcattatttggggacgatgagaaagaaaccggagaagagtcggaaatcatcccgactctggaaccgttaccgccacacgaggtgccgggccaccagagcgtgtttatgaatgagcctaggctctctgacttcaaacaagttctgctgagggaggggatacaggccgaattcgtggggggtgtgctggtctgcaacaatcaggttgcagtgcgtcgcacggaaaccggcaggatcgggctcgaaggctgcctgtgccaggatttctataggatcagagacctgctgtacgaacagtatgccatagtgtag

SEQ ID NO: 11519 - DNA, 243 bp, Artificial Sequence
  Description of Artificial Sequence: Synthetic coding sequence
atgaccagcatcatcaaacttacaactctgtcaggggtccaggaagaatctgccttatgctacctacttcaggtggatgaattcaggttcctccttgactgtggctgggatgagcacttctcaatggatattatcgattccctccggaaacacgtacatcaaatcgacgccgttttactgtctcaccctgacccattgcacctcggcgccctgccatacgcggtcgggaaactcggcctgtag

SEQ ID NO: 11520 - DNA, 2055 bp, Artificial Sequence
  Description of Artificial Sequence: Synthetic coding sequence
atgagcgcaattcccgcagaagaatccgatcagctactgattcggccactgggcgcaggtcaggaggtgggacggagctgcatcatccttgaatttaagggccggaaaattatgctcgactgcggtatccaccccgggttagaaggaatggacgccctcccctatatagatctgattgatcctgccgaaatagacctgcttctcatcagccattttcacctggatcattgcggagccctcccatggttcttacagaaaaccagctttaagggacggacctttatgactcatgccactaaggctatttatcggtggttgttgtccgactatgttaaggtctccaatatctcagctgacgatatgctgtacacggagaccgatctggaagaaagcatggacaaaatcgaaaccatcaactttcacgaggtgaaggaagtggctgggatcaagttctggtgctatcacgcgggtcacgtcttaggcgccgccatgtttatgattgagatcgccggggtgaaactactgtacactggtgacttctcccgccaggaagacaggcatctgatggcagccgaaatccctaatattaagcctgatatcctgattattgagtctacctacggtacacatatccacgagaagcgggaagaacgagaggccaggttctgcaataccgtgcacgacattgtaaatcgcggcggccgaggactgatccctgtgtttgccctgggaagggctcaggaactcctgctcatcttagatgaatattggcagaaccatccagagttgcacgatattccaatttactacgcatcatccttagccaagaagtgcatggcggtataccaaacctacgttaacgctatgaacgacaaaattaggaagcagattaacattaacaacccttttgtgttcaaacacatctcgaatctaaaaagcatggatcactttgacgacatcggcccaagcgtggtgatggcgtctcctggcatgatgcaatcaggactttccagagaactcttcgagtcctggtgcacagataaacggaacggggtcattattgcagggtactgtgtggaggggaccctagccaagcatataatgagtgagccggaagaaatcacgaccatgagcggacagaaactccctctcaagatgtcagtggactatatctctttcagcgcccatacagattatcagcagacaagcgagttcattcgcgcattaaagccacctcacgtgatactcgttcatggggagcaaaacgagatggccaggctcaaggccgcactgatacgggagtacgaggataacgacgaggttcacatcgaggttcacaaccccagaaacacagaggcagtgacactgaactttcggggagaaaaactggccaaggtcatgggcttcctggccgataaaaagccggagcaaggccaacgcgtgtctggaattttagtgaaacgaaacttcaactatcacatcctcagcccctgtgacctgagcaactatactgacctggccatgtccaccgtaaagcagacacaggccataccctatacagggcccttcaacttgctgtgttaccaactccagaaactgactggagacgttgaggaactggagatacaggagaaaccagccttgaaggtgtttaagaacattaccgtcatccaggaaccggggatggtcgtgttggagtggctggctaaccccagtaacgatatgtatgcagataccgtgaccacagtgatattggaagtgcagtctaatcccaagattcgtaagggagctgtacagaaggtgtctaagaaactggaaatgcacgtgtactcaaagagactggaaattatgctccaagatatcttcggcgaagactgtgtttctgtaaaggacgatagtattttgtccgtgactgtggacggcaaaaccgcaaacttgaatctggaaacgagaaccgtggaatgtgaggagggatcggaagacgacgaaagcctgcgggaaatggtggaactcgctgcacaaagactatacgaagccttaactcccgtccactag

SEQ ID NO: 11521 - DNA, 1641 bp, Artificial Sequence
  Description of Artificial Sequence: Synthetic coding sequence
atgtcagctattcctgcagaagaaagcgaccagttgctgattaggcccctgggggccgggcaggaggtgggcagaagttgtatcattctggagtttaaagggcgcaaaattatgttggattgtggtatccatccagggctcgaaggcatggacgctctcccttatatagatttgattgaccccgcagagatcgatctcttgctgatcagtcattttcacctcgatcactgcggagccttgccctggtttttgcagaagaccagtttcaaagggagaacattcatgactcacgcaaccaaagccatctacaggtggttgctttctgactatgtgaaagtgtccaacataagtgcagacgatatgctgtacacagagacagatcttgaagaatccatggacaagattgaaacaatcaacttccacgaggtgaaggaagtggctggcatcaaattttggtgctaccatgctggacacgtattaggcgccgctatgtttatgatcgaaatagccggggtaaaactgttgtacactggggatttctctaggcaggaggacagacacttgatggcagctgagataccaaacatcaagccagacattcttattatagaaagcacctatggaacgcatatccacgagaaaagggaggagagagaggctagattctgcaatactgtacatgatatcgtgaaccgagggggccgaggtttaatcccagttttcgccttgggcagggcacaagagctgcttctgatccttgacgagtactggcagaatcaccccgagctgcacgatatcccaatctattacgcctcctctctggccaagaagtgcatggctgtttaccaaacctacgtgaatgccatgaatgacaagatccgtaaacagatcaatattaacaaccctttcgttttcaaacacatctctaaccttaagtctatggaccatttcgacgatatcggtccttctgtcgtgatggcctctcccggaatgatgcagtcaggactctctcgtgaactgtttgaatcctggtgtacggacaagcggaacggcgtgatcattgcaggatattgtgtggaaggcaccctggccaagattttagttcacggcgagcaaaatgagatggcccgactgaaagccgcccttattcgggagtacgaagataacgatgaggtgcacattgaagtgcacaacccgagaaatacagaggccgtgaccctgaatttcagaggggagaaactggccaaagttatggggtttctggccgacaaaaagccagaacagggccagcgagtgtcgggaatcttggtcaaacggaactttaattaccacattttatcaccttgcgacctgtctaactatacggacctggctatgagtacggtgaaacagactcaggccatcccgtatacgggcccatttaacttgttatgctaccagttgcagaagcttactggggacgtcgaggagctcgagatccaagaaaagcctgcactaaaagtattcaagaacataactgtgatacaagagcctggtatggtggtcctggagtggctggctaaccccagtaacgacatgtatgccgacacagtgaccaccgttatactcgaggtgcagagcaatccaaagatccggaagtag

SEQ ID NO: 11522 - DNA, 1221 bp, Artificial Sequence
  Description of Artificial Sequence: Synthetic coding sequence
atggccgtctaccaaacttatgttaacgcaatgaatgacaaaatcagaaagcaaattaatataaataacccattcgtgttcaaacacattagcaacctgaagtcaatggaccattttgacgacattgggcccagcgtggtcatggcatctcctggtatgatgcagagcgggctcagtcgagagctgtttgagagctggtgcaccgacaagcgcaacggcgtgattatcgccgggtactgcgttgagggcactctcgccaagcacattatgagcgagccggaggagataacaactatgagcggacagaagttgccactaaagatgtcagtcgattatatatccttctccgcccataccgattatcagcaaacaagcgagtttattcgagccctaaagcctccccacgtgattctggtgcatggtgagcaaaacgaaatggcccgactgaaggcggccctgatccgtgaatatgaggacaacgacgaagtgcatatagaagtacataatccgaggaatactgaggctgttaccttaaatttcaggggagagaagttagccaaagtgatgggattcctggccgataagaaaccggaacagggtcagagggtgtccggcatcctggtgaaaaggaactttaactaccacatactgtccccgtgtgatttatctaattatactgatttagcgatgagcacagtgaagcaaacacaggccatcccatatacagggccatttaacctgctctgttaccagctccagaaattgaccggcgatgtggaagaactggaaattcaggagaagcctgccttaaaggtgttcaaaaatatcactgtgattcaagaacccggcatggtcgtgctcgagtggcttgctaaccccagcaacgacatgtatgcagatactgtgactaccgtaattctagaggttcagtcaaaccccaagattcgcaaaggcgccgtgcagaaggtaagcaaaaagctggagatgcatgtgtactcaaaaagacttgaaatcatgctacaggatatatttggagaggattgcgtcagcgtaaaagacgattcaattctaagcgtgactgtagacggcaagactgcaaacctcaatctcgaaaccagaacagtggaatgtgaagagggctcagaagacgatgagtctcttagggagatggtggagctcgccgcacagagactatatgaagcgctcactcccgtgcactag

SEQ ID NO: 11523 - DNA, 1545 bp, Artificial Sequence
  Description of Artificial Sequence: Synthetic coding sequence
atgggtcgacccgaaagtgcggggggaggaagtagaggcccattcgaaggaggagggcgtgccagacgagcaggtgggatttttctcactctgagtattttgcggacccgagacctgccatcaggggcaatgtcggagggggtcgatctgatcgacatctacgccgatgaggaattcaaccaagatcccgagttcaataatacagaccagatagacctgtacgacgacgtgcttacagccacttcacaaccaagcgacgacaggtccagcagcactgagcctccgcctcctgtccggcaggagccctcccctaaacccaataataagacgcccgcgattctgtatacctacagtggacttaggaaccggagagcagctgtttacgtcgggagcttttcatggtggaccaccgaccagcaacttatccaagtgatcaggtcaattggagtttacgacgttgtggagttgaaattcgctgaaaacagggctaacggacagtctaaagggtacgctgaagtggtcgtagcatccgagaacagcgttcataagctactagaactactgcccggcaaggtactgaacggcgagaaggtagatgttagaccggccacaagacagaatctgtctcagttcgaggcccaagcacgtaagcgggaatgtgtcagagtgcccagaggcggtatacctccacgtgcccactcaagagattcctccgattccgcagatggcagggctacgccctctgagaacctggttccatcgtctgcccgggtcgataagccacccagcgtccttccatacttcaacagaccgcctagtgctctcccacttatgggtttaccgccaccccccatcccccccccccctccgctatccagctcatttggcgtcccccccccgcctcctgggattcattaccaacatctgatgccccccccacctaggctcccgccacacctcgctgtgcccccgcccggcgccattccacccgccctgcacttgaatcctgctttctttcctccccctaacgccaccgtagggcctcctcctgatacatatatgaaagcgagcgcgccttacaatcatcatggcagccgggacagcgggccacccccttcaacagtctcagaagcagaattcgaggatattatgaaacgcaacagggcgatctcatccagcgccatttccaaggccgtatctggagctagcgccggggattatagcgatgccatcgagactcttctgaccgccatcgcggttatcaagcagtccagggtggcaaatgatgagcggtgccgagtgctgattagttccctcaaggattgtcttcacgggattgaggccaaaagctactccgtcggtgcgtcagggtctagctctaggaagcggcatcggagccgcgaaagatcaccatcaagaagccgggaatcttctcgacgccaccgggatctccttcacaacgaggatcgccatgatgactatttccaagaaaggaacagagagcatgaacggcacagggaccgggagagagacaggcatcattag

SEQ ID NO: 11524 - DNA, 1416 bp, Artificial Sequence
  Description of Artificial Sequence: Synthetic coding sequence
atgtctgaaggcgtggacctcatcgatatctacgcagatgaggaattcaaccaagaccctgaattcaacaacactgatcagattgacctgtacgatgatgtactaaccgcgactagtcagcccagtgatgatcggtcatcatcaactgagcccccgcccccagtcaggcaggagcctagcccaaagcctaataataaaacacccgccatactctacacctatagcggtctgcgtaatagaagagcggcggtgtacgtagggtcattctcatggtggaccacagatcaacagttgatacaggtcattcggtccattggagtctatgatgtcgttgagctcaagtttgcggaaaatagagctaacggacagtccaaaggctacgccgaggtggtggtggcctccgaaaattcagtccacaagctgttggagctcctgcccggaaaggttcttaacggcgagaaggtagacgtccggccggccacacggcagaatctcagtcagttcgaggcacaggccagaaaaagagagtgcgttagggtaccgagggggggtataccacctcgagcccactccagggactcgtctgatagcgctgacgggcgggcgacaccaagcgaaaatctggtgcctagcagcgcacgggtggacaaaccgccttcagtgctgccttactttaaccggccgcccagcgcccttcctctaatgggtctgccaccacctcctatcccccctccaccccccctctcaagttcatttggagtgcctcctcccccaccagggattcactatcagcatctcatgccccccccaccaaggctgcctccccatctagctgtgcctccacctggcgcgatccccccagctctccatttgaacccggccttcttcccccctcccaacgccacagtcggtccgcctcccgacacctatatgaaggcttcagctccctacaatcaccacggcagtagagattcgggacctcctccatcaactgttagtgaagctgaattcgaggatattatgaagagaaatagagccattagctctagcgcaatcagcaaagctgtctctggggcgagcgccggggactatagcgatgccatcgaaactcttctgactgctatagcagtgatcaaacagagtcgagttgcgaatgatgaacgctgtcgagttcttatcagctccctgaaagactgtctgcacgggattgaagccaagagttattcggtcggtgcctctgggagtagctccaggaaacgccatcgcagccgggaacggtccccttctcggtccagggaaagctcccgcaggcatagagatttattacataacgaggaccgccacgatgactattttcaggagcgtaatcgagaacatgagaggcacagagatcgggaacgcgaccggcaccattag

SEQ ID NO: 11525 - DNA, 618 bp, Artificial Sequence
  Description of Artificial Sequence: Synthetic coding sequence
atgtcagaaggagtggatcttattgacatctacgccgatgaggagttcaatcaggatcctgagttcaacaacaccgaccaaatcgatctgtacgacgatgtgcttactgctactagtcagccatcggacgacaggagcagcagcaccgagcctcctccgcccgtgagacaggagccgtcacctaaacctaacaacaaaacgccagctattttatacacgtacagcggcctacgtaaccgtcgtgccgctgtgtacgtcggaagtttcagttggtggaccactgaccagcagctcatccaagtcattaggtccatcggggtgtatgatgtggtggagctgaagttcgccgagaacagagccaatggtcaatccaaaggctacgccgaggttgttgtggcctcagagaacagtgtgcacaaactgcttgagctgttgccaggaaaagtgctgaacggggagaaagtggacgttagacctgcaacacggcaaaacttgtcacagtttgaggcccaagcgcggaagaggattccacccagggcgcatagccgcgattccagcgactccgccgacgggcgcgcaacgccatcagagaatctcgtccctagtagtgcccggtag

SEQ ID NO: 11526 - DNA, 1389 bp, Artificial Sequence
  Description of Artificial Sequence: Synthetic coding sequence
atgtcagagggagttgatctgattgatatatacgccgatgaagaatttaatcaagatcctgaattcaacaatactgatcagattgacctctacgatgacgtgctcacagccacctcacagccatccgatgatagaagttcctccaccgaaccccctcctccggttaggcaggagccctctcctaagcccaacaataagactccagcaatcctgtatacatattctggcctgcggaacaggagggccgcagtgtacgtggggagtttctcctggtggacgactgatcagcaactgattcaggtgatccggtccattggagtttacgatgttgtagagttgaagttcgcagaaaatagggccaacgggcagtctaagggctacgcggaggtggtggtcgcaagcgagaatagtgtacacaaactgctcgagcttttacccggtaaagtgctgaacggcgagaaggtggatgtgcggccggcaacacgacaaaacctgagtcagttcgaagctcaggccagaaagagaattcccccacgtgctcactctcgcgatagctccgacagcgctgacggacgggcgacccctagcgagaatctcgtacccagttcggctcgcgtggataaacctccctccgttttgccttactttaacagacctccttcagccctgcccttaatggggttgccacctccccctatccctcctccccctcctctgagttcttcattcggcgtgccacctcccccaccaggaatccattaccaacacctgatgcctccaccacccagattgcctccccaccttgctgtgccaccgccaggggccattccaccagcactgcatctcaatccagcattctttcctcctcccaacgctacagtgggcccgccaccagacacctacatgaaagcgtccgccccctataaccatcatgggagcagagacagcggcccaccgcctagcacggtgtccgaggctgagttcgaggatatcatgaagaggaaccgtgccattagtagttccgcaatttctaaagcagtgtctggcgcgtctgcaggcgactattcagatgccattgagacactcctgaccgcaatcgccgtcatcaaacagagtcgggtagccaacgacgagaggtgtcgcgtgctcatctcatcactaaaagactgccttcacggcatagaggcaaaaagttattcagttggagccagcggcagcagcagcagaaaaaggcatcgctccagagagagatcccctagccggtccagggaaagtagtagacggcacagagacttgcttcataatgaggacagacacgatgattatttccaggagaggaacagggaacacgaacggcacagggacagagaacgcgatagacaccactag

SEQ ID NO: 11527 - DNA, 1389 bp, Artificial Sequence
  Description of Artificial Sequence: Synthetic coding sequence
atgtcagaaggggtggaccttatagatatctacgccgacgaagagttcaaccaggaccccgagttcaacaacacagatcagatcgacctctacgacgacgtgctgacagctacatcccagccctctgacgacagaagcagttccactgaaccccccccacccgtcaggcaagaaccaagtcctaaaccaaataacaaaacccctgcaattctgtacacgtactctggattgaggaatagacgggccgctgtctacgtgggaagtttttcttggtggactacagatcagcagctcatccaggttattcggtctatcggagtctacgacgtcgtagagctcaagttcgctgagaaccgggcgaacggacagtctaaaggctatgctgaagtagtcgtagcctctgagaattcagtgcacaaactcttagagctgctgccaggtaaggtgctgaatggcgagaaagtcgacgtgaggccagccaccagacagaatctgtcacagttcgaggcccaggcgaggaagaggatccccccacgagctcattcacgggacagcagcgattcagccgatggcagagccacaccatcggagaatctggtaccttccagtgcccgagtggataaaccaccatccgttcttccctattttaataggcccccatcagccctcccgcttatgggcctccctccaccacccattcctcctcccccacccctgtcctcttcgttcggggttccacccccccctcctggcatacactatcagcaccttatgccaccgcccccccggctgccgccccatctcgcagtgccccctccaggcgctatcccacccgcactgcacctgaatcctgcattttttcctccaccaaacgctaccgttggtcctccccctgatacatacatgaaggccagcgcaccttataaccatcatggatcacgcgactcaggacccccacccagtaccgttagtgaagcggagtttgaggacatcatgaaacggaaccgagctattagttcttccgctatttccaaagccgtgtcaggcgcatcagcaggagactattcggatgccattgaaactttattgacagctatcgccgtaatcaagcagagccgtgttgccaacgacgagcggtgccgcgtcctcatctccagcttgaaggattgcttgcacggtattgaagccaagagctattctgttggcgccagcgggtcttccagcaggaaacgacacaggagtagggagcggtcaccctctcgctcaagggagagttccaggagacaccgggacctgctgcacaatgaggaccggcacgacgattattttcaggagagaaaccgggaacacgaacgccatcgagatcgggaaagggaccgccaccattag

SEQ ID NO: 11528 - DNA, 435 bp, Artificial Sequence
  Description of Artificial Sequence: Synthetic coding sequence
atgagcgagggcgtggatttgattgatatctatgctgatgaagagtttaatcaggaccccgagtttaacaacaccgaccaaatagacctgtacgacgatgtactgaccgccacctctcaaccctccgacgacagatcttcctccaccgaaccgcctccccccgtgagacaggagccgtcacccaaacctaacaataaaacaccagccattttgtacacatacagtggacttcggaatagacgagctgctgtctatgtgggctcattttcatggtggacgaccgatcaacagttgatccaggtgatcaggagcattggtgtgtatgacgtcgtggagttaaaatttgctgagaacagggcaaatgggcagtctaaaggatacgctgaagtggttgtggccagcgaaaattctgtgcacaaactgttagaattatag

SEQ ID NO: 11529 - DNA, 441 bp, Artificial Sequence
  Description of Artificial Sequence: Synthetic coding sequence
atgtcagagggagtagacctcatagacatatacgcagacgaggagtttaaccaagatcctgagttcaacaacaccgatcagatagacctgtacgacgacgtgttaacagcaacaagccagcccagtgatgataggagtagcagtactgaacccccccctccagttagacaggagccctctcctaagccaaataataagacccccgctattctatacacatactcaggcctgaggaaccgaagggctgcagtttacgtgggctccttctcctggtggaccacggatcagcagctcattcaggttatccggtcaattggggtttacgacgtggtggagcttaaattcgccgaaaatcgcgctaatggtcagagcaaaggctacgccgaagtcgtcgtggctagtgagaatagcgtgcacaaactcctcgagctgctaccatag

SEQ ID NO: 11530 - DNA, 867 bp, Artificial Sequence
  Description of Artificial Sequence: Synthetic coding sequence
atgtcagaaggagtggacctcatagacatctacgcagacgaggagttcaatcaggacccagagttcaataatactgatcagatagatctttatgacgacgtacttaccgctacatctcagccttctgatgataggtctagctcgactgagcctcctccaccagttcgccaagagccaagcccaaaaccaaataataaaacaccagccatcctatatacttactccggcttgcggaacaggagagcggccgtatacgtagggtcgtttagctggtggaccactgatcaacagctgattcaggtaatccgtagcattggcgtctacgatgtggtcgagctgaagtttgccgagaacagagccaacggacagtccaaagggtacgccgaagtagtggtggcctccgagaacagcgtccataaactccttgaattgcttccaggcaaagtactgaacggagagaaagtagacgtccggcccgcaacgcgacaaaatctgagtcagttcgaggcccaagcccgcaagagaatcccaccacgagcgcattctcgcgatagcagcgactctgccgacggccgggccacacccagtgagaatctcgtgccttcttccgcgagggtcgacaaaccaccttcagtgctgccatatttcaatcgcccaccctctgcgcttccgctgatgggtctaccccctccaccaatcccaccgccacctcccctctcaagttctttcggagtgccacctccgcctcccgggatccactaccaacatctcatgccccccccaccacgcctaccccctcacctggcggtcccaccccctggagccatcccacctgctctccacctcaacccagctttttttccgtag

SEQ ID NO: 11531 - DNA, 3162 bp, Artificial Sequence
  Description of Artificial Sequence: Synthetic coding sequence
atgagtcgccggaagcaggctaagcctcagcatatcaatagtgaggaggaccagggcgagcaacagccacaacagcaaactcccgagtttgcagacgctgcccccgccgctcctgccgcaggtgagctgggagcaccagtaaatcatcccggaaacgatgaagtggcgtctgaagacgaggctactgtgaagagactgcgccgggaggagacccatgtctgtgaaaagtgttgcgccgaatttttctcaattagcgagttcctagagcataagaagaactgtaccaagaaccccccagtcctcattatgaatgatagtgaaggccccgtaccctccgaagacttctctggtgcggttctaagccatcagccaacatctccagggtctaaggattgtcaccgcgagaacggtggatcctctgaggacatgaaagagaaacccgatgccgagtccgttgtctatctgaaaacagagacagcactcccaccaacacctcaggacatctcttacctagcgaagggaaaggtggccaatactaacgtcaccctccaggctctcagaggcactaaagttgccgtaaatcagaggtccgctgatgccctgccggctcctgtccctggcgctaattcgatcccctgggtactcgaacagatcctgtgcttacaacagcagcagttgcagcaaatccagctcacagaacagatcagaatacaggttaacatgtgggcgtcgcacgcacttcactcctccggcgccggagcagatacactcaagacattaggcagccacatgtcccaacaagtctccgcagccgtggctttgcttagccaaaaagcgggatcccaggggctcagtctggatgctctgaagcaggctaaacttcctcatgccaacatcccttccgctacctcatcgttgtcaccgggtctcgccccctttacactgaagcctgatgggaccagggtgctgcccaacgtcatgagtcgacttccctcagctctcctacctcaggccccgggatcagttctgtttcaaagcccctttagcacagtggctctggacactagcaagaagggaaagggcaagccacccaacatctcagcagtggacgttaagccaaaagacgaggccgccctttataaacacaaatgcaagtactgctcaaaggtatttggtaccgacagcagccttcaaattcacctaagaagccacaccggagagagaccatttgtctgttcagtgtgcgggcatcgattcactactaaagggaatctgaaggtgcacttccacaggcatccacaggtgaaagcaaatcctcaactgtttgccgagtttcaggacaaggtggccgctggaaacgggattccttatgctctctcagttccagatccaattgatgagcccagcctgtcacttgactccaagcctgtgctagtgactactagcgtcggccttccacagaacttgtccagcggaacaaatccaaaggatcttaccggtggatcactgccaggagatcttcagcctggtccctcacccgagtcggagggagggccaaccttaccaggagtcggcccaaattacaactcccctagagctggcggcttccagggctcaggcacccccgaacctggcagcgaaaccctgaagctgcagcaactggtagaaaacattgacaaggctacaaccgatcccaacgagtgcttaatatgtcacagggttctgtcgtgtcagagctcacttaaaatgcactacaggacgcacactggagagcggccattccaatgtaagatttgtggccgagcgttctcaacaaaggggaacctcaagacacacctgggcgtacacagaacaaatacttccatcaagactcagcactcgtgtcccatctgtcaaaaaaaatttactaacgccgtaatgctgcaacagcatatccgcatgcacatgggaggccagattccgaacacaccactcccagagaacccatgcgactttacaggctctgagccaatgaccgttggggaaaacggcagcacgggcgccatctgccatgatgacgtcatcgagagtattgacgtggaggaggtctcaagccaagaggctccaagcagctcatctaaagtccccacaccactgcctagcattcactctgcatcaccaaccctgggcttcgcaatgatggcatccctggacgcccccggaaaagtgggtccagctcccttcaacctgcagaggcagggaagcagggagaatggttcagtggagagcgatggcctcacgaacgactcctctagtctgatgggcgaccaggagtaccagagtagatcccccgacattctggagactaccagctttcaggccctgagccccgccaacagtcaggctgagtcaattaaaagcaaatccccagacgcgggatccaaggccgagtcaagtgaaaactctaggactgagatggagggtcgttccagccttccatccacctttatcagggctccgcctacgtatgtgaaagtcgaagtacccggaacattcgttggcccttctactctcagtccgggcatgacccccctgttagccgcccagcctcgcaggcaagctaagcaacatggatgtaccaggtgcggcaagaatttctcaagcgcctctgccctgcagatccacgagcgcacccacacaggcgaaaaaccctttgtgtgcaatatttgtggcagggcttttaccaccaaaggcaatctcaaggtccactatatgacccacggagcaaacaataactccgccaggcggggccggaaactggccatcgagaacacaatggcccttcttggaacagacgggaagagggtgtccgagatcttccctaaggagatcctcgcaccttcagtgaacgtggaccctgtcgtgtggaaccagtatacctccatgctgaatggggggctcgcagttaaaaccaacgagatctcggttatccagtcgggcggagtacccacattgccagtgtccctcggagctacgtctgtggttaacaatgccacagtctcaaaaatggacggaagccagagtggaatttctgcagacgtggagaaaccatccgcgacggacggcgtaccaaaacaccagtttcctcactttctcgaagagaacaagatcgccgtatcctag

SEQ ID NO: 11532 - DNA, 1038 bp, Artificial Sequence
  Description of Artificial Sequence: Synthetic coding sequence
atgtacagaaccaaagtaggcctgaaggacaggcagcagctgtataagcttataatctcccagctgctgtacgatgggtacatttccatcgccaacgggcttatcaacgaaatcaagccccaatcagtttgtgccccaagcgagcaacttttacacctcataaagctcggcatggaaaatgatgacacagctgtccagtacgcgatcggacgcagcgatactgtggcgcctggaacgggcatcgatctcgagtttgacgcagacgtccagactatgtctcccgaagcatcggaatatgaaacttgttatgtgacttcgcacaaggggccttgccgggtggccacgtattccagagacggacagctcatcgctacagggtccgccgacgctagcattaaaattctggacacagagcgtatgttggcaaagagtgccatgcctattgaagtgatgatgaacgagacagcacagcagaatatggagaaccaccctgtgattcgcactctatacgaccacgttgacgaggtgacttgtctagcttttcatccaacggaacagatcctcgccagtggctcccgagactacacactgaagttgttcgattacagtaagccttctgctaaaagggcctttaagtatattcaggaagcggagatgctaaggtcaatttcctttcaccccagtggagatttcatactcgtaggcacccagcatcccactttacgcctgtatgatattaataccttccagtgcttcgtgtcttgtaatcctcaagatcagcacacggatgcaatctgcagtgtaaactacaattcaagcgctaacatgtatgtgaccggtagcaaggacggttgtatcaaactttgggatggcgtttctaatcgttgtatcacgactttcgagaaggcgcatgatggggctgaagtgtgttccgccattttttctaagaacagtaagtacattctcagctccgggaaggatagtgtggcgaagttgtgggaaattagtactgggagaacactcgtaaggtacacttag

SEQ ID NO: 11533 - DNA, 1257 bp, Artificial Sequence
  Description of Artificial Sequence: Synthetic coding sequence
atgtacaggttaatcatttcccagctgctgtacgatggatatatctctatcgcgaatgggcttataaacgagattaagccacagtcagtctgcgccccgtctgaacagttgctgcatcttatcaaactcgggatggaaaatgacgataccgcagtgcagtacgccattgggcgcagcgacacggtggccccaggcacaggcattgacctggagttcgatgcagatgttcagactatgagccccgaggccagcgaatacgagacctgttatgtgaccagccataaagggccttgtcgcgtggcaacatactctcgagatgggcagcttatagcgacaggatcagctgacgcaagcattaagattctagacacagagcgcatgttggccaagagtgccatgccaatcgaagttatgatgaacgagaccgcccagcagaacatggagaatcaccctgtgattcgaactctgtacgatcatgtggacgaagtgacctgcctcgccttccaccccaccgagcagatcctggcttcaggctcccgtgactatacgttgaagcttttcgactactccaagccctccgcaaaaagggcttttaaatacatacaggaagccgaaatgttgagatccatctcatttcacccttcaggagactttattctagtcgggactcaacacccaacactcagactgtacgatataaacacgttccagtgctttgtaagttgcaaccctcaggatcagcatacagatgccatctgtagtgtgaactacaacagttccgctaatatgtacgttacaggcagcaaggatgggtgcatcaagctgtgggatggggtatccaaccgctgtattactacctttgaaaaagctcatgacggtgccgaggtgtgcagcgccatctttagtaaaaatagtaagtatatcctgtcatccggcaaggatagcgttgctaaactgtgggaaatatctaccggcaggacacttgtgcgatacaccggggctgggctttcaggacgccaagtccaccgaactcaagctgtgtttaatcatacagaggactacgttctgctccctgatgagaggaccatatctttgtgctgttgggattcacggacggcggagcgccgcaacctcttatctctggggcataacaacattgttcgatgtatcgtgcatagtcctaccaatcctggtttcatgacatgcagcgacgactttagggccagattctggtatagacggagtacaacagactag

SEQ ID NO: 11534 - DNA, 429 bp, Artificial Sequence
  Description of Artificial Sequence: Synthetic coding sequence
atgtaccggacaaaggttggccttaaagaccggcagcagctctacaaactgatcatcagccagctgctgtacgatggatacatttctatcgcgaacgggctcatcaacgaaattaaacctcagtccgtgtgtgcccccagcgaacagctccttcatctgataaagctcggcatggagaatgacgacactgctgtccagtatgccatcggaagatctgataccgtcgctcccggtactggtatcgatctggagttcgacgctgacgtgcaaacaatgtctcctgaggcttctgagtatgagacttgttatgtgaccagccacaaaggcccttgtagagttgccacttatagtagagacggccagctcatcgccacaggctccgccgatgcatctattaagattctcgataccgagaggatgttggcctag

SEQ ID NO: 11535 - DNA, 1038 bp, Artificial Sequence
  Description of Artificial Sequence: Synthetic coding sequence
atgtacaggacgaaggtcggcctgaaggatcgtcaacagctgtataaactcatcatctcccaactcttgtacgacggctacatttcgatcgcaaacggccttatcaatgagataaaaccccagagcgtttgcgctccaagcgagcagctcctgcacctgattaaactcggtatggagaacgatgatactgctgtccagtacgccattggcaggtcagatacagtggcccccgggaccggtatagatcttgaattcgacgccgacgtacagactatgtcaccagaagccagtgaatatgagacctgctacgttacctcccacaaaggaccttgccgtgtcgccacatattccagggacgggcagcttatcgctaccggctctgccgacgctagcatcaagatcctggacactgagcgaatgttggccaaatccgctatgcccatcgaggtgatgatgaacgagaccgctcagcagaacatggagaatcaccctgtgataagaacgttgtatgaccacgttgatgaggtgacttgcctggcattccatcccactgagcagatacttgcgtccgggtcaagggattatacccttaaactattcgactattctaaaccgagtgcgaagcgggcattcaagtatattcaggaagcagagatgctcagatcgattagctttcatccctcaggcgattttatattggttggcacccagcatcctaccttgagactctacgatattaacaccttccagtgctttgtgtcctgcaatccccaggaccaacacaccgatgctatctgctcagtgaactataactctagtgcaaatatgtacgtgactgggtccaaggacggttgtattaagttgtgggacggagtgtccaacaggtgtatcacaaccttcgagaaggctcacgatggcgctgaggtctgcagtgcaatctttagcaagaattcaaaatatatcctaagctccgggaaagacagcgttgcgaagctgtgggagatttctacaggacgtaccctggtgaggtacacctag

SEQ ID NO: 11536 - DNA, 1734 bp, Artificial Sequence
  Description of Artificial Sequence: Synthetic coding sequence
atggctggcctgaccgtcagggatcccgctgtcgatcggtccttacgctccgtgttcgtcgggaatatcccgtatgaggcaacggaagaacagctgaaggacatttttagcgaagttggacccgtagtgtctttccggcttgtctacgatagagagaccggcaagcctaagggctatggtttctgcgaataccaggaccaggagaccgctttatccgctatgaggaacctcaacggtcgcgaattctctgggagagcactacgtgtggacaatgctgctagcgagaagaacaaagaggaactcaaaagcctcggtacaggggccccggtcattgagagcccttacggggaaaccatttccccagaagacgccccagagagcatcagcaaggcggtcgcctcccttccacctgagcagatgttcgagcttatgaagcagatgaaactgtgcgtgcaaaactctccccaggaggccagaaatatgttgcttcagaatcctcagctcgcctacgcgctgctgcaggcccaggttgtgatgaggatcgtggaccctgagattgcactgaagattctgcacaggcagactaatatcccaacactcattgccggcaatccccagccagtccacggcgccggacctgggtccggcagtaacgtgtctatgaatcagcagaaccctcaggcccctcaggctcagtccctaggtggaatgcacgtgaatggggcaccaccgctcatgcaagccagtatgcaaggaggcgtgccagcccctggccaaatgcccgcagcagtcactgggcctggccccgggagcctcgccccagggggaggcatgcaagcacaggtgggtatgcccggatccggtccagtcagtatggagcgagggcaggtgccaatgcaggatccaagggctgctatgcaacggggctctctgcctgccaatgtgccaactcctcgaggactgctcggggatgccccaaacgatccccgcggcggaactttactcagtgttaccggggaggttgaaccgcggggctatctgggccctccccaccagggtcctccaatgcatcacgtgcccggtcatgaatcccgaggcccacctccacacgagctcaggggaggacctctgcctgagcctcgaccactgatggccgagccccgtggccccatgcttgatcaaagggggcccccccttgatgggagaggcggcagggatccccggggcatcgacgcaaggggcatggaggcccgcgcaatggaggccagaggactggacgcaagaggattggaggcacgggccatggaggcacgcgcaatggaagcacgagccatggaagctagagctatggaagctcgggcgatggaggtccgcgggatggaagctagaggtatggacacaagggggcccgtccctgggccgaggggtcccatcccctctgggatgcagggccccagtcccatcaacatgggcgccgtggtgccgcaaggatcacgtcaagtgcctgtcatgcaaggcaccggaatgcaaggtgcttccatccagggaggcagtcaacctggcgggttcagccccggccaaaatcaagtcacaccccaggaccacgagaaagcagccctcatcatgcaggtgctgcagctcacggcggaccagatcgccatgctgccccccgagcagaggcaatcaatccttatcctgaaggagcaaatccagaaaagcactggcgcaccttag

SEQ ID NO: 11537 - DNA, 1662 bp, Artificial Sequence
  Description of Artificial Sequence: Synthetic coding sequence
atggccggacttaccgtgcgtgatcctgccgttgataggtctctccgaagcgtctttgttgggaacattccttatgaggctacagaggaacaactcaaggacatatttagtgaggtggggcccgttgtatctttcaggctggtttatgacagggaaacggggaagcctaagggctacggcttctgcgagtatcaggaccaagaaaccgcactgtcagctatgaggaatctgaacggccgggagttctctgggagggccttaagggtggataatgccgcatccgaaaagaacaaggaggagcttaagtcactggggacaggggctcctgtaattgaatcaccctacggcgaaaccattagccccgaagacgcccccgaatctatctcaaaagccgtggccagtctaccacctgagcagatgtttgagctcatgaaacaaatgaaactctgcgttcagaactcgcctcaggaggcccgaaatatgctcctgcagaatccgcaactggcctacgccttgttacaggcgcaggtcgtgatgcgcatcgtggatcccgaaattgcactgaaaattctgcacagacagacaaatatacccacgctgatcgccgggaacccccaagcgcagtctttaggcggaatgcacgtgaatggtgcccctcctttgatgcaagctagcatgcagggcggtgttccggcaccaggtcaaatgccagccgccgtgaccggaccgggtcctggctccctggcccctggcgggggaatgcaagcacaagtcggaatgcccgggtccggacccgtcagcatggagcgagggcaagtgccgatgcaggatccgagagctgccatgcagagggggtctctcccagcgaatgtgccgacccctcggggcctactgggggatgcacctaatgatccacgcggcggaacgttactaagtgtcactggcgaggtggagccccggggctatctcggaccccctcaccaaggccctccaatgcaccacgttcccggtcacgagtcacggggccccccaccacacgaactccgtgggggacctttacccgagccacgtccactgatggccgaacctaggggtcctatgctggaccagcgcggtcccccccttgatggccggggcggcagagatccccgtgggatagacgcccggggaatggaggcaagggcgatggaggcaaggggactggatgcaagaggactagaagcacgagccatggaggcccgggctatggaagccagggctatggaggcacgcgcgatggaggcacgagctatggaagttcggggaatggaggctcgaggtatggacacccgaggaccagtgccagggcctagaggccccattccttcgggtatgcagggaccgtctcctatcaacatgggcgcggtagttccccaggggagccgacaggtgccagtcatgcagggaactggaatgcagggtgcctctatccagggaggctcccagccaggcggcttctcacctgggcagaatcaggtcaccccgcaggatcacgaaaaggctgccctgatcatgcaggttctacagttaaccgccgatcagattgctatgcttcctccagagcagaggcagagcatcctgattctaaaggaacaaatccagaagagtaccggcgcgccttag

SEQ ID NO: 11538 - DNA, 2154 bp, Artificial Sequence
  Description of Artificial Sequence: Synthetic coding sequence
atgtcaggtgacggggctaccgaacaggcagccgaatatgttcctgagaaagtgaagaaagccgagaaaaagcttgaggaaaatccctatgatctggatgcgtggtccatcctcatccgggaagcacagaaccagcccatagacaaggccaggaagacctatgagcggctggtcgcacagttccccagcagtggacgcttctggaagttgtacatagaagccgagatcaaggctaaaaactatgataaggtggagaagttgtttcaaagatgcctgatgaaagtactgcacatagacttgtggaaatgttacctgagttacgtgagggagactaaaggcaagctgcctagctataaggaaaaaatggcccaggcatacgacttcgcccttgataagatcggtatggagattatgagctatcagatctgggtggactatattaacttcctgaagggcgtggaggccgttggtagctacgcggaaaaccagcgtatcaccgcggtgaggcgcgtctatcagagaggatgcgtgaatccgatgattaacatcgaacaattgtggagagactacaacaaatatgaggaaggcattaatatccacttggccaagaagatgattgaggatagaagtagggactatatgaatgctaggagggtggctaaagagtacgaaactgtgatgaaaggccttgacaggaacgccccgtcagttcccccccagaacacccctcaggaggcacagcaggttgatatgtggaaaaagtatatccagtgggaaaagagcaatccactcaggacagaagatcagacattgatcacaaaaagagttatgttcgcatatgaacagtgtctgcttgttttgggccatcaccccgatatctggtacgaagctgcacaataccttgagcagtcaagtaaactgctggcggagaagggagacatgaataatgctaaactattctcagatgaggccgctaacatatacgaaagggcgatctctactctcctcaagaaaaatatgctcctgtattttgcatacgcggactatgaagagtctagaatgaagtacgagaaggttcattcaatttataatcggcttctcgctatagaggacattgaccccacgctggtttacatccagtatatgaagtttgcccgcagagccgaggggattaagtctgggaggatgatctttaagaaggctcgagaagacacaagaacacggcaccacgtgtacgtgactgcggccctgatggagtactattgctccaaagataaaagtgttgcgtttaaaatctttgagctgggcctgaaaaaatacggagacatccctgagtacgtgctggcctatatcgactatttgtctcatctgaatgaggacaacaatactcgcgtgctgtttgaacgggttctgacgagcggatccctcccacctgagaaatcaggggagatctgggccaggttcttggcatttgagtctaatattggggacctggccagcattctgaaagtggagaagcgtaggttcaccgcctttaaagaggaatacgaaggcaaagagacggccctactggtcgatagatacaagttcatggacctttacccctgttcagcaagcgagcttaaggccctcggatacaaagatgtgagtagagccaagctcgctgcaatcatccccgatccagtggttgccccttccatcgtacccgtactgaaagatgaagttgaccgcaaaccagaatatcctaagcctgatacccaacaaatgatcccgttccaaccgcgacatttggcccccccagggttgcacccagttcctggcggggtgttcccagtgcctcccgcagcggtggtcctgatgaaacttctgccacccccaatttgttttcaaggtcccttcgtgcaggtggatgagctgatggagatcttccggcgttgtaaaataccaaacacagtcgaagaagcggtacgcatcatcacagggggagcccccgaactggccgtggagggtaacggtccggttgagtcaaatgctgtgctgactaaagcagttaaacgcccaaatgaggacagcgatgaggatgaggaaaagggagcagtggtcccacccgtgcacgatatctatcgcgcacgccagcaaaagcgtattaggtag

SEQ ID NO: 11539 - DNA, 135 bp, Artificial Sequence
  Description of Artificial Sequence: Synthetic coding sequence
atgtctggagacggggctacagaacaggctgccgaatatgtgccagagaaggtgaagaaagccgaaaagaaactcgaggagaatccatacgatctcgacgcgtggtctattctgatccgtgaggcacaggtctag

SEQ ID NO: 11540 - DNA, 312 bp, Artificial Sequence
  Description of Artificial Sequence: Synthetic coding sequence
atgtcaggagatggagccacagaacaggcagctgagtacgtgccagaaaaagtaaagaaagccgagaaaaagctggaggaaaatccatatgatttggatgcgtggtcaattctgatcagggaagctcagaaccagcctatagacaaagccagaaagacctacgagcgcctcgttgcgcagtttccctcaagcggccgcttctggaaattgtacatagaggccgaggtgacgatcctgttctactttttcctgtatcagtactgtagcatccactgcagcgacagaaaacaagtgcgcaacatcgctaattag

SEQ ID NO: 11541 - DNA, 186 bp, Artificial Sequence
  Description of Artificial Sequence: Synthetic coding sequence
atgagcggagacggtgcgaccgaacaagcagctgaatacgtccctgaaaaagtcaaaaaagccgagaagaagctggaggaaaatccatacgatctcgatgcctggagcattctgatacgcgaggcccagaatcagcccatcgacaaagctcgcaaaacatacgaacgccttgtagcccagttctag

SEQ ID NO: 11542 - DNA, 1953 bp, Artificial Sequence
  Description of Artificial Sequence: Synthetic coding sequence
atgacccttatgctgggcgcccagatcaaggcgaagaactacgacaaagttgagaaactgtttcagcggtgtctaatgaaagtgctgcacatcgatttgtggaaatgctacctcagctatgtgcgggaaacaaagggcaaactgccatcatataaagaaaagatggcacaagcctatgacttcgccctggacaagataggaatggaaattatgtcttatcagatctgggttgattatattaatttcctcaaaggagtcgaggctgtgggttcctatgctgagaaccagcgcatcactgccgtgcggcgggtttaccaaagagggtgtgtgaatccaatgataaacatcgaacagctgtggagagactacaacaagtatgaagaaggtattaacatacacttagctaagaaaatgatcgaggatcggagccgggactacatgaatgcacggcgcgtggctaaggagtatgaaacggtgatgaagggtctggacaggaacgctccctccgtgcccccgcagaatacgcctcaggaggctcagcaagtcgacatgtggaaaaagtatattcagtgggagaagagtaatccgcttaggaccgaagatcagactctaataacaaagagagtcatgtttgcgtatgaacagtgtctgttggtgttgggccaccacccggacatttggtacgaggcagctcagtacctggagcagtcatctaaactgctagctgaaaagggggatatgaataacgccaagcttttctccgatgaggctgctaacatctacgagcgcgccattagtactttgctgaaaaaaaatatgctgttgtatttcgcctatgccgactatgaggagagcaggatgaaatatgaaaaagtccactctatttacaatcgccttttggccattgaggacatcgatcccactctcgtgtacatccagtacatgaagtttgcacgcagagccgaggggattaagtctggaagaatgatctttaagaaagcccgtgaagatacgcgaacaagacatcatgtctacgtgacagcagcactaatggaatactattgctcaaaagacaaatctgtagcctttaagattttcgagttgggcctgaagaaatacggggatatcccagaatatgtcctggcatacattgactatctgtcacacctcaacgaagacaacaatacaagagtgctgttcgagagagtcctcacaagcggttccctccccccagaaaagagcggtgaaatctgggccagatttttggcttttgagtctaacataggcgatctcgccagtatcctgaaagtggagaaaagaaggtttacggccttcaaggaagaatacgagggtaaagaaacagccctgttggttgatcggtataaatttatggacctgtacccttgttctgccagtgagctgaaagcgctgggttacaaagatgtttcacgggctaagttagctgccattattcctgaccccgtggtggctccctctatagtaccggtgctcaaggatgaggtggacaggaagcccgagtatccaaagccagacacacagcaaatgatcccctttcagccacggcatctcgcacccccaggtctgcacccggtccccggcggagtctttccggtgccccccgcagcagtggtattaatgaagctgctgccacccccaatttgctttcagggcccgttcgttcaagtcgacgagttgatggaaatcttcaggcgctgtaagatacccaacactgtggaagaagcagtgcggatcatcaccgggggtgctccagaactcgcagtcgagggaaatggaccagtggaatcaaatgctgtgctgactaaggctgtgaagagaccaaacgaggacagcgacgaggatgaggagaaaggcgccgtggtccctccagtccatgatatttaccgcgcccgacagcagaagcggatccgttag

SEQ ID NO: 11543 - DNA, 1740 bp, Artificial Sequence
  Description of Artificial Sequence: Synthetic coding sequence
atgcttcgcagtggacctgcaagcggacccagtgttccaaccggaagagccatgccatcacgcagagtcgctcggcctcccgccgcccctgagttaggagcattgggaagccccgatctcagctctttgagcttggccgtttcccggtccactgacgaactcgaaattatcgatgagtacattaaggaaaatggattcggtttggatggtggacagcccgggccgggcgagggattgcctcggctagttagccgcggcgctgcttccttgtccaccgtaacactcggccctgtagctccgccagctacccctcctccctggggctgtccgctcggccgccttgtgagtcccgcccctggacctgggcctcaaccgcacctggtcatcactgaacagcccaagcagcgcggtatgagattccgttacgaatgtgaagggcgatccgcagggtcgatcctcggtgaaagctccactgaagcttcaaaaacactgccagccattgagctgagagattgtggcggactgcgggaagtggaagtgaccgcctgccttgtatggaaagactggcctcatagggtacatccccactcactggtgggcaaggattgcacagatggcatatgtcgggtccgcctccgccctcatgtgagtccaagacactcctttaataatttgggaattcagtgtgttagaaaaaaggaaatcgaggcagccattgagaggaaaatacagttaggaattgacccatataatgcgggcagtctgaagaatcaccaggaagtcgatatgaacgtggtgcggatttgctttcaggccagttaccgcgaccagcaaggccagatgaggaggatggaccccgtgctcagtgagcccgtgtatgataaaaagtcgacaaacacatccgaactaagaatctgcagaattaacaaggagtccgggccctgtactggcggcgaagagctgtatctgctttgcgacaaggtccagaaagaagacattagcgtcgttttttcacgcgccagctgggaaggaagggccgatttcagccaggctgatgtccaccgtcagatcgcgattgtgtttaagacaccaccttacgaagatctggaaatcgtggaaccagtcaccgtgaacgtatttctgcagcgcttgactgacggcgtgtgtagcgaaccattgcccttcacctatctgccccgagaccacgactcctatggggttgacaagaaacgtaaacgcggaatgccggatgtgctcggtgaactgaatagcagcgacccacatggcattgagtcaaagcggagaaaaaagaagccagcaatcctggaccatttcttgcctaatcacggctctgggcccttcttgcccccatccgctctactccccgaccctgactttttttctggaacagtgagccttccagggttggagccacccgggggcccggatttgttagacgatgggtttgcgtatgatcctaccgcacccacactcttcacaatgctggacctgctgccaccagcccctccccatgcttctgccgtcgtctgcagtggcggagccggcgcagttgtgggcgagactcccgggccggaaccgctgaccctggacagttaccaagcccccgggcccggtgatggaggtacagcttccctcgtgggttccaatatgttcccaaatcactaccgggaggctgctttcggcggaggcttactatcccctggtccggaggcaacctag

SEQ ID NO: 11544 - DNA, 1785 bp, Artificial Sequence
  Description of Artificial Sequence: Synthetic coding sequence
atgtggcacgaggcccgcaagcatgaacgtaagttaagaggaatgatggttgattataaaaagagggccgagcggaggagagaatactacgagaagattaagaaagatcccgctcagtttttgcaggtgcatggtcgagcatgtaaagtccatcttgattcagccgtggcactggctgccgaaagtccagtcaacatgatgccatggcaaggagacacgaataacatgatcgaccgcttcgacgtgcgcgcacacttagatcatattcctgactatacgcccccactcttaacaaccatcagccccgaacaggagtccgatgagaggaagtgcaattacgagcgttatcgtggactagtgcagaatgactttgccggaattagcgaggaacagtgtctgtaccagatctatattgatgaactatatggaggactgcagcgcccctccgaagacgaaaaaaaaaaactggccgaaaaaaaggcgagcatcggctatacatatgaagattctaccgtggctaaagtggagaaagctgctgaaaagccagaggaggaggagtcagccgcggaagaagagtcaaactccgacgaggacgaggtgatccctgacattgacgttgaggtcgatgtcgacgaactcaatcaggagcaagtagcggatctgaacaagcaggctaccacttatggcatggccgacggagacttcgtgcgcatgctgaggaaggacaaagaggaagccgaagccataaaacacgctaaagctctggaagaggaaaaggccatgtattccggcagacgcagcaggcggcagagacgggagtttagagagaagaggctccgtggcagaaagattagtccaccgtcatatgcgaggagggactcaccaacatacgatccatacaaaaggtctccatctgagtcatcgtctgagagccgctcccggtcacggagtcctaccccaggcagggaggaaaaaatcactttcattacatccttcggaggatcagatgaagaagcggcggctgccgcagctgccgcagcagcaagtggtgtgactacagggaaaccccccgccccgccacagcctgggggccccgcgccggggagaaacgcctccgcgcgccggcgctcaagtagctcatctagtagctcttctgcgtctcggaccagctccagccgcagctctagccgctccagcagccgctcccgccgcggcgggggctattaccgatccggaagacacgccaggtcgaggagcaggagctggtcccgctctcgatcccgaagtaggagatacagtaggtccagatcacgcggacggcgccactcaggaggggggagcagagatggacatcgttactcccggtcccccgctcggcgggggggatacgggccccgcagacgcagcagatctagaagtcacagcggtgatagatacagaagggggggcagagggctacgccatcattcctccagtcggagcaggagttcctggtctctgagccctagccgatcccggtccctgactcgttccaggtcgcatagcccctctcccagccagtcccgctctaggtcacggtctcggtctcagtcaccgtcgcccagccctgccagagaaaagctcaccagacccgctgcttcacccgccgtcggggagaagcttaagaaaactgagccagccgccggcaaagaaacaggcgccgcaaaagttacccaggccgacgcatccggtgaggcagagaccgaggacgctgagggagccgagcaagctgtgcagggaggatag

SEQ ID NO: 11545 - DNA, 1839 bp, Artificial Sequence
  Description of Artificial Sequence: Synthetic coding sequence
atgtggcacgaagcgaggaagcatgagagaaaactccgggggatgatggtagattacaagaagagggctgagagacggagagagtattatgagaaaattaagaaggatccggcacagtttctccaagaatccgatgagcggaagtgtaattacgagcggtatcggggccttgttcagaacgacttcgccggcatttcagaggaacaatgcctgtaccagatctacatagacgagctatatggcgggttgcagcggccatcagaagacgagaaaaagaaactggcagaaaaaaaggcaagtataggttacacctacgaggatagcactgtggcaaaggtcgaaaaggcagcagagaagcccgaggaggaggagagtgccgccgaggaggaatctaactccgatgaggacgaagtgatccccgatatagatgtggaagtggatgtggatgagctcaaccaggagcaagtagccgacctcaataagcaggccacgacctacggtatggccgacggagacttcgtccgtatgttaaggaaggataaggaagaggccgaagctatcaaacacgctaaagcactcgaagaagaaaaggctatgtattccggccgccgctccaggcggcagcggcgggagttccgtgagaaaagattacgcgggaggaagattagtcctccctcttatgccagaagggacagtcccacctacgatccctacaaacgctctccatcagagagcagctctgagagcagatcgcggagccgcagtcctaccccaggccgggaggaaaagataacattcattacgagtttcggcgggtccgacgaggaggccgccgctgccgctgctgccgctgcagcatccggggtgacaaccggcaagccaccagcccctccccagcctggcggacctgcaccaggaagaaacgcttccgcccgccggaggagctcatcgagttccagcagctcttcagcatcacggaccagtagctcacgttcctcatctcgctcaagcagcagatctaggaggggtgggggttactaccggtcgggccgacatgctcgatcaagaagccggtcgtggtcccgttctaggtctcgatctcgacgctatagccgttcaagatccaggggacggaggcatagcggagggggaagtagggacgggcaccggtactcacgctctcccgctagaaggggtgggtacggtccaagaaggcgcagtaggagcaggtcccacagcggggacaggtaccggaggggcgggcgtggtttgcgtcatcactcaagctctaggtccaggtcaagctggtccctttcgccctccaggtcgaggagtctaacccgcagtcggagccactcacctagccctagtcagtctcgctctcgtagcaggtccaggagtcagtcgcccagcccatccccagcccgcgagaaactcactcggccagcagcaagtcccgccgtcggagaaaaattgaagaagaccgaaccagccgctggaaaagagactggcgcagcaaaacctaaactgactccccaggaaaagttaaaacttcgcatgcagaaggcactcaatcgccaattcaaggctgacaaaaaagccgcacaggaaaaaatgattcaacaggagcacgagaggcaagaacgggaagatgagcttagagcaatggccagaaaaatcaggatgaaagagagagaacgtcgagaaaaggaacgcgaggagtgggagagacaatactcacgccagagtcggagccccagccctcgatacagccgggaatatagctcctctagaaggcggtccagaagtcgctctcgctcaccccactacagacattag

SEQ ID NO: 11546 - DNA, 1968 bp, Artificial Sequence
  Description of Artificial Sequence: Synthetic coding sequence
atgtggcatgaagcacgaaagcacgagcggaagttgcggggtatgatggtggactataaaaagagggctgagcgtaggcgggagtactatgagaagatcaagaaggaccccgcacagtttctacaagtgcatggacgcgcctgcaaggttcatctagattctgccgtggcactggccgccgaaagtccagtgaacatgatgccatggcaaggcgataccaacaatatgattgacaggtttgacgtccgtgcacacttggaccacatcccagattacaccccaccgctactgaccaccatctccccagagcaggaatcagacgagagaaagtgtaactacgagaggtaccgagggttggtgcagaacgacttcgctggcattagtgaggaacagtgtttgtatcagatatacatcgacgagctttacggcggattgcagaggccttccgaagacgagaaaaaaaagcttgcagaaaagaaggcctctattggctatacctacgaagacagcactgtggcaaaagttgaaaaagctgcagagaaaccagaggaggaggagagtgccgccgaggaggaatccaatagtgacgaggatgaggtcatccctgacatagatgtggaagtcgatgtggacgaattgaatcaggagcaagtggcagatctgaacaagcaggcaactacttacgggatggcagatggcgattttgtcagaatgctgcgcaaggacaaggaggaggctgaggctattaagcacgctaaggccttagaggaagagaaagccatgtactccgggcggaggagtcggcgccaacgaagggaattccgggaaaagcgcctgcggggaaggaaaatttctcctccgtcttacgccagacgcgattcaccaacctacgacccgtataaacggtcccctagcgaaagctcttccgaatcccggtctagatcccgtagtcctacgcctggtagagaagagaaaatcacttttatcacatcctttggagggtctgatgaggaagccgcggccgccgccgccgcagccgcggccagcggcgtgacgactggaaagcctccggccccaccccaaccaggcggccccgctccaggcaggaatgccagtgctcgacgccgaagctcatcaagttcaagttcttctagcgctagccgtacgtcatcctctaggagttcaagcaggtccagcagtcgatctcggaggggtggcggctactataggtcaggcagacatgctagaagtcggtcacgcagctggtcccgctcaagatcccgaagtagacgctactcccggtcccgctccagaggccgtcgccattcaggagggggctcacgagacgggcataggtattctcggtcaccagcaagacgggggggctacggcccccggcggcgttcacgatctcggagccacagtggagaccgttatcggagggggggaagaggactgagacatcattccagctccagatcgcggagcagttggtcgctgagccccagccgatctcgctccctgacgagatcacgaagccactccccgtcaccctcacagtctcgcagtagatctcgcagtcgatcacagtcaccctctccctctccggcccgcgagaagctcacccggcccgcagcgagtccggcagtgggtgaaaagcttaaaaagacagaacctgctgcaggaaaggaaactggcgctgctaaggttataaaggccgataagaaagcggctcaggagaagatgatacagcaggaacacgaacggcaagagagggaggatgagttgcgggctatggcacgcaagattagaatgaaagaacgtgagcggagagagaaggagcgtgaagagtgggaaagacagtattcccgccaatcacgaagcccttctccccggtattccagggaatacagttcttcccgcagacgctcgaggtcccggagtaggtctccacactaccggcactag

SEQ ID NO: 11547 - DNA, 1242 bp, Artificial Sequence
  Description of Artificial Sequence: Synthetic coding sequence
atgtccttccgtgacctgcgtaacttcacggaaatgatgcgtgctttgggctacccacgccacataagtatggagaatttccgaacaccgaatttcgggctggtgagcgaagtacttctctggctggtgaaaaggtacgaaccccagaccgacatcccacccgatgtagataccgagcaggacagggtgttctttattaaagctatcgcccagttcatggccactaaggctcatatcaagctcaatacaaagaagctctaccaggctgacggctatgcagtgaaggaattgttgaaaatcacatctgtcttgtataacgcgatgaaaaccaaagggatggagggatcagaaatcgtggaagaggacgtcaacaagtttaaatttgatttggggtctaagattgccgacttgaaggccgccagacagcttgcctcggagattacttctaagggagccagtctgtacgatcttttaggtatggaggtggaactcagagagatgagaaccgaggccatagcaagacctctggagatcaacgaaaccgaaaaagttatgcgtattgccatcaaggagatcctgactcaagtgcaaaagaccaaagacttactgaacaacgtggcttccgacgaggctaatctggaggccaaaattgaaaaacgcaagcttgagttagagaggaacagaaagcgccttgaaactttgcagtccgtcaggccgtgcttcatggatgagtacgaaaagactgaggaagagcttcagaagcaatacgacacctacctggagaagtttcagaatttgacttatctcgagcagcagttggaggaccaccatcggatggagcaagaacggtttgaagaagcgaagaacactctttgccttattcagaacaaactgaaggaggaggagaagcgcctactgaaaagcggttctaatgacgacagtgacatcgatatccaggaagacgatgaatctgattcagagctcgaggaaagaaggcttccaaaaccgcaaacagctatggaaatgctgatgcagggccgtcctggaaagcggatcgtgggaacaatgcaagggggtgattcagatgataatgaggacagcgaagaaagcgagattgacatggaagatgacgacgacgaggacgatgacctcgaggatgagtccatttcgctcagtcccacaaaacctaaccggcgcgtgcgcaagtccgagccactcgatgagtcagataacgacttctag

SEQ ID NO: 11548 - DNA, 744 bp, Artificial Sequence
  Description of Artificial Sequence: Synthetic coding sequence
atgcgcacggaagcaatcgcaagaccactggaaatcaatgagactgaaaaagtcatgcggattgccattaaagagatcctcacacaggttcagaaaactaaggaccttttgaacaatgtggcgagcgatgaggcaaatctcgaagctaaaatcgagaaaagaaaactggagctggagagaaaccgtaaaaggttagaaaccttgcagtccgttcgaccctgcttcatggacgaatacgaaaagacagaagaagaactccagaaacagtacgatacgtatctggagaaatttcaaaacctgacctatctggagcaacagctcgaagaccaccacaggatggaacaggaacgctttgaggaagctaaaaacacactttgtttgattcaaaacaagctgaaggaggaggagaagcgtctgctaaaaagtggttcaaatgatgattctgatatcgacatccaggaggacgacgaatcagactctgaactagaggagcgacgcctgcccaagccccaaactgctatggaaatgctcatgcaaggacggcccggaaagcggatcgtcggaacaatgcagggcggtgactcagacgataacgaggacagtgaagagagtgagatcgacatggaggatgacgacgacgaagacgacgaccttgaagacgagtcaattagtctgtcgcccaccaagccaaatcggagagttagaaaatctgagcccctcgacgagtcagataacgacttctag

SEQ ID NO: 11549 - DNA, 576 bp, Artificial Sequence
  Description of Artificial Sequence: Synthetic coding sequence
atggatgaatatgagaagactgaggaggagttgcagaagcagtacgatacatatttggaaaagttccaaaacctgacatacttggagcaacagctggaagatcatcatcgcatggaacaagagcggtttgaagaggccaaaaacactctgtgtttgattcaaaataaacttaaagaagaggaaaaaaggctgcttaaatccggttctaacgatgactctgatatcgacattcaggaggatgacgagtcagactccgaactggaagagcggcggttgcccaaaccacagaccgcaatggagatgctcatgcagggaagaccaggcaagaggatcgtgggcaccatgcagggaggagattctgatgacaacatggaagccgcgcccgccctgcttggtaagtgcaaaacatctagttctaagaaacaggaggattccgaagagagtgaaatagatatggaggacgatgatgacgaggacgatgatctcgaggacgagtcaatttctctgtccccaacaaagcccaaccgaagagtacgcaagtcagaaccgctggacgaatctgataacgacttttag

SEQ ID NO: 11550 - DNA, 1242 bp, Artificial Sequence
  Description of Artificial Sequence: Synthetic coding sequence
atgtcttttagggacttgcgcaatttcacagagatgatgcgggctctggggtacccacggcacatctccatggagaatttcaggacccccaattttgggctggtgtcagaggtgttgctctggctcgttaagcgatacgagccacagaccgacatcccccctgatgtcgacacagaacaggacagagtgtttttcataaaagctattgcccagtttatggctacgaaggcacacattaagctcaacaccaagaaactttaccaggcggatggctatgccgtgaaggagctcttgaagatcaccagcgtgctatacaacgctatgaagaccaaggggatggagggatccgagattgtggaagaagacgtgaataaattcaagtttgacttgggctctaagatcgcagatctgaaggccgcacgacagttagccagcgaaattacgagcaagggcgcctctctgtatgatctcctgggaatggaggtggaactgcgggaaatgcgcacggaagccatcgcccggcctcttgagatcaatgagaccgaaaaggtcatgcgcattgctataaaagagatcctgacacaggtacaaaagacgaaagatctgctcaacaacgtcgcctcggacgaggccaatttggaggcaaagattgagaaacgcaagttagagctcgaacggaaccggaaacgcctggagaccttgcaatccgttcgtccttgcttcatggacgaatatgagaaaactgaagaggagcttcaaaaacagtacgatacttatctggaaaagtttcagaatctaacctatctggaacaacagcttgaggaccatcacaggatggagcaggagaggtttgaggaggccaagaataccctgtgcctgattcaaaataagctgaaggaggaagagaagcggttactcaagtccgggagcaacgatgactcagacatcgatatccaagaggacgacgagagtgacagcgagctggaagagaggagactccctaagccccagactgcaatggaaatgctgatgcagggaagacccggtaagagaattgtggggaccatgcagggaggcgactctgacgataatgaggactctgaagagtcagagatcgatatggaggatgacgacgacgaggacgatgacctggaggatgaatctatcagcttgagtcccacaaagcctaaccgaagggttagaaaaagcgaacccctagacgaatctgacaacgacttttag

SEQ ID NO: 11551 - DNA, 1116 bp, Artificial Sequence
  Description of Artificial Sequence: Synthetic coding sequence
atggccgcagctgccgccggattaggggggggcggcgctggcccagggccagaagccggagattttttggcgcgttaccggctggtgtccaataagctgaaaaagaggttcctgcggaaaccaaatgtggccgaggccggagaacagtttggacagctcggccgtgagttacgcgctcaggagtgtctaccttacgcagcttggtgtcaactggcggtggcccgatgtcagcaggctctctttcacggtcctggtgaggccctcgcactgaccgaggccgcacggctctttctccggcaggaacgggacgccagacagagactggtttgccctgctgcatatggagaaccacttcaagccgcggcgtctgcgctgggtgccgcagtgcgtctgcacttggagttaggtcaaccggcggctgcagccgctttgtgtctcgagctggccgctgccctgcgggacctcgggcagcccgccgctgcagcaggccatttccaacgggctgctcagctccagctaccacaattgccacttgcagctctgcaggcactgggggaggccgcaagttgtcagcttctggcccgggattacaccggcgcccttgcagtgttcacaagaatgcagagactggcacgggaacacggctctcacccagttcaaagcctccccccccccccccccccagccccacaacccggccccggtgctactccggcgctgccagcagcattgctcccccctaacagtggatcagccgctcccagccccgccgcgctgggcgccttttcagacgtactcgttagatgcgaagtctcacgggtgcttctgctcctcctcctccagccaccacccgctaagttactcccagagcacgcccaaaccctggaaaagtattcttgggaagccttcgactcacacggccaggagtccagcggccaactgccggaggagctgttcctcttgctgcaaagccttgtcatggcgacacacgagaaggacaccgaagccattaagagcctccaggttgagatgtggcccctgctcacagcggaacagaaccaccttctgcatctggtgctgcaggagaccatcagcccttccggtcagggagtgtag

SEQ ID NO: 11552 - DNA, 1116 bp, Artificial Sequence
  Description of Artificial Sequence: Synthetic coding sequence
atggcagccgccgccgctgggctgggtggtggcggcgcagggccggggcccgaggcgggcgattttcttgctaggtacaggttggtctcaaataagctcaagaaacgattccttcggaaacccaatgtggctgaggccggcgagcagttcggtcagttgggtcgggagctaagagcccaggaatgtctgccctatgctgcctggtgtcaactcgccgttgctagatgtcagcaggccctgtttcatggccctggagaggccctggcacttacagaagctgctaggcttttcctgcggcaggagagggacgcccgtcagagactggtgtgccccgccgcgtacggagagccccttcaggcagccgcttccgctctcggcgcagccgtgaggctgcatctggagctaggtcaacccgctgcggcagcggctctgtgcctggagctcgcagcggcattacgcgacctcgggcagcccgctgccgccgctggacactttcagagagcagcccagttgcagctgccccaattaccccttgcggctctgcaggcactgggcgaggccgcttcatgtcagctactcgcgcgcgactatacaggagctctggctgtctttacacggatgcagaggctggccagggaacacgggtctcatccagttcagagcctccccccacccccaccccctgctcctcagcctgggcccggcgccacccccgcgcttcccgcggcactgttgcctcccaattccggaagcgcagccccttcccccgccgccctgggagctttctcagacgtattggtgaggtgcgaagtctccagagtgctgctgctgttgctcctccagccccccccagcgaaattgttgcccgagcatgctcagacactggagaaatactcctgggaagctttcgattcccacgggcaggaatctagcggtcagttaccagaagaactcttcctcttgctgcaatcgctggtcatggcaactcatgagaaggataccgaagccatcaagagcttacaagtggagatgtggcctctgttgaccgccgagcagaaccacctgttgcacctggtgctgcaggaaaccatcagtccatctgggcagggcgtttag

SEQ ID NO: 11553 - DNA, 1116 bp, Artificial Sequence
  Description of Artificial Sequence: Synthetic coding sequence
atggctgccgccgcagccgggttgggcggagggggcgccgggccgggaccggaggccggtgattttttagcgcggtaccgtcttgtctccaataaacttaaaaagcgcttcctgagaaagcccaacgttgcagaagccggggagcagtttggccagctcggccgggaactgcgggcacaggagtgcctgccttatgccgcgtggtgccaattagccgtggcaaggtgtcaacaagcacttttccacggcccaggtgaggccttggctctcacagaggctgcccggctttttcttcgccaggagcgggatgctcgccagaggctggtgtgccctgcggcatacggcgagccgttacaggccgccgcatctgccctcggggcagccgtcagattgcacctagagctcggacagcctgccgctgcagccgcactgtgtctggagttggctgccgctcttagggacctgggtcagccagccgccgctgctggccacttccaaagggccgcacagttgcagctcccccagctgccgttggccgcgctacaggcgctgggcgaagccgcttcatgtcagctcctggcccgagattataccggtgccttggcagtgtttactcggatgcagcggctggcccgtgaacatgggagtcaccccgttcagagcctaccccctccgccaccccctgctccacaacctggccctggagccacgccggcacttccggctgctttgttgcctcccaatagcggatcagctgccccttcccctgccgcccttggtgccttctctgacgttctggtacgatgcgaagtctcgagagtgttgctcctgctgctgttgcagccaccccctgccaagttattacccgaacatgcccaaacgctggaaaagtactcctgggaggccttcgactcccacggccaggagagcagcgggcagctgcctgaggagctgtttcttctcctccagtctctcgtaatggcaacgcatgaaaaagacaccgaggccatcaaaagtttgcaggtcgaaatgtggcctctgctgaccgctgagcagaatcacctgttacacctggtcctgcaagaaaccataagcccctccggccagggggtctag

SEQ ID NO: 11554 - DNA, 2502 bp, Artificial Sequence
  Description of Artificial Sequence: Synthetic coding sequence
atgagtccagaaaaacaacaccgggaagaagatgaggtcgattcagtcttgctctctgcttccaagatactgaacagttctgaaggtgttaaagaatcagggtgttcagacaccgagtacggatgcatagctgagtctgagaaccagatccagcctcagtcagccctaaaggtgctgcaacagcagctcgagtcatttcaggccctgaggatgcaaacccttcagaacgtgagcatggtgcagagtgagatctctgaaatactcaataaaagcattattgaggtcgaaaacccgcagttcagtagtgaaaaaaacctggtatttggaactcggatcgaaaaggacctgcccacagaaaaccaggaggaaaacctgagtatggaaaaatcccatcactttgaagactctaaaaccctgcattcggtcgaggagaaactgagcggggacagcgttaactccctccctcagagtgtaaacgtaccatcacagatacactcagaggacactctgacactgcggacttctaccgacaacctgtcgtcaaatattatcatccacccgagtgaaaactccgatattctgaaaaattataataacttttaccgctttctcccaaccgctccacccaacgtgatgagccaggcagatactgttatcctggataaatcgaagattaccgtcccgtttcttaagcacggattttgtgaaaatctggacgatatttgccattcgattaagcagatgaaagaggaacttcaaaaaagccatgacggagaagtcgccttaacgaatgaactgcagaccctccagacagaccccgatgtgcacagaaatgggaagtacgatatgagcccaatccaccaggataagatgaatttcataaaggaggagaacctggatggcaatctgaatgaggatattaagtctaagcgaatcagcgagctcgaggccctggtgaaaaaactactcccatttcgggaaacggtgagcaagttccacgttcatttctgcagaaagtgtaaaaagctatcaaagagcgagatgcatcgcggcaagaaaaatgagaagaacaacaaggagatccccatcactggcaaaaacattactgatctgaagttccactccagagtgccccgctacaccttgtcatttttagatcagactaaacacgaaatgaaagataaagaacgccaacccttcctcgttaagcaggggtctatcatctctgagaacgaaaaaacctccaaggtgaacagtgttaccgaacagtgcgttgcaaaaatacagtatctgcagaattacctcaaagaaagtgtgcagatccagaaaaaggtcatggagctggaaagcgaaaacctgaatttgaaaagtaaaatgaaacctttgatattcacgacacagtccttgatacagaaagtggaaacgtacgagaagcagctcaaaaatttagtggaagagaaatcgacgattcagagcaagctgagtaagaccgaggagtactctaaggaatgcctcaaggaattcaagaaaatcatttccaaatacaatgttctgcaagggcagaataaaactctggaagagaagaatatccagctgtccctggagaaacagcagatgatggaagctttggatcagttaaaaagtaaagagcacaagacccagtccgacatggcaattgtcaataatgaaaataaccggatgtctatcgagatggaggccatgaagaccaatatcctgctgattcaggatgagaaggagatgcttgaaaagaagacacaccagctccttaaggaaaaaagcagcttgggcaatgaactcaaggaatctcagctggagatcatacaactcaaggagaaggaacggctagccaaaaccgaacaagagactcttctgcagatcatcgaaacggtgaaggacgagaagctgaatctggagacaacactccaggagagtacagccgcgcggcaaattatggaacgtgaaatcgagaacattcaaacataccagtccacagccgaggagaacttcctgcaggaaataaagaatgccaagtccgaggcctccatctacaagaattcactcagcgaaattggaaaggaatgcgaaatgctgtcaaaaatggttatggagactaaaactgacaaccaaattctgaaggaggaactcaaaaagcactctcaggagaacatcaagtttgagaactcaatcagcaggctcaccgaggacaaaatcctcttggaaaattatgtacggtcaattgagaatgagagagacacactcgagttcgagatgcggcacctccagcgggagtacctgtccctcagtgacaagatttgcaatcagcataacgatccttccaaaacaacctatatcagcaggcgagaaaagtttcactttgataactatactcacgaagacacaagctcaccgcaatccaggccactcgcctccgacctcaagggatatttcaaagtgaaggatagaaccctgaaacatcattag

SEQ ID NO: 11555 - DNA, 2391 bp, Artificial Sequence
  Description of Artificial Sequence: Synthetic coding sequence
atgtctcctgaaaagcagcaccgggaggaagacgaggtggactctgtcctgttaagcgcctcaaaaatactgaacagcagcgagggcgtgaaggaaagcgggtgcagcgatacagaatacggatgcattgcagagagcgagaaccagattcagccccagtctgctctcaaggtcctacagcagcagctagaaagttttcaggctctgcgcatgcaaactctgcagaacgtctcgatgccaacagagaaccaggaggagaacctgtccatggagaagagtcatcactttgaagatagtaagactctgcatagtgtggaagaaaaattgagcggagacagtgtgaactctctgccacaatccgtcaatgtaccatcccaaatacacagcgaggatacacttaccctgagaacctcaaccgataacctttccagcaatatcataatacatccatcagagaacagcgacattctgaaaaactacaataacttctacaggttccttccaacagctcccccgaacgtcatgtcccaggctgacaccgtgattcttgataaaagcaaaattactgtgccgttcctaaaacacgggttttgtgagaacctggatgacatatgccactcgattaagcagatgaaagaagagctgcaaaagtcccatgatggcgaagtcgccctaactaacgaacttcagactcttcaaactgaccctgacgtgcacaggaacggaaagtatgacatgtcccccatccaccaggacaaaatgaatttcattaaggaggagaatctagacggaaaccttaacgaggacatcaaatcgaaacgaatctccgaactggaagctcttgtgaagaagctgcttccctttagggagaccgtcagcaagtttcacgtgcacttttgtaggaagtgcaaaaaactttctaagagcgagatgcaccgaggaaaaaaaaacgaaaagaataataaggagatcccaattacaggcaagaacattacggatctgaaatttcacagtcgcgtgcccagatataccctgagtttcctggaccagacaaagcacgaaatgaaagataaagaaaggcagccatttcttgtgaaacaaggaagcataatttctgagaacgagaagacttcaaaagttaatagcgtcactgaacagtgtgtcgctaagatacagtatctacagaactacctcaaggagtcggtccagatacagaaaaaggtgatggagcttgaaagtgaaaacctgaacctgaagagcaaaatgaagcccctcatttttactacccagagcctgattcagaaggtcgagacctatgaaaaacagctcaagaatctggtggaggaaaagtcaaccattcagtccaagttaagcaagactgaagagtactcaaaggaatgccttaaggaattcaaaaaaataatttcaaaatacaacgttttgcagggccagaacaaaaccctggaggagaagaatattcagctgtcactcgagaaacaacagatgatggaagctctcgatcagcttaaatcaaaggaacataaaacccagtctgacatggctattgtgaataacgaaaataaccgaatgagcattgagatggaggccatgaaaacaaatatcttgttaattcaggatgagaaagagatgcttgagaaaaagactcaccagctcctcaaagagaaatccagcttgggcaacgagctgaaggagtcccagctcgaaattattcagctcaaagagaaggagagattggcgaaaactgaacaggaaacactgctgcaaatcattgagacggtaaaggacgaaaagctcaatctcgaaaccacactgcaggagagtaccgctgcgagacagattatggagcgggaaatagaaaatatccagacatatcagtctactgccgaagaaaatttcctgcaggaaataaagaacgcaaaaagcgaagcatcgatttataaaaattcattgtctgagatcgggaaagaatgtgagatgttgtccaaaatggtaatggagactaagactgacaaccaaattttaaaagaggaactcaagaaacactctcaggaaaacatcaagttcgagaatagtatctcacgcttaacagaggacaagattttgctagagaattacgtgagaagcatcgaaaacgaacgggacaccctggagttcgagatgcgccacctccaacgtgaatatctgagcctttcggataagatatgcaatcaacataatgacccctctaagacgacctatatttcccggcgagagaagttccacttcgataattacacccatgaggacaccagctccccccagtctcgccccctggcctctgatctgaagggctatttcaaggttaaagacagaactctgaagcatcactag

SEQ ID NO: 11556 - DNA, 726 bp, Artificial Sequence
  Description of Artificial Sequence: Synthetic coding sequence
atggccccagtacggagatctgcaaagtggcgccccggaggtatcgaggctcgaggagaaggcgtgagtacagtggggtaccgtaacaagaacgtccgccagaagacttggcgtcccaaccatccccaggcttttgtgggcagtgtccgcgaaggacaaggattcgccttcagaagaaaactgaaaatccagcaaagctataaaaaactgttaagaaaagagaagaaggcccagaccagccttgaatcccagtttaccgaccgttacccggataatctgaagcacctatacttggctgaggaggagagacaccggaagcaagcccggaaagtggaccacccactgtcagaacaggttcaccaaccactgctcgaagagcaatgttctatcgacgaaccgctcttcgaagatcagtgctcattcgatcaacctcaaccagaagaacagtgtatcaagactgtcaactccttcacaattcccaagaagaataagaaaaaaactagcaatcagaaagctcaggaagagtatgaacagatacaagctaaacgggccgccaagaagcaggagttcgagcgtagaaagcaggagagggaggaagcacaacgccaatacaaaaaaaagaaaatggaggtctttaagatcctcaacaagaaaaccaagaaaggtcaaccgaacctgaatgttcaaatggaataccttctccagaaaatccaggagaaatgctag

SEQ ID NO: 11557 - DNA, 888 bp, Artificial Sequence
  Description of Artificial Sequence: Synthetic coding sequence
atggaacatcagctcctgtgttgcgaggtggagacaatccggcgggcctaccccgacgccaacttactaaatgaccgggtcctaagagcaatgctgaaagcggaggagacctgtgccccatctgtatcatatttcaagtgtgtccaaaaggaggtgctcccctccatgcgaaaaatcgttgctacctggatgcttgaagtatgtgaggaacaaaagtgcgaagaggaggtcttccctctagcgatgaactatctcgatcggttcctgtccctggaacctgtaaaaaaatcacgcctccagcttcttggagccacttgcatgttcgtcgcctctaagatgaaggaaacaattcctctcactgcagaaaagctgtgtatttacactgacaacagcatacgccctgaagaactgctccagatggagttgcttcttgtgaacaaacttaaatggaacctagctgccatgacaccccacgactttattgagcattttttgagtaagatgccagaagccgaggaaaacaagcagattatccggaaacacgcccagacgtttgtggccctttgcgccacggatgtgaagttcatctccaatcccccttccatggtcgcagccggatctgtcgtagctgctgttcagggtctcaaccttaggtctccaaacaacttcctctcctattacaggcttactcggttcttaagccgggtgattaagtgcgaccccgactgtctaagagcttgccaggagcagattgaggcgctactcgaaagctccttacgccaggcacagcaaaacatggaccctaaggcagcagaggaggaggaagaagaagaggaggaagtggacctcgcttgcactcccaccgatgttcgggatgttgatatttag

SEQ ID NO: 11558 - DNA, 492 bp, Artificial Sequence
  Description of Artificial Sequence: Synthetic coding sequence
atggacacaccattacgccgaagcaggcgactgggcggcctgcgtcccgaatcccccgagagtctgacaagcgtatctcggacaagaagagcgctggtggagtttgagtctaatcctgaagagacaagagagccagggagtccaccctccgttcagcgggctggccttggaagccctgaaagacctcctaagacctcgcccggctctcctcggcttcaacagggagcaggactggaatcaccccagggtcaacctgagcctggagccgccagtccacagcgccagcaagaccttcaccttgaaagcccccagaacaaggaggaactgacgcctggggccccccagcaccagctgccaccggtcccaggttcccctgaaccttaccctggccagcaggccacttctagctggggtgatggcgatcgccgcctgagagggaaggaggcaaaacggttttttatcccgggcccgtccgtgcaagaggtggaatag

SEQ ID NO: 11559 - DNA, 315 bp, Artificial Sequence
  Description of Artificial Sequence: Synthetic coding sequence
atgctgcaggataagcccctccggacatcttggcaaagaaagatgaaagagcggcaggagcgaaaactagcgaaagactttgctaggcatttggaagaggagaaagaaagaaggagacaagagaagaagcaacggagggccgagaatctgaagcggagactcgagaatgagaggaaggctgaagtggtgcaggtgatacgtaaccccgcaaagttgaagcgagctaagaagaagcagctcaggagcatcgagaagcgagataccctcgctttgctccagaagcagcctccacagcaaccggctgccaaaatttag

SEQ ID NO: 11560 - DNA, 819 bp, Artificial Sequence
  Description of Artificial Sequence: Synthetic coding sequence
atggaagaggaggctattgctagtctccccggagaggaaaccgaggacatggatttcctgagtggactcgagctcgcagacctcctcgacccacgccagcccgactggcacttggacccagggctctcttccccgggacctctgtcatcttccggcggagggtcagactcaggaggactgtggagaggggatgacgacgacgaggccgccgcggctgagatgcaaagatttagcgacctgctgcaaaggcttctcaacggcatagggggctgtagcagctctagcgactccggatccgcggaaaaacggaggcgtaagtcgcccggtggcggcggtgggggtggttccggaaacgacaacaatcaggctgccaccaagagcccccggaaggcagccgctgcggcggcacgtttgaaccgtctcaagaagaaagaatacgttatgggcctcgagagtcgcgtgcgggggctcgccgccgaaaaccaggagctccgcgccgagaatcgggagctcggcaagcgagtgcaggctctgcaggaagaaagtcgctacctcagagcagtgctcgcgaacgagacgggcttggcccggctgttgagtaggctctccggagtgggtctgagactcaccacttctttgttcagagacagccctgctggcgatcatgattacgcgttgccagtggggaaacagaagcaagaccttttggaggaagatgactccgctggcggagtgtgcttacatgtagacaaggataaggtgagtgtcgagttttgcagtgcctgcgcacgcaaagcctcctccagtctcaagatgtag

SEQ ID NO: 11561 - DNA, 1065 bp, Artificial Sequence
  Description of Artificial Sequence: Synthetic coding sequence
atgcgtcactcactcacgaaactgctggctgctagcggtagtaattcccccacgcggagcgaatctcctgagcccgccgcaacctgtagcctcccgtccgatctcacacgcgctgctgcgggagaggaggagaccgccgctgccgggagcccagggcggaaacagcagttcggggacgagggggaattagaggctggccggggaagccgaggtggagtggccgtcagagccccttcaccagaggagatggaagaggaggcaatagcctccctgcctggcgaagagaccgaggacatggactttttgagcggccttgagctcgcagatttgctggaccctagacagcctgattggcacttggacccggggcttagctcacctggcccgctgagctcaagtgggggaggatccgactctggtggcctttggagaggcgatgacgacgatgaggctgccgcggcagagatgcagaggtttagcgacctccttcagagactgctcaacgggatcggcggctgttcatcttcctctgactctggttctgctgaaaaacgtaggaggaaatccccggggggaggcggggggggaggcagcggcaacgataataaccaggcggctaccaagtcacccagaaaggccgcagccgccgcggcccggttgaatcgactgaaaaagaaggaatacgtgatggggctggaaagtcgcgtgcgggggttagctgctgagaaccaggagctgagggctgagaacagagagttgggaaagcgcgttcaggccctgcaagaggagagcagataccttagagcggttctggccaacgaaacaggtctagccagactgctgtcccggttgtccggtgttgggctgcgccttacaaccagcttgttcagggacagtcctgccggagatcacgactatgccctcccggttggtaaacagaaacaagacctgctagaggaggatgattccgctggtggcgtctgcctccatgtggataaagacaaggtttccgtcgaattttgttccgcatgcgctagaaaagcgagtagctctctgaagatgtag

SEQ ID NO: 11562 - DNA, 1065 bp, Artificial Sequence
  Description of Artificial Sequence: Synthetic coding sequence
atgagacacagcctgactaagctgctggccgcttcaggcagtaattcacccacacggtcagaatctccagagcccgctgcaacttgcagcttaccgagtgatttaacaagagccgccgcaggggaagaggagactgcagccgcgggcagcccgggccgtaagcagcaattcggggacgagggggaacttgaagccgggcgtgggagccggggtggtgtagccgtgagggctccttcccctgaagaaatggaggaggaggccattgctagtcttccgggtgaggagactgaagatatggacttcctgtctggcctggagctggctgaccttctggaccctcggcagccggattggcatctggaccctggcctctcctccccgggaccactgtcgagctccgggggtgggagtgacagtggtggtctctggaggggggatgacgacgacgaggccgcggccgccgagatgcagagattttcagacctcctgcagcgcttgctaaatggtataggagggtgttcgtcctcttccgactcaggcagtgcagagaagcgacgtagaaagtcacctggtggagggggaggaggcggatcggggaacgacaacaatcaggctgccacaaagagtcctagaaaagcagcagcagctgccgcacggcttaacagactcaaaaagaaggagtacgtaatgggtctcgagagccgggtccgcggcttggctgccgaaaatcaggagctgagagccgaaaaccgtgagttagggaagcgcgtgcaagctctgcaggaggaatcacgctatctgcgagccgtgctggcaaatgaaaccggcctcgcccgcttattgtctcgcctaagcggagtgggactgagattaactacgtctctttttcgggattccccagccggcgaccatgactacgctctgcctgtgggcaagcaaaagcaggacttattagaagaagacgatagtgcggggggtgtctgcctgcacgttgacaaagataaagtgtccgtggaattctgttccgcctgcgctcgtaaggcttcaagctcccttaagatgtag

SEQ ID NO: 11563 - DNA, 816 bp, Artificial Sequence
  Description of Artificial Sequence: Synthetic coding sequence
atggagcacggttccattatcacacaggcacggagggaggatgcactggttcttacaaagcaagggctagtgtcaaaatcttccccaaaaaagcctcggggaaggaatattttcaaggcactgttttgttgttttagagcacagcatgtgggacagtcatcatcctctacagagctggcagcatataaggaggaagccaatacgatagcaaaaagtgacttacttcaatgcctgcagtatcagttttaccagataccgggcacgtgcttactcccggaagtcaccgaggaagatcagggccggatttgcgtggtcatagatcttgatgagaccctcgtgcattcttcatttaagcccattaataacgccgatttcatcgtccccattgagatcgaaggcacaacccatcaggtttacgtgctgaagaggccatatgttgatgagttccttcgccgaatgggcgagctgtttgagtgtgtattgtttacagcctccctggctaagtacgccgaccccgtcaccgatcttttggatcggtgcggggttttccgggcccgtttgtttcgggaatcatgcgtgtttcaccagggctgttacgttaaggatttatcacggctcggaagggacctgcgtaagacactaattctagataacagtcccgcgagctacatcttccaccctgagaatgccgtgccagtacagagctggttcgacgacatggctgatacagaactactcaatctcattcctatattcgaggagctctctggagcagaggatgtgtacacctcccttgggcaactccgcgctccttag

SEQ ID NO: 11564 - DNA, 831 bp, Artificial Sequence
  Description of Artificial Sequence: Synthetic coding sequence
atggatggtcctgctattattacccaagtcacgaaccctaaggaagacgagggccgcctgcctggggccggcgaaaaagcaagccagtgtaacgttagtctgaagaagcagcggtcgagatcaatcctgagctcttttttctgttgctttcgagattacaacgtggaagctcctccaccatccagtccaagtgtcctgcctccgttggtcgaagagaacgggggcctacaaaagggcgaccagaggcaggttatcccaatcccctcacctcccgctaaatacttactgccggaggtgactgtgcttgattacggcaaaaagtgcgttgtcatcgatctcgacgagacccttgtgcactcgtctttcaaacccatctcaaacgcagacttcatagtacctgtggagatcgacggcaccatccaccaggtgtacgttctcaagcggccacatgtcgatgagtttctgcagaggatgggacagctcttcgaatgtgtcctttttacggcctctctagcaaaatacgcagatcccgtagccgatcttttggacaggtggggggttttccgagcgaggctcttccgagagtcatgtgtgtttcaccgcggtaactacgtaaaagacctatcacgtctgggcagggagctttccaaagttattattgtggacaacagcccggcatcttacattttccatcctgaaaatgcagtcccggtccagtcctggttcgatgacatgactgacacagagttgctggatttgatccccttcttcgagggattgagtcgagaagatgatgtgtacagtatgctccacagactgtgtaatagatag

SEQ ID NO: 11565 - DNA, 798 bp, Artificial Sequence
  Description of Artificial Sequence: Synthetic coding sequence
atggatggcccagctatcattactcaagtcaccaatcccaaagaggatgagggcaggctgcctggagcaggcgaaaaagcctctcaatgtaatgtgagtctgaagaagcagcgctccagatctattctctcgtcattcttctgctgttttcgcgactataatgtggaggccccccccccatcctctccctcagtgctacctccgctagtcgaagagaacgggggcctgcagaaaccgcccgccaaatatctcctgcccgaagtcaccgtgctcgactacggaaagaagtgtgtggtgattgaccttgatgagaccctggtacactcatcctttaagcccattagcaatgccgacttcatcgtccccgtcgagattgacggcacaattcatcaggtttacgtactcaagcggccccatgtggacgagttcctccagcgtatggggcagttgttcgagtgcgttttgttcacagcttcattggcaaaatatgctgatcccgtagccgacctccttgataggtggggggtcttccgggctcgtttgttccgtgaatcctgcgttttccacagaggcaattacgtgaaggatttatctcggctgggcagagagctatcgaaggtcataattgtggacaactcaccagcaagctatatctttcatcctgagaacgcagttccagtccaatcgtggtttgacgacatgacagataccgagttgctagacctgatccccttcttcgagggactaagtcgtgaagatgacgtatattccatgctacaccggctctgtaacagatag

SEQ ID NO: 11566 - DNA, 3522 bp, Artificial Sequence
  Description of Artificial Sequence: Synthetic coding sequence
atgagtcgtggctctatagagattccgctgagggatacagacgaggtcatcgaacttgactttgaccagctcccagagggcgatgaagttataagcattctcaagcaggaacatactcagctgcatatctggatcgctctcgctttggaatactacaaacaaggaaaaactgaagagttcgttaaattgctcgaggccgctagaatcgatggcaatctcgattaccgcgatcatgaaaaggatcagatgacctgccttgatacactggctgcttattacgtgcaacaggcacgtaaggaaaagaacaaagataacaagaaggatctgatcacccaggccacactcttatataccatggctgacaaaatcatcatgtacgaccagaaccacctgttgggccgcgcctgcttctgtctgctggagggcgacaaaatggaccaagcagacgctcagttccattttgtccttaaccagtctcctaacaatatccccgctctgctgggcaaggcttgtatctctttcaataagaaggattaccggggtgccctggcctactacaagaaagccctgagaactaacccggggtgccctgctgaggtaaggcttggcatgggccactgcttcgtgaagctgaacaagttggaaaaagcgcgcctggccttctctcgggcactggaactgaactctaaatgtgtcggggcactggttggtctggcagtgctggagctgaacaacaaggaagcggatagtattaagaatggcgtgcagttgctgtcccgagcttacaccatcgacccctctaacccaatggttcttaaccatctcgccaaccacttcttcttcaagaaggactacagcaaggtgcagcatttggcattgcacgcgttccacaacactgaggtggaggccatgcaggctgaaagctgttatcagctagcccgcagctttcatgtgcaggaggactatgaccaggcatttcagtactactatcaagccacccagttcgcatcatctagcttcgtacttccctttttcgggttgggccagatgtatatctatcgcggcgacaaggaaaacgcctctcagtgctttgaaaaggtgttaaaggcctatccaaataattatgagacaatgaaaattcttgggtctctctacgccgcatccgaggatcaggagaaacgcgacatcgcaaaaggccatctgaaaaaagttaccgaacagtatccagacgatgtggaggcctggatagaactggcgcaaatactggagcagactgacattcagggtgccctgagtgcctatggtactgccacccgcattctgcaggaaaaggttcaagccgacgtgccgcctgaaattcttaataatgtgggggctctgcattttcgactgggaaatcttggcgaggcgaaaaaatactttctggcctcactggacagagccaaagccgaagccgagcatgacgagcattattacaatgccatttccgtcaccacatcgtacaacttagcaagactttatgaagctatgtgcgaattccacgaggctgaaaaactgtacaagaatattctgcgggaacatcccaattatgttgactgctatctccggctgggtgctatggcgcgtgataagggtaacttctacgaagccagcgattggttcaaggaggccctccaaatcaatcaggaccatcctgatgcatggtccctcatcgggaatctgcacttagcaaaacaggagtgggggccaggacaaaaaaaattcgaacgcattctgaagcagccctcgacacagtctgacacctactccatgctggcactgggcaatgtgtggctgcagacacttcatcaacctacacgcgatagggagaaggagaagaggcaccaggaccgggccctggcaatatataaacaggtgctccgcaacgacgccaaaaacctttatgcagctaatggaattggggccgtgcttgcacataaggggtatttccgggaggcgcgcgacgtattcgcgcaggttcgcgaagctacggccgatattagtgatgtatggctgaatttagctcatatctacgtggagcagaagcaatacatttcggccgtgcagatgtacgaaaactgcctgcgcaaattctacaagcatcagaatacagaggttgttctatatctggcccgagccctgtttaaatgcggaaagctgcaggagtgtaagcaaaccctgttaaaggcgaggcacgtggctccctcagatactgtgttaatgtttaatgtcgccttggtcttgcagaggctagccacttcagtgctgaaggacgagaagtctaacttgaaagaggtgctgaacgctgtcaaggagttggagttggcccatcgatatttttcctacttgtccaaggtgggagacaagatgagattcgatctcgcactcgcagcgacggaggcccggcagtgctctgaccttctgagtcaagcccaatatcacgtggcacgggctcgaaagcaagacgaggaagagcgggaactccgagcaaagcaggagcaggaaaaggagttgttaaggcagaagcttctgaaggagcaggaagagaagaggcttcgagagaaggaagagcagaagaagctcctggaacagcgcgcacaatatgtggaaaagacaaaaaacattcttatgtttacaggcgaaactgaggcaacgaaagagaagaagcggggtgggggcggaggaaggcggagtaaaaaaggcggcgaatttgacgaattcgtaaatgacgataccgacgacgatctgcctatcagtaaaaagaagaagaggagaaaggggagcggttctgaacaggaaggcgaagacgaggagggcggcgagcggaagaagaagaaaagacgccggcatcccaagggcgaggaaggatcagatgatgacgaaactgagaacggtcccaaacccaagaaaaggcgaccccccaaagccgagaagaagaaggcgcctaagccggaacgattgccgccttccatgaagggcaagattaagagtaaggccataatctcctctagcgacgatagttcagacgaagacaagctcaagatcgccgatgaggggcacccacggaactccaactcaaattccgactcagacgaggacgaacagagaaaaaagtgtgcgtcatctgaatctgactctgatgagaatcaaaataaaagcggctccgaggctgggagccctcgcaggcctcgccggcagcggagcgaccaggattccgactcggaccagccgtcacggaaacggaggccttctgggagcgagcaatccgataatgaaagcgtacaatccggccgcagtcattccggtgtgtctgaaaatgactctcggccagcatctccttccgctgagtctgaccacgagtctgagaggggaagcgataacgaaggctccggccagggaagcgggaacgagtcagagcctgaggggtcaaataatgaggccagcgaccgtgggtcggaacatggcagcgatgattctgattag

SEQ ID NO: 11567 - DNA, 3693 bp, Artificial Sequence
  Description of Artificial Sequence: Synthetic coding sequence
atggcctctgctagctaccatatcagtaatctcctggaaaaaatgacttcaagtgataaagatttcaggtttatggccacgaacgatcttatgacagagctacagaaagactccatcaaactggatgacgatagcgaaagaaaagttgtgaaaatgatccttaagcttttggaggataaaaatggggaggttcaaaatttggccgtcaaatgcctgggtccgctggtgtccaaggtaaaggagtaccaggtagaaactatcgtcgatacgctgtgcacaaacatgctgagtgataaggagcagttacgagatatttcatcaattggcctcaagaccgtcataggggagctccccccagcctcgtccggcagtgcactcgctgccaatgtgtgtaaaaagatcacaggacggctgactagcgccatcgcaaagcaagaggatgtaagcgtgcagctggaggccttggacataatggcggacatgctgtctcgacagggcggcctactggtgaatttccatcctagcatcctgacctgtctcctgccacaactgacctccccgcggctcgcggtccggaagagaacaatcatcgcactcggacacttagtgatgagttgtggcaatattgttttcgttgatctgattgaacaccttctctctgaactgtcaaagaacgattccatgtctacgaccagaacctatatccagtgtattgccgccatttcaagacaggccgggcataggattggcgagtatctggaaaagataattccactggtagtcaagttctgtaatgtggacgacgatgagctgagggagtactgcatacaggccttcgaatcctttgttaggagatgtccaaaagaagtgtatccccatgtgtctacaattattaacatctgcttgaagtatctcacttatgacccgaattacaattatgacgacgaggatgaagacgaaaacgctatggacgccgatggaggggatgacgacgatcagggtagcgacgacgagtattccgatgacgacgatatgagctggaaggtccgcagagcggccgccaagtgtctcgatgccgtggtgtctacccgccatgagatgctcccagaattttacaagactgtgagtcccgctcttatttcacgcttcaaagaacgagaggagaatgtgaaagccgatgtcttccatgcctatctgtctctgctgaagcagactcggccagttcagtcctggctgtgtgaccctgacgccatggagcagggagaaacccctctcacaatgctgcaatctcaggttcccaatatcgtcaaggccttgcacaagcaaatgaaggagaaatccgtcaaaacacggcagtgttgttttaatatgctgaccgaactggtgaacgtcttgcccggagcattgacgcaacatattcctgtcttggtcccgggaatcatattttctcttaatgataagtctagttcctctaacctgaaaatcgacgccctcagctgtctgtatgtgatactctgtaatcatagcccgcaggtgtttcaccctcatgttcaggcactagtgccaccagtcgtggcttgcgtgggtgaccccttttataaaatcacgagtgaggctctgctggtgactcagcagctggtcaaggtgatccggcctttggatcagccctccagtttcgacgccactccatatataaaggatctgttcacctgcacgattaagagactgaaggccgccgatattgatcaggaggttaaggaacgcgccatcagttgcatgggccagatcatctgcaacctgggagacaatctcggctcagacctgccgaacacacttcagattttcctcgagagactgaaaaatgaaattacacggctcacaacagtcaaagctttgacgctcatcgccggcagtccactcaaaatcgatctcagacctgtattgggggaaggcgtgcctatcctggccagctttcttaggaagaatcaaagagccctgaaattagggactctgtccgccctagacatcctgattaagaactattctgacagcctgacagcggctatgatcgacgctgtattggacgagcttccacctctgattagtgaatctgatatgcacgtctcacagatggctatcagctttctgacaaccctcgccaaggtgtacccaagtagcctgtccaaaatctccgggtcaatcttgaacgagttaatcggactggtgaggtccccactgctccaggggggagccttatctgcaatgctagacttcttccaggcactggtggttactggcaccaacaacttgggctatatggatctgctcaggatgttaaccgggccagtctacagtcagtccacagcactcacacacaaacagagttattactccatagctaaatgcgttgcggccctcactagagcctgtcctaaggagggaccggccgtggtaggtcaatttattcaggatgtaaagaactctcggtctactgacagtattagactgctggccctgctgtccctgggagaagtcgggcaccacatagacctttccggccagctggaattgaaatcagtgattctcgaggcttttagttcaccttcagaggaggtgaaaagcgcagcaagctacgctctcggctcaatctccgtaggaaacctgcccgagtatctaccgtttgtgctccaggagattacttcgcagccaaagcggcaatacctgttgctgcactctctcaaagaaattattagtagcgcgtctgtggtgggtttgaaaccatacgttgaaaacatctgggcgctgctgctcaaacactgcgagtgcgccgaagaaggtaccagaaacgtggttgctgagtgtctcgggaagcttacactgattgacccagaaacactgttacctcgtctgaaaggatatttgatttctgggtccagctatgccaggtcatccgtcgttaccgcagtgaagtttaccatttcagatcaccctcaacctatcgatccccttcttaagaactgcatcggcgatttcctgaaaacactagaggatcccgaccttaacgtaagaagagtggccctggtcacattcaactctgcagcccataataagccatccctgattagggacttgttggataccgtgctgcctcacctatataacgagactaaagtaagaaaggagcttatacgtgaagtggagatgggaccgtttaaacacaccgtggacgatggcttggacattaggaaagccgcattcgagtgtatgtataccctcttggacagctgtttggaccgtcttgatatcttcgaatttcttaaccatgtcgaagacggcttaaaggatcactacgatatcaaaatgctgacattcctcatgttggttagactttccaccctttgcccctccgcggttcttcaaagactcgatcggttagttgaaccgttgcgcgctacttgtaccacaaaagtaaaagcaaatagcgtgaaacaagaattcgaaaaacaggacgagctcaaaaggagtgcaatgagagctgttgcagccctgctgaccatccctgaagccgagaagagtcctcttatgagtgaattccagtcccaaatcagcagcaatccggagctggctgcgatttttgaatcgatccagaaggattcttcctcaaccaatctggagtcgatggatacctcttag

SEQ ID NO: 11568 - DNA, 1209 bp, Artificial Sequence
  Description of Artificial Sequence: Synthetic coding sequence
tatgagttggtctcacggcaaggaggcctcctcgtcaactttcacccttccatactgacctgcctcctcccccagctcacaagtccacgactcgccgtgaggaaaaggaccatcatcgccctggggcatctggtcatgtcatgtggcaatattgtttttgtagatctgattgagcacctgctatcagagttgagtaagaacgactctatgtctaccacccggacatatatccagtgtatcgcggcaatatcccgacaggctggacacaggatcggcgagtatttagaaaagattatacccctagttgtgaagttttgtaacgtggacgacgacgaattgagggaatactgtatccaagccttcgaaagctttgtgcggcgctgtcctaaagaggtttacccacacgtgagcacaataatcaatatctgcttgaaatacctcacatacgacccaaactataactacgatgatgaggacgaagatgaaaatgcgatggatgccgacggcggagatgacgatgatcaaggctcagacgatgaatattcagacgacgacgacatgtcgtggaaggtccgccgcgctgcggccaaatgtctggatgccgtggtgagcactaggcacgaaatgcttccagagttttacaaaacagtctcccccgccctgatttcacgtttcaaggagcgcgaggagaatgttaaggccgatgtttttcacgcctatctctccctcctcaagcagacgcgcccggttcaaagttggctgtgcgacccggacgcaatggagcaaggcgaaacccctctcactatgcttcagagtcaggtcccaaatatcgtcaaggcgttgcataaacaaatgaaggagaagagcgtcaaaactcgacagtgttgcttcaacatgctgacagaacttgtaaatgtgcttcctggagccctcacgcagcacattcctgttcttgtccccggaattattttcagtctcaatgataagtcctcctcctctaacctcaagatcgatgctctgagttgtttatatgtgatactctgtaaccactctcctcaggtctttcatcctcatgttcaggccctggtgccccccgtcgtagcttgtgtgggtgatccattctacaaaattacaagcgaagcgctgcttgtgacgcagcagcttgtgaaagctcatcatatgccagaagcccagtggttacgtctctag

SEQ ID NO: 11569 - DNA, 3693 bp, Artificial Sequence
  Description of Artificial Sequence: Synthetic coding sequence
atggcctccgccagttatcacattagcaacctgctggaaaaaatgacatcatccgataaggatttccgcttcatggctaccaatgacctcatgacagagctacagaaggattccattaagctggacgatgactccgagagaaaagtggttaagatgatcctgaagctgctcgaggataagaacggtgaggtacagaatctagcagtgaagtgtctcggtccattagtaagcaaagtcaaggagtaccaggtcgagacgatcgtggatacattgtgtacaaatatgttaagcgacaaggagcaactgagggatatcagctcgatcggactgaagaccgtgattggtgagctgccccctgcgtccagcggtagcgccctggctgcgaatgtgtgcaagaaaatcaccggtcggctgacatcagccatcgccaagcaggaagatgtgagcgtacagttggaagcgcttgacatcatggcggacatgctctcccgccaagggggcttgctggttaactttcacccctcaattcttacctgtttgctgccacagcttacttctcctaggctagcagtgcgaaagcggacaatcattgccttgggccatctggtgatgtcctgcgggaatatagtgtttgtcgatttgatcgaacacctcctatccgagctgtcaaaaaacgattcaatgtcgacaaccaggacttatatacagtgtattgcagcaattagccggcaggcaggacaccgaatcggcgaataccttgaaaaaattatccccttggtggtgaagttctgtaatgttgacgacgacgaattgcgggagtactgtatccaggctttcgaaagcttcgtgagacggtgtcctaaggaggtatacccccacgtatctaccattataaatatttgccttaagtatctgacttacgatccaaactacaactatgatgatgaagacgaagatgaaaatgctatggacgctgacggcggcgatgatgacgaccaaggtagtgatgacgagtactctgacgatgacgatatgagttggaaggtgcgccgagccgctgctaagtgtctggatgccgtagtgagcaccagacatgagatgctgcctgaattctacaagacggtgagtcccgccttaattagccggttcaaagagcgggaggagaacgtgaaagccgacgttttccatgcttatctgagcttgctgaaacagacccgacctgtgcagagttggttatgtgatccggatgcaatggagcagggcgagactcctctcaccatgcttcaatcccaggtacccaatatcgtcaaagcactgcataaacagatgaaggagaaaagtgtaaagacacgccagtgttgtttcaatatgctgacagagctggttaatgtcctgcccggagccttgacacaacatattcccgtgcttgtcccaggcattatcttctcactaaacgacaaaagcagcagctcaaatctgaaaattgacgccctgtcctgcctgtacgtcatactgtgcaatcatagccctcaggtgttccacccacacgtgcaggccctggtcccaccggttgttgcttgcgtgggcgaccctttttacaagattaccagcgaggctctgctggtgacacagcagttagtgaaggtcataaggccactggaccagccgagttcttttgacgctacaccctacatcaaggatttatttacatgcacgatcaaacggctcaaggcagcagacatcgaccaggaagtaaaggaacgcgccatctcctgtatggggcaaatcatttgcaacctgggtgataacctcgggtcagacctccctaataccttgcaaatcttcctggaacgcttgaaaaacgagattacacggctcacaacggtcaaggctcttaccctgatagccggatcacctctgaaaatcgacttgcggccagtgctgggtgagggtgtgcccattctggcaagttttctgcgaaagaaccagagagctttgaagctgggcaccctgagtgcgcttgatattctaataaaaaactactcagattccctgactgctgcaatgatcgacgctgtcttggatgagcttccccccctgatctcagaaagcgacatgcacgtctcacagatggccatctcctttttaacaaccttagccaaagtttacccatcgagtctaagcaagatctctgggtctatcctgaatgaactgattgggctggtcaggtcgcctctgttacagggcggtgccttgtcagcgatgcttgatttctttcaggccctggtggtgactggaactaataacctggggtatatggatctgctccgtatgctgacgggcccggtgtacagtcagagtactgcgttgacccacaagcagtcctattattcaattgctaagtgtgtagccgctctcaccagggcatgtcctaaagaaggacctgcagtggtggggcagttcatccaggatgtcaaaaactcccgaagcacagatagcatcaggctactggccctgctgagcttgggggaggtcgggcatcacatcgatctaagtggtcagctagagctaaagagcgtgatcctggaggcattctcaagcccctcggaggaagtgaagagcgcagcaagttacgcacttgggagcatctctgtggggaacttaccagagtacctcccctttgttctgcaggagatcacttcccagccgaagcgccaatatcttttgctacatagcttaaaggagataatcagttccgcctcagttgtcggcctcaaaccttacgtggaaaacatctgggcactcctgctgaaacattgtgagtgcgccgaggagggcactagaaatgtagtcgccgagtgtcttggcaaattaactctgattgacccagaaactttactcccaaggctgaaggggtacctcatctcggggtcaagctacgccaggagctccgttgtaaccgcagtaaaatttactatatcggaccatccacagcctatcgatcccttactgaagaattgtattggtgattttttgaagaccctcgaggatccagaccttaatgtccgcagagtggctcttgtgacctttaacagcgcggcccacaataagccgagtctcattcgggatctgctggacacagtccttcctcacctttataacgagaccaaggtaaggaaggaattgatcagggaggtggagatggggccattcaagcacaccgttgatgatgggctggacatccgaaaagctgcctttgaatgtatgtatacactgttggattcctgcctcgaccgactagatatctttgaatttctcaaccacgtcgaagacggactgaaagaccattatgacattaaaatgttgacattcctgatgctggtgagactctctactctctgtccttctgctgtcctccagcggcttgataggctcgtcgagcccttgcgggcaacctgtaccacgaaggtaaaagcgaattcagtgaagcaggagtttgagaagcaagatgagctgaaacgttccgcgatgcgcgcagtcgcagccctactgactataccagaagcagaaaagtcgcctctgatgtcggagttccaatcacagatctccagtaacccagagctggcggcaatatttgaaagcattcagaaagacagctcctccaccaatctggaaagcatggataccagttag

SEQ ID NO: 11570 - DNA, 3360 bp, Artificial Sequence
  Description of Artificial Sequence: Synthetic coding sequence
atgtctacagctgcattccatataagtagcctgctggaaaagatgacatccagcgacaaagatttccgatttatggcaacaagcgacctaatgtctgagcttcagaaagacagtatacagcttgatgaggatagtgagcgtaaggtggttaagatgctcttgcgcctattggaggataagaatggggaggttcagaatttagctgtgaaatggttgggagtacctctcggagcatttcacgcaagtctccttcactgtctccttccccagctctccagcccaaggctggccgtccggaaaagggctgtgggcgcgcttgggcatctggccgcggcctgttccacggatctctttgtcgagctggccgatcatctcctcgaccgcctgcccgggccacgtgtccccacatctcccacggcgattcggacacttatccagtgtctggggtccgttggccggcaggccggacaccgcctaggagcacacctggatcggttggtgccccttgtggaggacttttgcaacctggacgacgacgaactccgggaatcatgcctccaggccttcgaggccttcctgagaaaatgtcctaaggagatgggcccgcacgttcccaacgttactagcctgtgcctacagtacatcaagcacgatccgaactacaactatgatagcgatgaggatgaggagcagatggagaccgaggactccgaattcagtgaacaggagtcagaggacgagtattccgacgacgatgatatgtcttggaaagtaagaagagctgctgcaaagtgcattgccgctctgatcagcagtcggcctgacctcttaccagatttccactgtacactggctcctgtcctcatccgccggttcaaggaacgggaagagaacgtgaaggctgatgtttttactgcatacattgttcttctgaggcagacccagccaccaaaaggctggctggaggccatggaggagccgacacagactggatcaaacctgcatatgttgcgcgggcaggtcccccttgtcgttaaggcattgcaacggcagctcaaagaccggagtgtacgggccaggcagggatgcttttcgctacttacagaattagccggtgttctgccaggcagtcttgccgaacacatgcccgtgctggtgagcggtatcatctttagtctcgccgatcgcagctcttcttccaccatcagaatggacgcccttgcgtttttgcaaggtttgctgggcacagaaccggcagaagcctttcacccacacctccctatccttttgccaccggttatggcgtgcgtggcagattctttctataagattgcagctgaggctctagtggtcttgcaggagctggtccgcgcactgtggcccctccatcggcctagaatgctggatcctgagccctacgtgggagagatgtctgccgtaacacttgcccgcctccgtgctactgatttggaccaggaggtgaaggagcgtgccataagctgtatgggtcacctcgttggacacctgggggaccgcctgggcgacgacttagaacctacactcctgcttctgttagaccggctcaggaatgagatcacccgccttcctgccataaaggccttgacactagtcgcagtatctccgctgcagctggacttacagcctatactggccgaagcccttcacattttagcctctttcctgcggaaaaatcaacgtgcattgagattggcaaccctggctgcactcgacgccctcgcacagtcccagggcctgtcattgcccccatccgccgtgcaggccgtgcttgcagaactgcctgctctggtgaatgagagtgacatgcatgttgcccagctggctgtagatttcctcgctacagtgacccaagcacaaccagcctctctcgtggaagtgtcaggacctgtcctcagcgagctgcttaggttgttacgttctcccttactccctgctggagtccttgcagctgctgaaggctttctgcaggccctggtcggcactagaccaccctgcgtggattatgcaaagttaatcagtcttcttactgcccccgtgtacgagcaagctgtggacggagggcccggattgcataagcaagttttccacagcttggcgaggtgtgtggccgcgttgtccgctgcctgcccccaggaggccgcctctacagcttctaggcttgtgtgtgacgcccggagcccccattctagcaccggggttaaagttctggcatttctttcactcgccgaagtcggacaggtggctggccccgggcaccagcgggaactgaaggctgtgctactagaagcacttggctccccttccgaggacgtcagagccgctgcatcttacgccctgggtagggtgggggctggcagtttgcccgatttcctgccctttctcctcgaacagatagaggccgagccaaggagacaatacctattattacacagcctacgggaggctctgggtgcagcacagcccgacagcctgaagccttatgctgaagacatatgggctttgttatttcagcgctgcgaaggcgccgaggaggggaccagaggcgtggtcgcagagtgcatcgggaagctcgtgttagtgaatccctccttcctgttgcccaggctgagaaagcagctcgctgccggacggccccacacaaggtccacagtcataacggccgtgaaatttcttattagcgatcagccccacccaatagaccccttgctcaaatcttttatcgccgtccataacaagccaagtcttgttagggacctcctggacgacatcctccccctgctgtaccaggaaaccaagatcagacgggacctgatcagggaggtcgagatgggaccctttaagcacacagtcgatgacggcttggacgtgcgaaaggcagcgtttgaatgtatgtactcactcttagagagctgcctggggcagctcgacatttgtgaatttctgaatcacgtcgaggacgggcttaaggatcactatgatatccgcatgctaaccttcatcatggtggcaagacttgctacactgtgtcctgcccccgttttgcagagagtggaccgacttatagaaccactgcgcgcaacatgcacggcaaaagtcaaagccggatctgtgaagcaggagttcgaaaaacaggatgagttaaagcgctctgcgatgcgggctgtagcagcacttttgacaatccctgaagttgggaaatcgcccatcatggctgattttagttcacagattcgaagcaacccagagctggctgcgctttttgagtcaattcaaaaggactctgcgtcagctcctagtaccgatagtatggaactcagttag

SEQ ID NO: 11571 - DNA, 3711 bp, Artificial Sequence
  Description of Artificial Sequence: Synthetic coding sequence
atgtccaccgccgcattccacatcagtagcctcttagagaagatgaccagctcagacaaagattttagattcatggctacttccgacctcatgtcagagcttcagaaagactccatccagctggatgaggattccgaacggaaagtcgttaagatgctgctgcgccttctggaagacaagaatggagaagtccagaatctggcagttaaatgtctggggcctttggtcgttaaggtgaaagaataccaggtcgaaacaatcgtggacaccttgtgcaccaacatgaggtctgataaggagcagctgagagacattgcgggaatcgggcttaagacagtccttagtgagctgccgcccgccgccactggctccggcttggctactaacgtgtgtaggaaaattaccggacagctgacatcggctattgcacagcaagaggacgtggctgtccagctggaagcactggacatcctgtctgacatgctctcaagactcggggtccccctcggtgctttccatgcatccctattacactgcctgctcccacagctgtcatcaccaagactggccgtgagaaagagagccgttggagcactcgggcacctggcagcagcatgtagtacggatctgtttgtggaactggcggatcacctcttggaccgccttccagggcccagagtgcccacgtcccccacagcgatccgcaccttgatccagtgcctgggctcagtaggcaggcaggccggacatagacttggcgcacacctcgatcggctggtacctctggtcgaggacttttgtaatctggatgatgacgagctgcgtgagagctgcctccaggcgtttgaagcctttctaagaaagtgtccgaaagaaatggggccccatgtcccaaacgtcacatccttatgtctgcagtatattaagcatgatccgaattataactatgattcagacgaagacgaagagcagatggagacggaagactcagagttctccgagcaggagtctgaggacgagtattcagatgacgatgatatgtcctggaaagtgcgacgagctgcagctaaatgcatcgctgcgctgatttcctctcggcccgacctcttgcccgatttccactgtacactggcacctgtgcttattcggagatttaaggagcgggaagagaacgttaaagctgatgtatttacagcttatatcgtgcttctgcgccagacacaacctcctaagggttggctcgaggctatggaggagcccactcagacagggtcaaacttacatatgctgagagggcaagttccgctggtcgtgaaagctctgcagcgccagctgaaggatagaagtgtccgggcacggcaagggtgcttctccctgctgaccgagctcgccggtgttttgccaggatcactggcagaacatatgccggtactggtctcgggcatcatcttctccctggcagacaggtcaagcagcagcacaatcaggatggacgcactggccttcctgcagggactccttgggacagagcccgcagaggcgttccatccccacctgccaatcctactgccccccgttatggcgtgcgtggctgatagtttctataagatcgcagccgaagcactagtagtactgcaggagctcgtgagggcactctggcctttacataggccgaggatgttggatcctgagccatatgtgggagagatgtccgctgtaacacttgcacgactgagggccactgacttggaccaggaagtcaaagaacgcgctatctcctgcatgggtcacctggtgggacacctgggcgatcgtctgggtgacgatttagagccaacactgctgctccttctcgataggcttcgaaatgagatcactaggttaccagcgattaaagcccttaccctggttgcagtgtcgcccctccaattagacctccagcctatcctggccgaagctctccatatcttagcatctttcctgcgaaagaatcagcgggccttgaggcttgccaccctagccgctcttgacgctctggctcagagccagggtcttagcctgcccccgagtgctgttcaggcagtgctggcggagctccccgccctcgttaatgagtctgacatgcatgtcgcccagctggccgtggacttccttgctaccgtaacccaggcacaaccagccagcctggtggaagtctctggccctgtcctcagcgaattgttgcggctcctgcgcagtcccctactcccagcaggcgttctcgcagcagctgaaggattcttgcaagctctggtgggaactcggcccccttgtgtcgattacgccaaacttatctcactgctgactgcacctgtttacgaacaggctgtggatggcggcccaggtctgcataagcaagtctttcactcccttgctcgttgcgtggctgccttatctgctgcctgcccccaggaggcagccagtactgctagccgcttggtatgtgatgcaagaagcccccacagttctaccggagtaaaggtccttgcatttctgagtctcgccgaagtgggccaggtagccggaccaggccaccagagggagcttaaggcggtgctactggaggcacttggatctcccagcgaagacgtgagagcagcagccagttatgctcttggacgggtcggggccggcagcttgccagactttctgccctttctcctggagcaaatcgaagctgaaccacggaggcagtaccttctgctacactctctccgagaggccctgggcgccgcccagcccgactctcttaaaccttacgccgaggacatctgggcactcctgtttcaaaggtgtgagggcgccgaggaaggaacaaggggcgtagtggctgagtgcatcggcaaactggttctggtgaatccctccttcctgctgccaaggttgagaaagcaactggcggctggaagaccccacacaagatccacagtgattactgctgtgaaattcttgatctctgatcagccccatcctatcgacccactgctgaagtctttcattggggagttcatggagagtctgcaggaccccgatctaaatgtccgacgcgcaacacttgctttctttaattctgccgtgcataacaagccttcgttagtgcgggatcttctggacgacatcctcccgcttctttatcaagagactaagatccgaagggatctgataagagaagttgagatgggaccatttaagcatactgttgatgacgggctggacgtccgtaaagctgcgtttgaatgtatgtactcgcttctagaatcctgcttaggccaattggatatctgcgagtttttaaaccatgtcgaggacgggctgaaagatcattacgacattagaatgctaacattcatcatggtcgccaggctcgctaccctgtgccccgcacccgtgctccaaagggtcgatagactgattgagccgctgcgggctacatgtaccgctaaggtgaaagccggaagcgtgaagcaagaatttgagaaacaggacgaactcaagcggtcggcaatgagagcagttgcagcactcctcacaatcccggaagttggcaagagccccattatggctgacttttcatcccaaatacgatctaatcctgaactggctgcactctttgagagcattcagaaagactcagcctccgcccctagcaccgactcgatggagctaagctag

SEQ ID NO: 11572 - DNA, 4461 bp, Artificial Sequence
  Description of Artificial Sequence: Synthetic coding sequence
atggccgccaatgttggctcgatgtttcaatattggaaaagatttgatctcaggaggctacagaaagagctgaacagtgtagcctccgaactatcagccaggcaggaagaatcagagcattcccacaagcatctgatcgaactgaggagagagttcaagaagaacgttcccgaagaaatacgggaaatggtggccccagtgctgaagtctttccaagcagaggtcgtagctttgtcaaaacgtagtcaggaggcagaggcagccttcttatccgtatacaagcaactgattgaggcccccgacccggtgcccgtatttgaggccgcaagaagcctagatgaccgtcttcagccgccatctttcgatcccagtggccagcctcgtcgtgacctgcacaccagttggaaaagaaaccctgaattgctgtcccccaaagaacagcgcgaaggaacatctcctgctggacctaccctgactgaaggcagcaggttacccggaatcccagggaaggctttactcacagaaaccctattgcagcggaacgaagccgagaagcagaagggcctgcaggaagtgcagatcacattagcggccaggctgggcgaggcggaggagaagatcaaagtgctgcacagcgcactcaaagcaacgcaagctgaactgctggagctgagacgaaagtacgacgaggaagcagcttcaaaagcagacgaggtagggttgattatgacaaaccttgaaaaggcgaatcagagagcagaggctgcacagagggaagtcgagtctctacgggagcagctcgccagtgttaacagctctattaggctggcatgctgttcaccacagggccctagtggggacaaagtcaacttcacgttgtgcagtgggccaaggctcgaagcagcgcttgcatccaaggaccgggaaattctcagattgctgaaagatgtacagcacctgcagtcttcccttcaagaactggaagaggcttccgccaaccagatcgccgacctcgagagacagctaactgccaagtcagaggccatcgaaaagctagaggagaagcttcaagcccagagtgattacgaagaaattaaaactgagctttcaatcctgaaagctatgaagttggcatctagtacctgctccctgcctcaaggaatggccaaacccgaagactccctgctcatcgctaaagaagccttctttcccactcagaaattccttttagagaagccttcactgctggcatctcccgaggaggaccctagcgaggatgatagcattaaggacagcctcggcactgagcagtcctaccccagcccacagcaacttccaccgccccccggcccggaggatccccttagtccatcgccaggtcaacccttactcggaccctcattaggacccgatggaacccgtactttttcactttccccttttccctccctcgccagcggggaacgcctaatgatgccaccagcagcttttaaaggtgaagctggagggctcctggtgtttccgcctgcgttctacggagcgaagcctccgacagcacctgctacgccagcccctggccctgagccacttggcggacccgagcctgcagacgggggcggcggaggtgcagccggtccaggggccgaggaggagcagctggacaccgccgagatcgctttccaggttaaagaacaactgttaaagcacaatataggacaaagggtcttcgggcattacgtgctgggattgtcccagggttcagttagcgagatcctcgccagacctaagccgtggaggaagctcacagtgaagggtaaggaaccttttataaagatgaagcagttcctgagcgatgaacaaaatgtgcttgccctaagaactatccaggttagacagcgcggttccatcacccctcgcatcagaaccccagagaccggttccgacgacgctatcaagtcaatcctggagcaggctaaaaaggagattgagtcccagaagggcggggagcctaaaacatctgtggcacctctgtcaatcgccaacggaacaacgccagccagcacttctgaagatgccattaaatctattctagaacaggcacggagagaaatgcaagcgcagcagcaagcgttgttagagatggaggttgctcctcgtggcagatcagttccgccatcaccccctgagcggccttctctagccaccgctagtcagaatggggcccccgcactggtcaaacaagaggaaggcagcggaggccccgcacaggcacccctccccgttctctcacctgccgctttcgtccagtccattataaggaaagtgaagtctgagattggggacgccggctacttcgaccaccattgggcctccgatcgtggactcctgagtaggccttacgcctccgtaagccccagtttgagttcctcctcctcaagtggctactcaggccaacccaatggccgcgcctggccccgtggtgatgaagctcctgtccctcccgaggacgaggctgctgccggggctgaagacgagccccctcgcacgggcgagttaaaagccgagggcgccaccgcagaagccggggcacgccttccttattaccccgcatatgtcccccggactctcaaacctactgtgcccccactgacccccgaacaatacgagctttatatgtatagagaggtagatactctggagctaacgcgacaggtcaaagagaagctggcgaagaacggcatttgtcagaggattttcggggagaaggtcctaggactgtctcaggggtctgtttcggacatgttgagtagacccaaaccctggtccaaactgacccaaaaggggagggaaccctttatccgcatgcagctctggctaagtgaccaactaggccaggctgtgggacagcaacctggcgcatcacaggctagtccaactgagcctcgttcatctccgagccccccccctagtccaacggagccagagaagtcatcccaggagcctttgagcctatccctggaaagttccaaggaaaatcagcagccggagggcaggtcctcctccagcctgtccggtaagatgtactccggatcacaggcacccgggggtatacaggagatcgtggccatgtctcccgaactggatacttattcgattaccaagagggtcaaggaggtactcacagacaacaacctgggacagaggctttttggggagtccatcctcggactgacccagggttccgtgagtgatctgttatcccgacctaaaccctggcataagctgtcattgaaaggacgggaacccttcgtcagaatgcagctctggttaaatgatcctcataatgtggaaaagctccgtgacatgaagaagcttgaaaaaaaagcatacttgaagagaaggtacggtctcattagtactggtagtgattccgaaagtccagccacacgcagcgagtgcccaagtccctgcctccagccccaagacttgtcgctgctgcaaattaaaaaaccccgcgtggtgctagcacccgaagagaaggaagccttgaggaaagcctatcagctagagccatacccatcacagcagactattgagctgctgagcttccagctgaacctgaagacgaatactgtaattaactggttccacaactacagaagccggatgcgcagggagatgctggtcgaggggacacaagacgagccggatctggacccttccgggggccccggaatcttacccccaggtcatagccatccagaccccacaccccagtcacccgacagtgaaacggaagatcaaaagccgacagtgaaggagttggaactccaagaaggacctgaggagaattcaacgcccttgacgactcaggataaggcccaggtacgtattaagcaagagcagatggaggaagatgccgaggaggaggccggttcccaacctcaagactccggtgagttggataagggccagggcccaccgaaggaggaacacccagatccgcccggcaacgacgggcttccaaaggtggcgcctggccccttactgcccggaggctcaacccccgactgcccgagcctccatcctcaacaggaaagcgaggcaggcgaacgactgcatccagaccccctgtctttcaagtctgcttctgagtccagccgctgttcattggaagtgtcactcaattccccgagcgccgcttcatccccaggcctcatgatgagcgtttcccccgtcccatcaagcagtgcccccatttccccatccccccccggtgccccacctgccaaggtgccatccgccagtcccaccgctgacatggccggtgccctccaccctagcgcgaaagtaaaccccaacctgcagcggcggcacgagaaaatggcaaacctaaacaatatcatctaccgtgtcgaaagggctgcgaatcgcgaagaagccctggaatgggaattctag

SEQ ID NO: 11573 - DNA, 375 bp, Artificial Sequence
  Description of Artificial Sequence: Synthetic coding sequence
atggtcgcccctgtgctgaaatcattccaggctgaagtggtagctctgagtaagcgttctcaagaggctgaggcagctttcttatcagtgtataagcaactgatcgaggctccagacccagtgcctgtttttgaggccgcacgatccctggacgataggctgcagcccccgtctttcgatccatccggccaaccgaggagagacttacacacgtcctggaagaggaaccctgagttactgagcccaaaggagcaaagggagggtacctcacctgccgggcccacgttgaccgaagggagtcgcctgcctgggattcctggaaaagcacttctgacagagaccttgttacagagaaacgaggcagagaaacagtag

SEQ ID NO: 11574 - DNA, 2727 bp, Artificial Sequence
  Description of Artificial Sequence: Synthetic coding sequence
atgaaatcttccgtcgctcagatcaaaccctcttccggacacgaccgcagggaaaacttgaattcataccagcggaactcctcaccggaggacaggtacgaagagcaggaacggagccctcgggatagagactattttgattacagtcggtcagactatgagcactctcgacgaggtcgatcctacgatagctcaatggagagtagaaacagagaccgggagaaaaggagagagagagagagagacactgacagaaaacggagcaggaagtccccgtctccaggccggcggaatcctgaaacctctgtgacacagtccagtagtgctcaggatgagcccgcaaccaaaaagaagaaagacgaactggacccactgcttacccggacgggcggagcttacattcctcctgccaagctgagaatgatgcaggagcagattaccgacaaaaattccctggcatatcagcggatgtcttgggaggccttgaagaagtccatcaacggcctcattaacaaagtcaacatatctaacattagcatcatcatccaggaattactgcaggaaaatatagtgcgagaccgggggctcctgtcccgcagcgtgctgcaggcgcagtccgctagccccatcttcacgcacgtgtacgccgcgctggttgccattattaactctaagttcccccaaatcggggagcttattctcaagagactgatcctgaacttcagaaagggatacagacgcaacgacaaacagctgtgcctgactgcctcaaagtttgttgcacatctcattaatcagaacgtcgcccacgaggtgctgtgtttagagatgctcaccttgctcctagagcgaccaacggatgacagcgttgaagtggctatcggcttccttaaagagtgtggtctgaaattgacacaggtctctccccgaggaattaatgccatcttcgagcgactgagaaacattctgcacgaatccgagatagacaaacgcgttcagtacatgatagaggttatgttcgccgtgcggaaggacggatttaaggaccaccctatcattctggagggactcgatctcgtagaagaagatgatcagttcacacatatgctgccgttggaagacgactataatccagaggacgtcctgaatgtgttcaaaatggacccaaacttcatggaaaacgaggaaaaatacaaggctatcaagaaggaaatactagacgaaggggatacggactccaataccgatcaggacgctggcagttcagaagaggatgaggaagaggaggaggaagaaggagaggaagatgaggagggccaaaaagtcacaattcatgacaagactgagattaacctggtctcctttaggaggacaatatacctcgccatccaatcctcacttgactttgaagaatgcgctcataaactattaaagatggaatttccagagtcccagaccaaggaactctgcaatatgattttggactgttgcgcccagcagcggacgtacgaaaaatttttcgggctattggccgggcgattctgtatgctgaaaaaagagtatatggaatcctttgagggaatctttaaagagcagtacgatacaatccaccgtcttgaaacaaacaagctgcgcaatgtggccaagatgtttgcccatctcctctataccgattcactcccttggtccgtactcgagtgcatcaagttatcagaagaaacgaccaccagctcaagtcgaatttttgtgaaaatatttttccaggaactatgcgagtacatggggctgccaaaacttaatgctagacttaaagatgaaacactgcaacctttcttcgaaggcctccttcccagagacaacccgcgcaacacccgatttgccatcaattttttcacaagcatcggactaggaggactcacagacgagcttcgcgaacacctcaaaaatacccccaaggtcatcgtggcccagaagcccgacgtggaacagaataaatcatccccgtcgagctcatcttcagcaagctctagcagcgagtctgattctagtgattccgattctgattcctccgactctagcagcgagtcgtcaagcgaggagtccgattccagctccatttcctcccactcctctgcatccgctaacgacgtgcgaaagaaagggcatggaaagacacggagcaaagaagtcgataagctcatcagaaaccagcagacaaatgaccgtaagcaaaaggagagaagacaggagcatggtcaccaggagacacgaaccgagcgcgaacggaggagcgagaagcaccgggaccagaacagcagtggaagcaattggcgtgacccaatcactaagtatacgagcgataaggacgtgccgtccgagcgaaacaattactccagggtggccaacgatcgggatcaagaaatgcatattgacctggagaataaacacggcgaccctaaaaaaaagcgcggcgaacgtcgaaacagcttcagtgagaacgaaaaacatacccacaggatcaaggattccgagaattttaggcgcaaggatcgtagcaaatcaaaagagatgaatcggaagcactccggcagtcggagcgacgaagaccgataccagaatggcgccgagagacggtgggaaaaatcctccagatattctgagcagtctagagaatcaaagaaaaatcaggacagacggcgagaaaaatcacccgctaaacagaaatag

SEQ ID NO: 11575 - DNA, 2238 bp, Artificial Sequence
  Description of Artificial Sequence: Synthetic coding sequence
atgaaaagctccgtggcccaaatcaagccttcatctggccatgatcgccgtgagaatctgaatagctaccagcggaacagctctcctgaagataggtacgaggagcaagaacgcagtccacgcgaccgggattattttgattactctcgcagcgattatgaacactcgaggaggggcagaagttatgactcctctatggagtctcgtaatcgagaccgcgagaaacgacgcgagcgggaacgagacaccgacagaaaacgatctcgcaaaagccccagtcccggtagaaggaaccccgagacatcagtcactcagtcttctagtgcccaggatgaaccagcgacaaaaaagaagaaagatgagcttgaccccctgctcacacgaacaggcggcgcttacatcccccccgcaaaactgaggatgatgcaggaacagatcaccgacaagaattcactagcctatcaacgcatgtcatgggaggctctgaagaagagtataaacggtctcattaataaggtgaatatcagcaacatcagtattataatccaggagctgctgcaggagaatatagttcgaggccggggcttgctgtcacgttcggtgctgcaggctcaaagcgcgagtcctatattcactcacgtctatgccgcgctggttgctatcattaactccaagttcccccagatcggcgagctcattctaaaaaggctgatcttaaactttaggaaaggctatcgtcggaatgacaagcagttatgtctgacagcgtctaagtttgtggcacacctgatcaaccagaatgtggcacacgaggtgttgtgcctcgagatgctaactctgctgctggaacggccaacagacgattcagtcgaagtggccattgggttcctaaaggaatgcggacttaagctgacacaggtctcacccagaggaattaatgccatttttgagcggctcagaaatatcctccacgagtccgagatcgacaagagggtgcaatacatgatcgaagtcatgttcgcagtgcgtaaggatggctttaaggatcatccaattatcctcgagggcctcgacctcgtcgaggaagatgaccagttcacccacatgttgcctcttgaggacgattacaatccggaagatgtgctgaatgtcttcaaaatggaccctaacttcatggaaaacgaggagaaatacaaagctattaagaaagagattttggacgagggggacaccgatagcaacacggaccaggacgctggtagctctgaagaagatgaggaggaggaggaggaagaaggagaggaagatgaagagggacaaaaggtgactattcacgacaagacagagatcaatctggtgtccttccggagaacgatatacctggcaatccagtctagcctggattttgaagagtgcgctcataagctactcaagatggaatttccagagtctcagactaaagagctgtgcaacatgatcctcgattgttgcgctcagcaacgcacgtacgaaaagttcttcggcctgctggctggacgcttctgcatgctgaaaaaagaatacatggagtccttcgaaggaattttcaaggagcagtacgatacgatccatcgtttagagactaataagctcaggaatgtggctaaaatgtttgctcaccttctgtacacagatagcttgccatggtcagttttggagtgtatcaagctcagcgaagagaccacgacttcttcctctaggatattcgtgaaaattttcttccaggagctgtgtgaatatatgggactgcctaagttaaacgctcgcctcaaggacgagacactacagccatttttcgaggggctgctcccgagggacaaccctcgaaatacacgattcgctattaactttttcacatcaattggactcggaggattgaccgacgaactgagggaacacttaaagaatacacctaaggtgattgtcgctcagaaaccggatgttgaacagaacaaaagcagcccctcgtcctctagctctgccagttcttccagcgaatctgattccagcgattctgattctgacagctcggattccagttctgagtcctcctcagaggagtccgacagttcctcgatcagctcacacagtagcgcctctgccaacgacgtgagaaagaaaggccacggaaagactagatcgaaggaggtcgacaaactcatacgcaatcagcagactaatgatcgtaaacagaagtag

SEQ ID NO: 11576 - DNA, 2727 bp, Artificial Sequence
  Description of Artificial Sequence: Synthetic coding sequence
atgaagtcttccgtggcccagataaagccaagttctgggcacgacagaagagagaatttgaattcataccagcgaaactcctcgcccgaagacagatacgaggaacaggagcggagtccccgggatagagattactttgattatagtcgaagtgactacgagcactctagacggggaaggtcctacgattcaagcatggagtctcgcaaccgggatcgcgagaagcggcgagaacgcgagcgcgatactgatcgcaaaagatcccggaagtccccaagccctggacggagaaatccggaaacatcagtaacacagtcaagttcagcccaagatgagcctgcaaccaagaagaagaaggatgaattggatcccctcctcacgcggacaggcggcgcatacattccacccgccaagctgagaatgatgcaagagcagatcactgataagaattctctcgcctaccagcggatgtcttgggaagcactgaagaagtcaataaatggccttatcaataaagtgaacattagcaacatctccatcataattcaggagttgctgcaggaaaacatcgtgcgaggacgggggttgctgtcccgaagtgttctgcaggcgcagagtgcctcacccatctttacacatgtgtacgccgctcttgtcgccattatcaactcgaagtttccccaaataggtgaactcattctgaagcggctcattttaaattttcggaaggggtatcgcaggaatgacaaacagttatgcctgacggcctcaaagttcgtagcccacctgattaaccagaatgtggcacatgaggtgctgtgtttggagatgttaaccctgctgctggaacgcccaacagacgatagtgttgaggtggccatcggattcctgaaggaatgcggattgaaactgacacaggtctccccaagaggcatcaacgccattttcgagcgtcttagaaacatacttcatgagagtgagatagataaaagggtacagtacatgatcgaggtgatgtttgccgtgcggaaggatggttttaaggaccatccaataatcctagaaggacttgacctcgtcgaagaggacgaccagttcacccacatgctgcccctcgaggacgactacaacccagaagatgtgctgaacgtgtttaaaatggaccccaatttcatggagaacgaggaaaagtacaaagcaattaagaaagagatcttagacgagggcgatacggattctaacacagaccaagacgcaggctcttcggaagaagacgaggaagaggaggaggaggagggcgaggaagatgaagagggtcaaaaggtgacgattcacgataagaccgaaatcaacttggttagcttccgaagaactatctatctagccatccagtcatcacttgactttgaagagtgcgcccataaacttctgaagatggaattccccgaaagtcaaactaaggagttatgcaacatgatcttggattgttgtgcccaacagcgcacctacgagaagtttttcggcctgctggcgggacgcttctgcatgctgaaaaaagaatacatggaatccttcgaaggcattttcaaggagcaatacgacaccattcaccggctcgagacaaataagttgaggaatgtggcaaagatgttcgctcacctgctgtataccgacagcctaccttggagcgtgcttgagtgtattaagctgagcgaagaaaccaccacgtcatcttcccggatattcgtgaagatcttctttcaggagttgtgtgaatacatggggcttcctaaacttaatgcgcggcttaaggatgagaccctgcagcccttcttcgaaggcctactccctagggacaacccgcgcaataccagattcgcaatcaatttttttacttccatcgggctcggaggcctgactgatgagctgagagagcatttaaaaaatactcccaaggtcatcgttgctcaaaaaccagatgtcgaacaaaacaagtcgagtccttcgagtagtagcagcgcctcgtcctcatctgagtcagattcttccgattctgacagcgatagtagcgatagctcaagtgaatcatctagcgaggaaagtgatagtagctcaatctcgtcccattcaagcgctagcgcaaatgatgtccgcaagaaaggacacgggaaaactcggagcaaggaagtggacaagttgattcgtaaccaacagacgaacgacagaaagcagaaagagagaaggcaggaacacggtcaccaggagacaaggaccgaacgggagcgccgatcggaaaagcatcgagaccagaacagtagcggatcaaactggcgagacccaatcactaagtataccagcgacaaggatgtaccgtcggagaggaataactacagccgagtggccaatgacagagatcaggagatgcacatcgatttggagaataagcatggggaccccaagaaaaagcgaggagagcgccgaaactccttcagcgagaacgaaaagcacacccatcgcattaaggacagcgagaacttccggagaaaggataggtcaaaatcaaaggaaatgaaccgcaagcactcaggatcaagatctgatgaagatagatatcaaaacggcgcagagagaaggtgggagaagtcatcacgctatagcgaacagtctagggaaagtaaaaaaaatcaggatcgcaggcgggagaaaagtccagctaagcagaagtag

SEQ ID NO: 11577 - DNA, 1419 bp, Artificial Sequence
  Description of Artificial Sequence: Synthetic coding sequence
atgagcaatatctacattcaggagccgccaaccaacggcaaggtgttgctgaaaaccaccgccggagacatagacatcgaactgtggagcaaggaggcgcctaaggcatgcaggaactttatccagctgtgccttgaggcgtattacgacaataccatcttccaccgtgtcgttcctggattcatcgtgcagggcggggaccccacagggactggctctggaggcgaatccatatatggtgcaccatttaaagatgaattccacagcaggctgcgtttcaatagacgggggctcgtggcaatggccaacgccgggagccatgataatggatcgcaattctttttcaccctgggcagagcagacgagttgaataataaacacaccatttttggcaaagttaccggcgacaccgtttacaacatgctccgactgagcgaggtcgacatagatgacgacgaaagacctcacaacccccacaagatcaaatcatgtgaggtcctgttcaatccttttgatgatatcataccacgggagattaaaagattaaagaaagaaaaacctgaggaagaagtcaagaaattgaaaccaaagggcaccaaaaacttcagcctcctcagctttggcgaagaagctgaagaagaagaggaggaagtcaacagggtgtctcagtccatgaaggggaagtctaagtcatcacatgacttgcttaaggatgacccccatctttcctccgtgccagtggtggaatcggaaaaaggcgatgccccagatctagtagacgacggagaggatgaaagcgccgagcacgatgagtacattgacggcgacgagaaaaatctgatgagggaacgcatcgctaaaaaactgaagaaagacacctcagccaatgtgaaaagtgcaggagagggggaggtcgaaaaaaagagcgtgtctcgctcagaggagttgcgtaaagaggcgcgtcaacttaaaagggaacttctggctgctaagcagaaaaaggtggagaacgcggctaaacaagccgaaaagaggagtgaggaagaagaggctccccccgatggtgcagtagccgagtaccgtcgagagaagcagaagtacgaagcactccgaaagcagcagtctaagaaaggcacaagcagagaggatcagaccttggctttactgaatcagttcaagtccaagctcactcaggcaatagcggagacccctgaaaacgacattcccgagacagaggtggaggatgatgagggttggatgtcccacgtgctgcagttcgaagacaaaagccggaaggttaaagacgcaagtatgcaggactctgatacttttgaaatttacgaccctagaaaccctgtcaacaaacgcagaagagaggaatctaagaagcttatgcgagagaaaaaggaaagaagatag

SEQ ID NO: 11578 - DNA, 1173 bp, Artificial Sequence
  Description of Artificial Sequence: Synthetic coding sequence
atgagcaatatctacatccaagagcccccaactaatggaaaggtgctgttgaaaacgactgccggggatatcgacatagagctttggtcaaaggaggcccccaaagcttgcagaaactttattcagctctgtctcgaagcctactacgataacaccatcttccacagagtggtgccgggtttcatagttcaggggggagatccgacggggaccggctccggcggtgagagtatatacggggctccctttaaggatgagttccactcacggctgaggtttaaccggcggggactggtggccatggctaacgccggcagtcacgataatggatcacagttcttcttcacactgggccgggcagacgaactgaacaacaagcacacgatcttcggaaaggtaacaggagacacggtgtataatatgttaaggctcagcgaggtagatatcgacgacgatgaacgcccgcacaatccacataagatcaaaagttgcgaagttttgttcaatcccttcgacgacatcatcccacgagagattaagcggcttaagaaggagaaacccgaggaggaagtcaagaagcttaagcctaaaggaacgaaaaacttctccctgctgtcattcggcgaggaggccgaggaagaggaagaggaggtgaaccgtgtgtcacagtccatgaagggtaagagtaagagctcacatgatcttctaaaggatgacccgcacctaagctccgtgcctgtcgtggagtctgaaaaaggagacgcccccgatctggtggatgatggcgaggacgagagcgctgagcacgacgagtacattgatggcgacgaaaagaacctgatgagagaaaggatcgcaaaaaagctgaagaaagacacttccgctaatgttaaaagcgcaggggagggcgaagtggaaaaaaaatcagttagccggagtgaggaactcaggaaggaagctagacagctgaagcgggagcttctggcagccaagcagaagaaggtggagaacgctgccaagcaggctgaaaagaggtccgaggaggaggaggccccccccgacggggcagtggccgagtacaggcgcgagaaacagaaatacgaggcactgagaaagcaacaatccaagaagggcacctcacgagaagatcaggaaattacaaagagctcgtag

SEQ ID NO: 11579 - DNA, 1971 bp, Artificial Sequence
  Description of Artificial Sequence: Synthetic coding sequence
atggagggtgatgggagcgaccctgaaccacccgacgcgggtgaggactccaagagtgagaatggtgaaaacgcccccatttactgtatatgcagaaaaccagacatcaactgtttcatgattggatgcgacaattgtaatgagtggtttcatggcgactgtattcgaatcaccgaaaagatggctaaagctatcagggaatggtactgtcgtgagtgcagggaaaaagatcccaagctggagattcgctaccgacataaaaagagcagagagagggacggcaatgagagggactcatcagaacccagagacgaggggggagggagaaagagacccgtcccagaccctgacctgcaacgaagggccggatctggcacaggagttggtgccatgcttgccagaggcagcgctagccctcataagagctcccctcagccactcgtggctacgccgagccaacaccaccaacagcagcagcagcagataaagcgcagcgccaggatgtgcggagaatgtgaagcgtgccgtcgcaccgaggactgcggccattgtgacttttgtagagatatgaaaaaattcggcgggcctaacaaaatccggcagaagtgtagattgcggcagtgccagctgagggcacgagagtcttacaagtattttcccagcagcctcagccctgttaccccatctgagtccctgccacgcccccggcggcctctgcccactcagcagcagccgcaacctagtcagaaacttggccggattcgggaggacgaaggcgcagtggcctcatccaccgttaaggaaccacctgaagctaccgccacacctgaaccattgagcgatgaagacctgccgctggaccccgatctctaccaggatttctgcgctggagcctttgatgatcatggtttaccctggatgtctgacactgaggaatcaccatttttggatcccgcgctgcgcaagagggcggtgaaggttaaacacgtcaaacgtcgtgagaaaaaatcggaaaaaaaaaaagaagagcgctacaaacggcatcgacagaaacaaaagcacaaagataaatggaagcatcctgaacgcgccgatgcgaaggacccagccagcctgccacagtgcttgggacctggatgcgttcgcccggcacagccatcaagcaagtattgttcagatgattgcggcatgaaactggcagcaaatagaatttacgagatattgccacagagaatacaacaatggcagcagtccccttgcattgcagaggaacacggcaagaagctgttagagcgaattcgacgggagcagcagagtgctcgaacccgcctgcaggagatggagagaaggttccacgaactagaggccattatcttacgcgccaagcaacaggcagtccgagaggacgaggaatccaacgagggagattcagacgatactgatctgcagatcttctgcgtcagctgtgggcacccgattaaccctagggtggccctacggcatatggaacgctgctatgcaaaatacgagagccagacttcttttggatcaatgtaccccaccaggatcgaaggggcgactaggcttttctgtgatgtgtataacccccagtcaaagacgtattgtaagaggctgcaagttctatgccctgagcacagtagggaccccaaagttcctgcagatgaggtgtgtggatgccctctagtgagggacgtctttgaactgaccggcgacttttgccgacttcccaagcgtcagtgtaataggcactattgttgggagaaattaaggagagctgaggtggatctcgagagggtgcgggtatggtacaagctggacgaactgttcgaacaggaacgcaatgtcaggactgctatgaccaatcgggccggactcctggctctgatgctgcaccagaccatccagcacgacccactgaccaccgacctacgatcctctgcggatcgctag

SEQ ID NO: 11580 - DNA, 1983 bp, Artificial Sequence
  Description of Artificial Sequence: Synthetic coding sequence
atggaaggagatggctcagatccagaaccccctgacgctggggaggactctaaaagcgagaatggagagaatgcccctatttactgtatatgccgtaagcccgacatcaattgttttatgatcggctgcgataattgcaacgaatggtttcatggtgattgcatcagaattactgagaagatggctaaggcgatccgggaatggtactgccgagagtgtagagagaaggacccaaagttggagattcgctaccgtcataaaaagtccagagagcgcgacggaaacgagcgggacagcagtgaacctagagacgaaggtggcggccgcaagcgccccgtgcccgatcccgacttacagcggcgcgccggctccgggacgggagttggagccatgctggctagagggagcgcttctccacacaagagtagccctcagccactcgttgcaaccccctctcagcatcaccagcagcagcagcagcagattaagagatcagcgaggatgtgtggcgaatgtgaagcgtgccggcgcaccgaggattgcgggcactgcgacttctgtcgtgacatgaagaaattcggtggaccaaataagatccgccagaagtgccggctgagacagtgccaactgagagcaagagagtcttacaaatattttccgtcaagcttgtctcccgtcaccccttccgaatccctccctcggccccgcagaccactgccaacccagcagcagccccagccgtctcagaaactgggccgcattagagaagatgagggagcggtagctagtagcacggtgaaagagccgccagaagctacggctactccagaacccctcagcgacgaagatttgcccctggaccctgacctgtaccaggatttttgcgccggtgccttcgatgatcacggcttgccctggatgtctgacaccgaagagagtcccttccttgatcccgctctgcgaaaacgcgcggtgaaagtaaaacatgtcaaaaggcgggaaaaaaaaagtgagaaaaaggtcatggaaagaaaagaagaacgttacaaaaggcataggcagaaacaaaaacacaaggataaatggaagcatccagagcgggccgatgcaaaagaccccgccagcttaccacagtgtctcggaccggggtgtgtcagacccgctcagccttcctccaaatactgctcagatgactgtgggatgaagctggcagcaaaccgcatctatgagattttaccacagcgcatccaacagtggcagcagagcccatgcatagcggaagaacatgggaaaaagttactcgagcgaatcagacgggaacagcaaagcgcacggacccgcctccaggaaatggaacgtaggttccacgaacttgaggcgatcatactgagagctaagcagcaggccgtgagagaagatgaagagtctaacgaaggggatagtgacgacacggatctgcagatcttctgcgtttcctgcggccatccaattaatccgcgggtcgcgttaaggcatatggagaggtgctacgctaaatacgaatcccagactagttttggaagcatgtatccgaccaggatcgaaggcgcaacccgcctcttctgtgatgtctacaaccctcaatccaaaacgtactgcaagcggcttcaggtcctgtgccccgagcattcacgcgatcctaaggtgccagccgatgaggtgtgtggctgtcctctggtgcgggacgtatttgagctgactggagatttttgccggctgccaaaacgacaatgtaacaggcattattgttgggagaaattgcggagagcagaggtggacctggaacgggtgagggtctggtacaagttggatgagctgtttgaacaggagcgcaatgtgcggaccgccatgacgaatagggcgggtcttctggcgttgatgctgcatcagacaattcaacacgatccgttgaccactgatttgagaagctcggccgatcgctag

SEQ ID NO: 11581 - DNA, 834 bp, Artificial Sequence
  Description of Artificial Sequence: Synthetic coding sequence
atgtcactctgcgaggatatgctgctctgtaactatcggaagtgtcggatcaagctcagcggctatgcatgggtcacagcatgcagtcatattttttgcgatcaacacggtagcggagagtttagccgttcacccgctatatgcccggcctgcaatagcaccttaagcggcaagctggacattgtgcgaaccgagctgtcaccatccgaagaatacaaagctatggtccttgcaggcctgcgtccagagatagtgctggatatcagcagccgcgccttggccttttggacctatcaggtacatcaagagagactttaccaggaatataatttctctaaagcagaaggacacctgaagcaaatggaaaagatttatactcagcagatccagagcaaagacgtcgaactgacaagcatgaaaggtgaagtgacgtctatgaagaaagtcttagaagagtataaaaaaaagttttcagatatcagcgaaaaactgatggagcggaaccgtcagtatcagaagctgcaaggcttgtacgatagtctccggctgaggaatatcactatcgcgaatcacgaaggcacccttgagccttctatgattgcccagagtggagtcttgggatttccactcggaaataactccaagttcccactggataacacgcccgtccggaataggggggatggtgacggtgattttcagtttaggccattttttgcgggctcccccaccgcacctgagccctccaattcatttttctcttttgtttctccatctcgcgaactggagcagcagcaggtgtcctccagggcgtttaaggtaaaaagaatctag

SEQ ID NO: 11582 - DNA, 834 bp, Artificial Sequence
  Description of Artificial Sequence: Synthetic coding sequence
atgtctttgtgcgaggatatgcttctctgtaattaccgcaagtgtcgcattaaactgtcgggatatgcgtgggttactgcgtgtagccatatcttctgcgatcaacatgggagtggcgagttcagcagaagtccagctatttgccccgcgtgcaattctactctctccggcaaactggacatcgtgcgaactgagttatcgccaagcgaagagtataaggcgatggtgctggcaggcctgcggcctgaaatcgtcctcgatatctcctccagagcactcgccttctggacatatcaagtgcaccaggagcggctttatcaagagtacaactttagcaaagcggaagggcacctgaaacagatggaaaaaatttacactcagcaaattcagtcgaaggatgtggagctcacctctatgaaaggagaggtcacgagcatgaaaaaggtcttagaggagtataaaaaaaagttttcagacatttcagagaagctgatggagcgcaaccgccagtaccagaagttgcagggcctgtatgattcccttcgcctgagaaacatcacaatcgctaaccatgaagggactctggagccctccatgattgcccagtctggggtgcttgggtttccattaggtaacaattctaagttccctctggacaatacccctgtgaggaatagaggcgatggtgacggcgattttcagtttcgccccttcttcgctggatcaccaaccgctcctgaaccatctaactctttcttctcattcgtcagtccaagcagagaacttgagcaacagcaggtgagcagccgggccttcaaagtcaagaggatatag

SEQ ID NO: 11583 - DNA, 834 bp, Artificial Sequence
  Description of Artificial Sequence: Synthetic coding sequence
atgtctctctgcgaggatatgctgttatgcaactataggaagtgcagaatcaagctgtcagggtatgcctgggtgactgcctgctcccacatcttttgcgaccagcatggcagcggggaattctctcggtctcctgccatttgcccggcatgtaactctacactctccggcaagctcgacatcgtgcgtacagagctgtccccatccgaagaatacaaagctatggtattagcaggactcaggccagagatcgtcctcgacattagtagccgggctttggccttttggacctaccaggtgcatcaagaacgcttgtatcaagagtacaatttctccaaagctgaaggacatcttaaacagatggagaagatttacacccaacagatccaatctaaggatgtcgaactaacctcaatgaagggagaggtcacgtccatgaaaaaagttctggaggagtacaagaaaaaattctccgatatttctgaaaaactgatggaacgcaatcggcagtaccaaaagttgcagggattgtacgattcattgcgtttgcgaaacatcactatcgctaatcatgagggcactctagagccttctatgatagctcagtctggggtgttgggattccctcttggcaataactcaaaattcccacttgataatactccagtacggaaccgaggtgacggggatggagactttcagttccggcccttctttgcgggaagtcccactgcccccgagccttccaactcttttttcagttttgtttcacccagtagagaactggagcagcagcaggttagcagcagggcgttcaaggttaaacgcatttag

SEQ ID NO: 11584 - DNA, 834 bp, Artificial Sequence
  Description of Artificial Sequence: Synthetic coding sequence
atgtcactgtgtgaggatatgcttctgtgcaactataggaaatgccgcatcaaactcagtggttatgcttgggttaccgcctgcagccatattttttgcgaccagcacggctcaggcgaattctccagaagcccagcaatctgtccagcatgcaactcgacactcagtggaaaattggatatcgtcaggaccgagctctcccctagtgaggagtataaggccatggtgctcgctggcctcagacctgaaatcgttttagatattagttcaagagcccttgctttttggacatatcaggtgcaccaagaacggctctaccaagagtacaatttttcaaaggcagagggccatctcaagcagatggagaaaatctatacccagcaaatccagtctaaagatgtcgaactgacaagcatgaagggtgaagtgacctctatgaagaaggttctcgaggagtacaaaaaaaaattctccgatatttcagaaaagctgatggagagaaacagacagtaccagaagctgcaggggctttatgacagcctgcgcctgaggaatatcaccattgcaaaccacgagggcacattggagccctccatgattgctcagagcggggtgttaggctttccgttaggcaacaattcaaagttccctttggacaataccccagtccgaaacagaggggacggcgatggggacttccagttccggccgttcttcgcaggttctccgactgcccccgagccttctaactccttcttctcatttgtgagtcctagcagagaactggaacagcagcaggtgtcgagccgagcatttaaagtgaagcggatttag

SEQ ID NO: 11585 - DNA, 834 bp, Artificial Sequence
  Description of Artificial Sequence: Synthetic coding sequence
atgagcctttgcgaagacatgctgctctgcaactacagaaagtgcagaattaagctgtcaggttacgcctgggtgaccgcatgcagtcatattttttgcgaccagcatgggagtggagaattcagccggagtcctgccatttgccctgcttgcaattcgaccctgtctggtaagctggacatcgtgcggacagaactctcgccctcggaagaatacaaagccatggtgctggccggactgcgcccggaaatagtacttgatatttcttcaagagcgctggccttctggacctatcaggtgcaccaagagaggttataccaggagtacaatttcagcaaggccgagggccacctcaagcagatggaaaagatatacacgcagcagatccaaagcaaggacgttgagctgacatcaatgaagggcgaggtgacaagtatgaaaaaggttttagaggagtacaaaaagaagttcagtgatatctccgaaaagctcatggagagaaatcgacagtatcagaagctacagggcctgtatgactctttgcggctgaggaatatcaccattgccaatcacgagggcactctggagccttcaatgattgcgcaaagtggcgtgctgggttttcccctgggcaataatagtaagttccccttggataacacgccagtgcgaaatcgcggagatggggacggtgacttccagttcaggccattctttgcagggtcaccgacagccccagaaccttctaactcttttttttcctttgtttcgcccagcagagagctggagcagcagcaggtgtcctcaagggccttcaaagtgaagaggatctag

SEQ ID NO: 11586 - DNA, 834 bp, Artificial Sequence
  Description of Artificial Sequence: Synthetic coding sequence
atgtccctgtgcgaagacatgcttctctgtaattatcgaaagtgccgaatcaaattaagtggatatgcctgggtaaccgcttgtagccacattttctgtgatcagcacgggtctggggaattttctagatcacctgccatctgtcctgcttgcaatagtactctcagtggaaaactggatatcgtgcgcacagagctcagcccgtccgaagagtacaaagccatggtattggcaggtctgcgtcctgagattgttttggatatctcttcccgcgctttggctttctggacgtaccaggtgcatcaggagagattgtaccaagaatacaatttcagcaaagccgagggccaccttaagcagatggaaaaaatctatacacagcaaattcagagtaaagatgtcgagcttacctcgatgaagggggaagtcacctctatgaaaaaggtgttggaggaatataaaaaaaaattctctgatatcagcgagaagctgatggagaggaatcgacagtatcaaaaactccaggggttatacgatagcctgagactccgaaacataactatcgccaatcacgagggtaccctcgaacctagtatgattgcacagtcgggcgttctgggattcccgctcggaaacaattcaaagtttcccctggacaacacaccagtccgtaaccgcggcgacggcgacggcgactttcagttcagaccttttttcgcgggatcacccacagcccctgagccctctaatagctttttctcatttgtgtcaccctcaagggagttggagcagcagcaggtgtcatcacgggcttttaaggtcaagaggatttag

SEQ ID NO: 11587 - DNA, 15 bp, Artificial Sequence
  Description of Artificial Sequence: Synthetic coding sequence
atgagcctgtgctag

SEQ ID NO: 11588 - DNA, 465 bp, Artificial Sequence
  Description of Artificial Sequence: Synthetic coding sequence
atgagcctatgcgaggacatgctgctttgtaattacagaaagtgcagaattaagctgtctgggtatgcatgggtgacggcctgcagtcacatcttctgcgatcaacacgggtccggtgaattttctcggtcccccgccatttgccccgcctgcaattcaactctctccgggaagctggacattgtgcggaccgaactgagcccctctgaggagtacaaggcgatggtcctggcggggctcagacctgagatcgtacttgatattagcagccgggcattggccttctggacgtaccaggtgcatcaggaaaggctatatcaagaatacaacttctctaaggccgaaggtcatctcaaacagatggaaaagatctacacacagcagatccaaagcaaagacgtcgagctgaccagcatgaagggggaggtgacatctatgaaaaaggtgctggaggagtacaagtag

SEQ ID NO: 11589 - DNA, 1119 bp, Artificial Sequence
  Description of Artificial Sequence: Synthetic coding sequence
atggagctggaaggacagtggtggaggggacagctcgcagccgacattcatcaggcccttagatacaaagagctgaagctgcccagctacaaaggccagagccctcagctgagtttgcggaggtacttcgcagatctgattgccatcgtatctaatagattcacactgtgtcccagcgcccgacaccttgccgtgtatctattagacctgtttatggatcgctatgacatcagtattcagcagctccatctggtcgccctctcatgcctgctccttgcgtcgaagtttgaggagaaggaagatagcgtcccgaagctggaacaattgaatagtctcggctgcatgacaaacatgaatctggttctgactaagcagaatctcctgcacatggaactcctgctccttgagactttccaatggaacctgtgtctcccaaccgctgctcactttatcgagtattatctgtccgaggccgtacacgaaacggacttgcacgacggatggcctatgatttgcctggagaagactaagctctacatggctaaatatgccgactacttcctggaggtgtcgctgcaggtcgccgccgcctgtgtcgcctctagtagaatcatactgcggctgtctcctacctggccaacacgcctccacagattgacagcatattcttgggactttctggtacaatgtattgagagactgctgattgcgcatgataacgatgtaaaagaagccaataagcaaagaggccaggccggacctcagtctgcgcagctttcagtgtttcagaccgctagtcagccttcccggcccgttcactttcagcagccccagtatcttcaccaaacccaccagactagtctgcagtaccggcaccctacaagcgagcagccctcatgtcagcagattgtgtctacgacccacaccagctcctacacactgcagacgtgtcccgcaggattccagacaagtgtgcaaggactgggccacatgcagacaggcgtcggcatgtcccttgccattcccgtagaagttaagccctgcctttccgttagctacaatcgaagttaccaaattaatgagcattatccttgtatcacaccatgctttgagcgatag

SEQ ID NO: 11590 - DNA, 1116 bp, Artificial Sequence
  Description of Artificial Sequence: Synthetic coding sequence
atggaacttgagggtcagtggtggcgaggccagcttgcagccgacatccatcaggcccttcggtataaggaactcaaactaccctcctataagggccagtcaccacaactgagcctgcggcggtatttcgccgacctgattgcaatcgttagcaaccgatttacactgtgcccatcagcaaggcatctggccgtctacctgctggatctcttcatggaccggtacgatatctccatccagcaattgcacctcgtcgccctgtcttgtctattgctggctagcaaattcgaagagaaggaggactccgttcctaaacttgaacagctcaattctttgggatgtatgacaaatatgaatcttgtactcaccaaacagaatctgctgcacatggaactcttgcttttggagacttttcagtggaacttatgtttgcctaccgccgcccattttatcgagtactatttgagcgaggccgtgcacgagaccgatttgcacgatggatggcccatgatctgtcttgaaaagacaaaactctatatggccaagtacgccgattatttcctggaagtcagtctgcaggccgctgcatgtgttgcctctagtcgcatcattcttcgcctctctccaacatggcctaccaggcttcatcggcttactgcctattcttgggattttttggttcaatgcatcgagagactactcatcgcacatgataacgatgtaaaggaggctaacaaacaaaggggtcaggctgggccccagtcagcccagctttctgttttccagaccgcatcccagcccagtaggccagttcactttcagcaacctcaatatctacatcagacacatcaaacctctctccagtaccggcatcccacttccgaacagccaagctgccagcaaatagttagcactacccacaccagctcatacaccctgcagacgtgtcctgccggcttccagacatcggtgcagggtctgggccatatgcagacaggggttggaatgagcctggcgatacctgttgaagtcaagccttgcctcagcgtgtcctataacaggagctaccagatcaatgaacattatccctgcattacgccctgcttcgagcgttag

SEQ ID NO: 11591 - DNA, 1152 bp, Artificial Sequence
  Description of Artificial Sequence: Synthetic coding sequence
atggagctggagggtcagtggtggaggggccagctcgccgccgatatccatcaggcgttgagatacaaagagctcaaattgccatcttacaagggccagtctcctcagctgagtttgcgacgctactttgccgatctcattgccattgtgtccaataggttcactctttgcccatcagcgcgccacctggccgtgtaccttctggatctgttcatggacaggtacgatatctcaattcaacagctacacctggtcgcacttagctgcttgctgctggcatcaaaatttgaagagaaagaggattccgttcctaagctcgaacagctcaatagtctggggtgcatgaccaatatgaatttggtgttaaccaaacaaaacctcctccacatggagctgctgctcttggagaccttccagtggaacctttgtctgccaaccgccgcacattttatcgagtattaccttagcgaggcggttcacgagacagacctacatgacggttggcccatgatctgcctggaaaagaccaagttatacatggcaaagtacgccgactatttcttggaggtttcactgcaagactatgctttccttaactatgcccctagcctagtagcagcggcatgtgtggcttccagtaggataatcctgcgcttaagcccaacttggcccacacgcctgcaccgcctgacggcctactcgtgggactttctcgtgcaatgcattgagcgcctgcttatcgcccatgacaacgacgttaaggaggctaataaacagcggggccaggccggccctcagagcgctcagctcagtgtatttcagacagcctcccagccctctagacccgtccactttcagcagccccagtatttgcatcaaacacaccaaacatcactccagtaccgccaccctacatccgaacagccttcttgccagcaaattgtaagcacaacccatacctccagctataccctacaaacctgccctgctggtttccagacgtctgtgcagggcctgggccatatgcagactggcgtgggaatgtcgttagctataccagtggaggtcaaaccctgcctatccgtcagctacaatcggtcttatcagatcaatgagcattatccctgtattactccttgtttcgagcgctag

SEQ ID NO: 11592 - DNA, 1119 bp, Artificial Sequence
  Description of Artificial Sequence: Synthetic coding sequence
atggagttagagggccagtggtggcgcggacagctggccgcggacatccatcaggcccttcgttataaggaacttaagctacctagttataaagggcagtctccacagctttcactgaggcgatacttcgctgacctgatagccattgtgtcaaatagatttactctatgcccctctgcccgtcatctggcggtgtatctgctagacctgttcatggataggtacgatataagcatccagcagctccatctggtggccctgtcgtgtctgttattggcttcgaaatttgaagaaaaagaggactccgttcctaagttggagcaactcaactcacttgggtgtatgactaacatgaatctggtgctcacgaagcagaatctgctgcatatggaactgctcctccttgagacgtttcagtggaacctgtgcttgcctaccgcagctcacttcatcgaatattatctgagcgaggccgtccacgagacggacctacacgatggatggcctatgatatgtctggagaagacaaagctctacatggcgaagtacgctgattattttctagaagtaagcctacaggtcgctgctgcatgtgtcgctagctcgcgcattatactgcggctctctcctacttggcctacccggctccatcggctgaccgcctactcatgggatttcctcgtccaatgtatagaacggctcctcattgctcatgacaatgatgtgaaggaagctaataaacagcgtggacaggctggaccccagtcagcccaattatctgtctttcaaacagcatcccagccttccagaccggttcacttccagcagcctcagtacctgcaccagacacatcagacatcgttgcagtatcggcaccctacgtctgagcaacccagttgtcagcagatcgtgagtacaacccacactagttcctacacattgcagacctgccccgcaggatttcagacttctgtgcagggcctagggcacatgcagacaggggttgggatgtctcttgcgattcctgtggaggttaaaccctgcttgagtgtgtcctacaaccgctcataccaaattaatgaacactacccttgcatcaccccttgttttgagagatag

SEQ ID NO: 11593 - DNA, 4446 bp, Artificial Sequence
  Description of Artificial Sequence: Synthetic coding sequence
atgccaaactctgagcgccacgggggtaagaaggacggctccggaggggcctccgggaccttgcagcccagctcagggggtgggtcatcaaactccagagaacggcatcgtttggtgagtaagcataaaaggcacaagtctaagcattccaaggatatgggactagtaacacccgaggctgcctcacttggaactgtaatcaagccactggtcgagtacgacgatatctccagtgatagcgacaccttttccgatgatatggcttttaagctcgaccgccgcgaaaatgatgagagacgggggagcgatcgatccgaccgtctgcacaagcatagacaccaccaacaccgacggagccgggatctcctgaaagcaaagcagacggagaaagaaaagtctcaggaggtgtcatccaagtccggatctatgaaagacaggatttcagggagtagtaagcgctcaaacgaggagacagacgactatggtaaggcacaagttgccaagtcctcctcaaaggagtcgaggtcctcaaagctgcataaagaaaagacccggaaagaacgcgaactgaagtcgggccacaaagataggtctaaatcgcatagaaaacgggagacaccaaagtcctacaaaactgttgactcacctaaaagacgttcacggagcccccacaggaagtggtccgactcatctaagcaagatgactctccttcgggggccagctacggccaggactatgatctgagccccagtaggtcacacaccagcagcaactatgacagctacaagaaatcccctggttcgacgtctagaagacagtctgtgagcccaccttacaaagaaccatcagcctatcaatcctcgaccagaagcccatcaccatactcccggcggcagaggagcgtgtcgccatactcccgtcgcaggtcctcttcctatgaacgctcgggctcctatagcgggcgcagccccagcccatacggacggaggaggtcttcgtccccattcctgagcaagcgctccctgtctagatctccccttccaagtcgcaaaagtatgaaatctcggagtcgctcccccgcatatagcagacattcatcttctcactcgaagaaaaagaggtcctcaagccgttctcgacactcttctatttccccggtccgcctgccattgaattcgagcctcggagccgaactctccagaaaaaaaaaagagagggcagccgctgccgcagcggcaaaaatggacggaaaggagtccaagggcagtcccgtgttcctccctagaaaggagaatagttccgttgaagctaaggattccggactagagtccaagaagttgcctagatcagttaaattagagaaatcagcacccgacactgaacttgtcaacgttacccacctcaatacagaagtgaaaaactcgtccgataccgggaaagtgaaacttgacgaaaattctgagaagcatctggtaaaggacctcaaggcccagggtacccgggattctaagccaattgctctgaaggaagaaatcgtcacacccaaagagacagagacttcagagaaggaaaccccaccacccctcccaacgatagcctccccaccgccacctttgccaaccactacgccgcccccacagaccccacctctgccaccactgccacctattccagctcttccccagcagccacctctgccgcccagccagcctgcctttagtcaggtaccagctagctccacatcaacactaccacctagcacccactctaagacaagtgctgtctcaagtcaggcaaattctcaaccacccgtgcaggtcagcgtgaaaactcaggtttctgtaactgctgctatcccacacctaaagacatcaactctcccacccctgcccctcccacctcttctgcccggcgatgacgatatggattctcctaaggagaccctgcctagcaagcccgtcaagaaggaaaaggagcagcggacacgacatctgttgaccgacctccctctcccccctgagctgccaggcggggacctgagtccccccgacagcccagaacccaaggcaattacaccaccccagcagccatataaaaagcggcccaagatttgttgcccacggtacggcgagcggaggcagaccgaaagcgattgggggaaaagatgtgtggacaaattcgacatcattggtattatcggcgagggaacatatggacaggtgtataaagccaaggacaaagatactggagagctggtcgcactaaaaaaggttcgcctggacaatgaaaaagaggggtttccaattacagccattcgtgaaattaagatcctgcgtcagctgatccatcgcagcgtcgtcaacatgaaggaaatcgtgactgacaagcaagacgcccttgacttcaagaaggacaagggcgccttctatttggtgtttgaatacatggatcacgacctgatgggtttgctggagtccggactcgttcactttagcgaagatcatatcaagagttttatgaaacaactgatggaaggcctagaatattgtcacaagaagaactttttgcatagggacataaaatgtagtaatatacttttaaataacagtgggcagattaaattggccgatttcggcttggcccggctgtataattcagaggaaagccggccatacaccaacaaggtcatcacgctctggtacaggccgccggagttgctactgggcgaggagcggtacacgccggcaattgacgtctggtcgtgcggctgtatcctgggcgaattattcacaaagaagccaatctttcaggccaacctggaactggcccagctggagctgatatccaggttatgcggctccccatgccccgcggtctggccagacgttattaagcttccatacttcaacacaatgaagccgaaaaaacaatacaggcggcgcttacgagaagagttctcgttcataccctcggccgctctggacctactggaccatatgcttactctagacccctctaagcgctgcactgcagagcagaccctgcagtcagacttcctgaaggatgtggagctgagcaaaatggccccccctgacttgccccactggcaggattgtcatgagctctggtcgaaaaaaaggagaaggcagcggcagagtggagttgtcgtcgaggaacccccacctagcaagacttccaggaaagaaactacttccggcacctccacggagcccgtaaagaactccagtccagcccccccacaaccagccccaggcaaggttgagtccggggccggagacgcaattggactggcggacataactcagcagctgaaccagtctgagctagctgtgctgctgaatttgctgcagagtcagacggatctctccatcccccagatggcacagcttctaaatatacacagtaaccctgaaatgcagcaacagcttgaggcattgaaccagtctataagtgctcttaccgaggcaactagccagcagcaggactccgagacgatggcaccggaagagagccttaaggaggcgcccagtgccccagtcattctgccttctgctgagcagaccaccctggaggcatcttctacccctgcagacatgcagaacattctcgctgtgcttctctcgcagctcatgaagactcaggagccggctggaagtcttgaagagaacaactctgataagaacagtggtccacaaggtccgcggcggactcctaccatgcctcaagaggaggctgctgaaaagcggcctcccgaacctcctggtcccccaccacctcctcccccaccacctctcgttgagggtgacttgagttctgctccacaggagctgaaccctgccgttacagcagcccttttgcagctactgagtcagccagaggctgagccccccgggcacttgcctcacgagcaccaggcgttacgaccaatggaatattctacacgcccaaggccaaatcgtacgtacggcaatacagacggccctgaaacaggatttagcgccatcgataccgacgagcggaatagcggtccggcattgaccgaatcattagtgcagaccttggttaagaacagaaccttttcagggtccttgagtcacctgggtgagtcctcctcataccagggcaccggcagcgtgcagttccccggcgatcaggaccttagatttgcccgcgtgccgctggcactgcatcctgttgtagggcagcccttccttaaggcagaaggaagttcaaactccgtggtgcatgccgaaactaagctgcagaactatggcgagcttggcccaggaacaacaggcgcaagctcctctggcgccggacttcattggggtggccctacccagtcttcagcctacggcaaactatatagaggacccacaagggtccctccccggggtggaaggggacgtggcgtaccgtactag

SEQ ID NO: 11594 - DNA, 4473 bp, Artificial Sequence
  Description of Artificial Sequence: Synthetic coding sequence
atgcctaacagtgaaaggcacggtggcaaaaaagacggatctggcggggcctccgggacactgcagccaagttccgggggcggcagctcaaattctcgagaaagacacaggttggtgagtaagcataaacgacacaagagcaaacactctaaggacatgggccttgtgacgcccgaggcagcgagtctgggaacagtgattaagccccttgttgagtacgatgatatctcctcagactccgacaccttctcagacgacatggcttttaagttggaccgtagagagaatgacgagcggagggggtcggatagatctgacaggcttcataagcatcggcaccatcaacacaggcgcagtcgtgacctgctcaaggcgaagcaaacagaaaaagaaaagtctcaggaggtaagtagcaaatcaggctccatgaaagatagaatctctggttcaagcaagcgatctaacgaagaaaccgacgattatggtaaagcccaagtggccaaatcgtcatcaaaagagagtcgctcctccaagctgcacaaagaaaaaacacgcaaggaacgggagctgaaaagcggccataaggacagatccaagtctcaccgtaaacgagaaacaccaaaatcctacaaaactgttgactcaccaaagcgtagatcacgtagtccgcaccggaaatggtctgactccagtaaacaggacgacagtccatccggggcctcatacggccaggactacgacctctctccctcaaggagtcacacaagttccaactacgattcatataagaagagtcccggaagcactagcaggcgccaaagcgtctcaccgccttacaaggaaccaagcgcttaccagtcctctacaaggagtccgagtccttactcgaggaggcaacgcagcgtgagtccctattccagaaggagaagtagctcctacgagcggtccggctcttattctgggaggtcaccatccccatacggtagacgccgcagctcgagtccgtttttgagcaagcgctctctgagccgatcccctctaccaagtagaaagagtatgaaatccagatctcgaagccctgcctattcccgccactcctccagccacagcaagaagaaacgtagctcgtcacgatccagacatagctccatcagccccgtgcgactgcccttgaattcaagcctgggcgccgagctgagcagaaagaaaaaagagagggcggccgcagccgcagccgctaaaatggatggcaaggagtctaaaggaagccctgtttttctccctagaaaagagaattcttcagtggaggccaaagactctgggctggagtctaagaaactcccgcggtcagtgaagctggaaaagtctgcaccagataccgagttggtgaatgtgactcaccttaatacagaggtaaagaattcatctgacacaggaaaagtcaagctagacgaaaactccgagaagcatctagtgaaagacctgaaggcccaggggacacgggactccaagcctattgcgctcaaggaagaaattgtcaccccgaaagagacagaaacaagtgagaaggaaactcctccccccctgcccaccattgcctctccgccgccacctctgcccaccacaactcccccaccgcagactccgccgctgcctcccctccctccgatccctgcgctcccccagcagcccccgttgccccccagccagccggcttttagccaggtgcccgcctcctccacttctacccttccaccttcgactcactcaaagacaagcgcagtcagctctcaagcgaacagccagccccctgtgcaagtcagcgtgaaaacgcaggtgtccgttaccgcagcaataccccacttgaaaacctcaaccctaccccccttgcctttacctcccctactgcctggagatgacgacatggattctcccaaggagaccctgcctagcaaacccgtgaaaaaggaaaaggagcagaggactcgtcatctccttaccgacctgcctttgccccccgaactccctggcggggacctgtccccaccagactctcccgagcccaaggccattactcctcctcaacagccttacaaaaagcggccaaaaatatgttgtccgcggtatggggagcggcggcagacagagtcggactggggcaaaagatgtgtggacaaatttgacattatcggtatcattggagaagggacatacggccaagtctacaaggcgaaggataaggacaccggcgaactggtggcacttaaaaaggtccgtcttgataatgagaaagaagggttccccataactgctattcgggaaattaagatcctgaggcagttaattcaccgcagcgtggtgaatatgaaggagatagtaaccgataagcaggacgccctagatttcaagaaggacaagggagctttctacctcgttttcgagtatatggaccatgatctgatgggtttactcgagagtgggctggtgcacttctcagaagaccacatcaaaagcttcatgaagcagttaatggagggactcgaatactgccataaaaagaacttccttcatcgcgacatcaagtgttccaatattttactcaataattccggccagattaagctcgctgacttcgggctggcgcgactgtataactcggaggaatctagaccttatacaaacaaagtgattactctgtggtatcgaccgccagagctgctattgggggaagaaagatatacgccggccatcgatgtgtggtcctgtggatgcatcctgggggaactgtttacaaagaagccaatatttcaggcaaacttggaactggcacagctggaactgatttctcggttatgtgggagtccctgtccagctgtgtggcctgacgtgattaagcttccatacttcaataccatgaagccaaagaagcagtatagacgtcgcctgcgggaggagttcagctttattccaagcgctgccttggaccttttggaccatatgctgacattggacccctcaaagcggtgtaccgctgaacaaactctgcagagtgactttctaaaagatgtggagctgtctaaaatggccccacctgacctcccgcattggcaggattgccacgagctgtggtcaaagaaacgccgccgtcaaagacagtcgggtgtggtggtggaagagcctccaccgtccaaaaccagtagaaaagaaacaacatctggaacgtctacggagccagtgaagaactcttcgcctgcccctccgcaaccggccccggggaaggtcgaatctggagcaggcgatgccataggactggccgatatcactcaacagctgaatcaaagcgagctggctgtcctgctgaatctacttcagtctcaaactgacctgagcatccctcagatggctcagctgctaaatatccactcgaacccagagatgcaacagcaattggaagctttaaatcagtcaatttctgcactgaccgaggccacaagtcagcagcaagattccgaaactatggcccccgaggaatcattgaaagaggccccctctgcgcctgtgattctgccatccgctgaacaaaccaccctggaggcctcatcgacccctgccgatatgcaaaacattctggcagtgttattaagtcagctgatgaaaacacaggagccagctggttcgctggaagagaataactccgataagaattctgggccacagggcccccgtaggaccccaactatgcctcaagaggaagccgctgcatgccctccacacattcttccccctgagaaaagaccacctgaacctccaggtccacctcctcctccgcccccaccacctcttgttgaaggggatctgagtagcgctccacaggaacttaatcccgccgtgacagccgcgctcttgcaactcctctcccagcccgaagcagagccccctggtcacttgccgcatgaacaccaggcactccggcctatggagtattccacccggccacgtcctaatcgcacatacggcaataccgatggcccagagactggcttttccgcgatcgacaccgacgaacggaattccggtcccgccctcaccgaatcactggtccagacactggtcaaaaaccgaacattttcaggttcgctctcacatttgggtgagagcagtagctaccaagggaccggcagcgtccagtttcctggtgaccaggacctgaggtttgctagggtgcccctggccttgcaccctgtagtcggccagcctttcttgaaagccgagggaagcagtaacagtgttgtacacgccgagaccaagcttcaaaactatggagagctcggacccgggactaccggtgcctcaagttcaggggccggcctgcactggggcggtccaacccagtcgtccgcctatgggaaactctaccggggcccaaccagagttccgccacggggaggtcgcggccggggcgtcccttattag

SEQ ID NO: 11595 - DNA, 4539 bp, Artificial Sequence
  Description of Artificial Sequence: Synthetic coding sequence
atgcctagtagctcggacactgctctcggaggaggggggggactctcctgggccgagaagaagcttgaagaaagaagaaagcgccgacgcttccttagtccgcagcaaccaccactcctgctcccattactgcagccacagctcctgcagccacccccaccgccgccacccctgctgttcctcgctgcccctggtacagctgctgccgccgccgcagcagcagctgcctccagtagctgtttctcccccggcccacccctggaggtcaaacggttagccaggggtaagcgtcgagcggggggacgccagaaaagacgccggggacccagggcgggacaggaagcagaaaaacggcgggtatttagtttgcctcagccccagcaggatgggggcgggggcgcgtcatctggagggggagtgacaccactggtagagtatgaagatgtatccagccaatcagaacagggcctgctactggggggcgcttccgccgctacagccgctacggccgctggcggcaccggtggtagtggcggcagtccggcctcttccagcggcactcagcgtagaggtgaaggctctgagcgaagaccccgcagagatcgccgcagctccagtggtcggtctaaggaacggcatcgcgagcaccggcgacgggacggccaaaggggcgggtctgaggctagcaaatcacggtcaaggcatagccatagtggggaggagcgcgccgaggtggctaagagcggctcttcttcatcatctgggggccggcgcaagtcggccagtgcaacaagcagtagctccagttcccgaaaggaccgagacagcaaggctcacagatcacggaccaaatcatcgaaagagcctccctcagcctataaggaaccccctaaagcctaccgggaagataagacagagccaaaggcctaccggagacggagatccttgagcccactggggggaagggacgatagccccgtcagccaccgagccagtcagagcctgcggagcagaaaatccccctcccccgcgggtggaggcagcagcccttatagtcgcaggctgccacggagcccaagcccctattctcggcgaaggtcaccgtcctatagccgccattcaagttatgaacggggtggtgacgttagtccatcaccttactcgagcagctcatggcgccggtcaagaagcccctatagtcctgtgcttagacgctcaggcaaaagccgtagcaggtctccctacagctcccgccattcaaggtctcgaagtagacacagactgtctcgttcccgcagccgccattcttctatttccccaagcacgctaactctcaaatccagtcttgcagccgaactgaacaaaaataagaaggcccgtgcggcggaagcagcccgcgccgccgaagccgccaaagcagccgaggcaacaaaagctgctgaggccgctgcaaaggcagcaaaagcctcaaacacgtcaaccccaactaaaggaaatactgagacatctgcgagcgcctcccagaccaatcacgtaaaagacgttaagaaaataaaaatcgaacacgctccttccccaagcagtggtggcaccctgaaaaatgataaagccaagactaagccccctctgcaggtgactaaagtcgaaaacaatttgatcgtcgacaaggccaccaagaaggctgttattgtcggaaaagagagcaagtccgccgcaactaaggaagagagtgtgagtttgaaagagaagaccaaaccactgactccatcaatcggcgcaaaggaaaaggaacagcacgtggcccttgtcacaagtacccttcctcctctgcccctaccacctatgctgccagaagataaggaggccgatagccttagaggaaacattagtgtgaaagccgtgaagaaagaagtggagaaaaaactccggtgtcttctggccgatctgcctttgccccctgaacttccaggaggcgacgacctctcaaaatctccggaagagaagaagacagcgacccagcttcactcaaagagacgccccaagatatgtggccctcgctatggcgagacaaaggagaaggatatagattggggcaagaggtgtgttgataagttcgatattatcggaattattggtgaaggcacttatggtcaagtttacaaagcaagggataaagacacaggcgagatggtggcactaaagaaagtcagactggataatgagaaagagggctttccaattacagccattagagaaatcaaaatcttgaggcagctaacacaccaatctatcataaatatgaaagagattgttacagataaagaggatgccctggacttcaaaaaggataaaggtgctttttatttagtttttgagtacatggaccacgacctaatgggtctgcttgagagcgggctcgttcatttcaacgaaaatcacatcaagtccttcatgagacaacttatggagggtctggactactgccacaagaaaaattttctccatcgcgacattaagtgtagcaatatcctgctgaacaaccgcggacagattaagttggctgacttcggcttggcaagactttatagttccgaggaatctcgtccgtataccaacaaagtgatcactttgtggtatcgcccccctgaactgctgctgggggaggagagatacacacctgccattgacgtgtggagctgcggatgcatactcggcgagctgttcaccaaaaagccaatctttcaggctaaccaggagctcgcccagttggagctgattagtcgcatctgcggcagtccctgccctgctgtctggcccgacgtcatcaagctcccctacttcaatacgatgaagcccaagaagcagtatcgtaggaagctccgcgaggagtttgtcttcattcccgccgctgccctcgatttgttcgactatatgctggctctagacccctccaaacgatgcacagcagaacaggctctgcagtgcgagttcctgagggatgtggaacctagcaagatgcctccacctgacctccctttgtggcaggactgccacgaactctggagcaagaagagacgcaggcagaagcagatgggcatgacagacgacgtaagcaccattaaggctccccgaaaggatttatcccttggactggacgatagtaggactaacaccccgcagggagtgctgccaagctcccagttgaaatctcagggatccagcaacgtggctcctgttaaaacaggtccgggtcagcatttaaaccattccgaattagcgattttgttgaatctgctgcaatctaagacctctgttaacatggccgacttcgtccaagttctgaacatcaaggtgaatagcgaaacacagcagcagttaaacaaaattaacttaccagccggaatactggcgaccggagaaaagcagactgatccttccaccccccaacaggagtcctccaagcctcttggcgggatccagccgtcaagtcagacgattcaacccaaggtggaaaccgatgccgcccaggcagctgtacagagtgccttcgcagtgctgctcacacagttgatcaaagctcagcaatccaaacagaaggacgtcctcctggaggagagagagaatgggagtgggcatgaagctagcttacagctgaggcccccacctgagccttcaacacctgtcagcgggcaggatgacctcattcaacaccaggacatgaggatactggagttaaccccggagcctgatcgcccgcggattttgccaccagaccaacgtccccctgaacctccagagccccctccggttacggaggaagacttggattacagaactgagaaccagcacgtgccgactacctcaagttccctgacagatccgcatgctggggtgaaggcggctctgttacaactgcttgctcaacatcagccccaggacgacccaaaaagagagggtgggatcgattaccaagccggggacacatatgtgtcaacctccgactataaggataattttggttctagttcgttcagctcagccccttatgtgagcaatgatgggctgggctcttccagcgcgcccccgcttgagagacgtagcttcattggcaattctgacattcagagcctggacaactacagcaccgcatcatcacactccgggggcccgccccaaccttcagccttttctgaaagctttccttcaagcgtcgccggctacggtgatatttatctaaatgcaggtccaatgttgtttagcggcgacaaagatcatcggttcgaatattctcacgggccgattgccgtactcgccaacagtagcgatccttctacaggacccgaatccacacacccgctaccagccaaaatgcataattacaattacggcggaaacctccaggagaatcccagcggaccatctctcatgcatggtcagacgtggacctccccagcccaggggcctgggtatagccaggggtatagagggcacataagcacgagcacaggccgggggcgaggacgcggcctgccttattag

SEQ ID NO: 11596 - DNA, 4359 bp, Artificial Sequence
  Description of Artificial Sequence: Synthetic coding sequence
atgccctcctcttccgacacggcactgggaggcgggggaggactcagctgggcagaaaagaagctcgaggagaggagaaagcgacggcgattcctgagtcctcaacagccccctctgctcctccccctgttgcagccccagttgctgcagcccccgcctcccccacctcctttgcttttcctggccgcccctggaacggctgcagccgccgctgccgctgccgccgcctccagctcctgctttagcccggggcctccacttgaggttaaacgcttggcgagggggaagcgccgcgccgggggaaggcaaaagcgaagacgaggacctcgggctggacaagaggccgaaaaacggcgtgtgttcagcctgccacaaccgcagcaggatggtggcggcggcgcttcctccggggggggcgtcacccccttggtggagtacgaggacgtctccagtcagagcgagcaggggttgttattgggtggtgctagcgccgctacagccgccacggcagcaggagggacaggaggatctggcggctcccccgcttcctcttcgggtacgcaacgcaggggggaggggtccgaacgccggccacggagagacaggagatctagtagcggccgctccaaggagcgccatagggagcatagacggagagacgggcagcgcggcggaagtgaagcttccaaatcccgctctcggcatagtcattccggagaagagagggctgaggtagctaagagcggttcttccagcagcagcggcggccggcgaaaatcggcgtccgccaccagtagctctagctcctcccgaaaggatcgggactcgaaggcccataggtctaggactaaatctagtaaagagcctccctctgcttataaagagccgccgaaggcttatcgagaggacaagactgaacccaaggcctatcgcaggcggcgctccctttcacctcttggcggccgggacgacagccctgtgtcccacagggcaagccagagtctgcgatcccggaagtcccctagcccagccgggggcgggtcttccccttattcgagacgccttccaagatctccttccccgtactcaaggcggcgttcaccatcctatagccggcactcaagctatgaacgggggggagacgtgtctcctagcccctacagttctagttcatggagaaggtcaagatcaccttattctccagtattgcgtagaagcggaaagtctaggtccagatcgccatattcatcccgacacagtagaagcaggtcgcgtcaccgtttgtctcgaagtagaagccggcatagcagtatttcaccaagtacgttgacactgaagagctccctcgctgccgagctgaacaaaaacaagaaggcgcgagcagctgaggccgctcgtgctgctgaagccgccaaggccgcggaagcaactaaggccgccgaggccgctgctaaggccgccaaggcctctaatacatctacccccaccaagggaaacacagaaacatccgcttccgctagccagacaaaccatgtgaaagacgtaaaaaagattaagatagagcacgcgccatccccctcgagtggtgggactctgaagaatgacaaagctaagaccaagcctcccttgcaagttaccaaggtggagaacaatcttattgtggataaggccactaagaaagcagtgatagttggaaaggagtccaagtccgctgccaccaaagaagaatctgtgtctctgaaggaaaagaccaaacctttaacaccttccattggcgcaaaagagaaggagcagcacgtggccctggtcacgtccacgttgccccctctgcctctgccgcccatgctaccagaagataaggaggctgatagcttgcgaggtaatatctctgtaaaagccgtgaagaaggaggtcgaaaaaaagctgaggtgcctgctggcggaccttccattgccgccagagctgcccggcggcgacgacctcagcaagtctcctgaggaaaaaaaaacagcgacccagctgcattctaaacgaaggccaaagatatgtgggccccgttatggcgagacaaaggagaaagacatcgattggggtaaacgctgcgtggataagttcgatatcataggcatcatcggcgagggcacctatgggcaggtgtataaggccagggacaaggatactggagagatggttgcgttaaagaaggtgagattagataacgagaaggaagggttccccataacagccatccgggagattaaaattctgagacagctgacacaccagtcaataatcaacatgaaggagatcgttacggacaaggaggatgctttggattttaagaaagataagggcgccttttacttggtctttgaatacatggatcatgatctcatgggcttgttggagtccggtttagttcacttcaatgagaatcatattaaatcttttatgagacagcttatggaaggactggactactgccacaagaaaaactttttgcaccgagatatcaaatgttccaatattctcttgaacaacagaggccagattaagctggccgatttcgggttagccagattatacagttcagaggagtctagaccatacactaacaaagtcatcactctgtggtatcgaccccctgagctccttcttggcgaggagcggtatacaccggccatcgatgtgtggagctgtggatgtatccttggagagctttttacaaaaaagccaattttccaggcgaatcaggaactcgcccagctggagctaatatcacgcatctgcggatctccatgccccgctgtgtggcccgatgtgataaaactcccctattttaatacaatgaaacccaagaaacaatatcgccggaaacttagggaagagttcgtgtttattcccgcagctgcattggacctgttcgactacatgctcgctttggacccgtccaaacgttgcactgctgagcaggcactgcagtgcgagttcttgcgcgatgtggaaccatcaaagatgccacctcctgatttgcccttatggcaggactgccacgagctctggagcaagaagagacggcgccagaaacaaatgggaatgaccgatgacgtgtcaacaatcaaggcccctaggaaagatctgagcttggggctggacgacagtagaacaaacactcctcagggagtgcttccctcttctcagcttaagtcgcagggctcgtcgaacgtagccccgggagaaaagcagactgaccccagtactccacaacaagaatcctccaaacctcttggcgggatacagccatccagccaaactattcaaccaaaagtcgagacagatgctgcccaggctgccgtgcagtcggctttcgccgtgctgctgacgcagcttattaaagctcaacagagcaagcagaaggatgtactcctggaggaaagagaaaatggtagcgggcacgaggctagtctccaactgaggccaccacccgagccttcaactccagttagtggacaggacgatcttatccagcaccaggacatgaggattttggagcttacacctgagccagaccgacctaggatcctgcctcccgaccagcgtcctccggaaccaccggagccccctcccgtcactgaggaggacttagactacagaacggagaatcaacacgtgccgacgaccagcagcagcctgaccgatccgcacgcaggcgtgaaggccgcactcttgcagttgctagctcagcaccagccccaggatgacccgaaaagagagggcggaatcgactaccaggctggagacacatacgtttctacctcagactataaggataacttcgggagtagttccttcagttccgctccgtacgtgtctaacgatggcttaggtagttccagcgccccacctcttgagagaagatcttttattggcaattctgacatccagagcttggacaattactctacggctagctcacacagcggcggaccgccacagcctagcgccttttcagaaagttttcctagtagtgtggcaggttacggcgacatctatctcaacgctgggcctatgttatttagcggggacaaagaccataggttcgaatattcccatgggcctatcgcggtgctagctaacagctccgacccctcgacaggccccgagagcacccacccccttccggctaaaatgcataactataactatggtggtaatcttcaggagaatccatccgggccaagtttgatgcacggtcagacctggacatcgcccgcccaaggcccaggatattcacagggctatcggggccacatctctacgtccacaggccggggtcgggggagaggcctgccctactag

SEQ ID NO: 11597 - DNA, 1770 bp, Artificial Sequence
  Description of Artificial Sequence: Synthetic coding sequence
atgaccggcctgttgaagaggaagtttgaccagttggatgaggataactcatccgtctcgtcaagcagctcaagctctgggtgtcagtcacgaagctgctctccctcatcaagcgtgtcaagggcatgggactccgaggaagaaggaccctgggatcaaatgcctctgccagaccgcgacttttgtggaccgaggtcattcacccccctgtctatcctgaagcgggctagacgggaaagacctggccgagtagcctttgatggcatcacagtattttattttcctaggtgccagggctttacttctgtacctagtagaggtggctgcaccctcggtatggctctcagacattccgcttgtaggcgctttagcctcgccgaatttgcacaagaacaggcacgcgcccgccacgagaaactgcggcagcggttaaaagaggaaaagttggaaatgctgcaatggaagctctctgccgccggagtgccccaggccgaggccggtctgccccctgtcgtggatgccatcgatgatgcatccgtcgaggaggatctggccgtagccgtggccggtggaagactcgaggaagtctctttcctgcagccatacccagcgaggcggaggcgagctctgctgcgcgcttcgggagtccggcggatagatcgcgaagagaaacgggagctacaggctctccgccagagccgtgaagactgcggttgtcattgcgacaggatttgtgacccagaaacatgctcctgttcactcgcaggtatcaaatgtcaaatggaccacactgcattcccctgcggatgctgtcgcgagggttgtgagaacccaatgggccgggttgagtttaatcaagcaagggtgcagacccacttcattcatacacttacgaggctgcagcttgagcaggaggccgagtcttttagggagttagaagcccccgctcagggttcccctccttctcccggggaagaagctctggtgcctacattcccactggctaagcctcctatgaacaacgaactcggcgataatagttgctcaagtgacatgaccgatagctcaaccgcaagctccagtgcctccggtaccagcgaggccccagattgccctacccaccctgggctgccaggacctggattccagccgggcgtcgatgacgacagcctggctcggattctatctttcagcgacagcgatttcgggggcgaggaagaggaggaagaagaagggtccgtggggaatctggataatctgtcgtgcttccatcctgcagatatctttggaacgagcgaccctggggggctcgccagttggactcattcatactcaggctgttcgttcacctctggcgtactcgacgagaacgctaatttggacgcaagttgtttcctcaatggcgggctcgagggtagcagggaaggcagcttgcctgggacgtccgttccaccctccatggatgcaggacgctcgtcttcagtcgacctcagtctatcgtcctgcgatagcttcgaattgctgcaagcccttccagactactcgctgggcccacattatacaagccagaaggttagcgactcactggacaacattgaagcgcctcatttcccgctgccaggtttatcccccccaggagatgccagctcctgctttcttgagtccttgatggggttttctgagcccgctgctgaggccctcgatccttttattgattctcagttcgaggatactgtacctgctagcctaatggagcccgtgccagtttag

SEQ ID NO: 11598 - DNA, 744 bp, Artificial Sequence
  Description of Artificial Sequence: Synthetic coding sequence
cgtcggagatgccggacccggcgagcccggggcggttggactgacggatgccgagccgaaaggacagagagccgacggagagggagaccgcgacccggccgcgggagccgccgctgcccgccccgggcctcaggactccaggccgtgtgtccccaaacaccggaacatgtccgccaccatcacgactgggctgttgaagaggaagaagggagcgtaggcaacttagacaatctgagctgcttccacccagcagatatatttgggactagcgatccagggggactggcatcctggactcactcctatagcgggtgtagtttcacctctggagtcctggacgaaaacgcaaacctggacgcatcttgtttcctcaacggtggcctggaagggagccgcgaaggcagcttaccaggtacctccgtcccgccgagcatggacgcaggaagaagtagctctgtcgatctcagcctgtcttcttgtgactcatttgaactgctgcaagccctacctgactacagtctcggtccacactatacatcacaaaaagtgtctgatagtcttgacaacattgaggctccacatttcccgctccctggcctaagtcctccaggagatgcaagctcctgcttcttagagtccctgatgggtttcagcgaaccagccgctgaggccctggacccttttatcgattcacaatttgaggacactgtgccagcatctctgatggagccggtgcctgtctag

SEQ ID NO: 11599 - DNA, 1770 bp, Artificial Sequence
  Description of Artificial Sequence: Synthetic coding sequence
atgaccggcctgctgaagcggaagttcgaccagctggacgaggacaatagcagtgtctcttcatcatcaagttcctctggctgtcagtcaagatcctgcagccccagtagctccgtgtccagagcctgggactcagaggaagagggaccttgggaccagatgcccctgccagatcgcgatttttgcgggccacgcagctttactccactcagcatacttaaacgcgcaaggagagagcgaccaggccgggtggcttttgatggcatcacggtgttctacttcccacggtgccagggatttacgtctgtgccatcaagaggcggctgcacactaggtatggctttgagacattccgcatgccggcgattctctctcgccgagttcgcccaggaacaggcacgggctcggcatgagaaactgcggcagagactcaaggaagagaagctggagatgctgcagtggaagctgagcgccgcaggtgttccacaagccgaagctggcttaccgccagtggtggacgccattgatgacgcgagcgttgaggaagatcttgccgttgccgtcgcaggtggccggctggaagaagtgagcttccttcagccctatccagcccgaagacgtcgcgcgctcctccgcgccagcggtgtccgccgaattgatagggaagagaagcgggaactgcaggcactgagacagtctcgggaggattgcggatgccattgcgacagaatctgcgatccggagacatgttcctgcagcctggccggcattaaatgtcagatggaccacaccgcattcccctgcgggtgctgtcgcgagggatgtgagaaccccatgggacgagttgaatttaaccaggcccgcgtgcaaacgcacttcatacacactttgacacggttgcagctagaacaagaggccgagagcttcagagagctcgaggcccccgcccaaggatctcctccctcccccggtgaagaggctctggttcccaccttccctctggccaagccccccatgaacaacgaactcggtgacaactcatgttcctcagatatgaccgatagttctactgctagctccagtgctagcgggacatcagaggcaccagattgccccactcaccctggactccccgggccaggtttccagcctggtgtggacgacgactcgttagcacgcattctcagcttctccgattccgacttcggcggcgaggaggaagaagaggaggaagggtctgtcggtaatctggataatctgtcttgcttccacccagccgatatcttcgggaccagcgaccccggtgggcttgcatcctggacccactcatatagcggctgttctttcacatccggtgtgcttgatgaaaatgccaatttggacgcgagttgcttccttaacgggggcttggaggggtctcgagagggaagcctgccaggtactagcgtacctccctcaatggatgccggtcgtagttccagcgtggacctttccctgtccagctgcgattcgttcgaattgttgcaagcacttcccgactattccctgggccctcattacaccagtcagaaggtctcggactctttggacaacatcgaggccccacactttcctctcccaggattatctccccctggcgatgcctcatcctgcttcctggaatcactcatgggcttctctgagccggcagcagaagcattggatccttttattgatagccagtttgaggacactgtgcctgcctcactcatggagcccgtgcccgtttag

SEQ ID NO: 11600 - DNA, 1191 bp, Artificial Sequence
  Description of Artificial Sequence: Synthetic coding sequence
atgctcagcgaagtgctcttagtgtctgcccctggaaaagtgatattgcatggtgagcatgcagtggttcacggcaaggttgcacttgctgtgtctctgaacctgaggaccttcctccgactccagccgcactctaatgggaaggtcgacctcagcctcccaaatattggcatcaagcgcgcctgggacgtggcacgcctgcagagtcttgacacttcttttctcgagcaaggcgacgtcactacccctacctccgaacaggtcgagaagctcaaggaggtcgctggactccccgatgactgtgctgtaaccgagcgactggcagttctcgcttttctgtatctgtatttgtctatctgcagaaagcagcgtgccttgcctagtcttgatattgtggtatggtctgagctgcctccaggggcggggctcgggtcatctgctgcctattcagtgtgtcttgctgccgccctgctgactgtgtgcgaggagatcccgaatccattaaaggatggcgactgcgtgaacagatggactaaggaagaccttgagctaatcaacaagtgggcgttccagggggagaggatgattcacggcaaccccagcggcgtggataatgccgtctcgacatgggggggcgcactgcgatatcaccagggaaagattagctctcttaaaaggtctcccgcattgcaaatcctcctaaccaacactaaggtgccccggaatacacgggctttggttgctggagtacgtaatcgcctactgaagtttcccgagatcgtggcaccgttgctaacctccattgatgccatcagtttggagtgcgaacgcgtcctgggtgaaatgggagaggcaccagcccccgaacaatatctcgtgttggaggagctgatcgacatgaaccaacaccacctcaacgcactgggggtggggcacgctagtttggaccagctgtgccaggtcacaagagctcgaggcctgcattccaagctgactggagctggcggcggaggatgcggtattacattactgaaaccggggttagaacagccggaagtggaggccacaaagcaggccctgacgagctgcggcttcgattgtcttgaaacaagcatcggcgcccctggcgtgtcaatccatagtgccacctctctggacagtcgcgtccagcaagcccttgatgggctgtag

SEQ ID NO: 11601 - DNA, 177 bp, Artificial Sequence
  Description of Artificial Sequence: Synthetic coding sequence
atggacgccttcacaggaagtggtctgaagcgtaagttcgacgatgtggatgtgggatcctcggtctccaatagcgatgacgagattagctcctcagattccgcggatagttgtgatagcctgaacccccccacaactgcgtctttcacgcctacctccatcctgaagcgccagtag

SEQ ID NO: 11602 - DNA, 345 bp, Artificial Sequence
  Description of Artificial Sequence: Synthetic coding sequence
atggacgctttcacagggtctggtctaaaaagaaagttcgatgatgttgacgtggggtcttcagtctccaacagcgacgacgaaatttcctcgagcgacagcgccgattcctgcgatagcctgaatccccccactaccgcctcctttacgcccaccagcatactgaaaagacagaagcagctgcggagaaagaacgtgagattcgaccaggtgacggtgtactacttcgccaggaggcagggcttcaccagtgtgccctcacagggcgggtcttcattaggcatggcccagcgccataacagcgttcgaagctacaccttgtgcgaatttgcgcaggaacagtag

SEQ ID NO: 11603 - DNA, 261 bp, Artificial Sequence
  Description of Artificial Sequence: Synthetic coding sequence
atggacgcttttactggctcaggacttaagcggaagtttgacgacgtggatgtcggatcctccgtctctaactcagacgatgaaattagcagctccgacagtgccgattcttgtgatagtctaaacccgccgacaactgcctcctttacaccaacgagtatcttgaaacgacagaagcaacttcgccgaaagaacgtgcgctttgatcaagtgactgtatattattttgcgcggcgccagggcttcacctcagtcccctag

SEQ ID NO: 11604 - DNA, 1758 bp, Artificial Sequence
  Description of Artificial Sequence: Synthetic coding sequence
atgtctgggattttgaagcggaaatttgaggaagtagatgggagttccccatgctctagcgtgcgagaatcggacgatgaggtttcctcctctgagagcgccgattccggcgactccgtgaatccaagcactagcagtcattttacaccctcctctattctcaaaagggagaagcgattaagaactaagaacgtgcacttctcttgtgtgactgtctactattttacaaggcgtcaggggttcacatcggtgccctctcaaggcgggagcacccttggcatgtcctctagacacaacagtgtccgccagtacacgttgggcgagtttgccagagagcaagagagactccatcgggaaatgctgcgcgagcaccttcgcgaagaaaagttgaattccctgaagctcaaaatgaccaagaacggtacggtggagagcgaggaggcaagcacgttaactctggacgatatctcggacgacgacatagaccttgataacactgaagtcgatgaatattttttcctgcagcctctgcccaccaaaaaacgccgggccctcctcagggcgagcggcgttaaaaaaatagatgtggaggagaagcacgagttgagagccattcgactgtctcgtgaagactgcggctgcgattgcagagtcttctgtgatccagatacctgcacgtgtagcttagcaggcataaagtgtcaggtggatagaatgagttttccctgcggctgcaccaaggaggggtgttctaacacagcgggccgcattgagtttaaccccatacgggtacgcacccatttcctgcatactatcatgaagctggaactcgaaaagaatagggaacaacagattcctacactgaacggatgtcactcagaaatttccgcccactcatcgagcatgggccccgtcgcacactctgtcgagtacagcattgcagactcatttgaaatagagaccgaacctcaggctgccgtgctgcacctccaaagcgccgaagagttagactgtcagggagaggaagaggaggaggaagaggatggatcaagcttctgttctggcgttacagacagctcaacccagtctcttgcaccttctgaatctgacgaagaggaggaggaggaggaggaagaggaagaagaggaagacgacgacgacgataagggggatggatttgttgaaggactggggacacatgcagaggtggtgcccctgccctccgtgttatgttatagcgacggaaccgcagtgcatgaaagccacgccaaaaacgcgagcttttacgccaacagttctacactctattaccagattgattctcatatccctggtacccctaatcagataagtgaaaactatagcgagcgggacaccgtcaagaatggcaccctctctctcgtgccatacacgatgactccagagcaatttgttgactatgcccgccaggctgaggaggcctatggcgcatcacactaccccgctgctaacccatccgtgatcgtgtgctgtagctcttccgaaaacgattccggcgtcccctgtaactccctctacccggagcaccgctctaaccacccgcaagtggagtttcatagttacctcaaaggtccctcacaggaggggttcgtgagcgccctgaatggggactcccacatctctgaacatcccgctgagaacagcttaagcttggctgaaaaatcgattctgcacgaggagtgcattaaatcacctgtcgtagagactgtgccagtatag

SEQ ID NO: 11605 - DNA, 1758 bp, Artificial Sequence
  Description of Artificial Sequence: Synthetic coding sequence
atgtcaggtatcctcaagcggaagttcgaggaggtggacggtagttcaccatgcagcagtgtccgggagtcagacgatgaggtgtcttctagcgagagcgccgacagcggcgatagtgtcaatcccagcacgtcctcacatttcactccaagtagcatactgaagcgggagaagaggttgcgtaccaaaaacgtccatttctcatgtgtgaccgtgtactatttcacccgtcgccaagggtttactagtgtgcctagtcagggaggctctaccctcggaatgagttctaggcacaactcagtccgccagtacaccttgggggagttcgctagggaacaagaaagattacacagggagatgctgagggagcatcttcgtgaagagaagctaaattctctgaagcttaaaatgacgaaaaacggcaccgtggaaagtgaagaagctagcacgcttaccttagatgatatctcggatgatgatatcgaccttgacaacaccgaagtggatgaatacttttttctgcagcccctgcctaccaaaaaacgtagagcactactccgggcatcaggtgtgaaaaaaatcgatgtggaggagaaacacgagctgagagccatcaggctaagtagagaggattgtgggtgcgactgtcgcgtgttctgtgatcccgacacatgcacgtgttcactggctggaattaaatgccaggttgatagaatgtcttttccatgtggctgcactaaggaaggttgtagtaataccgccggacggatcgagtttaatccaattcgcgttaggacgcactttcttcacactattatgaaattagagcttgaaaaaaatagagagcagcagatccctacacttaacgggtgccacagtgagatctcggctcattcatcatctatgggaccggtagcacactccgtggaatatagtatagccgattcattcgagattgaaaccgagcctcaagctgccgtgctgcacctgcagtcggccgaagagctggactgccagggcgaagaggaggaggaggaggaagatggttcatctttttgtagcggagttacagactccagcactcaatcactggcgccctcggagagtgacgaggaagaggaggaggaagaggaggaggaggaggaagaggacgatgatgacgacaagggagacggctttgttgaaggcctgggcacacacgccgaagtggtcccgctcccaagcgttctgtgctatagcgatggaaccgcagtgcatgagagtcatgccaagaatgccagtttttatgcaaactcttccacactctattaccagattgactcgcatattccaggaacacccaaccaaatcagcgaaaactattcagagcgagatacggtgaagaacggaaccctgagtctcgtgccttacacaatgaccccggaacaatttgtggactacgcaagacaagccgaggaggcctacggcgcgtcacactatccagccgcgaatccctctgtcattgtatgctgttcctcttcagagaacgatagcggtgtaccgtgtaactccctgtacccagagcatcgctctaatcacccacaggtggaatttcactcttatctgaagggcccaagccaggagggttttgtgtcagctctgaatggagacagccatatttccgaacaccccgctgagaactcattgtccctggctgaaaagagtattttacacgaagagtgcatcaagagccccgtagtcgaaaccgtcccggtgtag

SEQ ID NO: 11606 - DNA, 1854 bp, Artificial Sequence
  Description of Artificial Sequence: Synthetic coding sequence
atgaaatgtgcactgttcctccgcgtgaaaatcctccaaagagtctgtcggagcaggtatatcgtccatgcgggtacctgcgacagtaccgcagccatgtccggaattctgaaacggaaatttgaggaggtggatggttcatctccctgttctagtgtgagagagagcgacgacgaagtgtcttcgagtgaaagcgccgattctggagacagtgtcaacccatcaacaagcagccacttcacaccaagttctattcttaaaagggagaagaggctccgtacaaagaatgtgcatttttcctgcgtcaccgtgtattatttcacaagacggcaggggtttacctctgtcccgtcacagggcggaagcacactcgggatgtccagccggcataatagtgtgcgccaatataccctcggcgagttcgctcgagagcaggagcgactccatagggagatgctcagggaacatctgcgcgaagagaagttgaactctctcaagctcaaaatgaccaagaacgggacggtggaatcagaggaagcctccaccctgacactcgacgatatttctgacgatgacatagatctggacaacaccgaggtagatgagtacttcttcctgcagcctctccctacaaaaaagcgaagagccctgctgagagcgtccggtgtaaagaaaatcgatgtggaggagaaacatgagctacgagctattcgactgtctagagaagactgtggttgcgattgccgagtgttctgcgatccagacacgtgtacctgctctctggccgggattaagtgtcaggtagataggatgtccttcccctgcggatgtaccaaggagggatgctctaacacggccggtagaattgagttcaatcctatccgagtaaggactcactttcttcatacaatcatgaaactggagctcgaaaaaaatcgggagcagcaaatacctacactcaatgggtgccattccgagatcagcgctcattcaagtagcatgggccctgtggcacattctgtggagtattctatagctgactctttcgagatcgagaccgagccccaggcagcagtcctgcacttgcagagcgctgaagagctagattgccaaggtgaagaagaggaagaagaggaggacgggagctcattttgtagtggcgtgaccgacagtagtacccagagcctggccccctccgaaagcgacgaagaagaggaggaggaagaggaagaggaggaggaggaggacgacgacgacgataaaggtgacggcttcgttgagggcttaggaacacatgccgaggtggtccctcttccctctgtgctttgttactccgacggcactgccgtgcatgagtcgcatgcgaaaaatgcttcattttacgcaaacagtagcacactgtactatcagatcgatagccacatcccgggtacacccaatcagatcagtgagaattattctgaaagagacacagtgaagaacggtacactctctttggtcccatacacgatgactcccgagcagttcgtagactacgctagacaggccgaagaagcctacggagcctcacactacccagccgcaaatccgtccgtgattgtctgctgctccagttcagaaaacgactcaggtgtgccttgcaattccctgtacccagaacacaggagtaatcatccacaagtggagttccactcctacctgaaaggcccaagtcaggaaggcttcgtctctgccctcaacggggattcccatatttctgagcatcccgctgagaacagtctgagtctggcagagaagtctatccttcatgaggagtgtattaaatcacccgtcgtggaaacagtcccagtttag

SEQ ID NO: 11607 - DNA, 417 bp, Artificial Sequence
  Description of Artificial Sequence: Synthetic coding sequence
atgtcaggaattctcaagcgcaagttcgaagaagtcgatggtagttccccttgcagtagcgttagagaatcagatgacgaagtgagctcgtcagagagcgcggattccggggatagtgtcaatccatcaacatcatcccactttacacctagctcaatcctgaaaagagaaaagaggctccgaaccaagaacgttcacttcagctgcgtgactgtttattacttcacccgcagacaaggatttacctctgtaccttctcagggcggcagcacccttggaatgagctcacgccacaactccgtgagacagtataccttgggagaatttgcccgggaacaggaacgactgcatcgagagatgctaagagaacatctgcgagaagaaaaattaaatagcctgaaacttaagatgacttag

SEQ ID NO: 11608 - DNA, 1314 bp, Artificial Sequence
  Description of Artificial Sequence: Synthetic coding sequence
atgtcggggattttgaagagaaaatttgaggaagtggacggctcaagcccatgttccagcgtcagagagagcgacgatgaggttagctcgtccgaatccgcagattccggtgacagcgtgaatccaagtacctcgagccacttcacccctagcagcatcttgaagcgtgaaaaacgactcagaacgaagaatgtgcatttctcttgcgtcaccgtgtattactttacgcgaagacaggggttcacttccgtccccagccaaggagggagcacactgggaatgtctagtaggcataattccgtgcggcaatacaccctaggagagtttgcacgggagcaggagcgcctgcaccgagagatgctccgcgaacacctgcgtgaggagaaactgaactcccttaaactgaagatgaccaaaaacggaaccgttgagtctgaagaagcctccactttgactctggacgacattagtgacgatgacattgatctggacaataccgaggtcgacgagtatttctttctccagccccttccgaccaaaaagagaagggctctgttacgagcgagcggcgtaaagaagatagatgtggaagaaaaacacgaactacgtgcaatccgcctcagcagggaggactgtggctgcgattgccgagtcttttgtgatcccgatacctgtacgtgctctctggccggcattaaatgccaagtagatcgcatgagcttcccttgcggatgtacgaaagagggttgttccaacaccgccggacgtatcgagttcaacccgatcagggtgaggactcactttctgcataccatcatgaagctggagctggagaagaaccgcgagcagcagattcccactctgaacggatgtcattccgagatctcagctcactcaagctccatgggaccggtagcccattccgtcgagtactcaattgccgattcttttgaaatcgaaacggaacctcaggcggctgtgctccacctgcagagcgctgaagaactggactgtcagggagaggaggaggaggaagaggaggacggttcctcattttgctcaggcgtgactgactcctccacccagtcactcgcaccaagcgagagcgatgaggaagaagaggaagaggaggaggaggaggaggaagaagatgatgatgatgataagggggatggatttgttgaggggctaggcacccacgcagaagtcgtgccactgccgtctgtcctgtgttactctgacgggactgcagtgcacgagtcccatgcaaaaaacgccagcttctacgctaactcaagcacactgtactactag

SEQ ID NO: 11609 - DNA, 1569 bp, Artificial Sequence
  Description of Artificial Sequence: Synthetic coding sequence
acttgcgattcgactgctgccatgagtggcatcctgaaacgcaaatttgaggaggtcgacggctcttccccctgttcctccgtgcgcgagtctgatgatgaggtctcatcgagtgaatccgctgacagtggcgattccgtgaacccttccacaagctcacacttcacccccagttctatcctgaagagagaaaaacggctgcgaaccaaaaacgttcatttctcctgcgtcacagtctattattttacaaggcggcagggttttacgagcgttccaagccagggagggtcaacgctggggatgtcctcacggcacaatagtgtcagacagtacacgcttggtgaattcgctagggaacaggagaggctccacagggagatgttgcgggaacacctacgggaggagaaactaaacagtttaaaattgaagatgacaaaaaacggcactgtggagtccgaagaagcctccaccttgaccctggatgatatcagtgacgatgacatcgatttagacaacacagaggtcgacgagtattttttcctacagcccctgcctactaagaaacgccgcgctctcctgcgtgcaagcggggtcaaaaaaatcgacgtggaggagaagcacgaactgcgtgcaattaggctgtctcgggaagactgcgggtgtgactgcagagtgttctgcgatcccgatacttgtacttgctccttggccggtattaaatgtcaggtggacaggatgtcattcccatgcggctgtacaaaggaagggtgttccaatacagcgggacggatagagttcaatccaatcagggtgaggacgcactttctccataccatcatgaaactggaactggagaagaatcgagagcagcagataccaacactaaatggatgccactctgaaatctcagctcacagctccagtatgggcccagttgcgcatagcgttgagtactcaatcgctgatagcttcgagattgagacagagccccaggccgcggtgcttcatcttcagtctgccgaggagttagactgccagggtgaggaggaagaggaggaggaggatggatcatccttctgcagtggtgtcactgacagcagcactcagtctctggcgccttccgaatcagatgaggaagaagaagaggaggaagaagaagaagaggaagaagacgatgacgacgacaaaggggacggtttcgtggagggcctgggcacacatgcagaggtcgttccgttgccaagcgttctctgttacagcgatgggaccgcagtgcacgaaagtcacgccaagaacgcctctttctatgccaactcctccactctgtattatcagaacgactcaggggtcccctgtaattccctgtatcctgaacataggtccaatcacccccaggtggagttccactcttatctgaagggaccatctcaagaaggttttgtaagcgccctcaacggtgatagccacataagcgagcatccagcagagaactctttgagtttggcagagaagtccatcctccacgaagagtgtattaagagccctgtagtggagaccgtgccggtttag

SEQ ID NO: 11610 - DNA, 2127 bp, Artificial Sequence
  Description of Artificial Sequence: Synthetic coding sequence
atggctgtccctgccgctctgattcctccaacgcagctggtacctccacagcctcccatttccaccagcgcgtcctcaagtggcacgaccacatctacttctagtgccaccagctctccagcgcccagcatcggcccacctgcgagctccggccccacactgttccgacctgaaccaatcgcaagtgccgccgctgctgctgccacagttaccagcaccggcggcgggggaggtggtgggggggggggctcaggggggggcggaggtagctcgggcaatggcggcggcgggggcggaggaggcgggggctccaattgcaacccgaaccttgcagccgcttcaaacgggtctggaggcgggggcggaggaatctcggcagggggcggcgttgctagttccaccccaattaacgcatccaccggttcatcttcctcttcatcatcttcttcctctagttcatcttctagctccagcagttcttccagcagttcttcttgcggccccctgcctggaaaaccagtttactcaactcctagccctgttgaaaatacaccacagaacaacgaatgtaaaatggttgacctcagaggagcgaaggttgcaagcttcacggtcgaggggtgcgaattaatctgcctaccccaggcctttgacctattcctgaaacacctggtgggcgggctgcacaccgtttacacaaagctgaaaagattggagattaccccagtcgtctgcaatgtcgaacaggtgagaatcctacggggactcggcgccattcagcccggtgtgaataggtgcaagctgatctctcgcaaagatttcgaaacattatataacgattgtaccaacgcatccagtcgccccggacgccccccaaaaagaactcagagcgtgactagtccggaaaacagccatataatgcctcatagcgtgcctgggctcatgtctcctggtatcatcccacccacagggctgaccgcagcagcggccgcagccgctgccgccacaaatgccgccatagccgaggctatgaaagttaaaaagatcaagttagaggccatgtccaattaccacgcatctaacaatcaacacggcgccgattcggaaaatggtgacatgaacagttccgtgggccttgaactgccttttatgatgatgccccaccctctgatccctgtgtcattgccacccgcaagcgtgaccatggccatgtctcagatgaaccacctgtccacgatagcgaacatggcagccgcagcccaggtgcagtcccccccttcccgtgtggagacatccgtgataaaagaacgagttcctgattcccctagtcccgctcccagcctggaggaaggtagacgccctggatctcatcccagctcccatagatcttcctcagtcagctctagtcccgcaagaaccgaatcttctagcgataggatccctgtgcaccagaatggtctctcaatgaaccagatgttgatgggtctcagccctaatgtgctgcccgggcccaaagagggggaccttgccggtcacgacatgggtcatgaatctaagcggatgcatattgaaaaggatgaaacaccgttaagtacaccaacagctagagattctctggacaagctctcactgacaggccacggacagcccctgccaccgggcttcccttctccttttctgtttcccgacggactgtctagcatagaaaccctgctgaccaatattcagggactgctgaaagtggctattgataatgctcgcgcccaggaaaagcaggtccagctcgagaagactgaactcaaaatggacttcctccgtgaacgcgagctgagagagaccctcgagaaacaattggcgatggaacagaagaacagggcaatcgtccaaaaaaggttaaaaaaagagaaaaaggctaaacgaaagttgcaagaagccttggagttcgaaactaagcgcagggaacaggctgagcaaactctgaagcaggctgcctcaacagattcacttcgcgtgctgaacgactccttgactcccgagatcgaagcagatagatcaggcggccggaccgacgccgagaggacaatacaggacgggagattgtacctgaaaacaacggttatgtactag

SEQ ID NO: 11611 - DNA, 1683 bp, Artificial Sequence
  Description of Artificial Sequence: Synthetic coding sequence
atggcagtgccagcagctctgatccctcctactcagctggtcccaccccagccacccatctccacaagtgctagtagttcagggacaactacttcgacctctagcgccacaagcagccccgcacctagtatagggccccccgcttcttccggtcctaccctgttccgccccgaaccgatcgcaagcgccgccgcagccgcagcaacagttacttccacaggagggggtggaggcggaggaggtggcggtagcggaggtggagggggctcatcagggaatggcggtggtgggggaggcggaggggggggatccaattgtaatcctaatttggctgcagcctccaacggttcagggggcggcgggggtggaatttcagctggaggcggagttgcaagttccacccctattaatgcctcgaccggtagcagcagcagctcttcaagtagttcatctagcagctcgagttcctcctctagctcgtcaagctcgagtagctgtgggcccctgccaggaaaaccagtttattccactccatctcccgtggaaaacacacctcagaataatgagtgtaaaatggtagacctccgcggcgccaaggtcgcttcatttaccgtggagggttgtgaactcatctgtcttcctcaagcgttcgacctctttctgaaacacttggtggggggattgcacacagtgtacactaagctcaaacgcctggagatcacccctgttgtctgtaacgttgagcaagtgcgtattctgcgcggattaggggctattcagccaggcgtcaataggtgcaagcttataagtagaaaggatttcgagaccctgtacaatgattgcactaatgcttcatcaaggccaggaagacctcccaaacgaacacagagcgttacatcgccggaaaacagccatatcatgcctcattcggtccctggcctcatgtcaccgggcatcatcccacccacaggcctgacagcggctgccgctgcagcagccgcagccactaatgcggcgattgctgaggccatgaaagtcaaaaagatcaagctggaagctatgtccaactaccacgcctctaacaatcaacatggcgctgactccgagaacggcgatatgaactctagcgtggacgagacgcctcttagtacacctacggcacgagattctctggataaactttcattaacaggccacggccagccgctgccacctgggttcccatcaccctttctgtttcctgatggattatcaagtatcgagactctgctcactaatatccaggggcttctgaaggtggccatcgacaatgcccgggcgcaagagaagcaagttcagcttgaaaaaacagagctcaaaatggactttctgcgggagcgggaattacgcgaaacccttgaaaagcagcttgcaatggagcagaagaatagagcgattgtccagaaacggctgaagaaggagaagaaggcaaagagaaaattacaggaagcactcgagtttgaaacgaagaggagggaacaggcagaacagacattgaaacaagctgcaagcaccgattccctcagggtgttaaatgatagcctaacaccggagatagaggccgaccgttcagggggaagaactgacgccgaacgcaccattcaggacggccgattgtacctgaagactaccgtgatgtactag

SEQ ID NO: 11612 - DNA, 1521 bp, Artificial Sequence
  Description of Artificial Sequence: Synthetic coding sequence
atggcggttccagcggccttgatcccacctacccagctcgtgccaccacaaccaccaatctctacatccgcttcctcttcaggcaccaccacctcaacctcatccgcaactagcagcccagcccccagcattgggccacccgcgtcctctgggccgaccctgttccgccctgagcccattgcttccgccgcagcggctgccgctaccgtcacatctactggggggggcgggggcggagggggagggggaagcggtgggggcgggggttcatccggaaatggcggaggaggcggtggtggcggcggtggttccaattgcaacccgaacctcgcagccgccagcaacggatctgggggtgggggaggaggcatctctgctggtgggggcgtagcctcctcaaccccaatcaatgcttcgacgggatcaagttcaagtagttcctcgagctcttcgtcttcttctagtagctcgagcagtagcagtagctccagttcttgcggccctctgcctgggaagccagtttactcgaccccttccccagtggaaaacacccctcagaacaatgaatgtaaaatggtggacctgcggggggctaaagtcgccagcttcactgtggagggatgcgagctcatatgtctgcctcaggcctttgacctcttcctgaaacatctcgtaggaggattgcacacggtgtacaccaaacttaagcgcctggagattactcccgtggtatgtaacgtggagcaggtgcgcattctgagggggctgggagcgatccagcccggcgtgaatcggtgcaaactgattagccgcaaggatttcgagactttgtacaacgactgtactaacgcgtcctcaagacctggccgaccccccaagagaacacagtctgttaccagcccggagaactcccacatcatgccacacagcgtaccaggactgatgtcccccggcataattccgcccacggacgagacccccctttctactcccaccgcacgggattctctggataaattgagtttaactggtcacggccaaccattgcctcccggatttccttccccttttttatttccagatggtctttcgagtatcgagaccctcctgaccaacattcagggacttctgaaagtagccattgacaacgcccgtgctcaggaaaagcaagtccagctggagaaaactgagttgaagatggacttcctacgagaaagggagcttagagagactctcgagaagcagctggccatggagcagaaaaatcgcgcaatcgtccagaagagacttaaaaaagagaaaaaggccaagaggaaactccaggaagccttggaattcgagactaaaagacgagagcaagccgagcagacgttaaaacaggctgcctccactgactccttgcgagtgctcaacgacagtctcactcccgagatcgaagcagatcgatcaggtgggcggactgatgcggagcgcactatacaagatggtaggctgtacctcaaaactaccgtcatgtactag

SEQ ID NO: 11613 - DNA, 2283 bp, Artificial Sequence
  Description of Artificial Sequence: Synthetic coding sequence
atggctgtgcctgctgctctgataccccctacccagcttgtccctcctcagcctcccatctccacatccgctagctcttcagggaccactacatcaacatcaagcgcgacttcgtcacccgctcctagtattggcccccccgcctcctccggaccgactctgtttaggccggagcctatcgcaagcgcagccgccgccgccgccacagtcacaagtactggaggaggcggcggagggggcggaggcggatctggcggagggggtggatctagcggtaacggagggggaggcggcggaggggggggtggttccaattgcaatcctaacctggccgctgcatccaatggaagcggtggcggcggcgggggcatcagcgccggaggaggtgttgcctcctccactcctattaacgctagtacgggaagctcatcctcttcctcatcatccagctcaagtagtagctcctccagtagcagctccagctcatcttcttcttgcggacctctgcccggaaagccagtgtattcaacaccctctccggtggagaatacgccccagaataacgagtgcaaaatggttgatctccgaggcgcaaaggtagcgagctttacggtcgagggatgtgagctcatctgcttaccacaagcattcgacctgtttctgaaacatttggtgggggggctgcacaccgtatacacaaagttgaagcgactggaaatcacgccagtggtttgcaacgtggaacaggtgagaattctgcgtgggctcggggccatccagccgggagtgaataggtgtaagttgatttcccgcaaggattttgaaactttatataacgattgtaccaatgcctcttccagacccggacggccccccaagaggactcaatccgtgacatctcctgagaactcccacatcatgcctcactctgtccccggcctgatgagcccaggtatcatcccgccaaccggcctcacggccgctgccgccgccgctgccgcagcaactaatgccgccatcgcggaggctatgaaggttaagaagatcaaacttgaagctatgtcaaattatcatgcctcgaataaccagcacggtgccgatagcgaaaatggagatatgaatagcagcgtggggagctctgacggtagttgggacaaggaaactctgccttcaagccccagtcaggggccacaagcctctattacccatcctcggatgcctggcgctcgttccttacccctttcccatcctctaaaccatctgcaacaatcacacttgctcccaaatggtctcgaactgcccttcatgatgatgccacaccccctgatccccgtgagcctccctcccgcctccgtgactatggcaatgtcccagatgaaccatctgagtacaattgctaacatggccgcagccgctcaggtacaaagccctccgtcacgggtggagacttctgtgataaaagaaagagtccctgacagcccaagtcctgctcctagcttggaagaaggccggagaccagggtcccatcccagcagccaccgctcatcaagcgtaagcagttcacctgcccggacagagtcaagctccgatagaatccctgtacaccaaaacggcctgtccatgaaccaaatgctgatgggactgtcacctaacgtgctcccaggcccgaaggagggggaccttgctggtcacgacatgggccatgagtccaaaagaatgcacatcgaaaaggacgagacacctttgagcactcctaccgcaagagatagtcttgacaaattgtctttaactggccatggtcaacccctgcccccgggatttccttcacccttcctctttccggatggactctcctccatcgaaaccctcctgacgaatattcagggactccttaaagtggccattgacaatgcaagagcccaagaaaagcaggtgcagttggaaaagacagaactaaagatggactttctcagagagcgcgagttgagggaaacgctagaaaagcagctagccatggagcagaagaacagagcaatcgtgcagaaacgtctcaagaaagaaaaaaaagccaagcgcaaactgcaggaagccctggagtttgaaacaaaacgaagggagcaggcagagcagactctgaaacaggcagcctccacggactcactgcgggtcctgaacgactctttaacaccggaaattgaggcagatcgctctgggggtcggaccgatgccgaacggactattcaggatggcaggctgtacctgaaaacaacagtcatgtattag

SEQ ID NO: 11614 - DNA, 2283 bp, Artificial Sequence
  Description of Artificial Sequence: Synthetic coding sequence
atggccgtgcctgctgcccttatcccgcccactcaactagtgcctcctcagccacccataagcactagcgcctcatcatccggtacaacaacttcaacatcatccgctacaagcagtccggcccccagcatcgggccccccgcctcctccggccctacattatttaggcctgagccaattgcctcagctgccgcagcagcagctacggtcacgtcaacaggaggggggggggggggggggggcgggggttctggcggcgggggggggagcagcggcaatggaggtgggggtggagggggcggaggcggctccaactgtaaccctaatctcgccgccgctagtaatggctcaggaggtggcggcggtggcattagcgccgggggaggggtagctagctcaacaccgattaatgcttctacggggtcctctagtagctcttcaagttcttcctccagctctagctcaagctctagcagctcctcgagtagctcttcttgcggccctctgccgggaaagccagtctacagcacaccctctcctgtggagaacacaccccagaataacgagtgtaagatggtggacctcagaggcgcgaaggtagcttcctttacagtggagggttgtgaattaatctgtcttccgcaagctttcgatctgttcctgaagcatctggtgggaggcctccacacggtgtatacaaagctgaagcggcttgaaataacacctgtggtatgcaatgtggaacaggttcgcatcctgcgtgggcttggcgctatacagcctggagtgaaccgatgtaagctgatttccagaaaggatttcgagacgttatataatgattgtactaatgcctcttcgcgtcctggccgaccaccaaaacgcacccagtcagttactagtccagaaaacagccatatcatgccccattcagtacccggcctgatgtcccctggaataattccaccgacagggctgaccgctgctgcggcagctgccgcggccgccaccaacgcagctatcgcagaagccatgaaagtgaaaaaaattaaactggaggctatgtctaactaccacgcatcaaataatcaacatggtgccgattccgaaaacggcgacatgaattcaagcgttggctcaagcgatggctcttgggacaaggagaccttgccttcttcacccagtcaaggaccgcaggcctccatcacgcacccccggatgccaggggcccgtagtttgccgctctctcacccactgaatcatctacagcagagccatctcctccccaacggcctcgagttgccatttatgatgatgccacatcccctgattcctgtatcgcttcctcctgcttcagtgacaatggcaatgtcccaaatgaatcacctgtctaccattgccaacatggctgccgcagcacaggtgcaatcaccaccctcccgagtggagacctctgtgattaaggagcgagttccggactcacccagccccgctccctcattagaagagggtaggagacccggcagtcatccgtcttcccaccgctcctcctccgtaagttcaagccctgctaggaccgagtcctctagcgacagaatcccagtgcatcaaaacggtctgtctatgaaccagatgctgatgggtctctcaccaaatgttcttccaggtccgaaagagggagatttggcaggccacgatatgggccacgagtctaagcgtatgcacattgagaaggacgaaaccccactatcaacacccaccgctagggacagtctggataagttgagccttactgggcacggccagccactgcccccgggattcccatctcccttcctgtttcccgatggcctttccagcattgagacactgctcacaaatatccagggtcttctgaaggtggctatcgataacgcacgggctcaggagaagcaggttcagcttgaaaaaaccgaactgaaaatggacttcctgagagagagggagttgagagagactctcgagaagcagctggcaatggagcagaagaacagggcaattgtgcagaaaaggttgaagaaggagaagaaggccaaacgaaagttgcaggaagcccttgagtttgaaacaaagcggcgcgaacaagccgagcagactctcaagcaggctgccagtaccgattctctcagagtcctgaatgactccctcacccctgaaatcgaggccgatcggagcggtggaagaacagatgcggagcgaactatccaagcagcgcggctgtacatcaagaccgtgtgcatgtattag

SEQ ID NO: 11615 - DNA, 1800 bp, Artificial Sequence
  Description of Artificial Sequence: Synthetic coding sequence
atggctgtgagcgcaagtccagtgatttctgccacatcgtccggcgcaggggtccctggaggtctctttagagcagagcccctgtacagtaccccacgggagccaccacgccttacccccaatatgatcaattcctttgtcgttaacaaccactctaatagcgccgggggcgggggccggggaaacaccaacaccaatgagtgtcgaatggtagacatgcatggaatgaaggtggccagtttcctgatggacggtcaggaactgatatgcctgccccaggtttttgacctcttcctgaaacacctggtgggcggcctacataccgtgtatactaagttgaagagactggatatcagtcctgtagtttgcacagtcgaacaggtccgcatactgcgtggcctgggggccattcagccaggcgtgaatagatgcaagctcatcactcggaaggacttcgagaccctgttcaccgattgcacaaacgccaggcgaaaacgacagatgacccgaaagcaggctgtgaactcatctaggcccgggcgacctcctaagagatcactgggtgtgcttcaagaaaatgccaggttgctgactcacgccgtgcctgggctcctgtcccccggtctgatcacaccaacagggattacggccgccgccatggctgaagccatgaagcttcagaagatgaagctcatggctatgaatactctccaagggaatggctcccaaaatgggaccgagtctgagccagacgatttaaactccaacactggcggctccgagtcctcttgggacaaggataagatgcagtccccttttgccgcacccggccctcagcacggcattgcccatgctgccctggcaggtcaacccggaatcgggggagctcctactttgaatcccctccaacagaaccacctgttgactaaccgcctggatctgccctttatgatgatgccccatcccctcctgcccgtgtccttgccaccagcatccgtggccatggcaatgaaccaaatgaaccacttgaacactattgcgaacatggctgccgctgcacagattcattccccacttagtcgggccgggacatctgtaattaaggagcggatcccagaaagcccgtctcccgctccctctcttgaagagaatcatcgaccgggaagccaaacatcatcccatacgtcgtctagcgtgtcgtcctccccatcccagatggaccaccatctcgagagaatggaggaggtgcccgtacaaattccaattatgaagtctcctctcgacaaaattcagctcacgcccggacaagccctcccagcagggttcccgggaccctttatattcgccgacagcttaagctccgtggaaaccttgctgaccaacattcagggactccttaaggtggcactggacaatgctaggatacaggagaagcaaatccaacaggaaaaaaaggagctgcgcctggaactttatcgcgagagggagatccgtgaaaacctcgagcgacagttagctgtggagttgcagtctaggacaaccatgcagaagagacttaaaaaagaaaagaagaccaagcgaaaactgcaggaggctctcgagttcgaatcaaaacgccgtgagcaagtggaacaagctctgaaacaggcgaccacatctgattcaggactgcgcatgctcaaggatacgggcatccctgacattgagatagagaacaatggaaccccccatgactctgcagccatgcagggcggcaactattattgcctggagatggcacagcagctgtacagcgcctag

SEQ ID NO: 11616 - DNA, 1800 bp, Artificial Sequence
  Description of Artificial Sequence: Synthetic coding sequence
atggccgtgtccgcttcaccagtgatttctgccacgagtagcggggctggcgtgccaggaggtctcttccgggctgaacctctctattcaacaccgcgggaacctccaaggctcacccccaacatgatcaacagctttgtcgtgaacaatcatagcaacagtgctggcggaggcggacgcggcaacactaataccaacgaatgccgcatggtggacatgcatggaatgaaagtggccagcttcctgatggacggtcaagagcttatctgtttgccccaggtgttcgatttgtttcttaaacaccttgtaggcggactgcacacagtgtacacaaaacttaaacgcctggacatctctccagtcgtgtgtaccgtagagcaggttcgtatcttgcgcggcctcggtgcaattcaaccaggagtgaacaggtgcaagcttataacgcggaaagattttgagacgctgttcaccgactgtaccaatgcgaggcgcaagaggcagatgactcgcaaacaggctgtgaattcctctcggcccggccgtcctcccaagcggagtctgggagtgttacaggagaatgcgcggctgctgacccatgcagtgcccgggctcctgtctcccggtctgattacccccacgggtattactgccgctgcaatggcagaggccatgaagttgcagaaaatgaaactgatggcaatgaacactcttcaaggaaacggaagccaaaacggcactgaatcagaaccggacgatctgaattcaaacaccggggggtcagaatcatcgtgggataaagacaaaatgcagtctcccttcgctgcccccggtcctcaacatggcatcgctcacgccgcactggctggacagcctggtattggcggcgcacctactttgaatccactacagcaaaaccacctgttaactaaccgtctggacttaccctttatgatgatgccgcaccccttactgccagtgtccctgccgcctgcctccgtagcaatggcaatgaatcagatgaatcatcttaacaccattgcaaatatggcagccgccgcacagatacacagtcctttgtcaagagctggaactagcgttataaaagaacggataccggaatcaccgtcccccgcgcccagtcttgaggagaaccaccgtccaggttctcaaacttcctcacacacaagcagctccgtctcatcctcaccatcccagatggatcatcacctggagagaatggaagaggtcccggtccagattcctatcatgaaatcgccactcgacaagattcagctgacacccggacaggctctgcccgccggattccccggcccttttatatttgctgattccctcagctccgtggagactctgttaaccaacattcaggggttactgaaggttgcactggataatgccaggattcaggaaaaacaaattcagcaggaaaaaaaagagttgcggctggagctgtaccgcgagagagaaattagggagaatttggaacggcagctggccgtggaattacagtcacgtactacaatgcagaagcgactcaagaaggaaaaaaaaaccaagcgaaagttgcaggaggctctcgaatttgaatccaaacgcagagaacaagtagagcaggccctcaagcaagccaccacaagcgatagcggccttagaatgttaaaagacacgggaatccccgacattgagatcgagaacaatggcaccccgcatgacagcgcagcaatgcaagggggcaattactactgccttgagatggcacagcagctttattccgcttag

SEQ ID NO: 11617 - DNA, 1716 bp, Artificial Sequence
  Description of Artificial Sequence: Synthetic coding sequence
atggcggtctctgccagccctgtgatcagcgcgacatcgtctggagctggggtcccaggtggcctctttcgcgcggagcccctgtattccactccaagagagcctccacgactcacgcctaatatgatcaactccttcgtggtcaacaaccattcgaacagcgctgggggtggggggcgcgggaatactaatacaaatgaatgtcgcatggtggacatgcacgggatgaaggtggcaagtttcctgatggatggccaggagcttatctgtctgccgcaagtcttcgacctgtttctgaaacatctggtaggaggccttcatactgtttacacaaagctgaagcgactggatatctcccctgtcgtctgcacagtggagcaagttagaatcctgaggggattaggagccatacaacctggggtgaaccgatgcaaattgatcacgcggaaggatttcgagaccctgtttactgactgtacaaacgcctctagtcgtcctgggcgtccaccgaagcgcagtttgggtgtattgcaagaaaatgctagactgttgacacatgctgtgcctgggctgctgagtccaggtctgatcaccccaacgggaattactgcagctgccatggctgaggccatgaaattgcagaaaatgaagctcatggctatgaacacattgcaagggaacggatcacagaatggaactgagtccgagcccgacgacctcaacagtaacacggggggcagtgagtctagctgggacaaggacaaaatgcagtcaccattcgccgccccgggaccccagcatgggatcgctcacgctgctctggccggacagcctggaatcggaggcgcccctaccttgaacccccttcagcagaatcacctgctcactaatcggctggatctgcccttcatgatgatgccgcacccccttctgccggtgagcctccctccggcgtcagttgccatggctatgaatcagatgaaccacctgaataccattgccaatatggctgccgccgcccagattcatagccctctgtcaagagctggcacaagtgtgattaaagaacgtatccctgagagtcctagtccagctcctagtttggaagaaaatcaccggccggggagtcagacctctagccatacctcttcttctgttagcagttctccctcccaaatggaccatcacctggagcggatggaggaggtgcccgtgcagattcctatcatgaaatcccccctggataagatccagctaactcccggccaagctctgccggctggcttccccggccctttcattttcgcggattctctcagcagtgtcgagaccttgctgacaaatattcaggggctcctgaaagttgcgctcgacaacgcacgcatccaggaaaaacagatacaacaggagaagaaggagctgcggctcgagctttaccgggagcgagagattcgcgaaaatctggagcgacaactggccgttgaactgcagtctaggactaccatgcagaagcggttaaaaaaagagaaaaagacgaaacgtaagctgcaggaggccctggaattcgagtctaagagacgtgaacaggtggagcaggccctcaaacaggctacaactagcgactctggcttgagaatgttgaaggacaccggtattcccgacatcgagatagagaacaacggcaccccccacgacagtgccgcaatgcaggcctag

SEQ ID NO: 11618 - DNA, 1299 bp, Artificial Sequence
  Description of Artificial Sequence: Synthetic coding sequence
atggctcagaaccagtttttcaatagttcccggcccgggcggccccccaaaagatccctgggtgtcctgcaggagaatgcaagactcctcacacacgcggtacccggactgctgagtccaggactgattacccctacgggcatcaccgcggcagccatggctgaggcgatgaaactccaaaaaatgaagcttatggctatgaacacacttcagggaaatggtagccagaacggtactgagagtgagcccgatgatttgaatagcaataccggaggatctgagagtagctgggacaaggataaaatgcagtccccattcgccgcccctggcccgcaacacgggatagcccacgccgcccttgctggtcagcctggaatagggggcgctccaaccctcaaccctcttcagcaaaaccatctgctgacaaaccgactggatctgccattcatgatgatgcctcatcccctgctgccagtgtcactcccccctgccagcgtcgcaatggcaatgaatcagatgaatcatttgaatacaatagcaaatatggctgctgctgcacaaatccattcacctctgtcgagagctggtacatcagtaataaaagaaaggattcccgaatccccctcccccgctccctccctcgaggaaaatcaccggcctgggagtcagacgtcctctcatacctcttccagcgttagctcctccccatctcagatggatcaccacctcgaacgcatggaggaggtgcctgtccaaatccctatcatgaaatcgcctttggataagattcaactgactccagggcaggctctccccgccggatttcccggtccttttatttttgccgacagcctatcatccgttgagaccctacttaccaacatacaaggcctcctgaaggtcgctctggataacgctagaatacaggaaaaacagatacagcaggaaaagaaagaactccgcttggagttatatcgagagagggagattagggaaaacctcgagagacagctggctgtggagcttcagtcacgcacaacaatgcaaaagcgcctgaagaaggagaagaagacgaagcggaagctccaggaggctctggagtttgaatccaaacgcagggagcaggtggagcaggctctgaagcaggctacaacctccgatagtgggctgcgaatgttaaaagatactgggattccagatatcgagatcgagaataacggcacaccacatgactccgccgccatgcagggcggaaattattattgtctcgagatggctcagcaactctactcagcatag

SEQ ID NO: 11619 - DNA, 1299 bp, Artificial Sequence
  Description of Artificial Sequence: Synthetic coding sequence
atgacacgaaaacaggccgtgaacagttctcggccgggtaggcctccgaaacgatccctcggagtactgcaggaaaatgcccggcttctcacccatgcagtgcctgggctgctgtctccagggttgataactccaacagggataacagcagctgccatggccgaggcgatgaaactgcagaaaatgaagctgatggcaatgaatacgctgcagggaaatgggtcacagaacggcacggagtctgagccagatgacctgaacagcaatacaggaggcagcgagtcaagttgggacaaggacaagatgcagtcccccttcgcggcaccagggcctcaacacggaattgcacacgcagcgctcgccggacagcccggtatcggcggagctcccactctgaaccccctgcagcaaaaccacttgcttaccaataggctagatctgccatttatgatgatgccgcacccattactgcccgtgtccctgcccccagccagtgtagccatggccatgaaccaaatgaaccacttgaatactatagctaacatggctgccgccgctcagatccactccccactgtcacgggccggcacctcagtgatcaaggagaggattccggaatccccctctcctgcgccctcgctcgaggagaatcaccgaccaggatcccagacgtctagccatactagttcttctgtgtcttcgtccccttctcaaatggatcaccacctcgagaggatggaagaagttcccgtccagattcccattatgaaatctcccctagacaaaattcagctaacccctggccaggcacttccagctgggttccctggccctttcatcttcgcagatagtctatcctctgttgagaccctgctgacgaacatccagggactgctcaaagttgctctggacaacgcgcgcatacaagaaaagcaaatacaacaggaaaaaaaagaactcagactggagttatatcgagagcgcgagatccgggaaaaccttgaacgccagcttgcagttgagctgcagtccagaactacgatgcaaaaaagactcaagaaggaaaagaaaactaagcgtaagctgcaggaagcgttggagttcgagtctaaacgtcgcgaacaggtggagcaggcgctgaagcaggccacaacctcagatagtgggcttaggatgctcaaggatacgggcatacctgacattgagatcgagaacaatggaactccccatgattccgctgcgatgcaaggcggtaactattactgtctcgagatggcccagcagctctactccgcgtag

SEQ ID NO: 11620 - DNA, 1143 bp, Artificial Sequence
  Description of Artificial Sequence: Synthetic coding sequence
atggccgaagccatgaagttacagaaaatgaaactgatggctatgaacactttgcagggcaatgggtcccagaatggtaccgaatcagaacccgacgacctgaattctaacacgggcggtagtgagagcagttgggataaggacaagatgcagagcccattcgctgcccccggtccacagcacggcatcgctcacgcagccttagccggccagccagggataggcggggcgccgactctcaatcctctgcagcaaaaccatctgttaacgaaccggcttgatttgccgtttatgatgatgcctcatccccttctgcccgtgtccctgccaccagcctctgtcgcaatggcaatgaaccagatgaaccacttgaacacaatcgctaatatggcagcggccgcccagattcatagtccgttgtctagggccggaacatctgtgataaaggaaaggatccctgagtctccatcacctgcccctagcctagaggaaaaccatagaccgggatctcagacgtcctcccatacgtccagcagcgtgtcctcatccccatcacagatggaccaccacctggaacggatggaggaggtgcccgtccagatcccaataatgaaaagccccctggacaagatccagctgacgcctggccaggccttgcctgctggattccctggacctttcattttcgcggattctttaagcagcgtcgagactctgctcactaacatacagggccttctgaaggtagccttggataacgcacggatccaggaaaaacagatccagcaagaaaagaaagaactgaggttagagttgtaccgggaaagagagataagagaaaatctcgaaagacagctggcggtggaactgcagtcaagaacaactatgcagaaacggctgaaaaaagaaaaaaagacgaagaggaagctccaagaggcattggagttcgaatctaaacgcagggaacaggtggaacaggccttgaagcaagctactacttctgatagcgggttgcgaatgcttaaagacacaggaattccagatatcgaaatagaaaacaacggtacaccacacgactccgccgccatgcagggcggtaattactattgcttagaaatggcccaacagctgtactctgcctag

SEQ ID NO: 11621 - DNA, 1794 bp, Artificial Sequence
  Description of Artificial Sequence: Synthetic coding sequence
atgcaatggccccccccatggagacgtagtccgctggtgtccgccacaccccctcctggcccaacccggggcttactgtgtccacgcagggtgagcgaagccggtgatagctctactgaaggcgcccgcactggccaccgccactatgtgaccccagctgaatccgccatggaaggacggtcacagccactaccaagcctacgacccgcatcgcccaccaacgcaccagcccacgggaggggatctgactgtaccgctaaagagcctcctctagccaatgtgtgccgtcagaattacggtgctgcgcaagatcccgtcgagcccgctggacgccgctctgcttctcacgtcacaggctcctcactgggtaaggcagaggtggcatgtggtagaagatggaggtgggccgagttgctggcagacacctcatggagtcccgccggccgggctacagagatgaaggtcaaaatgttatctagaaatccggacaattacgtgcgagaaacaaaactggacctgcagagggtaccacggaactatgaccctgccctgcatcccttcgaggtgccacgggaatatatccgggccctcaacgcaaccaaactggagagggtgtttgcaaaaccatttctcgcttctctggatggccatcgcgacggagtaaattgccttgccaaacacccagaaaagctggccactgtcctctccggcgcatgtgatggtgaagtacgcatttggaacctcacccagaggaattgtatccgtactattcaggctcacgaagggttcgttagggggatttgcactaggttctgcgggacaagctttttcaccgttggagatgataagaccgtgaaacagtggaaaatggacggccccgggtatggggacgaagaagaacctctgcacaccatacttggtaaaacagtgtataccggcatagatcatcattggaaggaagcagtgttcgcaacatgtggacaacaagtcgatatctgggacgagcaacgaactaaccctatttgctccatgacctggggctttgactccatctcctctgtgaaatttaaccccatcgagacatttctcttgggctcttgcgcctcagatcggaatatcgtattatacgatatgcgacaggctacacctctgaaaaaagtcatcctggacatgcggaccaacaccatctgttggaatcctatggaggccttcatcttcaccgccgcgaacgaagactacaacctgtatacattcgacatgagggctctggatacacctgtgatggtccatatggatcacgtgtcagccgttctagacgtagactactcgccgaccgggaaagagttcgtcagcgcttcgttcgacaagagtataagaatttttccagtcgacaagtcacggtcacgagaagtttaccacacaaaaaggatgcagcacgtgatttgcgtcaagtggacttccgactcaaaatatattatgtgcggtagcgacgaaatgaacatccggctatggaaggctaacgcgagtgaaaaactgggcgtgctgaccagtcgggagaaggctgcaaaggattataatcagaagcttaaggagaagttccagcattatccacacattaaacgtatcgcaaggcatcggcacctgccaaagtccatttattcacagattcaggaacagcgcatcatgaaggaggccagacgtaggaaggaggtcaaccgcatcaagcactccaaacctggttcagttccccttgtttccgagaaaaagaagcacgtggtggctgttgtaaagtag

SEQ ID NO: 11622 - DNA, 291 bp, Artificial Sequence
  Description of Artificial Sequence: Synthetic coding sequence
atgaaggtgaaaatgctctctcggaatcctgataactatgtccgggaaacaaagctggacctgcagcgcgttcccagaaattatgacccagctttgcacccttttgaggtaccacgcgagtacatccgagcgctgaacgcaacaaaactggagcgcgtttttgccaagccattccttgcctctctggacggacatcgcgatggggtaaactgtctagccaagcacccggagaaactcgctacagtcctgtccggtgcatgcgacggtgagttgaacatgatcaaactatag

SEQ ID NO: 11623 - DNA, 2583 bp, Artificial Sequence
  Description of Artificial Sequence: Synthetic coding sequence
atgtctcggggtggaagctatccgcacctgttgtgggacgtccgaaaacgctctttaggccttgaagatccgtcaaggttacgatccagatatttgggccgtcgagagtttatccagaggctgaaactggaagctacccttaacgttcacgatggatgcgtgaacaccatatgttggaacgacactggtgagtacatcttgtctgggagcgatgacaccaaactggtaatttccaatccttattcacgcaaggtgctcaccactatccgatctggacaccgtgccaacatcttttccgcgaagtttttaccgtgcactaatgacaagcagattgtcagttgtagcggcgacggcgtcattttttacaccaatgtggagcaagatgctgagaccaataggcagtgtcagtttacttgccattatggcactacatacgagatcatgacagtacctaacgatccctacactttcctgtcatgcggcgaggacggcaccgtaaggtggttcgatacaagaataaaaacctcctgtacaaaagaagactgcaaggatgacatcttaatcaactgtcgccgagctgcgacttccgttgccatctgtcccccaattccttactacctggccgtgggttgtagcgattcctccgtgcggatctacgacagacggatgctaggcactcgagcaactggcaactacgcagggaggggcacaacaggcatggtggcgcgcttcattccgtcccacttgaataataaatcctgtcgcgtaacatcgctgtgttatagcgaagacggtcaggaaatcctagtgtcatactccagtgattacatctacctgttcgaccccaaagacgacaccgctcgagagttgaaaacaccctccgcagaggaaagaagagaagagcttcgacaacctcctgtaaagcgcttgaggctaaggggtgattggtctgatactggcccgagggccagaccagaaagcgagcgtgagagggatggagagcaatctcccaatgtgagccttatgcaacgtatgagcgacatgctctctcgttggttcgaggaagcaagtgaggtggctcagtccaatcgaggcagggggaggtcacggcccagggggggtacaagccagtctgacattagcaccctgcctacagtgccgtcttctcccgaccttgaagtgagcgagacagcaatggaagtggatactcccgccgaacagttcctccaaccttctaccagctctacaatgtcagcacaggcccattcaaccagcagtcccaccgaatccccgcatagcaccccgttgcttagcagccccgattcagagcagcggcagagcgtcgaggccagcgggcaccacactcaccaccagagcgacaataataatgaaaagttaagcccaaaacccgggacgggtgaaccagtactgtcactccattactcaactgaaggcactaccacatccaccatcaaattaaattttaccgacgagtggagtagtattgcgtcgtcttcaagaggaatcggctcacactgtaagagcgaaggtcaggaggagtctttcgtcccccagtcatcagttcagcctcccgagggcgatagtgagactaaggcacccgaagaatcaagcgaggacgtgactaagtatcaggaaggagtgtcagccgagaacccggtggaaaatcacattaacataacgcaatccgataaatttaccgccaagccactggactcaaattccggagagagaaacgatctgaatctcgaccgcagctgcggtgttcctgaagagagcgcatctagcgagaaggctaaggagccagaaacctctgaccagacatccacagaatccgccactaacgagaacaatacaaatcccgagcctcagttccaaaccgaggccaccgggccttcagctcacgaggaaacttcaacccgcgattcagccttacaggacaccgatgactcggacgatgaccccgtactcatccccggagcgcggtaccgagctggccctggggataggcgctcagccgtggccaggatccaggaattctttcggagaaggaaagagcgaaaggaaatggaggagttagataccttaaatatcaggcggccccttgtgaagatggtgtacaagggtcaccgtaactcaaggaccatgatcaaagaagcaaacttttggggtgcaaatttcgtgatgagcggctcagactgtggccatatctttatttgggacaggcacaccgcagagcacctgatgctattagaggccgataaccacgtggttaactgtctccagcctcacccttttgacccaatcctggccagctctggcattgattacgacatcaaaatctggtcacccttggaagagtcccggatcttcaaccgaaaactcgccgatgaggtcattactcgcaacgaactcatgctagaggaaaccaggaatacgatcacagtcccggcctcatttatgctgagaatgttagcaagtttgaatcacattcgggccgacaggcttgagggggatcgcagtgagggaagtggacaggagaacgagaacgaggatgaggagtag

SEQ ID NO: 11624 - DNA, 2856 bp, Artificial Sequence
  Description of Artificial Sequence: Synthetic coding sequence
atgagcagagggggcagctacccgcatttactttgggatgtccgtaaaaggtctctgggactggaggatcccagtcgattgcgctctcgatatttgggccgccgggaattcattcagcgactgaagctcgaggctaccctcaacgttcatgacggctgcgtgaatacaatatgttggaacgatacgggcgaatatatcttaagcggcagtgacgatacaaaactcgtgatctcaaacccctatagccgcaaggtgctgacaaccatccggtcaggccacagggctaatatcttctcggcaaagttcctgccctgcaccaatgacaagcagatcgtgtcttgcagtggcgacggcgtgatcttttacaccaacgtcgaacaagatgccgaaacaaaccggcagtgccagtttacctgccactacggcacgacttatgagatcatgacggtaccgaatgacccctatactttcctcagctgtggggaggatggaacagttaggtggttcgacactcgtataaagacatcatgcactaaggaggattgtaaagatgacatcctgattaactgtcgccgcgccgctacctccgttgcaatctgtcctccaattccctactatcttgccgtggggtgctcagattcctctgtgcggatttacgaccgcaggatgctggggacacgggccactggcaactacgcaggccgcggtactacaggaatggtggccagatttatcccatctcacctgaataataagtcttgccgggtaacttctctctgttatagtgaagacggtcaagagattctggtctcttacagctcggactacatctatctgttcgatccaaaagacgatactgccagagagctcaagaccccctccgccgaggagcgtagagaggagctcagacagcctccagtgaaacgcctgcgactacgaggggactggagtgataccggacccagagcccggccagagtccgagcgggagcgggacggagagcaatcccccaacgtctccctgatgcagagaatgtccgatatgctaagtcggtggttcgaggaagcctctgaggtggctcagagcaatcgggggcgggggcgcagtcggccccgaggcggaacgagtcaatctgacatatccacactccctactgtgccttcgtcccctgaccttgaagtgagtgaaactgccatggaggtcgatacaccggctgagcagtttctgcaaccgagcacatcttctactatgtccgcccaggcacatagtactagttcccccaccgaatccccccattctacacccctgctttcttccccagatagcgagcaaaggcagtcagttgaggcgagcggtcaccatactcatcaccagtccgagttcctcaggggaccggagatcgccctgctacgtaaaaggctgcagcagttacgcctgaagaaggccgagcaacaacggcagcaagaattagccgcgcatacccagcagcaacctagtacttctgatcagtcttctcacgagggttcctctcaggatccccatgccagcgattcaccaagctcggtcgtgaataaacagctggggagcatgtccctggacgagcaacaggacaacaataacgaaaagttgagccccaagcctggcactggagagcctgtcttgagtctgcactactccaccgaaggtaccaccacatctaccatcaaactcaacttcaccgacgaatggtctagcattgcctctagttctagaggtatagggtcacactgtaagtcagagggacaggaagagtcgtttgtgccacagagtagcgtccaacctcctgaaggcgatagcgagaccaaggctcctgaagagtcctcggaagatgtcactaagtaccaggagggagtttctgcagaaaacccagtcgagaaccacattaatattactcaatcagacaaattcacggccaagcctctcgatagtaattccggtgagaggaacgatctgaacttggatcgcagttgtggggtgcctgaggagagtgctagcagcgaaaaggccaaagagcctgagacttctgaccagacctccactgagtccgcgactaatgaaaacaacacaaaccccgagcctcagtttcagacagaggcgaccggcccttccgctcatgaggagacaagtacacgggacagtgctttgcaggatacagacgatagcgatgatgatccggttcttattcctggcgctcgctaccgagccggccccggtgatcgttttaatattcgcggcactacaattggcgaccggataatgcgcagatcagcagttgcgagaatacaggaattcttccgtagaagaaaagagcgcaaagaaatggaagaactggatacactaaatatccggcgccctctggtaaagatggtgtacaagggacacagaaattcacgcactatgattaaggaagccaacttctggggtgccaacttcgtcatgtctggtagtgattgcggccacatctttatttgggatcggcacacagccgaacacctcatgcttctggaggctgataatcatgtagtcaactgcttgcagcctcacccgtttgatcctatcctggcttcttctggcatcgactatgatattaagatctggagccctttggaagaatcaaggatctttaacagaaaactggccgatgaagttataacgagaaatgaactcatgcttgaagaaacccggaacacaatcacagtccccgctagctttatgttacgaatgctcgctagcctcaatcacataagggctgacaggttagagggggaccgctctgaggggtccggtcaagagaatgagaacgaggacgaagagtag

SEQ ID NO: 11625 - DNA, 2643 bp, Artificial Sequence
  Description of Artificial Sequence: Synthetic coding sequence
atgagccgcggaggcagttatccacatttattatgggacgtgagaaagcgctcactgggcttggaggatccctctcgtctgagaagccgctaccttggtcgacgggaatttattcagaggctcaagctggaagcaaccctcaatgtgcacgacggctgtgttaatactatctgctggaatgacacaggggagtacatactctctggtagcgatgatactaagctagttattagcaatccatattctcgcaaggtgttgacaaccattaggagtggacaccgcgcgaacatattcagtgctaaatttctgccatgtaccaacgataagcagattgtgtcatgctctggcgatggcgtgatcttctacaccaacgtggaacaggatgccgagaccaatcgccagtgtcagtttacatgccattatggcacaacctatgaaattatgaccgtgccaaacgacccttacacttttctttcctgcggggaggacggcacagtccggtggttcgatacacgcatcaagacctcttgtaccaaggaggattgcaaggacgacatcctgatcaactgcagaagagccgccacctctgttgctatctgcccaccaataccctactatctggcagtggggtgctccgatagcagtgtccgtatttacgaccgacgaatgttgggtacacgggctacaggtaattatgctgggcggggcacgacaggaatggtagcccgctttattcctagccacttaaacaataaatcttgtcgcgtaacaagtctttgttactccgaggatgggcaagaaatactagtttcctattccagcgactacatttacctcttcgatcccaaggatgataccgcccgcgagctgaaaacaccaagtgccgaggagaggcgcgaagagttgcgccagccccctgtgaaacgactcaggttgcgaggagactggtctgataccggcccccgagctaggccggaaagcgaacgcgaacgcgacggagagcagagccctaacgttagcttaatgcaacggatgagcgacatgctgtccagatggttcgaagaggccagcgaggtcgcccagtccaaccgcgggcggggtagatcccgtcctcgcggcggtactagccagtccgatatttctaccctccccaccgtgccatcctctcctgacttggaggtgtccgagacagccatggaggtagatacacctgcagagcagttcttgcagccaagtacatcttcaactatgagcgcacaggcccatagtacaagttcccccactgaaagtcctcactcgactccgctactgagttcgccggactcagaacagaggcaaagtgttgaggcttccggccatcatacgcaccatcagtcagacagcccgagctctgtggtaaataagcaattgggcagtatgagtctcgacgagcagcaggataacaataacgagaagctctcacccaagccaggtaccggtgagcccgtgctctcactacattactcaactgaagggaccactacatcaacaataaaattaaattttacggacgaatggagctctatcgcttcgtcctcccgcggcattggcagccattgcaaaagcgaaggacaagaagagagcttcgttccacagagcagcgtccagccccccgaaggggattccgagacaaaagcaccagaggagtcaagtgaagacgtcaccaagtatcaagagggggtgtctgccgagaatcctgttgagaaccatataaacattacacaaagcgataagttcaccgcaaaacctctggactcaaactctggtgaaaggaatgatttaaaccttgatagaagctgcggtgtccccgaagaatcggcttcgagcgagaaagctaaggagccagagacttctgaccaaacatctactgagtccgccaccaacgagaataacaccaatccggagccccagttccagacagaggccactggtccatccgcacatgaagaaacaagcacaagggatagcgcacttcaggatacagacgacagtgacgatgacccagtgctcataccaggagccaggtatagggcaggaccgggagataggcggtctgcagtcgctaggattcaggaattttttagacgcaggaaagagaggaaagaaatggaggagctggacactctcaacattcggagaccactggtgaaaatggtgtacaaagggcatcgcaattcaaggactatgattaaggaggccaacttctggggtgctaatttcgtgatgtcagggtctgactgtggccacattttcatttgggatagacacacggccgagcacctgatgctgttggaggcagataaccacgtggtgaattgcttgcagccccaccccttcgaccctattctggcatcgagcggtatcgactatgatatcaaaatctggagccccctagaggaatccagaatattcaaccgcaaattggccgatgaggtcatcaccagaaacgagttaatgcttgaggaaacccggaacaccatcacagtgcctgcctcctttatgcttagaatgctggcaagtctcaatcacatcagggctgacaggctggagggagatagatcagagggatctgggcaggagaatgagaatgaagatgaggaatag

SEQ ID NO: 11626 - DNA, 2763 bp, Artificial Sequence
  Description of Artificial Sequence: Synthetic coding sequence
atgtctcggggaggctcctatccgcacctcctgtgggatgtgcgaaagaggtccctggggctggaagacccttcccgcctacgatctcggtatctggggagacgggagttcatccagcgcctgaaattggaggccacgttgaacgtgcacgacggctgcgtcctaacaactatacgctccggtcacagagccaacatctttagcgccaagtttctgccttgtaccaatgacaagcagattgtgtcctgttcaggggacggagtcatcttttataccaacgtggagcaggatgctgagactaaccgccagtgccagtttacgtgccattatgggactacatacgagatcatgacagtcccaaatgacccatacaccttcttgtcttgtggagaagacggaacagttaggtggttcgacacaaggatcaaaaccagctgcactaaagaggactgtaaagatgacattctcattaactgtcggagggcggcgacgtcagtggcaatttgcccaccaatcccttactatttagctgtgggttgttcagactcaagtgttcggatttatgataggcgaatgctgggcacaagagccaccggaaactatgccggtaggggcaccaccggcatggtggcaaggttcattcctagccaccttaataacaaatcctgccgcgtcacttctctgtgctactctgaagatggccaggagatcctggtgtcgtatagctctgactacatatacctgtttgacccaaaggacgacacagcccgggaattgaaaaccccatccgctgaggaacgccgggaagaactacgccagcctccggtcaaaagactcagattacggggggattggtcagacactggtccacgcgctcgcccagagtccgagagggaacgggacggggaacagagtccaaatgtcagcctaatgcagaggatgtcagacatgctaagtcgctggtttgaggaggctagtgaggttgcccaatccaaccggggccggggtcggtctcgccctagggggggtacttcccagtccgacatctccacactccccacggtgcccagcagtccggacttagaggtcagtgagaccgctatggaagtcgacacaccggcagagcaattcctccagccgagcacttcaagcaccatgtccgcccaagctcatagcaccagctctcccaccgagagccctcactccaccccgctcctttccagtccagatagtgaacagcgacagtcagtggaagctagcggacaccacacgcaccaccagtcagagttcctgcggggaccggagattgcactcctgagaaagcgcctgcaacagttgcgtctgaaaaaggctgagcagcaaagacagcaggaactggctgcccatacacagcaacagccctctacctcagatcaaagttctcacgagggttcctcgcaggatcctcatgccagtgacagccctagttccgtggtcaacaagcagttaggctctatgtccctcgacgaacagcaggacaataacaacgagaagctgtctcccaagccaggtacaggagagcccgtcctctccctgcactactcaacggaggggacaactacttccacaattaaattgaattttaccgacgaatggagctctatcgcaagctcatcgagagggattggtagccattgtaaatctgaggggcaggaagaatccttcgtgcctcagtcaagtgtgcagccgccagaaggagattccgagaccaaagcgccagaggagagtagtgaggatgtcacaaagtaccaggaaggagtttccgcagagaatcccgttgaaaaccatatcaacataacccaaagtgacaaattcactgcaaagccactggattcaaatagcggcgagcggaatgatttaaatcttgaccgaagttgcggagttcccgaggaatccgcatcgagcgagaaggcgaaggagcccgaaactagtgaccagacatccactgaatccgcaacaaatgagaataacacgaatccggagccccagttccagaccgaggcaactggcccgagcgcccacgaggagacaagcacccgagacagcgccctgcaagacacagacgactccgatgatgatcccgtcctgatacccggcgccaggtatcgtgcaggccctggagaccgtttcaacatccgagggaccacaataggggatcgtattatgcggaggtcagctgtggctagaattcaggagtttttccgccgccgaaaagagcgaaaagagatggaggagctggataccctaaacatcaggagaccattggtgaaaatggtttacaagggccatcgcaattcccggactatgatcaaggaggcgaacttctggggcgcaaactttgtaatgagcggctcggactgcggccatatatttatctgggataggcatacagcagagcacttgatgctgctggaggcagataatcacgtcgtaaattgtcttcaaccgcaccctttcgaccctatactggcttcaagcggcattgactacgatatcaagatctggtcaccacttgaagaaagtagaatctttaaccgaaaactggctgacgaagtaattacccggaacgaacttatgctagaagagaccagaaacaccatcacagtccctgcatctttcatgttacggatgctggcttctctcaaccacattcgcgcagacagattagagggggacaggtcagaggggtctggccaggagaacgaaaacgaggacgaggaatag

SEQ ID NO: 11627 - DNA, 1524 bp, Artificial Sequence
  Description of Artificial Sequence: Synthetic coding sequence
atggaagattccgaggcccttggattcgaacatatggggctcgacccccgactcctacaggcggtgaccgacttaggatggtccagacctacattgatccaggaaaaagccatccccctggcactagaggggaaggatttgttagccagagcccggacaggctctggcaaaacagcagcatatgcaattcccatgttgcagctactgttgcacaggaaagctactggcccagtggtggagcaggcagtgagaggcctggtcctggtgcctactaaggaactggcacgccaggcccagagcatgatacagcagctggcaacatactgtgcacgcgacgtgcgtgtggccaacgtttccgctgcagaagatagcgtttcacagagggctgttttaatggaaaaacccgacgtagttgtgggaacgccctcccgcatcttatcacatttgcagcaagatagtttgaaactgcgggacagcctggagctgctcgtggtggacgaagctgacttattgttttcattcgggtttgaagaagagctgaaaagtcttctgtgccatttgcctcggatttaccaggcctttctcatgtccgccactttcaacgaagacgtacaggccctgaaagagctgatcttgcacaatcccgtgacacttaagcttcaggagtctcagctgccaggacccgatcagttgcagcaattccaggttgtatgtgagactgaagaggacaaatttctcctactgtacgctttactcaaactatctctcatcaggggaaaatccctgctgttcgttaataccctcgaaaggtcctatcggcttcggctcttccttgaacagttctccatccccacgtgtgtgctgaatggagagctgccactcaggtcccgcgcgtcagacccggaggccggtgtcgcgagagggattgatttccatcacgtgtccgctgtccttaattttgatctcccccccacacccgaagcctatatacaccgcgctggccgtaccgccagagccaataatcccggtattgtgcttacgtttgtactccccaccgagcaattccacctcgggaaaatcgaggagctgctgtcaggggagaatcgcggacccattcttctgccgtatcagtttcgaatggaggaaatcgaggggttcagatatagatgtcgcgacgccatgcgtagcgtgactaaacaagccatccgggaagcccgcttgaaagaaataaaagaggaacttctgcatagcgaaaagctcaagacatactttgaggacaacccgcgcgacctgcaactcctccgtcatgatcttccactccacccagctgtggtgaagcctcacttaggacatgttcctgattacttggtcccgccggctctgcgcggcctcgtgagaccacataagaaaagaaagaagttatctagctcgtgtagaaaggcgaagcgggctaaatcccagaatccgctaaggtccttcaagcacaagggtaagaagttccggcccactgcaaagccctcctag

SEQ ID NO: 11628 - DNA, 2391 bp, Artificial Sequence
  Description of Artificial Sequence: Synthetic coding sequence
atggtcctggcccaacggcggagggggggatgtgagaaactcagggctggaccacaagccgttctagcaagtggcagcggcttttgcgacaatatgttggcagacctggggcttatcggcactattggggaggacgacgaggtgcctgtcgaaccggagtcagacagcggggacgaagaagaggagggtcccattgttctgggtagaagacagaaagcacttgggaagaataggtccgcagactttaatccagactttgttttcacagagaaggagggaacatacgacggatcatgggcactggcggacgttatgtcccagctaaaaaagaaaagagcggcaactaccttggacgaaaagattgaaaaagtacgtaagaagcggaaaaccgaagataaggaggctaaaagtggaaagctcgagaaggaaaaagaagcgaaggaaggctccgagcctaaggagcaagaggatttacaggaaaatgacgaagaagggtctgaggatgaggcttcagaaactgactactctagcgccgacgaaaacatcctcacaaaggcggacacactgaaagtcaaggaccgaaagaagaaaaagaaaaaggggcaggaggctgggggattctttgaggacgccagtcagtatgacgagaatctgtccttccaagacatgaacctgtcccggcccctccttaaagccatcacagctatgggtttcaaacagcctactcccatccagaaggcgtgcataccagtggggttgttaggcaaggacatatgtgcatgcgcggctacaggtactggaaaaaccgctgctttcgccttgccagtcttagagcggctcatttacaaaccacgccaagcaccagtgactagggtgttagtcctggtgcctacaagggagctgggaattcaggtgcattcagtgactcgtcagttagcgcagttttgtaacatcacaacgtgtctggcagtgggcggcctagatgtgaaaagtcaggaagctgccctgagggcagcacccgatattctgatagccacacctggacgcttgatagaccacctacataactgcccatcttttcacctgagcagtatcgaggtgcttatacttgacgaggcagacaggatgctggatgagtacttcgaagaacaaatgaaggagatcatcagaatgtgttcacatcaccgccagactatgctcttcagcgctacaatgaccgatgaggttaaggacctggcctccgtgtcactcaagaaccccgtccgcatctttgtcaatagcaacaccgacgtggcaccatttctgagacaggagttcatccgcatcagacccaatcgcgagggggatcgcgaggccattgtagcagccctcctaactagaaccttcactgatcacgttatgctcttcacccagacaaagaagcaggcccaccgaatgcacatcctgctcggtctgatggggctccaggtgggtgagctacacgggaatttgagtcaaacacagcgtctggaagcgctgagacgttttaaggatgagcagatagatattcttgtggccacagacgttgctgcccgtgggctggatattgaaggagtgaaaaccgtgattaatttcacgatgcccaatacaattaagcattatgtccacagggtaggacgcactgctagagccggaagggccgggagaagcgttagcctggtgggagaagacgagagaaagatgctcaaagagattgttaaagcggccaaggcacccgttaaagcgcgtatattaccccaggatgtcatcctgaagttcagggacaaaatagagaaaatggagaaggatgtgtacgcagttctccagctggaagcagaagagaaggagatgcagcagtccgaggcgcaaataaacacagcaaaacggctcttggagaaaggaaaggaggccgtcgttcaagagcctgaacgttcctggttccagaccaaagaggaacggaagaaagagaagatcgcaaaagccctgcaggaattcgacctggcactgaggggcaagaagaagcggaagaaattcatgaaagacgcgaaaaaaaagggtgagatgactgctgaagagaggagccagttcgaaatattaaaggcacagatgttcgctgagaggctcgctaaacggaatcggcgcgctaagcgggcccgtgccatgccagaagaggaacccgttaggggaccggccaagaagcagaagcagggcaaaaaaagtgtttttgatgaggaactaaccaatacatcaaagaaggccctcaagcagtatagagccggcccctcgttcgaagagcgaaaacagctcggactaccacatcagcgacgggggggaaatttcaagtctaaaagtcggtacaaacgacggaagtag

SEQ ID NO: 11629 - DNA, 411 bp, Artificial Sequence
  Description of Artificial Sequence: Synthetic coding sequence
atggtgctggctcaacgcaggcgtgggggttgtgaaaaattgagagccggaccccaggccgtgctggctagtggatctggcttctgcgacaatatgttggccgatcttggcctgattggcaccattggcgaggatgacgaggtgccggtggaacctgaatctgattcaggggacgaggaggaagagggtccgattgtactgggccgccgtcaaaaagcactgggaaaaaatagatcggcggattttaacccagattttgttttcacagaaaaggaaggtacctatgatgggtcgtgggccttagccgacgttatgtcccaattgaaaaaaaaacgggcagctaccacattggacgagaaaattgaaaaggtccggaagaaaagaaaaaagaaaaagaaaaaaaaaaaatag

SEQ ID NO: 11630 - DNA, 1758 bp, Artificial Sequence
  Description of Artificial Sequence: Synthetic coding sequence
atggcccccgacctcgcctctcagcgacattctgaatccttcccctccgtgaacagtcggcccaatgtgatactgcccggcagggagggtagacgtgaagggctgccccctggtggtggcaccaggggtagcctagtccccactaggccagttcccccatcaccagcccctctgggcacttccccttactcttggagtcgcagcggtcccgggcgaggcggcggggcaggctcctcacgtgtgccccggggggttcctggccccgccgtatgtgcccctggatccctgttgcatcatgcctcacccactcagaccatggctgccgcagacggatcactcttcgacaatccacggaccttcagccggcgtccacccgcacaagccagtaggcaagccaaggccactaaacgcaagtaccaggctagtagcgaggcccccccagcgaagcggcgaaatgagaccagttttctacccgctaaaaagacatccgttaaggaaacccagcgaacttttaaagggaatgcccagaaaatgttttctccgaagaaacactctgtaagcacgtccgatagaaaccaggaggagagacagtgcatcaaaacaagcagcctcttcaagaacaatcctgatattcctgaactgcaccgcccagtggttaaacaagtacaggaaaaggttttcactagtgccgcgttccacgaactaggacttcacccacacttgatatctacgataaataccgtgctcaagatgagcagcatgacttccgtgcaaaaacaatcaattcctgtgctgttggagggcagagacgccctggtacggtcgcagactgggtctggaaaaactctggcctattgcattcccgtcgttcagtctttgcaggccatggagagcaaaatacagaggtctgatggaccttatgctctggtgctggtgccaacccgagaactggcactgcagtcattcgacacagtccagaagcttctcaagccattcacgtggatcgtccccggcgtgctgatgggtggcgagaagcgtaagtccgaaaaagctcggctgagaaaagggataaatatcttgatttcaacccctgggcggttggtggatcatatcaaatccacaaagaacattcattttagcaggctgcgatggcttgtcttcgatgaagccgatcgaattctcgatttggggtttgagaaggacattaccgtcatcctcaatgctgtgaacgctgagtgccaaaaaaggcagaacgtgttactttccgctacgctcaccgaaggtgtcacaagactggccgacatttcgctgcatgatcccgtcagcatctcagtgctggacaagtcccacgaccaactgaatcccaaggataaggctgtgcaagaggtgtgtcccccgccagcaggggataaactggattcctttgcaattcctgagtctctgaaacagcatgttacagttgttccatccaaattacgcctggtctgtttagccgccttcattctgcagaagtgtaaattcgaggaggatcagaagatggtggtcttcttctccagttgcgaactggtggagtttcactactccctgttcctgcagactttgctgtcttccagcggtgcgcccgcctccggccagctccccagcgcttctatgcgtctcaagttcctgcgtctgcatggcggcatggagcaggaggaaagaactgccgtgttccaggaattcagtcattctcgtagaggcgtgctcttatgcacatag

SEQ ID NO: 11631 - DNA, 2337 bp, Artificial Sequence
  Description of Artificial Sequence: Synthetic coding sequence
atggcgccagacctggcctcccaacgacacagtgagagtttcccgtcagtcaactcgcgaccgaacgtgattcttcccggccgggaggggagaagagagggacttccaccaggaggcggaaccagaggctctctggttcctacaaggccagtacctcctagtccagcaccactgggaacttccccgtactcttggtctcgaagcgggccagggcgcggaggtggtgccgggtccagtcgtgttcctaggggggtccccggaccagccgtctgcgcgcccggaagtctgctgcaccatgcatcccccacacagacaatggccgccgctgacgggagcctcttcgataacccgaggacattttccaggagacctccagcccaggcttcgagacaagcgaaggcaacgaagcgtaaatatcaggcttctagtgaggctcctcccgctaagcgccgcaacgaaactagcttcctcccggctaaaaagacgagtgtgaaggaaacccagcgaacttttaagggtaacgcacagaaaatgttcagccccaagaaacactctgtctcaacaagtgatcggaatcaggaagaacgccagtgcattaagacgagcagcttgttcaaaaacaaccctgatattcctgagctgcaccgtccagtagtaaaacaggtccaggagaaagtctttacatcagcagcattccacgagctcggcctgcatcctcatcttataagcaccatcaacacagtcctcaagatgtcaagcatgaccagtgtgcaaaaacaatcaatcccagtgctattggaggggagagacgccctggtccggtctcagaccgggagcggaaaaaccctggcttactgcattcccgtggttcagagcctccaggccatggaatcaaaaatacagaggagtgacggcccctacgccctcgtactcgtaccaacgcgggagctggcactacaatctttcgacacagtccaaaagctgctcaagccattcacctggattgtgcccggcgtgttaatggggggcgagaagaggaaatcagaaaaggccaggctgcgcaagggcattaatatattgatatctaccccgggaagactggtggaccacattaagagtactaagaatatccatttttcacgcctgagatggttggttttcgacgaagccgacagaatactcgatttgggattcgagaaagatattacagtgatccttaatgccgtcaatgccgagtgccagaagcgccagaatgtattgctaagcgccactctcaccgagggcgttacacgtctcgcggatatctctcttcatgaccccgttagcatcagcgtactggataaatcccacgatcagttgaaccccaaagataaggccgtccaggaggtgtgccctcctcccgccggcgacaagttggatagctttgccattcctgaaagtcttaaacagcacgtcacagttgtgccatccaaactgcgcttagtgtgcttggctgcattcattcttcagaagtgcaaatttgaagaagatcagaaaatggtggtgttctttagcagctgcgaactggttgagtttcactatagtctttttttacagaccctactttctagtagtggggctccagctagcggtcagctcccttcagcctctatgagactgaagtttcttcggctgcacgggggtatggaacaagaggagcgaacggccgtgttccaggaattttcccattctcgcaggggcgtgctgttatgtactgatgtggccgctcgaggtctcgacctcccccaggttacttggatcgtacagaacaccagtactgggttagaggagccaccaggactggccgctatgggggcagcatgctcattttggctgctccggcgacaaaacatgagtacacgctggctgctcacaaagtcaaccctccagtcatttatccaggcctacgccacatatcccagggaactgaagcacattttccatgtcaggtcactccatctgggccacgtcgcaaaaagctttggccttcgcgatgcgcctagaaatctttctgcgcttactagaaaaaagagaaaggcacatgtcaagcggcccgacctacacaaaaagacccagagcaaacatagtctcgctgagatcctgagatcagagtacagttcagggatggaggctgacattgccaaggttaaaaaacagaatgcacccggtgagcccggcggaagacccctgcagcactccctgcagcccaccccatgttttggcagagggaagacgctgaaatggcgaaagactcagaagggagttcagcgagactctaagacttctcagaaggtatag

SEQ ID NO: 11632 - DNA, 2328 bp, Artificial Sequence
  Description of Artificial Sequence: Synthetic coding sequence
atggcccctgacttagcctcacagcgccattccgagagtttcccatctgtgaatagccgcccaaacgtgatccttcctggccgggaaggacgcagggagggtctgcccccgggaggcggcactagaggctcactcgtgcccacccgccctgtgccgccgagccccgcccctctcggcacgtccccttattcatggagccgcagcggcccagggcgagggggcggcgcagggtcttctcgagtaccccgtggggtgcctggaccagctgtgtgcgcacccggaagcttgctccatcatgcctcccctactcagacaatggccgccgccgacgggtccctctttgacaaccctcgtacattttcccgacgcccacctgcacaggcttccaggcaggccaaggcgacaaaacgcaaataccaggcttcctcagaggcccctcccgccaagcgcagaaacgagactagtttcctcccggccaagaagacatctgtgaaagagactcaacggacgttcaaaggaaacgctcagaaaatgttcagtcctaagaaacacagcgtgtccactagcgaccggaatcaggaggagcgccaatgtatcaagacaagcagcctgtttaaaaacaatcccgacatccctgagctgcaccgtccagtcgtaaaacaggtccaggagaaggtgttcacttctgctgccttccacgaattgggcctccatccacacctgatttccactattaacaccgtcctaaagatgagtagcatgacaagcgttcagaagcagagcattccagtgctcttggaaggaagagacgcactcgttcgctcccagacagggtcgggcaagacactggcctactgtatccccgtggtgcagagtctccaagccatggaatcaaaaatccaaaggtcggatgggccttacgcactggtccttgttccaacccgggaactagcccttcagtcattcgatactgtacagaaattgctgaagccattcacttggattgtgcctggtgtcctgatgggtggggagaagcgcaaaagcgaaaaagccaggttgaggaaagggattaacatccttatcagcacaccaggacggctcgttgaccatatcaagtcaaccaaaaatatccattttagtagactacgttggctagtttttgatgaggccgacagaattcttgacctgggttttgagaaggacattacagtgatcctaaacgcagtgaacgccgagtgtcagaagagacagaacgtgctgctgagcgccaccttgacagaaggggtgacacgcttggccgacattagtctgcatgatcccgtgtccataagtgtgctggataagagccatgaccaactgaaccccaaggacaaggctgtccaggaagtttgccctccacccgctggggataaacttgactctttcgccattccggagagcctcaagcaacacgttaccgtggtaccttctaaactgaggctggtgtgcctggccgcgttcattctgcaaaaatgcaagtttgaggaggatcaaaaaatggtggtgtttttttcaagctgcgagctcgtggagtttcattacagcctgtttctacaaactctgcttagcagtagtggcgctcctgcgtctggccaactcccgagcgcgtccatgcggctcaagttcctcagactccacggcggcatggaacaggaggaacggaccgccgtgttccaagagtttagccatagccggcgcggggttctgttgtgcacggacgtggccgctagggggcttgatctgccccaggtcacctggatcgtacaatacaacgctccctcctcgcccgcagagtatatccatcggattgggcgcactgcccgaatcggttgtcacggctcatctttgcttatcctggctccatccgaagccgagtacgtcaacagcctcgcctcacacaaaatcaacgtatcagagattaagatggaagatatcctatgtgtgctcactagggatgattgctttaaagggaaacgctggggcgcccaaaagtcccacgctgttgggccccaggaaataagggaaagagccaccgtcctgcagacagtatttgaggactacgtgcatagctcagagcgccgagtgtcctgggctaagaaagtgtggtcgctggagactcccgtacttaccgcgagcctgccagctcttttctccttttcatccgcggtactgcatccctctcttcggcacctgccccagggggctgaggctcacttgccaaggcccataccaccaccttgggcttgtggcgaagagctgcggactaaacgctgtccacaggaatcctag

SEQ ID NO: 11633 - DNA, 2556 bp, Artificial Sequence
  Description of Artificial Sequence: Synthetic coding sequence
atggcacctgacctggccagtcagaggcattccgagtccttcccatctgtgaatagcagacccaacgtcattctcccaggcagggaaggtcggcgtgaggggcttcctcctggggggggaacacgcgggtcactcgtccctacccgtccagtgcccccaagccctgcacctctgggtacaagcccttacagctggtcacgatctggtccagggagaggcgggggagcaggaagttcccgtgtcccacgtggggtgcccggaccagcagtgtgcgcacccggttctctcctgcaccacgctagtcctacacaaacaatggcagcagccgacggatcgctcttcgataatcccaggaccttctctaggcggcctccagctcaggccagtcgccaggcgaaggcgacgaaacggaagtaccaagcatcttcggaagccccaccggccaaaaggcgcaacgagacatccttcctgcctgctaagaagaccagcgtaaaagaaacccagcgtacctttaaaggcaatgcacagaagatgtttagccctaagaaacatagcgtgagcaccagcgatagaaatcaggaagagagacagtgtataaaaaccagcagtctctttaagaacaatccagacatccccgagctgcacagacccgtggtgaaacaggtgcaggagaaagtgtttacaagcgccgcattccacgaacttggtctccacccccacctgatctcaacaattaatacagtgctaaaaatgtcaagtatgacttcagtgcagaaacagtcgatccccgtgctgcttgaaggcagggatgctctagtgcgttcccagacaggatccggaaagactctggcttattgtattccggttgtccaatctttgcaagctatggagagtaagattcagaggtcagatggcccctacgcacttgtcctggtaccaacgcgcgagttggccctgcagtctttcgatactgtccaaaagctgctaaagcctttcacctggatagtcccgggagtactcatgggaggcgagaagcggaagtccgagaaggcacgtcttaggaaggggataaacatcctgatctctacgccagggcgactagtagaccatataaagagcaccaaaaacattcatttttcacgattaaggtggttggtttttgatgaagcagatcggattttagacctggggtttgagaaagatataactgtcatcctcaacgctgttaatgctgaatgccagaaaagacagaacgtcctgctgtcagccactctgactgaaggcgtgactaggttggccgacatttctctgcatgacccagtgtccatcagcgtgctcgataagtcccatgaccagctgaacccaaaggataaagcagtacaggaggtgtgtccaccacctgccggggacaaactcgacagctttgcaatccctgagtccctcaaacaacacgtcacagtggtgccatccaaactgaggctggtttgcctggcagcgttcatcctccagaaatgcaaatttgaggaggaccagaaaatggtggtgttcttctctagctgcgagcttgtcgagttccactacagcctgtttctccagaccctgctgtcgtcttcaggagccccagcgtccggccagctcccaagtgcgtcgatgcgtctaaagtttctcaggctgcacggaggtatggagcaggaagagcgcaccgctgtgttccaggagttctcccactcccgaagaggcgtgctgctgtgtacggatgtggctgccagaggtttagacctcccccaagtgacctggattgtgcagtacaatgcccccagctccccagctgagtacatccaccggattggtaggaccgctagaatagggtgtcacggctccagccttctcatactcgccccctcagaagcggagtatgtcaacagcctcgcgtcccacaaaatcaacgtctctgaaatcaagatggaggacattctttgtgtactgacgcgagacgactgtttcaagggaaaaaggtggggcgcccagaagtcacacgctgtggggcctcaagagattagggagcgcgctacagtgttacaaactgtttttgaagattacgtccactccagcgaaagacgcgtttcatgggctaaaaaggccctgcagagttttatacaagcctatgccacctatccacgggagttgaagcatatcttccatgtacggtccttacatctcggacatgtggctaaatccttcgggcttcgcgacgccccaaggaacctgagtgccctcaccaggaagaaaaggaaggcccacgtaaagaggccggacttacataagaagacacagtccaaacacagcctggcagagatcctgaggtcagaatactccagtgggatggaggcggatatcgccaaagtgaagaaacagaacgcgccaggtgagccgggcggcagacccctccagcactctctgcagcccacaccctgctttgggagaggcaaaaccctgaagtggagaaaaacacaaaagggcgtgcaaagggatagcaagacctcccagaaggtgtag

SEQ ID NO: 11634 - DNA, 2169 bp, Artificial Sequence
  Description of Artificial Sequence: Synthetic coding sequence
atgcaggcaaaggcgacaaagcggaaatatcaggcctcgagcgaggcaccccccgccaagcgccgaaatgaaacctcctttctgcctgccaaaaagaccagtgtgaaagagactcagaggactttcaaaggcaacgcccagaaaatgtttagccctaaaaaacatagtgttagtactagcgacaggaatcaagaggaacgacagtgcatcaagacctcaagcttgtttaagaataatccggacatcccagagcttcaccgcccagtcgtgaaacaggttcaggagaaggtttttacttcggccgcctttcacgagctaggtctccatccgcacttgatcagcacaatcaacactgtgctgaaaatgtctagtatgactagtgtgcagaagcagtccattcctgtactactcgagggtcgcgatgcattggttcgatcccagacgggctccggaaagaccctggcctattgtatcccagtggtgcaaagtttgcaggcgatggaaagcaagatccagagaagcgatggcccctacgcgctggtccttgtgcccactagggaacttgccctacagagttttgacactgttcagaagctgctcaaaccatttacctggattgttcctggcgtcctcatggggggggaaaagcggaagtccgaaaaagcgagactccgtaagggtatcaatatactaatctcgaccccagggcgactggtggaccacataaagagtacaaagaacatccacttttcgcgcctgcgctggcttgtcttcgacgaggcggatcgaatactggacctgggctttgaaaaggatatcactgtaattttgaacgctgttaacgccgagtgtcagaagaggcagaatgttctgctgagtgcaacactaacggaaggagtgacccgactggctgatataagcctccatgatccagtaagcatttccgtcctggataagagccacgatcagctgaatcctaaagacaaagccgtgcaggaggtgtgtccacctccagcgggtgacaaactggattccttcgccattcccgaaagtctcaagcaacacgtgacggtggtgccaagcaagctgaggcttgtgtgtctcgccgcattcatcctacagaaatgtaaattcgaagaggatcagaagatggttgtgtttttctcttcttgtgaactggtcgaatttcactactctctgtttttacaaacactgttatccagctccggggccccagcatctgggcagctgccgtccgcatctatgcgccttaagtttctgagactgcatggcgggatggagcaggaggaacggacagcagtgttccaggaattctcccactcccgccggggagtgctactgtgtacagacgtggccgcccgaggtctggatctcccgcaggtgacctggattgtgcagtacaatgccccctctagccccgctgagtacatccaccgaatcgggcgaacggcacgcatcgggtgccatggatcatctctactgattcttgccccaagcgaagctgaatatgtgaactcgctggcctctcacaagattaacgtgtctgaaattaagatggaggatatcctctgcgtgctgaccagggacgactgtttcaaaggaaaaagatggggcgcacagaaatcgcacgctgtcggcccccaggagattagggagcgcgccactgttctgcaaaccgtcttcgaggactatgtgcacagttctgagcgccgtgtgtcatgggcgaagaaggcgctgcagagtttcattcaagcctacgctacttaccccagagaactgaagcatatctttcacgtgaggtccctgcatcttggccatgtggctaagtcattcggactgagagatgccccacgcaacctaagtgccctcacgcgaaagaagagaaaggcccacgtgaagaggcccgatttgcataagaaaactcagagcaagcatagtctggcagagattctgcggtccgaatatagcagcggcatggaagcggatatcgctaaagttaaaaagcagaacgcgccaggtgagccagggggaagacccctgcagcatagtctgcaacctactccctgcttcgggcgtggtaagacccttaaatggcgaaagacgcagaagggagtacagagagatagcaaaacttcccagaaagtatag

SEQ ID NO: 11635 - DNA, 483 bp, Artificial Sequence
  Description of Artificial Sequence: Synthetic coding sequence
atgcggctcgaggccggcagtggcgctgtctggagaggtggcgagcttgctcctgccccacgcaaagtaaaggagggcatccgcggatgctttccttggaagcaggccaaggccactaagcgcaagtaccaggccagtagcgaagctccacccgctaagaggagaaatgaaacctcgttcctacccgccaaaaaaacatcagtgaaggagacccagcggacttttaagggaaacgcccaaaaaatgttctccccgaagaaacacagtgtgagcacaagtgatcgtaaccaggaagagcggcagtgcatcaagaccagttccttgtttaaaaataatcccgatataccagagctgcaccggcccgtcgttaaacaagtgcaggaaaaagtgtttacgtccgctgcatttcacgagctcggcctccaccctcacctgatcagcactattaacactgtgctgaagatgagctctatgactcgctag

SEQ ID NO: 11636 - DNA, 1284 bp, Artificial Sequence
  Description of Artificial Sequence: Synthetic coding sequence
atggctgagcaggacgtggaaaacgatttactggactacgacgaggaggaagaaccacaggctcctcaggaatcaacaccggccccacccaagaaggacattaaaggcagttacgtgagtattcacagtagcgggttcagagactttctgttgaaacctgaactcctcagggcaatcgtggactgtggatttgaacatcctagtgaagtgcagcacgaatgcataccccaggccattttgggcatggatgtactgtgtcaagccaagtctggtatggggaaaacggcagttttcgtcctcgctaccttgcagcaaatagaacccgtgaatggccaggtgaccgttctcgtcatgtgtcatacacgggaactggcctttcagatctctaaggaatacgaacggtttagtaagtatatgccctctgttaaagtcagtgtattttttggaggcctatcaattaagaaagatgaggaagtcctcaaaaagaattgtccccacgtcgtggtgggcacccctggtagaatcctggctctggtcagaaacaggagcttctcactcaaaaatgtgaagcactttgtgctggacgagtgtgacaaaatgctggaacagctcgacatgcgacgagacgtgcaggagatttttagactgactccacacgagaaacagtgcatgatgttcagcgccaccctttctaaggatattaggccggtgtgccggaagttcatgcaagatcctatggaggtgttcgttgatgacgaaacgaagctaacactccacgggttacagcagtactatgtgaagttgaaagatagtgaaaagaaccggaagctgtttgatctcctggacgtcttagaattcaaccaggtgatcatctttgtgaagagcgtacagcgctgcatggcgctggcacagctgctggtggaacagaacttcccggccattgccattcaccgcggaatggcccaggaagagagactgtcacggtaccagcagttcaaggactttcagcgtaggatcctggtggcaaccaatctattcggccgtgggatggacatcgagagggtgaatatcgtattcaactatgacatgcctgaggattcagacacatacttgcatcgtgtagcacgagccggccgatttggcaccaaagggctcgctattactttcgtgtctgatgaaaatgatgcaaaaattctgaatgatgtgcaggaccggttcgaggtgaatgttgcagagcttccggaagagatcgacatctccacatacatcgagcagagtcggtag

SEQ ID NO: 11637 - DNA, 969 bp, Artificial Sequence
  Description of Artificial Sequence: Synthetic coding sequence
atggccgagcaggatgttgagaatgatctcttggactatgacgaagaggaggagccccaagccccacaggaaagcactcctgccccaccaaagaaagacattaaagggagttatgtgagtatccacagcagcggctttcgggattttctgctgaaaccagaactgctgcgggcgatcgtggattgcggctttgaacacccttcagaggttcagcatgaatgtatcccgcaagccattctgggtatggatgtcctgtgtcaggcgaaaagtggtatggggaagacagcagtttttgtgctggcgacactgcagcagattgaacccgtcaacgggcaagtgacggtgctcgtgatgtgccataccagggaactggcattccaaatcagcaaagaatatgaacgtttttctaagtacatgccatctgtcaaagttagcgtcttttttggagggttgagcatcaaaaaggacgaggaggtcctgaaaaagaactgcccccacgtggtagtgggaacacctggtaggatcctcgcactcgttagaaaccggtctttttccttgaagaacgttaagcattttgtccttgatgagtgcgataagatgttagaacagttggatatgcgtcgagatgtccaggaaattttccgactgaccccacatgagaaacaatgtatgatgttctctgccacgctgtctaaagacatccgtccagtgtgccgcaaattcatgcaggatcccatggaagtttttgtggatgacgagaccaagctgacacttcatggccttcaacagtattacgtgaagctgaaagactcagagaaaaaccgcaaattgtttgacctgcttgatgtgttggagtttaaccaacccgtaactctctcggccgtgcaggggtttcccgccgcggatcctggtggtcatcagagcgtatggcccggcgatggccaccgcgcatctcaacatcgcctctag

SEQ ID NO: 11638 - DNA, 1413 bp, Artificial Sequence
  Description of Artificial Sequence: Synthetic coding sequence
atggcctacggggcgccctctcccacatggtctcttagcgtgcggccaaacagacctcgtggcgggttaggcccctttggtgaggtgcaggtcatactgctgcccccatcctcctgggactactcaatcatggcggagcaagacgtcgagaacgacctccttgactacgacgaagaggaagagcctcaagctccacaagagtctaccccggccccacccaaaaaggatattaagggctcatatgtctccatccactcttccggatttagggacttccttctgaagcctgaactactccgggccatcgtcgactgtgggttcgagcatccaagcgaggtacagcatgaatgtatcccacaggcgatattagggatggacgtgctttgtcaagcaaaatctggcatgggaaagaccgctgttttcgtgttggccacacttcaacagatagagccagtgaacggccaggtgacggtgcttgttatgtgtcatacccgggagctcgccttccagatctccaaggaatatgagcggttcagcaagtacatgccaagcgtgaaagtgtctgtctttttcggagggctatcgattaagaaagacgaggaagttctgaagaagaattgcccccacgtggtagtgggtacaccgggccgcattcttgctctggtgcgaaaccgctccttttctctgaaaaacgtgaagcactttgtgctcgacgagtgcgacaaaatgttagaacagctcgatatgcgtcgtgacgttcaggagatctttcggctgacaccccacgagaaacagtgcatgatgtttagcgcaaccttgtcaaaggatataaggccagtttgcagaaaatttatgcaggatccaatggaagtgtttgtggacgacgagaccaagctgactctgcacggactgcagcaatattacgtgaaacttaaagactctgagaagaacagaaaactcttcgatctcctggacgttctcgagtttaatcaggtgatcatcttcgtcaaaagtgtgcagcgctgcatggctctggcgcagttgctggtagaacagaatttcccagcgatcgcaatccaccgtggtatggctcaggaagaaaggttgtcacggtaccagcagttcaaggacttccaaaggaggatattagtagccaccaacctgtttgggagggggatggacatcgagagagtgaacattgttttcaattatgacatgccagaagactcagacacatacctgcaccgagtagcaagagctgggcggttcgggaccaagggtctggctattacctttgtttccgacgagaacgacgctaagattctgaacgacgtgcaggatagattcgaagtcaacgtggcagagctgcccgaagagatcgatatttctacatacatcgagcaatccagatag

SEQ ID NO: 11639 - DNA, 804 bp, Artificial Sequence
  Description of Artificial Sequence: Synthetic coding sequence
atggccgaacaagacgtggagaatgaccttctcgactacgacgaggaagaggaaccccaggctccccaagagtccacgccagcacccccaaagaaagatatcaaggggagttatgtctcaatccactcatctggcttcagagatttcctgttgaaacctgagctgctaagggctattgtagactgtggctttgaacacccatcagaggtgcagcacgagtgcattccacaggctatcctcggaatggatgtgttgtgtcaggccaaaagtgggatgggcaaaaccgccgttttcgtgcttgctacattgcagcagattgagcccgtcaacggccaggtaactgtcctggtgatgtgccatacccgagagctagccttccaaatcagcaaagaatacgagagattctcaaagtacatgccatccgtgaaggtctccgtcttcttcggtggactgagtatcaagaaagatgaagaggtgctgaaaaagaattgccctcacgtcgtcgtgggaactcctggaaggattctcgctttggttagaaacaggtcttttagtctcaagaacgtcaaacatttcgttctggatgaatgcgacaagatgctggagcaactcgacatgcggcgcgacgtccaagaaatattccgcttgacaccacacgaaaagcaatgtatgatgttctccgccaccctgtctaaggacatcagaccagtttgccgtaagttcatgcaagacgtgctctgggaggtgtctcacaaaggggtcgctcattggaaagtgctgggcagaagggatgcgcaacgatag

SEQ ID NO: 11640 - DNA, 3096 bp, Artificial Sequence
  Description of Artificial Sequence: Synthetic coding sequence
atgggaagggaatccagacattaccggaagcgcagcgccagtagaggtcgcagcgggagcagatctagatccagatccccaagtgacaaacggagcaaacgcggcgatgatcgtcgttccaggagtagagaccgcgacaggaggcgcgaaaggtcccgtagccgtgataagcgccgtagtaggagccgcgataggaagcggctgcgtcggtcacgttcacgggaaagggatcgcagccgagagcggagaagaagccgctcccgagataggcgtcgctcgcggtcgcgctcccgcggtcggagatccaggtcatcttccccaggtaataagtccaagaagaccgagaaccgcagccgctctaaagagaagaccgacggcggcgaatctagcaaagagaaaaagaaagataaggacgataaggaagacgagaaggagaaggacgccgggaacttcgatcagaacaaactcgaggaagagatgcgtaaaaggaaagagagggtcgaaaagtggcgagaggaacagcgaaaaaaagccatggaaaacattggggagcttaagaaggaaatcgaagaaatgaagcagggtaaaaagtggtcattagaggatgacgacgacgatgaggatgatcccgccgaagctgagaaagagggaaacgagatggagggagaagagctggaccctttagatgcttatatggaagaggttaaggaagaagtgaagaagtttaacatgcggtcagtcaagggcgggggtggcaatgagaagaagagtgggccaacggtcactaaagtagttacagtggtcactacaaaaaaggccgttgtggatagcgataagaagaagggcgaactcatggagaatgaccaggacgccatggagtacagctcggaggaggaggaggtggacctccaaactgcattgactggctatcaaacaaagcagaggaagcttctagagcctgtagatcacgggaaaatagagtacgagcctttccgaaaaaacttctatgtcgaagtccctgaacttgctaagatgtcccaagaagaagtaaacgtttttagactcgagatggagggcatcactgtaaagggcaaagggtgccccaaaccaataaagagctgggtgcagtgtggaattagcatgaaaatccttaatagcctcaagaaacacggttatgagaagcctacacctatccagactcaagcaatcccggctatcatgtcgggccgggacctgataggtatagctaaaactgggtcaggtaaaaccatcgcattcctgctgcccatgtttaggcatattatggaccagagatctctggaggagggagagggtcccatagcagttatcatgactccaacccgtgagctcgccttacaaattaccaaagagtgcaagaagttttccaagacactgggccttagagtcgtttgtgtgtatggcggcactgggatctcagagcagatcgcagagctcaaaaggggagctgagatcatcgtgtgcaccccaggcaggatgattgatatgttagctgctaattccggtcgggtcaccaacttgcggagagtgacatacgtggtgctcgatgaggctgatcgaatgttcgatatgggattcgaaccacaagtcatgcgaatcgtggacaatgtgcgccccgacaggcagactgtcatgttttctgcgacattcccgcgggcgatggaggccctcgcccggcgcatcctgtccaaacctattgaggtccaggtagggggaagaagcgtggtgtgttcggacgtagagcaacaagtgatcgtgatcgaagaagagaaaaaattcctgaagctgttggagctgttaggccattatcaggaaagtggcagcgttatcatcttcgtcgataaacaggaacatgccgatggtctgctgaaggacctgatgcgagcctcatatccctgtatgtccctccatggtgggattgaccagtatgaccgggactcaatcatcaatgattttaagaatggcacctgcaagctgttagtcgccacctccgtggccgctcggggacttgacgttaaacacctgatcttagtggtgaattatagttgcccaaaccactacgaggactatgtgcaccgagctggaaggaccggtcgcgccggtaataagggatacgcctacactttcattactgaagatcaggccagatatgccggggacattataaaggccctcgagctgagcggtaccgcagtgcctccagacctggagaagctatggtccgactttaaagatcagcaaaaagccgagggcaaaatcatcaagaagagcagtggattctccgggaaaggcttcaagttcgatgagacagagcaggcactggccaatgagagaaagaagctccagaaagctgctctggggctccaggactccgatgatgaggacgccgctgtcgatattgatgagcaaattgaatctatgttcaattcaaagaagcgcgttaaggacatggcagcccccggcacgtcctccgtacccgcacccactgccggcaatgcagagaagctggagattgccaagcgcctggccctccgtatcaatgcccagaaaaatctcgggatagaatcacaggacgttatgcagcaggcaaccaacgctatcctcaggggagggactatccttgcgcccactgtatcagcgaagacaatagcggagcagttagccgagaagatcaacgcaaagttaaactatgtcccacttgaaaagcaggaggaggaaaggcaggacggaggccagaatgagtcatttaaaaggtatgaagaggaactcgagattaatgattttccccagaccgcacggtggaaagtaacaagtaaggaagcactccaacgcatatctgagtacagcgaggcggccatcactatcagaggaacgtatttccctccgggcaaggagcccaaggaaggggagaggaaaatctatttagccatagagagtgctaacgaactggccgtgcagaaggcaaaggcggaaataactagacttataaaggaggaactgatccggttgcaaaatagctatcagcctacaaacaagggaagatataaggttctgtag

SEQ ID NO: 11641 - DNA, 3099 bp, Artificial Sequence
  Description of Artificial Sequence: Synthetic coding sequence
atggggcgggaatcgcgccactaccggaagagaagcgcttcacggggtcgctccggcagtaggtcccgctcccgctccccctccgataagcgatccaagaggggagatgatagacggtcccgaagcagagaccgggatcgccggagggaacggtctaggtcaagggataagagacgctccaggagtagggatcggaaaagactccggagatccagaagtagagaaagagatcgctcaagggagaggcgaaggtcccggtcccgggatcgtagaaggagtaggtcacgttcacgcggcaggcgctccaggagctcttctcctggaaacaagagtaagaagaccgaaaacagatcaaggagcaaagagaaaactgacggcggagagtcctctaaagaaaaaaaaaaggacaaggacgacaaagaggacgaaaaagagaaagacgcaggaaatttcgaccaaaataagctggaggaggagatgcgaaagagaaaagaacgggtggaaaagtggagagaggagcagcgtaagaaggccatggagaacattggagagctgaagaaggagattgaggaaatgaaacagggtaagaaatggtctttggaggacgacgatgatgatgaggacgatcccgccgaggccgaaaaagagggtaacgaaatggagggggaggaacttgatcctctggacgcttatatggaggaggtaaaagaggaagtcaaaaagttcaacatgagaagtgtgaaaggcggcggcggaaacgagaagaagtctggcccaacagtgactaaagtcgtgacggtggttactactaagaaggctgtggtggactcggataagaaaaaaggcgagcttatggagaatgaccaagatgccatggagtactcttccgaagaggaagaagtggacctgcaaaccgcactaaccggttatcagactaaacagagaaaacttctggaaccagtggatcatgggaagattgagtatgagcccttcaggaagaatttctatgtggaggtgcctgaactagcgaaaatgagccaggaagaagttaacgtgtttcgcttggagatggagggaatcaccgtaaagggaaagggctgtcctaagcctatcaagagttgggtgcaatgtgggatctctatgaaaatcctaaactccttgaagaagcatggctacgaaaagccaacaccaatccaaacgcaggccattccggctataatgtctggccgagacctgatagggatcgccaagaccggttctgggaagaccatcgccttcctgctgcctatgtttcggcatatcatggatcagcggtccctagaagaaggggagggaccaatcgccgtgattatgaccccgaccagggagctggcactgcagattaccaaagagtgcaagaaatttagtaagaccctcggccttcgtgtggtttgcgtctatggcggcactggaattagtgagcagatcgctgaacttaaacgtggagcagagatcatcgtttgcaccccagggagaatgattgacatgctcgccgctaatagcggccgtgtaacaaacctaaggagggttacttatgtggttttggatgaggctgatcggatgttcgatatgggctttgagcctcaggttatgcggattgtcgacaatgtcagacccgaccgccagacggtgatgttttctgcaactttcccaagggcaatggaggcgcttgcacggagaatactttcgaagcccattgaagttcaggtgggaggccgaagtgtcgtctgtagtgatgtcgagcagcaagtgatcgtgattgaagaagaaaaaaagttcttgaagttactggagctactgggccactaccaggagtcgggctccgtcatcattttcgtggataagcaggagcacgcagatggactcctgaaggatctgatgcgcgcttcttacccgtgtatgagcctccacggaggtatcgaccaatacgatcgcgatagcataatcaacgattttaaaaatggcacttgcaagctgttagtggccacctctgtagccgcaagaggattggacgttaagcatctaattttggttgtaaactactcttgtcccaatcattatgaggattacgtccaccgcgcgggccgaaccggcagagctggtaacaaaggatatgcttatacatttatcacagaggatcaggctcgttatgctggtgacatcatcaaagccctggagctcagcgggactgccgtccccccggatctggaaaaattgtggagtgacttcaaggaccagcagaaggccgaaggtaaaataattaagaagtcttcaggcttctctggtaagggtttcaagttcgacgagactgaacaagccctggcaaacgagcgcaaaaaacttcagaaggccgccctaggattacaggacagcgacgacgaggacgcagccgttgacatagatgagcaaatcgagagtatgtttaacagtaagaagcgcgtgaaggatatggccgctccaggcacaagctccgtaccagcgcccactgctggaaatgcggagaaactggagattgctaaaaggcttgcgctgaggatcaacgctcagaagaatctggggattgaatcacaggtcgacgtcatgcaacaggccacaaatgctatcctcaggggcggtaccatcctcgcccctacggtgtctgccaagacaattgccgaacagctcgccgaaaagataaacgctaagctgaattatgtccccctggagaaacaggaagaggagcgccaggatggcgggcagaatgagagcttcaagcgctatgaggaagaactggaaatcaatgatttcccgcagaccgcgaggtggaaggtgacctcgaaggaggcacttcaacggattagcgaatattccgaagcagccataacaattagaggaacttactttcccccaggaaaggagcctaaggaaggtgaacggaagatctatctggcgattgagtccgctaatgagcttgctgtgcaaaaggccaaagctgagatcacccggctaatcaaagaggagctgatccgcttgcagaactcttaccagcctacaaataaaggccggtataaggtcctttag

SEQ ID NO: 11642 - DNA, 780 bp, Artificial Sequence
  Description of Artificial Sequence: Synthetic coding sequence
atgggacgcgagtcgagacattacaggaagcggtctgctagtagaggacgcagcgggagtcggtcgagaagccggtcaccaagcgataaaagatccaagcggggggacgacaggaggagccgctccagggatagagatcggcgacgggaaagaagtaggagtagggataaacgtcggtctcgatctcgcgatcgcaagaggttaagaagatccagatctagggaaagggatcggtctcgcgagagaaggaggtcacgtagccgtgaccgccgccggtctcgctctcgttcccgtggacgtagaagtagatcttccagtcccggtaacaagagcaaaaagacggagaacaggagcaggtccaaggaaaagacagacgggggcgagagtagcaaagaaaagaaaaaagacaaggatgataaggaggacgagaaagaaaaggatgcgggaaatttcgatcagaacaaattggaagaggaaatgagaaagcgcaaggagcgggttgaaaagtggcgcgaggaacagagaaaaaaggctatggaaaacattggagagcttaagaaggagatcgaagaaatgaaacagggtaagaagtggagtcttgaggatgacgacgatgacgaagacgaccccgctgaagccgagaaggaaggtaatgagatggaaggcgaagaacttgatcccctggatgcatatatggaggaggtcaaagaggaggtaaagaagttcaatatgcggagcgttaaagcggtctccaagaaaaagaagaaaaagaagaagtag

SEQ ID NO: 11643 - DNA, 1221 bp, Artificial Sequence
  Description of Artificial Sequence: Synthetic coding sequence
atggccgcgcccgaagaacacgacagccccacagaggcttcgcagcctatcgtggaggaagaggaaacaaagacctttaaggatcttggagtcaccgacgtattatgtgaggcctgtgatcagctcgggtggacaaaacctacaaaaattcagatcgaggcaatccccctggccctgcagggacgagacattatcggactcgccgagactgggagcggtaaaacaggcgcttttgccttacccatattaaatgccttattagagaccccacaaagattgtttgccctggtgctgacccccaccagagaactagcttttcaaatatcggaacagtttgaggctttaggaagtagcatcggtgtccagtccgccgtaatagtagggggaatcgattctatgagtcaatctttggcgctggccaagaaacctcacataatcatcgccacccctgggaggcttatcgatcatctggagaacacaaagggatttaacttaagggcactgaagtatcttgtcatggacgaggccgaccgcatattaaacatggactttgagacagaggttgataagatcctcaaggttatcccccgtgatcggaaaacgttcctattctcagcgacaatgactaaaaaagttcagaagctgcagcgggctgctctgaagaaccccgttaagtgtgccgtgtcaagcaagtaccagacggttgaaaagcttcagcagtactacatcttcatcccctctaagttcaaatctaagagactgggcagtctgaacaaattcaaggccaaggcacgctctattctgctggccacagacgtcgcatccaggggcctggacatcccccatgtcgacgtggttgttaattttgacatacccactcactcaaaggactacatccatagggtcgggaggactgctcgtgccgggcggagtggaaaggcaattacattcgtgactcagtatgacgtcgagctctttcagcgaatcgaacatctgataggcaaaaaattacctggctttcccacgcaagacgacgaagtgatgatgctgacggaacgcgtggctgaagcgcagcggtttgctcgcatggagcttagggagcatggtgaaaagaagaagcgctcacgagaagacgcaggagataatgacgacacagagggagccattggtgtgagaaacaaggtggccggggggaaaatgaagaagaggaaagggcgatag

SEQ ID NO: 11644 - DNA, 1368 bp, Artificial Sequence
  Description of Artificial Sequence: Synthetic coding sequence
atggcagcccccgaggagcatgactctccaactgaagcctcccagcctattgtcgaagaggaggagaccaaaactttcaaagacctcggcgtgacagatgtgttgtgcgaggcttgcgaccagctgggttggacgaagcccacgaagatccaaatcgaagctatcccgctggccctgcagggcagggacattatcggacttgcagagactggcagtgggaaaaccggcgcctttgcccttccgatcttaaacgcattgctcgagacccctcagagattattcgctctcgtgttaacccctacgcgtgaattggcttttcaaatatccgagcagtttgaggcgcttgggagttccataggagtgcagtcagcggtcattgttggcgggatcgactctatgagccagtccctggctctggccaagaaacctcacattataatcgcgacacccggaagactgattgatcaccttgagaatacaaagggattcaacctgagggcgctgaagtacctggttatggacgaggccgatcgcatcctcaacatggactttgagaccgaagtggacaagatcctcaaggttatccctagagaccgcaagacctttctttttagcgctacaatgacgaaaaaagttcaaaagctgcagcgggctgcactgaaaaatccggtgaaatgtgcggtgagcagtaagtatcaaacggtggaaaagcttcagcagtactacattttcattcccagcaagttcaaggacacttatctcgtgtatatcttgaacgagcttgccgggaactcttttatgattttctgttcaacgtgcaataatactcagagaacagcgctgttgcttagaaatctgggtttcacagctatccctctccatgggcagatgtctcaaagtaagcggctgggttcactgaataaatttaaagccaaggccagaagtatcctgctggcaacagacgtagcttcccgcgggctagatatcccacatgtggatgttgtggtcaatttcgacatcccaactcatagcaaagattatatacaccgtgtcggccggacagcccgggctggccgaagtggaaaggcgattactttcgttacgcaatatgacgtcgaactcttccaaaggatcgagcacctgatcggaaaaaaactgcccggattccccacccaggatgatgaagtgatgatgcttactgaaagagtcgctgaagctcagaggtttgctagaatggagctgcgggaacacggggaaaaaaaaaagagaagtcgcgaggacgcaggggacaatgatgacacggagggggcaattggcgtgagaaacaaagtggccggcggcaagatgaaaaaaaggaagggaagatag

SEQ ID NO: 11645 - DNA, 2214 bp, Artificial Sequence
  Description of Artificial Sequence: Synthetic coding sequence
atgcccgggaaactactctggggagatatcatggagctggaggccccactggaggaaagcgaatctcagaagaaggaacgacagaagagcgaccggaggaaatctcggcaccattacgatagcgacgaaaaatccgagactcgggagaatggggtcacagatgatctggacgctccgaaagctaaaaagagtaagatgaaagagaaactcaatggagatacggaagaaggttttaacagactgagcgacgagttctccaaatctcataaaagtagaagaaaagatctgcctaacggagatattgatgagtatgaaaaaaagagcaagagggtatcttcattggacacaagcacccacaaatcttccgataataaactggaagaaacgctgacccgtgaacagaaagaaggggctttcagcaactttccaataagtgaggaaacgattaaactgctgaaaggcaggggcgtgacttatctgtttccaatacaagtcaagacctttggaccagtgtacgagggtaaggacctgattgcccaggctagaaccggcaccggaaagactttcagcttcgccattcccctcatcgagagattgcagcggaaccaggagacaatcaaaaagagcaggagccctaaggtgctggtccttgctccaacacgagagctcgcaaatcaagttgcgaaagatttcaaggatattacccggaagctgagcgtggcctgtttttacggagggactagttaccaatcacagatcaaccacatcagaaacggtattgatattctcgtgggcacacccggtaggattaaggatcatctccaaagcgggagactagacctgtccaagcttcgccacgtggtcctggacgaggtggatcagatgttggacctgggcttcgcggagcaggtggaggacattatacatgagtcttataagactgatagcgaggacaacccacaaactctccttttttccgctacttgccctcaatgggtatataaggtggcaaagaagtatatgaaaagtcgctacgaacaggttgacctggttggtaagatgacccagaaagctgccaccacggtagaacatctcgctatccagtgtcactggtctcagagacctgcagtgatcggtgacgtgttgcaagtgtactccggcagtgagggaagggctattatattttgtgagactaagaagaatgtaacagaaatggctatgaatccccatatcaaacagaatgcccaatgtttgcatggagacattgctcagtcccagcgcgagattacccttaagggattccgcgagggaagttttaaagttctggtggcgaccaatgttgccgctcgcggacttgacattccagaggtggatctcgtgattcagtcctctccgccccaggatgtggaatcttacatccaccggagcggccggaccggtagggccggcagaaccggaatttgcatttgtttttaccaacctcgcgagagagggcagctgaggtatgttgagcagaaggcggggattacctttaagagagtgggggtccccagcactatggatctggtgaagtccaagtcaatggacgccattaggagtctcgcttcagtcagctacgcagcagtggacttctttcgaccttctgctcaaagactaatcgaggaaaagggggcggttgatgcgctcgctgcggccctggctcatatttccggcgcgagttcctttgaacccaggagtctgatcacaagtgacaaggggttcgtcaccatgaccctggaatcccttgaggagatccaggatgtgagttgcgcctggaaggaactgaaccgcaagctctcatcaaatgctgtgtcacagattacgaggatgtgcctccttaaaggtaacatgggagtgtgttttgatgtgcccacaaccgaatccgaaaggctgcaggccgaatggcacgactcagattggatactgtccgtgcccgccaaattgcccgaaattgaagagtattacgatgggaataccagcagtaactctcggcagagatccggatggagttccggcaggtcaggccgatccgggcgctcagggggacgatctggtggacgcagcgggagacagagtcgacagggcagcagatcgggttctcgacaggatggtaggcggcgctccgggaatcggaatagaagtcgttcaggaggccataagagatcttttgactag

SEQ ID NO: 11646 - DNA, 2136 bp, Artificial Sequence
  Description of Artificial Sequence: Synthetic coding sequence
atgccaggcaagctcctttggggcgacatcatggaactggaggctcctctggaggaaagtgagagtcaaaagaaggagcgccagaaaagcgaccggagaaagtctcgtcatcactacgactccgatgagaaatcggaaacacgggagaacggcgtgaccgatgatttagacgcccccaaagccaaaaagagtaaaatgaaggaaaaactgaacggcgacactgaggaaggctttaaccgcctctctgatgagtttagcaagtcacataaatcccgccgaaaagacctgcccaacggggatatagatgagtatgagaagaaatccaaacgcgtctcctccttggacactagcacccacaagagctctgacaacaagctggaggagaccctgactagggagcaaaaggagggggctttctccaatttccctatctctgaagaaaccatcaagctgctaaaagggagaggagttacttacctcttcccaatccaagtgaagaccttcggacctgtctatgagggtaaggacttgatcgcgcaggccaggacaggtaccggcaaaacattctccttcgctattccactgatcgagagactgcagcggaatcaagagactataaagaagtctaggagtccaaaggtcctggtgttggctcccacgcgagaacttgctaatcaagtggccaaagacttcaaggacatcacccgtaagttgtctgtagcatgtttctacgggggcacatcttaccagagccagattaaccatattcggaatggtatagatatcttagttggaacacccggccgcatcaaagatcacctgcagagtggcaggctggatttaagtaaactgaggcacgtggtactggatgaggtggatcagatgctcgacctgggattcgcagagcaagtcgaagacattatccacgaatcctacaagacagattccgaagataatccacagaccctgcttttctccgccacatgcccgcagtgggtttacaaggtggccaaaaaatatatgaaaagccggtacgagcaggtcgacctggttggcaagatgacacagaaggctgccactacagtcgagcatctggccattcaatgccattggtcccaaaggcctgctgtgattggagacgttctacaggtttacagcggttccgaggggagggccatcattttttgcgaaacaaagaaaaacgttacagagatggccatgaatccacacattaaacagaacgcccagtgcctgcacggagacattgcccagagccaacgcgagatcacgctaaaagggtttcgtgaaggttctttcaaggtccttgttgcaaccaacgtggctgctagaggtctggatatccccgaagtggatcttgttatccagagcagccctccccaggacgtggaaagttatattcatcggagcggccggaccgggagagccggccgaacaggcatttgtatttgcttttatcagccgagggagagagggcagctgcggtacgtggaacagaaagcaggcattacctttaaacgggtcggcgtgccttcaaccatggatttagtgaaaagcaaatctatggatgccattagaagcctcgctagcgtgagttacgctgctgtcgatttcttccgccccagcgcgcagagattgatagaagaaaaaggggctgtggacgcgcttgccgccgcccttgcccatatctccggcgcatcatcttttgagccgcgctctctgatcaccagtgacaaggggttcgtcactatgacccttgagtccctggaagaaatccaagacgtgagttgcgcctggaaggagctgaatcgtaagctgtcttcaaacgctgtcagtcagattacacgcatgtgtctcctgaaaggcaacatgggcgtctgtttcgatgtgccaacaacagaatcagagcggctgcaagccgagtggcacgacagcgattggatcctgtcggtcccagcaaagcttccggaaatagaagagtactatgatgggaataccagctcaaattctaggcagagtcggcagggctcccgctcgggatcccggcaagacggccggagaagaagcggcaataggaatagatctagaagcggggggcacaaaagaagttttgactag

SEQ ID NO: 11647 - DNA, 2001 bp, Artificial Sequence
  Description of Artificial Sequence: Synthetic coding sequence
atggctctgttctatgtggcaagatatcctggacctgacgctgcggctgcggccgggcctgagggtgctgaggcaggggctcacggacgcgctagggcccttttagaaagactgcaatccagagcccgggaacggcaacagcagcgtgaaccagcacagactgaggcagctgcaagcaccgagcctgcaactcgccgtaggcgtagaccgaggaggcgccgccgggttaatgacgccgagcccggttcacccgaggctccgcaaggaaagaggagaaaagccgacggtgaagacgcaggagccgagagcaacgaggaagcaccaggggaaccaagcgccggcagctccgaggaggctcccggagaacccagcgccggaagctcagaagaggcgcccggggaacgttcaacatccgctagcgcagaagccgcacccgatggccctgctctggaagaagccgctggcccactggtgcctggccttgtcctcggtggatttggcaaaagaaaggcaccgaaggtgcaaccgtttctgccaaggtggctggcagagcccaactgtgttcgacgcaacgtgactgaggacctggtgcctatcgaagacattcccgacgttcatcccgaccttcagaagcagctcagagcccacgggatctctagctactttccagtacaggcagccgtgattcccgccctcctagagagtgcagcgtgtggctttctggtaggcagaggtggatatcgtccaagtgacctgtgtgtgagtgccccgactggttccggcaagacccttgcatttgttattcccgtggtccaggcacttctgagtagggttgtgtgtcatattcgtgccctcgttgtgctccctactaaggaactggcacagcaggtctcaaaggttttcaacatatatacagacgcaacccccttgcgcgtgagtctggtgacagggcagaagagcctggctaaagagcaagagtctctcgtccagaaaaccgcagacgggtatcgttgtttggccgacatcgtagtcgctactccaggtagactggtggatcatatcgatcagactcccggctttagtcttcagcagttgagatttctaataattgatgaggcagatagaatgattgatagcatgcatcagagctggctcccgcgcgtcgtggctgctgcttttcaatctgaagatccggcagatccttgtgccttactgcagcgaaggcaggcccaggctgtcaccgccgcctctacctgctgtccgcaaatgccacttcagaaactgctgttctcggccacattgactcagaatccagagaaactccaacaactgggactgcaccagccccgtctattctctacgggactggctcataggggcctggaggacactgatggggatggcgacagtggtaagtatgcgttccctgttggactcacacatcattacgttccatgttccttgagctctaaacccctcgtcgtgctgcaccttgtcctggaaatgggcttcagtagagtgttatgctttactaattcgagggaaaacagtcatagacttttccttctagttcaagctttcggaggcgtggatgtagctgagttttcctctcgttatgggcctggacagcgtcgcatgattttgaaacagttcgaacaaggtaaaatacagctcctgattagtaccgatgctaccgccaggggcattgacgtccagggagtggaacttgtcgttaattacgatgctccacagtacttgaggacatacgttcatagagtcggacgaacggcgcgcgccggaaagaccggccaggctttcactcttctgttgaaagtgcaggagcgacgttttctgcggatgctgaccgaggctggcgctcctgaactccagcgccacgagctgtccagtaaactgctacagcccttagtcccaagatatgaagaggccctctcacagctcgaggaatctgtcaaggaagagaggaaacaacgagcagcctag

SEQ ID NO: 11648 - DNA, 1896 bp, Artificial Sequence
  Description of Artificial Sequence: Synthetic coding sequence
atgtcacattgggcgcccgaatggaagagagcagaggcgaatcctagggacctgggggcctcttgggacgttagaggaagccgtggctctggctggagtggcccctttggccatcagggcccacgcgcggctgggagccgcgagccaccactgtgtttcaagatcaagaacaacatggtcggagtcgtgataggctactcaggcagcaaaatcaaagatctccagcatagtaccaacaccaagatccaaatcataaacggcgagtcagaagctaaagtgcggattttcggcaatagagaaatgaaagcaaaggctaaggccgccattgagaccctcattcgaaagcaagagtcatataatagcgagagttctgttgataatgcagcctctcagacgcctattgggcggaacctgggccgcaacgatattgttggagaagctgagcccctctctaactgggatcgaattagagctgccgtggttgaatgcgagaagcgcaagtgggctgacctgccacctgtgaaaaagaatttttacatcgaaagcaaagctacaagctgcatgagtgagatgcaagtgataaactggagaaaggaaaatttcaacattacctgcgatgacctcaagtctggggaaaagcggctgatacctaaacccacttgtcggttcaaagacgcatttcagcagtatcccgacctgctgaagtccatcatcagggtggggatcgtgaagcccactcctattcagagccaggcctggcccattattttgcaggggattgatttaattgttgtggcccaaaccgggactggtaagaccctgtcgtatttgatgcctggctttatacaccttgacagccagcctatttcgagagagcaaagaaacggccctgggatgttggtacttacgcccaccagggaactggctttgcacgtcgaagcagaatgctctaagtactcttataaaggcctgaagtctatctgtatctatggcggcaggaaccggaatggacagattgaagacatttctaagggagtagatatcattattgcaacccccggcaggttgaacgatttgcagatgaataactctgtgaacttgcgcagtataacttaccttgtgatagatgaggccgacaaaatgcttgatatggaatttgagcctcagattcggaaaatccttctggatgtgcgcccagatcgacagactgtaatgacttctgccacctggccagacactgtccgacagcttgcgctgagctacctcaaggacccaatgatagtgtacgttggcaacctcaacctcgtagccgtaaacaccgtgaaacagaacattatcgtgaccaccgaaaaggaaaaacgagccctgacacaggaatttgtggagaacatgagccccaatgacaaggtgatcatgtttgtcagccagaaacatattgccgatgacttgagctcagactttaacatccagggtatctccgctgagtccctccatggtaacagcgaacagtccgaccaagagagagctgtggaagattttaagtctggcaatataaagatcctcataacgaccgatatcgtttcccgtggactggatctgaatgacgtcacacatgtctacaactacgattttccccgtaatatagacgtgtacgtccaccgagtcggctacattggtagaacagggaaaacaggaacatctgtgacacttatcactcagagggattccaagatggcaggcgaactgatcaagattctcgatagggcaaatcagagcgtgcctgaagacctcgtggtgatggctgagcagtataagctcaatcaacaaaagcgccatcgggagacaagatcacggaagcctggccaacggagaaaagagttttactttctgagctag

SEQ ID NO: 11649 - DNA, 1644 bp, Artificial Sequence
  Description of Artificial Sequence: Synthetic coding sequence
atggaagactcagaggccctgggattcgagcacatgggactcgacccaagactcctgcaggccgtaaccgacctgggatggtcaagacctacgctcatccaggagaaggccattcccctggcactcgaaggcaaggacctgcttgctcgcgctcggactgggtcgggcaaaaccgcggcgtacgctatccctatgctgcaactgctgttgcataggaaagccactggccctgtggtggagcaggctgtgcgaggcttggtgctggtgccgacaaaggagctcgctcgccaagcgcagtccatgatccaacagctggcaacatactgcgctcgtgacgtgcgtgtggcgaatgttagcgccgcggaggacagcgtcagccagagggcggttctaatggaaaaacccgacgtagttgtcggaacaccctcccgcattctgtctcatctccaacaagacagtctgaagctcagagattcactcgaactcctggtcgtggatgaagcagatttgctctttagtttcggcttcgaggaagagctcaaatcgctgttgtgccacctgcctagaatttatcaggccttcttaatgtctgctactttcaacgaggacgtgcaagcactgaaagaacttatcctacataatccagtgaccctgaaactacaggagtcccaacttccaggccctgatcagttgcagcagtttcaggttgtttgcgaaacagaggaggataagttcctgctgctctacgccctattgaaattgtctctaatacgcggtaagtcgctgttattcgtgaacacccttgaacgctcatatagattgagattgtttctagaacagttcagtatcccgacttgcgttctcaatggcgagcttccactgaggtcccggtgccatatcattagtcagttcaatcaagggttttacgattgtgtaattgccacagacgccgaagtcctgggagctcctgtgaaaggcaaaaggcgcgggcggggacctaagggggataaagcctccgaccccgaggccggagtcgctcggggtatcgactttcatcacgtgtcagccgtgttgaattttgatctacccccaactccggaggcttatatccaccgggctggacggaccgcacgcgccaacaatccaggcattgtacttaccttcgtactacccactgaacagttccacctcgggaagatcgaggaactcctgagcggggagaatagaggccctatcctgctcccatatcagttccggatggaggaaatcgagggatttagatatcggtgtcgcgatgcaatgaggagtgttacaaaacaggctattcgggaggcccgactgaaagaaatcaaagaagagctacttcattccgaaaagttgaaaacttatttcgaggacaacccccgcgatctgcagttgctgaggcacgatctaccactccatcccgccgtggtgaagccccacttgggccacgtgcccgactacttggtcccccccgctctccgggggctggtccgaccccataagaagaggaagaaactaagctcttcatgccgcaaagccaagagggccaagtcacaaaacccactccgcagtttcaagcataaggggaaaaaatttaggccaaccgccaagccttcatag

SEQ ID NO: 11650 - DNA, 2112 bp, Artificial Sequence
  Description of Artificial Sequence: Synthetic coding sequence
atggcagctcccgtaggtcccgtcaaattttggagacccgggaccgaagggccaggcgtgtccatctccgaggaaagacaatctctcgccgaaaatagcggcacaaccgttgtttataatccttacgcagccctgtcaatcgagcagcagcgccagaagctcccagtctttaagctaaggaatcacattctgtacctcatcgagaattatcaaaccgttgttattgtcggggaaaccggatgcgggaaaagtacccagataccacagtatctggcggaggcagggtggacagcagaaggacgggtcgtcggtgtgacacagcctcgcagagtggccgctgttactgttgccggtagggtggccgaggagaggggggccgtattgggccatgaggtcggttactgcattagattcgacgactgcacggatcagctcgccaccagaatcaaattccttaccgacggaatgttagtcagagagatgatggtcgaccctctactcacaaaatactcagtgataatgctcgatgaagcccacgagcgcacattatatacggacattgccattggtctgctgaaaaaaatacagaagaagaggggggatctgaggctgattgtcgcatctgcaactcttgacgccgacaaattcagggattttttcaaccagaacgaaacttctgatcccgcccgcgatacctgcgtgatcttaacggttgagggcagaacctttcctgtggacatcttctatcttcagtcccccgttcccgattatattaaaagtacagtcgagacagtcgtgaaaatccaccagaccgagggtgacggagacgtgctcgccttcctgactggacaagaggaggtggaaaccgtcgtaagcatgttgatcgagcaggcccgcgcgttggccaggacggggatgaagcgacatctgagagtactgccgatgtatgctgggttaccgagttttgaacaaatgaaggtgttcgagcgggtgtcccgttccgtgaggaaggtcatagtcgcaactaacgtggcagaaacaagtataacgatcagcggaatcgtgtacgtgattgattgtggtttcgtcaaattgcgagcttataatccgaggaccgcaatagaatgcttagttgtggtgccagtgtcccaagcgtcggcaaatcagcgagcgggcagaggcgggcggtctcgcagcggcaaatgctatcgactgtatacagaggaagccttcgataaattgccccagtctacagttccggaaatgcagcgctctaatctagcgcccgtgattctgcaattgaaggccctgggcatcgacaacgttttgcggttccactttatgtcaccacctcccgcccagagtatggttcaagctttagaactgttgtacgcactcgggggcctggacaaggactgccgcctgaccgaacctctgggcatgcggattgctgaatttccccttaatcctatgtttgcaaagatgctgctggagagtggaaacttcggctgtagtcaggagatactgagtattgcggccatgatgcagatccagaatatctttgtcgtgcctccaaaccaaaaatcgcacgcaatccgggtccatcggaagttcgctgtggaggagggcgaccacttgacaatgctcaatatttatgaggcttttattaagcataacaaggattctaagtggtgtcaagagcattttctaaactataaagggttggtgagggcggccactgttagagaacagcttaaaaaactcctggttaaatttcaagtaccccgaaagtcgagcgaaggagaccctgacctcgtactgaggtgcattgtcagcgggttctttgccaacgcagccaggtttcattccacgggggcctaccgaacaattagagacgaccatgagctgcatatccaccccgcgagcgtactatacgctgaaaagccacctcgctgggtcatctataatgaagtcatccagacatcaaagtactacatgagggatgtgacagccatcgagagtgcctggctcctcgaactggccccacacttttaccagcagggaactcaccttagcttaaaggctaagagagcaaaggttcaggatccgtag

SEQ ID NO: 11651 - DNA, 552 bp, Artificial Sequence
  Description of Artificial Sequence: Synthetic coding sequence
atgctactggagtccggaaactttgggtgcagccaggagattttatctatcgccgctatgatgcagatccagaatatctttgtggtgcccccaaaccagaagtctcacgcccataataaggactcaaagtggtgtcaagaacacttcttaaactacaagggcctagtccgcgcggcaactgtgagggagcagctgaaaaaactgctggtgaagtttcaggtgcctcgaaagtcatctgaaggagatccagacctggtactcagatgtatagtctccggctttttcgcaaatgccgcccgctttcactctacaggtgcatatagaacaattagagatgatcacgaacttcacattcaccctgcctccgttctgtatgccgaaaagccaccgcgctgggtaatttacaatgaggtaatccagacgtcaaaatattacatgagagacgtcacagccatagagagcgcctggctactcgaactggcgcctcacttctaccagcagggaacacacctgagtctgaaggccaagagggctaaggtccaggacccgtag

SEQ ID NO: 11652 - DNA, 2019 bp, Artificial Sequence
  Description of Artificial Sequence: Synthetic coding sequence
atggcggcccccgtggggcccgtgaagttctggcggccgggaaccgagggcccaggcgtgtcaatctccgaggaacggcagtcactggccgagaacagcggaactacagtagtctacaacccttacgccgctctttctatagagcagcagaggcagaagttgccagtattcaagtatctggctgaggccggctggaccgccgaagggagagtagttggggtcacccaacctcgtcgagtggcggccgtcacagtggcaggacgagtcgcagaagagagaggcgctgtgctcggacatgaggtcggatactgcatacggtttgatgactgcacagaccaacttgctacgaggatcaaatttctgacagatggtatgctagttagggaaatgatggtggatccattgcttaccaaatattctgttatcatgttagacgaagcccatgagaggacactatacacagacatcgctattggcctgctgaaaaaaatacagaagaagaggggggacttgcgtctcattgtcgcatcagcaacccttgacgctgacaagttccgtgatttttttaaccagaatgagaccagcgatccggcgagagatacctgtgtcattctcacagtggagggcaggacttttcctgtagatatcttttatttacaatcccccgtacctgactatattaagagtacagtcgagaccgtggtcaagatccatcagactgaaggagatggggatgtgctggccttcctcacggggcaggaagaggtagagacagtggtgagcatgctcatagaacaagctcgcgcgttagccaggacaggcatgaaacggcacctccgagtcctaccaatgtacgcaggcctgccgagctttgagcagatgaaagtgtttgagcgggtttctagaagcgtacggaaagttatcgtcgcaactaacgtggctgaaacaagcatcaccatctcagggatcgtctacgtgatcgattgtggctttgtgaaactgcgcgcgtacaacccgcggaccgctattgagtgcctggtggtggtccccgtgagtcaagcttccgcaaaccagcgagccgggcggggtggcagatctagatctggcaagtgttacagactgtacacggaggaagctttcgacaagttacctcaatcaaccgttccggaaatgcagaggagtaacttagctccggtgatattacagctgaaagcccttggcatcgacaatgtcctccgatttcattttatgagtccccccccagcacaatccatggtgcaagcgcttgaattactttatgccctggggggcctcgataaagactgtaggctgaccgaacccctcggcatgcggatcgccgaatttcctctcaatcccatgttcgcgaagatgttgctcgagtccggcaattttggctgtagccaggagatactgtctatcgccgccatgatgcagattcaaaatatttttgtggttccaccaaatcagaaatcccacgccattcgggtgcaccgtaagttcgccgtagaagagggagatcacctgaccatgctgaacatttacgaagcctttatcaaacacaataaagactcaaagtggtgccaagaacactttcttaactataagggacttgtgcgtgcagccacagtgcgcgagcaattgaaaaaacttctggtgaagttccaagtgccccgcaagagttctgagggcgatccggatctcgtcttgaggtgtattgtcagtgggttttttgccaacgccgcaaggttccatagcaccggtgcttacagaacaattcgggatgatcacgagctccacatacaccctgctagtgttctgtatgcggaaaaacctccacgatgggtgatttataatgaggtgattcagacatccaagtactatatgcgtgacgttacggccatagagagcgcttggcttctggagcttgccccgcacttttaccagcagggcacccacctgagcttaaaggctaagagggcaaaagtgcaggacccatag

SEQ ID NO: 11653 - DNA, 2154 bp, Artificial Sequence
  Description of Artificial Sequence: Synthetic coding sequence
atgacctctcagcccctccgtctggcagaggagtacggtccgagcccaggggagagtgagttagcagtgaaccccttcgatgggcttcctttctcctcccggtactacgagttgttgaaacagagacaagccttgcctatttgggcagcgaggttcacttttcttgaacagctggagagtaaccctactggcgttgtactagtgtctggagagcctgggagcggcaagtctacgcagatcccgcagtggtgcgcagaattcgccctcgcccgagggtttcagaaagggcaagtcactgttacccaaccctacccactggctgccagaagtctggcccttcgggtggctgacgagatggaccttacacttggccacgaagtgggttatagcattccacaggaagactgcacaggaccgaacacactgttgcggttctgttgggatcgcttactgctccaagaagtcgctagtacccggggaactggggcttggggggtactggtcctcgacgaggcgcaagagagatcagtcgcctcagacagcctccaagggcttctgcaggatgcaagactggaaaagctccccggggacctgcgggtggtggtggtgactgatccagcccttgagcccaaactcagagcattctgggggaacccaccgatcgtgcacatcccacgggagcccggcgaaagaccctccccaatctactgggataccatccctccagaccgcgtggaagcagcttgtcaggctgttctagaactgtgcaggaaagaattgcccggggatgttctggtctttctcccctcggaggaagaaatctctttgtgctgtgagtctttgagcagggaggtggagtctctactgctgcaaggcctgcctccgcgcgtcttaccactgcatccagattgtggaagggcggtacaagctgtgtacgaggacatggatgctaggaaagtcgtcgtaacgcattggctggcggacttttccttctccttgcctagtattcagcatgtgattgactccgggctagagctcagatcagtctacaacccccggatccgggccgagtttcaggtactcagaccaatctcgaagtgtcaggcagaggctcggaggcttcgagctcggggtttcccacctggctcttgtttatgcctgtatccgaaaagctttctggagcttgaagcccccccattgccacaaccccgcgtctgcgaagaaaacttgagttctttggtgcttctattaaaaaggagacagattgccgagcccggcgaatgccatttcctagaccagcccgccccagaagcattaatgcaggctctggaggacctggactacctagcggcactagatgacgatggggacctgtcggatctgggcgtaattctgagcgagtttcccctggcaccagagctggccaaggcattactcgcgagttgcgagtttgactgcgtcgatgagatgctgactctcgcagcaatgctgacggccgcgcccggcttcacaaggcctcccttaagtgccgaagaagctgcattaagacgcgctctggagcacacagatggcgaccacagttccttgatccaggtgtacgaagccttcatccaatcaggggcggatgaggcttggtgtcaggcccgaggattaaactgggcggcattatgtcaggctcataaactccgcggggagctgctggaactcatgcagcgaatcgagttgcccttatccctaccggcgttcggttcggaacagaacaggcgcgacctgcagaaagctctggtctctggatatttcctcaaggtggcgagggacacagatggcacaggaaattatctattactgactcacaaacatgtcgctcaactttcaagttactgctgttatagatccaggagagctcccgctagacctcccccatgggttttgtatcacaatttcactatttctaaggacaattgtctgtctatcgtctccgagatccagccccaaatgttggttgagctcgctcccccttattttctgagcaatctgcccccctcagagtcaagagatctgctgaaccaacttcgcgaaggtatggccgactctacagccggctctaaatctagctcagctcaggagttcagagacccatgtgtcctccaatag

SEQ ID NO: 11654 - DNA, 2154 bp, Artificial Sequence
  Description of Artificial Sequence: Synthetic coding sequence
atgacatcccagcctctccgcctcgctgaggaatacggcccctcccctggcgaatcggaattggcagtgaaccccttcgatggcctcccgttctcatcgcggtattacgagctcttaaaacaacggcaggctctgccaatctgggcggctcggttcactttccttgagcagctcgagagtaatcctaccggtgttgtcctggtctccggagagccaggttctggaaaaagcacccagatacctcaatggtgtgccgagttcgcactcgcacgggggtttcagaaagggcaggtgacagtcacccagccgtaccctcttgccgcccgcagcctcgcactcagagtggctgacgagatggacctgacactgggacacgaagtcggctattcaatcccccaggaagactgcaccgggcctaatactctcctaaggttttgctgggaccgcctgctgttacaggaggtcgctagtactagaggaacgggcgcttggggtgtgctcgtgcttgatgaggcccaggagcgctctgtggctagcgatagcctacagggccttctacaggatgccagactagagaagctgcccggtgacctgcgcgtggtggtagtgactgatcctgccttggagccgaaactacgggcattctggggcaacccgcctattgttcatattccgagggagcctggtgagcgcccttcgccgatctattgggacacaataccacccgaccgggttgaggccgcttgtcaagcagtgctagagttatgccggaaggaacttcccggagacgtgctggtattcctgccctcagaggaggagatctctttatgctgtgagtcgctaagccgcgaagtggagtctcttctgctccagggcctgcctccgcgagtcctgccactgcaccctgattgcggtcgcgccgtacaggctgtgtacgaagatatggacgcccggaaggttgtcgtcacccattggctcgctgacttctctttctcactgccctctatacagcatgtcatagacagcggactggaacttaggtcagtctacaaccctcggatccgcgctgagttccaggtgttgaggccaatcagtaagtgccaagcagaggcccggaggctccgcgcacgaggcttccccccaggttcatgtctctgcctctatcccaagagtttcttagaactggaggcgcctcctctgccccaacctcgggtatgtgaggagaacctaagctcacttgtgcttctgcttaaacggaggcagattgcagaaccgggggaatgtcactttctagaccagcctgcccctgaggcgcttatgcaggccttggaggatttggactacctggctgcactggatgatgatggcgatctgtcagatttgggggttatcctatcagaattcccattggcccctgagctggccaaggcattgctcgcgagttgcgaatttgattgcgtcgacgagatgttgacattggccgcaatgttaacagcagcacctggcttcaccagaccacctctttccgcggaagaagcagcgctgcggcgagctctcgagcacactgatggagaccactcaagcttaatccaggtgtacgaggcattcatacagtctggagcagacgaagcgtggtgccaggctaggggcttaaactgggccgccctgtgtcaagcccacaagcttcgaggtgaactgctggagctcatgcagagaattgagttacccctgtcactgcccgcattcggcagcgaacagaatcggagggacctacagaaagccttagtcagcggatattttctgaaggtggctcgcgacacagatgggacaggaaattatttgctgctaacgcataaacatgtagctcagctgagcagttattgttgctaccggagtcggcgcgcacctgctcggccgcccccatgggtgttgtaccataatttcacaatctctaaggataattgcctgagcatcgtaagtgagatacagccacaaatgctggttgagctggcccctccctactttttgagtaacctccctccatctgagtcccgcgacctcctgaaccagctgcgggaggggatggctgattcgacagccggtagtaaatccagtagtgctcaagaattccgagatccatgtgtgttgcagtag

SEQ ID NO: 11655 - DNA, 981 bp, Artificial Sequence
  Description of Artificial Sequence: Synthetic coding sequence
atggccttatcaggaagcacaccggccccatgttgggaagaggatgaatgcttggactattatggaatgttgagcctgcataggatgtttgaggtggtgggtggtcaacttaccgagtgcgagctagaactgcttgcgtttcttcttgatgaggccccgggcgcagcggggggtcttgctcgggctaggagcgggctcgagttgttacttgaactggagcgaagagggcagtgcgatgaatctaatttgcgactgcttggccagctgctgagagtgctggctagacacgacctccttccacacctagcgcgcaagcggcggcgccctgtgtctcctgagcgatactcctatggcacaagttcttcatctaagcgaaccgaaggatcttgtcgtcgcagacggcagtctagctcttcagctaattcccagcagggacaatgggaaaccggaagccccccaaccaaaaggcagagaaggtcccgagggaggccgagcgggggcgcacggcgccgccggcgcggggcaccggctgctcctcaacagcagtctgaaccagctaggccttcatccgagggtaaggtcacctgtgatataagactgcgggtccgtgctgaatactgcgagcacggacctgccctggaacagggcgtcgctagccgccgcccacaggccttagcccggcagttggatgtttttggtcaagccaccgccgttctgcgctcccgggatcttgggtccgtcgtatgcgacattaagttctccgagctgagttacttagacgccttctggggagactatttaagtggggccttgctgcaggcactccgcggcgtgtttctgacagaggccttgcgtgaggccgtgggaagggaagcagtgcgccttctggttagcgtggacgaggccgactacgaggccgggcggaggagactgcttctcatggaggaagaggggggtagacggcccacggaagcctcttag

SEQ ID NO: 11656 - DNA, 981 bp, Artificial Sequence
  Description of Artificial Sequence: Synthetic coding sequence
atggccttgagcggttccacacctgccccgtgctgggaggaagacgagtgtctagattactacggcatgctgtctctgcatcggatgttcgaggttgtgggtggacagctgactgagtgcgagctggaattgctggcctttctcctcgacgaggcccccggcgccgctggaggattagccagagcccgaagtggcctggagctgttgctggagttggaacgacgagggcaatgcgatgagtctaatttgcgtctgctgggccagctattgagggtgcttgcacgtcatgatttattgccccacctggctcgaaagaggcgacggcctgtctcacccgagagatattcttacggtacttcatcatccagcaagcggaccgagggctcttgtaggcggagacgtcaatcttcctcatctgcaaactcccaacagggccagtgggagaccgggtctcccccaaccaagcgccagcgccggtctcgaggccggccatcagggggggcccgccgcaggcggagaggagctcccgcagcaccacagcaacagagcgagcccgcgcgcccatccagtgaaggaaaggtgacatgtgacatcaggctgcgtgtcagagccgagtactgcgagcacggccccgccttggagcagggggtggcttctcggaggccacaggccctggcaagacagttagacgtgttcggccaagcaactgccgttttgcgttctagagaccttggttctgtcgtctgtgacataaaatttagcgagctgtcctatcttgatgctttctggggggactacctctccggtgcattgctgcaggccttgaggggtgtgtttctgaccgaggccctgcgcgaggcggtggggagagaggccgtaaggctgcttgtctctgtcgatgaagcagactacgaggcagggcggcggcggcttctgctcatggaagaagagggcggtcgtcgccccaccgaggcatcttag

SEQ ID NO: 11657 - DNA, 1635 bp, Artificial Sequence
  Description of Artificial Sequence: Synthetic coding sequence
atgcgggtggctgtggccggttgctgccacggagaactcgacaaaatttatgagacactcgccctggcggaaaggcgggggccaggacctgtggatctactgctgtgttgcggtgattttcaggccgtacgtaacgaggccgacctccggtgtatggctgttccgcctaagtaccgacacatgcagactttttaccgatattactccggagaaaaaaaggccccagtgctcacccttttcatcggcggtaaccatgaagcgtctaaccatttgcaggagctgccatacgggggttgggttgcacccaatatttactaccttggtcttgcaggtgtagtcaagtaccgcggtgtgcgaatcggaggcatctcaggcatatttaagtcccacgactatagaaagggccacttcgagtgccctccctacaactcctcaactattaggtctatttaccacgttcgtaatattgaagtctataagctgaagcagctgaaacagcccattgacatctttctgtcacacgactggcctaggtcaatatatcactacggaaacaaaaagcagctgctcaaaaccaaaagtttctttcgacaggaagtagagaataataccctcggctcccccgcagcgtctgagctgttggagcacttaaagccgacctattggttcagcgcacatctgcatgttaagttcgcagccctgatgcagcaccaagcaaaagacaaagggcagaccgctagagctaccaaattcttggctctggacaagtgtttgccccatagagactttttgcagattttagaaatcgaacacgaccccagcgctcctgactatcttgaatacgatatagagtggctgaccatcctgcgcgcgactgatgatctgattaatgtaactggcagattatggaatatgccagagaataatggactgcacgctcgctgggattatagtgcgacggaagagggaatgaaagaggtcctcgagaagttgaatcatgaccttaaagtgccttgcaatttctctgtaactgctgcctgttatgacccatcgaaaccacagacgcagatgcagttgatccatagaatcaatcctcagaccacagagttttgtgcccagttagggatcatcgacatcaatgtgcggctccaaaagtctaaagaagagcaccatgtctgtggtgagtacgaggagcaggatgacgtcgagtccaacgattccggcgaggaccagagtgagtacaatactgatacatcagctctcagcagtatcaacccagatgagattatgcttgacgaggaggaggatgaggactccatcgtctccgctcacagtggcatgaatacaccctcggtcgagccatcagatcaggctagcgaattttctgcttcctttagcgatgtgcggatcttacccgggtccatgatagtctcttccgatgacacggtcgacagtaccattgacagggaagggaagcccggcgggacggtcgagtcaggaaacggcgaggacttgacaaaggtaccattaaagcggctgagtgatgaacatgagcccgaacagcgtaagaaaataaaacgacgaaatcaagctatctacgcggcagtggatgacgatgatgatgacgcggcctag

SEQ ID NO: 11658 - DNA, 933 bp, Artificial Sequence
  Description of Artificial Sequence: Synthetic coding sequence
atgcagcaccaggccaaggataaggggcaaactgctcgggccaccaaatttctagcactggataaatgtttacctcaccgcgattttctgcagattctcgagatcgagcatgacccttctgctccagattacctcgaatacgatattgagtggctgaccattctacgggcgacagatgacctgataaacgtgacaggaaggttatggaacatgcctgaaaataatggactgcacgctagatgggattattcagccaccgaggaaggtatgaaggaagtcctggaaaagctcaaccatgaccttaaggtgccatgtaattttagcgtaaccgccgcatgttacgatccctctaagcctcaaacccagatgcagctgatacaccggatcaacccccagacaactgagttttgtgctcaactgggcatcatagacatcaacgtcagattgcaaaagagcaaggaggagcaccacgtgtgtggtgagtatgaggaacaagacgatgtggaatctaatgatagtggcgaagatcagtccgagtataacaccgacacgtcagctttaagctcgatcaatccagacgagattatgctggacgaggaggaggacgaagatagtatcgttagtgctcattcaggcatgaacaccccatcggtggagccctcagaccaagctagcgagttttctgcctcctttagcgacgtgaggatactccccgggtctatgatcgtgagttctgacgacactgtcgatagcacaattgatcgggagggcaagccgggcggcaccgtggaatcgggcaacggggaggatttaactaaggtgccactgaagcgtctgagcgatgagcacgaacccgaacagaggaagaagattaagaggcggaaccaggctatatacgccgctgtcgacgacgacgatgacgacgccgcgtag

SEQ ID NO: 11659 - DNA, 1653 bp, Artificial Sequence
  Description of Artificial Sequence: Synthetic coding sequence
atggatcatcatgtttccaccatcaagcctcgtcggatccagaatcagaatgtgattcacaggctggaacggaggaggatttcatctggcaaggcaggcactcactggcatcaagtgagggtgtttcaccaaaacgttttccctaactttaccgtggttaatgtggagaaaccgccctgtttcctgagaaagttctctccagatggaagatacttcatcgccttttcttccgatcaaaccagcctagaaatctatgagtaccagggctgtcaagccgccgaggacttattgcagggttacgagggagaaattctgtctaacggtaacgaccagcgctccgtcaatattcgaggcagactctttgagagattctttgtcctactgcacatcaccaatgtggccgctaatggcgagcatcttaatcgtgagtgcagcttgtttacagatgattgccgatgcgtaatagttggatctgcagcctacctcccagacgaaccccaccccccttttttcgaggtgtatcgcaactctgaaagcgttaccccaaacccgagaagtccactcgaagactactccttacacatcattgaccttcacactggacggctgtgcgacacgcgaacgttcaaatgcgacaaggtagttctcagccataaccagggactgtacctctacaaaaatattttggccatactgtctgttcagcagcagactatccacgtttttcaggtgactcccgaaggaacttttatcgatgtccgtaccatcgggcgcttctgttacgaagatgaccttttgactgtgagcgccgtgttccccgaggttcagagggattcccagactggcatggccaacccttttcgagatccatttatcaattctctgaaacacagattgttggtttacctgtggagacgcgccgaacaggacggttccgccatggctaagaggcggtttttccagtactttgaccagctaaggcagctgaggatgtggaagatgcaactgctggacgagaaccacctctttattaagtatacatccgaggacgtggtcaccctccgggtgaccgacccttcccaggcatctttttttgtcgtgtacaacatggtgacaactgaggtgatagcagtcttcgaaaatactagtgacgagctgctggaactgttcgagaatttttgtgatctcttcaggaatgcgaccctgcacagtgaagtccagtttccatgctctgcaagcagcaacaactttgctaggcagattcaaaggcggttcaaagacacaatcataaacgccaaatatggcggccatactgaggcagtgcggagactgctggggcagttacccatttccgcccaatcctattcaggctctccctatctcgacctttcactattttcctacgacgacaagtgggtttcagtgatggaaagacctaagacatgcggcgatcaccccatcaggttctatgcacgcgacagcggcctgctgaagtttgagattcaggcagggctgctgggacgccctatcaatcacaccgtgcgtcgcctggtggctttcacatttcaccctttcgaaccgtttgcaatctctgtccagagaactaacgccgaatacgtggtgaacttccatatgaggcactgctgtacctag

SEQ ID NO: 11660 - DNA, 1686 bp, Artificial Sequence
  Description of Artificial Sequence: Synthetic coding sequence
atggttgggcagattctgaaacgtgatgttatcatggatcaccatgtgtcaaccataaaaccacgtcggatccagaatcagaacgtaattcatcgtctggagagacgcagaattagcagcggcaaggcaggaacgcactggcaccaggtacgcgtttttcaccagaatgtgttccccaattttacagtcgtgaacgtcgaaaaaccaccttgctttctgcggaaattctctcccgacggaagatacttcatagcctttagctcagatcagacctctttagaaatctatgagtaccagggctgtcaggccgccgaagatctgctgcaggggtacgagggagaaatattatcaaatggaaatgaccagcgctccgtcaacattcgtggacggttgtttgaaaggttttttgtccttctacacattacaaatgttgccgccaatggcgaacaccttaacagggaatgctctctgtttacagatgactgcagatgtgtcattgtaggttctgctgcgtacctgccggacgaaccgcacccccctttttttgaagtttatcgcaacagcgagagcgtaactcccaaccccagaagtccacttgaagactatagcctccatatcattgatcttcatacgggaagactctgtgatactcgaacattcaagtgtgacaaggtcgtactgagccacaatcagggtctttatctgtataaaaatattttagctatcctttccgtacaacagcagactatccacgtttttcaggttacacccgaggggaccttcatcgatgtcagaaccattgggcgtttctgttacgaggacgatcttctcacagtcagtgctgtgtttcccgaggtccaacgcgactcccagaccggcatggccaacccattcagagatccgttcattaactctctaaagcaccgcctgctggtgtatctgtggaggagagccgagcaagatgggtcagctatggctaagcgccgattttttcagtacttcgatcaactgaggcagctgcggatgtggaaaatgcaattactcgacgaaaatcatctctttattaaatacacttcagaagatgtggtcactctgcgcgtgacagatccttcacaggcatcattcttcgtcgtgtacaatatggttaccaccgaggtcatagcggttttcgaaaacacatctgatgaactgttggagctgttcgagaacttctgtgacttgttccgaaacgcaactctccattccgaagtacagttcccttgttctgcctcctccaataattttgcacgtcagattcagcggcggtttaaggatactataataaatgccaaatacggaggccatactgaagccgtgcgaaggctgctgggtcaactgccaatttcagctcaatcctattctggatctccttatctggatctatccttgttctcatacgacgataagtgggtaagtgttatggaacgccctaagacgtgtggagatcaccccatcagattctatgcgcgagatagtggactgctcaagtttgaaattcaagcaggactcctcgggcgccctatcaaccacaccgttaggcgacttgtcgcatttactttccatccatttgagcctttcgctattagcgtccagaggacaaacgctgaatacgtagtgaactttcatatgcggcactgttgtacatag

SEQ ID NO: 11661 - DNA, 1686 bp, Artificial Sequence
  Description of Artificial Sequence: Synthetic coding sequence
atggtcggtcaaatcctcaaacgggacgtcatcatggatcatcacgtcagcacaatcaagccccgccgcattcagaatcagaatgttattcataggttagaaagaagacggatctcttctggcaaagccggaacgcattggcaccaggtccgagtgtttcaccagaacgtcttccccaactttaccgtggttaacgtcgagaagccaccatgtttcctgcggaaattctctccagacgggagatacttcatcgctttcagttctgaccaaaccagcctcgagatctacgagtaccagggctgccaggcagccgaagatctccttcaggggtatgaaggggaaatcctgtctaacggtaacgaccaacgaagtgtcaatatccgcggtaggctcttcgaacggttctttgtgctcctccatataacaaacgtggcggccaacggcgagcacttgaatagagagtgttcactcttcacagacgattgccggtgtgtgatagtgggcagcgctgcctacctgcctgacgagccgcaccccccattttttgaggtgtacaggaacagtgaaagcgtgactcctaatccaagaagcccattggaagattactcattgcatataatcgatctgcacaccggccgtctatgtgacacccggactttcaagtgtgataaggtggtactgagtcataaccagggcctctacctttacaaaaacatcctcgcaatcctctctgtccagcagcagaccatccatgttttccaggtgaccccggagggtacatttatcgatgtgcgaaccatcggcagattttgctatgaggacgatcttttaactgttagcgcagtgttcccagaagtgcaaagagatagccaaaccgggatggcaaacccctttcgcgacccttttatcaatagcctgaaacaccggttgctcgtttacctatggcgtcgggcagaacaggacggctcagctatggcaaaacgccgattctttcagtactttgaccagctgagacagttgagaatgtggaagatgcagctgctagatgaaaatcatctgttcatcaagtatacatctgaggatgtggtaacactccgggttacggacccctcccaggcgagcttttttgtggtttataacatggtcacaacggaggtcattgctgtcttcgagaatacgtctgatgaacttctcgagctgtttgagaatttctgtgatttgtttaggaacgcgacgctccactcagaagtgcaattcccctgctcggctagcagtaacaacttcgccagacaaattcagcgcagatttaaagacaccatcatcaatgctaagtacggcgggcataccgaagcggtacgaagactcttaggacagcttcctatctcagcccagagttattcaggaagtccgtacctagacctaagcctcttttcatatgatgacaaatgggtgtcggtcatggaaaggcccaagacatgtggcgatcaccctattaggttttatgcccgagacagcgggctcctcaagtttgaaatccaagctggcctgctgggcagacctatcaatcataccgtgcgccgtctggtggcatttactttccatccctttgaaccattcgctatttccgttcagaggactaatgccgagtatgtggtcaatttccacatgcggcattgctgcacttag

SEQ ID NO: 11662 - DNA, 5592 bp, Artificial Sequence
  Description of Artificial Sequence: Synthetic coding sequence
atgatcgaggacaagggccctcgagtcgcagactattttgtagtggctggccttacagatgtcagtaagcctctggaagaggaaatacactttaacgatgcctgccacaaggtggccaagcctaaagagcctataacagatgtgagcgtgattataaaatccctgggcgaagaagttcctcaggactacatctgtatcgacgtaacacccacaggacttagcgcagaccttaacaatggtagtttggtcggccctcagatctacctgtgctacaggaggggccgcgacaaaccacctttaactgacctaggagtgctctatgactggaaggagcgactgaaacaggggtgcgaaatcatccagagcaccccctatggacggcctgcaaatatcagcggctcgaccagctctcagcgcatttacatcacctatcgaagagcttcagagaacatgactcagaacacgttagcagtgacggacatctgtataatcattccatccaaaggagagagccctccacatactttctgcaaggtggataagaatctcaataattccatgtggggatctgctgtgtacctgtgttataagaaatctgtcgccaaaacaaataccgtaagttataaggctgggctgatctgtcgctacccacaagaagactacgagtcattcagcctaccggagagcgtgccactgttctgcctgcccatgggcgccacgatcgaatgctggcccagcaattctaagtatcctttgcccgtgttctccaccttcgtcctcactggggctagcgcggagaaggtctatggggccgccattcagttttacgaaccctacagtgaggaaaaccttacagagaagcagcgcctcttgctggggcttacttcagccgacggaaaaagcgattccagcaaaaccatccacaccaacaaatgcatctgcctgctgagccactggccctttttcgacgctttcagaaaatttttgacgtttttgtatcgttacagtattagcgggccccacgtgctgcccatagaaaagcacatctcccactttatgcacaaggtccctttcccgtcaccccagcggcctcgcatcctggtgcagttgtcaccacacgacaacctcatcctgagtcagccagtttcttcaccgctccctctttctggcggaaaattcagtacattgctccagaacctgggacccgaaaatgcagtgactctcctggtgtttgccgtaacagaacataaaattctgatccatagcttgcggccgtcggtgctcactagcgtcactgaggcactggttagcatgatttttccctttcactggccctgcccctacgtgcccctgtgtcccttagctttagctgacgtgctaagtgccccctgtcccttcatcgtcgggatcgatagtcggtactttgatctgtacgatccacctccagacgtgtcttgtgtggatgtcgataccaatacaatcagccaaataggtgacaagaaaaacgtggcctggaaaatcctccctaagaagccgtgtaaaaatttaatgaataccctgaacaatctacatcagcagctcgccaaactgcagcagaggccacgcgacgacggcctcatggatcttgcaattaatgactacgatttcaattcagggaaacggctgcacatgattgatctggagatccaggaagccttcttgttctttatggccagtattctaaagggttataggagctatcttcggccaattacacaggctccgtccgagacagcaactgatgcggcctcacttttcgcgttgcaagcattcctaaggtcacgagacaggtcccatcagaagttctacaatatgatgaccaagacccagatgttcattaggttcatagaggaatgttcattcgtgtcagacaaggacgctagcttggcattcttcgacgattgtgttgacaaggtcgacatggataaatccggcgaggtacgtctgattgagctggatgagagctttaagtccgaacacacagtcttcgtaactccgcccgagataccccacctccctaacggagaagaacctccactccagtatagttacaacggcttcccagtgttaagaaataacctgtttgagagaccagaagggttcctgcaggccaagaaaaataagctgccgagtaagtcaagtagcccgaatagccctctgcccatgtttaggagaacaaaacaggagattaaatcagcccataaaatcgccaaacgctacagtagtattcctcagatgtggtctcggtgcctgctccggcactgctacgggctgtggtttatctgtttgcctgcttatgtcaaggtctgtcattcaaaagtcagagccttgaaaacggcatacgacgttctgaagaaaatgcagtcaaagaaaatggatccaccggacgaggtatgttaccgcatattaatgcagctctgcgggcaatatgatcagccagtgctcgctgtgcgtgtcttgttcgagatgcagaaggctggcatcgaccccaacgcgatcacttatggctactacaacaaagcagtcttggagtcaacttggcccagtagaagtaggtcaggatactttctctggaccaaggtccgcaacgtggttcttggtgtgactcagtttaaaagggcactgaaaaagcatgctcacctttcccagacaaccctctccggtgggcagtctgacctaggatataactccctctctaaagacgaggtgaggcggggcgatacttccacagaagacatccaggaagagaaagacaagaagggctctgattgcagcagcttgagtgagtccgaatccacaaagggttctgcggactgcctgccaaaacttagctaccaaaacagttcctccatcgttcgcttgacaggaacatccaacaatagcgctgggaagatctcaggcgagagtatggaaagcactccagaactcttactgattagttctctcgaagatactaacgagacacgcaacatacaaagcagatgcttccggaaacggcacaaatccgacaatgaaacgaacctgcagcagcaagttgtctggggaaacaggaatcgcaatctctccggtggggtcctcatgggctttatgctcaacagaatcaaccaggaagctactcctggcgacatagtggagaaactcggtgccgacgctaaaatcctgtcaaacgtgatcagcaagagcacccgccctaacaccctggatatcggtaagccccccctccgtagtaagcgggattccctggagaaggaatcctcagatgatgatactccttttgacggaagcaattaccttgcagataaagtggattcccctgtcatcttcgacttggaggacctcgactccgagacagatgtgagtaaagcagggtgtgtcgcaactcaaaaccctaagaggattcagcggatgaactctagcttttctgtgaagccattcgaaaaaaccgatgttgccacaggatttgacccactgtctttgctcgttgccgaaactgagcagcagcagaaggaagaggaggaagaagatgaggatgactccaagagcatcagtactccgtccgcaagaagagacctagcggaggagatcgtgatgtacatgaataacatgtcctcccccctgaccagcagaactccctcaattgatctccagcgcgcctgcgacgacaaactgaataagaagtcaccccccctggtcaaagcctgcaggagatcttcacttccgcctaacagtccgaaacccgtgcgactgaccaagagtaaatcttatacaaaatccgaagaaaagcccagagaccgattatggagtagtcctgcattctctcctacttgtccctttcgggaggaatcccaggacaccttgactcacagctccccctcttttaatctggacacacttcttgttcctaagcttgacgtgttgcgcaactcgatgtttaccgccggaaagggtgtggctgagaaggccagcaagtggtatagtagattcaccatgtacaccacatcctccaaggatcaaagttctgataggacatccttgtccagcgtaggtgcccaggactccgagtccacttcccttactgatgaagatgtctgccatgaactcgagggaccgattagttctcaagagacctccgcgactagtggtaccaagcggatcgatctctccagaatttccttggaatcttccgcctctctggagggtagtcttagcaagttcgcacttccaggtaaatcagaggtcaccagctctttcaacgctagcaataccaatattttccagaactacgcaatggaagtgctgataagcagttgcagcaggtgtcgaacctgcgactgcctggtacacgacgaggagatcatggcggggtggacagccgacgatagcaacctcaatacaacctgtcccttttgtggcaatatttttctgccatttttaaatatcgagatccgcgatctgcgccgtcccggcagatatttcctgaaaagctcccccagtaccgaaaatatgcattttccctcaagcatttctagccagacacggcagtcctgcatctccacctcggccagcggcttggacacctccgctctgagcgtccagggtaattttgatctgaattcaaaaagcaaattacaggagaatttttgtactcgcagtatccagataccggccaacagatcaaaaacggcaatgtctaagtgccctatctttccaatggctagatccatttctacctccggtcctttggacaaggaggatacaggaagacaaaagcttatttcaaccggttctctcccagcaacgcttcagggagcaacagactccctgggactggaatggcatctgcctagtcccgacccagtgactgtgccctatctgtcccccctggtagtctggaaagagcttgaatctctcttggaaaacgaaggagatcacgctatcactgtagcagactttgtcgaccaccatcctatcgtcttttggaatctcgtctggtattttaggcgcttggacttacctagcaatctcccaggtttaattctgtcctccgagcactgtaacaagtactctaagatcccgcgtcactgtatgtcagaagactcgaagtacgtcctgattcagatgctctgggataacatgaaactccaccaggacccaggccagcccctgtacatcctgtggaatgcacacacccaaaaatatccaatggttcacctgcttcaaaagtccgacaattctttcaaccaagaactcttgaagtctatggtgaaaagtattaagatgaatgacgtgtacggtccgatgagtcaaatactcgagacactgaataaatgccctcattttaagaggcagcgaagcctgtatcgcgaaattctatttctgtcactcgtggctctaggtcgggagaacattgacattgacgcctttgataaggagtataaaatggcctatgaccgactcacgcccagccaggttaaatcgacacataattgcgatagacctcctagtaccggggtgatggaatgtcgtaagaccttcggcgagccctacctgtag

SEQ ID NO: 11663 - DNA, 5721 bp, Artificial Sequence
  Description of Artificial Sequence: Synthetic coding sequence
atgattgaggacaaggggccccgagttgcagactatttcgtagtagccggcctgacagacgtttctaaacccctggaggaagagatacatttcaacgacgcctgtcataaggtggctaagcctaaggaacccatcacagatgtgtccgtgatcatcaagtctctgggcgaggaggtaccgcaggactacatctgcatcgatgttaccccaactggactgtcagctgatctgaacaacggaagtcttgttgggccccagatctacctgtgctataggaggggccgggataagccccctctgactgacctaggggtcctgtacgactggaaagagcgactcaaacaggggtgtgagattatacagtctaccccttacggcaggcctgcaaatataagtggctcaacctcttcccagagaatctacatcacataccgccgcgccagtgagaacatgactcagaatactctcgcggtgacagatatatgcattattatacccagcaagggcgaatccccacctcacactttctgcaaggtagacaagaatctgaacaacagcatgtggggatcagcagtatacctgtgctacaagaagtccgtagcaaagactaatacagtcagctacaaagccggtttaatatgccggtacccacaggaggactacgagagttttagcctccctgagtccgtgccccttttttgtctgcctatgggagccactatcgaatgttggcccagcaacagtaaatacccccttccagtcttttcaacgtttgtgctaacaggcgcaagcgctgaaaaagtttacggcgcagcaattcagttctacgagccatactcggaggaaaatctcacagagaaacagcgcttgctgctgggtcttaccagcgccgatggcaaatccgactcttcgaaaactatccacaccaataagtgcatctgtttgctaagtcactggccgtttttcgacgccttccgaaaatttctgactttcctgtacaggtactcgataagcgggccccatgtccttccaatcgaaaaacatattagccactttatgcataaagtaccgtttccctccccccagcgccctcgaatcctggtgcagctctctcctcatgacaatttaatactcagtcaacccgtgtccagtcctctgccattgtcagggggaaaattctctactctcttgcagaatctcggaccagaaaacgcagtaaccctcctcgtttttgcagtaacagagcataagatccttatccacagcctccggcccagtgttctgacttccgtcaccgaagcccttgtgtccatgatcttccccttccactggccatgtccctacgtgccactatgcccccttgccctcgcggatgtactctctgctccctgtccctttatcgttggaattgactcacgttacttcgatctctacgatccacctccagatgtcagctgcgttgatgtggatactaatacgatcagccagataggcgacaaaaagaatgtcgcttggaagatcctgccaaaaaaaccctgcaagaacctgatgaacactctgaacaaccttcaccagcagcttgccaaacttcaacagcgcccaagagacgatgggttgatggatcttgcgataaacgactatgattttaattccgggaagcgcctgcacatgattgacttagagattcaagaggccttcttgttcttcatggcctcaatcctgaaaggctacagaagctaccttagaccaatcacccaagcccccagcgagacggccaccgacgctgcctcgctttttgctttgcaggccttcctgcgcagcagggaccggagccatcagaagttctacaacatgatgactaagacgcaaatgtttattagattcattgaggaatgcagctttgtcagtgataaagatgcaagcttagccttcttcgatgactgcgtggataaggtcgacatggataagtctggagaggtgcggctcatcgaactcgacgaaagcttcaaatctgagcacactgtgtttgtcacaccacccgaaatcccccaccttcctaatggtgaggagccaccattacagtacagctataatggcttcccagtgctgcgtaacaaccttttcgagcggcctgagggattcttacaggccaaaaagaacaaattgccgagcaaatcgtcaagtcccaacagcccccttcctatgtttcgtaggacgaaacaagagattaagagcgcccacaaaattgctaaacgatatagttcaattccgcagatgtggagtcggtgcttgttacggcattgttatggcctatggttcatttgtttacccgcatatgtgaaagtgtgccattcaaaggtgcgggccctgaagaccgcttacgatgtccttaagaagatgcagtccaaaaaaatggaccctcccgatgaagtgtgttatcgcatcctgatgcagctgtgcggccagtacgaccagcctgtcctcgctgtgagagttctgtttgagatgcagaaagcgggcattgaccccaacgctatcacttatggttactataacaaggctgttcttgagtcaacctggccctcgagaagcaggtctggttacttcctgtggaccaaggtgcgtaacgttgtgctgggagtgactcaattcaagagagccctcaaaaagcacgctcacctcagtcagaccacactctctgacggttcagatctcgatgccgtgagccacgggtccatggactccggccacggtactcacacagtggagcaggcgcctttcaataccgggctcatcaaggtgtatgcaaccgatgatcggtcttccaccggcggtcagtccgatttaggttataattccttgagcaaggacgaggtgcggagaggagacactagcactgaagatattcaggaggagaaagataagaaggggagcgactgcagttcattatccgagtcagagtctaccaaaggaagcgctgactgtttgccaaagctcagttatcagaattcatcgagtatcgtgaggttgaccgggacctcgaataatagcgcggggaaaatctctggtgaatccatggagtccacccctgaacttctgcttatcagtagcctagaggacacaaatgagacgaggaatattcagtctcgatgtttccgtaaacgccacaagtcagataatgagaccaacctccagcagcaggttgtctggggcaaccgcaatagaaatctgtcaggcggcgtcttaatgggctttatgctgaaccggattaatcaggaggccacacccggcgatattgtggaaaagctgggagccgacgctaagatactgtctaatgtgatcagcaagtctacgcgacctaatacgttggatattggaaagccaccactgagaagcaaaagagacagtctggagaaagagtcaagtgacgacgataccccattcgacggctctaactacttggcggataaggtggattctcctgtgatcttcgacctcgaggacctggacagcgaaacggatgtcagcaaggccggctgcgtggcaacccagaatccaaaacggatacagcggatgaactctagttttagtgttaagccgttcgagaagaccgacgtggctactggatttgatcccttatcgctgcttgtggctgaaacagagcagcagcagaaagaggaagaggaggaggacgaagacgactccaaaagcatatccacccccagcgctcggcgtgatctggcagaggagattgtgatgtacatgaataacatgtccagcccactcacaagccgcacccccagcattgatctgcagcgcgcatgtgatgacaagctcaacaagaagtctccacccctcgtgaaggcgtgcagacgttcctcactgccacccaattctccaaaacccgtcaggctgaccaaaagcaagtcctataccaagagtgaggaaaaacctagggataggctgtggtccagccctgcattcagccctacatgtcccttcagagaggagagccaggataccctcactcactctagccccagcttcaacctcgatacactcctagtaccaaaacttgacgtactccgaaattccatgtttaccgcaggaaaaggagtggccgaaaaggcgagcaaatggtatagtagattcaccatgtataccaccagttcaaaagatcagtcttccgatagaactagcttgtcttccgtcggcgctcaggactcagaaagcacttctctcacggacgaggacgtttgtcatgagctggagggcccaatctcctcccaggagacctctgctacgtcaggcactaagcgcatagacctctcccgcatttccttggagtcgagcgcgagtctggaaggtagcctgagcaagttcgccctcccagggaaatcggaagtgacttcatccttcaacgcctctaatacaaacatctttcaaaattacgctatggaggttttaataagttcttgctctaggtgtcggacctgcgattgtctcgtccatgacgaggaaatcatggccgggtggaccgcagatgatagcaaccttaacacgacctgcccattttgcggaaatatcttcctgccatttcttaatatcgaaattagagatctgcgaaggcccggcagatacttcttgaagagtagtccctcaacagagaacatgcatttcccaagcagcatttccagccagacgcgacagtcatgtataagtacatcagcttccgggctcgatacctctgccttgtcagtgcagggtaactttgacttgaactccaagagcaaactccaagaaaacttttgtacaagatccatccagatccctgccaaccgctctaaaaccgcaatgagtaaatgccccatattccctatggcccgttctatcagtaccagcggccccctggataaggaggacacaggccggcaaaaactgatctccactggatccctccctgccacactacagggcgctacggattccctgggacttgaatggcaccttcctagccccgacccagtgaccgtgccatacctctcaccactggtggtttggaaggagctggaatccctgctcgagaacgaaggggatcatgcaatcaccgttgccgactttgtggatcaccacccaatcgttttctggaaccttgtctggtatttccgtcggttagaccttccgagcaatttacctggcctaattctgagcagcgaacactgcaataagtactcaaagatcccgcgccactgtatgtcggaagacagtaagtacgtgctgatacaaatgctttgggacaacatgaagttacaccaagacccagggcaacctttgtacattctctggaacgcccacactcaaaagtatccgatggtgcacctcctccagaagtccgacaatagttttaaccaggaactacttaagtctatggtaaagtcaatcaaaatgaatgatgtgtacgggccaatgagccagattctcgagacccttaataagtgccctcacttcaagcgccagagaagtctgtatcgtgagatcctttttctgtcccttgtcgctctcggtcgcgagaacatcgatatagacgcattcgataaggagtacaagatggcctacgataggctgaccccctctcaggtcaaatcaactcacaactgtgaccggccaccttccacgggtgtgatggagtgcaggaaaaccttcggggagccctatttgtag

SEQ ID NO: 11664 - DNA, 102 bp, Artificial Sequence
  Description of Artificial Sequence: Synthetic coding sequence
attattaagtacctcctgttatattctttcctttgcgtcttgatcaagtgccaagattcattcaaaatctattgcttcccctgctacccattttacaattag

SEQ ID NO: 11665 - DNA, 990 bp, Artificial Sequence
  Description of Artificial Sequence: Synthetic coding sequence
atgggcgcaacaggggatgccgagcagccacgaggtccttctggcgccgaaaggggcgggcttgaacttggggatgctggagccgcaggccaacttgtcctgactaatccttggaacattatgatcaagcacagacaggtgcagcggcgaggcaggaggtcacaaatgaccacaagttttacggaccctgccatcagcatggacctattaagggccgtgttgcagccatccattaatgaagaaattcagacagtctttaacaaatacatgaaattctttcagaaggccgccctgaacgtaagggacaatgtcggtgaggaggttgacgctgagcagttgatccaggaagcttgtaggtcttgtttggagcaggccaagctgcttttctccgatggagaaaaggttataccacggctgactcacgagctgccaggaattaagagagggaggcaggcagaagaagaatgcgctcaccggggttccccactgccgaagaaaaggaaaggaaggcccccgggccatatactgtccagcgaccgtgccgctgccggaatggtatggaagccgaagagctgtgaacccatcagaagagaaggcccaaaatgggaccctgcacgactgaatgagtctaccacatttgttctgggctcaagggcaaacaaagccctaggcatgggtgggaccagagggcgaatatacattaaacacccccacctctttaagtacgcggccgatccccaggacaagcattggctcgcagaacaacaccacatgcgagctacggggggaaagatggcttatctacttatcgaagaggatatcagggatttagctgcttctgacgactatagaggctgtctggacctcaagctcgaggagctgaaatcgttcgtcctgccgtcttggatggttgagaaaatgagaaagtacatggaaacactgcgcaccgagaacgaacatcgggccgttgaagcccctccacagacttag

SEQ ID NO: 11666 - DNA, 2271 bp, Artificial Sequence
  Description of Artificial Sequence: Synthetic coding sequence
atggttgtgacacggtctgcaagggccaaggcctcaatccaggccgcaagcgcggaatcctctgggcagaaatcgtttgccgcaaacggtatccaggctcatcccgaaagcagcaccggcagtgacgcacgcacaacagcggaaagccaaacgaccgggaagcagagcttgatccctagaaccccaaaggccagaaagcgcaagtctcgaactaccggttccctccctaaaggaaccgagcccagcactgacggcgagaccagtgaagcagaatcaaactattctgtttccgaacaccacgacacgatcctccgcgtgactcgacggagacagatcttgatcgcctgtagccctgtgagctcagtgcgcaagaagcctaaggtgacgcctacaaaggaaagctataccgaagagattgtgagcgaagcagaaagtcatgtctccggaattagtaggatcgtcctgccaactgaaaagactacaggcgcccgtcgttctaaggccaagagccttaccgatccaagtcaggaaagtcacacagaagcaatctccgacgccgaaacttcatcaagcgacatctcattttccgggatcgcaaccagacgaacccgctcaatgcagaggaagcttaaagcacagaccgagaaaaaggactccaaaatcgtgcccggcaatgagaaacaaatcgttggcactcccgtgaacagtgaagactctgacacaagacagacctcacacctgcaggccagatccctgtccgagataaataaacccaatttctataataatgactttgatgatgatttcagccaccggtcttcagaaaacatcctgaccgtgcacgagcaggccaacgtcgagagcctgaaagagactaagcagaactgtaaagatcttgatgaggatgccaacgggattactgacgaaggaaaagaaatcaacgagaagagctcacagctgaaaaacctctctgagctgcaagacactagcctgcaacagctggtatcccagcggcacagcacgccccaaaataagaacgcagtctccgtccactccaacctcaattcagaagccgttatgaaatcactcacacaaacatttgcgactgtggaagtggggcggtggaacaacaataaaaagtctcctattaaagcatcagatctgaccaaatttggagattgtggcggatccgacgatgaggaggagagcaccgtcattagcgtgagcgaggatatgaactccgaaggcaacgtggactttgagtgcgatacaaaactatacacctccgcacccaacacatctcagggaaaggacaatagcgtcctgctggtattgagttcagatgagtctcaacagagcgaaaattctgagaatgaagaggataccctgtgcttcgttgagaactcaggtcagagggagtcactgtccggagatacggggtccctgagctgcgataacgcactctttgttatcgatacaaccccaggcatgtctgcggacaaaaacttttatctggaggaggaagataaagctagcgaggtggcaattgaagaggaaaaggaggaggaggaagacgagaagtctgaagaggattcatctgatcacgatgagaacgaggatgagttttcggatgaagaggacttccttaactctactaaggctaaattactcaagttgacatcatcctctatcgacccagggctgagcatcaagcagctggggggattgtacattaactttaatgctgataaactgcagtctaataagcgtacactgactcagatcaaggagaaaaagaaaaacgagctcctgcagaaagccgtcatcaccccagactttgagaagaaccactgtgttcccccttactcagagtctaagtatcagcttcaaaaaaaaagaagaaaggagcggcaaaagactgccggagatggatggttcggtatgaaggctccggagatgacaaacgagcttaagaacgatctgaaggcattaaagatgcgtgcatctatggaccccaagcgattttacaagaagaacgaccgagatggattcccgaagtatttccagataggcactattgtcgataatcccgcagacttctatcattcaagaatccccaagaaacagcggaaacgaactatagtggaagaactccttgctgacagtgagtttcggcgttataaccgaaggaagtactcggaaattatggccgaaaaggccgccaatgcggctggcaagaagtttcggaaaaaaaaaaaatttcggaattag

SEQ ID NO: 11667 - DNA, 1020 bp, Artificial Sequence
  Description of Artificial Sequence: Synthetic coding sequence
atgctgcccagtgcagtggcagctcatgctggagcctactgggacgtcgtggcctcctccgccctcttgaacttacccgcagcgcccgggtttggaaacttaggcaaaagttttctgattgaaaatctcctcagggttgggggcgcgcctacaccacggctccagcccccagcaccccacgaccccgccactgccctggccactgccggcgcgcaacttaggcctctgcccgccagccctgtcccattaaagctctgtcctgccgcagaacaggtgtcgcctgccggtgcaccatatggtaccaggtgggcattccaagtgttatcgcccagcgcagattcggctcgcttgcctgggagggctcctggagacagggactgcactttccaaccttctgctcccgctccgagcaagccgtttctactgagcaccccacctttctacagcgcatgctgcggaggttcatgccggagacctgcttcatctactgccttcccgcgggaagagagcatgctacccctgttgacacaggacagcaactctaaagcccgaagaggcatcctccgccgagccgtgttttcagaagaccagaggaaagcgcttgaaaaaatgttccagaagcagaagtatatttccaagactgatcgaaagaagttggccatcaatctgggtcttaaggagagccaggtcaagatttggtttcagaataggagaatgaagtggaggaattctaaagagaaggaagtcctgtcgaatcgctgtatccaagaggtgggactccaggaagatcctctgtcccggtctgcactgggcttcccttccccttgtccctctatctgggacgtgccacaacaacattcatctcctcggtggcgtgaaaacagcccggaacccagcgagcgtctgattcaggaaagttccggagctcccccccccgaggctaacagtctgcaaggagctctgtacttgtgttctgaggaagaggcaggctcaaaaggtgtgcttaccggagccgtgtag

SEQ ID NO: 11668 - DNA, 1134 bp, Artificial Sequence
  Description of Artificial Sequence: Synthetic coding sequence
atgcagcattatggcgttaatgggtattcgctccatgccatgaactcactgtccgcaatgtacaatctgcatcagcaggctgcacaacaggctcagcatgccccagactatagaccctctgtgcacgctttgaccctggcggaacgattggctgacataattctggaggcccggtatgggtctcagcaccgcaaacaacgccgatctaggacggcttttactgcccagcagttggaagcacttgagaagacttttcagaagacccactacccggacgttgtcatgcgcgaaaggctcgccatgtgcaccaatctccccgaagcacgcgtgcaggtctggttcaagaatcggagagcgaagttccggaagaagcaaaggtcactgcagaaagaacagctccaaaaacagaaggaggctgagggatcccacggcgaggggaaagctgaggcacctacaccggatacacagcttgatacagaacaacctccaagactgcccgggtccgaccctccagccgaattgcacctgagtctgtccgagcagagcgcctcagaatctgccccggaggaccaacctgatcgagaagaggacccgcgcgcgggggccgaggacccaaaagctgaaaaatcccctggcgccgacagcaagggcttgggttgcaagcgtgggtctccaaaggctgatagccccgggagcctaacaatcacacccgtcgcccccgggggtggtcttttgggtccctcccattcctacagttcctcaccactgtccctgttccggcttcaggagcagttcaggcaacatatggcagccacgaataatctggtccactatagcagtttcgaagtcggaggtcctgcccctgccgcagcagctgccgcagctgcagttccctacctgggtgtgaacatggcacccctggggtctctccattgccagtcttattaccagtctttatccgctgcagctgcggcccaccagggagtatggggttccccgctcctcccagccccacctgccggccttgcaccagcgagcgccaccctaaattctaagaccacctccatagagaatttgaggctcagagccaagcagcacgctgcgtccctgggtttggacactttaccaaactag

SEQ ID NO: 11669 - DNA, 1149 bp, Artificial Sequence
  Description of Artificial Sequence: Synthetic coding sequence
atgcagcactacggagtgaatgggtactccctgcatgccatgaactccctgtcggcgatgtataacctgcaccagcaggccgcacaacaggctcagcatgcacccgactataggcccagcgtacacgctctgacactggcagaaagactcgctgggtgtacattccaggacatcattctggaagccaggtacggatcgcaacacaggaaacagagacgtagtagaactgcttttaccgcgcagcagctcgaggcattagaaaaaacctttcagaaaacgcactatccggatgtcgtcatgcgggagcggctcgccatgtgtaccaatctccctgaggctagggtacaggtatggtttaaaaaccggcgggctaagtttcgaaagaaacagagatcattgcagaaggagcagttgcagaagcagaaggaagccgaaggatcacacggagaggggaaggccgaggctcccactcctgacacacagctcgacactgagcagcctcctaggcttcccggctccgatcctcccgccgagcttcatctgtcactcagcgaacagtcagcgtccgaaagtgcgccggaggatcagcctgatcgggaggaggacccccgcgccggcgctgaggatcccaaagccgagaagagtcccggtgccgatagcaagggacttggttgcaagagagggtctccgaaggcggacagcccaggtagccttaccattaccccagttgcacctggtggcggcctcctcggtccttcccacagttattcttccagccccctgagtcttttcaggctgcaagaacagttcaggcagcatatggccgccaccaacaatcttgtgcactactcctccttcgaggtgggtggacctgctccggcggctgctgctgcagctgccgcagtgccttatctcggtgtgaatatggctcctttgggatcgctgcattgccaatcctattatcaatctctatccgctgctgccgctgctcaccagggagtgtgggggtcaccccttctccctgcacctccagccggtctggcacccgcctccgcaaccctaaactctaagaccacctcaatcgaaaacctccggctcagggccaaacaacacgccgcaagcttagggctcgacactctgcccaactag

SEQ ID NO: 11670 - DNA, 1431 bp, Artificial Sequence
  Description of Artificial Sequence: Synthetic coding sequence
atggagactcctggggcctccgcatccagcctcttgctaccagccgcaagccggcccccacggaagcgcgaggccggggaggccggcgccgcaacctccaagcagcgagtgttagatgaggaggaatacatcgaggggctgcagacagtcattcagcgcgacttttttcccgatgttgaaaagctccaggctcagaaggagtatctggaagctgaggaaaacggcgatctggagcggatgcggcaaattgcaatcaagttcggtagcgcgctgggtaagatgtcccgggagccaccgccaccctacgtcacacctgcaacatttgaaacgcccgaggtgcatgcaggtactggtgtggtaggaaataaacctcgccctcggggccgtggcctggaagacggtgaagccggtgaagaggaggaaaaagagcctctgccttcgctcgatgtcttcctgagtcggtatactagtgaggacaatgcttccttccaagagattatggaagtcgctaaggaacgctcacgtgcaaggcacgcgtggctctaccaggccgaggaagagtttgagaagcgccagaaagacaacctggaattgccaagcgcagagcaccaggccattgagtcctcccaggcctccgtggagacatggaagtataaggccaagaattcactgatgtattatccagagggggtgcccgacgaagagcagctgtttaaaaaaccccgtcaggtggtccacaagaatactcgtttcctccgcgatcctttttcccaggcgctgtcccgctgtcagctccagcaggctgctgcactcaacgcacagcataagcagggaaaagtgggacccgatggtaaagagttgataccacaggaaagcccacgggtgggcggctttggatttgtggcaaccccatctccagccccaggagtcaacgagagccctatgatgacatggggcgaggttgagaatacacctctaagggtcgagggaagcgagactccttacgtcgataggactccaggccctgcgtttaagattctggaacccggcagacgggagagactcggcctcaagatggcgaatgaggccgccgccaagaaccgagccaagaagcaggaagcgctgaggcgagtgaccgagaatcttgccagtctgactccaaaaggcctctctcctgccatgagtccggcactgcaacgtttagtgtcacgaactgctagcaagtacaccgatagagcacttcgagcctcgtatactccctcacccgcgagaagtacacacctgaagacgcctgcttcgggcttacaaactccgacttcaacgcccgctcccgggtccgccaccaggactcctctgacacaagaccccgccagcataacagacaaccttcttcaacttcctgctagacgcaaggccagtgatttcttttag

SEQ ID NO: 11671 - DNA, 747 bp, Artificial Sequence
  Description of Artificial Sequence: Synthetic coding sequence
tagtgttccacatggtctttcttggcaccactgcctcagcagtttcacctgaagattctcttcttgccccttacccccttgcgcctgttactattgtcggctcaagtcctgattgtggtcccctttagagaagcagctctgcgcgtggttcaactctttatcagcttactagaaggcgattccaaaaaaaagatcatcgtctccaacaaaaagcggtttcagggggagtatggctcagatccggaagaacggccccccaacctgaagagacctgaagactatgaagcagtgtttgtcggcaacatcgacgatcatttccgaatcggcgtcgccatcctgcagaggtctatcagactttatgcccctttctactcaagcgatattcttatcgctagtcccctaggacttaggacaatcataggaggggaaggagagaagaaacgtgacttcgatttcctgagctctatcgaactgctcattattgatcaggccgacatctatctaatgcaaaactgggaacacgtcctccatcttatgaatcatatgaacctactgccgctcgactctcatggagtggacttctcaagggtaagaatgtggagtttgaacaactggtccaaatattatagacagaccttgttattcggggccctccaggacgctcagataaactccgtgtttaacaagtattgtgtgaatatgcagggtcaggtcggttcccggctggtcagcagtgtttcttcctag

SEQ ID NO: 11672 - DNA, 2271 bp, Artificial Sequence
  Description of Artificial Sequence: Synthetic coding sequence
atgggcaaaaggggatcaagatcccagagccagctccttaatacactgactaagaagcagaagaagcatctgagagacttcggggaagagcaccctttctacgaccgcgtatcgaggaaggaggccaagcctcagatctgccaactgtccgagtctagcgattcttctgactccgaaagtgattctgaatccgaaccacagcaagtttctggttaccacagactgttggcgacactgaaaaacgtatccgaagaggaagaggaggacgaggaagaggaagaagaagaagatagtatagtggatgatgctgagatgaatgatgaagacggaggctctgacgtttccgtggaggaagagatggccgccgagagcactgagtcacccgaaaatgttgcccttagtgccgaccccgagggcaaagaggatggtgaagaacctccggggacctcacaaacttctccagaagaattcaccgacgcaaagcacgaaagtctcttcagtctggaaacaaactttcttgaagaagagagtggggataactcaagtttgaaagcatctcaggacccatttctacagcacgtcaacaaggaactgaaggagaaagctattcaagccgtggccacgaaccccaaaaccacccacgaactcaaatggcccatccttggtcagcttttcttcagctcaaaattccagaaactggaaactttcaagccccctaaggatatcgatcttaagagtttgcatttacagaagccattagagtcaacctggaccaaaactaatagccagttcttatctgggccacagaaatcctccagtcctttcactcctctgcagaaggaacttttcctaatcatgaactcttatcgggatttgttctacccagaacgcactgctttgaaaaacggagaagaaattcggcacgtttattgtctgcatgtcatcaatcacattctgaaggcgaacgcccaggtgctggggaataactcccggcgccgatcccagaaattcggggtcggtgacgacgatgacttcagagaccaaggcctgactcgccccaaggtcctgatagtggtgccctttcgtgaagccgctctgcgtgtcgtgcagctcttcataagtctgctggagggtgactctaaaaaaaaaatcatagtgtcaaacaagaagcgctttcagggcgagtacgggagtgacccagaggaacgcccacccaacctgaagcgccctgaggattatgaggcagtgtttgtgggcaacattgatgatcacttccgcatcggcgtggctattctgcaacgcagcatccgtctgtacgcacccttctatagttccgatatactgatagccagcccgttgggcctgcggacaatcatcgggggggagggagaaaagaaacgtgacttcgactttctgtcaagcatcgaactcttaattatcgatcaggccgacatttatctgatgcagaactgggaacacgtgctgcacctgatgaatcacatgaatctactgcctttggattcacacggagttgacttcagtcgcgttcgaatgtggagtttaaacaattggtccaagtattacagacagactctgctgttcggagctcttcaagatgcacagattaacagtgtgttcaacaagtactgtgtaaacatgcaaggtcaggtagccgtgcggaatgtgccaatgaccggcagcatttctcacgtgctggtgcaactcccacacgtcttccagcgaatggaagctgagaatttggcttcagtcatagatgctcgctttaatttcttcgtcaataagatcctgccacagtaccgggacgccgtgatgtcccacacgttgatctacattccaagctacttcgactttgtgcgcttacgcaactattttaagaaggaggagttgaactttacacacatctgcgaatacacacagaagtctggagttagccgggcccgccatttcttcctacagggagaaaagcagttcctgttatttaccgaacgctttcatttttataagaggtataccatcaagggcattagaaatctcatcttttacgagctgccaacatacccgcatttctattctgagatctgtaacatgctccgcgcgacaaataggggagaggaggcaacctggacctgcacagtgctttacagtaagtacgatgcacagagactggccgccgtggtgggggtggagcgtgcggcccagatgctgcagagcaataaaaatgttcacttatttatcaccggggagaagtag

SEQ ID NO: 11673 - DNA, 942 bp, Artificial Sequence
  Description of Artificial Sequence: Synthetic coding sequence
atgccaaaagtaaaatccggagccatcgggaggcgtcgaggacgacaggagcaacggagggagcttaaatccgctggcggccttatgtttaatactgggattggtcaacacatcctcaaaaaccccctgattatcaactccattatagataaagctgccctgaggccaacagacgtcgtactggaggtaggacctgggacgggtaatatgaccgtgaaactattggagaaggcaaaaaaggtggtagcctgcgagttggaccccagacttgttgccgaactgcacaagcgcgtacagggtacccccgtggcatccaaacttcaggtgctcgtgggtgacgtcctgaaaacagacctgccattcttcgacacgtgcgtcgcgaatctcccctatcagatatcctcaccattcgtgtttaagctactcctgcacagaccgttttttagatgcgctattctgatgttccaaagagagttcgcgctgcgcctggtagcaaaacccggagataagttgtactgtcggctttccatcaatactcagctgctagcccgagtggaccacctgatgaaggtgggaaagaataatttccggcccccccccaaggtggagtcctccgtggtgcgtatcgaaccaaagaacccacccccacccattaactttcaggagtgggatggcttagtcagaatcacgttcgtgcggaaaaataagaccctctctgcggcatttaaaagctccgccgtccagcagctgttagagaagaattacagaatccattgtagcgtgcataatattatcatacccgaggacttctctatagccgataaaatccagcagatcctgacctccaccggtttttctgataagcgggctcgatccatggatatcgacgacttcataagactgcttcacggttttaacgctgagggaattcatttttcatag

SEQ ID NO: 11674 - DNA, 4719 bp, Artificial Sequence
  Description of Artificial Sequence: Synthetic coding sequence
atggcagacagaggatgtccactggaggccgctcctttgccagcagaggtcagggaatcactggccgagctcgaattggagctgagtgaaggagatataactcagaaaggatacgaaaagaagcgtgctaaactgctagctcgctatattcccctgatccagggaattgatccatctctgcaagccgagaatcgcatcccgggtcccagtcagactaccgccgcagcacctaaacaacagaaatctcgtcctactgccagtagggacgagaggttccgcagcgatgtgcacacagaagccgtacaggccgccctcgcgaagtataaagaaagaaaaatgccaatgcctagcaaaagacgatctgtcctggtccactcctcagtcgaaacttatacgcccccagacaccagctccgcttctgaggacgagggaagcctgcggaggcctggtcgcttaacaagcacaccgctgcaaagtcatagtagcgtggaaccatggcttgatagggtgatacagggcagttcaacatcgtccagtgcctcatcaacttccagtcacccagggggcaggcccacaacagccccctccgctgctgcgacacctggagccgctgcaaccacagctctggcggggctcgaagcccatactcatatagctgaccttcactcggcgccacctgatgtgaccactggattggtggagcattcatatttcgagagaccacaggtggcaagcgtcaggtctgtgccccgtggatgctctggcagcatgttggagacagcagatggcgttcccgtaaattctagagtgtcatcaaagattcagcagttactgaatacccttaagcgccccaaaaggccgcctctgaaagaatttttcgtggatgattttgaagaacttctggaagtgcagcaacctgaccctaaccagccaaaacctgagggcagcgagacctctgtgctgagaggggaacccctgacagccggcgtaccacgcccacccagcttgctggctacactccagagatgggggacaactcaacccaaatccccttgcctcaccgccctggacacaacgggaaaagcggtgtacacactaacctatggtaaattatggagccggtctcttaagctggcttataccctgcttaataagctaacttcgaagaacgagcccttgcttaagcccggagatagagtggcgctcgtgttcccgaacagtgatccggtgatgttcatggtcgcattttatggttgcctgctggccgagttggtgccggtcccaatcgaggttccactgacccgcaaggacgcaggctctcagcaggttggattcctgctcggctcttgtggcgtgttcctggccctgaccacagatgcttgtcagaagggcctcccaaaagctcagaccggggaagtggccgctttcaagggatggcctccgctgagttggctcgtgattgacgggaaacacctggcgaaaccccctaaagactggcacccactggctcaggatacgggcaccggcactgcttatatcgagtataaaacgtcaaaagagggatcaacagtcggagtgaccgtcagccacgctagcctcctagcccagtgcagagctttgactcaggcctgcgggtacagtgaggctgagacccttaccaacgttctggatttcaaacgagacgcgggtctctggcacggggtcctgacatctgtgatgaaccgcatgcacgtggtctccgttccttacgctctgatgaaagcaaacccactgtcatggatccagaaagtttgcttctataaagccagggcggccttggtaaagagccgcgacatgcactggtccctgcttgcccagcgggggcagcgtgacgtgtccttgagctcattgcggatgctgatcgttgctgatggcgcgaatccttggagcatctcgtcatgtgacgcattcctgaacgtcttccaatctcgcgggctgcggccggaggtcatctgcccctgtgcaagtagcccggaggccctgaccgtcgccatacgccgccccccagatctcggcggcccaccgccacgcaaagccgtccttagtatgaacggtctgtcttatggtgtgattagagtagacacagaggagaaattgtccgtgctgaccgtacaggacgtaggccaagtgatgcccggcgctaacgtttgcgtcgtgaagctcgaagggacgccttacctgtgtaaaaccgacgaggtgggtgagatatgtgtgtcaagctccgcaacgggtacggcttactatggcctgctgggcattacaaagaacgtctttgaggccgtccccgttacaaccggcggggcacccattttcgacaggccctttacgcgcacaggtttgttgggctttattggcccagataacctggtgtttattgttggcaagctggacggtcttatggtaaccggggtccggcggcataacgccgacgatgtggtcgccacggctctagcagtcgaacccatgaagttcgtgtatcggggcagaattgctgtgttctctgttactgtgttgcatgacgaccggatcgtgcttgtggccgagcaacgccctgacgctagtgaggaagatagttttcaatggatgtcacgcgtgctgcaggccatcgacagtattcaccaggttggcgtctattgcctggccctcgtgccggccaatacccttccaaaggcccctctggggggcattcatatctccgaaactaaacagcgtttcctggaagggacgttacatccctgcaatgtcttgatgtgtccccacacatgtgtcacgaatcttcctaagcctcgtcagaagcagcccgaggtgggacccgctagtatgattgtgggcaatttagtcgccggcaagcggatagctcaagcttctgggcgggagttagcgcatctcgaggattccgaccaggccagaaaattcttgttccttgcggacgtattacagtggagggcacacactaccccagatcatcccctgttccttctacttaacgcaaaaggaactgtaacatcaactgctacctgcgttcaactccacaagagggcagaacgggtggccgccgccctcatggaaaagggaagactctcggtcggagaccacgtggccctggtttacccaccaggagttgacctaattgcggccttctatggctgcctgtactgtgggtgtgttcctgtgactgtcagaccgccacacccacagaatctgggcactacccttcccactgtgaagatgatcgtcgaagtctcaaagtccgcttgtgttcttaccacccaggcggtcacgcggttgttgagaagcaaagaagctgcagcagccgtggatatcaggacatggcctacaatcctggatactgatgatattcctaaaaagaagatcgccagcgtattcaggccacctagccccgacgtgctcgcttaccttgacttctcagtgagtaccacagggatcttagccggcgtcaagatgagccacgccgccacgtccgctctctgcagatcaatcaagcttcagtgcgaactatatcctagccgacagatcgccatttgcttagacccttactgtggcctgggttttgctctatggtgtctatgctctgtctacagcggtcatcagagcgtgctggttcctcctctggaactggaatcaaatgtgtcactctggctcagcgccgtgtcccagtacaaggccagggtcacattttgcagctactcagttatggagatgtgtactaagggtttaggggcacaaaccggtgtgctgcggatgaaaggggtcaacctgtcatgtgtaagaacgtgcatggtggtggccgaagagaggccccgaatcgccctgactcagtcgttttctaaattgttcaaggacctcggcctgccagctagagccgtgtctacgacatttgggtgcagagttaatgtggctatctgtttgcaggggacagctggccctgatcctactacagtgtatgtagatatgcgtgccctgcggcatgatcgtgttcgcctggtcgaacgcggcagtcctcactccctgcctctcatggaaagcggcaaaatcctacctggcgtcaaggtcataatcgctcatactgaaacaaaaggaccacttggcgactctcacctgggcgagatttgggtgtcgagcccccacaatgcgaccggctattataccgtgtacggcgaggaggcactgcacgctgatcacttctcggcgcgcctgagctttggtgatacccagacaatttgggctagaaccggctatctggggttcctccgacgcaccgaactgactgatgcctccggaggcaggcatgatgcattgtatgtggttggtagcctagatgagaccctggagctcaggggcatgagataccaccctatcgatatcgagactagtgtgatccgtgcccatcgctctatcgcagagtgtgctgtgtttacgtggacaaacctcctggtggtggtagtcgaacttgatggcctagaacaggatgccctcgacttagtggctctggttaccaatgtcgtactggaggagcattaccttgtggttggagtggtcgtgattgtcgaccctggggtgatccctatcaactcccgcggggagaagcagcgcatgcatctgagggacgggttcctagccgatcagctagatcctatttacgtggcctataatatgtag

SEQ ID NO: 11675 - DNA, 2394 bp, Artificial Sequence
  Description of Artificial Sequence: Synthetic coding sequence
atggcagatcgggggtgtcctctcgaggcagccccactgcccgctgaagtgcgagaaagcttagccgagctggaactggaactgagcgaaggtgatattacccaaaagggctacgagaagaagcgagcaaagctcctggcccgctatataccgctgattcaggggatcgatccttcactgcaagctgaaaatagaatacctggcccctcgcagactacggcagccgcacccaagcagcagaaatctcgaccaaccgcctcgcgcgacgaacgcttccgatctgatgttcacaccgaagctgtgcaggctgctcttgctaaatacaaggaacgcaaaatgcctatgcctagcaagaggaggagtgttctggtgcactcttcagtggaaacctacacccctcctgacacttctagcgcttctgaagacgagggcagcctccgccggccagggcggctcacctccacacctctgcaatcgcactccagcgtcgagccttggctagaccgtgtcatacagggctcttccacctcctcatccgcaagctcaacctcctcacatccgggcggaagacccactacagcaccctccgctgcggctacacctggcgccgctgcgactaccgctctggccggcttggaggcccatacacatattggagtccctgttaatagccgtgtgtccagcaaaatccagcaacttttaaataccttgaaaaggcccaagagaccccccctgaaagagttcttcgttgatgacttcgaggagcttcttgaagttcagcagccagacccaaaccagcccaaaccggagggatccgagacatccgtgctgagaggagaacccctcaccgcaggtgtcccgaggcccccaagcctgctggctaccctgcagagatggggaacaactcagcccaagtcaccatgcctcaccgcactcgatacgacaggcaaggccgtttacacccttacttatggaaagttgtggagtagatctctcaagctcgcctatactttactgaataaactgaccagcaaaaacgaacctctattgaagccgggcgaccgagtggcactggtgtttccaaatagtgatccggttatgtttatggttgccttctacggttgtctgttggctgaacttgtgcccgtgcctatagaagtccctctgaccaggaaggacgctggctcccaacaggtgggattcctgctgggaagctgcggcgtgttccttgcccttacgactgacgcctgccagaaaggactgccgaaagcccaaaccggagaagtggccgcgtttaaaggctggcccccgctgagttggcttgtgatcgacgggaaacaccttgctaagccgcctaaggattggcaccccctcgcccaagacaccggcaccggaacagcctacatcgagtacaagacatcaaaggagggaagcaccgtcggtgtcaccgtgtctcatgcctcccttttagcccagtgcagggccttgacccaggcttgcggatatagcgaggccgagaccctcactaatgtgctcgatttcaagcgcgacgcggggctgtggcatggggtgttgacaagcgtcatgaacaggatgcatgttgtttccgtgccctatgccttgatgaaagcaaatcctctctcctggatccagaaagtttgtttttacaaggctcgcgccgctctggtgaagagtcgcgatatgcactggtcccttttggctcagagagggcagagagacgtgtctctttcgtcactccgcatgctgatcgtggcggacggagcgaatccctggagcatcagcagctgtgacgccttcctgaatgtgttccagtctcggggactcaggcctgaggtgatttgtccatgcgcatcttctcctgaagcattaactgtggccatccgcagaccgccagacctgggcggacccccccctcggaaagctgtgttaagcatgaatggactgtcatatggggtgatcagagtcgacacagaagaaaagctcagcgtgctcactgtgcaagatgtgggacaagtcatgcccggggccaatgtgtgtgtagtgaaattagaaggaaccccctatctgtgcaaaacggatgaagtcggtgaaatctgtgtgtcaagctccgccacaggtacagcctactacggcctgctcggtattaccaagaacgtgtttgaagcagtacccgtgaccaccggcggcgctcctatctttgatcgcccctttacaaggacagggcttctcggctttattgggcccgacaacttggtctttattgtgggaaaattggacggcctcatggtaactggcgtgcgaagacataacgccgacgacgtcgttgcgaccgccctggccgtggagccgatgaaattcgtttaccggggctag

SEQ ID NO: 11676 - DNA, 4704 bp, Artificial Sequence
  Description of Artificial Sequence: Synthetic coding sequence
atggcggaccgcggatgcccgctggaagctgcccccctgcctgccgaagtccgggaatccctggcggagctggagctggaactctctgagggtgatattactcaaaagggctacgagaagaaacgcgctaaactgctggctagatacattcctttaatccaaggaatcgaccccagtctccaggccgaaaatagaatccccggaccaagtcagaccacagccgctgctccaaaacaacagaagtctagacccaccgcctcgcgcgatgagagattcagatccgatgtgcacaccgaagctgtacaagccgccctcgctaagtacaaagagagaaaaatgccaatgccttccaaaagacgctccgtattagtccacagtagcgttgagacttacacaccccccgatacaagcagcgcttcggaggatgaggggagcctacgccggccagggagacttacttcgacccctctccaaagccactcttcggtggaaccctggctggaccgagtaatccagggaagctctacttcgtcttctgccagtagtacatcatcccatccaggcggaagacccactacagcaccctctgccgccgcaacacccggagcagccgcaacaactgccctggcaggactcgaggcgcacacgcatatcgatttacactcagctcctccagacgtcacaacagggcttgtagagcactcctactttgagagaccgcaggtagcctctgtgcggagtgttccacgcggctgctccgggtcaatgctggaaacagcagatggagtcccagtgaattcaagagtctcttcaaagatccagcagctcctgaacaccctcaagagacctaagcgacctcccctgaaggagttctttgtggatgactttgaggagctcctggaggacccaaatcagcccaagcctgaagggagcgaaactagcgtgctcagaggagaaccgcttactgccggtgtgccacggccacctagtctgttagctaccctgcagagatgggggactactcagccgaagtcaccttgtttgaccgccctcgacacaaccggcaaggccgtgtacaccttgacctatggaaaactgtggtctagatctctgaagctggcttatactctgctcaataagctgacctccaagaacgaacccttactcaagccaggcgaccgcgtggctctcgtcttccctaactctgacccagtcatgttcatggtggccttttacggttgcctgctcgccgaactggtgcctgtcccgatcgaagtccccctaacaaggaaggacgcaggcagtcagcaggtgggatttttgctcgggagttgtggagtgtttctcgcactgacaacagatgcctgccaaaaggggctgccaaaggctcaaaccggggaggtagctgcgtttaaaggttggccccctctctcatggctggttattgacggcaaacacttagctaaaccccccaaggattggcatccccttgctcaggacacggggaccggaacagcatatattgagtataagacgtcaaaagaggggtcgactgttggtgtgactgtgtcccacgcatccctgctcgcccagtgtcgggccttgacccaggcctgcgggtactcagaggcagaaacgttgactaacgtcctggacttcaagcgtgatgctggcctttggcatggcgtgttgaccagcgtgatgaacagaatgcacgttgtgagcgtgccatacgccctcatgaaagccaaccccctctcttggattcaaaaagtatgcttttacaaagcccgtgccgccctggtcaagagcagggacatgcattggtccctgctggctcagcgtgggcagcgtgatgtcagccttagctctctgaggatgctcattgtggccgacggggctaacccttggagcatcagctcatgcgacgcattcttaaacgtgttccaatccaggggtcttcgacccgaggttatctgcccctgtgcctcctctccagaggctctgaccgtggccattagaagacccccagacctgggaggaccccctccccgcaaggcagtcctttcaatgaatggcttgagttacggtgtgatccgggtggatactgaggaaaaactgtcagtcttgactgtgcaggacgttggtcaagtcatgccaggcgcgaatgtgtgtgtggtcaagcttgagggcactccctacctttgtaagaccgacgaggtgggtgaaatctgtgtttccagttctgccacaggcacagcctactacggcctcctcggcataactaagaatgtctttgaagctgtgccagtgaccacgggcggcgccccgatcttcgatcgacctttcacccggacaggcttgctggggttcatcggccccgataacctcgtgtttattgtgggaaaactggacggtctgatggtcactggagtacggcggcataacgccgacgacgttgttgcgacggcactagcagtggagcccatgaaatttgtttacagggggcgaatagcggtgttttccgtaactgtgttgcacgatgatcggattgtacttgtggctgagcagcgacctgatgcgtccgaggaggacagttttcagtggatgtcccgcgttctccaggcgatcgactccattcatcaagtcggcgtctattgtctcgctcttgtgccagccaacactcttccaaaggcccccttgggagggatccatatctctgaaaccaagcagcgattcttggagggaaccctgcatccttgtaacgtgctcatgtgcccccatacctgtgtgaccaatcttccaaaaccaagacagaagcaacctgaggtggggccagcaagcatgatcgtgggaaacctggtagcaggaaaacgcatcgcacaagcatcagggagagagctcgcacatcttgaggactccgaccaggctagaaagtttctatttctcgccgacgtcttacaatggagggcccacacaaccccggatcatccactctttttgttgctgaacgcaaaggggaccgtcaccagtactgcaacttgtgtgcagttgcataagcgcgccgagagggtcgccgcagcccttatggagaagggaagactgtcagtgggagatcatgtagcgttagtttatccaccaggcgtggatctaatcgcagccttttacggatgcctctattgcggctgcgtccctgtaactgtgaggcctccccacccacagaacctcggcacaaccctccctactgttaagatgatcgttgaggtgtcaaagtctgcctgtgtcctaacgacccaggcggttacgaggttattgcggtctaaagaagcagccgctgccgtcgatattaggacctggccaaccatccttgatacggatgacattccaaaaaagaagatagcaagcgtcttccgaccaccaagtcctgacgtgctagcttatctggacttcagtgtcagcacgacaggaatcctcgctggagtaaagatgtcacatgcggccactagcgctctttgccgtagcattaagctacaatgcgaattatatccctctagacaaatcgcaatctgcctcgacccttactgtggcttgggcttcgctctctggtgtctttgctctgtgtacagcggccaccagagcgtgctggtcccccctttagaactggagtcaaatgttagcctgtggttgtccgctgtgagtcagtacaaggctagagtaaccttctgttcttattctgtgatggagatgtgcacaaaaggactgggggcccagacgggagtgctgaggatgaaaggagtaaacttaagttgcgttaggacctgcatggtggtggcggaggagcgtcctagaatcgctctcacccagagcttcagcaagctattcaaagacctgggactgcctgcccgcgccgtgagcacaaccttcggctgtagggttaatgtggcaatttgtctgcagggaaccgcagggcccgaccccaccacagtgtacgtggacatgagggcattgagacatgatcgggtcagactcgtagagcgggggagtccgcattcactaccactcatggaatctggaaagattttgcccggagtgaaggttattattgcccacacggagactaaaggccccttgggagattcgcacctgggcgagatctgggttagtagtcctcacaacgctacaggctattatacagtctatggggaagaggccttgcacgctgatcatttctctgctcggttgtcctttggcgatacccagactatatgggccagaaccggttacctcgggtttcttcgtcggactgagcttacggatgcaagtgggggtcgacatgatgcactgtatgtcgtgggctctttagacgagacgctggagctgagagggatgagatatcaccccattgatatcgagacttctgtcatccgggcacaccggagtatcgctgaatgtgccgtgtttacttggaccaatctactggtggtagttgtcgaattagacggcctcgagcaggatgcactcgaccttgttgctctcgttacaaatgtcgttctagaggaacattacctggtggtgggtgtagttgtgatcgtggaccccggagtcattcccatcaattcgcgcggggaaaagcagaggatgcaccttcgcgacggctttctcgctgaccaactggacccaatctatgttgcttacaacatgtag

SEQ ID NO: 11677 - DNA, 4716 bp, Artificial Sequence
  Description of Artificial Sequence: Synthetic coding sequence
atggctgacaggggttgcccccttgaagctgcacctctcccggccgaagtgcgagagtcgctggcagagctggaactcgagctcagtgaaggggacataactcagaaggggtacgagaagaagagggcaaaactgctagctcggtatattccactgattcaagggattgacccttctctgcaggccgaaaaccgcatccctggcccatcacagaccaccgcggccgctccaaaacagcagaagagtcgtccgacggcaagccgtgatgagcggttcagaagtgatgtgcataccgaggccgtgcaggcagcacttgccaagtacaaagaacgtaagatgccaatgcccagtaaacggcggagtgtcctggtgcactcaagtgtcgagacatacacaccacctgacacctcatcagcaagcgaggacgagggatcactgaggcgacccggccgcctcactagcacacctcttcagagtcactcaagtgttgaaccctggcttgaccgagtgatccagggatcctctacgagcagttccgcctcctctacgtccagtcatccagggggtcgaccaaccacagctcccagtgcagcagccacgccgggggccgcggccaccacagctctagctgggctcgaggctcacactcacatagatcttcactccgcccctccagatgtcactactgggctggtggagcacagttactttgaaagacctcaggtggcttcagtgcggagcgtaccacggggttgcagtggctcgatgctcgagacggcagatggggtgcccgtgaactccagggtgagctctaaaatccagcaattgctgaatacacttaaacggcctaaaaggccccccctcaaggagttcttcgtggacgactttgaagaactcttggaggttcagcagccagacccaaatcagccgaagccagaaggatccgagacctcagtgctgaggggggagcctcttacagctggagtcccacggcccccctccttattggccacattgcagaggtggggcaccactcaacccaaaagtccatgtctcacagcgcttgacaccacaggcaaagcagtgtacactctgacatacgggaaactgtggagtcggagcctcaagctcgcatataccctcctgaacaaacttacatccaaaaacgaaccactgctgaaaccaggcgatagggtggcactcgtgttccctaactctgatcctgttatgttcatggttgccttttacgggtgcctgttagctgagctcgtgcctgtgcctatcgaagttccactgaccaggaaggacgcgggctcccagcaagtgggtttcctcctcggttcctgtggtgtgttcttagctctgacgaccgacgcctgtcagaagggcctgccgaaggcacagacgggagaagtcgctgcgtttaaaggctggcccccgttgagttggctcgtgattgacggaaaacatttggctaaaccaccaaaggattggcacccgctggcccaggacacaggaacaggcacagcatacattgaatacaaaacatccaaagaaggtagcaccgtgggagtgactgtctcccatgcgtcccttctggcccagtgtcgggcactgacgcaagcatgtggctacagtgaagcggaaactttaactaacgtgctggattttaagcgggacgccgggctgtggcatggggtcctcacatccgtgatgaatcgcatgcatgtggtgtctgttccctacgcattaatgaaggccaatccactgtcatggatccaaaaagtatgcttctacaaagctagggctgcacttgtgaagtcacgggacatgcattggtctctgctggcgcaacggggccagcgagatgtatctcttagctcactgcgcatgctgattgtggcagacggggccaatccttggtcaatttctagctgcgatgcttttctgaacgtgtttcaatcccgcggactcagacccgaagtgatctgcccctgcgccagctctcccgaggccctgaccgtggccatcaggagacccccggacttaggtggcccgcccccccgtaaagcagtgttaagcatgaacggactttcatacggcgtgatcagggttgatacggaagaaaagcttagcgtattgaccgtacaagatgttggacaggtaatgccaggggcgaatgtgtgtgtcgtaaaactcgaaggtacgccatacctgtgtaaaaccgatgaggttggtgagatctgtgtttcttcctcagcaactggcaccgcttattatgggcttcttggaattaccaagaatgtatttgaagcagtgccggtcactacaggtggtgcacctatcttcgataggccattcaccaggactgggcttctgggattcataggcccagataatctagttttcattgtgggaaagctggatggtcttatggtcacaggtgtccgcaggcataacgccgacgatgtggtcgccaccgccttagccgtggagcccatgaaatttgtttaccggggacggatagcggttttttccgtgacagtcctgcatgatgatcggattgtgttggtagcggaacagagacctgacgctagtgaggaagattctttccaatggatgtccagggtgctgcaagcgatcgattccatccatcaggtgggagtgtattgcctggctcttgtgcccgcaaacacactgcctaaggcccccctggggggaattcacatctccgaaacaaagcagcggtttctagagggaactctgcacccctgcaacgtgctgatgtgcccgcatacttgtgtgaccaacttaccaaaaccacgccagaaacagccagaagtcgggcctgcctctatgatcgtcggtaatttagtcgccggaaagcgcatcgcacaggcctctggcagagagctcgcacatttggaggatagcgatcaggcccggaagttcctctttctcgctgacgtgctgcaatggcgcgcccatacaacgcccgatcacccattattcttgctgctgaacgccaagggcaccgtcacttccaccgccacgtgtgtgcagctacataaacgggcggaaagagtggccgcagccctcatggagaagggacgcctgtccgtgggcgaccatgtggccctagtctaccctcctggggttgatctgattgcagctttttacgggtgtctttattgcggatgcgtgcccgtaactgtgcgcccacctcatccacaaaatctgggaactacgctgcccacagtgaaaatgatcgtcgaggtatctaagtcagcctgtgttttgaccacacaggctgtgacacggttactgcgcagtaaagaggccgccgccgcggttgatattcgtacttggcctactatacttgacaccgatgatatccctaagaaaaagatagcaagtgtctttcgcccgccttcccccgatgtcttagcctatctggatttttctgtgagtacgaccggcatcctggcgggggtgaaaatgtcccacgccgccacgtctgcactctgtcgatccattaagctacagtgtgaattgtacccttcacggcagatagcaatatgcctcgatccttattgtggcctgggctttgccctctggtgtctctgctccgtatactctggccaccagtctgttctggtgcccccgctggagctcgagtctaatgtcagcctgtggttgtctgcagtgtcgcaatataaggcaagggtgacattctgctcttattccgtgatggagatgtgcactaagggcttaggggcgcagacaggtgtgcttagaatgaaaggggtgaatctgtcttgcgtgcggacttgcatggtggttgccgaagaacgcccgcgaatagcactcacacaatcattctcaaagctctttaaagaccttggccttcctgccagagcggtcagcacaactttcggttgccgcgtgaatgtggctatctgcctgcagggaaccgcaggtcctgaccccaccacagtgtatgttgatatgagagccctcagacacgacagagtgagacttgttgagcgggggtctccacacagtttgcccctgatggaatccggcaaaattctgccgggtgtaaaggttataattgcgcacacagagaccaagggtcccctaggcgacagtcacctcggggagatctgggtaagctcccctcataacgcaaccggctactatactgtgtacggcgaagaggctctacatgcagaccatttctctgcacggctcagcttcggcgatacccagactatatgggccagaacggggtacctggggtttttgcggcggactgaactgacggacgcatctgggggccgccacgatgccctttacgtcgtcggtagcctggatgagaccctggaacttaggggcatgaggtatcaccctatcgacattgagacctctgttatccgagctcacaggtccattgccgagtgtgctgtctttacgtggacaaacctccttgtggtcgtagtagaactggatgggcttgaacaggacgccctcgatttggtcgccctagtcaccaacgtggtgctcgaagaacactacctcgttgttggtgtcgttgtcatcgtcgaccctggagttatccctatcaacagccggggcgaaaaacagcggatgcacctcagggatggtttcctcgccgaccaattagatccaatctatgttgcctacaatatgtag

SEQ ID NO: 11678 - DNA, 3333 bp, Artificial Sequence
  Description of Artificial Sequence: Synthetic coding sequence
atggcagataggggatgcccgctggaggcggcgccgttacccgccgaggtgcgggaatcccttgctgagcttgaactggagctttccgaggacgtgcacaccgaagctgtccaagcggcactggctaagtacaaggaaaggaagatgcccatgccgtccaagagacgcagcgttctggtacatagctctgtggagacctacaccccccccgacacatcttccgcatctgaggatgaaggttccttaaggcgacccggaagacttacctccacaccgctccagtcacattccagcgtggaaccatggctcgatcgagtcattcagggctccagcactagtagctccgctagctccacctcaagccacccaggcggccgaccaacaactgccccctccgccgctgccactcctggggctgctgcgactaccgcgctggctggtctggaggctcacacacacatcgatctgcattctgcccctccagatgtgaccactggactggtcgaacacagttactttgagcggccccaagtcgcatcagtaaggagcgtacctcggggctgctccggctccatgctggagaccgctgacggcgtgcccgttaactcccgcgttagttccaaaatccagcagttactcaatactctgaaacgtcccaaaagaccccctctgaaagagttcttcgtggatgacttcgaggagctgcttgaggttcaacaacccgaccccaatcagcctaaaccagagggcagcgagacatcagtgctccggggcgagcccttgacggcgggggtcccgagacccccttccctgctggccaccctccaacgttggggtacgacacagcctaaatccccctgtctaactgctctggacactactggaaaggcagtgtataccttgacctacggtaagctatggtcccgcagccttaagctagcttacactctcctgaacaagctgacatccaaaaatgaaccactgttaaagcctggcgaccgagtggccctcgtgttcccgaattccgacccggttatgttcatggtagccttttacggatgtctactggcagaactggtgccggttcctatagaggtgcctcttacaagaaaagacgcaggttctcaacaggttggctttttactggggagctgcggcgtttttcttgccctgacaaccgacgcttgtcagaaaggactgccaaaagcccagactggcgaagtcgcagcatttaagggctggccacccctgagctggcttgttatagatggaaaacatctggctaagccccccaaggattggcatcccttggcacaggatacaggcaccgggacagcatatattgaatataagactagcaaggaaggatcaactgtgggggttaccgtctcacatgcctctctactggcccagtgccgtgcactgacccaagcttgcgggtacagcgaggcagagacactcactaatgtcctggatttcaaacgggacgccggcctgtggcatggagtgttgaccagcgtgatgaatcggatgcatgtggtgagcgtgccctacgccttaatgaaggccaatcctctgtcctggatccaaaaggtatgcttttacaaggctcgagccgctcttgtgaaaagcagagacatgcactggagcctgctggcccaacggggtcaacgggatgtaagcctgtctagcttacggatgctgatcgtagcggatggggcaaatccatggtccatctcttcttgcgatgcctttttgaatgttttccagagtcgcggcttgcggccagaagtaatctgtccctgtgcttcctcacctgaagcattaaccgtggctattcgccgaccacccgatctcggcgggccacctcccagaaaagccgttctatcgatgaacggactcagctacggtgtcattagggtcgacaccgaagagaagctgagcgttctgacagtacaagatgtgggccaagtcatgcccggggcaaatgtttgtgtcgtgaaactagaaggcacaccatacctgtgtaagacagatgaggtgggcgagatttgtgtttcatcatccgccactggaaccgcgtattacgggctccttggtattacaaagaatgtgtttgaggccgttcctgtaaccactggcggtgctccgatcttcgatcgcccatttacgaggaccggcttgctcggcttcatcgggccagataatctagtgttcattgtgggaaaattagatggactgatggtcaccggcgtgcggaggcacaacgccgacgacgtggtagccacagcgttggcagtagaaccaatgaaatttgtgtaccgcggacgcatcgctgtgttttccgtgactgttcttcacgacgatagaatcgtcctggtggcagagcaacgtccagacgcgtcggaggaagacagctttcagtggatgtctcgtgtgttacaggctattgactccattcatcaggtcggcgtgtactgcctggccctggtgccggcaaatacccttcccaaagcgccgctcggaggaattcacatttccgaaaccaagcaaagatttcttgaagggacgctccatccgtgtaacgttttgatgtgtccgcacacctgcgtgacaaacctccctaagcctagacaaaagcagccagaagtgggaccagccagtatgattgtgggtaatctggtggcaggcaagcgcatcgcgcaggcaagtgggcgcgaactggctcatcttgaggattccgatcaggcccgtaagttcctctttttggcagacgtactccagtggagagcacacacgacgcctgatcaccccctcttcctcctgctgaacgctaagggaaccgtcaccagcacggccacatgcgtacagctccacaagcgggctgaacgagttgctgctgcactgatggagaagggaagactgagcgtgggcgatcatgtggccctagtgtacccgcccggggtggacctgattgcggcattttacgggtgtctctattgtggatgtgtcccggtaacagttcgcccgccacacccacagaacttgggaacaaccctcccaaccgtaaagatgattgtcgaggtaagcaagtcagcctgtgtgctgaccacacaggctgtgactcgcctgctacgtagcaaagaggcagcagctgcagtggacattcggacatggcccaccattctcgataccgatgatatacccaaaaagaagatagctagtgtgtttcgaccaccatcccccgacgtcctcgcatatctcgattttagtgtgtctacaactggaattctcgcgggtgtgaaagccgggcggggtggcagccgcctgtag

SEQ ID NO: 11679 - DNA, 2526 bp, Artificial Sequence
  Description of Artificial Sequence: Synthetic coding sequence
atggcggacagagggtgccctctggaggcagcacccctcccagctgaggtgcgcgagtcacttgctgagctcgaattggagttgagcgaaggggacattacccaaaaggggtatgaaaagaagcgagcaaagctcctggctcgctatattcctcttatacagggaattgatccgtccctgcaggccgagaaccgtataccaggacctagtcaaaccacagcagcagcccctaagcagcagaagtccaggccgactgctagtagagatgaacgcttccgatctgatgtgcacaccgaagctgttcaggcagcactggctaagtacaaggagcgcaaaatgccaatgccctccaagcgcaggtccgttttggtgcactcatctgtcgaaacctatacacctccagacacaagttccgcttcagaagatgagggctctctgaggaggccaggcagacttactagcaccccactgcagtcacattcatcggtagagccttggttggatcgggtgattcagggttcgagcacctcctcaagcgcctcatcaacgagcagtcatcccggcggtcgtcctacaacagccccatcggccgccgcgacccctggggcagcggcaacgacggccttggcaggcctggaggcgcatacacacattgatttgcactctgcgcctcccgatgtcacaacgggtttggtggaacactcctactttgagcgacctcaggtggcctcagtacgatcggtgccgagagggtgttctggtagcatgttggagacagcagatggcgtacccgtgaattcaagagtttcttctaaaattcagcagttactcaacacgttaaaacgacccaaacgacctcctctgaaagaattttttgtcgatgattttgaggagttactggaagtgcagcagccggaccccaaccagcccaagcccgagggctccgaaacctccgtgctgcggggcgagcctctgaccgctggcgtgccgaggcccccctcactcctggcaaccctgcagcggtgggggacaacgcagccgaagagtccgtgtttaaccgccctcgataccaccgggaaggccgtctataccctgacgtatgggaagttgtggagcaggtccctcaagctggcctacacactgctaaacaaattaacatctaaaaacgaaccccttttgaagccaggcgaccgggtggcactggtcttcccaaactctgacccagtaatgttcatggtagccttttatgggtgcctgttggctgagctcgttccagtgcctattgaggtacccctaactcgcaaagatgctgggtcacagcaggttggattcctgcttggctcctgtggcgtgttcctggcccttacaaccgatgcctgtcagaaagggctgcctaaggcgcaaactggagaagtggcagcgtttaagggctggcccccgctttcctggctcgttatcgacgggaaacatctcgctaaacccccaaaggactggcaccccttggcccaggacacggggaccggcacagcttacatcgaatacaaaacctcaaaggaaggctcaacagtcggggtgactgtatcacacgcttccctattagctcaatgcagggcacttacccaggcatgtggatactctgaggcggagacgctgacgaacgttctggatttcaagcgcgatgcagggctttggcacggtgtactgacctctgtgatgaatcgtatgcatgttgtcagtgtaccatacgcactcatgaaggcgaatccgctctcctggatccagaaggtatgtttttacaaggctcgggccgccctagtcaaatctcgggacatgcactggagccttctcgcgcaacgtggccagcgagacgtgagcctctcatccctgaggatgctgattgttgccgacggagcaaacccgtggagtatttcctcatgtgatgcgttcctgaatgtctttcaatctagaggtttgaggccggaggttatttgtccgtgcgcctcctccccagaggcacttaccgtggccatacgccggccacctgacttgggcggcccaccaccacgcaaggccgtgctcagcatgaatgggctgagttacggcgtgatccgagtcgatactgaggagaagctttccgtccttacggtacaggacgttgggcaggttatgcccggtgcgaacgtttgcgtggtcaagctcgaaggaaccccttatctgtgcaaaaccgatgaggtaggtgagatttgcgtgtcctcctcggccactggaaccgcctactacggattgctgggcattactaagaatgtgttcgaggcagtccctgtgacaacgggcggcgcacctattttcgatagaccttttacccggaccggtctgctggggtttataggccctgataacctggtctttattgtgggaaaactggatggattgatggttacgggagtgaggcggcataatgcagatgatgtcgtggctaccgccctggctgtagaaccaatgaaattcgtgtaccgggggagatag

SEQ ID NO: 11680 - DNA, 2670 bp, Artificial Sequence
  Description of Artificial Sequence: Synthetic coding sequence
atggcagacaggggctgcccactggaagccgctcctttgccggccgaggttagggagtctctcgccgagctggagctggaactttcagaaggcgatattacccagaagggttatgagaagaaacgtgctaagctacttgcccgttatattcccctaatccagggcatcgacccgtctctgcaggccgagaatcgcatccctggcccatctcaaacaaccgccgctgcaccaaaacagcagaagagccgaccgacagcatctagagatgagcgttttagatcggatgtgcacactgaggcagttcaagccgccctagccaagtacaaagagcggaaaatgcccatgccaagcaagcgacggtcagttcttgtgcacagttcggtggagacatatacacctcccgacacatcttccgcctccgaagatgagggaagcctccggcgcccagggagattgaccagtacgccgctgcaatctcacagttcagtggagccttggctcgaccgtgtgatccagggatccagtacatcatcatccgcctcctctacttcaagccacccagggggaaggccaacaactgctcctagtgccgctgccacccctggtgccgccgcaactactgcattggctggcctagaggcacatacacacatcgatctgcatagtgcgcctcctgacgttactacagggctcgtggagcatagctatttcgagcgcccacaggtagcgtccgttaggtccgtaccgcggggctgttcagggagcatgttggaaactgcagacggagttccagtgaattctcgtgtctcttccaagattcagcagctactgaatacccttaagcgtccaaaacggcccccgctgaaagagtttttcgtggacgactttgaggaattgctcgaagttcagcagcctgatccaaaccagcccaaacctgagggttccgagacatctgtgctaagaggggaacctctgaccgccggtgtgccccggccccccagtctgctggctaccctacagcgctggggcacaacccagccgaagagcccatgccttacagctctggacacaacgggaaaggcagtgtatactttaacttatggtaagctttggtctagatcccttaaattagcttacacactcctcaataagctgacgtctaagaacgaacccttattaaagccgggagaccgggttgcactggtctttcccaatagtgatccagtgatgtttatggtggcattttatggctgcctcttggccgaattagtacccgtccctattgaggttccgctaacacggaaggacgctggttcacagcaagttggatttctgctcggcagctgcggggtctttctggcactgacgactgacgcatgtcagaaaggtttgccaaaagctcagacaggagaagtcgctgctttcaaagggtggcctccactgtcctggctggtaattgacggaaagcacctcgccaaaccgccaaaagactggcaccccctggctcaagataccgggaccggcaccgcgtatattgaatacaaaacctccaaggagggctccaccgtgggcgtgacggtctcacacgcttctctcctcgcgcagtgccgagccctcacacaagcctgtggttacagcgaggcagaaacccttactaatgtcctggatttcaaaagggacgccgggttatggcatggggttctgaccagcgtcatgaataggatgcatgtcgtgtctgtgccgtatgccctgatgaaggcaaatcccctgagctggatccaaaaagtttgcttctacaaggctagggcagctctggtcaaatctagagacatgcattggtccctgctcgctcagcgcggacaaagggatgtgagcctgtctagtcttaggatgctcatcgtggctgatggcgcaaatccgtggtcaatcagtagttgcgatgcatttttgaacgtgtttcagagccgaggcctgagacccgaggtcatctgcccatgtgcctcatcccctgaagcgctgaccgtcgccatcaggcgaccaccggaccttggagggccgccaccgagaaaagccgtgttgtcaatgaacggacttagctatggggtcatacgcgtggacacagaagagaagctgtccgtgctgacggtccaggacgtagggcaggtcatgcctggtgctaatgtctgtgtggtcaaacttgagggcacaccatacttgtgcaagaccgatgaggtgggtgaaatttgcgtctccagctccgccacgggcactgcttactacggtctgttgggaataacaaaaaacgttttcgaagctgtgccagtaactactggtggcgcccccatctttgaccggcccttcacaagaacaggattgctcgggttcattggtcctgacaaccttgtgttcattgtcggtaagttagatggactcatggtcaccggcgtgcggcggcacaacgccgacgacgtagtggctactgcccttgctgtggaaccaatgaaatttgtatacagaggcagaattgcagtgttctctgtgaccgtgcttcacgacgatcggatcgtgttggtggccgagcaacgtccggacgctagcgaagaagactccttccagtggatgagtcgcgtgctacaggtcggtgcccctgcaagaccaatggtgagatag

SEQ ID NO: 11681 - DNA, 2397 bp, Artificial Sequence
  Description of Artificial Sequence: Synthetic coding sequence
atggccgaccgaggctgtccgttagaagccgccccacttcccgctgaagtgcgagagagcctagctgagctggaattggaactctccgaaggtgatataacccagaaagggtatgaaaagaagagagcaaagctgttagcaagatatattcctctgatccaggggatcgatcccagtctacaggcggagaatcggatccctggaccctcacagaccacagcggccgccccgaagcagcagaagtctcgccccacagcatccagagatgaacggttccggtccgatgtgcataccgaagcggtccaggccgcgctggccaaatataaggaaagaaagatgcctatgccaagcaagcggaggagtgtgctggtgcacagctctgtcgagacttatacaccaccagatacgtcctctgccagtgaggatgaggggtctctgcgcaggccaggccgtttaacatctactcctctgcagtcccatagctcagtcgaaccctggctggaccgcgtgattcagggttcatccacttctagtagcgcaagctcaacctctagccacccagggggacggcctaccacggccccaagtgcggcagcgacccccggcgccgccgcaactaccgccctggccggattggaagctcatacgcacataggggttccagtaaactcccgtgtgtcctccaagatccagcagctgttaaatacactgaaaaggcctaagcggccgccactgaaggagttctttgtggatgactttgaggaattattggaagtacaacagccagatccgaatcaaccaaagcccgaaggcagcgagactagcgtcttgaggggggagcctctgaccgcaggggttccccgcccccctagcctcctggctaccttgcagagatgggggactacacaaccaaagtccccttgcctaaccgctctggacactacaggcaaggcagtctatacgttaacttatggtaaactgtggtctcggtcacttaagttggcatatacgctgctaaacaagctgacatcaaaaaatgagcctttgctgaaaccgggcgacagggtggctctggtcttccctaattcagaccccgtgatgtttatggttgcattttacgggtgtctgctagccgaactggtgcctgtccctattgaggtgccactgacacggaaggatgccggctcccagcaggtgggattcctgttgggcagttgcggtgtcttcttggctctaacaaccgatgcctgccagaagggtctgcctaaggcacagacaggcgaagtggctgctttcaaggggtggccccccctgagttggttggtcattgatggaaagcacttggctaaaccccccaaggactggcaccctctggctcaggacactggaactggtacggcctacatcgagtacaagactagcaaagaaggctcaactgtgggggtgaccgtgagccatgccagcctcctggcccagtgcagggctttgacacaggcctgcggctattcagaggctgagaccctgaccaacgtgctggatttcaaacgcgacgccggcctgtggcacggagtcctcacaagcgtgatgaaccgcatgcacgtcgtcagcgtaccatacgccctgatgaaggcaaatcctctgtcttggatacagaaggtgtgtttttacaaagcccgagctgcccttgtcaagagccgagacatgcactggagtcttctcgcccagagaggccaacgcgacgtgtctctatcttcgctgcgcatgctgatagtggctgacggagcaaacccatggagcatttccagctgcgacgcttttctgaacgtcttccagtccaggggcctgagacccgaagtgatttgtccctgcgcttcaagcccggaggcactaaccgtggccattaggcgtccccctgacctaggcggcccacctccccgcaaagccgttctgtctatgaacggcttaagctacggagtcatccgggtcgatacagaagagaagctctctgtgttgactgtgcaggacgtgggccaggtgatgcccggggcgaacgtatgcgtggtaaaattggaaggaaccccctatctgtgtaagactgacgaggtgggcgagatatgcgtgagcagctcagccacagggactgcctactatggcctattagggatcaccaagaatgtgtttgaagcagtgccagtgactacaggaggagcgcccattttcgatcgaccctttacccgcaccggcttgctgggcttcatcggacccgataatctggtgtttatcgtggggaagcttgatgggttaatggttaccggcgttcgcagacataacgccgacgacgtggtggcgacggccctagccgtggaaccaatgaaattcgtgtacaggggaaggtag

SEQ ID NO: 11682 - DNA, 1515 bp, Artificial Sequence
  Description of Artificial Sequence: Synthetic coding sequence
atggagcgatcgcagtgtgggtcaagggatagaggggttagcggcagaccgcacctggcccctggcctggttgttgccgcacctccccccccttccccagctctgcccgtgccaagtggcatgcaagtgccacccgctttcctgaggccaccctccctcttcctgcgtgccgctgccgctgccgccgctgcggcagctgccactagtgggtctggcggttgtccgccagcccctgggctggagtcaggggttggcgccgtaggctgtggctaccctaggaccccaaagtgtgccaggtgtagaaaccacggagtggtatccgcattgaaaggccataagcgcttttgccggtggagggactgtgcctgcgctaagtgcacactgatcgctgaacggcagcgcgtgatggctgcccaggtcgctctgcgccgacagcaggcacaggaggaatcggaggcacgcgggctgcagaggttgctgtgctctgggctctcttggccccctggaggaagggcctccggcggaggtggcagagctgagaacccacagagtactggtggtccagcggctggggcggccttaggcctgggggcactgcgccaggccagcggctcagccacccctgctttcgaggtctttcaacaagactacccggaagagaagcaggaacaaaaggagtctaaatgcgagagttgtcagaatggccaagaggagttgatcagtaagtctcaccagctttatttaggaagctcatcgagatcaaatggagtgattggtaaacaatcgatcggatcaagcattagtgagtactcaaacaagcccgactcaatcttgagcccccatcccggtgaacagtccggcggtgaagaatctcctaggtctctctcaagtagtgacctcgaaagcggaaacgagtccgaatgggtcaaagaccttactgccacgaaagcctctttgcccacggtatcttcccggccacgtgaccccctagacatcctgaccaagatattcccaaactaccggcgatctaggcttgagggtatcctgcgcttctgcaagggtgacgtagtccaagcgatagaacaagtgctgaatggaaaagaacataagccagacaaccgcaacctcgctaattcagaggagttagagaacacagccttccagcgggcttcaagcttctcgctcgccgggataggctttggaacccttgggaacaaatccgccttttccccattgcagactacaagtgcaagctacggaggcgattcttccttgtacggagtaaatccaagggtcggtatctctcctctaagacttgcctattcctccgcgggaaggggtttgtccgggttcatgtccccatatctcacgcctggactcgtgccgaccttgccctttaggcctgccctcgactatgcattctcggggatgattagagactcttcttacctgagttctaaggacagcattacatgtgggagactttactttaggccaaatcaggataacccctag

SEQ ID NO: 11683 - DNA, 1629 bp, Artificial Sequence
  Description of Artificial Sequence: Synthetic coding sequence
atggagttacgctcagagttgccttccgtaccgggcgccgcaacagccgccgccgccactgcaactggcccacctgtcgcgtcggtagcttctgtggcagccgcagcggctgcggcggcgtcactgcctgtgtccgttgccggcggcctcctccgtggccctcctctgctgttgagagcagccgaaaaataccctcgaacacccaagtgcgcacgatgcagaaaccacggagtcgtctcagctctaaaaggtcacaaacgctactgtagatggaaagactgtctctgtgctaaatgtacactgatcgcggaaagacaacgagtgatggccgcacaggtggccctgcggcggcaacaggcccaagaggagaatgaggcccgcgagctccaattactatacggcaccgccgagggccttgccctcgccgcagctaacgggatcataccacctcggcccgcctatgaggtattcgggtccgtgtgcgccgctgatggtggtggaccaggagccggtgctcctgccggcaccggtgggggggcagctggggcaggcggctccgaggccaagcttcagaagttcgatctattccccaagactctgctgcaggcaggccggcccggaagtcctttgcctccacctgtaaaacccttgtcgccggacggagccgactccgggccaggtacatcatcgcccgaggttaggccaggatctgggagtgagaacggggacggggagagctttagtggatctcctctcgcccgcgcctccaaagaagcaggcggatcttgccctggctcggccggcccaggaggcggcggggaggaagactctcctggctctgcttcacccctggggtcggaatctggcagcgaagcagataaggaggagggagaggctgcgccagcccctggactaggcgggggcagcggcccaaggcaacgcacaccgctagatatcctgactagggtgtttcccggtcaccgaaggggagtccttgaattggtgctccaaggctgtgggggcgatgtcgtacaagctatcgagcaagtcctgaaccatcatagaggcggtctggctgctggactaggacctgccgcaccgccggataaggccgcagtgggggcagcagccgccgccgacgacgcctggccaagtcgcgtcgacgcggccgctgcggccgctgcagctgccggcggccctggcctccctgcgccactgcaggccgggcctgccgcaccaccccaccatcgacccttgctggcaggagccatggcaccgggcgctcttggtagtctgtcatcacggagcgcattctcaccactgcagccgaatgctagtcatttcggagccgatgcaggagcttaccccttgggtgcacctctcggtctctctcctctccgcctggcgtacagtgccgcagcagctcactcccggggcctggcctttatggctccatacagcacggccgggcttgtccctaccctgggattccggccaccaatggattacgcattctccgaccttatgcgggatcggagtgctgcagcagccgccgccgtgcacaaggagcccacctacgggggcggcctctacggccccatggttaacggtgcgcctgagaagcagtag

SEQ ID NO: 11684 - DNA, 1629 bp, Artificial Sequence
  Description of Artificial Sequence: Synthetic coding sequence
atggagctgcgttcagaattgccttctgttccgggggccgccaccgccgcggccgccaccgcgaccggaccaccagtagctagcgttgcctcagttgctgctgcagcggccgctgccgcctctctgccagtgtccgtcgctgggggcttgttgcgggggcctcctttgcttttacgagcagctgaaaaataccctagaactcctaaatgcgccaggtgcagaaaccatggtgtggtaagtgcactcaaagggcataagcgctattgccgatggaaagactgtctttgcgcaaagtgcaccctcatcgccgagaggcaacgcgttatggccgctcaggtggccctgcggcgccagcaggctcaagaggagaatgaagctagggagcttcaacttctgtacggaaccgctgagggtctcgcactcgcggctgccaacgggataatcccccctaggcccgcgtacgaggtcttcggatcagtgtgtgctgctgacggcggcggacctggtgcaggcgcgcctgcagggacggggggcggagccgcgggggctgggggatccgaggccaagctgcaaaaattcgatctatttcctaagaccctactgcaggctggcaggccgggcagtcctttaccacctccagtaaagcccctgtccccagacggcgctgacagtggaccgggcactagctccccagaagtgcgccccggctctggctccgagaatggcgatggtgagagcttcagcggatcccccctcgccagggccagcaaggaggccggcgggtcttgcccagggagcgcaggtcctggcggcggcggcgaagaagacagcccaggtagcgcctcacctttgggctcagagagtggcagtgaagcggataaggaagaaggcgaggccgcccccgcccctgggttagggggaggcagcggcccccgccagcggacccctcttgatatcctgacacgggtttttcccggacacaggaggggcgtgctcgagctagtgcttcaagggtgcggtggagacgttgtccaagccatcgagcaggtgttaaaccatcacagagggggtctggccgccgggttgggtccagcagctccaccagataaggccgcagtgggagccgccgcagcagctgacgacgcttggccctctagggtagatgccgcagctgctgctgccgccgcagcaggcggccccggcctgcccgcacctctgcaggcaggacctgccgcccctccgcatcatcgtcctcttctggcaggtgccatggcacccggagctttaggcagcttaagcagcaggagcgctttctccccactacagccaaacgcctcacatttcggcgctgacgctggagcatatccattaggggccccactcggactgagccccctgcgcctcgcttactctgcagcagcagcccattctcgtggactcgcatttatggccccttactccacggccggcctcgtacccacattgggtttcagaccacccatggattacgctttcagtgacttaatgagggatcgaagcgctgctgctgccgccgccgtccacaaggaacccacttacgggggcggattgtacgggccgatggtgaacggcgcccccgagaagcaatag

SEQ ID NO: 11685 - DNA, 1029 bp, Artificial Sequence
  Description of Artificial Sequence: Synthetic coding sequence
atggctgacaaaatggttcgcactcccaaatgtagtcggtgcagaaatcacggattcctcgtgcccgttaaaggccatgccggcaaatgcagatggaagcaatgtttatgcgagaagtgctatctgattagtgagcgtcagaagataatggcagcccagaaggtgctaaagacacaggcagcagaagaagagcaggaggcggccctgtgcgctcagggtcccaaacaggcttcaggtgcagccgcagcagcgcctgctcctgttccggtgcccgccgcttctttgaggcctctaagccccggcactcctagtggcgacgcggatcccggccccgagggaagggccgccgcatgttttttcgagcagccacccagaggccgaaatcctggccccagagctctgcaacccgtgctgggcggcagatctcatgtggagccctccgaacgagcagctgttgccatgccctctctggccgggcctccttttggcgccgaggccgcggggtctggctatcctgggccactagacctcagacgcccaatgaggactgtgcccgggcccctgttcactgattttgttagaccactcaacattaaccccgaccgcgccctgggccctgaataccctggcgggtctagcatgcatccatattgtccctttcccctgggctacctggacgctccacctggggtcccactccagcaaggcttccggcacgtcagccggtcacaatatcaaggcggaggtctggttagcgaaccgggaggcgacttccagcccagctactaccttcctccaccaccccccccgttgcctccattgcccccactcccaccacagccccaatttctgccgcctggctacctgtcggcgttgcactttttgccacctccccctcctccccctcctccatcttcctttagccttacagtactgttcgacaccgacaaggagaatactgacgaccaagacgcggaggtactgtccggcgaaccctctcaacctagctcccaggaacagtccgattag

SEQ ID NO: 11686 - DNA, 432 bp, Artificial Sequence
  Description of Artificial Sequence: Synthetic coding sequence
atgccatcgcttgccgggcctccgttcggagccgaggcggccggcagtgggtatccaggaccgctggacctccggagacccatgaggacagtgcctggtccactattcaccgacttcgtgcgacccttaaacataaatcctgacagagccttgggaccagaataccctgggggatcctctatgcatccctattgccccttcccgctgggctacctggatgcacctcccggagttccacttcagcagggatttcgacatgtaagcagaagtcagtaccagggaggaggactggtctcggagcccggcggagatttccagccaagctactacctcccaccacccccacctcccttgccgcctctacccccattgccaccgccagccactgcaaccaccacatctatcatattcctgacagatcgacccgtctag

SEQ ID NO: 11687 - DNA, 1104 bp, Artificial Sequence
  Description of Artificial Sequence: Synthetic coding sequence
atggaacctagtgatatgcccgctggatatcattgtccactggactctgccccctgggacgaaaccagagacccacagagcacagagctgatccctcggcgggcgatctcacggtccccaacttgtgctcgatgccgcaatcatggggtgactgcacaccttaagggacacaagagattgtgcttgttccaggcttgtgaatgtcacaaatgcgtcctgatcctcgaacggcgacgggtcatggcggcccaggtggccctgcggcgccaacaggaggctcaactgaagaagcacttgatgcgcaggggcgaggcttccccaaaagctcctaaccacttccgcaaagggacaacccaaccccaggttcctagcgggaaggagaacatcgcaccacagccccaaacaccccacggggctgtactcctcgctccgactccaccaggcaaaaatagttgcggaccactcctgctctcacatcctccagaggcctcccccttatcctggacgcccgttccccctggtccttgggtgccaggccactggcttccacccggtttcagcatgccaccccccgtcgtctgccggttgctttaccaggaacctgctgtgtcactgcctccttttcccggattcgaccctggtacttcgttacagctccctactcacgggccgttcaccacgtgccccggttcccaccctgtgctgacggcccctctctcaggggagccccaggggccacctagtcagcctcggacccatagcaccctgatcctgcagccatgcgggacccccgacccacttcagctgcaaccccaggctagcggtgccagttgtttagctcgcacctctggccccagtgagtggcaattgcagcaggaggccgccgaagctctagtgggactgaaggatagcagtcaagccccacgcgtgaccccctctgttccaccaaatccagcatggatttctttgctccacccttgtggccctccagcccctgccggtggcaggggctttcagcctgtgggcccatgtttaaggccatcccctgccccatctgtggcccttcatataggtagattggggtctatttcgcttctgtcttag

SEQ ID NO: 11688 - DNA, 1404 bp, Artificial Sequence
  Description of Artificial Sequence: Synthetic coding sequence
atggccactggcgctgacgtcagagacatcctggaattgggcgggcccgaaggcgacgctgcctcaggcaccatttctaaaaaggatatcattaatccggataagaagaagagtaagaaatcatctgagacccttacttttaagcgcccagaggggatgcaccgcgaggtctatgccctcctctatagtgataagaaggatgcccccccactcctgccgagcgatactggccaggggtaccggacagttaaagcaaaactaggcagcaagaaagtacggccatggaaatggatgccctttaccaaccccgccaggaaggacggggctatgttctttcattggcggcgggctgctgaggagggaaaagattacccctttgccagattcaataagacggtccaggtaccagtctactcagagcaggaatatcagctgtaccttcatgacgatgcttggaccaaagcagaaactgaccatttgttcgatctttctcggcgatttgatcttcggtttgtggtcatccacgacagatatgatcatcagcagttcaagaagagatcagtcgaagacttgaaggaaaggtattaccacatttgcgcaaaactcgcaaatgttagagccgtgccggggacagacctgaagattccagtgtttgatgcaggtcacgagagaaggcggaaggagcagctggaaagactctacaaccgcacgcctgagcaggtggctgaggaagagtacctgttgcaggaactcagaaagatcgaggccagaaagaaagaacgtgagaagcggagtcaagacctgcagaaacttatcactgcagccgatactactgctgagcagcgcaggaccgaaaggaaagcacctaaaaagaagctgccacagaaaaaagaggccgagaagcccgccgtgccagagacggccggcatcaaatttcctgattttaaatccgcaggggtgactctccggagccagcgcatgaagctcccctcatcggtggggcagaagaagatcaaggctctggagcaaatgctgctcgagctgggagttgagctgtccccaacccctacagaggagctggtacacatgttcaacgagctgcggagcgatctggtcctcctctatgaactgaaacaggcttgcgccaattgcgaatacgaactacagatgctgaggcatagacatgaggccctggcgcgagccggggtgctggggggacctgctaccccggccagcggaccgggccctgcctctgccgaaccagcagtaaccgagcccggcctgggtccggaccccaaagatacaatcattgatgtcgtgggcgctcctttgaccccgaatagcaggaagcggagggagtctgcttcctcaagttccagtgtgaagaaggccaaaaagccctag

SEQ ID NO: 11689 - DNA, 1404 bp, Artificial Sequence
  Description of Artificial Sequence: Synthetic coding sequence
atggcgacgggagcagatgtgagagatatcctggaactgggcggccccgagggtgacgctgctagtggcaccataagcaagaaagatataattaacccggataagaaaaaatctaagaagtcttcagaaactctcacattcaagagacccgagggaatgcatcgcgaagtgtacgctctcctttattccgataagaaggatgctcctcctcttctgccatcggatacaggccagggttacaggactgtaaaggcaaagctggggtccaagaaggttaggccatggaaatggatgccctttacaaacccagcccggaaagatggcgctatgttcttccattggcgccgggcagcagaagagggcaaagattacccttttgctcgcttcaacaaaactgtccaggtgcctgtgtacagcgagcaagagtaccagctctacctgcacgacgatgcttggacgaaagctgagactgaccatctgttcgacctgtctcgccgctttgatctccggtttgtcgtgattcacgaccgttacgaccatcagcagttcaagaaacgcagtgtggaggatctgaaggagaggtattaccatatctgtgctaagctcgccaacgtacgggccgtcccaggaactgatttaaaaattcccgtattcgatgcgggacacgagcgacggcggaaggaacagcttgaacgcctgtataacagaacccccgagcaggtggccgaagaggagtacctgctgcaggagttgcgcaagattgaggcgaggaagaaggagcgggagaagcggagccaggacctgcagaaacttattactgccgcggataccaccgccgagcagcgaaggacagagcggaaagcccccaaaaagaagctgccacagaagaaagaggctgaaaaaccggctgtcccggagacagccggcatcaaattccccgactttaagagcgccggagtcactctcagaagtcagcgcatgaagctgcctagctccgtgggtcaaaagaaaattaaagcacttgagcaaatgttgctggagcttggagtcgaactgagccccactcccactgaagaactggtacacatgtttaacgaactacgctcagacctggtcctgttgtatgaactgaagcaggcttgtgccaattgtgagtatgagcttcagatgctgaggcacaggcatgaagctttggcacgcgcaggcgtcctggggggacccgccacccctgcttctggaccaggcccagcaagcgccgagcccgcagtgaccgagccaggactcggccctgatcccaaggacaccatcattgacgtcgtaggcgcgccactgacaccaaactccagaaagcgcagagagtcagcatcttctagctcaagcgttaagaaagcgaagaagccatag

SEQ ID NO: 11690 - DNA, 858 bp, Artificial Sequence
  Description of Artificial Sequence: Synthetic coding sequence
atggcaactggcgccgacgtccgcgacatcctggagttgggcggccccgaaggagatgctgccagcggaacaatcagtaaaaaggacataatcaaccccgacaagaaaaagagtaaaaagagtagtgaaacactcactttcaaaagacccgaggggatgcatcgcgaagtgtatgcactcctgtacagcgataaaaataagggaagctgcttgttatcgcgcatgcaggaggacctgaagtcgttcgcacccggtcatgactttctggcaattggcgacgcacccccacttctccctagtgataccggccaaggttaccgtacagttaaagcaaaactgggctcaaaaaaagtaaggccctggaagtggatgccctttaccaaccccgcccgcaaggatggcgcaatgttttttcactggaggcgggccgccgaggagggaaaggactatccttttgctcgctttaacaagaccgtacaagtgccagtgtactcagagcaagaatatcagttgtatttgcacgatgatgcgtggactaaagcagagactgaccacctgtttgacttgagcagaagattcgatctgaggttcgtagttatccacgaccgttacgaccaccagcagttcaaaaaacggtcggttgaggatctaaaggagagatactaccacatatgcgctaaattggcgaatgtcagggcagtcccgggtacagatctcaagattcccgtctttgatgctgggcatgagcgacggcgcaaggagcaactcgaaaggctctacaatcggacaccggagcaggtggctgaggaggagtacctcctacaggagctgaggaaaatcgaggcaagaaaaaagtag

SEQ ID NO: 11691 - DNA, 1404 bp, Artificial Sequence
  Description of Artificial Sequence: Synthetic coding sequence
atggccactggcgccgatgtaagagatattttagagctaggaggacctgaaggagacgccgcttccggaaccatatccaaaaaagacatcatcaaccccgacaagaagaaatcaaaaaaatctagtgagactcttacctttaagcgtcccgaggggatgcaccgagaagtgtatgccttattgtattctgataaaaaggacgcccccccactcctgccctcagatactggccaggggtacagaacggtcaaggcaaaactcggatccaaaaaggttaggccatggaaatggatgccctttacgaatccagctcggaaggacggcgccatgttcttccactggcggagagctgccgaggagggaaaggactacccctttgccaggttcaataaaacagttcaggtgccggtctatagtgagcaggaataccagctctatctgcacgacgatgcatggacgaaggctgaaactgaccacctgtttgatctttctcggcggtttgatcttcggtttgtggtgattcacgatcgctatgaccatcagcagttcaaaaagaggagtgtggaggatctcaaagagaggtactaccatatctgtgctaaacttgccaacgtccgggcagttccgggtaccgatttaaaaattcccgtattcgatgctggccacgagagaagaagaaaagagcagttggagcgtttatacaatagaacgcccgagcaggtcgcagaggaggaatacttgctgcaggagcttagaaagattgaagcgcgaaagaaggagcgggaaaagaggtcgcaggatctccagaaactaatcacagcggcagatactactgccgagcagaggcgaactgaaagaaaggcacccaaaaaaaagctgccccagaagaaggaggcagagaagccagctgtgcccgaaacggcaggaatcaagtttccagattttaaaagcgcaggggttaccctccgcagccagcggatgaaactgccttccagcgtcggccaaaaaaagatcaaagcgctggaacagatgctgctagagttaggcgtcgagctctctcccaccccaactgaagaactggttcatatgtttaatgagctgcgtagtgatctggttctgttgtacgagctaaagcaggcatgcgccaactgcgaatatgagttacagatgcttcgccacagacacgaggccctcgccagagccggtgttctcggcgggcccgctacccccgcaagcgggcctggccctgctagtgcggagcccgctgtgaccgaacccgggcttggccccgatcctaaagatacgataatcgatgttgttggcgcgcccctgaccccaaattcccggaagagacgtgaatctgcttctagcagttccagcgtaaaaaaagctaagaagccttag

SEQ ID NO: 11692 - DNA, 399 bp, Artificial Sequence
  Description of Artificial Sequence: Synthetic coding sequence
ataattaatcccgacaagaaaaaaagtaaaaaaagctctgaaacccttacatttaaacgaccggaaggcatgcacagagaggtctacgctctgctgtatagcgacaaaaaagacgctccaccactcctgccgagtgacacgggccagggatatagaacggttaaggcaaagctgggcagtaaaaaggtgaggccctggaagtggatgccctttactaaccccgctcgtaaagacggtgcgatgttcttccactggaggcgtgccgcagaagagggaaaagactaccccttcgccagatttaacaaggagtaccagctttatctgcatgatgatgcatggaccaaagccgagactgatcatctgtttgacctttccaggcgtttcgacctccgtttttag

SEQ ID NO: 11693 - DNA, 456 bp, Artificial Sequence
  Description of Artificial Sequence: Synthetic coding sequence
atggctactggcgccgacgtgagagatattctggagctcggcggccccgagggagatgctgcgtcggggactatctcaaagaaagacatcatcaaccctgataagaagaaatcaaagaagtcatctgaaactctgacatttaaaaggcctgaaggtatgcaccgcgaggtgtacgcgctcttgtacagtgataaaaataagggctcctgtctgctgtcgagaatgcaagaagacctcaagtcattcgccccgggacacgactttctggccatcggcgacgcccccccactactgccatcagataccgggcagggctatagaacggtgaaggctaagcttggatcaaaaaaggttaggccgtggaagtggatgcccttcacaaacccagcgcggaaggacggggcaatgtttttccattggcggagggctgccgaagaaggtaaagactacccatag

SEQ ID NO: 11694 - DNA, 858 bp, Artificial Sequence
  Description of Artificial Sequence: Synthetic coding sequence
atggcaacaggggccgatgtccgcgacatcctcgagctggggggaccagagggcgacgccgctagcggcacaattagcaagaaagacatcatcaaccctgacaagaaaaaatccaagaagagtagtgagacattaactttcaaaaggccagaaggcatgcaccgcgaggtttacgcgctgctgtattccgacaaaaacaagggctcctgtttgttgtctaggatgcaggaagatctgaagagctttgccccaggacatgatttcttagccattggagatgcacctcccctgctgccatctgacacgggacagggatatagaacggtcaaggccaaactcggttcaaaaaaggtgcggccttggaaatggatgccattcaccaaccccgctcgtaaggatggcgccatgtttttccattggcgccgagctgcggaagagggaaaggattacccattcgctcgctttaacaaaaccgtgcaagtcccagtgtattccgaacaggaatatcagttgtaccttcacgacgacgcctggactaaggctgaaactgaccatttgttcgacctgagccggaggtttgacttgcgtttcgttgtgattcacgatcgttacgatcaccagcagtttaaaaagcgtagcgtcgaggatctgaaggagcgttactaccacatctgtgcaaaactcgccaatgtcagggcagttcccggtactgacctgaagattcccgttttcgacgccggccatgaacgcagaagaaaagagcagctggagaggctgtataaccgaaccccggagcaggtagcagaagaagagtacctgctgcaggaactgcgaaaaattgaggcgcgtaagaagtag

SEQ ID NO: 11695 - DNA, 714 bp, Artificial Sequence
  Description of Artificial Sequence: Synthetic coding sequence
atggcaacaggggcagatgtgagggacattttggaactgggcgggcccgagggtgatgcggccagcggaacaatcagcaagaaagatattatcaatcctgacaagaagaagtctaagaagagcagcgagacgctcacatttaagcggcccgaaggcatgcatcgggaggtgtatgcgctcctatactctgataaaaaggatgctccacccctgcttccctcagacaccggacagggctatcggacagtgaaagctaagctgggttctaagaaggtcagaccatggaagtggatgccattcacaaatcccgcccgtaaagatggcgctatgtttttccattggagacgagcagcagaggagggcaaagattacccctttgctaggtttaacaagaccgtgcaggtcccagtgtacagcgaacaggagtatcagctctatttgcacgatgacgcatggacaaaggccgagactgatcacctctttgacctgtcaaggaggttcgatcttaggtttgtggttattcacgaccggtatgatcaccagcagtttaaaaagcggagcgtggaagacctgaaagaaaggtactatcacatatgtgcaaagctagctaacgtgagggcagtgccaggtactgaccttaagatccccgtgttcgacgcgggccatgaaaggaggagaaaggaacagttggaacggttgtataatcggacatag

SEQ ID NO: 11696 - DNA, 909 bp, Artificial Sequence
  Description of Artificial Sequence: Synthetic coding sequence
atggccactggtgctgacgtgcgggacattctagaactggggggccccgaaggggatgcagccagtggcacaataagcaaaaaagatataatcaacccggacaaaaagaaaagtaaaaagtcttctgaaacactgacttttaagagaccagaaggcatgcaccgtgaagtctacgctttactttatagcgacaaaaaagacgcaccacctctacttcccagtgacaccgggcagggctatcggaccgtgaaggctaagttgggatctaagaaagtaagaccctggaaatggatgcccttcacaaaccctgccagaaaagacggggccatgtttttccattggcggagagccgccgaggagggtaaggactacccctttgcgcggtttaataaaactgtgcaggtcccggtctacagcgagcaggaatatcagctgtacctgcatgatgacgcctggactaaggcagagactgaccacctgtttgatcttagcaggagattcgatctgcggtttgtcgtgatacatgacaggtacgaccatcagcagttcaaaaagaggtccgttgaagatctgaaggagcgttattatcacatctgtgccaagctagctaacgtccgggcagtgcccggaacagacctgaaaataccagtatttgacgctggacacgagcgtagaaggaaagaacagctggaaaggctctacaatcgcacgccagaacaggtcgccgaggaggagtaccttctgcaggagcttcgtaaaatagaggcccgcaaaaaggagagggagaaacggtcccaggatctccaaaagctcattaccgccgccgatacgacagccgagcagcggagaaccgaacgtaaggcgccaaagaaaaaactgcctcagaagaaagaggctgaaaaaccatag

SEQ ID NO: 11697 - DNA, 762 bp, Artificial Sequence
  Description of Artificial Sequence: Synthetic coding sequence
atggcagccagcggcgagagcgggaccagtggaggcggaggatcaacagaggaggcttttatgaccttttactctgaggtgaagcagattgagaaacgggactcagttctgactagtaagaatcagatcgaacggctgacccgccccgggtcctcctattttaatttgaatcctttcgaagtgcttcagatcgatccagaagtgactgacgaggaaattaaaaagcggtttcggcagctgagcatactcgtgcatcctgataaaaaccaagatgatgcagaccgcgcgcaaaaggcatttgaggctgtggataaggcctacaaactcctactggatcaggagcagaagaaacgggctcttgacgttatccaggccggaaaggagtacgtcgagcatactgtgaaggagagaaagaaacaacttaaaaaggaaggtaagccaacaatagttgaggaggacgaccctgagctgttcaagcaggctgtttacaagcagacaatgaagttatttgctgagctggaaataaaaaggaaagagcgtgaagccaaggagatgcatgaacgaaagcgacagcgggaggaagagattgaagcacaggaaaaggccaagcgcgaacgcgagtggcagaaaaattttgaggagtcccgtgacggtcgtgttgactcctggcgtaatttccaggccaacacaaagggcaagaaggagaaaaaaaaccggacctttcttcggccgccgaaggtgaagatggagcagcgcgagtag

SEQ ID NO: 11698 - DNA, 1458 bp, Artificial Sequence
  Description of Artificial Sequence: Synthetic coding sequence
atgaaaggatggagccttcccgcctgtggccctctgcagggcagattagctggctggctggctgtccgcgccggcctcctggcagctcccgctgccgttcacagtcccgccgaggtccatggctcccccccagcatccctctgtcctcgaccgtctgtgaagttccggcccggcctgacagccatggccctgcctaccccttcagactcaactctgcccgccgaggctagaggccgtggccgcaggcggcgcctggtgtggactccttcacagagcgaggctctgcgtgcttgttttgagcgtaacccttatcctggcatcgccaccagagagaggcttgcgcaggccatcggcatcccggagcctcgtgttcagatctggtttcaaaacgagagatccaggcagctccgccagcatagacgcgagtccagaccttggccagggcgacgcggaccgcctgaagggcggcggaagcgaactgcagttacaggttcccagacggctctgctcttacgcgctttcgagaaagatcgcttcccagggattgctgcacgggaggaattagctcgggagacaggactgcctgaatcccgcatacaaatctggtttcagaatcgccgcgcccgtcatccaggccagggcggtcgagcacccgcacaggctggtgggctctgttccgcggcccccggcggagggcatcctgcaccaagttgggtggcttttgcccatacaggcgcttggggaacgggcctgcccgccccacacgtaccttgtgcccctggggcactcccccaaggggcttttgtgtcccaagccgctcgcgcggccccagctttgcagcctagtcaggccgctcccgcagagggcgtgtctcagccggcccccgcccggggagatttcgcatatgctgctcctgccccacccgatggagcactaagccacccccaggcccccagatggccaccccacccagggaagtcgcgagaagaccgagatccacagagggatggcctgcctggcccttgcgctgtcgcacagcctggaccagcccaagctggaccacagggccaaggcgtcctggctcctccgacctcacagggcagtccatggtggggatggggacgcggcccccaggtcgcaggcgctgcctgggaacctcaggccggcgctgcgcccccgccacagcctgcccccccagacgctagcgcgtcagcccgtcagggtcagatgcagggcatcccagcacccagccaggcgctacaggagcccgcgccttggtccgcactgccatgcggcctgttattagatgagctgctggcctctcccgaattcttgcagcaggctcagcctctgctcgagaccgaagccccaggtgagctcgaggcttctgaagaggccgcctcactggaagctccgctttctgaggaagagtatcgtgctttgttggaagaattgtag

SEQ ID NO: 11699 - DNA, 1275 bp, Artificial Sequence
  Description of Artificial Sequence: Synthetic coding sequence
atggccctgcccactccatctgattctacactgcccgctgaggcccgcgggcggggccgcaggcgcaggctagtgtggacacctagccagagcgaggctctgcgagcctgttttgaaagaaacccgtatccaggtatcgccactagggaacgtctggctcaggccataggaatcccagagccccgtgtccaaatttggtttcagaatgagaggtctaggcagttacggcagcatcgcagggaaagtaggccatggccaggacggcgggggccgcccgagggcagacgcaaacggactgccgtgactggatctcagaccgccctgcttctgagggctttcgaaaaggatcgattcccaggaatcgccgcgcgggaagaacttgctcgcgaaaccggactccccgaaagtagaatacagatttggtttcagaacagaagagcccgacacccaggccagggcggcagagccccagctcaggccggcgggctatgtagcgccgcccccgggggtggccatcctgctccatcatgggtggcattcgctcacactggcgcctggggaacaggactgcctgcaccccatgttccctgtgccccaggcgccctgccccagggggcctttgtatctcaggctgctagagccgctccagctctgcagccctctcaggccgcacctgcagaaggcgtcagccagcctgcgcctgccaggggcgacttcgcctatgccgcgcccgccccccccgacggagctctaagccacccacaggcccctcgttggccaccccatccaggcaagagccgtgaggatcgcgaccctcagcgagatgggctgccaggaccatgtgcagttgctcagccaggacccgcacaggcagggcctcagggtcagggcgtcctggcccctcctacttcccaggggtcaccttggtgggggtggggccgaggaccccaggtggctggggctgcctgggaaccccaggccggggcagcccctccaccacaaccggcgcccccggacgcttccgccagtgccagacagggccagatgcagggcattcccgcacccagtcaagctctgcaggaacctgcaccatggtctgctctgccttgtggcctcctgctggacgagctacttgcaagccctgagtttttacaacaggcgcagccactgttagagacagaggccccaggcgagctcgaagcgtctgaggaagccgcctctctcgaggcccccttgtcagaggaagagtatcgtgccctgctcgaggagctgtag

SEQ ID NO: 11700 - DNA, 1458 bp, Artificial Sequence
  Description of Artificial Sequence: Synthetic coding sequence
atgaaaggctggagtttgccagcctgcgggcctcttcaagggagactagcaggatggctggctgttcgggccggtctgctggctgcacccgcagccgtgcactctccagcagaagtgcatggctctcctcccgcatcgttgtgtccacggccgagcgtcaagtttaggccaggcctcactgcgatggctcttcctacgccgtcagattctaccctgcctgctgaagcccgaggccgggggagaagacgacgtttagtgtggacgcccagccaatcggaagcactgagagcttgctttgagcggaacccttacccagggatagcaacaagggagcggctcgcccaggctatagggatcccagagcctagggtgcagatttggtttcaaaacgagcgcagcagacagctgcgccagcacagaagggaaagtcgcccatggccagggagacggggtccaccagagggtcgcagaaaaaggactgcggtaaccggttcccagaccgcactgcttctccgcgctttcgagaaggatcggttccccggtatcgcagcccgggaggagttagctcgggagaccggcctgcccgagagccgcatccagatttggttccaaaatcgacgggctaggcatccagggcaaggcggtagagctccagcacaggccggcgggctctgctctgccgcaccagggggtggccatcctgctccgagttgggtcgcttttgctcatactggggcgtgggggacaggccttcctgctccccacgtcccctgtgcccccggggccttgccacaaggcgcctttgtttcacaggccgcacgggccgcccccgctctgcaaccttctcaagctgcccccgccgagggggtgtctcagccagcaccagcacggggtgattttgcttacgcagccccagccccgccagacggcgccctctcccatccccaggcaccaagatggcctccgcaccccggcaagtcacgggaggatcgcgatccacagagggatggtttacccggaccatgtgcagtggctcaacccggacctgcccaggcgggccctcagggtcagggtgtgttggcgcctcccacctcccagggaagtccctggtggggatgggggagaggccctcaggtggcgggagctgcgtgggaaccccaagctggtgcagctccaccaccacagcctgcgcctccggacgcctccgcttcagctcgccagggccagatgcagggcatccccgcacctagccaggctctgcaggaaccggcaccgtggagtgccctaccctgcgggctgcttctggacgaactgctggcttcccctgaatttctacaacaagctcagcctctccttgaaactgaggcccccggagagttggaagccagcgaggaagctgcgagtttggaagcccccttatcagaagaggagtacagggcgcttttagaggagctgtag

SEQ ID NO: 11701 - DNA, 1275 bp, Artificial Sequence
  Description of Artificial Sequence: Synthetic coding sequence
atggcgctccctacaccatctgactccacactccctgccgaggcaaggggacgaggacgccggcggcgtctagtgtggacaccttcccagagcgaggcccttagagcatgcttcgaacggaatccctaccctgggattgcaacccgggagcgcctggcccaggctattgggattccagagccgcgcgtacagatttggtttcagaatgaaaggtctcggcagctgagacagcacagaagagagtcacgtccgtggcctggacgcagaggaccccccgaaggccggcgaaaaagaaccgccgtaacagggtctcagactgcacttttgttacgtgctttcgaaaaggatagattccccggtatcgccgcacgggaggaattggcccgggagacgggtctgcccgagagtcgcatccagatctggtttcagaataggcgtgcacgccaccctggacaggggggcagagcacccgcccaggcgggcgggctctgctcagccgctcccggagggggtcacccggccccatcctgggtggctttcgcgcacactggcgcctggggcacaggactgcccgccccgcacgtgccttgtgcacccggagcgctgccacaaggggcctttgtgtcacaggccgcaagagccgctcccgccctgcagccctctcaggctgcaccagcagaaggagtgtcacaaccggcgcccgcccgaggcgactttgcttacgccgcgccggcaccaccggatggagccttgagccacccgcaggctccgagatggccaccgcatccaggcaaatctcgcgaggatcgcgacccacagcgcgacgggttgcccggcccctgcgcagtggcacagcccggccccgcccaggccggcccccagggccagggcgtacttgccccgcccacctcacagggatctccgtggtggggctggggacgaggtccccaggtggcgggcgcagcttgggagccgcaggccggagctgccccacctcctcagccagcccctccagatgcctcggccagcgcccggcaaggacagatgcagggaattccagccccatctcaggccctccaagagccagccccttggagtgccctgccttgtggcctgctgttggatgagctgttagcttcacctgaatttctgcagcaggctcagcctctgctggagacagaagctcccggcgagctggaggcttctgaggaagcagcaagcttagaggcaccattaagtgaggaggagtacagggccttgcttgaagaactgtag

SEQ ID NO: 11702 - DNA, 1452 bp, Artificial Sequence
  Description of Artificial Sequence: Synthetic coding sequence
atgaaagggtggtcccttcccgcttgcgggcccctgcagggccgactggccggatggctcgccgtgcgggcaggtctgctggccgcaccagccgccgttcactcacctgccgaggtacatggaagcccccccgcatctctctgtccaagaccttctgttaaattcagacccgggctgaccgctatggcgttacctaccccttccgatagcactctgcctgcagaggcgcgcggacgtggacggcgacggagactggtctggacccctagccaatccgaggccttgcgggcctgtttcgaacgcaatccgtaccccgggatagcgaccagagagcgcctcgctcaggccattgggatacccgaaccgagggtccagatttggtttcagaacgagagaagcagacaactcagacaacatcgtcgcgaatcacggccatggcccgggcgacgaggcccccccgagggaagacgaaagcgaactgctgtgacaggatcacagactgccctcctgttacgcgctttcgagaaggacagattccccgggatcgcagctcgtgaagagttggcgcgggaaacaggattaccagagagccgcatccagatttggtttcagaatcgcagggctcgacatccggggcagggtggtagggccccagcgcaggccggagggctttgctctgctgctccgggtgggggccatccggcacctagctgggttgccttcgcgcacaccggcgcttggggaactgggcttccagcaccccacgttccctgcgcacccggagcactgccacaaggcgcctttgttagccaggctgctagagctgcccccgccctgcagccctcccaggctgcccccgccgagggagtgagccagcctgctcccgctagaggagactttgcctacgctgcacctgcacccccagacggagcgctctcccatccccaggccccacgctggccaccacacccagggaagtctagggaagatagggacccccaacgcgacggcctcccagggccctgcgctgtagctcagccaggacctgcacaagctggaccccaggggcagggtgtgttggcccctccgacgagccagggcagcccttggtggggctgggggagaggcccacaggtcgcaggcgctgcctgggagcctcaggcaggcgaggcccccccaccgcagccagctccgcccgatgcttctgcccgccaggggcagatgcaaggaattccagccccatcacaggcactgcaggaacccgcaccttggagtgccctgccctgcggcctgctactggacgagcttcttgccagccccgaattcctgcagcaggcacagccgcttctggaaaccgaggcccctggtgaactcgaggcctccgaagaggccgcaagcctggaagcgcctctgagcgaggaggaatatcgggccctcctggaagagctgtag

SEQ ID NO: 11703 - DNA, 1269 bp, Artificial Sequence
  Description of Artificial Sequence: Synthetic coding sequence
atggcactgcctacgcccagcgactctaccctccctgctgaggccaggggacgcggacggcggcgacggttggtctggactccctcccaatcggaagcccttcgcgcttgttttgaacgcaacccctatcccggaattgctacacgagagcggcttgcccaggctattggtataccagaacccagggtccagatttggtttcaaaacgagcgttcgagacaactccgccagcatagaagggaaagccgaccatggcccggcaggcggggccccccagagggtaggagaaaacggacagccgtgactgggtcccaaactgcgctgctcctgagagcctttgagaaagatcgcttcccagggatcgccgcgagggaggaactggcccgtgaaacaggcctgcccgaatctcgaattcaaatctggtttcaaaatcggagagccaggcaccctggacaaggcgggagggcgcccgcccaggcaggtgggttgtgttcagctgctccgggtggagggcacccagctccttcatgggtggcctttgcccacacgggtgcttgggggaccggtctgcctgccccccacgtgccctgtgcccccggcgcgctgccccagggcgcatttgtgtcacaggcagctcgggccgcgcccgccttacagcccagtcaggcggcaccagctgagggagtgtcccagcccgccccggctcgcggggacttcgcctacgcggcgcccgctccgcccgatggggcactctcccatccacaggctcctcgatggccaccacatcccggcaagagcagagaggatagggaccctcaacgcgacggtctgcccggtccttgcgctgttgcccagcccggacctgcgcaagcaggaccacaggggcagggagtgttagcacccccaacatcccagggcagtccctggtggggatgggggcgcggtccccaggtggcgggagcagcatgggagccacaggccggcgaagcaccgccacctcagcccgctcccccggacgcctctgcccggcagggacaaatgcagggtatccctgcccccagccaggcactccaagaacccgcaccctggagcgccctcccttgcgggttactgctggatgagcttctggcgagcccagagttcctccaacaggcccagcctctacttgaaacagaggcacctggcgagttggaagcaagcgaggaggcagcatccctcgaggcaccgctgtccgaggaagaatacagggccctcctggaggaattatag

SEQ ID NO: 11704 - DNA, 1458 bp, Artificial Sequence
  Description of Artificial Sequence: Synthetic coding sequence
atgaagggctggagcctcccagcttgcggcccactgcagggacggttggctggatggttggccgtgcgggctggcctgctggcagcccccgcagcagttcacagcccggcagaggtccatgggtcgccacccgcatcactatgcccacgtcccagtgttaagtttagaccggggctgacggctatggcgttgccaaccccatccgattcaacccttccagcagaagctaggggacgaggtaggcgcaggcggttggtgtggaccccttcgcagtcagaggcactgcgggcctgctttgagagaaatccttatcccggcatcgcgacccgggagagattagcccaggcgattgggatccctgagccacgggtccaaatttggtttcagaatgagcggtcacgacaacttaggcaacacagaagggagtcacgcccctggccgggcaggcgtggtcctcctgaaggccgccgcaagagaacagctgtcaccgggtcgcagacagctctgctcctccgagcatttgagaaggaccgcttccctggaatcgctgcgagggaggaactcgcacgggaaactggactgcccgagtccagaattcagatctggttccaaaaccggagggcaagacacccaggacaaggcggtcgtgcacccgcacaggctggaggtctatgcagcgcagctccaggcgggggacatcccgcccccagttgggtcgcatttgcccacaccggagcctggggtacaggcttgcctgctccccacgttccttgcgcacctggcgccttaccgcaaggcgctttcgtgtcacaggctgcccgggccgcacccgccctgcagcccagccaagcggcccccgccgaaggggtttctcagccagcacctgctcggggcgatttcgcctacgccgcacccgcgcccccagacggagccttgagccacccgcaggcaccacgctggcctcctcatcccgggaagagccgggaggaccgtgacccccaacgggacgggctacccggaccatgtgccgtcgcccagccagggcctgcacaggctgggcctcagggccagggcgtcctggccccccctacatcacagggcagtccctggtgggggtgggggagaggccctcaggttgccggggctgcctgggagccccaggcaggtgccgcaccgccaccacagccagccccccctgatgcaagcgcctcagcccggcaaggccagatgcaaggaatccctgcgccctcacaagcactccaagagccagcgccttggagtgctcttccttgtggacttctgttagatgaattactggcctccccggagttccttcaacaagcccagccgttgctggaaacagaagcccctggggaattggaagcctctgaagaagcagcctccctggaggcccccctttccgaggaagagtacagggccctgctggaggagctctag

SEQ ID NO: 11705 - DNA, 1275 bp, Artificial Sequence
  Description of Artificial Sequence: Synthetic coding sequence
atggccctgcccactccatctgacagcacgttaccggcagaggctagaggaagagggagacgcaggcggttagtctggacaccctcacaatcagaggctttgagggcttgctttgaacggaatccctaccccggaattgccacccgagagcgtctcgctcaggcgattgggatcccagagccccgggtccagatttggtttcagaatgagagaagtaggcaattgcgacagcacagacgggaatccaggccatggccgggccggcggggcccgcccgagggcagacgaaaaaggacagccgtcaccggcagtcagacagccctgcttctgcgtgctttcgaaaaggatcgattcccgggaattgccgccagagaagaactggccagggaaaccggtttgccagagtctaggattcaaatttggttccagaataggcgagccaggcaccctgggcagggcggccgtgcacctgcgcaggctggcggcctgtgctctgcagctcccggtggcgggcaccccgcccccagctgggttgcatttgcgcataccggtgcgtgggggaccggattgcctgcaccacacgtgccatgtgctcctggcgccctgcctcagggagccttcgtcagtcaggctgccagggctgccccagctctgcaaccgtcccaagccgcacctgcagaaggggtgagccagccagctcccgcacgaggagattttgcttacgcggcacccgctccgccggacggggctcttagtcacccacaggccccccgttggccacctcaccctggtaaatcacgggaagatagagacccacagcgggatggcctgcccgggccatgcgccgtggctcaacctggaccagcccaggctggtccccagggccagggggtcctcgcacccccaacatctcagggctcgccgtggtggggctgggggcggggaccacaggtcgcgggcgccgcttgggagccccaagcaggagcagcaccacccccccagcctgcacctcctgatgcttccgcgtctgcccgccaaggacagatgcagggcatccctgccccgtcccaagcgctgcaagagccagctccttggtcagccttaccgtgcggcctgctgcttgatgagctgctcgcctctcccgagtttctgcagcaggcccagccactgctggagacagaagccccaggcgaactcgaagcatctgaggaggctgcgtccttggaagcccccttgagtgaagaagagtatcgggctttactggaggaactgtag

SEQ ID NO: 11706 - DNA, 1275 bp, Artificial Sequence
  Description of Artificial Sequence: Synthetic coding sequence
atggcactccccactccatctgactccaccctgcctgcagaggcccgggggagggggcgacggcgtaggctggtctggacaccatcccagtccgaggcactcagagcatgcttcgagagaaacccataccccggaattgccacaagagagaggcttgcccaggctattggtatccccgagcctagagtgcagatttggtttcaaaatgaaaggagtaggcaactgagacagcaccgcagagagagccgtccttggccaggcagacgcggccctcccgagggacggcggaaacgtacagctgtgactggatcgcagactgccctcctgctgcgggcttttgagaaagataggtttcctgggatcgccgctcgcgaggaactcgcaagggagacaggccttcctgaatcgagaattcaaatctggttccaaaatagaagagctcggcatcctggtcaaggcggaagggcccctgcccaggcaggaggcttatgttctgcggctcccggtggcggccaccctgctccatcatgggtcgccttcgcccacacaggtgcatgggggactggattgcccgcaccgcacgttccatgtgccccgggggccctgcctcagggagcctttgtgtcccaagctgctcgggcagcaccagctctgcagccatctcaggccgctcccgcagagggggtttcacagccggcgccggcccggggtgatttcgcttacgcagctcccgcaccccctgacggagccctgtcccaccctcaagcccctcggtggccacctcaccccgggaaatccagggaggaccgggatccccaacgtgacgggcttcccggtccgtgtgcagtggcgcaaccaggacccgcacaggcgggtccccagggtcagggcgtcctggctcctccaacttctcaggggagtccatggtggggctgggggcgggggccccaggtagctggggctgcttgggaaccccaggctggtgccgcccctccaccacagcccgccccgcccgatgccagcgcctcagctcggcagggacagatgcaagggataccagcaccaagccaggctttgcaggagcccgccccatggagcgctctcccttgtggcctgctcctggatgagctgctggcgagcccagagttcctgcagcaggctcaaccactcctagagacggaagccccgggggaattggaagctagcgaggaagcagccagtttggaggcccctctgtccgaggaggagtatcgcgccttgctggaggagctgtag

SEQ ID NO: 11707 - DNA, 1458 bp, Artificial Sequence
  Description of Artificial Sequence: Synthetic coding sequence
atgaaggggtggtctctccctgcatgcgggccgcttcagggaagacttgcaggctggctcgctgtaagggccggactgctggccgcccccgccgccgtgcattctcccgctgaagtacacggctcaccaccagcctcactgtgtccgcgtcctagtgttaaattccgccctggccttaccgcaatggcgctccccacgccttccgacagcaccctgcccgctgaagctagggggaggggtaggagaagaagacttgtatggacaccatctcagtcagaggccctcagggcgtgtttcgaaagaaacccttatccaggtatcgccaccagagaacggctcgcccaggccatcggcataccagagcctcgcgtccagatttggttccagaatgagaggtctcggcaactgcgccagcatcggagagagagtagaccgtggccaggcagaagaggtccaccggaaggtcgacgtaaaaggacagcagtcacagggagccagacagctttactgttacgggcatttgagaaagaccggtttcccggcatcgcagcaagggaggaactggcccgggagacaggcctgccggagagccgtattcaaatctggtttcagaaccgcagggccagacatcctggtcagggcgggagagctcccgcccaggccggcggtctgtgcagcgccgcgccaggaggaggccatcccgcaccttcgtgggtggctttcgcccacacaggagcttggggaacaggcctcccagcaccgcacgtcccatgcgcaccgggagcactgcctcagggagccttcgtcagccaagctgctagggccgcccctgccctacagccttcccaagccgccccagcagagggcgtgagtcagccagcccccgcccgcggcgactttgcctacgctgctcctgcaccccctgatggagctttgagtcacccacaggccccgcgatggcctccgcacccggggaaatcacgtgaagatcgcgacccccaacgcgatgggctgcccgggccttgtgccgtggctcagcctggccccgcccaggcaggccctcaggggcagggggtgctggcgccccccacatctcagggttcaccctggtggggttgggggaggggcccccaggtggccggggccgcttgggaaccccaggcaggggcggcgcctccgcctcagccagcgccaccagacgcatcagcctctgctcgccaggggcagatgcaagggattcccgcccctagtcaggccctccaggagcccgcgccctggagtgccctcccctgtggtctcttgctcgatgagctgctggcctccccggaatttctccaacaggcacaacccctcctggagacagaggcccccggggaactggaagcttcagaagaagccgcgagcctggaggcaccactttctgaagaagaatacagagctctgctggaggagttgtag

SEQ ID NO: 11708 - DNA, 1458 bp, Artificial Sequence
  Description of Artificial Sequence: Synthetic coding sequence
atgaaaggatggtccctgcctgcatgcgggcccctacaagggcgtctggcaggatggttagcagtgcgcgctggccttctggctgctccagcggccgtgcactctcccgccgaagtgcatggaagcccccccgcatcactttgtccaaggccatccgtcaagtttagacccgggctcacagctatggccttaccaacgccaagtgattccaccctccctgctgaagcccgcggccggggccgacggcgaagactggtctggacgccttctcaatccgaggcattgagggcctgcttcgagcgtaacccttaccctgggattgctacccgggagaggctggctcaagctataggtattcccgaaccccgcgttcaaatctggtttcagaacgaacgctccagacagctgagacagcaccgtcgcgagtcgcgcccctggcctggcaggagggggcctccggaggggcggcgcaagcgcaccgcagtcaccggctctcagactgctcttttgctcagggcgtttgaaaaggataggtttccagggattgcagcccgagaagaactggccagagaaaccggcctgccagagagccgaattcaaatctggtttcagaatagacgcgcccggcaccctgggcagggtggcagagctccagcacaagcgggtggactttgttcagctgcccctgggggagggcatcccgctccatcgtgggtcgcgttcgcccatacgggtgcctggggcactgggctccccgcaccgcacgtcccttgcgcgccgggtgcactgcctcaaggagcctttgtgagccaggcagcccgggccgcacctgctcttcagcccagccaggcggcacccgccgaaggtgtgtcccagccagcacctgctcgcggagacttcgcatatgcggcacctgccccaccagacggggcactttcacacccccaagcgcccaggtggcccccccatccagggaaatccagggaagatcgagatccacagcgcgacgggctgcccggaccttgtgctgttgctcagcccggccccgcccaagccgggccacagggacagggggtccttgcgccccccacatcccagggttccccctggtggggctgggggcgggggccccaggtcgctggcgccgcatgggagccacaggccggcgccgctcctcccccccagcctgcccccccagacgcgagcgccagtgctcggcagggacagatgcaggggattccagcacccagtcaggctcttcaggagcctgccccatggagcgcactgccttgtggcttgcttctggatgagttgcttgcctcgcctgaattcctacagcaggcgcagccgttattggagacagaggccccaggagagctggaggcatcggaggaagccgcctccctggaagcccctctgtccgaggaggagtacagagccctcctcgaggaactgtag

SEQ ID NO: 11709 - DNA, 1275 bp, Artificial Sequence
  Description of Artificial Sequence: Synthetic coding sequence
atggccctgcctacacctagcgacagtacattacccgctgaggccaggggccggggccgaaggcggcggctcgtgtggacaccatcacaaagcgaggctctcagagcttgctttgagaggaacccgtatcctggcatagcaacccgcgaaaggctagctcaagcaatcggcatcccagaacctcgcgtccagatctggttccagaacgagcggtctagacagctgaggcagcaccggcgggagagccgcccatggcctgggaggaggggaccccccgaagggcgccggaagagaaccgcggtgactggttctcaaacagctctgttactgcgcgcttttgagaaggatagatttcctggtattgccgctagggaggaactcgcgagagaaaccggtctcccagagagtagaatccaaatctggttccagaacagaagggcccgccatcccgggcaaggtggacgcgcacctgcccaggcaggaggtctgtgtagtgccgcccccggtggcggccaccccgcgccaagttgggtggcctttgctcacacgggggcatgggggacaggcttgccagccccccacgtcccatgcgccccgggggctctgccacagggtgccttcgtttcacaggcagctagggcagccccagctctgcagccaagccaggcagcgcccgccgaaggagtgagtcagcccgcccctgcccggggggattttgcctacgctgcacctgcccctccagacggcgcactgagccacccccaggccccaaggtggccccctcatcctggaaaatcccgcgaggacagagatcctcaacgggatgggcttcccggtccgtgtgctgttgcacagccagggcccgctcaggcgggcccgcagggccagggtgtcttggccccacccaccagccaaggaagcccctggtggggatggggacgcggtccccaggtcgcaggggccgcctgggaacctcaagctggtgccgctcccccccctcagcctgccccacctgacgctagtgcctctgcgagacaaggacagatgcaaggcatcccggctccgagccaggctttgcaggaacccgccccatggagcgctctgccctgtggactgttactggacgagctgttggcctcacctgagtttctgcagcaagcccagcccctgctcgagacagaggctcctggggaactggaggcgagcgaagaggctgcctcattagaggctcccctctctgaggaagaatatagggccctgctcgaggagctgtag

SEQ ID NO: 11710 - DNA, 1275 bp, Artificial Sequence
  Description of Artificial Sequence: Synthetic coding sequence
atggcacttcccaccccaagcgattctaccttgcctgccgaggcgcgcgggaggggccgtagaagaaggttagtctggacaccttcacagtctgaggcgctgcgcgcatgtttcgaaagaaatccatatcctgggattgctacacgcgagcgacttgcccaggctattggcatccccgagcctagagtgcagatctggtttcagaacgagagaagtcgccaactgagacaacaccgacgcgagagtcgtccctggcctgggcggagaggcccacctgaaggaagacgaaaaaggactgccgtgaccgggtctcagactgcactcctgttgagggcctttgagaaggaccggtttcctggaatagccgcccgggaagaacttgcccgcgaaacaggactgccagagtcgaggatccagatctggttccagaatcgaagggcgaggcaccctggccagggcgggagagctcctgctcaggccggcggtctctgttccgctgcccctggaggcggccatcccgctccatcttgggtggcctttgcgcatacaggcgcatggggtaccggcttgcccgccccacatgtgccatgcgcccccggggctttgccccaaggcgctttcgtgtcacaggccgccagggccgcgccggccttacaacctagccaggcagcgcctgccgaaggagtctcacaacctgctccagctcgaggcgattttgcctacgcggcacctgcccccccggatggcgcactctcccatccacaggccccaaggtggccacctcatcctggcaagagtcgggaagacagggatccacaaagggatgggctgccaggaccttgcgccgtggcccagcccggaccagcgcaggcgggaccccaaggccaaggggtgctcgctccacccacatcacaggggtcaccctggtgggggtggggccgtggaccccaggtcgccggggcagcctgggagccacaagcaggtgccgccccaccgccacagcccgccccccccgatgcctcagcgagtgctagacagggtcaaatgcagggtatacctgcccctagtcaggccctgcaggaaccagctccttggtctgcccttccctgcggcttgcttctggatgaactgctggcaagtcccgagtttttgcagcaggcacaaccactcctggagaccgaagcccccggggaactcgaagcgagtgaggaagccgcctccctggaggcccctctgagtgaagaggagtacagagcactgctggaagagctgtag

SEQ ID NO: 11711 - DNA, 1419 bp, Artificial Sequence
  Description of Artificial Sequence: Synthetic coding sequence
atgaatggatacggaagcccctatttgtatatgggcggtccagtgtcccagccccctagagcacctctgcagagaacgcctaagtgcgcccggtgccgcaaccatggagtattatcttggttgaaggggcataagcggtactgcaggtttaaagattgtacctgcgagaagtgcatcctgatcatagaaagacaaagggtgatggctgctcaggtcgctctaaggcgccagcaggctaacgaatctcttgagtccttaatccccgacagccttcgggcgctccccggaccccctcctccaggggacgccgtggccgccccccagcctccccctgcttcccagccatcacagccacagcctccacgcccagctgcagagctggccgccgctgccgccctgcggtggaccgctgagccgcagccgggggccctccaggcacagttagcaaagcctgaccttacagaagagcggcttggcgatgggaagagcgcagacaataccgaggtgttcagcgacaaagacactgatcagagaagcagccctgatgtcgccaaatcgaaaggctgctttactccagaatctcccgaaattgtctctgtcgaggagggcggatacgctgtgcagaagaacggaggaaatccagaatctcggcctgacagccccaagtgccatgcggagcagaatcacctcctcattgaggggccttctggaacagttagtctaccatttagcctgaaggcaaatcgaccgcctctggaggttctgaagaaaatttttccgaatcagaaaccaacggttctggagttaatcctaaaaggatgcgggggggacctggtttctgccgtggaagtgctgttgagtagtaggtcgtccgtgaccggggccgaaagaacttcagccgaacccgaaagcctggccctgccaagtaatggccacatttttgagcacactctgagttcttatccgatcagcagttcgaaatggtctgtcgggtccgcttttcgggtccctgacaccctacgcttcagcgcagactctagcaacgtcgtcccatcgcctctcgccgggcctctccagccaccctttccacagccacctagatacccacttatgttgcgcaatacacttgctcgctcccagtcctcccccttcctaccgaatgacgtcaccttatggaacactatgacgctgcagcagcagtaccaactcagatctcagtacgtgtcccctttcccttcaaatagcacaagcgtttttcgcagttctcctgtgctgccagctcgggctacagaggaccctaggatttccattcccgacgacgggtgcccattcgtgtctaaacagagcatatacactgaggacgactacgatgaaagaagcgactctagtgactccaggaccctcaacacatcaagttag

SEQ ID NO: 11712 - DNA, 339 bp, Artificial Sequence
  Description of Artificial Sequence: Synthetic coding sequence
atgcacactagaaagcgactgacccagctgttctgtttcccggaccttacagaagaacgcctcggggatggcaagtccgctgacaacacagaagtcttctcagataaagatacagaccagaggagctcacctgacgtggctaagtctaaagggtgtttcacaccagagtccccggaaatcgtgtcagtggaggagggagggtatgctgtacagaagaatggagggaaccccgaatcacggccggactccccaaaatgccatgctgagcagaatcacctgctgatcgagggtcctagcggaactgtgtccttgcctttttcactgaaggcgaacagatag

SEQ ID NO: 11713 - DNA, 1701 bp, Artificial Sequence
  Description of Artificial Sequence: Synthetic coding sequence
atggctctgtccgtacctggctacagtccgggattccgtaagccacccgaagtcgttcgacttcgtcgcaagcgggcacggtcccgaggcgcagctgctagcccaccaagggagctgaccgagcccgcagccaggagagctgctctggtggccggtttaccacttcggcccttccctgctgcaggcggaagaggcggcgggagtggcggcggccccgctgcggccagaaggaatccttttgcaagactggacaacaggcctagagttgctgccgagccaccagatggtcctgccagagagcagcccgaagcccctgtgccgttcttggactccaaccaagagaacgacttgctgtgggaggagaagttccctgaaaggactactgtcacagagctcccgcagaccagccacgtgtctttttctgaacccgatatcccatcttcaaagtctacagagttgcccgtggactggtctattaaaaccagacttctttttacctccagccagcccttcacttgggccgatcacttaaaggcccaagaagaagcgcaaggcctggtgcagcactgccgcgccaccgaggtgacactgcccaaatctatacaggatccaaagctctcaagtgagcttagatgcacttttcagcagagtctgatttactggctccatcccgccctctcgtggctgccgctgttcccgcggattggtgctgaccggaagatggcaggcaagactagcccttggtctaacgacgcaactttacaacacgtcctcatgagcgactggagtgtgtctttcacctctctttacaatcttctgaagaccaagttgtgcccttatttttacgtgtgcacctaccagttcacagtcctgtttcgggcagccgggctggcagggagtgatctgatcaccgccctgatcagccccaccacaagaggactccgagaagcgatgcgcaacgaaggtatcgagttcagtctgcctctgattaaggaatcgggtcacaaaaaagagaccgcgtccggcacctctctgggctacggcgaggagcaggcgatctccgatgaagatgaggaagagtcattcagctggctcgaagagatgggcgtgcaagataaaatcaagaagccggacattctgagcatcaagctcaggaaggaaaagcatgaagtgcaaatggaccaccgccctgaaagtgtagtcttggtgaaggggattaacacgttcacgcttctgaacttccttatcaatagcaaaagtctcgtcgcaacaagcgggccacaggctggactcccacccacgttactctctcctgtggctttccggggggccactatgcagatgctgaaagcacggtcagtcaatgtgaaaacacaagcgctgtctggatacagagatcagttctccctggaaattaccgggcccattatgccccatagcctccactcactgaccatgttgctcaagtcatcacagagtggatccttttcagccgtcctctatccgcatgagcctacggccgtgttcaacatctgtctccagatggacaaggtgctcgatatggaggtcgtccacaaagaactgacaaactgtggtctgcaccccaatactctcgaacagctctcacagatcccactcctggggaagagctctttaagaaatgtggtgctccgcgactacatttacaattggagatcatag

SEQ ID NO: 11714 - DNA, 618 bp, Artificial Sequence
  Description of Artificial Sequence: Synthetic coding sequence
atgcccagtaagaagaaaaagtacaacgcgcggttccccccagcccgtatcaagaagatcatgcagacggatgaggaaattggcaaggtagccgcagcagttccggttattatctctagagccctcgagctgttcttggagagcctcctgaaaaaggcttgtcaggtaactcagagcaggaatgccaaaaccatgactacttcacatcttaagcaatgcatcgagttggagcaacagttcgactttctcaaggatctggtagccagcgttccagacatgcagggtgatggcgaagacaaccacatggatggcgacaagggtgccaggcgtggccgtaagcccggctctggcggacgcaagaacggcggaatgggcaccaaatctaaggacaaaaagttatccggaacagattctgagcaggaggacgagtctgaggatactgacactgacggcgaagaagagacatctcagcctcccccacaagcaagtcaccccagcgctcactttcaatcgcccccaactccattcttgccatttgcgtcaactctgcctctcccacccgcaccccccgggccatctgccccagacgaagaagacgaggaagattatgacagctag

SEQ ID NO: 11715 - DNA, 750 bp, Artificial Sequence
  Description of Artificial Sequence: Synthetic coding sequence
atgaacccaagtcctagcaagatccgaattaatctggaggacaacgtccagtacgtatctatgagaaaagctctaaaggtaaaacgacctaggttcgacgtctccctggtgtatttaacacggaagttcatggatctggtgcgatcggccccaggcggcattctggacctgaataaggtcgccaccaagctcggtgttcggaagcgacgagtgtacgacattaccaatgtgctggacggcatagacttggtggaaaagaagagcaagaaccatattagatggatcggttctgatttaagtaatttcggagctgtgcctcaacagaaaaaactccaggaagagttgagcgatctctcagcgatggaggacgctctggatgaactcatcaaagattgtgctcaacagctgtttgagctcaccgacgataaagagaacgaacggctggcctatgtaacttatcaagacattcatagtatacaggcctttcatgaacagatcgttattgcagtgaaagcccccgctgaaactcggctcgatgtcccagcaccaagggaggacagcattacagtgcacatcaggtcaacaaatggtcccattgacgtgtatctatgcgaagtagagcagggccagacaagcaacaagcgatctgagggcgtgggaacatcctccagcgaatctacacacccagaggggccagaagaagaggagaacccacaacagagcgaagagctcttggaagtctctaattag

SEQ ID NO: 11716 - DNA, 402 bp, Artificial Sequence
  Description of Artificial Sequence: Synthetic coding sequence
atgagtcagcaacgaccagcccgaaagctaccgagcctgttgcttgaccccacagaggagactgttcgacggcggtgcagagatccaatcaatgttgaggggctgttgccctcaaagatacgcatcaacctcgaagataacgttcaatacgttagcatgcgcaaagctctgaaggtgaagagacctcgttttgacgtaagcctggtgtacctgactagaaagtttatggacctcgtgcggtcggccccgggggggattctggacctgaataaagtcgccactaagctgggagtccggaagcgtcgtgtgtatgatatcactaacgtgctggatgggattgacctagtagagaagaagagcaagaatcacatacgctggatgaccctatctcagtgtacctag

SEQ ID NO: 11717 - DNA, 846 bp, Artificial Sequence
  Description of Artificial Sequence: Synthetic coding sequence
atgagccagcagcggcctgccagaaagctgccatcattgttgctcgaccccactgaggagactgtccgccgccggtgtcgtgatcctatcaacgtagaaggactgctcccgagcaagattcggatcaacttagaagataacgttcagtatgtgtccatgcgcaaggcactgaaagttaaacgcccgcggtttgacgtctctctggtgtacctcacgcgtaaattcatggatctggtgcgctctgcaccgggtggcatccttgacttgaacaaagtggcaaccaagctgggtgtccggaagcggagggtctatgacatcacaaacgttctcgacggtattgacctggtggagaagaagtctaagaaccatattagatggattggatccgacctgtccaacttcggcgcagtccctcagcagaaaaaattacaagaagagttgtctgaccttagcgcaatggaggacgcgctggacgaactgattaaggattgtgcccagcagctgtttgagctgacagacgataaagaaaatgaacgactagcctacgttacttaccaagatattcattctatccaagcattccacgaacagatagtcatcgccgtaaaagcgccagctgaaactcggctggacgtgcctgccccgagagaagatagcatcacggttcatatccgcagcaccaacggacctattgatgtgtatctgtgtgaggtcgagcaggggcagactagtaacaaacgctcagagggcgtgggaacgagctctagcgagagcactcaccctgagggacccgaagaagaggaaaacccacagcagtcagaagagttgctggaagtgtcgaattag

SEQ ID NO: 11718 - DNA, 621 bp, Artificial Sequence
  Description of Artificial Sequence: Synthetic coding sequence
atggatctggtgcgcagcgccccaggcgggatcctggaccttaataaagtggctaccaaactgggagtgcgcaagagacgagtatacgatatcacaaacgtacttgacggtattgatcttgtagagaaaaaatcaaaaaatcacattagatggatcgggagcgatttgtctaactttggagcggtgcctcagcagaaaaagcttcaagaagagctttcagacctgagcgctatggaagacgcactggacgaactcataaaggattgtgctcaacagctgttcgagctgaccgatgacaaggaaaatgaacggctagcatatgtgacctatcaggatattcactcaattcaggcattccatgagcagattgtgattgctgtgaaggcaccggcagagacccggcttgatgtgcctgcgcccagggaggactctatcactgtacacattcggtccacaaacggtccaatagacgtttatctttgcgaagtagaacaggggcagaccagcaacaaaagatccgaaggtgtcgggacaagttcctccgagagcactcacccagagggaccagaggaagaggagaatcctcagcaatctgaggagcttcttgaggtctccaactag

SEQ ID NO: 11719 - DNA, 621 bp, Artificial Sequence
  Description of Artificial Sequence: Synthetic coding sequence
atggatctggtgagaagcgctccgggtggtattctggacttaaacaaagtcgcgactaagctgggagtgaggaaaaggagagtctatgacatcacgaacgtgctggacggtatcgacctcgttgaaaaaaagtcaaaaaaccacatcagatggattggctccgatctctccaatttcggggccgtcccccaacaaaaaaagcttcaggaagagctgtcagacttgagtgcaatggaagatgcgctggatgagctgataaaggactgcgctcagcagctgtttgaactcactgacgacaaggagaacgagcgtctggcttacgttacctaccaggatattcacagcattcaggcctttcatgagcagatcgtgattgcggtgaaagcccctgccgagactcggctggacgtgcctgctcccagggaagacagcatcaccgtgcacatccgctctaccaatggcccaattgatgtctatctctgcgaggtggagcaggggcagactagtaacaaaaggagcgaaggcgtaggaacatcttcttccgaaagtacacaccccgagggccccgaagaggaggagaacccccagcagtcagaggaattgctggaggtgtctaactag

SEQ ID NO: 11720 - DNA, 1860 bp, Artificial Sequence
  Description of Artificial Sequence: Synthetic coding sequence
atggcggctgttgtacagcaaaacgatctagtcttcgaatttgcgtcaaacgtgatggaggacgagcgccagctgggtgaccccgccatttttcctgctgtgatagtggaacatgtgcccggcgcagacattctgaattcctatgccggtctcgcgtgtgtggaggaaccgaatgacatgattactgaaagtagcctcgacgtcgccgaggaagagataatagatgacgatgacgacgacattacactgaccgtcgaagcaagctgccacgatggcgatgagactattgagaccattgaagccgcagaggcccttctaaacatggactcacctgggccgatgctggacgagaagaggataaacaacaacatattttcctcccctgaggacgatatggttgtcgctcccgtgacccatgtgtcggtaacactggatgggatccccgaggtgatggaaactcagcaagtccaggaaaaatatgcggatagcccaggggcaagctcacctgaacagcctaagcgcaagaaagggaggaaaacaaagccacctcgcccagattccccagccaccactcccaacataagcgtgaagaagaagaataaagacggcaaaggaaatacaatctatctttgggagtttctgctggccctgttgcaagacaaggccacctgtccaaagtatatcaagtggacccagagggagaaaggaatatttaagcttgtcgacagtaaagccgtctcccgactctgggggaaacacaaaaacaagcccgatatgaactatgagaccatgggccgggcactgaggtactattaccagaggggcatccttgccaaggtggagggccagcggttggtgtaccaattcaaggaaatgccaaaagatctcatctatattaacgacgaggaccctagcagctccatcgaatcctcagacccttccctctcgagctcagccactagcaatcgcaaccaaacctcccggtctcgcgtctctagctctccaggggtgaaggggggggctacaacagtcctcaagccaggcaattcgaaagcagccaagcctaaggaccccgtggaggtggctcaaccctcagaggtgttgagaaccgtgcagccaactcaatctccatatcccacccagctctttcggacagtccacgtagtgcagccagtccaggccgtccccgaaggggaggctgctaggacatccacaatgcaagatgagacgcttaattcctcggtacaatctatccgaacgattcaagcacctactcaagtccccgtcgtggtaagccctagaaaccaacaattgcataccgttaccctgcagacagtcccactcactactgttatcgcgtccaccgacccctctgcgggtaccggctctcaaaaatttatcctgcaggccattcctagctcacagccaatgaccgtgcttaaagaaaacgttatgctgcaaagtcagaaagccggtagtccgccatcgattgtgctgggccccgctcaggtgcagcaggtgctgacttctaacgtacagacaatttgtaatggtaccgttagcgtggcgagcagcccatctttttcggcaaccgcccctgtggtgacattctcaccacgtagctcccagctcgttgcccatcccccaggtaccgtaattacctccgtcattaaaacccaggaaactaaaacgctcacacaggaagtggaaaagaaagagtccgaggaccacctcaaggagaatacagagaaaaccgaacagcagccccagccctacgtgatggtcgtgtcatcaagtaatggattcacatcacaagtagcgatgaagcagaatgagctgctggaacctaactctttctag

SEQ ID NO: 11721 - DNA, 1086 bp, Artificial Sequence
  Description of Artificial Sequence: Synthetic coding sequence
atgaactatgagactatgggccgcgcccttcgttattactaccagagagggattctcgcaaaagtcgagggccaaaggcttgtctatcagtttaaggagatgcctaaagacctgatttatatcaacgatgaggacccttcttccagcatcgagtcgtcagatccttccttaagtagtagcgccaccagtaaccgcaatcagacgtctcgcagtcgggtttcctcaagtcccggggttaaggggggcgctactaccgtcctaaagccaggcaattccaaagccgctaagcccaaggatcctgtggaggttgcgcagcctagcgaagtactgcggaccgtccagccaacccagtccccgtaccctacacagttgttccgcaccgtacatgttgtgcaacctgttcaggcagttcccgagggagaagcagctcgcacctcgactatgcaggatgagacactgaacagctctgttcagtctatccgcacgatacaggcccctacccaagtccccgtggtcgtctcccctaggaaccagcagttacacactgtgacactccagactgtccctctgacaactgtcattgcctcaaccgatccatcggccgggaccgggtcacagaaattcatcctgcaggccataccatcatcccagcccatgacggtcttgaaagaaaacgtgatgctgcaaagtcagaaggcagggtcacccccatctatagtcctggggccagcccaggttcagcaggttttgacaagtaatgttcagaccatctgtaacggcaccgttagtgtggcttcttcaccctctttctccgccaccgctcccgttgtcacatttagtccaagatcttctcagctggtggcccatccccctgggaccgttattacctcagtcattaaaacccaggaaaccaagaccctcacacaggaggtcgagaagaaagaatctgaagaccatctgaaggagaatacggagaagaccgaacagcagccacagccttatgtcatggtggtctcttccagcaacggctttacttctcaggttgccatgaagcagaacgagcttttggagcccaactccttctag

SEQ ID NO: 11722 - DNA, 75 bp, Artificial Sequence
  Description of Artificial Sequence: Synthetic coding sequence
atggccgcagtcgttcagcagaacgacctggtgtttgaattcgcttcaaacgtgatggaggatgagagacagtag

SEQ ID NO: 11723 - DNA, 1788 bp, Artificial Sequence
  Description of Artificial Sequence: Synthetic coding sequence
atggcagctgtggtgcagcagaatgacctagtgtttgagttcgcctcaaacgtcatggaagatgagaggcagctcggcgaccccgctattttcccggcggttatcgtggagcacgtacccggcgctgacatcctgaacagttacgccgggctggcctgcgtcgaggagccgaatgatatgatcaccgaaagttcactcgatgttgctgaagaagagattattgatgacgatgacgacgatatcacactcaccgtagaggcctcctgtcatgatggcgacgagacaatcgagaccatcgaggctgccgaggcgttactcaatatggattctcctggcccaatgctggacgaaaagcgaatcaacggtatacctgaagttatggagacccaacaggtccaagagaagtatgccgactctcccggcgcatcttctccagagcaaccaaagagaaaaaaaggacggaagacgaagcccccacgccctgatagcccggcaacgaccccaaatatatctgtaaagaagaagaacaaggacggcaagggtaacaccatctacctgtgggagttcctgctcgccctgctacaagataaggccacttgcccgaaatacattaaatggacacagcgtgaaaagggaatttttaaacttgtcgatagcaaggccgtcagcaggctgtgggggaagcataagaataagcccgatatgaactatgagactatgggacgtgccctacggtactattaccagcgggggatccttgcaaaggtggaaggacaacggctcgtgtatcagtttaaggaaatgcctaaggatttgatctatatcaacgatgaagatcctagcagcagtatcgagtcctccgacccaagcctctcttcctctgcaacaagtaaccgcaaccagacgtcacggtctcgagtctctagctcccctggggtaaaaggtggggcgaccacagttctgaagcccgggaacagcaaggcagctaaacccaaggacccggttgaggtagcccaaccaagtgaagtgctacgtaccgtacagcccactcagagcccataccccacacagttgttcagaactgtgcacgtagttcagcccgtgcaggctgtgcctgagggtgaagccgcccggaccagcacgatgcaggacgagactctaaattcgtccgtgcagtccatcagaaccatccaggctccaacccaggtgccggttgtcgtctctccccgaaatcagcagctacacactgtaaccctgcaaactgtgcccctgaccactgtcatcgcgagcacagaccccagcgcagggactgggagccagaaatttatcttacaggcaattccatcctcccagccaatgacagttctgaaagagaatgtgatgctacagtcccagaaagccggaagccccccctccattgtcctcggacccgcacaggtccagcaggttctgacctccaatgtgcagacaatttgtaacggtaccgtctctgtggcctccagcccttcgtttagcgccaccgcccccgtcgtcactttttctccccgctccagtcagctggtggcccatcctcctgggaccgtaatcacctccgttatcaaaacccaggagaccaaaaccttgacccaggaggtcgaaaagaaagagagtgaagatcatctgaaggagaataccgaaaagaccgagcaacagccacagccttatgtgatggtcgtgagtagcagcaacggattcacaagtcaggtggcgatgaagcagaacgagctgctggagcctaactcattctag

SEQ ID NO: 11724 - DNA, 1776 bp, Artificial Sequence
  Description of Artificial Sequence: Synthetic coding sequence
atgtttggcatacaggaatccatacagcggtccggatcttccatgaaagaggagcccctcggctcaggcatgaatgctgtgcgcacatggatgcaaggagccggcgtcctggatgctaacactgcggcccaatccggagtgggcctggcaagagcccacttcgagaagcagccaccatccaatctgaggaagagcaatttctttcatttcgttttagcactatatgatcggcagggccagcctgtagaaatcgaacgtacagcgttcgtagggtttgttgagaaagaaaaggaggccaactccgagaagactaataacgggatccattaccgtttgcagttgctgtattcaaacgggatcagaacagagcaggacttttatgttcgccttattgatagcatgaccaaacaagccatagtttatgagggacaggacaagaacccggaaatgtgcagggtgttactgacccacgagataatgtgcagcagatgttgtgataaaaagagttgtgggaaccggaacgaaacaccctccgaccccgttattattgataggttttttctcaagttcttcctgaagtgtaatcagaactgccttaagaacgctgggaatcctcgtgatatgcgtaggttccaggttgtcgtgtcgaccacagtcaacgtggacggccatgtgctggctgtgtctgataacatgttcgtgcataataattccaaacacggtagacgtgcacgtcggttggatcctagcgagggcaccccttcttacctggaacatgccacaccatgcattaaggccatttctccctccgagggctggacaacaggcggggcgaccgtcatcatcataggagacaactttttcgatgggctgcaggtgatctttggtactatgctggtatggtcagagctgatcactccccacgctattagggtgcagactccccctagacacattccaggagtggtggaggtgactctctcatataaaagcaaacagttctgcaagggtacacccggtcgctttatttataccgccctaaacgagcccactatcgattatggctttcagaggctgcaaaaagtaatcccgaggcatccaggagacccagagaggcttccaaaggaagtgatcctgaagagagcggccgaccttgtggaagccctctatgggatgccccataataatcaggaaatcattctcaaacgtgccgccgacatcgccgaagccttgtatagtgttccgcggaaccacaaccagctacccgccctggccaacactagcgtgcatgctgggatgatgggagttaactcttttagcggacagctggcagttaatgttagcgaggcatcccaggcaaccaaccagggatttacaaggaattcgtcgtctgtctctccccatggatatgtgccatccactactccccagcagactaattacaactcagtgacaacaagcatgaacgggtacggatctgccgctatgtctaatctcgggggaagtccaacattcctcaacgggagtgccgcaaattcaccctacgctatcgtaccatctagtccaaccatggcatcgtctactagcctcccctctaactgctcctcttccagcggtatcttcagtttctcccccgccaacatggtctctgcggtgaagcagaaatcagcctttgccccagtggtgcgacctcagacctccccaccccctacctgtacctctaccaatggaaattccttgcaagccatttccggcatgattgtgcctccgatgtag

SEQ ID NO: 11725 - DNA, 1776 bp, Artificial Sequence
  Description of Artificial Sequence: Synthetic coding sequence
atgttcggtattcaggaaagcatccagaggagtgggagtagcatgaaggaggagcccctcggttccggcatgaatgctgtgcggacatggatgcaaggagccggcgtgttggacgctaacaccgccgcccagtccggtgtgggattggctagagcacactttgaaaagcagcccccctctaacctacggaagtctaattttttccattttgtcctcgcactgtatgatagacaggggcagccggtagaaattgagagaacggcttttgtgggattcgtggaaaaggaaaaagaagctaactctgagaagacgaacaatgggattcattatcgcctgcagctactgtattccaacggcatacggaccgagcaagacttctacgtaaggctgatcgactcgatgaccaagcaggccattgtttacgaaggacaagacaagaaccccgagatgtgccgtgtactcctgacccacgagatcatgtgtagcaggtgttgcgacaaaaaaagttgcggcaacagaaacgagacacccagcgatcctgtcatcatcgacagattctttctgaaattttttctgaagtgtaatcagaactgcctaaaaaacgccggcaatcccagggacatgcgtcgattccaggtggttgtgagcacaaccgtgaacgtggacggccacgtactagccgtgagcgacaacatgtttgtccacaataactccaagcatggacgcagagcccgcagactcgacccctctgaaggtactccatcttatctggagcacgccactccttgtatcaaagccatctccccctccgaaggctggaccactggtggcgccactgtcatcatcattggcgacaatttctttgacggattgcaggttattttcggcaccatgttggtgtggagcgagctcatcactccccatgctatcagggttcagacacctccccgacacatccccggcgtggtggaggtgactctctcttacaagtcaaaacagttctgtaaagggacccctgggaggtttatctacacagctttgaatgaaccaaccatcgactacggatttcagaggctgcagaaggtgattcctagacacccgggcgaccctgaaagactgccaaaagaggtgatcttgaagagggccgcggatctggtggaggctctgtatggcatgccccataacaaccaggagataattctgaagcgagctgccgacatcgcagaggctttgtattctgtacccaggaaccacaatcagttaccagccttagctaacacaagcgttcatgcaggcatgatgggggtgaactcatttagcggccagttggctgttaatgtctcagaagcctcacaggccacaaatcaaggctttaccagaaactcgagtagcgtatcccctcacggatacgtgcccagcactacacctcagcaaactaactacaactcagtgaccacctcaatgaacggatacggcagcgcagctatgagcaatctcggcggttccccaacctttctgaatgggtccgccgcaaactctccttatgctatcgttcccagctcgcctacaatggctagctccacgtctctccccagtaactgctcgtcctctagcgggatcttctccttttccccagccaacatggtgtcagcagtcaagcagaaatccgcttttgcgcccgtggtccgccctcagacatcaccacctccaacttgtacttccacaaatggaaattctcttcaggcaatctccgggatgatcgtcccccccatgtag

SEQ ID NO: 11726 - DNA, 1683 bp, Artificial Sequence
  Description of Artificial Sequence: Synthetic coding sequence
atgtttggtatccaggaatccatacagcggtcgggcagcagcatgaaggaggaacctctggggagcggcatgaacgccgtgaggacgtggatgcagggagcaggagtgctagatgcaaatacagccgcccaaagtggagttggactcgcccgcgctcactttgaaaaacagccccccagtaatctccgcaaaagtaacttttttcattttgtccttgctctctatgaccggcaggggcagcccgtggagatcgagcggacagccttcgtgggcttcgtggagaaggagaaagaagccaattccgagaaaactaacaacggcatccactacagactccaactgctctactccaatgggattcgcacagagcaggacttctatgtgcggcttatagacagtatgacaaaacaggctattgtgtatgagggtcaagataagaaccccgaaatgtgtcgagtgttgctgactcacgagatcatgtgccggttctttctgaaatttttccttaagtgcaatcaaaactgccttaagaacgccggcaacccgagggacatgcgacggtttcaggtggtcgtgtcaaccacagtgaacgtggatggccatgtgctggccgtgtccgataatatgtttgtgcacaataatagcaagcacgggcggagggccaggcggcttgatcccagcgaagcaaccccttgcatcaaagcgatctcacccagtgaagggtggacgaccggcggcgccacagtaattattattggtgacaatttttttgacggcttacaggtcatctttggaaccatgctggtctggagtgaacttattacacctcatgcgatcagggtgcaaactcccccccggcacattcctggggtcgtggaagttaccctatcgtataagtcaaagcaattttgcaagggtacacctggaaggttcatctatacagcactcaatgaacccaccatcgactacggcttccagaggttgcagaaggtcatccccaggcaccccggggaccctgagcgattgccaaaagaagttattctgaaacgcgcagcagacctggtcgaggcgctttatggtatgccccataataaccaggagattattcttaaaagagccgcagatattgccgaggccttgtatagcgtaccaaggaaccacaaccagcttccagctctggcaaacacctcggtgcatgcggggatgatgggtgtgaactcattctcagggcagctggcagtgaatgtctctgaggcatctcaagcaactaaccaaggtttcactcggaactcttcgagcgtgagtccgcacggatacgtgcctagtactactccccagcagacaaactacaattccgttacaacaagcatgaacggttacgggtcagcagcaatgtcgaacctgggaggctctcctaccttcttaaatggctccgctgctaattcaccttacgccatcgttccctccagtccgacaatggcttcttcgacctctctgcccagcaactgctcttctagctctggcatcttttctttctctcccgccaacatggtttctgcggttaagcagaagtcagccttcgccccagttgtacgacctcaaacctcaccgcctccaacctgcacctctaccaacgggaatagcctacaggctattagtggaatgatcgttccgccgatgtag

SEQ ID NO: 11727 - DNA, 4506 bp, Artificial Sequence
  Description of Artificial Sequence: Synthetic coding sequence
atgtgcaaaatggcaattatacccgactggttgcgttcccacccccacaccaggaagtttacacattcccgaccacattcttcaccctgccgtgtctactccagaaatggctcgccgaacaagttccggtctagttccaccaccgctgttgcgaatcctactttaagtagcctggacgtgaagcggattctgttccaaaagattacggatcgcggcgacgagctccagaaggctttccagctgttggataccgggcagaacctgactgtatctaaatcagagctccgccgaataatcacggactttctgatgccactgactagagagcagttccaggatgtcttagcgcagatccctctttccacatcaggaacggtaccttacctggcgtttctcagtcgattcggcggtattgacctgtacataaatggtattaagcgaggagggggcaacgagatgaactgttgcaggactctccgggagctggagattcaggttggcgagaaagtgttcaaaaacattaagacagtgatgaaggctttcgagctgatcgatgtgaataagacgggcctggtgaggccccaggaattaaggcgggtgctagaaaccttctgcatgaagctgagggacgaagagtacgagaagttttcgaagcactacaatattcataaagatactgcggttgactacaatgtgttcctgaaaaacctttcaataaacaatgatctgaacctccgttattgtatgggcaatcaggaagtgagcttggagaaccaacaggcaaaaaattctaagaaagaaaggcttctcggtagcgcctcttcagaagatatttggcgaaactacagtctcgatgagatcgaacgaaacttttgcttgcaacttagtaagtcttatgagaaggtggagaaggccctgtcagccggggacccttgcaaaggcgggtacgtgtcatttaactacttgaagattgtgctggatacattcgtataccagatcccgcggcggatcttcatccaacttatgaagcgttttggcctgaaggcaacaacaaaaattaactggaagcagttccttacatccttccatgaaccccaaggtctacaggtgagctcgaagggccctttgaccaagagaaactcaatcaattcaaggaacgaaagccataaagaaaatataatcacgaagttatttcggcatactgaagaccactccgcttccctcaagaaagccctcttgataattaacacgaaacccgacggaccaattacccgggaagaatttcggtatatcttgaactgtatggcagtcaaacttagtgatagtgaattcaaagaattaatgcagatgcttgacccaggtgacactggcgtggtgaatacgagcatgttcatcgatctgatcgaagaaaattgcaggatgagaaagacatcaccatgcactgacgcaaagacaccattcctactggcgtgggactctgtggaggaaattgtccacgacactattactaggaacctccaagccttttacaacatgctcaggtcgtacgacctgggtgatacagggcgaatcgggcggaacaatttcaaaaagatcatgcacgtgttttgtccattcctgacgaatgctcattttattaaactatgctccaagatccaggatataggcagcggaaggatcctctataaaaaattgctggcttgtatcgggattgacggcccgccgaccgtaagtcctgtgcttgtccctaaagaccaacttttgagcgagcatttgcagaaggatgaacagcagcagcctgatttgagcgagcggactaagctgacagaggacaagaccactctaacgaagaagatgacaaccgaggaagtgattgagaagtttaagaagtgcatccaacagcaggaccctgccttcaagaagaggttcttggatttttccaaggaacctaatggtaagattaatgttcacgattttaagaaggtgctcgaagatacaggcatgccaatggatgacgatcagtacgccttactcacaacgaagattggcttcgagaaagaaggaatgagctacctggatttcgccgcggggtttgaggaccctccaatgcgcggaccagagaccactccaccccaaccccccacaccatccaagtcttacgtgaacagtcacttcataaccgccgaggagtgtctcaagctcttcccgaggaggctgaaggaatcatttagagatccttactctgcattttttaagacagacgcagatcgagacggtataattaacatgcacgacctgcatcgcctgctgctgcacctgctcctcaatctcaaagacgacgaattcgagaggtttctgggcttacttggtctaaggctgagtgtaactttgaatttcagggaatttcagaatctctgcgaaaagcgcccatggcggaccgatgaagcaccccaacggttaatcaggcctaagcagaaggtcgccgattctgagctcgcttgtgagcaggcccaccaatacctggtgaccaaggcaaaaaacagatggtccgaccttagcaaaaattttctggaaacggataacgaagggaacgggattctccggaggcgggatataaagaatgccctgtatggatttgacatacctcttacaccccgggaattcgagaagctgtgggccagatatgacaccgaaggtaaggggcacatcacttaccaggagttcttgcagaagctgggcattaactacagcccagcagtccataggccctgcgccgaggattactttaattttatggggcacttcactaagccccagcaactccaggaggaaatgaaggaattgcaacagtcgaccgagaaagccgttgctgctagggacaagctgatggatcggcatcaggacatttcaaaagccttcacgaaaactgatcaaagcaaaacaaattatattagtatttgtaagatgcaggaggtgctggaggagtgcgggtgctctttgactgaaggagagttaactcatctcttgaacagctggggcgtcagccggcacgacaatgccatcaattatcttgacttcctgagggccgtggaaaacagcaagagcacaggagcccagcccaaggaaaaagaagaaagtatgcctatcaattttgctacattgaatccgcaggaagccgtgcggaagatccaggaagtggttgagtcttcccaattggctctctcaaccgctttttccgcgctggataaagaggatacggggtttgtaaaagcgaccgagtttggacaagttttgaaagacttttgttacaagctgaccgacaaccagtatcattattttcttcgcaaacttaggatccatctaaccccctatatcaactggaagtatttcctccagaacttcagttgtttcctggaagagactgctgacgagtgggcagaaaaaatgccaaaggggccccccccaactagtcccaaagccaccgcagatcgcgatatactggctcgcctgcacaaagccgtgacctcgcattaccacgccattacccaggagttcgaaaatttcgacacaatgaagactaacacaatttctagagaggagtttcgggccatctgcaacagaagggtgcagattcttaccgatgagcaatttgacaggttgtggaatgagatgccagtgaacgccaagggcagactgaagtaccctgacttcctgtctcgcttttcctccgagactgctgccacacctatggctacgggtgattctgccgtcgcccagaggggctcaagtgtcccagatgtttcagagggcacgaggagtgccctgtcacttccgacccaggaattgcggcctggttctaaaagccagtctcacccatgcacgccagccagcacaactgttattcccggcactccccccctgcagaactgtgacccgattgaaagtcgcttaagaaagcggatccaggggtgctggagacagctgttgaaagagtgtaaggagaaagacgtcgcgagacagggtgatatcaacgcaagcgattttcttgctctagtagagaaattcaatttggacatttctaaggaagaatgtcaacagctgataattaagtacgatttgaagtctaacggcaagtttgcctactgcgacttcatccagagctgcgtacttctgctcaaagctaaggaatcctcattaatgcacaggatgaaaatacaaaatgcgcacaagatgaaggaagcaggtgccgagacacctagcttctacagtgctctgctgcgtatccagcccaaaatcgtacactgttggcgcccaatgagaagaaccttcaaatcgtacgatgaggcagggactggactgctctctgttgctgacttcagaacagtgttgagacagtactcaattaaccttagcgaggaggagtttttccatattctggagtactatgacaagactctgagctccaaaatcagttataacgacttcctgcgggcctttctgcagtag

SEQ ID NO: 11728 - DNA, 732 bp, Artificial Sequence
  Description of Artificial Sequence: Synthetic coding sequence
atggtgccacagattagttccgacctgctgcagattcccctatccaccagcggaactgtaccttatctggcgttccttagcagatttgggggaatcgatctttatatcaacggcatcaaaagaggaggggggaatgagatgaactgctgccgtactctgagggaattagaaattcaggtaggagagaaggtgttcaagaacattaaaaccgtgatgaaggcttttgaactgatcgacgtgaataagacggggttggtcaggcctcaagaacttagacgagtgctcgaaacgttctgtatgaagctgcgtgacgaggaatacgagaaattcagcaaacattataatatccacaaagacaccgcagtcgactataatgtctttctgaaaaatctttctatcaacaatgacttaaatctcaggtattgcatgggcaatcaggaagtgtccctggagaatcagcaggctaagaattctaagaaagaaagactgctgggcagcgcctctagtgaggatatatggcgaaactactcattggatgagattgaaaggaatttctgtctgcagctgtcaaagagctacgagaaagttgagaaagcactgagcgccggggacccttgtaagggaggctacgtgtcatttaactacctgaaaatcgtgctggacacattcgtctaccagatccctaggcgaatatttatccagttgatgaaacgtaatcctatggatcgatag

SEQ ID NO: 11729 - DNA, 4050 bp, Artificial Sequence
  Description of Artificial Sequence: Synthetic coding sequence
atgaattgttgcaggacgcttcgcgagctggaaatccaagtcggcgaaaaagttttcaaaaatattaagacagtaatgaaggccttcgaattaatcgacgtcaacaaaactggtcttgtgaggcctcaggagctcagaagagtgctggagaccttttgtatgaagctgagggatgaggagtacgaaaagtttagcaagcactataacattcacaaggatacagccgtagactataacgtgttccttaaaaatctgagcatcaacaacgatctgaacctgcgctactgcatgggaaaccaggaggtatcattggaaaaccagcaggctaaaaatagtaagaaagaacggctgcttggcagcgctagctccgaagacatttggcgtaattattcactcgacgagattgagcggaatttctgtctgcagctgtctaaaagctacgagaaggtggagaaggccttaagcgctggcgatccatgcaaaggaggatacgtgagctttaattacttaaaaattgttctggatactttcgtgtatcagattccccggcgaatatttattcaattgatgaaaagattcggcctcaaggctaccaccaagattaattggaaacaattcctgacatccttccatgagccacagggccttcaggtttcgtccaagggacccctgactaagcgcaatagtatcaattccagaaatgagtctcacaaagaaaatattattaccaaactctttagacacaccgaggaccacagcgcctccctgaagaaagccctcttgattatcaatactaaacccgacgggccaattactcgagaagagtttcgctatatcttaaattgcatggccgtgaagctcagtgactcggaatttaaggagttgatgcagatgctggacccaggcgatactggagtcgtgaatacatctatgttcatcgatctcatcgaggaaaattgccgaatgcggaaaacttcaccttgcaccgacgctaagacgcccttcctgctggcatgggatagcgtggaagagattgttcatgacactatcacacgcaacctgcaggccttttataacatgctccggtcttatgatcttggagacacagggagaatcggtagaaataacttcaaaaagatcatgcatgtgttttgtccctttctgacaaacgcccactttattaaattgtgttccaaaatccaggacatcggaagcggtcggattttatacaagaagttattagcctgcatcgggatagatggcccccccaccgtgagccctgttctcgtgcctaaggatcaactgctctcagagcatctgcaaaaggatgagcagcagcagcccgatttgagcgagaggactaagctgacagaagacaagacgaccttaactaagaagatgaccacagaggaggtgattgaaaagtttaaaaagtgcatacagcagcaagatccagctttcaagaagcgcttcctggatttctcaaaggaacccaatggcaagatcaacgttcatgatttcaagaaggtcttggaggatactggtatgccaatggatgacgaccagtatgcgttgctcaccaccaagattgggttcgagaaggaaggcatgagctatctggactttgctgctggcttcgaagaccctccaatgcggggtccagagaccacaccgcctcagcctccgaccccttccaaaagctacgttaattcccacttcatcaccgccgaggaatgcctgaagcttttccccagacggctgaaggagtctttccgagatccatacagtgctttcttcaagaccgacgctgaccgggatggcattattaacatgcacgatctgcatcggctgttgctgcacctcctgctgaaccttaaggatgatgagttcgaacgattcctgggcttgctcgggctgcgactgtccgtaacgctgaattttcgcgagttccagaatctttgtgaaaaaaggccttggcgaactgatgaggccccccagcggctgatccgcccaaaacagaaagtagccgactctgagctcgcatgtgaacaggcacaccaatatttggtgacaaaggccaaaaatcggtggtcagacctttcaaagaattttctcgagacagacaacgaaggcaatggcatcctaaggagaagggacatcaagaatgccctgtacgggttcgacataccattgacaccgagggagtttgaaaagctttgggcgcggtacgacaccgaagggaagggacacatcacttaccaagaatttcttcagaaacttggaatcaactactcccccgctgtacatagaccctgcgcggaagactactttaacttcatgggtcactttacgaagccacagcagctgcaagaagagatgaaggaactccagcaaagcactgaaaaagccgtggccgcacgggacaaattgatggatagacaccaggacattagcaaagcatttacgaagactgaccaatcaaagactaattatatttccatctgtaagatgcaagaagtgctggaggaatgtggctgcagcttgaccgaaggagaattaacacatctgcttaatagttggggagtcagcagacacgacaacgctattaattatttagactttctccgcgccgtcgagaattccaagtctaccggtgcacagccaaaagagaaggaggaatctatgcccatcaacttcgccacactgaaccctcaggaagccgtgcgaaaaatccaagaggtggtggaatcatcacaattggccctcagcacggccttctcggctttagataaggaggacacaggctttgtcaaggccaccgaattcggtcaggtgctgaaagatttctgctataagttgaccgacaaccagtatcactatttccttagaaagctgcgtattcatcttaccccttacatcaactggaagtacttcctgcagaacttttcttgcttcctggaggagaccgctgacgagtgggcggaaaagatgcctaaggggcctccccccaccagccccaaggctactgctgaccgagacatactggcccggctccataaggcggtcacaagccattatcacgcgataacgcaggagtttgagaactttgatactatgaagacgaacacgatttctagagaagagttccgggcgatatgtaatagaagagtccagattctcacggacgagcagtttgacaggctttggaatgagatgcccgttaacgcaaagggaagactgaaatacccagactttctctctcgcttcagctctgaaaccgcggccacgccgatggcaaccggcgattctgccgtggcccagcgtgggagttccgtccccgacgttagcgagggaacccggagcgccttgagccttcctacacaggaactgcggcccggctcgaagtcccagtcacacccatgtaccccggcttctactactgtgatccctgggacaccaccattgcagaattgtgatccgattgagtcacgcctcaggaaacggattcaggggtgttggaggcagctgcttaaggagtgcaaggagaaagatgtcgcccgtcaaggcgatattaacgcctcagacttcctggccctcgtcgaaaaatttaacttagatatcagtaaagaagaatgccagcagcttatcatcaaatacgatctcaagtccaacggcaagtttgcatattgtgacttcattcagtcttgcgtccttcttcttaaagcgaaggaaagctccctgatgcaccggatgaagattcagaacgcacacaagatgaaagaagccggcgccgagacaccaagcttctactcggccttgctccgcattcagcctaagattgtacattgttggaggcccatgcgccgaaccttcaaatcttatgatgaagccggcacaggcctgttgtctgttgcagactttcgcacagtgctccgtcagtatagcataaatctgagcgaggaagagttctttcacattctcgagtattacgacaagacactctcatctaagatctcatacaacgacttcctgcgcgcgtttctgcagtag

SEQ ID NO: 11730 - DNA, 783 bp, Artificial Sequence
  Description of Artificial Sequence: Synthetic coding sequence
atgaattctgctgccggcttctctcatttagatcgccgtgagcgcgtgttaaagctgggcgaatcattcgaaaaacaacctcgctgtgccttccacaccgtgaggtacgattttaagcccgcaagtatcgataccagctctgaggggtatcttgaggtcggcgagggagaacaggtcaccatcactcttccgaatattgaaggcagcacccctccagtgacagtttttaaaggttcgaagaagccctacctgaaagagtgcattttgattatcaaccacgatacaggcgagtgcagactggagaagctgagctccaacatcacggtgaagaagacccgcgtcgaaggctctagcaagatccagtacagaaaggaacagcagcagcagcaaatgtggaattccgcaaggacgcccaaccttgtgaaacacagccccagcgaggacaaaatgtcccctgccagtcctattgatgatattgagagggaactgaaggccgaggcgagcctgatggaccaaatgtcttcatgcgattcttcatccgatagtaaaagcagctctagtagttcatcagaggattctagctctgacagcgaagatgaggactgcaagagtagcacatctgatacgggaaactgcgtgtccggccatcccactatgactcagtatcgcattccagatatagatgcctcgcataatcgcttccgggacaacagcggcctcctgatgaacacactgcgtaacgatttgcagcttagcgagagcggaagcgattcggacgactag

SEQ ID NO: 11731 - DNA, 792 bp, Artificial Sequence
  Description of Artificial Sequence: Synthetic coding sequence
atgaactctgcagccgggttctctcacctcgatagaagagaaagggtgcttaagcttggcgaaagtttcgagaaacagcctcgctgcgccttccataccgttagatatgattttaaaccggcttctatcgatacttcttcagaaggttatctggaagtgggcgagggagagcaggtcactataactcttcctaatattgagggcagtactccacctgttactgtgttcaagggttcgaagaagccctatctcaaagagtgcattctgattatcaaccacgatactggagaatgcaggctcgaaaaactttcaagcaacatcaccgtcaaaaagactcgggttgagggatcatctaaaatccagtaccgaaaagagcagcagcagcaacagatgtggaatagtgcccgtacacctaacttagttaaacattccccatctgaggataaaatgtcacccgcaagtccgatcgatgatatagaaagagagctgaaggcagaagcctccctgatggaccagatgtcatcctgcgactcaagctcagactctaaatcttcaagctcttccagcagtgaggactcttcctccgattctgaggacgaagactgcaaaagcagtactagtgacactggcaactgcgtcagcggccatccaactatgactcagtatcgcataccggacatcgacgcgtcccataatagatttagggacaatagcggacttctgatgaatacccttaataatctaagcagccactccttcagcagtctgtacgacccgcttttgtcgcattag

SEQ ID NO: 11732 - DNA, 252 bp, Artificial Sequence
  Description of Artificial Sequence: Synthetic coding sequence
atggggagacgtaagtcaaagcgcaaacctccgccaaagaaaaagatgacaggcaccttggaaactcagtttacttgccctttttgtaaccatgaaaaatcatgtgatgtcaagatggaccgagcccggaatacaggcgtgatcagttgtaccgtttgcctggaagagtttcagactcctatcacatacctgagcgagccagtggatgtgtattccgactggatagacgcgtgtgaggcggcaaatcagtag

SEQ ID NO: 11733 - DNA, 306 bp, Artificial Sequence
  Description of Artificial Sequence: Synthetic coding sequence
atggtggtgagcaagatgaacaaggatgcgcagatgcgcgccgcaatcaaccagaaactgatagaaactggagaacgggaacgcttgaaggagttgctgcgcgctaagctaatcgaatgcggttggaaggaccagctgaaggcacattgcaaggaagtcatcaaagaaaaaggcctggagcatgtgactgtagacgatctagtcgccgagattacaccaaagggcagagcactggtccccgatagcgtcaagaaggagcttctgcaacgaatacggacatttcttgctcaacacgcgagcctgtag

SEQ ID NO: 11734 - DNA, 291 bp, Artificial Sequence
  Description of Artificial Sequence: Synthetic coding sequence
atgaataaggacgcacagatgagggctgcaataaaccagaagttgattgaaacaggagaacgcgagcgccttaaggagctgcttcgggcaaagctgatagagtgcggctggaaggaccagctgaaggcacactgcaaggaagttataaaggagaaaggcttggagcatgtcactgtggatgacctggtggcagaaattacccctaaaggacgcgctctcgtccctgattcagtgaaaaaggagcttctccaacgcatacggaccttcctggcccagcatgcctccctgtag

SEQ ID NO: 11735 - DNA, 486 bp, Artificial Sequence
  Description of Artificial Sequence: Synthetic coding sequence
atggcggagcccactggactcttagaaatgagcgaacttcccggcgactcatctgttccacaggtggggacggcgtctggtgtgtccgacgtcctgagaggagcagtcggcggcggggtacgtgtgcaggaggccagggaagggcctgtagcagaggctgccaggtcaatggctaggatgccagggcctgtgcctggccccattcccagcagtgtgcccggattggcaagcgctcctgatcctcaccagcagctggccttcttagagatcaatcgacagttgttgttccgggaatacctagacggctcctcaatgattcctgtacggctcttgcgggacttcgaagaaagaaggcgcctgtttgtagaagggtgcaaagccagggaagctgccttcgatgctgatccaccacagatggattttgccgccgtggccttcactgttgctttgacggcgtccgaggccttaagtcccttggctgattag

SEQ ID NO: 11736 - DNA, 2556 bp, Artificial Sequence
  Description of Artificial Sequence: Synthetic coding sequence
atgagcagcaaacaggaaattatgagcgaccagcggtttaggcgggtagctaaggatccacgcttctgggagatgccagagaaggaccggaaggtaaagatcgacaagcgtttcagggcgatgttccatgacaagaagtttaagctgaattacgccgtggacaaaaggggtaggccaatcagccacagtacgaccgaggatttgaagcgcttctacgatctgagcgattctgattctaacctgtctggtgaagactctaaggcactctctcagaaaaaaatcaagaagaagaagactcagacgaagaaggagatcgattccaagaacctggtcgaaaaaaagaaggagactaagaaggctaaccataaaggctcggagaacaagacggaccttgacaatagtataggcattaaaaagatgaagacctcctgtaagttcaaaatcgattctaacataagtccgaaaaaagattctaaggaattcacacagaagaacaaaaaggaaaagaaaaatatcgtccagcataccacagacagctctctggaagaaaagcagcgcacacttgactccggaactagtgaaatcgtgaagtctccgaggatcgaatgctctaagactcgacgcgagatgcagtcagtcgtgcagctgataatgacaagagactctgatggatacgagaatagcaccgatggcgagatgtgtgacaaggacgccctggaggaagacagcgagtccgtgtctgaaatcgggtcagatgaagagtccgaaaacgagattacctccgtgggacgcgcttcaggggacgacgatggttcagaagatgacgaggaggaggatgaagacgaagaagaagacgaggacgaggacagcgaggatgacgacaagtctgatagtgggccggatttagctagaggtaagggcaacatagagacgagcagcgaggacgaggatgatacagccgatctctttcccgaggaatcagggttcgagcacgcctggcgggagctggataaggacgctcctagagccgacgagattacccgccgcctcgctgtctgcaatatggattgggacagactgaaggccaaggacttgttggctctattcaacagttttaaacctaagggcggcgttatcttctcagtgaagatataccctagcgaattcggtaaagagaggatgaaggaggagcaggtccaggggccagttgagcttctgtctatccccgaggatgcgcctgagaaagactggacttcgagagagaaactgagggactaccagttcaaacgtctgaagtactattatgctgtcgtcgactgtgatagccccgaaactgcctctaagatttatgaggactgcgacgggctggaattcgagagctcttgttcttttatcgacctgcgatttatccctgatgacattacctttgacgatgaaccaaaggacgtggctagtgaggtgaatttgaccgcctacaagcctaagtatttcactagcgcagccatgggaacatctactgtggaaattacctgggacgagacagaccacgagagaataacgatgctcaataggaagttcaaaaaagaagagctgctcgatatggactttcaggcgtatctcgcaagttcatctgaggacgaggaagaaatagaggaggaactccaaggagatgatggggtaaacgtggaagaggacggcaaaacaaagaagtcacagaaagatgatgaggagcagatagcaaagtacagacagttgttgcaagttattcaggagaaggagaaaaagggcaaagagaacgacatggaaatggagattaagtgggtgccggggctaaaagaatcggccgaagaaatggttaaaaataagctagaggggaaagataagcttaccccgtgggagcagttcttagagaagaagaaggagaaaaaacgcctgaaacgtaagcagaaggccctggcagaggaggcctccgaggaggaactgccctccgatgtggatcttaacgacccctactttgcagaagaggtgaaacaaatcggcatcaacaaaaagtccgtcaaaagcgccaaagacggaacctcccctgaagaggagattgagattgaaagacaaaaggcagagatggccctgctgatgatggacgaagatgaggattcaaaaaaacactttaactataataagatagtagagcaccagaatctctctaagaaaaaaaagaagcagctgatgaagaagaaagaacttattgaggatgatttcgaggtcaacgtgaacgacgctcggttccaggctatgtatacaagccacctgttcaatctcgacccttcagatcccaacttcaagaaaacgaaggcaatggagaagattctggaggagaaagccagacaaagagagcgcaaggagcaagaactcacccaggcaatcaagaagaaagaatctgagatcgaaaaggaatctcaaaggaagagcatcgatccggccctatccatgctcatcaaatccatcaagactaaaacagaacagttccaggcccggaagaagcagaaagtaaagtag

SEQ ID NO: 11737 - DNA, 333 bp, Artificial Sequence
  Description of Artificial Sequence: Synthetic coding sequence
atgtcaagtaagcaagagatcatgagcgatcagagatttagacgcgttgctaaggatccgcgcttttgggaaatgccagagaaagaccggaaagtcaaaatagacaagcggtttcgcgccatgttccacgacaaaaaatttaaactgaactatgccgtggataaacgaggacgcccaatctctcatagtacaaccgaagatcttaagcgcttttacgatctgagcgatagtgattccaatcttagtggtgaggactctaaggcactgagccagaaaaagattaagaaaaagaagacccaaacaaaaaaaaaaaaaaagaagaaaaaaaaatag

SEQ ID NO: 11738 - DNA, 1086 bp, Artificial Sequence
  Description of Artificial Sequence: Synthetic coding sequence
atgcactgcagctgcttggctgagggcatccccgccaaccccggcaattggatctcgggcctagccttccctgactgggcatataaagctgagtctagtccgggatcccgacaaattcagctctggcattttatcctggagctccttcagaaagaggagttccgacacgttatcgcctggcaacagggagagtatggtgaattcgtcattaaggatccagatgaggtcgcccgactgtggggtagaaggaaatgtaagcctcagatgaactacgataagttatccagggcgctgaggtactattacaataagcgtatccttcacaaaaccaaaggaaagagatttacatacaagttcaattttagcaagctgattgtggtgaattacccactctgggaggtgcgcgcccccccttccccacaccttctacttggggccccagcgctttgtcgaccggcccttgtgcccgtcggcgtgcaaagtgaactgcttcattcaatgctctttgcacatcaagcaatggtggaacagctgacagggcagcagacgccccgcggccctccagaaacctcaggagataaaaagggatctagctcttctgtgtaccgcctcggcagcgcgccagggccatgcagactgggactgtgttgccacttagggagcgtgcagggcgaattgcctggcgtggcctctttcacccctccactgccaccaccactaccaagcaactggacctgtctgtcgggtccattcctaccgcccttgccgtcggaacagcaattacctggtgcgtttaagcctgacatcctgctacctggaccccgcagtcttcctggcgcgtggcactttccaggccttcctctcctcgcgggtctaggccaaggagcaggcgagcgcttgtggcttctgtccttgaggcctgaaggcctggaggtcaagcccgctcctatgatggaagcaaagggtggccttgaccccagagaagttttctgccctgagactaggcgtctgaaaacaggagaagagtccctcacttctcccaacctggaaaacctgaaggccgtctggcctttggatcctccctag

SEQ ID NO: 11739 - DNA, 498 bp, Artificial Sequence
  Description of Artificial Sequence: Synthetic coding sequence
atgagccaagccactaaacgcaaacacgtggtgaaggaagttctgggcgagcatattgtgccaagtgaccagcagcagattgtacgcgtcctccggacccccggtaataatctccacgaggtcgaaactgcacagggtcagcgattcctcgtttctatgcctagtaagtaccggaagaatatttggattaagcgcggggatttcctgattgtcgaccccatcgaggagggggaaaaagtcaaggctgaaataagctttgtactgtgtaaggaccacgtgcgctctctgcagaaggaaggcttctggcccgaggcttttagcgaagtcgctgaaaagcacaataacagaaatagacagacacagccagagttgcctgcggaacctcagctcagtggcgaggagtcgtcaagtgaagatgatagtgacctttttgttaacacaaatagaaggcagtaccatgagagtgaagaggagtcagaagaagaggaagcagcctag

SEQ ID NO: 11740 - DNA, 498 bp, Artificial Sequence
  Description of Artificial Sequence: Synthetic coding sequence
atgtcacaggcgacaaaaagaaagcatgtggtcaaggaggttctgggagaacacattgtcccatcggaccagcaacaaatcgtgagggttctccgaacccccggcaataacctacatgaagttgagacagcccagggccaacggtttttagtaagcatgccaagcaaatatcgtaagaacatctggatcaagcggggagatttcctaatcgtggatcccatcgaagaaggggaaaaagtgaaggcagagattagcttcgtcctctgtaaagatcacgttcgctcgctgcagaaggagggattctggcctgaggcgttcagcgaggtagcagagaagcacaataaccgcaaccgccagacccaacctgagcttccagcagaaccacagctgagtggagaagagtctagctcggaggatgattctgacttatttgtgaacaccaacagacggcaataccacgagagcgaggaagaaagcgaggaagaggaggcagcctag

SEQ ID NO: 11741 - DNA, 237 bp, Artificial Sequence
  Description of Artificial Sequence: Synthetic coding sequence
atgagccaggctacaaaaaggaaacacgtggtgaaggaggttctcggcgaacacattgtgccatctgatcagcaacaaatcgtcagggttctacgtactcctggaaataacttgcacgaggtggagacagctcaaggccagagatttcttgtttcaatgccgagtaaataccggaaaaatatctggatcaaaaggggagacttcctcatagtagaccctattgaggagggcgaatag

SEQ ID NO: 11742 - DNA, 498 bp, Artificial Sequence
  Description of Artificial Sequence: Synthetic coding sequence
atgtcccaggcgaccaagaggaaacatgtggtcaaggaggtcctgggtgaacatatcgttccctctgatcagcagcagatcgtccgtgtgctgcgaacccccggaaataatttgcacgaggttgaaaccgcccagggtcaacgcttcctggtgtccatgcccagtaagtaccgcaagaacatttggatcaagcgcggagattttcttatcgtggatccaattgaggagggggagaaagttaaggcggaaatctctttcgtgctatgcaaagatcacgtgagaagcctgcagaaagagggcttctggcccgaagccttcagtgaggtggcggagaaacataacaaccgcaatagacagacccagcctgagttaccagctgaacctcaactgtctggcgaggagagtagtagtgaggacgattctgacctctttgtcaacaccaaccgcaggcagtaccatgaatcggaggaggagagtgaggaagaagaggctgcatag

SEQ ID NO: 11743 - DNA, 441 bp, Artificial Sequence
  Description of Artificial Sequence: Synthetic coding sequence
atgagccaagctaccaaacggaagcacgttgtgaaggaggtgctgggcgaacatattgtcccttctgatcagcaacaaatagtgagagtgcttagaacccccggcaataatctgcatgaggtggagaccgcccaaggccagaggtttctggtcagtatgcccagcaagtatcgaaagaacatttggattaagcggggggattttttgatcgttgatcctatcgaggagggagaaaaggtgaaagccgaaatttcttttgtgctgtgcaaggatcatgtgcgaagcctccaaaaggaagggttctggcctgaggcttttagtgaagtcgctgaaaagcataataaccgtaaccgtcagacccagccggaactgcctgccgagccccagctttccggtgaagagagtagttcagaagacgactccgatcttttcgtgaactag

SEQ ID NO: 11744 - DNA, 345 bp, Artificial Sequence
  Description of Artificial Sequence: Synthetic coding sequence
atgagccaagctaccaaacgcaagcatgttgttaaggaggtccttggggaacacatagtaccctctgatcaacagcaaatcgtacgggttttgcgcacccccggcaataatttgcatgaggtggagaccgcacaggggcagcgctttctcgtgtccatgccttcaaaataccggaaaaacatctggattaaacggggcgattttctcatcgtagatcccattgaggaaggagaaaaggtgaaagccgaaattagcttcgtactttgcaaagaccacgtgcggtctttgcagaaagaaggtttctggcccgaagctttcagcgaggtcgctgagaaacacaactag

SEQ ID NO: 11745 - DNA, 342 bp, Artificial Sequence
  Description of Artificial Sequence: Synthetic coding sequence
atgagccaagccactaagcgcaaacacgtcgtgaaagaagtgcttggagagcatatcgtcccgtccgatcagcagcagatcgtgcgcgtcctgaggacgcctggcaacaacttgcacgaggttgagactgcgcagggccagcggttcctcgtctctatgcctagcaagtacagaaagaatatatggatcaaacgaggcgactttctaatcgtggaccccatcgaggagggggagaaagtcaaggccgagatctctttcgtgttgtgtaaagaccacgtaagatccttgcagaaagagggattttggccagaagctttcagtgaggttgccgagaagcattag

SEQ ID NO: 11746 - DNA, 498 bp, Artificial Sequence
  Description of Artificial Sequence: Synthetic coding sequence
atgagtcaagcaactaagagaaaacacgtggtaaaagaggtgctcggggaacatatagttcccagtgaccagcagcagattgttcgggtgctacggacaccagggaacaatctgcatgaagttgaaaccgcccaggggcaacggttcctggtgagcatgcctagtaagtatcgaaagaacatatggatcaagcggggagacttcctgatcgtcgaccccatagaggagggtgaaaaagtgaaggccgaaatctcatttgtgctctgtaaagaccacgtgcgttcactgcaaaaagagggattctggccagaggcctttagtgaggtggctgaaaaacacaataacaggaaccggcagactcagcccgagttgcctgccgagccgcagctctcgggagaggagtcctcctccgaggacgatagtgatctgtttgtgaataccaatcgaagacaatatcatgaatccgaagaggagagcgaggaggaagaagccgcttag

SEQ ID NO: 11747 - DNA, 1230 bp, Artificial Sequence
  Description of Artificial Sequence: Synthetic coding sequence
atggagggtgaaagtacctccgcagtgctgtctgggtttgttttgggtgcccttgctttccagcacctgaacactgactctgataccgagggcttcctcctgggggaggttaagggcgaggcgaaaaactcgataaccgattcccaaatggatgacgtggaagtggtttacaccatcgatattcagaaatacatcccttgttaccagctattcagcttttataatagctctggagaggtgaatgaacaggctctgaagaagatcttgagtaacgtcaagaagaatgtggtgggctggtataaattccgacgacactctgatcagatcatgacctttagggaacggcttcttcacaaaaatctccaggaacacttcagtaaccaagacctggtgtttctgctgctcacaccttctatcattactgagagctgttcaacccacaggctcgaacacagcttgtacaagcctcagaagggactgtttcatcgggtgccgctggtcgtagctaatctgggaatgtcagaacaactgggctacaagaccgtttccggtagctgcatgagtaccggattctcccgagctgtgcagacacattctagcaaattctttgaagaagatggctctctcaaggaggtgcataagatcaacgaaatgtacgcgagcctgcaggaggagctgaagagtatttgtaagaaagttgaagattctgagcaagctgtagataaactagtgaaggatgtgaataggctgaaacgggagattgaaaagagaaggggagcccagatacaggctgcccgggaaaagaacatccaaaaggacccacaggaaaacatctttctctgccaagccctgagaaccttttttcccaacagcgaatttctgcattcctgtgtcatgagcttgaagaacagacatgtgtctaaatcttcttgcaactataatcaccaccttgatgttgtagataatttgacactcatggtggaacacactgatatccccgaagcttcacctgcctcaaccccacagatcatcaaacataaagctctggacctcgacgaccgctggcaatttaaacggtctaggctgctggatacccaggacaagcgttcgaaagccgatacggggtcatctaatcaggacaaagcgagcaagatgagttcccctgaaacggacgaggagatagagaaaatgaaaggatttggtgagtactctcgctctccgacattttag

SEQ ID NO: 11748 - DNA, 1083 bp, Artificial Sequence
  Description of Artificial Sequence: Synthetic coding sequence
atggatgacgttgaggtggtttacaccatcgatattcaaaagtatatcccatgctatcaactcttttcattttacaactctagtggcgaggtgaacgagcaagccttgaagaagattctttccaacgtgaagaaaaacgttgttgggtggtataaattcaggcgccactctgatcagattatgacctttcgggaacggttgcttcacaaaaatctccaggagcatttctccaaccaggaccttgtatttctgctgctgacccctagcatcattacggagagctgttccacacaccgattagaacattcgctgtacaaacctcagaaaggcttgttccatcgcgtgcctcttgtggtagcaaacctgggcatgtcggaacagctaggttacaagacggtcagcggatcttgcatgtctaccggcttctcaagagctgtgcaaacccactcatctaagttcttcgaagaggacggttcgctgaaggaagtgcacaagataaatgagatgtacgcctccctgcaggaggagcttaagtccatctgtaaaaaggtcgaagattctgagcaggcagtggacaagctcgtaaaggatgtgaacaggctgaagcgggagatagaaaagaggcggggagcacaaattcaggcagccagagaaaagaacatacaaaaggacccccaagaaaacatttttctatgtcaggccttgagaaccttcttccctaactctgagttccttcactcctgcgtgatgtcgttgaagaatcggcacgtttcaaaatcctcctgcaattacaatcaccatttagacgtggtggataacttaaccctgatggtggagcatacagacatccctgaagcgtctcctgcatcaactccacagatcatcaagcacaaggctcttgacttagatgaccgctggcagttcaagaggtcccgccttctggatacacaggataagcgttcaaaggccgataccggatcttcaaatcaggataaggcaagcaaaatgagttcacccgaaacggatgaggagatagagaagatgaaggggtttggtgaatactcacggagcccgaccttctag

SEQ ID NO: 11749 - DNA, 333 bp, Artificial Sequence
  Description of Artificial Sequence: Synthetic coding sequence
atggacgatgttgaagtggtttacactattgatatacagaaatacatcccatgttaccagctgttcagtttctataatagctcgggcgaggtgaacgaacaagccttgaagaagatactgtccaacgtgaagaagaacgttgtagggtggtataagttccgcagacacagcgaccagataatgacctttcgggaacgactgctccataaaaatctccaggaacatttttcaaatcaggatttagtttttttgctattaaccccaagcatcataactgagtcgtgtagtactcaccgccttgagcacagcttgtacaaaccccaaaagggctag

SEQ ID NO: 11750 - DNA, 1338 bp, Artificial Sequence
  Description of Artificial Sequence: Synthetic coding sequence
atgtcggagctcactaaagagctgatggagctcgtgtggggcaccaagagtagccccggcctctcagataccatattttgccgctggactcagggtttcgtgttctctgagtccgagggctccgctctcgaacagttcgagggcggcccttgtgcggtgattgcaccggtgcaggcctttctgcttaagaagcttctgttctcaagtgagaagtcctcgtggcgcgattgtagcgaagaagagcagaaagaactcctgtgccataccctgtgcgacattctggagagcgcctgctgcgaccacagcggaagttattgcctagtgagctggctgcggggaaagactaccgaggagacagccagtattagcgggagccctgccgagagttcctgtcaggtggagcatagtagcgcactcgccgttgaagaactcggatttgaacgcttccatgccttaatccagaagagatccttcaggtctctgccagagctcaaggacgccgtcttggaccagtatagtatgtggggtaacaagttcggcgtattgctcttcctgtacagtgtattgctgactaagggtatagagaacatcaagaatgaaatcgaagacgcctccgaacctttgattgatcccgtgtacggccatgggtctcagtccttgatcaaccttttgctgaccggtcatgccgtgtcaaacgtctgggacggtgacagggagtgctcaggcatgaagcttctcgggattcacgaacaggccgctgtaggctttctgactctcatggaggccctcagatactgtaaggtggggtcataccttaagtcgccaaagttcccaatctggatcgtcggaagcgaaactcacctgactgtgttttttgccaaagatatggcattagttgctcctgaggccccatccgagcaagcccggagagtattccagacctacgatccagaagataacggtttcatccctgacagcttgctcgaagacgtcatgaaggcgctggacttggtgagtgatcccgagtatatcaatcttatgaagaataagttggacccagagggcctggggataatcctgctggggccatttctccaggagttcttccccgaccaaggtagctcaggcccagaatcattcaccgtatatcactacaatggtctgaagcagagtaactataatgaaaaggttatgtacgtcgagggaaccgccgtcgttatgggattcgaggatccgatgctgcagaccgacgatactccaataaaacgatgcctgcagactaagtggccttatattgagctgctgtggaccaccgatcgcagcccaagcttgaactag

SEQ ID NO: 11751 - DNA, 453 bp, Artificial Sequence
  Description of Artificial Sequence: Synthetic coding sequence
atggccctggtggctcctgaggcccccagcgaacaggcccggcgtgtttttcaaacctatgatccagaggataatggcttcataccagattctctgctggaagacgtgatgaaggccctcgaccttgtgagtgatcccgagtatatcaacctgatgaagaacaagctggaccccgaagggctagggattattctcctcggcccttttctgcaggagttttttcctgatcaggggtcgagtggcccggaatcctttaccgtgtaccactacaacggtctcaagcagtccaattacaacgagaaggtgatgtacgtcgagggaacagccgtagttatggggttcgaggatccgatgctgcagaccgacgatactccaatcaagagatgtctgcagacgaaatggccctacatagaactgctatggaccactgatcggtctccgagcctgaactag

SEQ ID NO: 11752 - DNA, 453 bp, Artificial Sequence
  Description of Artificial Sequence: Synthetic coding sequence
atggcactcgtggcccctgaagcgccatccgaacaagcacgccgggtctttcaaacctatgaccccgaggacaacggcttcatacccgacagtctgctggaagacgtcatgaaggctctggatctagtatctgatccagaatacataaatttgatgaaaaacaaactggatcccgagggactggggatcatcctgttgggaccatttctgcaagaattttttcctgatcagggttcgagcggcccggagtccttcaccgtgtaccactacaacggattaaagcagagtaattataacgagaaagtgatgtatgtcgaggggaccgccgttgtgatggggtttgaggatccaatgttgcagaccgacgataccccgatcaagagatgcttgcagaccaaatggccctacatcgaactgctgtggacgactgaccgcagtccatcccttaactag

SEQ ID NO: 11753 - DNA, 549 bp, Artificial Sequence
  Description of Artificial Sequence: Synthetic coding sequence
ttgcccgagctgaaggatgccgtacttgatcagtactcaatgtggggcaataagtttggggtactgctctttttgtacagtgtcttgctcaccaagggtatagaaaatatcaagaacgagatcgaggacgcttcagaacccctgatcgaccctgtgtacggccacggtagtcagagcctgataaacctcttacttacgggtcacgcagtgagcaatgtctgggacggcgaccgggaatgctcaggtatgaaactgctgggcattcatgaacaggctgccgtcgggttcctgacactcatggaagccctgcggtattgcaaggtcggctcttacttaaaatctccaaagttcccaatttggattgttggatccgaaactcatttgacggtgttttttgccaaagatatggccttggttgcgccagaggcaccttctgagcaggcacgtagggtcttccagacttacgaccccgaggacaatggctttattcccgactctctgctggaggatgtcatgaaggcactggacctggtgagcgatcccgaatag

SEQ ID NO: 11754 - DNA, 495 bp, Artificial Sequence
  Description of Artificial Sequence: Synthetic coding sequence
atgaagcggttcccagcaaaaaagcgatccttccgtagccttccggagctgaaggacgccgtgctcgatcagtactccatgtggggcaataaattcggtgtgctcctgttcctctactcagtgctcctgaccaaaggcatagaaaacattaagaacgaaatcgaagacgcaagcgagcccctgattgaccctgtttacggtcacggcagccagagcttgatcaacctccttctgactggtcatgctgtttctaacgtatgggacggcgatcgggaatgtagtggtatgaaactactcggaattcatgaacaagcagccgtcggatttttgaccctgatggaggcactaaggtactgtaaagtcgggtcttacctgaaaagccccaagttccccatatggatcgtaggttctgagacacatctcacagtgttcttcgcaaaagatatggccctcgtagcacccgaagcacctagcgaacaagctcggagagtgtag

SEQ ID NO: 11755 - DNA, 765 bp, Artificial Sequence
  Description of Artificial Sequence: Synthetic coding sequence
atggacggtggcgacgacggcaacctcataattaagaagagatttgtcagtgaggcagaacttgacgaacgccgtaaacgccggcaagaggagtgggagaaagttcgcaagcccgaggaccccgaggagtgtccagaggaagtttatgatccaaggagtctgtacgagcggctacaggagcagaaggaccggaagcagcaggagtacgaagaacagtttaaattcaagaatatggtgagagggctggatgaagatgagactaacttcctcgatgaagtgtccagacagcaggagctaatagaaaagcagcggagggaggaggagctgaaagagcttaaagaatatcgaaataatctgaagaaagttggcatctctcaggaaaataaaaaagaggtggagaagaaactcactgtgaaaccaatcgaaacaaaaaataagttttcccaggcaaagttactggccggggctgttaaacataaatcctctgaatctggcaacagtgtcaaacgcctgaaacctgacccagagcccgatgataaaaatcaggaaccctctagctgcaagagcctcggaaacacctcactgagcggtccttctattcactgtcccagcgccgccgtttgtatcggcattttgcccggactcggcgcttattctggcagctctgattcagaatcatcctcagacagtgagggaaccattaatgccactggaaaaatcgttagttcgatatttcggacgaatacattcctggaagctccgtag

SEQ ID NO: 11756 - DNA, 765 bp, Artificial Sequence
  Description of Artificial Sequence: Synthetic coding sequence
atggatgggggggacgatggtaatctcattatcaaaaaacgatttgtgtcggaggctgagctcgatgaaagaaggaaacgccgccaggaggagtgggaaaaggtcaggaagccggaagatcccgaggaatgtcctgaggaagtgtatgatcctcgctctctatacgagcgcctacaggaacagaaggacagaaagcagcaggagtacgaggagcaattcaagtttaagaatatggtcagaggtctcgacgaggacgaaaccaatttcctagatgaggtatctcgacaacaggagcttatcgagaagcaaagacgggaggaggagctgaaggaacttaaagagtataggaataacctaaagaaggtgggaataagccaagagaacaagaaagaagtggagaagaagctaaccgtaaaaccaatcgaaaccaagaacaaattcagccaggccaagttactagcaggggccgtgaaacacaaaagcagcgagagcggtaatagtgtcaaacgactcaaaccagatcccgaacccgacgacaagaaccaagaaccaagttcatgtaaatcccttggaaacaccagtctcagcggtccatccatccattgtccttccgccgctgtatgtattgggatactgcccggcttgggggcatactccgggtctagcgacagtgagtcctccagcgactcagagggaaccatcaatgcaactggtaagatagtctcgagtatattcaggacgaacacattccttgaggcaccttag

SEQ ID NO: 11757 - DNA, 246 bp, Artificial Sequence
  Description of Artificial Sequence: Synthetic coding sequence
atggacggcggagacgatggtaatctgattatcaaaaaaaggttcgtttccgaagccgagcttgatgagagacgcaaacgaagacaggaagaatgggagaaagttcggaagcctgaggatcctgaagaatgcccggaagaggtttacgatccacggagcctctatgaaaggctgcaggaacaaaaagatagaaagcagcaagaatatgaggagcagtttaaattctctaagcagttcgacccttag

SEQ ID NO: 11758 - DNA, 1617 bp, Artificial Sequence
  Description of Artificial Sequence: Synthetic coding sequence
atgcgccacgtgcaggccgagcccagtccatcttccgagcccgaagctggtccaagccaaccccccgtgaggcaaggagcccttcagggcggtcttttgatgggttatagccctgccggtggtgccaccagcccaggcgtatatcaggtcagcatcttctccccccctgctgggacgagcgagcctcatcgagcactgaagcggcaagcacctagtactgaaggacctagggaactcaaacgcggacctggcttgggcgcccgcgaaggactgccaccggaggagcccagcaccgtcggcctgctgggccctgagggacccggactggggctgggcgtagcgtctcagcacttctcccaccggggactgtgtgttgtggagcagagatcttcagtcacgtccagctggaccagcggcgcgtggtcacctccctgcccaccatctaatgcttcctgtaacaccctccacactagggactgggcctcccccgacccaggaggccaaggcagtctgggcgagtccccgggccctgctccccctggtcagttacatacccttgatacagatctgcatagcctcgctcagattgggggaaaatcccccgtcgctggcgttgggaacggaggctctctgtggcctagagaatctcccggcaccgctaacgggcacagtccagaacatacccctccaggacccgggccaccaggcccttgccccaccaagagacgccttctgccggcaggggaagcccccgatgttagttccgaagaggaaggcccagccccaagaaggaggaggggatcactcggacacccgacagccgctaactcctcagacgctaaggccaccccattttggagccacctgctgcccggacctaaggagccagtcctggacccgacggattgtggccctatgggcaggcgcctgaagggcgcccggagactgaaactctccccactgagaagcctaaggaaggggcccggcctgctgagccccccaagtgcttcacctgtgccaaccccagctgtaagcagaaccctcctcgggaactttgaggagtcattgttgcgtggtcgcttcgcgccaagcggacacattgaaggatttacagccgaaattggggccagcggatcgtactgccctcagcatgtcacccttcccgtcacggtaacattcttcgacgtttcagagcagaacgcccctgcaccgttcctcggcatcgtcgacttgaacccactggggaggaaaggttactcagtgcctaaggtaggaaccgtgcaggtgaccctgtttaaccctaatcagactgtagttaagatgttccttgtgactttcgacttctccgacatgccagctgcccacatgacattcctgcggcacagactctttctcgtgccagtcggagaggaaggaaacgccaatccaacacaccgcctgttgtgctatctgctccatttacgatttagaagtagtaggtccggccggctgtccctacacggcgatattcgtcttctgtttagtcggaggtccctagaactggacactggcttgccttacgaacttcaggctgtgacagaggccccccacaaccctcgttacagtccgctcccatag

SEQ ID NO: 11759 - DNA, 1329 bp, Artificial Sequence
  Description of Artificial Sequence: Synthetic coding sequence
atgcgacacgtgcaggctgagcctagccccagctccgaacctgaggcaggtccttcacagcctcccgtaagacagggcgcccttcagggagggctgctcatggggtactctcccgccggcggggctactagccccggagtctatcaggtcagcatcttttcacctcctgccggcacttccgagccacaccgggccctgaaaaggcaagccccatccacagagggtcctcgcgagctgaaacgcggccctggactgggggctcgagagggtctaccccctgaggaaccaagcaccgttgggctgctgggacccgaaggccccggcctcggattgggcgttgcctcacagcacttctcgcatagaggactttgtgtggttgaacagcgttcctccgtgacctcatcctggacttcaggggcttggagtcctccttgccctcccagcaatgctagctgcaacaccctgcatactcgtgactgggcatcacccgatcccggaggtcaggggagtctcggcgaatctccaggaccagcgccacccgggcaacttcacactctcgacacagacctccacagcctggctcagatagggggaaaaagccctgtcgccggggtgggaaatggaggtagtctctggccccgggagtcccccggcaccgccaatggacattccccagagcatacaccacctggacctgggccccccgggccgtgtcccactaaaagacgtctattgcctgccggggaggcccccgacgtgtcgagtgaggaagagggccccgccccccgcagacgccgcggttcacttggacaccccaccgccgccaactcaagcgacgccaaggcaaccccattttggagccaccttctacctggcccaaaggaacccgtcttggacccaacagattgcgggcccatgggacgccgtctcaagggagctcgcaggttaaaacttagtcctctgcggagcctccgtaaaggtcctggattactgagcccaccctccgcaagccccgtacccactcctgcggtgtcccggacattacttggtaattttgaggagtccctcctgcggggacgctttgccccctcaggccacattgagggctttactgcggaaatcggcgcgagcggatcatactgcccacagcacgtcacactgccagtgaccgtcacatttttcgatgtgtcagaacagaacgccccagccccctttctcggcatagtcgacctgaacccccttgggcgaaaggggtacagtgttcccaaggttggaaccgtacaggttaccctgttcaacccaaatccgttcaccagcccaacactctag

SEQ ID NO: 11760 - DNA, 1617 bp, Artificial Sequence
  Description of Artificial Sequence: Synthetic coding sequence
atgaggcacgtgcaggctgagccttctccctcttctgagcccgaagcgggaccaagccagccccctgtcagacaaggagcactccaaggtgggctgctgatgggttactctcccgctggtggagctacttccccaggtgtctatcaggtgtccatcttctcccctccagccggaacaagcgagccccatcgggccctgaagagacaggctcccagcaccgaaggtcccagggagctgaagcgcggacccggtttgggggcacgcgagggcttgccgcccgaggagcctagtaccgtgggccttctcggaccggagggaccaggactggggctcggggtggcgagccagcactttagccatcggggtctctgcgtggtcgagcagcgaagcagcgtcacttcatcctggacttcaggcgcttggagtcctccctgcccacccagtaacgccagctgcaacaccttgcatacaagggactgggctagtcctgatccaggcggacagggctcacttggagagagccctgggcctgccccaccgggccagttgcacactcttgatactgacctccatagcctcgcccagataggtggaaagtcgcctgtggctggcgtgggaaatggggggtccctgtggccccgtgaatcccctgggaccgcaaatggtcacagtcccgaacatacccctccaggaccgggtcctcccggcccctgtcctacgaagcggcgcctcctgccagctggagaagcccccgacgtgtcatcagaggaagaagggccggcacccaggaggagacgggggtccctcggacaccccacagccgctaacagttctgacgcgaaagccaccccattttggagccatcttctgcccgggcccaaggagcccgtgctggatcccacagactgtgggccaatggggaggcgcttaaagggcgcccggcgtcttaagctgagtcccctccgctctctgcgtaaaggacctggcctgctttccccaccctcagctagcccagttcctacccctgcagtctcacgcactttgctgggtaactttgaggagtctcttctgcgtgggcgcttcgccccaagcggacatattgagggcttcaccgcggagataggcgccagtgggtcctactgcccgcagcacgttacgctgccggtgacggtgacattcttcgacgtctctgagcagaatgctcctgctcccttcttgggcatagtcgacttgaatccactgggtcgcaaggggtattctgtccctaaagttggaacggtgcaggtgactctgttcaaccctaaccagaccgtggtgaagatgttcttggtgacatttgacttttccgacatgccagccgctcatatgacgtttctaaggcataggctattcctggtgcctgttggagaagaaggcaacgcgaacccaactcaccgattgctgtgttacttacttcacctgcggttccggtcgagtcgctctggacggctgtctctgcacggggatatcaggctactgttcagtcgacggagcttggaactggacacaggactgccctacgaacttcaggcggtaacagaggccccgcacaacccaagatatagccccctcccatag

SEQ ID NO: 11761 - DNA, 1617 bp, Artificial Sequence
  Description of Artificial Sequence: Synthetic coding sequence
atgagacacgttcaggcggagccaagcccctcctccgaaccggaagcaggcccctcacagcccccggttcggcagggagcccttcaaggaggactattaatgggctacagtcccgcgggcggggccacttctcccggcgtttatcaggtctccattttctcacctccagccgggacctcagagccccatagagcattaaaacggcaggctccttcaacagagggcccccgggaattgaaaaggggacccggtctgggcgcgcgagagggcctcccgcccgaagagccatctactgtgggtttactggggcctgaaggcccaggtttgggacttggagtggcctcacagcactttagtcatagaggtctctgtgtggtcgaacaacggtccagcgtgacttcctcgtggacctcaggagcgtggtcccccccttgtcccccatcaaacgcctcatgcaataccctgcatacccgggactgggcttcaccagaccccgggggccagggatcgcttggggaaagccctggcccagcacccccggggcaattacatactctggatactgacctgcactccctggcccagataggcgggaaatctccggttgctggagtcggcaacggtggctcgctttggccaagagagtccccggggacagcgaacggtcactcacctgagcatactcccccgggcccagggcctccagggccctgtccaactaaacgcaggcttctccctgcaggtgaggcccctgatgtaagtagtgaggaggaaggcccagcacctagaaggaggaggggatccctgggccatcctactgctgccaatagcagtgatgcgaaggcaacgcccttctggagccacttgctccccggccccaaagaaccagtacttgacccgactgattgcggacccatgggacgaaggcttaaaggagcaagacggctcaagttaagccctttgagaagtctgaggaagggacctggcctgctgagcccaccaagcgctagtccagtgccgacccccgcagtgagtcgtacactgttgggaaatttcgaggagtcactgctcagaggacgcttcgcgccttcagggcatattgaaggctttactgcagaaatcggcgcttcaggctcctactgtccacagcacgttaccctgccggtgaccgtgacatttttcgacgtctcagaacagaatgcccccgctcccttcctcggaatcgtggacttgaaccccctgggacgaaaggggtactccgtgcctaaagttggtaccgtgcaggtgacactgttcaaccctaaccagactgttgtcaagatgttcctcgttacattcgactttagcgacatgcccgctgcccacatgaccttcctgagacaccgactgtttctggtgcccgtgggagaagaggggaatgcaaatccaacacaccgtctcctgtgctacttgctgcaccttcgctttcgatcatcaagatccgggagactatccttgcatggcgacatccgcctcttattcagcaggagatcgctggagctagacaccgggctaccctatgagctccaagccgtgacagaagccccgcacaatccacgctactcgcccctgccatag

SEQ ID NO: 11762 - DNA, 702 bp, Artificial Sequence
  Description of Artificial Sequence: Synthetic coding sequence
atgggaagacgactcaagggggccagacggttgaagctgtccccactgcgttcactccgtaaaggcccaggcttgctttcacctccatcagcatcacccgtgcccacaccagcagtatccagaaccctccttggaaacttcgaggagagcctgctcagagggaggttcgccccgtccggtcatattgagggattcacggctgaaattggagcttccggatcctactgtccccagcacgtgacattgccagtaactgttaccttcttcgacgtttctgagcagaatgctcccgctccctttctcgggatcgtggatctaaatcctctggggagaaagggttattccgtgcctaaagtgggcacggtacaggtgaccctcttcaatcctaatcaaacagtggtaaagatgttccttgtgacttttgacttctccgatatgccagctgctcacatgacatttcttcgccaccggctatttcttgtacccgtgggcgaagaaggcaacgccaacccaacccatcgcttgctgtgctacctactgcatctcaggttcagatcctcccgttctggccgactaagccttcatggcgacatcaggctgttatttagccggaggagtttagagttagataccggtttgccatatgagctgcaagcagtgactgaggccccccacaacccaaggtacagccctctaccctag

SEQ ID NO: 11763 - DNA, 339 bp, Artificial Sequence
  Description of Artificial Sequence: Synthetic coding sequence
atggaagcgtacgagcaagtccagaagggaccccttaagctgaagggagtggctgagcttggcgttactaaacgcaaaaaaaaaaagaaagataaggataaagcaaagctgttggaggccatgggtacctctaagaaaaatgaggaagagaagcggagaggccttgacaagaggacccctgctcaggcagcattcgagaaaatgcaagaaaagcgacagatggaacgcattctgaagaaggccagtaaaacccataaacagcgcgtggaggatttcaatcgccacctcgatacactaactgagcactatgacatcccaaaagtttcttggacaaagtag

SEQ ID NO: 11764 - DNA, 639 bp, Artificial Sequence
  Description of Artificial Sequence: Synthetic coding sequence
atggagcccgcagtcggcggtcctggcccattgattgtgaacaacaaacagcctcaaccaccaccgccgccccctcctgcagcggcacagccgcccccaggcgccccacgcgctgccgcaggtctgctcccagggggcaaagctagggagttcaatcgcaatcagagaaaagattccgagggatattctgagagccctgatctagagttcgaatacgccgataccgacaaatgggccgccgagctgagcgaactatacagctatactgagggtcctgaatttctgatgaatcgcaagtgttttgaagaggattttcggattcatgtgacggacaagaagtggaccgagctcgataccaaccagcaccggacacacgccatgaggctgcttgacggcctggaggtcactgctcgcgagaaaaggcttaaggtagcacgggccatactctatgtggcacaggggacctttggagagtgctcttctgaagctgaagttcagtcatggatgagatataacatcttcctgttattagaggtcggtacgttcaatgcactggtagaactgttgaacatggaaatcgaacattgttgtgtgcggcctgccgtatctgccctcgccggaggacaggcgcaagactag

SEQ ID NO: 11765 - DNA, 2514 bp, Artificial Sequence
  Description of Artificial Sequence: Synthetic coding sequence
atggagcccgctgtgggtggacctggcccgttgatcgtgaataacaagcaaccacagcctcctcctcccccgcccccagctgcagcccagccacccccgggagcccccagggcagcagctgggctgctgcctggagggaaagcacgtgaattcaacaggaatcaaagaaaggacagcgagggatattccgagtctcctgacctggaatttgagtacgccgatactgataagtgggcggccgaactatctgaactgtattcttatacggaaggtccagagtttctcatgaaccgcaaatgcttcgaggaggatttccgcattcacgtaacggataagaaatggacagaactcgacactaatcagcatcggactcatgcaatgaggttgctcgatgggctcgaggtcactgctagggagaaaaggttgaaggttgcaagagccattctctacgtagcccaaggcaccttcggtgaatgcagctctgaggcagaggtgcagagttggatgcgctacaatatcttcttactcctcgaggtgggaactttcaacgctctggtggagctgctgaatatggagatcgataatagcgccgcttgctcgtcagcggtgagaaagcccgccatcagccttgctgactcaaccgatctgcgagttctgctcaacataatgtacctgatcgtagaaaccgtccaccaggagtgcgaaggggacaaggccgaatggaggacgatgcgacagaccttccgggccgaactcggatcgccactgtataataacgagcccttcgccatcatgcttttcgggatggtgactaaattctgttcaggccacgcccctcacttcccgatgaaaaaagtgctgctactcctgtggaagacggtgctgtgcaccctcggcggattcgaagaactacagtctatgaaagccgaaaaaagaagcatcttaggcctcccacccctccctgaggatagtatcaaggtgattcggaacatgcgggccgcgagtcctcccgcatcggccagcgacttaatcgagcagcagcagaaaagaggcaggcgtgagcacaaagccctgatcaaacaggacaaccttgacgcctttaatgagcgcgacccctacaaagcagatgattctagggaagaagaggaagagaacgatgacgacaatagtctggaaggcgagacgtttcctctggagcgtgacgaggttatgcctccccctctccagcatccccagacggatcggctcacttgtccaaagggcctgccatgggcacctaaggtgagagaaaaggatatagagatgttcttggagtcgtccaggagcaaatttattggttacactctaggaagtgacacaaatactgttgtggggctgcctagacctatccacgaaagtattaagactctcaaacagcataaatacacctctattgctgaggtccaggcccagatggaagaagagtatttgcgttccccactttcaggtggtgaggaggaagtggagcaggtccctgctgagactctgtatcaggggctgctcccctctctgccccaatatatgattgcactattgaagatacttctcgcagccgcccctacgtctaaagcaaaaactgacagcataaatatacttgccgacgtgctgcctgaagaaatgcccacaacagttctccagagtatgaaacttggagttgacgtgaaccggcacaaagaggtaatcgtgaaggctatctccgccgttctcctgttgcttttgaagcattttaagttaaaccacgtgtaccagttcgagtacatggcccagcacctggtctttgctaattgcattccactgatcctgaagttttttaaccagaacataatgtcttacataactgcaaagaatagcatttcggttctcgactatcctcactgtgttgtccatgagctgcctgagctgacagccgaatcactcgaagccggggattccaatcagttctgctggagaaatctattcagctgcattaatttgctgcgcatcttgaacaagctgacgaagtggaagcactctaggacaatgatgcttgtcgtgttcaagtctgctccaattttgaagcgcgctttaaaggtgaaacaggccatgatgcagctgtatgtgctaaagctactaaaagtgcagacaaaatacctaggacggcagtggcggaagagtaacatgaagactatgtccgcaatttaccaaaaggtgagacacaggctcaatgatgactgggcttacggaaatgatctggatgcacggccgtgggatttccaagcggaagagtgcgccttgcgcgcaaacatagaacgctttaatgcccgcaggtatgaccgggcgcactccaaccccgacttcctaccagtcgataactgcttgcaatcagtgctggggcagcgcgtcgacctacccgaggacttccagatgaattacgatctgtggctcgaacgagaggtgttctccaaaccaatttcatgggaagagctcctgcaatag

SEQ ID NO: 11766 - DNA, 2229 bp, Artificial Sequence
  Description of Artificial Sequence: Synthetic coding sequence
atgaatcgtaagtgcttcgaggaagattttcggattcacgtgacagacaagaaatggaccgaactagatacaaaccagcacaggacacacgccatgagactactggacgggctggaggtgaccgcccgggagaagcgactcaaggtcgccagagccatcctctacgtggcgcagggaacctttggagaatgtagttctgaggcggaagtgcagtcatggatgagatataatatattccttcttttggaggttgggacctttaacgcactggtggaattgctgaacatggaaatcgacaactctgctgcctgtagttccgcggtcaggaagccagccatttctctagccgattccaccgacctgagggtgctgcttaatatcatgtatctgattgtggaaacagttcatcaagagtgcgagggcgacaaagcagagtggcgaacaatgagacagaccttccgtgccgagcttggatctcctctctacaataacgagcctttcgcaatcatgctgttcggaatggtgaccaaattctgtagcggccacgccccccactttcctatgaaaaaggttcttctcctgctctggaagactgtgctttgcaccctaggcgggtttgaagaacttcagtccatgaaggccgaaaagcgctctatcttgggcctgccccctctgcctgaagattctattaaagttatcagaaatatgcgggcagccagccctccggctagtgcatccgatctgatagagcagcagcaaaagagaggacgcagggaacataaggccttaatcaaacaggataaccttgatgccttcaacgagagagacccttataaggccgatgactcacgcgaggaggaggaagaaaatgacgacgataattcgctcgagggggagacgtttcccctcgagagggacgaggtaatgccccccccactgcagcatccgcagaccgaccgcctcacttgccctaagggcctgccttgggcccctaaggttcgagagaaagacattgagatgttcttggagtccagccggagcaaatttattggatatacgctcggcagcgacacgaacaccgtcgttggtttgccaagacctattcatgagtcgatcaaaactctcaagcaacataagtacacaagtatagccgaggtccaggcacagatggaagaagaatacctgagatcccccctgtctgggggagaagaagaagttgaacaagtcccagcggagacgctgtatcagggattgctgccctcgctcccccaatatatgattgctttactgaaaatcctgctggccgctgctccgacgtctaaggccaagaccgacagcattaacattcttgcggacgtactacccgaagagatgcccactaccgtcctgcaaagcatgaaattgggagtcgatgttaataggcacaaagaggttatagtgaaggctatctccgctgtcctacttctcctactcaaacacttcaagcttaaccatgtgtatcagttcgaatacatggcacagcacctcgttttcgcaaattgtattccactcatcctgaagttttttaaccagaacatcatgtcttacatcaccgcaaaaaacagtatttctgttctcgactatcctcattgtgtggtgcatgagctgccagagctgacagctgagagcttagaggcgggcgattccaatcaattttgttggaggaaccttttttcatgcatcaatttgctgagaattctgaataaactgactaagtggaagcatagccggactatgatgctggttgtcttcaagtccgcccccattctgaagagggcgctcaaggtgaagcaggcgatgatgcagctgtatgtgcttaaactgctgaaggtgcagaccaaatacctgggccgtcaatggcgtaagtccaatatgaaaacaatgtctgcgatttatcagaaggtgcggcacagactcaatgatgattgggcctacgggaatgacttagatgcaaggccctgggactttcaggcagaagaatgcgcacttagggccaatatagagcgcttcaacgctagaagatatgaccgcgctcacagtaacccagattttctgcccgtggacaactgtttgcagtctgtgctgggccagagggttgacctcccagaggactttcagatgaattatgacctttggcttgagcgcgaggtgtttagcaaacccatttcgtgggaggagctgttgcaatag

SEQ ID NO: 11767 - DNA, 783 bp, Artificial Sequence
  Description of Artificial Sequence: Synthetic coding sequence
atgaaatcgaatatcgataagaagttttctgcccactatgacgccgtggaggcggaactcaaatcatctaccgtgggtctggtcaccctgaatgatatgaaggccaaacaggaggctctagtgaaagagagggaaaaacagctggctaagaaagagcaatccaaagagctccagatgaagctggaaaagctgagggagaaggaaagaaagaaagaggcaaagcgtaagattagctctttaagcttcactttggaggaggaagaagagggaggagaagaggaagaggaggccgccatgtacgaagaggaaatggaacgggaagagattactacaaaaaagaggaaactggggaagaacccggatgtggacactagcttcctgccagatcgagacagagaggaagaggaaaacagacttagagaagaactgcgccaggagtgggaagcgaagcaggagaagattaagtcggaggagatcgagatcacattctcctactgggatggctccgggcaccgccgcacagttaagatgagaaagggaaatactatgcagcagttcctgcagaaggcgttggaaatattgcgcaaggacttttccgagctgcggagtgctggtgtggagcaactgatgtacattaaggaagacctgataattccccaccatcatagcttctatgatttcatcgtgacgaaagcaaggggaaaaagtgggccactcttcaacttcgacgtgcatgacgatgtgcggttactgagcgacgctaccgttgaaaaggacgagtag

SEQ ID NO: 11768 - DNA, 1020 bp, Artificial Sequence
  Description of Artificial Sequence: Synthetic coding sequence
atggcccaatacaagggagctgctagcgaagcaggcagagccatgcatcttatgaagaagcgcgaaaaacagagggagcagatggaacagatgaaacaacgcatagccgaagagaatattatgaaatctaatatcgataagaagtttagtgcccactacgacgcggtcgaagcagaacttaagagtagcactgtggggctggtcaccctaaacgacatgaaggcaaagcaggaggcgttggtcaaggagagggagaagcagctcgctaagaaggagcagagcaaagagctccagatgaaactggagaaactgagagaaaaagaacgtaagaaagaagcgaagcggaagatctcaagtctcagcttcactttggaagaggaagaggagggcggtgaggaggaggaggaggctgcaatgtatgaggaagagatggagagggaggagatcaccacaaaaaagcgaaaactaggaaagaaccccgatgtggacacctctttcctgcccgatcgagatagagaagaagaagagaacaggttacgtgaagagcttaggcaagagtgggaggcaaagcaggaaaaaatcaagtcagaagagatcgagatcaccttctcctactgggacggctctggccaccgacgaaccgtaaagatgcgcaagggcaatactatgcagcaattcttgcagaaggccctggaaatcctcaggaaagacttctcagagctaaggtctgcaggagtagaacaactcatgtatataaaggaggatttgatcatacctcaccatcattctttttacgactttatcgtcactaaagccaggggcaaatcagggccattatttaactttgatgtgcatgacgacgtgcgtcttctctctgacgcaaccgtggagaaggacgaatctcacgctggtaaggtggtcctgcgctcttggtatgaaaaaaacaaacacatcttcccagcctccaggtgggagccttacgatccagaaaaaaagtgggacaagtacaccatccgctag

SEQ ID NO: 11769 - DNA, 1197 bp, Artificial Sequence
  Description of Artificial Sequence: Synthetic coding sequence
atggtcactcttataacagaaaagcttcagagccagagcttggatgacctcacatgcaaggccgaagcggggccactgcagtattcggccgagacattaaataaatcggggcggcttttccctctagaacttaatgatcagtctccctggaaagtgttctccggaggaccccctgtgcgcagccaggccgccacaggcccagatttttcctttttgccggggttgagtgcagctgcccatacaatggggttgcagtggcagccccaatccccccgtccaggtgcaggactgggggccgcctctacagtcgaccctagcgaaagcactggctcgtccacagcccctcctacaaaacggcattgccggtctttgtctgaaccagaggagcttgtgcggtgtcgtagcccctggcggcccggctcaagtaaggtctggacccctgtgtccaagcgcagatgcgatagcggcggttctgcaacgcgccagggatcacctggcgcggtccttcctcgctcggcagtctggagcaccggaccgaccagtcccgccaccccacggccctcaagcgcgtctggcggttttgtggattcttctgagggctctgcaggttccggcccactgtggtgctctgccgaatcctgtcttccgtcaacccgaagaagaccctcgctttctcaggagcgcctcgccggggcggggaccccactgccttgggcaagctccagtcctactagcactcccgctctcgggggaagaagaggattacttcgatgcaggtctcagccttgtgtgctgtcaggtaaaaggagccgcagaaaacggcggcgcgaggaagacgcccggtggactaggccttcgctggactttttgaagatgactcaaacactgaaaaattcaaaatcactttgctctctcaactatgaggatgacgacgaggacgacaccccggtgaagacagttcttagtagtccttgcgatagccgcggcctgcccggaatcacaatgcccgggtgttcacagagaggcctgaggacatccccagtccaccccaacttatgggcgagccgtgagtccgtgaccagcgacggatcccggcgcagctctggagaccctcgggacggcgacagcgtgggcgaagaaggcgttttcccgagggccagatgggagttggatttagagcagattgagaataactag

SEQ ID NO: 11770 - DNA, 1197 bp, Artificial Sequence
  Description of Artificial Sequence: Synthetic coding sequence
atggtgacactgattacagagaaactacagtcccagagcttagatgatctgacctgcaaagctgaggcgggccccctacagtacagcgcagagacactaaataagtccggacggttgtttcctttagaactgaatgaccagtcaccatggaaggtgttctctggaggacctcccgtcagaagtcaggctgctactggccccgactttagcttcttgcccgggctgagtgcagccgctcacacgatgggccttcagtggcaaccccagtctccccgcccaggggctggcctgggagctgccagcacagttgaccccagcgagtcgaccgggtcttctacggcccctcctaccaaaaggcattgtagatccctatctgagcctgaagagctggtcagatgcagaagcccttggagacctgggagctctaaggtttggactccggtaagtaagagaagatgcgattcaggtggctccgccaccaggcaaggcagcccaggagcagtgctccccaggagcgctgtgtggagcacaggcccaacttccccagccaccccaaggccctccagcgccagtggagggttcgttgacagttccgaaggtagcgccgggtcggggcctctctggtgtagtgctgagagctgcctgcccagtacccgccggcgcccctcactcagtcaggaaagactagcaggcgctgggacaccactcccttgggcttcatctagccccacaagtacccctgctctcgggggacgacggggacttctccgatgtcgctcgcagccatgcgtgctgagtggcaagcggtcaagaagaaagcggagacgggaggaagatgcccgctggacacgaccatcactggacttcctcaaaatgacgcagactcttaagaattcaaagagtttatgtagtcttaactatgaagacgatgatgaagacgacacccccgtaaaaaccgtgctctccagcccatgtgacagccgggggctccccggaatcactatgcctggatgctctcagcgaggattgagaacttcccctgtccatcccaatctctgggctagccgcgaatccgttaccagtgacggctctagacgttcctccggcgatccaagggacggagactcagttggggaggagggggtgtttccgcgcgcccggtgggagctagaccttgaacaaattgagaataattag

SEQ ID NO: 11771 - DNA, 327 bp, Artificial Sequence
  Description of Artificial Sequence: Synthetic coding sequence
atggttacgctcattaccgaaaaactgcagtcgcaatcactggacgacctgacctgcaaggctgaggctggtccacttcagtactctgccgaaacgttgaacaaatccggccgcctctttcctcttgaattaaatgatcagagtccctggaaggttttttccgggggtccccctgtgagatctcaggcagccacagggcctgactttagttttttgcccggactaagcgcggctgcccataccatgggactgcagtggcaaccccagtccccaagacctggcgccgggctcggcgcagcctctaccgtcgacccttctgagtcctag

SEQ ID NO: 11772 - DNA, 1197 bp, Artificial Sequence
  Description of Artificial Sequence: Synthetic coding sequence
atggtaacactgataaccgagaaactccaatcccagagtctggatgacctaacatgcaaggccgaagccggccccttgcagtactccgctgagacattgaataagtccggccgtttgttccctctggaactaaacgatcagtccccctggaaggtttttagtggcggacctcccgttagatcccaagccgctacaggccccgacttctcttttctccccggccttagtgctgccgcccacacaatggggctgcagtggcaaccgcagagcccaagaccgggagccggcctgggagccgcgagcactgtagacccatctgagagtaccgggtcgtccaccgccccacccaccaagcgccactgcaggtccctgtccgaacctgaggagttggttcggtgtaggtctccttggcgtccggggtcaagcaaggtttggactcccgtcagcaagcgccgctgtgacagcggtggatctgccactcgccagggcagcccaggggccgtgctccctcgtagcgcagtgtggtcaaccgggcctactagccctgctactccgcgaccttctagtgcaagcggcggcttcgtggacagcagcgaaggttccgccggttccggccctttatggtgctcggcagagtcatgtctgccctccacccgccgacggcccagtttgtcacaggaaagactcgcaggagctggtacaccacttccatgggcgagttccagtccgacctcaacccccgcattgggtgggaggagaggactgctgagatgtaggagtcagccatgcgtcctaagtggtaaaaggtcccgccggaagcgacgacgcgaggaagacgctcgctggacaaggccgagcctggattttctcaaaatgactcaaacccttaagaactcaaaaagcttgtgctctcttaactacgaagacgatgacgaggatgataccccagtgaagactgttttaagctccccgtgcgactcccgggggctgcccggcattaccatgccggggtgttcgcagagagggctgagaaccagccccgtacatcctaacctctgggcctctcgggaatctgtaacttccgacggctcccgccgttcaagtggagatccgcgggacggagacagtgtgggagaggagggagttttccccagagctagatgggagttggacctcgagcagattgaaaacaactag

SEQ ID NO: 11773 - DNA, 717 bp, Artificial Sequence
  Description of Artificial Sequence: Synthetic coding sequence
atggcatctaggtggcagaacatgggaacatccgtgcgccggcggagtctccaacaccaagagcagctggaggattccaaggaacttcagccagtggtttcccaccaagagacaagtgtgggggcgcttggatctttgtgtagacaatttcaacgccgcttgccattacgggccgtgaatcttaatctgagggctggcccctcatggaaaaggttggaaacccctgagcctgggcagcagggcctccaggctgctgcaaggtcagccaagtctgctctgggtgcggttagccagaggattcaggagagttgccagtccggaacaaaatggctagttgagactcaagttaaggctagacgccggaaacgtggcgcacagaagggctctggctcacccacacacagcctgtcacagaaatccactcgcctaagcggtgctgcacccgcacacagtgccgccgacccatgggagaaggagcaccaccggctctccgttcgcatggggagccatgcgcaccctctgaggcggagtagacgggaggcagcctttcgttctccatatagctccactgaacccctgtgttcccccagtgaaagcgatagtgatctggaacccgttggtgctggcatccagcacctgcaaaagctgtcacaagagctggacgaggccattatggccgaggagtcaggagatattgtttcactaatccatgactag

SEQ ID NO: 11774 - DNA, 747 bp, Artificial Sequence
  Description of Artificial Sequence: Synthetic coding sequence
atggccagccgctggcagaatatgggaacaagcgtgcgtagaaggtccctccagcatcaggagcagttggaggactccaaagaactgcagcctgtagtgtctcaccaggaaacaagcgtgggtgcactgggctcactgtgccgacagttccagcgtcgactgccactgcgcgcagtgaatctgaacctgcgtgctggcccaagttggaagaggttggaaacgccagagcccggacagcagggtttacaagccgcagcacggtctgctaaatcagcgctcggcgccgtgtctcagcgtatccaagagagttgccaaagtgggacaaagtggcttgtagagacacaggtcaaggcacgacggagaaagcgaggggcacagaaggggagtggcagccccacccacagtctgagccaaaagagtacccgcctgtctggggccgcaccggcacatagtgcagcagatccatgggagaaggagcaccacagactgtcggtgaggatggggtcccatgcccatccgctgagacgatctaggagggaggctgcatttcgatctccctacagcagcactgagcctttgtgttccccctcggaaagtgactccgatttagagcctgttggagcagggatccagcacctgcaaaaactgtcgcaggagctggacgaagcaattatggcagaggagcgtaagcaggccctaagtgatcgacaaggcttcatacttaaagacgtttacgcctccccatag

SEQ ID NO: 11775 - DNA, 717 bp, Artificial Sequence
  Description of Artificial Sequence: Synthetic coding sequence
atggccagccggtggcagaacatgggcacctctgtcaggcgacggagcctgcagcaccaagagcaactcgaagactcaaaggaactgcagcctgtagtttctcatcaagagacgagtgtgggtgctttaggctcactatgccggcagttccagcggagactccctctgcgggcagtcaatctcaacctccgggccggcccttcttggaaacgtcttgagacacccgagccaggccagcaaggactgcaggcggccgcccggagcgccaaaagcgctcttggggccgtcagtcagcgcattcaggaatcatgccaatccggtaccaagtggctcgtggagacccaagttaaggcacgccgacgaaaaaggggggcccagaaaggttctgggagtccaactcacagtcttagtcaaaaaagtacaaggttgtccggcgctgcaccagcacactctgctgccgacccatgggagaaggagcaccatcggttgtccgtgcgcatgggcagccacgctcaccctctccgccgctcacgaagagaggccgctttcaggtctccatacagctcaaccgaacctttatgtagcccatccgagagcgacagtgatctggaaccggtgggtgcagggattcagcacctgcagaagttgtctcaggagctggacgaggcgattatggctgaggagagtggagatatagtatccctcattcacgattag

SEQ ID NO: 11776 - DNA, 1818 bp, Artificial Sequence
  Description of Artificial Sequence: Synthetic coding sequence
atgtccaacgaatcctgtctcccctattatactgcccatagctactcatctatgagcgctttcaaaacctcaatgggtgatctgcagcggcagctttataatcgcggcgagtacaacatcttcaagtacgcgcccatgttcgagagtaacttcattcagatcaacaagaaaggcgaggtcatagacgtgcacaaccgtgttcgcatggtaactgtaggaatcgtgtgcacaagtcccatcctgccgctgcccgatgttatggttctagctcagcccacaaaaatctgtgagcagcacgtccggtggggacgcttcgcgaaagggcgtggacgccgccccgttaaaacgctggagctgacaaggttgctaccactgaagttcgtgaaaatctccatccatgaccacgagaaacagcagctacggctgaagttggccacgggcaggacattctacctgcagctatgtccttcttcggatactagggaagaccttttttgctactgggaaaaactggtgtatttactgaggcctcctgtcgaatcctattgttccacaccaaccttgctcagcggtgatgctcctcctgaggacaataagtcattggttgcggccgaactgcacagagagggtgatcaatcagaaaccggattgtataagccatgcgatgtgtctgccgccaccagctcggcttacgctggtggggaagggatccagcacgcctctcacggcacagcctctgcagcaagcccctccaccagtactcccggggctgccgagggaggagcagcccgcaccgccggcgggatggccgtggccggcacagccacaggaccacgtactgacgtggcaattgccggggcagcgatgtcccctgcgacgggcgccatgagtatagccaccaccaagtcagcaggtcccggacaggtgaccaccgcgctcgccggggcagcgattaagaacccgggggaaaacgagtccagcaaaagcatggccggtgctgctaatatctccagtgaaggaatatcgctagccctggtgggcgcagctagcactagcttagagggcacttctacatccatggccggcgctgcctccctgagtcaggatagcagcctttctgccgcctttgcggggtccattaccacctcaaaatgcgccgcagagcgaaccgaaggccccgccgtgggcccgttgatttcaaccttgcagtcagagggctacatgtcagaaagggatggctctcagaaggtcagccaaccaagtgccgaggtgtggaatgaaaataaggagagaagggaaaagaaggatcgacacccttcccggaagtcttcccatcatagaaaagccggcgagtcacaccgccgaagagccggagataagaaccagaaggcttctagtcaccgttctgctagtggtcataagaatacaagggatgacaagaaggaaaagggttatagtaacgtgcgcgggaaacgccacggttcttctaggaagtcctcaactcacagcagtacgaagaaagagagcaggacaacccaggaactgggaaagaatcagagcgcatcaagcaccggggctcttcagaaaaaagcctctaaaatatccagttttctgcgaagtctgcgggccacccctggctctaagactagggttacatctcatgatcgggaggtggatattgtggcaaagatggtggaaaaacaaaatatcgaggccaaggtcgagaaagcccaaggcggccaagagctagaaatgatcagtgggaccatgacctctgaaaaaactgagatgatcgtgtttgaaaccaagagtatatag

SEQ ID NO: 11777 - DNA, 3054 bp, Artificial Sequence
  Description of Artificial Sequence: Synthetic coding sequence
atgatgtcagagggaaagccccccgataaaaagagacccaggcggtctctgtccatttccaagaataagaagaaagcgagcaactcaattatctcatgttttaataatgcaccaccagccaagctcgcatgtcccgtctgctctaagatggttccacggtacgacctgaaccgccatctggatgaaatgtgcgcgaataacgacttcgtccaagtcgacccaggccaggttggcctgattaactctaacgtgagcatggttgatctgacctcagtcacgctggaagacgtgacccctaaaaaatctccccccccaaaaactaacctgacaccagggcaatcggactccgcaaaacgagaagtgaagcagaagatttctccttactttaagtcaaacgacgtggtgtgcaaaaatcaggacgaactgaggaaccgtagtgttaaggtgatatgcttaggcagccttgcaagtaagttatctcgcaaatatgtgaaggccaagaagtcgatagataaagatgaggaatttgcagggtccagtccacagagctctaaatccacagtggtcaagagcctgatcgacaactcaagcgaaatcgaagatgaggatcaaattctggagaactcatcccagaaggagaatgtcttcaaatgcgacagcctcaaggaggaatgtatccccgagcatatggtcagaggaagcaagatcatggaggccgaatcccaaaaggcgacgcgcgaatgcgaaaagagtgccctcacacctgggtttagtgacaacgcaatcatgctgttctccccagactttacactgaggaatacactaaagtccacatccgaggattctctagtgaagcaggaatgcatcaaagaggtggtcgagaagagagaagcctgccattgtgaagaagtcaaaatgactgtggcaagcgaggcaaaaattcagctctctgacagcgaggccaaatctcattcttccgctgatgacgcaagtgcttggtctaatatacaagaagcgcctttgcaggacgattcctgcctgaataacgatatccctcatagcattccgctagagcaaggatctagctgcaatggccctggtcagaccaccggccatccatactacctgcgttcctttctcgtggttctgaagaccgtgcttgagaatgaagatgacatgctgctcttcgacgagcaggagaagggcattgttaccaagttttaccagctaagcgccaccgggcagaagctatacgttaggctctttcagagaaaactctcttggattaaaatgactaaactggaatacgaagaaattgctctcgatctgacaccagtcattgaggaactgacaaatgcgggttttctgcagactgagagcgaactgcaggaattgagcgaagtcctggagttgctgtcagctcctgagctcaaaagcctggccaagaccttccacctggtaaaccctaacggccagaagcaacagttggtcgatgcattcctgaagctagccaagcagcggagtgtgtgcacttggggaaagaataaaccgggtatcggcgctgttatcctcaaaagagccaaggcactggcaggacagagcgtgcgaatttgcaagggccctagggcggttttttctagaatccttctgctcttcagtctaacggacagcatggaggacgaggatgctgcctgcgggggtcagggccaactatctaccgtcctgcttgtaaacctgggtagaatggagtttccatcttacactattaacagaaaaacacacatcttccaggatcgagatgacctgattaggtacgccgcggcaacccacatgctgagcgatattagctccgctatggccaacggaaactgggaagaagcaaaagaactggcccagtgtgctaaacgagactggaacaggctgaaaaaccatccaagcctgcgttgccacgaagatctaccgttgtttttgcggtgctttaccgtgggctggatatatacacgaatcctctccagatttgtcgaaattttgcagcgactgcatatgtacgaggaagcagtgcgcgaattggaatctttgctcagtcaacggatctactgccccgacagccggggccggtggtgggataggctcgctctgaatctccaccagcacctcaaacgccttgagccgacaataaaatgcattaccgaagggctggcagacccagaagtaagaacagggcatcgcctgtctttgtaccaacgagcagtccgattgcgggagtcacccagttgcaaaaaatttaagcatctgtttcagcagctcccagagatggcggttcaagacgtgaaacatgtaaccattaccggaagactgtgtccccaacgaggcatgtgcaagtctgtcttcgtcatggaagctggcgaagctgctgacccaactaccgtgttgtgctctgtggaggaactggccctggcacactatcgcagatccggtttcgaccagggcatccatggtgaggggagcactttcagtacgctgtatggcctgctgctgtgggatatcatcttcatggacggaattcctgatgtgtttcgtaacgcttgtcaggcatttcccctggacctgtgtacagactccttctttacctcacgcagacctgccctggaagccaggcttcagctgatccacgacgctccggaagaatccctgcgcgcctgggtagcagcaacctggcatgagcaggaaggaagagtggcatctttggtgtcttgggatcggtttacttcacttcaacaagcccaggatctggtcagctgcctaggtggccccgtcctgtctggagtgtgccgccaccttgctgcagactttagacactgccgcgggggcctgccagacctggtggtgtggaacagccagtcacggcatttcaagcttgtggaggtgaagggaccaaatgaccggttaagccataagcaaatgatttggcttgctgagcttcagaaactgggagccgaggtagaagtttgtcatgttgtcgccgtaggcgccaaatctcaaagtctctcttag

SEQ ID NO: 11778 - DNA, 1602 bp, Artificial Sequence
  Description of Artificial Sequence: Synthetic coding sequence
atgatgagcgagggtaaacccccggacaagaaacgaccaaggaggtccctatctatcagcaaaaacaaaaagaaggcttccaactcaattatttcctgttttaacaatgcccctccagcaaaactggcctgtccagtctgcagcaagatggtaccccgctatgacttgaataggcaccttgatgagatgtgtgcaaataatgacttcgtacaggtggaccccggccaagtggggctgattaatagcaatgtgtctatggtggatctgacctccgttacgcttgaagatgtcacacctaagaagagccctccacctaaaacaaacctgacaccggggcaatcagatagtgccaagcgcgaagtgaagcaaaaaatcagtccttatttcaagtcaaacgatgtcgtgtgcaaaaatcaagacgagctccgaaacagatccgtgaaagtgatctgcctgggcagtctcgcatccaaactatctagaaagtatgtgaaggcaaaaaaatcaatcgacaaggatgaagaatttgctggaagctctccgcaaagttcaaagagtacggtagttaagtctctgatcgacaacagttctgagatcgaggatgaagaccagatcttggaaaattcatcgcagaaggagaacgtgttcaagtgcgattcgcttaaagaggaatgcatccccgagcacatggtaaggggaagtaaaataatggaagccgagtcacagaaggccacccgagaatgcgagaaatctgccctgaccccaggctttagtgataatgcaattatgcttttttcaccagatttcactctgcgcaacacgctgaaatccacctctgaagactctcttgttaaacaagagtgcatcaaagaggtcgtagaaaagagggaggcttgccactgtgaggaggtgaagatgaccgtggccagtgaggcgaaaattcagctgtctgactccgaagcaaagtcacattctagtgccgatgacgcgtccgcatggtccaatattcaggaggctcccctgcaggatgattcttgtctcaacaacgatatcccccattccatcccactggaacagggcagcagctgcaacggacccggacaaaccaccggacacccttactacttacggtctttccttgttgtgttaaagactgtgctggagaacgaggacgacatgctgctttttgatgagcaggaaaagggcatagttacaaagttctatcagctgtcagccacagggcaaaagctctacgtgcgcctcttccagagaaagctgtcatggattaagatgacgaagcttgaatatgaagagatcgcccttgacctgactcccgtcattgaagaattgacaaacgcaggatttctacagacagaaagtgaactgcaggaactgtccgaagtcctggaactgctaagcgctcccgagctgaaatctctggctaagacctttcatctcgtgaatcctaatggtcaaaagcagcagcttgtcgacgcctttcttaagctggccaaacagaggagcgtatgcacctggggaaaaaacaagcccggcataggcgccgtcattctcaagcgcttctgctggctcctccttcaatag

SEQ ID NO: 11779 - DNA, 1719 bp, Artificial Sequence
  Description of Artificial Sequence: Synthetic coding sequence
atggcggagctcgtgcagggtcaatccgcgcctgtcggaatgaaagccgaaggctttgtagatgctctccaccgggtgagacagatcgctgccaaaatcgactcaatccctcaccttaataatagcacgcccctggtggaccctagcgtgtatggatatggggtgcagaaacgaccactagacgatggggtgggcaaccagctgggggcactggttcaccagagaacagtaattaccgaggaatttaaagtgcccgacaagatggtcggtttcataatcgggcggggtggggagcaaattagcaggatccaggcggagtctggttgcaagatacagattgccagcgagtcatctggaatcccggagcgcccctgcgtgctgaccggcacccccgaaagcatcgagcaagcaaaacgcctcctgggacagattgtggaccgctgccgaaatggtcctggctttcataacgatatcgactctaactccacaattcaagagatcctgatcccagctagtaaggtgggcctggtgattggtcggggcggcgagaccatcaaacaactacaggaacgcacaggtgttaaaatggtgatgatacaggatgggcccctgcccacaggggccgacaagcctttaagaattactggggacgcatttaaagtccaacaggccagagaaatggtgctggaaatcatacgagaaaaggaccaggccgattttcgcggcgttagaggggatttcaactccagaatgggtggcgggtccatcgaggtgtcagtaccacgatttgctgtaggcattgttatcggtcggaatggggagatgattaaaaagatacagaatgacgctggcgttcggatccagttcaagcccgacgacgggatttcccccgagcgcgcggcccaggtcatgggccctcccgatcggtgtcagcatgctgcacatatcatcagtgagttgatattgaccgcccaggaaagagacggatttggcggactggcagctgcacgcggcagaggtaggggtcgaggagattggagcgttggagctccgggcggcgtgcaggagatcacctacactgtccccgccgacaagtgtggcctggtgataggcaaaggcggcgagaacataaagagcataaaccaacaaagtggtgcacacgtggagctgcagaggaatccaccaccaaacagtgaccctaacctccgtcggttcacgatccgcggcgtgccacagcaaatcgaggtggctcgacagctgatagacgaaaaggttgggggaacaaacctaggcgcccctggggcttttggacagtctcccttctctcagccacccgctccccctcaccagaacactttcccccctcggtcatctggatgctttcccaacatggccgccaaagtgaacggcaacccccatagcactcctgtatcgggacctcccgccttcctcactcaggggtgggggtccacttaccaggcctggcagcagcccacgcaacaagtgccttcccagcagtcccagccccagtccagccaaccgaattacagcaaagcatgggaggactattataagaaacagtctcatgccgcctcagccgctccacaggcctcatcgccacccgactataccatggcctgggctgaatactacaggcaacaggtcgcgttttacggacagaccctgggccaagcccaggcacatagccaggagcagtag

SEQ ID NO: 11780 - DNA, 927 bp, Artificial Sequence
  Description of Artificial Sequence: Synthetic coding sequence
atgaaagcagagggattcgtagatgctcttcatcgagtgcgacaaatcgctgctaaaatagatagtatacctcaccttaataactcaacaccactagttgaccccagtgtatacggctatggggtgcaaaagcggccgcttgacgatggagtcggtaaccagcttggggctttagtgcaccagcgcacagtgattactgaagaattcaaagtgccagataaaatggtgggtttcataatcggccgcgggggggaacaaatttcgcgaatccaggccgagagcggttgtaagattcaaatcgcatctgaatcctctggcataccagaacgcccctgtgttctaaccgggacacccgagagtatcgagcaggcaaagaggttgctgggccagattgttgataggtgtcggaacgggcctggcttccacaacgacatcgacagtaactccacaattcaagagatcctgatacccgccagtaaggtaggcctggtgatcggaagagggggggagaccataaagcagctccaagagcgcacaggagtgaaaatggtgatgatacaagatggcccactccccacaggagctgataaacccttgagaatcacgggtgacgctttcaaggttcagcaggcccgggaaatggtccttgagataatacgcgaaaaggaccaggcagatttccgtggagtgcgaggcgactttaattcccgcatgggtgggggatctattgaagtgtccgtgccccgatttgccgtaggaatcgtaatcggccggaatggggagatgattaagaaaattcaaaacgacgcaggtgtccggatccagttcaaacctgatgatggcatctctccagagtactaccgccagcaggtagcattctatggacagactttgggacaggctcaggcccactcacaagatgagtag

SEQ ID NO: 11781 - DNA, 786 bp, Artificial Sequence
  Description of Artificial Sequence: Synthetic coding sequence
atgccccccattgggaaccaattaggcgccctggtgcaccaacggacggtgatcaccgaagaatttaaggtccccgacaagatggttggcttcataatcggccgcgggggagagcaaatctcacgaattcaagctgaaagtggttgtaagatccaaatcgcatcagagagttccggaattccggagagaccttgtgtgctcacaggaacaccagagagcatagagcaagcaaagcgacttctgggccagatcgtcgatcgctgccgtaacggcccgggattccataacgacatcgatagcaattctacaatccaggaaatcttgatccccgccagcaaggtagggcttgtcattggacgaggcggagagaccattaaacaactgcaggaaaggaccggcgtgaagatggtgatgatccaggacggaccactccctaccggcgctgataaacctctccgtatcacaggggatgcattcaaggtgcagcaggcaagagaaatggtgctagaaatcattagagagaaggatcaagcagacttccggggagtcagaggggatttcaactcacgcatgggggggggctcgatcgaagtgagtgtgccgcgcttcgcggtcgggattgttatcgggcggaacggagagatgattaagaaaatacagaatgacgcaggggtgcgtatccagtttaagcccgacgacggcatcagccccgaatactatcgccagcaagtggctttctatggccagaccctcggacaagcccaggctcattcccaggaacagtag

SEQ ID NO: 11782 - DNA, 597 bp, Artificial Sequence
  Description of Artificial Sequence: Synthetic coding sequence
atgggcaagcagaagaaaactcggaagtacgcgaccatgaaacgtatgctaagtctacgggaccagagattaaaagagaaagaccgcctcaagcccaagaagaaggaaaagaaggacccctcagccctcaaggaacgagaagtgccacagcaccccagctgtctgttcttccaatataatactcaattgggccccccatatcatatactagtagacaccaactttattaacttcagcattaaggctaagctagacctagtgcaaagcatgatggactgcctgtacgcaaagtgtattccttgcatcactgactgcgtgatggccgagattgagaaactgggtcaaaagtacagggtggcattgcgcatcgcaaaggatcctcgctttgagcgcctgccctgtacacataaaggcacctatgctgacgactgcctggtccagagggtgacacagcataaatgctatattgtggctacagtggatagggacttgaaacgtcgcattcggaagatacccggagtgcctatcatgtatatctccaatcaccgctataatattgaacgaatgcctgatgactacggcgccccgcgtttttag

SEQ ID NO: 11783 - DNA, 501 bp, Artificial Sequence
  Description of Artificial Sequence: Synthetic coding sequence
atggccgcctatcccgagagttgcgtcgatacaactgtgttggattttgtggccgacctgtccctggccagccctcgaaggcccttgctgtgtgattttgcgccaggagtgagtttgggggatccggctctggccctgagggaaggtagaccaaggaggatggcaagattcgaggaaggtgaccccgaggaggaggagtgtgaggtagaccagggcgacggtgaagaagaagaggaagaagaaagggggcggggcgtttcacttctggggcgacccaaaaggaaacgggtgatcacatacgctcagcgacaggccgccaatattcgggaacgtaaaagaatgtttaacttaaacgaggccttcgaccagttacggaggaaagtccccacattcgcttacgagaaacggttgtctcggattgaaacgctgagactggctatcgtctacatcagctttatgacagagttgttagaatcgtgtgagaaaaaggagagcggttag

SEQ ID NO: 11784 - DNA, 2280 bp, Artificial Sequence
  Description of Artificial Sequence: Synthetic coding sequence
atgatctcctcaacctcggtctacggcctgaaaatgcagtggactccagaacatgctcagtggccggaacagcacttcgatataaccagcacaacacgcagtcccgcgcacaaggtggaggcttatcggggccacctgcagaggacttaccagtatgcttgggccaacgacgacatcagcgctttaactgctagtaatctcctcaaaaagtacgcggaaaagtatagtggtatcctggaaggtcctgttgaccgtcctgtacttagcaattattcagacacaccatccggcctcgtaaacggaagaaagaacgagagcgaaccctggcagcccagcctcaactcagaggctgtgtaccctatgaattgtgtgccagacgtgattactgcttcgaaggcaggggtgagcagcgccctcccacccgcggatgtttccgcaagcatcggctcatcaccaggcgtggcatccaatctaactgaaccttcatacagctcctcaacttgcggaagccacacagtcccatcccttcacgcaggcctgccatcacaggagtatgcaccagggtacaatggatcctacctgcacagcacatactctagccagccggcccccgccctcccttcacctcacccgtcaccgctgcatagctccggcttgctgcagcctcctccccctcccccccctccaccagcacttgtgcctggctataacgggacaagcaacctgagttcatacagttacccatccgcctcttatccgccccaaactgccgtgggctctgggtactctcccggcggcgcacctccacctcctagtgcttatttgccctcaggaatccctgctcccactccccttccgcccacaacggtgcccgggtatacctaccaggggcacggcctgacacccatcgctccctctgcgctcaccaatagcagtgcttccagcttgaaacgcaaagccttttatatggccggccaaggtgatatggacagctcgtatggaaattattcgtacggccagcagcgctccacccaaagtcccatgtatagaatgcctgataactcaattagtaacacaaatcggggaaacggcttcgataggtctgcagagactagttctctggctttcaagccaacgaaacaattaatgtcaagtgaacagcagaggaaatttagttcccagagttctcgggcactcacccctccttcatattccacagctaaaaattcactgggaagcagatcctcggaatcctttggaaaatacacaagcccagtgatgtccgagcacggggatgaacatcgacagttgctgtcacatcccatgcagggtcctggcctcagggcagctaccagctccaaccactccgtcgacgaacaactcaaaaacaccgacacccatctcatcgaccttgtcaccaacgaaattataacccagggaccacccgtagactggaacgacattgcagggctagacctggtgaaagccgtgatcaaggaggaggtcctctggccagtgctacggagcgatgccttttctgggctaaccgccctgccgagatccattctcctgttcgggccccggggaactggaaaaaccctgctgggccgatgtatcgcttcacagctgggcgcaacgttctttaaaatcgctgggtctggcctcgtggcaaagtggcttggggaggccgagaaaattatacatgcatctttcttagtagcccggtgtaggcaaccctcggtcattttcgtgtcagatattgatatgctcctaagctctcaggtcaacgaagagcattcacctgtctcacgcatgcggactgagtttctgatgcagctggacaccgtgttgacatcagcggaagaccaaatcgttgtcatatgcgcgacttcaaagccggaggaaatcgatgagagtctgaggcggtattttatgaaacggctgttgatcccactccccgactccacagcccgccaccagattatcgtccagctgttatcccagcacaattattgcctcaacgataaagagtttgctttgctggttcagcgtaccgaggggttctccggactggacgttgctcatttgtgccaagaagcagtggttgggcccctgcatgccatgccagccactgacctcagtgccattatgccctcccagctgcgacctgtgacataccaggatttcgagaacgccttttgcaagattcagccctctatcagccagaaggagctagatatgtatgtggagtggaacaaaatgtttggatgtagccagtag

SEQ ID NO: 11785 - DNA, 1050 bp, Artificial Sequence
  Description of Artificial Sequence: Synthetic coding sequence
atggagaccccccccgttaatacaatcggagagaaggacacatcccaacctcaacaggaatgggagaagaatttaagagaaaacctggactcggtgatccagattaggcagcagcctcgcgatccaccgaccgaaaccttggagttggaagtttcccccgatccagcctctcagattctggagcacacgcagggggccgaaaaattggtggctgaacttgagggagactcccacaagtctcatggctctacaagtcaaatgccggaggccctgcaggcttcagacctgtggtattgtccagatggaagcttcgtgaagaaaattgttatccgcggccatggcctggacaaaccaaaattgggcagctgttgccgggtgctcgcacttggattcccgttcggttccggaccgcctgaaggctggaccgagttgacaatgggcgtgggcccgtggcgggaagagacgtggggcgagctgatcgaaaagtgtttggagtccatgtgtcagggcgaggaagccgaattgcagctcccggggcattccggcccccccgtgcgattgactctggcttctttcacacaggggagggattcctgggagctcgagacctccgaaaaggaagcactagcacgtgaagagcgagctagagggacagagttgttcagagcaggcaacccagaaggcgctgctcggtgctacggccgcgcgctgagactcttgctgaccctgcctccccccggaccccctgagaggacagtgcttcatgccaacctggctgcttgtcaactgttattagggcagccccaactcgctgcccagtcctgcgaccgggtgttggagcgggaacctggacacctgaaggcattgtaccggcgcggagttgcccaggctgctttaggcaatctcgagaaggccacggcagatttgaaaaaggtccttgccatcgatcctaagaacagggccgcccaagaggagctcggaaaagttgtaattcaggggaagaaccaggatgctgggctggcacagggcctcagaaagatgtttggctag

SEQ ID NO: 11786 - DNA, 1050 bp, Artificial Sequence
  Description of Artificial Sequence: Synthetic coding sequence
atggaaacgccaccagttaacaccatcggcgaaaaggacacgtcccagccacagcaggaatgggagaaaaacctccgcgagaacttggatagtgtcatccagatcaggcaacagcccagggatccgccgacagagactctggaactggaggtctccccagatcccgccagccagattctcgagcatactcagggggcagaaaagctggtggctgaactggagggagattctcacaaatcccatgggtccacatcccagatgcccgaagccttgcaggcgagtgatctgtggtattgcccagatggttcttttgtgaaaaagatcgtgatacgaggccacggactagataagccgaagctggggagttgctgtagagtactcgcgctggggtttcctttcggaagcggcccccctgagggctggaccgagctgacaatgggcgtgggaccatggcgggaagagacctggggcgagctaatcgagaaatgtctggaatcaatgtgccagggcgaggaagcagaacttcagctcccagggcacagtggccctccagtgcgcctgactctggcttcgttcacacagggccgcgactcttgggagttggagacctctgaaaaagaggcactggcaagagaggagcgtgccaggggcacagaactgtttagggccggcaatcctgagggtgcagcccgttgctatggcagagcccttaggctcctcctcactctacctccaccagggcctccggagcggacagtgctccacgccaacctggccgcctgtcagttacttctcggacagccgcagctcgccgcacagagctgtgatcgtgtccttgagagggaaccaggtcacctgaaggctttgtatagacgcggggtggcccaagccgccttgggaaatctggaaaaggccacggcagacttaaagaaggtcctggcaattgaccctaagaatagggcagcccaggaggagctgggaaaagttgtcattcagggaaagaatcaggatgccggcctagcccaaggcctcaggaaaatgtttggatag

SEQ ID NO: 11787 - DNA, 1050 bp, Artificial Sequence
  Description of Artificial Sequence: Synthetic coding sequence
atggagacgcccccagtcaacactatcggcgaaaaggacacatcccagcctcaacaagaatgggaaaagaatctcagagaaaacctggacagcgttatccagatcaggcagcagccccgcgaccctcctaccgaaacattggagctcgaagtgagtcccgacccagcttcccagatcctcgaacacactcagggcgccgagaagttggtggcagaactggaaggtgatagccataagtctcacggcagcacatcgcagatgcctgaagctcttcaggccagtgatctttggtactgtcccgacggatcatttgtgaagaagatcgtgatcaggggtcacgggctggacaaacccaaattgggttcttgttgcagggtcttggccctcgggttccctttcggctccggccctcccgaggggtggacagagcttaccatgggagtgggcccctggagagaggaaacctggggcgagttgattgaaaaatgcttggaatctatgtgtcagggcgaggaggccgaactgcagctccctgggcactcaggacccccagtgcgtctaacactcgcgagcttcacacaggggagagattcttgggaactcgagacctcagagaaagaggccctcgcccgggaggagcgcgctcgggggactgagctcttcagagccgggaatcccgagggagccgcacggtgttacggaagggcattgcgtttgctgcttacactccctcctcctggtccacctgagcgaacggtcctccatgcaaatctggccgcctgtcaacttcttctgggccagccacaactagcagcacagagttgcgatcgcgtcttggagcgggaacccggccatctgaaggctctgtatcgtaggggagtggcccaggctgcgctgggcaatctcgaaaaagcaacagccgacctaaagaaggtcctcgccatagatcccaaaaatagagccgcccaagaggaactcggcaaagtggtgatccaggggaaaaaccaggatgcagggctcgctcaggggctccggaagatgttcgggtag

SEQ ID NO: 11788 - DNA, 2151 bp, Artificial Sequence
  Description of Artificial Sequence: Synthetic coding sequence
atgcccctcccagagccctccgagcaggagggcgagagcgtgaaggctgggcaggagccatccccgaagccaggcacagatgtaatccctgctgccccacggaagcccagagagtttagtaaactcgtcttactgaccgcttctgaccaggacgaggatggagtggggtccaaaccacaagaagtacactgcgtgctcagcctagaaatggctggaccggccactttagcatccaccctgcagatcctgcctgtagaagaacagggtggcgtggtacaaccagccttggaaatgccagaacaaaagtgctcgaagttagacgccgccgcaccacagagtctcgagttcctgagaacaccctttgggggacgcctcttggtcctcgagtcctttctgtacaaacaggagaaagctgtgggggacaaggtctactggaagtgccggcagcatgcagagctggggtgtcgcggccgggccattacaaggggactacgggccacagtgatgagagggcattgtcatgccccagatgagcaggggctcgaggccaggaggcagagagagaagttaccctccctggccctccccgaagggctgggagagcctcaggggcctgagggtcctggaggcagggttgaggaacctctggaaggcgtgggcccatggcagtgcccagaagaaccagagccaacccctggcctggttttatcgaaaccggccttagaggaggaggaggctccacgcgccctgagcctcctctcactgccaccaaaaaagcggtcaattcttggtctgggtcaagcccgtccactggagtttctgaggacttgttacggggggagcttcctggtgcatgagtcgtttctgtataagagggagaaggcggtaggcgacaaagtttattggacgtgccgcgatcacgccctgcacgggtgccgaagtagagctataactcagggccagagagtgaccgtaatgaggggccactgccaccaacccgacatggaagggctggaggctcggagacagcaggaaaaagcggtggagacactgcaggctggacaggatgggcctgggtcccaggtggacacactcctccgtggcgttgacagtctgttatataggagagggcccggcccgctgacactcactagaccacgaccccggaagagagctaaagtggaagaccaggaactcccaacccagccggaagcacccgacgagcaccaggatatggatgcggaccctggaggccctgagttcctgaaaacccccctgggaggcagcttcctggtttacgaaagcttcctgtaccggcgtgagaaagcagctggcgagaaggtctattggacctgtcgagatcaggctagaatgggctgtagaagtagggccataactcagggtcgtcgagtgaccgttatgagaggtcactgccaccctcccgacctaggtgggcttgaggcactgaggcaacgggaaaagaggccaaacactgcacaacggggatcacccggaggcccagaatttctaaagactcccctggggggttctttcctggtctacgaaagctttctgtaccggcgcgaaaaggctgctggggagaaggtatattggacgtgccgggaccaggcccggatgggctgtcgcagccgggccattacacagggacgcagggtcatggttatgcgtcggcactgccacccccccgaccttggcggcctggaagcactaagacagcgagagcatttccccaatctcgcccagtgggatagccccgaccctctcagacctctggagttcctgcgcacttccctgggcgggcgttttctcgtgcacgagtccttcctgtaccgaaaagaaaaggccgcaggcgagaaggtgtactggatgtgccgagatcaggctcgtctgggctgtaggagccgcgccatcacgcagggtcataggatcatggtcatgcgttcacattgccaccagcctgaccttgcgggattggaggccctaaggcagcgcgagaggctccctaccacggctcagcaggaagaccccgaaaagattcaggtccaactgtgctttaagacctgctctccagagtcccaacagatttacggcgatattaaagacgtgcggctggacggtgaatcccagtag

SEQ ID NO: 11789 - DNA, 987 bp, Artificial Sequence
  Description of Artificial Sequence: Synthetic coding sequence
atgccacaagccacttccccaccgctatggccactgtcacttcacggcggcaagggcatcttatgggctaggcactcccaccccccgggccctccttcccatcatattcaggattcaggtcgctgtagcctgcctctccctcaatcccccggcgtgacccccctgcctgctcggttatcgggggctacccctcttagccccattcgcttgttgtctagcttcgtcccccgtggcccgcgagtcatcccactcactaatcaggctagaaggaccctccacgcgagcttgggtgggtgctgggggcgcacatccgacgccgctgataccgccagcttaaaagcatggcagggcggcccagagttcttgaaaacccccctcggcggatcctttctggtgtacgagtccttcctttatcgtagagagaaggctgccggagagaaagtgtactggacgtgccgagaccaggcccgcatgggctgccgctccagggccattactcagggccgaagagttatggtgatgcgcaggcactgccacccacctgacctcggaggactggaggcgctgcggcagagagagcactttccgaacctggcccagtgggacagccccgacccgttgcgtccacttgaattcttacgaacaagcctgggcggtagatttcttgtccacgagtcctttctgtacagaaaggagaaagctgcaggcgaaaaggtgtactggatgtgtagggatcaggcccgtcttgggtgtagaagtcgagccatcacacagggtcaccggataatggtgatgagatcacattgtcaccagccagacctcgccggcctggaagcgctgaggcagcgggagcggctacctacaactgctcagcaagaagaccccgaaaagatccaggtgcagctttgtttcaagacctgctcaccagagagccagcagatctatggggatatcaaggacgtcagattggatggagaatcccaatag

SEQ ID NO: 11790 - DNA, 2298 bp, Artificial Sequence
  Description of Artificial Sequence: Synthetic coding sequence
atgcctttgccagaaccctctgagcaggagggggaaagcgttaaggctggacaggagcctagcccaaagccaggtacagatgtcatccctgccgctcctaggaagcctcgcgagtttagtaaactggtgctgctgacagcttcagatcaggacgaggacggcgttgggagcaagcctcaggaggttcactgtgtgcttagccttgagatggctggcccggcaactcttgcatctacacttcagattctccctgtcgaagagcagggcggggtggtacagcctgctttggagatgccagagcagaagtgcagcaagctggatgccgccgccccccagtcactggagtttctgcgcacacctttcggcgggaggttgttggttctcgagagcttcctttataaacaggagaaggccgtgggagataaagtctattggaaatgtcgacaacacgcggaactgggctgtcgaggacgcgccattacaagaggtctgcgcgccacagtcatgaggggacactgccatgcccccgacgaacagggtctcgaggcgagaagacagagggagaaactgcccagcctggccctcccagaaggtcttggtgagccacagggccccgagggacctggcggcagggtggaagagcctttggagggggtcgggccatggcaatgccctgaagaaccggaacccacaccagggctggtcttaagcaaacctgcactggaagaagaggaggcccccagggctttgtccctgttgtcgctccctcccaagaaacgttcaatcctaggactcggacaagccagaccactggagtttctgcggacttgctacggcggctctttcttggtccacgagtctttcctgtacaaaagggagaaggctgtgggagataaggtgtattggacctgcagggaccacgctcttcatggctgccgatctcgggctatcacccagggccaacgggtgacagtcatgagaggccactgccaccagccggatatggagggtttggaggctcgtaggcagcaggaaaaagcagtcgagactctgcaagctggtcaagatggcccgggttcgcaagttgataccctactcagaggcgtggactccttactctacagacggggacccgggccactgaccttgactcgaccaagaccgcgcaagcgcgcaaaggttgaagatcaggaactgcccacccagcctgaagcacccgacgagcatcaggacatggatgccgacccgggcggacctgagtttctcaagactccgttaggcggttcatttctggtgtacgagtcttttctttaccggcgggagaaagcagcgggggagaaggtctattggacttgcagggatcaagcgcgaatgggatgcaggtctcgcgccatcacccagggaaggcgtgtcactgtgatgagaggacattgccaccccccggacctcgggggcctggaggccttgagacaaagagaaaagcgtccaaatacagcccagagaggaagccccggggcagggttgagcttccaatggcttttccggatcttacagctgctcggacacgctccagtgctgttgtgccctagtggatccagctgcctgccttctctgcccgcacctcacggaccatgccctgcacttagcatccctcttgagggtggccccgagttcttaaagacccccctgggcggctcatttctggtctacgaaagctttctttatagaagagagaaagcggctggagagaaagtgtactggacatgccgagatcaggccagaatgggatgcagatctcgtgccataacccaaggccgtcgagttatggtgatgcggagacactgccacccgcccgacctcggaggcctagaagcacttcgccagcgggaacactttcccaatctggctcaatgggattcgccagaccctctgaggcctctggagttcctccgcaccagtcttggcgggagatttttagtacatgaaagctttttgtaccgcaaggagaaggcggcaggagaaaaggtctactggatgtgtagagaccaggccagactgggttgtagaagccgcgccatcactcaggggcatcgtattatggttatgagatcccactgccatcagcctgatctggctggacttgaagccttacgccagcgggagcgcctgcctaccacagcacagcaagaagaccctgaaaagatccaggtgcagctctgcttcaagacctgtagtcccgaatcccaacaaatatatggtgatatcaaggacgtacgactcgatggtgaaagccagtag

SEQ ID NO: 11791 - DNA, 2148 bp, Artificial Sequence
  Description of Artificial Sequence: Synthetic coding sequence
atgccgctgccagaacccagcgaacaggaaggtgagagcgtgaaggctggtcaggagccttcccccaaacctggtacagacgttattcctgccgctccgaggaagccccgggagttctctaaactggtgctgctgacagctagcgatcaagatgaggatggcgttggctccaaaccccaggaagtccactgcgtgctatcgctggagatggcaggaccagcaactcttgcctcaacacttcaaatactgcccgtcgaagagcaaggaggcgtggttcagccagccctcgagatgccagagcagaagtgctctaaacttgacgccgcaccccagtctctcgagttcctgaggacccctttcggcggtagactcctggtgctggagtcttttctttataagcaggagaaagccgtgggagacaaagtgtactggaagtgcaggcagcacgccgaattgggctgccggggacgcgccatcactagaggccttcgggcgactgtaatgaggggccactgtcacgccccagatgagcaaggactggaagctcggcgacagcgggagaagttgccaagcctcgctctgcccgaggggctgggggagccacagggccctgaaggccctggcgggcgcgtggaagagccgttggagggagtgggtccttggcagtgccccgaggagcctgaacctacccctggcctggtcctctccaagccagctctggaagaggaagaggcgccacgggccctcagcctacttagtttgccgcctaagaaaagatccatcctgggcctgggccaggcacggcctttggagttcttgcgcacctgctatggtggatcctttctggtgcatgaatcgttcctgtataagcgtgaaaaggccgttggcgacaaagtctactggacctgtcgggaccacgctctgcatggctgcagaagccgcgccattacacaggggcaacgagtgacagtaatgcgtggacattgccatcagcctgacatggagggcctggaagccagaaggcagcaggaaaaagctgtggaaaccctccaagctggccaggacggccctggatcccaagtcgacacattgttgcggggagtggattctctgctgtaccgtagggggccggggcctctgaccctcactcgccctaggccacgcaagagggcaaaagtagaagatcaggagttaccgacgcaaccagaagcaccagacgagcaccaagatatggatgcagatcccggcggccctgagtttctgaaaacgcctctcggaggaagcttcctggtgtacgaaagctttctgtaccgacgagagaaagcggctggtgagaaagtgtattggacctgtcgcgatcaggcaaggatgggatgcaggtcccgggccatcactcagggcaggcgcgtcactgtgatgcggggacactgtcatccacccgatctgggtggattagaagcgcttcgccagcgcgagaagcgtcctaacacggcccaaagaggctcaccaggtggccccgagttcctcaaaacccctctggggggctcctttctggtttacgagtcttttctgtaccggcgcgaaaaagccgcaggtgagaaagtgtactggacatgtcgggaccaagcccggatggggtgccgctcccgggcaatcactcaggggcgccgtgtcatggtcatgcgcaggcactgtcatcctcctgatctgggaggtctggaggcccttaggcagcgagagcactttcctaacttggctcaatgggatagccccgaccccctccggcctttagagtttctgaggacctccctcggaggaaggttcctggtccatgagagtttcctttatagaaaggaaaaggccgcaggcgagaaggtatattggatgtgcagggaccaggcccggctcggatgccggtcaagagccataacgcagggccataggattatggtcatgcgtagtcattgccatcagccagacctcgcaggcctggaagcgctccgccagcgagagcggctgccgacaaccgcacagcaggaagatccagaaaagattcaagttcagctctgtttcaagacctgctcgccagaaagccaacagatctatggagacatcaaggacgtgaggttagacggcgagtcccaatag

SEQ ID NO: 11792 - DNA, 978 bp, Artificial Sequence
  Description of Artificial Sequence: Synthetic coding sequence
atgccccggccgggccgcaacacctacagtgatcagaagccaccctacagctatatctccttgacagccatggccatccagagcagtccagaaaaaatgctgcccctctctgagatatacaaatttatcatggaccggttcccgtactaccgcgagaacactcagcgctggcagaacagcctgagacataacttgagcttcaacgattgtttcatcaagattccccgccggcctgatcagcccggtaagggcagtttctgggccctgcacccatcctgtggcgatatgttcgagaatgggagctttctgaggagacggaagaggtttaaagtgctgaaatcagaccacctcgctccctcaaagccagccgatgcagcacaatatcttcagcaacaggcaaagcttagactgtctgctttggcggcgagcgggactcacctcccacagatgcccgctgctgcatacaaccttggcggagtggcccagcctagtggctttaaacacccatttgccatcgagaacatcatcgcccgggaatacaagatgcccggcggccttgctttcagtgctatgcagccagtgcctgcggcctatcctctgccgaaccagctaacaacgatggggagctcactcggtaccggttggccccacgtttatgggtcagccggcatgattgacagtgctaccccaataagtatggcctccggggattactcagcatacggggtgccactcaaaccactgtgccacgctgccgggcagacactaccagcaataccagtaccaataaagccgacgcctgctgcagtgcccgcactgcccgctctacccgccccaatccccacgctgctgagcaatagccccccatcactctcacccacatcaagtcaaacagccacctcacaatcctccccggccacacccagcgagactctgacctccccagcctctgcccttcacagcgtggccgtgcattag

SEQ ID NO: 11793 - DNA, 1299 bp, Artificial Sequence
  Description of Artificial Sequence: Synthetic coding sequence
atgccccgacctggcaagagttcatactcggatcagaagccaccctatagttatatttcattaactgccatggcaatccagcactctgctgaaaagatgcttcctttgagcgacatctacaagttcattatggagaggtttccctattaccgggagcatacacagcgctggcagaactcactgaggcataatttgagcttcaacgactgttttataaaaattccaaggcgtcccgaccagcccggaaaaggcagcttttgggccctgcacccggactgtggggatatgtttgagaatggatcatttctgcgcagacgcaaacgcttcaaggttctgagagccgaccacacacatctgcatgcaggctccaccaagagcgcacctggtgctggaccgggaggccatctacatcctcaccaccaccatcatccccaccatcaccaccaccaccacgctgccgctcaccaccaccaccatcaccatccgcctcagccacccccaccgccaccaccccccccaccacacatggtccactacttccaccagcagccacctactgccccacaacctccaccccacctgccgtcgcagcccccacagcaaccaccacagcagagccaacctcagcaaccctcacacccaggcaaaatgcaggaggccgcagcggttgccgcggccgccgccgcggcagcagcggccgccgtgggttctgttgggcggctcagtcagttcccaccctacggcctggggtcagctgctgcagccgcagcagccgctgcagccagtacctccggctttaaacacccctttgccattgaaaatatcattgggagggattataagggcgtcttgcaggccggaggactgcctttggctagtgtgatgcaccacctgggatatccggtgccaggacagctgggtaatgtggtgagctctgtatggccacatgtgggagttatggacagcgtcgccgccgctgccgccgctgccgcagccgctggcgtgccagttggccctgaatatggggcctttggggttcctgtaaagagcctgtgtcatagcgcttcacaaagtctccccgctatgcctgtccccataaaacccacccccgcccttccccctgtcagtgcgttacagccgggcctcacagtgcctgccgcctcacaacagccaccagctcccagtacggtctgctccgccgcggcagcatcccccgtggccagcctacttgagcctacggctcccactagtgccgaaagtaaaggcggctctctccacagcgtgcttgtacattcatag

SEQ ID NO: 11794 - DNA, 1251 bp, Artificial Sequence
  Description of Artificial Sequence: Synthetic coding sequence
atgaatcttcctcgcgccgagcgacccagatcgaccccacagcgtagcttgagagattccgatggagaggacggaaaaatcgacgtgctcggagaagaagaggatgaggatgaagtagaagatgaagaggaagaggcccgccagcagttcctggaacaaagcctccagcctggtctgcaggtggcccgctggggcggtgtggcacttccacgggagcacatcgagggtggcgggggtccttcggatccctctgaatttgggacgaaatttagagcccccccacgttccgccgcagcctctgaggacgctcggcaacctgctaagccaccttactcatacatcgccctgatcacaatggcaattttacagaaccctcacaaaaggttaaccctgtcaggaatctgtgcctttatcagtggtcggttcccatactaccggcgaaaattccccgcctggcagaattcaatccgacataacctttccctgaacgactgctttgtgaaaataccaagagagcccggtcaccctggcaagggtaattactggtctctggatcctgccagtcaggatatgttcgacaacggaagcttcctcaggcggagaaaacgctttaagaggcaccagttgacccccggtgcacatctcccgcaccccttccccctccccgccgcgcacgcagccctgcataatcctcacccgggccctcttttgggagcccccgcacctcctcagcccgtgcctggcgcatatcccaatacagcaccagggcggagaccctatgctctgttgcatccccaccctctgcggtacctgctgctcagtgcgagagtgtacgcaggtgcaccaaaaaaagccgagggcgctgatctggccacgccagcgccattcccctgctgtagcccacaccttgttctcagcctaggccggcgcgctcgcgtatggcggcgccacagggaggcagatgcaagcttgagcgcattgagggtcctatgcaaaggcagcggcgaacgcgtgcaggggctccgccgtgtctgcccccgcccaagaggcgccacagccacatgctcatctgaccaccaggcatgttgtatccccaaaccacttcctctgtgttgcaagtgccccccccccctcctgctgggccagttctgctctaatagcagtagcattcggaggaccgcacccacagcagcactcccaccaagggctcgctgctgggccggaacatgccggccacggaggaggtgctag

SEQ ID NO: 11795 - DNA, 1251 bp, Artificial Sequence
  Description of Artificial Sequence: Synthetic coding sequence
atgaacctgcctagagccgagcggcctcgatccacccctcaacgctctctgagggactctgacggcgaagatggtaaaatcgacgtgctcggtgaagaggaagatgaggacgaagtggaggacgaggaggaagaggcaaggcagcaattccttgagcagtctttgcagcccggcttacaggtggcacggtgggggggggtggccttaccaagggaacacattgagggggggggggggccgagcgatccaagcgagtttggcaccaagtttcgggctccccctcggtctgctgctgcatccgaagacgctcgtcagccggccaagcctccatactcctacattgcactgataacaatggctatcctgcaaaaccctcacaagcggttgactctgtccgggatctgcgcctttatcagtggacgtttcccctattatcgaagaaagttccccgcttggcagaattcaatccgccacaatctgtctctgaacgattgtttcgtgaagattccgagagaacccggccaccccgggaaagggaattactggtctctcgaccctgcaagccaggatatgttcgacaatggttctttcctacgacgaaggaagagattcaaacgacatcagctcacacccggcgcccacctaccgcatccatttccactgcccgccgcccacgctgcactgcacaacccgcatccaggccccttactgggcgctccggcacccccccagccggtaccgggggcctatcctaataccgccccaggacggtgtccttatgccctgctccacccacacccgcttagatacctgctactgagcgcccccgtgtacgccggtgccccgaaaaaggccgagggagctgacttggccactcctgcacctttcccttgttgctcacctcatttagtcctctccctgggaagacgcgccagagtatggaggagacatagagaggcagacgcgagtcttagcgctctccgcgttctgtgtaaagggtctggggagagagtgcaaggactgaggagggtgtgccccagaccacggggtgccacagccacgtgctcttctgatcaccaggcatgctgcatccctaagcctctgcccctatgctgcaagtgtcctccaccactgctgctcggccagttctgctctaacagcagctctatccgtaggaccgcacctaccgccgcccttcccccgcgggcccgttgttgggctgggacgtgcaggccgcggcggaggtgttag

SEQ ID NO: 11796 - DNA, 1254 bp, Artificial Sequence
  Description of Artificial Sequence: Synthetic coding sequence
atgaacctcccccgcgcagaaaggctgaggagtactccccaaaggtctcttagagatagtgatggggaggatgggaagatcgacgttctgggcgaagaagaagacgaggacgaagtggaagacgaggaggaggctgcgtctcagcagttcctggagcagagcctgcagcctggtttacaggtcgctaggtggggtggggtagccctgcccagggagcacattgaaggcgggggaggcccgtcagatcccagcgagtttggaaccaagttccgcgcccctccacggtcagccgccgcctctgaagatgccaggcagccagcgaagccaccgtattcctacatcgcactgattacgatggcaatacttcagaacccgcacaaacgcctaacactctcgggaatctgtgcatttatctccgggagatttccatactaccgacgcaagtttcctgcgtggcagaattccatccgtcacaacctcagtcttaacgactgctttgtcaagatccctcgggagcctggccacccaggaaaggggaactactggtctctagatcccgcatcccaggacatgttcgacaatggcagctttctgcggcggcgaaagagatttaagaggcatcagttaactccgggtgcacatcttccccaccccttccctctgcccgcagcccacgccgctcttcacaacccccaccctggtcctttactgggggctcccgcccctccacagcccgttccaggggcatatcctaacacagctcctggaaggcggccatacgccttgctgcatccacaccccctccgctacttactgttgtctgcccctgtgtatgcgggcgccccaaaaaaagctgagggagctgcgctggccacccccgctcccttcccttgttgctcaccccacctcgtgctatcactagggcgcagggctcgggtctggcggagacaccgagaagcggacgcttctctgtcagccctgagggttctgtgcaagggcagcggggagcgtgtgcagggacttcggagggtgtgtccccgtccccgtggcgcaacggcaacatgttccagcgatcaccaggcttgctgcattcctcggccactgcctctgtgctgtaaatgtccccccccccctttactgggacagttctgttctaatagctctagcatccgccgtcgcactgcccccacagcggcactgccacccagggcaagatgttgggccggcacctgccgtccacgtcggccatgctag

SEQ ID NO: 11797 - DNA, 1140 bp, Artificial Sequence
  Description of Artificial Sequence: Synthetic coding sequence
atgtctagcgcccctgaaaagcagcaacctccccacggagggggagggggaggcggggggggtgggggggcggccatggaccctgctagcagcggcccgtccaaggccaagaagacaaatgcaggcattcggaggcctgagaagcctccgtattcgtacattgcccttattgtcatggcgatccagagtagtcccacgaaacgccttacgctgtccgaaatttaccaatttctgcagagtcgctttcctttcttcaggggcagttatcaggggtggaaaaatagcgtacggcataatctcagcctcaatgaatgctttatcaaattacctaaggggctcgggagacccggcaaggggcactattggactatcgacccagcttctgagttcatgttcgaggagggaagcttcaggcggaggccccgcggcttccgtagaaagtgccaggctcttaagccaatgtattctatgatgaatggactgggctttaaccacctgcctgatacctacggatttcaggggtcagccggcgggttgtcctgtccacctaactcattagctctggagggcggtctgggaatgatgaatggacatcttccaggtaacgttgacgggatggcactgcccagccatagcgttccgcatctccctagcaatggcgggcacagctatatgggcggctgcggcggagccgccgccggggaatatccccatcacgacagctcagtgcccgctagtcctctgctgccaaccggtgcaggtggggtaatggaacctcatgccgtttatagcggtagcgcagctgcctggccgccttcggctagtgcagccctgaatagcggcgcctcttacatcaagcaacagcctctctcgccctgcaatcccgcagccaacccattatcggggtccctgtctacgcactctctcgaacaaccatatctccaccagaactcccataacgcccccgctgaactgcagggcatcccacgctaccacagccagagccctagcatgtgtgaccggaaggaattcgtgttcagcttcaatgcaatggccagcagcagcatgcacagcgctggcggtggctcttattaccaccaacaagttacatatcaggacatcaagccctgcgtcatgtag

SEQ ID NO: 11798 - DNA, 765 bp, Artificial Sequence
  Description of Artificial Sequence: Synthetic coding sequence
cccgccctgcctagtaccctgccccatcggcctgccccaagcacaaggccaggcccgtgtccccggtgtttgccttcgagaatgggtccttgcagcgggagtagacttggcccaccagaggccgagagcccaagccagccacccaagaggcggaagaagcgttacctgcgccatgataagcccccctatacctacctggccatgattgctctcgttatccaagcagcaccttcaagaaggctgaaactggcccagattatccgccaagtccaggcggtatttcccttcttccgagaagactatgaggggtggaaggacagcattagacataacctgagtagcaataggtgcttccgtaaggtgccaaaagaccctgccaaaccgcaggctaagggaaatttctgggcggtcgacgttagcctgatccctgccgaggccctgcggctccagaacacagcgctgtgtcgacggtggcaaaacggcggagctcgcggggcttttgcaaaggacctgggcccttacgtgttgcacggacgcccctatcgtcctccctcaccaccgcccccaccctcagaaggcttttcaatcaagtcactactgggcggctccggggagggcgccccctggccaggcctggccccacagtctagccctgttcctgccggcactggaaattctggagaagaggctgtcccaactcctccccctccaagtggcgggagctgtcctccccctacctgtctgagcactctgcctatgtggtag

SEQ ID NO: 11799 - DNA, 1098 bp, Artificial Sequence
  Description of Artificial Sequence: Synthetic coding sequence
atgggtccgtgttccggatctcgtctgggccctcccgaggcagaatctcccagtcagccgcctaagaggaggaagaaaagatacttgcggcacgataagccgccttatacctatcttgcaatgattgctctggtgatccaggccgctccgtcaaggcgacttaagctcgcacaaataatccggcaggtccaggcagtcttccctttttttcgggaagattatgaggggtggaaagactctattaggcataacctgagcagcaatagatgctttagaaaggtccccaaggatccagcaaagccacaggccaagggaaatttttgggccgtggatgtatcactgatcccggctgaggcactgcgcctccagaatacagcactgtgtcgccgatggcagaatggaggtgctagaggcgcttttgccaaggacttaggcccatatgtgctccacggaaggccttaccggcccccatcacctcccccccctccgagcgaggggttctccattaagagtctactgggtggtagcggagagggggccccatggccaggcctggccccacagtcttctcctgtcccagccgggacggggaattctggagaggaggcggtgcccacaccacctctgccaagtagcgaaagacccctttggcctctgtgccccctgccagggcctacccgcgttgaaggggaaaccgtgcagggaggtgcgatcgggccctccacattatctccagaacctcgggcctggcccttacatttgctccaaggtacagctgtgcctggcggccgctcaagcggcgggcaccgcgcttctctctgggggcagctcccaactagctacctgcccatttacacacccaacgtggttatgcccttagcccccccccccacgtcctgcccccaatgcccttcaacttccccagcgtattggggtgtagcacctgaaaccagggggcccccaggtctgctgtgcgacctcgacgcactgttccaaggggtgccacctaacaaatctatatacgatgtctgggtgtctcaccctcgcgacctggcagcccccggaccagggtggctgctgagctggtgctcgttatag

SEQ ID NO: 11800 - DNA, 957 bp, Artificial Sequence
  Description of Artificial Sequence: Synthetic coding sequence
atggcgacatattgcgacgacttaggtccttcctccgctcccccaggccaggctcaagctacggctcaccctccaggctacgagcccggtgatctgggagctgtgggcggagggcctctactctgggtgaatgcacctgctctgagccccaaatcctacgccagcgggccaggccccgccccaccttatgccgcgccttcatatggggcccccggaccccttctcggggcccctggtgggttggctggggccgacctagcttggctttcactgtccggccagcaagaactgcttagattagtaaggcctccatacagttattctgctctgattgctatggctattcagtcggcaccgttaagaaagctgaccctttcacagatttatcaatacgtggctgggaattttcccttctacaaacggagcaaagctggatggcagaattccattcgccataatctttccctgaacgactgttttaaaaaagtgcctagggatgaagatgacccaggcaagggaaattattggacccttgatcccaactgtgaaaaaatgttcgacaacgggaatttccgccggaaacgcaaaaggcgcgcggaggccagtgcggccgttcgctcgggcgccagatccgttgggggcgcagaggccccagcacttgagccaccctctgcggcatgtctggatctgcaggcatcaccctccccttcagctcctgaggcggcaacatgtttttctgggtttgccagcgctatgagtgccttggctgggggtctgggcactttcccagggggtctggccggggacttctcttttggacggcgaccccccaccgtcgcgactcacgcgcctcagactctgaatccctcgccgggatttgcgcccggccaccagactgctgccgcaggatttaggctgagtcacctcttgtactcccgcgaaggaactgaagtctag

SEQ ID NO: 11801 - DNA, 1725 bp, Artificial Sequence
  Description of Artificial Sequence: Synthetic coding sequence
atggcctcagacctcgaaagcagcctcacatccatcgactggctgccgcagctcacgctcagagccactatcgaaaaattgggaagcgccagccaggcaggtcctcccgggagctcgcgcaagtgttctccaggcagtccaaccgacccaaacgcgaccttgagtaaggacgaggcggcagtacaccaggatggtaagccacggtactcttatgctacactgataacgtacgccatcaatagcagccccgcaaagaagatgaccctgtccgaaatctataggtggatttgcgacaactttccttactacaagaacgctgggatcggctggaaaaactcaattcgacataacctcagtctcaacaaatgctttaggaaagtgcctagacctagagacgacccaggaaaaggctcctattggaccattgacacatgccccgatatcagtaggaaaagacgtcaccccccagatgatgatttgtcccaggacagcccagagcaggaggcatctaaaagcccgcgtggcggcgtagcaggctccggagaagcgtctctgcctcccgagggcaatccacagatgagtcttcaatcaccaacgtccatagcctcttacagtcagggaacaggctctgttgatggtggggccgttgctgcgggtgccagcggtagggaaagcgccgagggcccaccacccctgtataacaccaatcatgacttcaagtttagttactccgagatcaattttcaagacctctcatggagctttaggaacctctacaagtcaatgctggaaaaatcaagcagctcatcacagcacggattctcttccttgcttggagatatcccaccttcgaataattactacatgtaccagcaacaacagcctcctcctccgcaacaacaacagcaacaacagcaacctccccagcctcctccgcaacagtctcagccacaacaacagcaggcacctgcacaaggaccctcagcggtaggcggcgctccaccacttcataccccatcgaccgatgggtgcactccaccaggcggaaaacaggctggtgcggagggttacggaccgcctcccgtcatggccatgcatcctccgcctctgcaacatgggggatatcacccgcaccaacatcacccccacagtcatcccgctcagcagccccccccccctcagcctcaggcgcagggtcaggctcctattaacaacacgggttttgccttcccctctgactggtgctccaatattgacagcctcaaggaaagcttcaagatggtcaatagactaaattggagctcgatcgaacagagccagttctctgagctgatggaaagtttgaggcaggctgagcagaaaaactggactctggatcagcaccacattgccaatctgtgtgattctctcaatcatttcttaacccagactggtcatgtccctcctcagggaggcacacaccgccctcccgcgcccgctagaattgcagactcatgtgcactcacgagcgggaagcaagagagtgctatgagtcaggtcaactcttatgggcacccacaggccccccacttgtatccaggccccagcccaatgtaccctatccccacacaggacagcgctgggtacaataggccagcccaccacatggttccacgccctagtgtgcctcctcccggcgctaatgaagagatccctgatgattttgactgggaccttatcacctag

SEQ ID NO: 11802 - DNA, 1581 bp, Artificial Sequence
  Description of Artificial Sequence: Synthetic coding sequence
atggcgtccgatttagagagctccctcactagcattgactggctccctcagctcaccctacgggctaccattgagaaattggggagtgcttcacaggctggcccccctgggtcatctaggaaatgctcccccgggagccctactgacccaaacgcaaccctgagtaaggacgaggcagctgtccatcaggatggcaagcccagatacagttacgctaccctaattacatatgcaattaacagctcccccgcaaaaaagatgacccttagtgagatctacaggtggatctgcgacaattttccttactacaagaacgctggcatcggctggaagaacagtatacgtcacaatctgtccctgaacaaatgtttcaggaaagtgccccgtccacgagacgatcctggaaaaggcagctattggacaatcgacacatgccccgacatttcccggaagcgaagacatccaccagacgatgatctgtctcaagacagtccagagcaggaagcatctaagtccccacgcggtggggtggctggaagcggggaggcttctttaccccccgaggggaatcctcagatgagcctacagtcacccacctccatcgcatcatattcccaaggaaccggtagcgttgatggtggagcagtggccgcaggagcatctggccgagaatctgccgaaggcccacccccactgtacaatactaaccatgattttaaattctcctattccgaaattaacttccaggacctgtcttggtctttcagaaacctttataagagcatgcttgaaaagtcctcttcaagttctcaacatgggttcagctcactcttaggagacattccccccagcaataactattacatgtaccaacagcagcagcctccgccacctcagcagcagcaacagcagcagcagccccctcagccccccccccagcagtcacagcctcagcagcagcaggcacctgctcaggggccaagcgctgttggcggggcacccccactgcacaccccatcaaccgatggatgtacaccccctggtggcaaacaagccggcgctgagggctacggcccccctccagtgatggcaatgcacccacccccactgcaacatggagggtatcacccacaccagcaccacccgcatagccaccctgctcagcaacctccacccccacagccgcaggcacaaggccaggcaccgatcaacaacaccggttttgcctttccaagcgattggtgttctaatatcgactcgctgaaggagagttttaagatggtgaacaggctgaactggagtagcattgaacagtctcagttctctgaactgatggagtcacttcgtcaggctgagcagaaaaactggactctagatcagcatcatatcgccaacctttgtgattccctgaaccatttcctcacccagactggacatgtgcccccccagggcggcactcaccgcccacctgcccccgcacgtatcgctgattcttgtgccctaacatccgggaaacaagagtctgcaatgtcccagggcaccgccccttctcagctgccctggcgatggcggttgtgttag

SEQ ID NO: 11803 - DNA, 1869 bp, Artificial Sequence
  Description of Artificial Sequence: Synthetic coding sequence
atgggcttatatggacaggcctgtccctccgttacaagtttgcgcatgacaagcgaactggagagctctctgaccagtatggactggctccctcaactcactatgagagcagccatccagaagtcagacgccactcagaacgctcatggtacgggcattagtaagaaaaatgccctgctggacccaaatactacactcgatcaggaggaggtgcagcagcacaaagatggaaaacccccttatagctatgcaagtttaatcacgtttgcaatcaatagcagtccaaagaaaaaaatgaccctgagtgagatataccaatggatctgcgataattttccgtactatcgcgaggccggcagtggctggaaaaattcgattaggcacaacttgtcattaaataaatgctttctgaaagtcccacgcagcaaggatgatcctggcaagggcagctactgggctatagataccaaccccaaagaagacgtcttgcctacaagacccaagaagagagcccgctctgtggaacgagcgtctaccccgtattccatcgactctgacagcctgggaatggagtgcatcatctccgggtccgcgagcccaactctagctataaatacggtgacaaacaaggtgactctgtacaacaccgatcaagacgggtcagattcccccagatcctcccttaataacagcctgtcagatcagagtttggcatcagtgaatctgaactcggtggggtccgtgcactcatataccccagtcacaagtcatcccgagagcgtatcccagagccttactccacagcagcaaccgcagtacaatctgcccgaacgggacaagcagcttctgtttagtgaatataactttgaagatctgagcgcctcatttcgaagtctatataaaagtgtgttcgaacagagtctctcccagcagggattgatgaacattcccagcgagtctagccaacagtctcacacgtcttgtacatatcagcactcccccagttcgacagtctctactcacccccacagcaatcagagcagcttaagcaatagtcacggctctggcctgaatacaacagggtctaattcggttgcgcaggtgtctctgtcgcaccctcagatgcacactcagccctcgccacatccgccgcatcgcccacacgggttgccacaacacccacagcggtcaccacatcccgccccccacccgcagcaacactcccagctccagtctcctcatcctcaacacccatctccacaccaacatatccaacaccatccaaaccatcagcatcagactctgacacatcaggctccacctccacctcagcaggtgtcatgtaacagcggagtgtcgaatgactggtatgcaactcttgatatgctgaaagaaagctgcagaatagctagttccgtgaattggtccgacgtggacttgagtcagtttcagggacttatggagtccatgcgccaagctgacctaaagaattggtctttggaccaggtgcagtttgccgacctgtgttctagtctgaaccagtttttcacccagactggcctgatacattctcaaagcaatgttcagcaaaatgtctgccacggtgccatgcaccctaccaagccttcgcagcacattggtactggcaacttgtatatcgactcacggcaaaacctgcccccttctgtgatgcctcctcccggctatccccatattcctcaggcactgtcaacgcccggcaccacaatggcgggacaccaccgggctatgaatcagcagcatatgatgccctctcaggccttccagatgagacgttcgctcccccctgacgatatccaggatgattttgattgggactctattgtctag

SEQ ID NO: 11804 - DNA, 1767 bp, Artificial Sequence
  Description of Artificial Sequence: Synthetic coding sequence
atgggactgtacggccaggcatgtcccagcgtcactagccttcgaatgacctccgaactcgagtcctccctcacttccatggattggttgccccagttgactatgagagcagccattcagaaaagcgacgcaactcaaaatgctcatggcactggaatctccaagaaaaatgccctgttggatcccaacactacgcttgatcaggaagaagtgcagcagcataaggacggtaaacccccttactcctacgcctctctgatcacttttgccattaattcttctcctaagaagaaaatgaccctttcagagatataccaatggatatgcgataactttccatattatcgggaggccggcagtggctggaaaaatagcatccgacacaacctgagtctcaacaagtgctttctgaaagtcccgaggagtaaagacgatcctggaaaggggtcatattgggctatcgataccaatccaaaagaggacgttctcccaacacggccaaaaaagagggcccgcagtgtagagagggttaccctgtacaataccgaccaggacggtagtgatagcccaagatcttctctcaataatagcctctctgatcagtcactggcttccgtgaatctgaattctgtgggatcggtccattcctataccccagtgacatcccaccctgaaagcgtgtctcagagtctgactccccagcagcagccgcaatacaatttgcccgagagagacaaacagcttcttttttccgagtacaactttgaggacttaagcgcctcatttcggtcattgtacaagagcgttttcgaacagtcactctcacagcaaggtcttatgaacatcccttcagagtctagccagcagagccacacgagttgcacttatcagcatagtccttcgtcaacagtgtccacccacccgcactccaatcagtctagtctgtcaaactctcatgggtctggactgaacaccaccggcagcaactccgtggcacaggtaagcctgtcccatccccaaatgcacactcagccatccccccatccaccccacagaccccacggcctcccacagcatccacagcgcagtccccatcccgctcctcatcctcagcagcactcccaacttcaaagtccacacccacagcaccctagccctcaccagcatattcagcaccacccaaatcaccagcatcagaccttaactcaccaggctccgcctcctcctcagcaggtgtcctgtaatagcggggtaagtaacgactggtacgccacactagatatgctgaaagaaagttgtagaatcgcatcgtctgtaaattggtctgatgtggatctctcacagtttcaaggcttaatggagtccatgagacaggccgacttgaaaaattggtcactggatcaggtgcagttcgcagacttatgtagtagcctaaaccagtttttcactcagacaggactgattcatagccagagtaatgtgcagcagaatgtatgtcatggtgccatgcatccgacgaagccttcccagcacattggaacgggcaacctgtacatagactcacggcaaaacctgccgccctccgtaatgccccccccagggtacccacacattccgcaagctttaagtacacccggaactactatggcagggcaccatcgtgcgatgaaccagcaacatatgatgccgagtcaggcttttcaaatgcgccgatctcttcctccagatgatattcaagacgacttcgactgggactcaatcgtctag

SEQ ID NO: 11805 - DNA, 411 bp, Artificial Sequence
  Description of Artificial Sequence: Synthetic coding sequence
atggagtctatgagacaggcagacctcaagaactggtcactggatcaagtgcagttcgccgacttgtgctcaagtctgaatcagttctttacgcaaacaggcttaatacattcccagtccaacgtacagcaaaacgtgtgccacggagcaatgcaccctaccaagccgagccagcatataggcactgggaatctatacatagactctcgtcagaacttgcctcccagcgtgatgcccccgcccggatacccacacattccgcaggctctctctacccctggtacaacaatggcaggccatcacagagctatgaatcaacagcacatgatgccgagtcaggccttccagatgcggaggtctcttccaccagatgatatacaggacgactttgactgggactcgatcgtatag

SEQ ID NO: 11806 - DNA, 1869 bp, Artificial Sequence
  Description of Artificial Sequence: Synthetic coding sequence
atgggcctgtatggacaggcttgcccatccgtcacctccttgcggatgactagcgaactggaaagtagcctgacatcaatggactggctgccacagcttaccatgagggccgcaatacagaaatcagatgctacacagaacgcccacggtaccggtatctctaaaaaaaatgcgctgctcgaccccaacacaactctcgaccaggaggaagtccaacagcacaaagatgggaagcccccctactcttacgcctcactcatcacatttgcaattaattctagcccaaaaaaaaaaatgacactgagtgagatataccaatggatatgtgataatttcccgtactatagagaggctggaagtggctggaagaatagcatccgtcacaacctgtcactcaacaaatgttttttgaaggttccaagaagcaaggatgaccctgggaaggggtcctattgggccatagacacaaaccctaaagaggacgtgttaccaacgcgccccaaaaaaagggcaaggtcggtcgaacgagcaagcacaccctactccattgacagcgattcattggggatggagtgcatcattagtggctctgctagcccgactcttgccatcaataccgtaaccaacaaggtcactttatacaacacagatcaggacggatctgactctcctaggtcttctttaaataacagtttgtcagatcaaagcttagccagcgtgaatcttaattcggtgggctctgtccactcatacaccccagtgacttcccaccctgagagtgtctcacagagcctgacgccccagcaacagcctcagtacaatctgcccgagcgagacaagcagctcctgtttagtgaatataactttgaggatctgtcagcctcctttcgcagcttgtataagagcgtgttcgagcaatccctttctcagcagggtctgatgaatattcctagtgaatcatcacagcagtcgcacacctcatgcacctatcaacacagccccagctcaactgtgtcaactcacccccatagcaatcagtccagcctgtccaactctcacggcagtggattaaacaccacgggcagtaatagcgtagctcaagtatccttaagccaccctcagatgcacacacagccttctccacaccctcctcacaggccgcacggccttccccagcatcctcagcgatcaccccacccagctcctcacccgcaacagcactcacagctacagtccccacatcctcaacacccctccccccaccagcacatccagcatcacccaaatcaccaacaccagacccttacacaccaggcaccccctcccccccaacaggtttcatgcaactccggagtgagtaatgattggtacgctactcttgatatgctgaaggagagttgccgcatcgcttctagcgtgaattggagcgacgtggacttgtcccaatttcaggggttaatggagtcaatgcggcaagcagacctgaagaactggtccctggaccaggtccaattcgctgatttatgtagttcgttgaatcaattcttcacccagacaggcctgatacatagccagagcaacgtgcaacagaatgtctgccacggggcaatgcaccccactaaaccatcgcaacatatcggaaccggaaacctttatattgatagtaggcagaacctcccccccagcgttatgccccctcccgggtacccacacattcctcaggcactttccaccccggggactaccatggcaggccaccatagggctatgaaccagcagcatatgatgccatctcaggcctttcagatgcgccgatccctgcctccagacgacattcaggatgatttcgactgggacagtatcgtgtag

SEQ ID NO: 11807 - DNA, 1869 bp, Artificial Sequence
  Description of Artificial Sequence: Synthetic coding sequence
atgggtctgtatgggcaggcttgtccttcagtaacttcacttagaatgacctcagaattggagagtagcctgacgagcatggactggctgccccagctgaccatgcgtgccgcaattcagaagagcgatgcgacacagaatgctcatggcaccggaatcagcaaaaagaacgcgttactggatcctaatacaacattggatcaggaggaggttcagcagcacaaggacggaaagcccccctattcatatgcctcgttgataacttttgccataaattcctctcccaaaaaaaagatgaccctgagtgagatctatcaatggatctgtgataattttccctattacagagaggctggctctggctggaaaaactccattagacataacctctctttgaataaatgctttcttaaggtacccaggagcaaagacgatcctggaaaggggtcctattgggccattgatactaatcctaaggaggatgtacttcccactcgacccaaaaaaagggctaggagtgtcgagagggcgagtactccttactctattgactccgactccctgggaatggaatgcatcatctcggggtctgcgagccccacccttgccatcaatactgtcactaacaaggttacgctgtataacaccgaccaggacggatcagattctccgcggagcagtctgaataatagtctgagtgaccagagcctggcaagtgtgaacctgaactctgtcggcagcgtgcattcttataccccagtgacaagccatcctgagtctgtctcccaaagtttgacgcctcagcagcagccacaatataaccttcccgagagagacaaacaactcctcttttctgagtataacttcgaagacctctcagcctcattccggtccttatataaatccgttttcgagcagtctctgagccagcagggcttaatgaacatcccctcggagagtagccagcagtcacacacatcttgtacatatcaacattctcccagttccaccgtgtccacacatcctcactctaatcagtcttccttatccaacagccacggctctggcctgaataccacagggtcaaatagcgtggcacaagtgagcctctcgcacccacagatgcatactcaaccttcccctcaccctccccatcgtccgcacggtttaccccaacacccacagagaagtccacatcctgcacctcacccacaacagcactcccaactgcagagcccccatccacaacatccctcaccacaccagcatatccaacatcaccccaaccaccagcatcagacactgacacaccaggcaccacctcctccccagcaggtcagctgtaatagcggagtcagtaacgattggtacgctaccttagatatgctaaaagagtcgtgccgtatcgcatcctctgtcaactggagtgacgttgacctgtctcaattccaagggctgatggagtcaatgagacaggccgacctcaagaactggtctctggatcaggtgcagttcgcggatctctgcagttctctgaatcagttttttacccagacaggcctgatccattcccagtcaaacgtccaacaaaacgtgtgtcacggagccatgcacccgacgaagccatcacagcatatcggaactggcaacctttatatcgattctcgccagaatctccccccatcggtcatgccaccccctggatacccccacatcccgcaggccttgagcaccccaggtacaacaatggcagggcatcacagggccatgaaccagcagcatatgatgccttcccaggcctttcagatgaggagaagtctgccaccagacgacattcaggacgattttgattgggactctattgtgtag

SEQ ID NO: 11808 - DNA, 264 bp, Artificial Sequence
  Description of Artificial Sequence: Synthetic coding sequence
atggagtgtatcataagtggatccgcttcgccaaccctggccattaataccgtgaccaataaagtgacgctttacaatacggaccaggacggtagcgactcgcctcggagcagcctgaataacagccttagtgatcagtctctggcctccgtgaatttgaatagtgtgggcagtgtgcatagctacaccccagtgactagccatccggagagtgtctcacagtcacttaccccccagcagcagccccaatacaatttaccatag

SEQ ID NO: 11809 - DNA, 1149 bp, Artificial Sequence
  Description of Artificial Sequence: Synthetic coding sequence
atgggcctgtatggccaggcttgtccgagcgtaacatcacttagaatgacaagcgaactggagagctccctgacatccatggattggctcccccagcttaccatgcgcgcagcaattcagaaaagcgacgccacccagaatgcacatggcacaggcatttctaaaaaaaacgccctactagatcccaacactaccctagaccaagaagaagtgcagcaacacaaagatggtaaaccaccatactcctacgcctcattaattacgtttgcaattaattcttcccccaaaaaaaaaatgactcttagtgagatttatcagtggatttgcgataactttccatactaccgggaggctggctctggatggaaaaattccattaggcataacctgtcgctcaataagtgtttcctgaaagtccctcgctccaaggacgaccccggtaagggtagctattgggccatcgatacaaatccaaaggaggatgtccttcctacgcgtcctaagaaaagagccagaagtgtcgaacgggtgaccctgtacaacactgatcaggacggcagcgatagcccccggagtagcctcaataattcactctctgatcagtccttggcctcggtcaaccttaacagcgtaggcagtgtgcactcgtacactcccgttacctcccaccctgaatctgtctcccagtccctgactccccaacaacagcctcagtataacctgccggaaagagataagcagctgctgttctccgagtataatttcgaggacttatcggcttcgttccgatccctttacaagtccgtttttgagcagtccctgagccaacagggcctgatgaacattccctccgagtccagtcaacagagtcacacctcctgcacgtaccaacactcccctagctctaccgtcagtacacacccacattctaatcaatcttctctctcaaatagtcatggttctggcctcaatacaacggggagcaattctgtcgcacaggtgtcgttatcccatccccagatgcatacccagccctctccgcacccccctcaccgaccacacggccttccccagcaccctcagcgatcaccccatccggccccccaccctcagcagcacagccagcttcagtccccccatccccaatag

SEQ ID NO: 11810 - DNA, 378 bp, Artificial Sequence
  Description of Artificial Sequence: Synthetic coding sequence
gcaacccagaacgcacatggtactggcatcagtaagaaaaacgccctactggatccaaatactactcttgatcaggaggaggtgcagcagcataaagatggcaagccaccctactcctatgcaagtctgataactttcgccattaacagcagccccaaaaaaaaaatgacactcagcgaaatttatcagtggatttgtgacaactttccgtactatagagaggccggctcaggatggaaaaactctatcaggcacaacctgtctctgaataaatgctttttgaaggttcccagaagcaaggatgatccaggaaaggtggggttcatatttctgaaacagctgaatagcagcgtgtgtcatctaagctgccttaattag

SEQ ID NO: 11811 - DNA, 1869 bp, Artificial Sequence
  Description of Artificial Sequence: Synthetic coding sequence
atgggcttatacggccaggcttgcccatccgtgacaagcttgaggatgacgtctgaattagagtctagtctgacgtcgatggattggctacctcagttaacaatgcgagctgctatccagaagtcagatgccacccagaacgcccatggaaccggaatctcaaagaagaacgctttgctggaccccaacaccactctggatcaggaggaagtgcaacagcacaaagatgggaaacctccatatagctatgctagcctcattacttttgctatcaacagctcgcccaagaaaaagatgaccctgtcagaaatctaccagtggatctgtgacaactttccttattacagagaggccggatccggctggaagaatagtattcgccataacctaagcctcaacaaatgcttcctgaaagtacctaggtccaaagacgaccccggtaaagggagctactgggcgatcgatactaacccaaaggaggacgtgctcccaacccggccaaaaaaacgggcaagaagcgtcgagagggctagcaccccctacagcatcgacagcgacagcttgggcatggaatgcatcatctcaggatccgccagcccgacgctggctataaacaccgttacaaacaaggtgaccctctataacaccgaccaagatggcagtgactccccccggagctcactcaataactcactcagtgaccagtccctggcctctgtgaatttgaacagcgtgggcagcgtgcattcctacactcccgtcactagtcaccccgagtctgtgtcccagtccctgacgccacagcagcaaccacagtacaatcttccggagagagataagcagcttctgttcagcgagtacaactttgaggaccttagcgcatccttccggagcctgtacaagtcagtgttcgagcagtctctgagccagcagggtctgatgaacattccctcggagtcgtcacaacagtctcacacttcatgtacctaccagcactctccatcttccaccgtttctacccacccacactccaatcagtcatctctttccaactcccacggctctggtcttaacacaactgggtccaactccgtggcacaggtctccctttctcaccctcagatgcatactcagccatcacctcatcccccacaccgacctcacgggttgcctcaacacccacagcgctctccccacccagccccccaccctcagcagcacagccagctgcaaagcccacatccgcagcatcctagtccgcatcagcacatacagcatcatccgaaccatcaacaccaaacattgacacaccaggctccaccacccccacaacaggtcagctgcaactcaggtgtgtccaacgattggtatgctaccctagatatgttgaaagaaagttgcagaattgcgagttcagtgaattggtccgacgtggatctttcacaatttcaagggctgatggaaagcatgcggcaagctgaccttaagaactggtcgctggaccaggtgcagtttgcagatctgtgcagttccctcaatcaattctttacacagactggactgattcattcccagagcaatgtccaacagaacgtttgtcacggcgcaatgcacccaactaagccatcccaacacatcggcactggtaatctgtatatcgatagccgacagaacctgcccccctcagtgatgcctcccccagggtacccgcatataccacaggctctgagcactcctgggaccacaatggctggccaccaccgcgccatgaatcagcagcatatgatgcctagtcaggcctttcaaatgcggcggtctctgccacctgacgacattcaggacgacttcgattgggatagcattgtctag

SEQ ID NO: 11812 - DNA, 1023 bp, Artificial Sequence
  Description of Artificial Sequence: Synthetic coding sequence
atgatgtgtcacccactagaccaactggctacacgtacacagaaaaagtcggccacttccaaacctccatatagtttctccctgctgatctacatggccatcgagcattccccgaacaaatgtctgccagtgaaggagatttacagctggattctggaccactttccatatttcgcaaccgcacccaccggctggaaaaactccgtgagacacaatctttctttgaataagtgttttcaaaaggtggagcgtagccacggaaaggtcaacgggaagggttcactctggtgcgtcgaccctgagtataaacctaatctgattcaggccctgaagaaacagccgttttcttccgcctcttcacagaacggatctctgtctccccactacttaagttctgttatcaaacagaaccaagtccgaaatctgaaagagtctgatattgatgccgccgcagcaatgatgctcctcaacaccagtattgagcaaggcatcctggagtgcgagaagcccctgcccctgaagaccgctctacagaaaaagagaagttacggcaatgcctttcaccacccaagtgcggtgagactgcaggaatccgactctctggcaacctctatcgaccctaaggaagaccataactactcagcttcctctatggctgctcagaggtgtgcatccaggtcaagcgtcagtagcctatcctctgttgacgaagtatacgaatttattcctaagaactctcatgtcggttctgatggttctgagggattccacagcgaagaagatacagatgtggactatgaggatgaccccctgggcgactctgggtatgcctcccagccctgcgccaagattagcgagaaggggcaaagcggcaaaaaaatgagaaagcagacttgccaagaaattgatgaagaacttaaggaggctgcaggatctctcctgcatctggccggcataaggacttgccttggttctctcatctctactgctaagacgcagaaccaaaagcagcggaagaaatag

SEQ ID NO: 11813 - DNA, 1296 bp, Artificial Sequence
  Description of Artificial Sequence: Synthetic coding sequence
atggggccagtgattggcatgacgccggataaaagggccgagactcctggagcagagaagattgccggcctgtctcagatttataagatgggctctcttcccgaggccgtggatgctgccaggcctaaggcaaccctagtggacagcgagagtgcggatgacgagctcacgaacctaaattggctacacgaaagcacaaatcttttgacaaacttcagcttggggtctgaagggctgccgatagtgagccccttgtacgatatagagggtgatgacgtgccgagttttggacccgcctgctatcagaacccagagaagaaatccgccacttcaaagccaccttactcgttcagcctcctgatttatatggccattgaacacagtcctaacaagtgcctacctgtgaaggaaatctacagctggatactagaccattttccatacttcgctactgcccccacaggctggaagaactctgtgcgccataacctgtctctgaataagtgctttcagaaggtagaacggagtcatgggaaggtcaacggaaagggctccctctggtgtgttgaccctgagtataaacccaatcttatccaggccctgaaaaagcagccgttcagctctgcgtctagccagaatggaagtctgtctcctcattatcttagttcagttatcaaacaaaaccaggtcaggaatctgaaggagtctgacatcgacgccgccgctgcgatgatgctgctcaataccagcatcgaacaaggcatcctcgagtgtgagaaaccccttcctcttaaaaccgctcttcagaagaaacgatcttacggaaatgcatttcatcacccaagcgcagtgaggctacaggagtctgattccttagcaacgtccatcgaccctaaggaggatcacaattactcggccagctccatggcagcccaaagatgcgcgtcacgaagtagtgtgagctccttgagtagcgttgatgaagtgtacgagttcatccccaaaaattctcatgtaggatcggacggttctgaggggtttcacagtgaagaggacaccgatgttgattacgaagatgaccccctgggagattccggttacgcctctcagccttgtgctaaaattagcgaaaaagggcaaagtgggaagaagatgcggaagcagacttgccaggaaatcgatgaagagttaaaggaggccgccgggagcctcctacatctggcaggaatacgaacctgtcttggttcactgattagtaccgcaaagacccagaaccagaagcaacgcaagaaatag

SEQ ID NO: 11814 - DNA, 741 bp, Artificial Sequence
  Description of Artificial Sequence: Synthetic coding sequence
atgggcccagttatcggaatgacacctgacaagcgggcggagaccccaggcgcagagaagatcgcgggactctcacagatttataaaatgggctctttgcctgaggccgtggatgcagctaggcccaaagctaccctggtggattccgaaagcgcagatgatgagctgaccaacctcaactggctgcacgaaagcaccaacctactgacaaatttctcattgggatctgagggcctccctattgtgagccccttgtacgacattgagggtgatgacgttcccagctttggccccgcttgctaccaaaaccctgagaagaaatcagcaaccagcaaaccgccgtacagcttttcattgttgatctatatggccatcgaacatagtccaaataaatgtttgcctgtgaaagagatctacagctggattctcgatcactttccctatttcgctaccgcacccaccggctggaaaaattccgtccgacacaacttatcactgaacaaatgcttccagaaagtcgaacggtcccatggtaaagtgaatggcaagggtagtctgtggtgtgtggacccagaatataagccaaacttaatacaggccctcaaaaagcaaccattctccagtgcaagcagccagaatggcagcttgtccccacactacctgagctcagttataaaacagaatcaggtgaggaatctcaaagaatcagatatagacgcagcggcggcaatgatgctgtag

SEQ ID NO: 11815 - DNA, 879 bp, Artificial Sequence
  Description of Artificial Sequence: Synthetic coding sequence
atgggtaatgaactgttcctggcttttaccacgagccacctccctctcgccgaacaaaagcttgcacgttacaagctgaggatagtgaagccaccgaaactgcctttggagaaaaagccaaatccggacaaggacggccccgactatgagcctaatctttggatgtgggtgaacccaaacattgtttatcctcccggcaagttggaggtttccggtcggaggaagcgcgaggacttaaccagcaccctccctagtagtcagccaccacagaaagaagaagatgcttcatgcagtgaggcagctggggtggaaagcctgtctcagtcgagctctaagagatcccccccccgaaaacgttttgcttttagcccaagtacatgggagttaaccgaggaggaggaagcagaggatcaagaagatagctcaagtatggctttgccttcaccccacaagcgcgcgccacttcagtcacggaggcttagacaggcatcatctcaagcagggcggctctggagcaggccgccacttaattacttccacctgatcgctctggccttgcgtaactcgtcaccctgcggactcaatgttcagcagatatactcctttacaaggaaacactttccgttttttcgaacagcccccgagggctggaaaaacaccgtgcgccacaatctctgttttcgcgacagttttgagaaggtacccgtgagcatgcaagggggggcttcaacgaggccccgatcatgtctgtggaagttgaccgaagaggggcacaggcgtttcgccgaggaggcaagggccctcgcttccaccaggcttgagagcatacaacagtgtatgtcccagcctgacgtgatgccttttttatttgacctgtag

SEQ ID NO: 11816 - DNA, 936 bp, Artificial Sequence
  Description of Artificial Sequence: Synthetic coding sequence
atggatttaaagctgaaggactgcgagttctggtacagcctacatggccaggtgcccggactcctggactgggacatgagaaacgagctattcctcccctgtactactgatcagtgctcgctcgccgagcagatcctggccaagtaccgtgttggagtaatgaaacctcctgagatgcctcagaagcgacgaccatctccagacggtgacgggccgccttgcgaaccgaacctctggatgtgggtcgaccccaacatcctgtgtccccttgggagccaagaggccccaaaaccatcagggaaagaggacctgaccaacatttctcccttccctcagccccctcaaaaagacgaagggtctaattgcagtgaagacaaggtagtggagtcactacccagcagtagttcggaacagtcccctctgcaaaagcagggaattcactcaccctccgacttcgagctgacagaggaggaggcagaggaaccggacgacaatagtctgcagtcgcctgaaatgaaatgttaccagtctcagaagctgtggcagatcaacaatcaggaaaagtcatggcagcggccaccattgaattgcagccacctcatcgctttagcccttcgaaacaatccacattgtggattgtctgtacaggaaatctataatttcacccgacagcactttccctttttctggacagcgcccgacggctggaagtctactatccactataatctttgttttctcgacagctttgaaaaagtgcctgatagtctaaaagacgaagacaatgcccgcccaaggagttgcttatggaaattgacgaaggaaggtcatcggcgattctgggaggagacccgggtgctcgccttcgctcagagggagcggattcaggaatgtatgagccagcccgagctgctgacctccctgtttgacctgtag

SEQ ID NO: 11817 - DNA, 993 bp, Artificial Sequence
  Description of Artificial Sequence: Synthetic coding sequence
atgcagcagcagcctctgcctgggccgggtgctccaaccaccgaaccaacaaagccgccatattcttacatcgcacttattgccatggctatccagtccagcccaggtcagcgggctactttgagcgggatctaccgctacataatgggaagatttgcgttctaccggcacaaccgccccggttggcagaattcgattcgccataatctgagcctgaacgaatgcttcgtcaaggtcccccgagacgatagaaaacccggcaagggcagctattggacactggatcccgattgtcatgatatgtttgaacacggctctttcctgaggcgtcggcgcagattcacaaggcagaccggtgctgaaggtacacgtggtcctgcgaaagcccgccgcggacctctgcgggctacttctcaagatcctggcgtccctaatgccactaccgggaggcaatgcagttttccaccagagctgcctgatccaaagggtctgtcctttgggggactagtaggcgcgatgccagccagtatgtgccctgcaactaccgacggcagaccacggcctcccatggagccgaaagagatctctaccccaaaaccagcttgtcccggtgaattgcccgttgccactagtagctcatcctgcccagcctttggcttcccggctggattctctgaggctgaatcattcaacaaggccccaaccccagtgctgagtcctgaatccgggatcgggtccagctatcagtgcaggctacaggcattgaatttttgcatgggcgctgacccgggactcgaacatctcctggcctccgccgctccgtcccccgcgcccccaaccccccctggctcacttagagcaccgctgcccttgccaaccgaccacaaagagccatgggtcgccggcggattccccgtgcagggcggaagtggatatcccctcgggctgactccatgcctttacaggacaccaggtatgttcttcttcgaatag

SEQ ID NO: 11818 - DNA, 957 bp, Artificial Sequence
  Description of Artificial Sequence: Synthetic coding sequence
atgaatcgattcggaaccaggctcgtgggggccaccgcaacctcaagccccccaccgaaagctagatctaacgaaaacctcgataagattgatatgagcttggatgacattatcaagctgaatcggaaggagggtaaaaaacaaaactttccgaggctcaaccgaagattattacaacagtctggggctcaacagttccgtatgagggtccggtgggggatccagcagaactccggctttggcaagacatccttgaatcggaggggtcgcgtcatgcccggaaagcgccgacctaacggcgtgattactgggctggcagcgagaaaaaccaccggcatacggaaggggatatcccctatgaaccggccacccttaagcgacaagaatattgagcaatactttcccgtgttaaaacggaaggctaacctcctgaggcagaacgaggggcagagaaagcctgtggccgtcctgaaaagaccttctcagttgagtcgtaagaacaatattcccgccaattttacacggtctggaaataaactaaatcatcagaaagatactagacaagccacattcctgttccgtagaggcctcaaagtgcaggcacagttgaacacagagcagcttttagacgatgtggtcgccaagcggactcgacaatggcgtacaagtacaaccaacggcgggatcctaactgtgagcatagacaatcccggggcagtacagtgtccagtgacgcagaaacccaggctcacaagaacagccgtgccttctttcctgaccaagcgggaacagtcagatgtgaaaaaagtgccaaagggcgtccccctacaatttgacattaattctgtgggtaaacagaccggcatgaccctgaatgagagatttggcattctcaaagaacagcgtgcaaccctgacttacaataaaggaggttcccgcttcgtaactgttggatag

SEQ ID NO: 11819 - DNA, 684 bp, Artificial Sequence
  Description of Artificial Sequence: Synthetic coding sequence
atgccgggcaagaggaggccaaacggagtgattaccgggctggccgcacggaagaccactgggattagaaaaggcatcagcccaatgaatagaccccccctgagcgacaagaatatcgaacagtactttcctgtactgaaaagaaaggctaacctattaaggcagaacgaaggacagaggaagcccgttgcagttctgaagcggcccagtcagttatcaaggaagaacaacatccccgccaattttacaaggtctggcaataaattgaatcatcagaaggataccaggcaggctacatttttatttcggcggggtctcaaagtgcaggcccaacttaatactgaacaactgctggatgacgtagtcgccaagcgcactcggcaatggaggacaagtaccacgaacggagggatcctcactgttagcatagataaccccggcgccgtacaatgcccagtaacccagaagcccaggctgacacgcaccgcggtaccgtccttcctaaccaagcgggagcaaagtgatgttaagaaagttccaaaaggcgttcctctgcagttcgatattaattccgtgggaaagcagactggaatgacccttaatgaacggttcggaatcctgaaggagcagcgggccacgctcacttacaataagggcggctcccggttcgtaacagttggatag

SEQ ID NO: 11820 - DNA, 879 bp, Artificial Sequence
  Description of Artificial Sequence: Synthetic coding sequence
atggagccgtctgttatcatgggaaatgacattatcaagctgaatcgaaaagaaggtaagaagcagaatttcccccgcttaaatcggaggctcctgcagcagtccggggcccagcaattcagaatgcgcgtgcggtggggcatccaacagaattctgggtttggaaagaccagcctgaacagaagaggacgtgtgatgcctggtaagagacggccaaatggagtgatcaccggccttgcagcccggaagacaactgggatccgaaagggcatcagtcccatgaaccggcctcctctaagcgataaaaacattgaacaatatttccctgtcttgaagcggaaggctaacctgctgcggcagaacgaggggcagagaaagcccgtggcagtgctgaagagaccgagccagttgtcaaggaaaaacaacatcccagccaactttaccaggagtggcaacaagctgaatcaccagaaggatacacgccaggccactttcctgtttagaagggggctcaaggtgcaagcccagcttaatactgaacagctgttagatgacgtggtggcaaagcgcaccagacaatggagaacaagcactaccaacgggggcattcttactgtctctatagataaccccggcgctgtccagtgtcccgttacccagaaacccaggttgactagaactgctgtgccttccttcctcaccaagagagagcagtccgatgtgaagaaggtgcccaagggggtgccgctccagtttgacattaactctgtaggtaaacagacgggtatgaccctgaatgagcgtttcggcattctgaaggagcagcgggccacactgacttataataaaggaggttccaggttcgtgactgtgggttag

SEQ ID NO: 11821 - DNA, 837 bp, Artificial Sequence
  Description of Artificial Sequence: Synthetic coding sequence
atgggaaagggcaacgaagatccagacctgcattgcagctcaatccagtgttcgaccgaccagccacccttccagcagatctcctttacagaaaaagggtcagacgaaaagaagccattcaaggagaagggcaagacagccttcagccactccagtgaaaagcacatacagaggcaaggcagcgagccgaacccgaataaagagaattctgaagagacaaagctcaaggccgggaactctacggctggaagtgaacccgaaagctcgagttaccgggagaattgccgcaagcgcaaaatgagctctaaggactcctgccaggatacggccgggaattgcccagagaaagagtgttcactgtcgcttaacaaaaaatctcggtcttctacccctgtacacaattcagagatccaggagacctgcgatgcccaccatagaggcaggagccgggcttgcaccggtcgatccaaacggcaccgatcccgggcactcggtgtccagacacccagtattcgtaaatccttagtgacttctgttagagctatgtcagaggcagtctatcaggatctggctcaggtgtgggcgcagcagatccattccccgcttacttgcgagcagctcacactgctgacgaggctcaggggccctttatgcgcacaggtccagacactttattccatggcaactcaggccgcctatgtattcccagcagagtcctggctggtccccgccacattaccaggtcctggcgagagcgccctagatcgagaggcacacccttttcccggccaagagattacagaaaccgtgagtgggtcggacgaggccaaactatag

SEQ ID NO: 11822 - DNA, 840 bp, Artificial Sequence
  Description of Artificial Sequence: Synthetic coding sequence
atgggcaaggggaacgaggacccagacctgcactgctccagcatacaatgttcaacagaccagccccccttccagcaaatttccttcaccgagaagggcagcgatgaaaaaaagcctttcaaggagaaaggtaagacggcgttttcccactctagtgaaaaacacattcagaggcaagccggaagcgagcccaatcccaacaaggagaattctgaggaaactaagctgaaagcaggaaatagcaccgcaggctccgagcccgagtcaagcagctaccgggaaaactgtagaaaacgcaaaatgtctagtaaagacagctgccaggacaccgctggcaattgtccagaaaaggagtgctctctgagtttaaataaaaagtctcggtcatccactcctgtgcataattccgaaatccaggagacttgcgacgcgcatcatagaggaagaagtagggcatgtacaggtagaagtaagcgccataggtcccgagcacttggagtgcagacccccagcataaggaagtcccttgtgacatccgttagggctatgagtgaggccgtgtaccaggaccttgcccaagtatgggcccagcagattcattcccctctcacatgtgagcagctgaccctcctaacccggctgagagggccactgtgtgcccaagttcagaccttgtacagcatggcgacgcaggccgcatatgtcttcccagcagagtcatggctggtacctgctactctaccgggcccaggagagtcagctctggatcgtgaagctcatcccttccctgggcaagagatcaccgagactgtgtctggcagcgacgaggctaaactatag

SEQ ID NO: 11823 - DNA, 2544 bp, Artificial Sequence
  Description of Artificial Sequence: Synthetic coding sequence
atgggaaaaaaaggcaaagtggggaagtcacggcgggataaattttatcacttagccaaagagacaggctacagaagcaggtcagcgttcaaactgattcagcttaatcgtagatttcaattcctgcagaaggcccgggctctcctcgacttgtgcgcagctccaggggggtggcttcaggtggccgcaaagtttatgccagtttcatcactgatagtcggtgtcgacctggtgcccataaaaccactcccgaatgttgttaccctgcaacaggatatcactacagagcggtgccggcaggctctcagaaaggagttgaagacttggaaggtggacgtggtcctgaatgacggtgcccccaatgtgggggcctcctgggtccacgacgcctacagccaggcacacctgaccctgatggcccttcgtctcgcgtgtgactttctcgcgcgcggcggcagctttattactaaagtgtttcggtctagggactaccagcccctcctgtggatttttcagcaactttttcggcgagtccaagccacaaagccccaggcatcccgccacgagtcagctgaaatcttcgtggtgtgccagggattcctggctccagataaggtggacagcaaattttttgaccctaagttcgccttcaaggaggttgaggtgcaagctaagaccgttaccgagttggtcaccaagaagaagcccaaggcagaaggctacgcggaaggtgacctgacactataccataggacctcagtcactgattttcttagagctgcgaacccagtcgactttctgtcaaaagctagcgagataatggtggatgatgaggagctggctcagcatcctgccacaaccgaagatattagagtgtgttgtcaggatattcgggtgctcggccggaaggaattgcgctcccttctgaattggcgtacaaagcttcgtcggtacgtagccaagaagctgaaagagcaggcaaaggctctagacatctccttgagctccggcgaagaagacgaaggagatgaggaagattcaacagcagggaccaccaagcagccctctaaagaagaggaggaggaggaggaagaagagcagctgaaccagacactggccgaaatgaaggcccaggaagtggccgaactgaagaggaagaagaagaaactgttaagagaacagcgcaagcagagagagcgcgtcgagctaaagatggacctgcctggcgtgtcgatcgccgacgaaggggagacaggcatgttcagcctctctacaatccgcggacaccaactacttgaagaagttactcagggggatatgtccgctgcagatactttcctgagcgatttgccccgcgacgacatctacgtatcggacgtcgaggacgacggggatgatacgtcactggattccgatttggaccctgaagagctcgccggagtgagagggcatcaaggtctgcgagatcagaagaggatgcgcctcaccgaggtgcaggacgataaggaggaggaagaggaggagaaccctctgctggtgccacttgaagaaaaggcggttctgcaggaagaacaggcaaatctctggttttctaaaggtagcttcgctggcatcgaagatgatgccgacgaggcgttggaaattagccaggcccagctgctcttcgagaacaggagaaaaggacgccagcaacagcaaaaacagcagctgccacagacgccccccagctgtttgaagacagaaataatgtcaccgctttatcaagacgaggcccccaagggtactgaagccagctcaggcacagaggcggcaactggtttggaaggggaagaaaaagacggaatatccgattccgactcttcaacctctagcgaggaggaagaaagttgggaaccattgagagggaaaaagagatccaggggacctaaaagcgatgacgacggcttcgagatcgttcccattgaggatcccgccaaacataggatcctggacccagaggggcttgccctgggggctgtcattgcttctagtaagaaagccaagagggatctcatcgataactccttcaaccgatatacttttaatgaggacgagggcgaattacccgaatggtttgtgcaagaagaaaaacagcaccgaatacgccaactcccagtggggaagaaggaggtggaacactaccggaaacgctggcgagaaattaatgctagaccaattaaaaaggttgcggaggctaaggcccgaaagaaacgccgcatgctgaagaggcttgaacaaacccggaaaaaggcagaggcagtggtgaacacagtcgatataagcgagcgggagaaagtagctcagctgcgcagtctttataagaaagcagggctgggaaaagagaaaaggcacgtgacgtacgttgttgccaagaaaggcgtgggccgcaaagtccgcagacccgcgggggttcgagggcattttaaggtggtagattcaagaatgaaaaaagaccagcgcgcccagcagcgcaaggaacagaagaagaagcacaagcggaagtag

SEQ ID NO: 11824 - DNA, 1431 bp, Artificial Sequence
  Description of Artificial Sequence: Synthetic coding sequence
atggctgactctaaggaaggcgtactcccattgaccgccgccagtaccgcgccaatctcgttcggcttcacgaggactagtgcccgacggcgactggccgatagtggagacggggcaggaccgtcaccagaggagaaagatttcctgaaaacagtggagggccgcgagctccagtccgtcaaaccacaagaggctcctaaagaacttgtgatcccactgattcaaaacgggcatcgaagacagcctccggcacgtcccccagggcccagcacagatacaggcgccctggcagacggtgtagtgtctcaagctgtcaaagagctgatcgctgagagtaaaaagtcactagaggaacgagaaaacgctggggtcgacccaacactggccatccccatgatccagaagggctgcacgcccagcggcgaaggcgccgacagtgagccacgagcagaaacagtcccagaagaagctaattacgaagcagtgcccgtggaggcttacggcctcgcgatgctgcgaggcatggggtggaagcccggagaaggaattgggcggacgttcaatcaggtggtaaaacctcgagtgaacagcctgcgccccaaaggacttggtctgggcgccaatttgacggaggcccaggctctgactcctactggcccgagtaggatgccaagaccagacgaggaacaagagaaagacaaggaggatcagccacagggcttggtccctggcggggcagtggtggttctgagtggccctcaccgcggactgtatggcaaggtggagggactcgacccagacaatgttcgagccatggttcggttggctgtgggatccagggtcgtaacggttagtgaatattatctgcgccctgtcagtcaacaggagtttgataagaataccctggatctgcggcaacagaatggtacggctagctcccggaagacactttggaaccaagaactttacatccagcaagataatagtgaaaggaaacggaagcacttgccagaccggcaggacggaccagccgcaaagtccgaaaaggccgctccccgctcccagcattggctgcaccgggatctgagagtcagattcgtggataacatgtataagggagggcagtactacaataccaaaatgattatcgaagacgtgctcagtcccgatacttgtgtctgccggacagacgaggggagagttctagagggcctgagggaggacatgttggaaacactggtccccaaagctgagggggatagggtgatggtagttctaggcccccagactggccgggtgggtcatcttttgagtagggatcgggccaggtctcgcgcgctcgtgcaactgccaagagaaaaccaagtagttgagctgcactacgacgctatatgccagtacatgggaccgtcagacaccgacgacgactag

SEQ ID NO: 11825 - DNA, 2796 bp, Artificial Sequence
  Description of Artificial Sequence: Synthetic coding sequence
atggccgcacgtgatagtgatagcgaagaggatctagtctcttatggaaccggcttagaaccattggaagaaggagaacgccccaagaaaccaatcccactgcaagaccagaccgtgcgagacgaaaaggggcgctacaaaagattccacggagctttttcagggggcttttcagcggggtacttcaacacggtgggcagcaaggagggctggacaccatccacgtttgtgtcaagtcggcagaaccgggccgacaagtccgtcctggggcctgaggactttatggatgaagaagacctgagcgagtttgggattgctcctaaggcgattgtgacaacagacgattttgcgagtaagactaaggatagaatccgtgagaaagcccgccaactggccgccgcaacagcgcctatccctggtgctacactgctagacgatttgatcacccctgcgaaacttagcgtgggcttcgagctgttgcggaagatgggctggaaagagggacagggtgtgggacctagggtaaaacgccgccccagacgacaaaagcccgacccaggagtgaaaatttacggttgcgctttgcctcccggctcctccgagggatccgagggcgaggacgacgattacctgccagataacgtaaccttcgcccccaaggatgtgaccccagtcgatttcacccccaaagataacgttcatgggctggcatacaagggacttgatccacatcaggccttgtttggaacatctggggagcacttcaatctcttttccggaggatcggagagagccggagatctgggtgagattggccttaacaaaggccgaaagttgggaatctctgggcaagcctttggcgtcggtgctttagaggaagaagacgatgatatttatgctacagaaacactgagtaaatatgacaccgtgctgaaggacgaggagccaggggatgggctttatggatggaccgccccacgacaatataagaatcaaaaggagagcgagaaggatttgaggtatgtgggtaagattctggacggattctctctggcctcaaaaccactttcaagcaagaagatttaccctccccccgagctgcccagagactatcgtccagttcactatttcagacctatggttgccgccaccagcgagaacagtcacttattgcaggtgttgagcgaatcagccggcaaggccacacccgaccccggtacccatagtaagcaccagctaaacgcgtccaaacgtgcagaactgctcggagaaacacctatccagggcagcgccactagtgtcctggaattcctcagccagaaggataaagaaaggatcaaagaaatgaagcaggctacagatcttaaggcagctcagttaaaggctaggtcactcgcccaaaacgcccaaagtagtcgggctcagctgtccccggcagcggctgctgggcattgtagttggaatatggccctcgggggtggtaccgccaccttaaaagcctctaatttcaaacccttcgctaaagatcccgagaagcaaaagcggtacgatgagttcctggttcacatgaaacaaggccagaaagatgccctggagagatgtctggacccaagtatgaccgaatgggaacggggtcgcgaacgggacgagttcgcccgggctgcccttctgtacgcctctagtcacagtaccttgagttcgcgtttcacacatgccaaggaagaggacgattctgatcaggttgaagtaccacgagatcaagaaaacgatgtcggggataagcagtccgccgtcaagatgaaaatgttcggaaagctgacccgtgacacctttgagtggcacccagataaactcttgtgtaaacggtttaacgttccagacccctaccctgattcgactctcgttggtttaccgcgcgtgaagcgcgataagtacagcgtttttaactttctgaccctaccggagacggcctcactgccgacaacccaggccagcagcgaaaaagtgtctcagcacagaggccccgacaagtcacgaaagcctagccgctgggatacatcaaagcatgaaaagaaagaggactcaatatctgaattcctctcactggccaggagcaaggccgaaccaccgaagcaacagagcagcccactcgtgaataaggaggaggagcacgctcctgagctttccgcgaaccagaccgtaaacaaggatgtggacgctcaggccgaaggagaaggaagtaggccatccatggacctttttcgggctatttttgcctcgagctcagatgagaagtcaagttcatctgaagacgaacagggcgatagtgaggatgatcaggcaggctcaggcgaagctaacttccaaagttctcaggacaccgaccttggtgaaaccagctcagtggcacatgctctcgttccagccccacaggagccaccccccagctttccaatacagaaaatgcagattgatgaacgggaagagttcggccctaggctgccccccgtgttctgccctaacgcccgccaaacccttgaggtgccacaaaaggagaagcataaaaagaataaagacaagcacaaagctaagaaggagcatcggcgcaaaaaagaaaagaagaagaagcatagaaagcacaagcacaagggcaagcagaagaacaagaagcccgagaagtcttcgtccagcgagagttctgacagcagtgatagtcagagcgacgaagagacggctgacgtttcaccccaggagctcctgcggcggctcaagtcccttcccctgcggcgacagtag

SEQ ID NO: 11826 - DNA, 984 bp, Artificial Sequence
  Description of Artificial Sequence: Synthetic coding sequence
atgcccgccctcctagagcggccaaagctgtccaatgccatggcacgggcactgcaccgccacatcatgatggaacgagagcgcaagcgccaagaagaggaggaagtggataaaatgatggaacagaaaatgaaagaagaacaggagaggagaaagaaaaaagagatggaggagagaatgtcccttgaggagacgaaggagcagattttgaagctggaggaaaagctcctggccttacaggaggagaagcatcaattgttcctgcagctgaagaaagttttacacgaggaggaaaaaaggaggcgcaaggagcaatcggacctgacaacacttacgtcagccgcctatcagcagagcctgacggtccatacaggcacacatctgctctccatgcagggctcccccggagggcataatcgccccggaactctgatggccgccgatagagcaaagcagatgttcggcccacaggtcctaactacccgccactatgtggggtctgccgccgcctttgccgggacgcctgagcacggccaattccaagggtcaccagggggtgcttatggaaccgcacagcctcctccccattacggtcccacacagcctgcatattcccccagtcagcagctgcgggcccctagtgcatttcctgccgtgcagtacttgagtcagcctcaaccccagccatacgccgttcacggacattttcagccgacgcagactggctttcttcagccagggggcgcactcagtttacagaagcaaatggaacatgcaaaccagcaaacgggcttctctgactccagctctttgcggcccatgcacccgcaagccctgcatccagcgcccggtttgcttgcctcccctcagctgccagtccagatgcaacccgccggcaagtccggttttgccgctacgtctcaacccggacctaggctgccttttatccaacactcccaaaacccgaggttttatcataagtag

SEQ ID NO: 11827 - DNA, 984 bp, Artificial Sequence
  Description of Artificial Sequence: Synthetic coding sequence
atgccagcgttactggaacgccccaaactttcaaatgctatggctcgggccctgcaccgccacattatgatggaaagggagcgtaagcgacaggaggaggaagaagtagacaaaatgatggagcagaagatgaaggaggagcaggaaaggaggaaaaagaaggaaatggaggaaagaatgagcttggaagagacaaaagaacaaatcttaaagctagaggagaaattgttagctttacaggaagaaaagcatcagctgttcctccaactaaagaaagtcctgcacgaagaagagaagcgcagaagaaaggagcagtcagatctcacaaccctgaccagcgccgcctaccaacaatccctgactgtgcatacaggcactcatctgctgtctatgcaaggtagccctggcggccacaaccgacctggtacactgatggccgccgaccgcgctaagcagatgtttgggccacaagtgctgaccaccaggcactatgtgggttctgcagctgcgttcgctggcacccccgagcacggccaattccagggctccccaggaggcgcctacgggactgcgcagccaccccctcactatggtccaacacagcctgcctattcccccagtcagcagttgagggctcctagcgctttccccgccgtacagtacctgagccagcctcagccccagccatacgccgtgcacggacacttccagcctacacagactgggttcttgcagccgggtggcgcgctgagtctgcaaaaacagatggagcatgcgaatcaacagaccggtttttcagactctagctcgctcaggccaatgcatccccaggccctgcaccccgctcctgggctgctggcaagtccccaattgccggtccaaatgcagccggctggcaagagtggctttgcagccacctcccagcctggacctcggctaccgttcatacagcactcccagaaccccagattttatcacaagtag

SEQ ID NO: 11828 - DNA, 984 bp, Artificial Sequence
  Description of Artificial Sequence: Synthetic coding sequence
atgcccgctctcctggagaggcctaagctgagcaacgctatggcccgagccctgcacaggcatatcatgatggagcgcgagagaaagcgtcaagaagaagaggaggtggacaagatgatggagcaaaagatgaaggaagaacaagagaggcgtaaaaaaaaagagatggaagagcggatgtccctggaggagaccaaggaacagatcttaaaactggaagaaaagctccttgccctacaggaagagaaacatcagctctttctgcagctcaagaaggttctacacgaagaagagaagcgcaggagaaaagagcagtccgatctgaccactctgacgtccgctgcctatcaacagtccttgaccgtgcacactggcacgcacctgttatctatgcagggaagccccggcggccacaatcggcctggaactctcatggccgccgatagagccaagcagatgtttgggcctcaagtacttacaactaggcactacgtgggttcagccgcagcattcgcaggcactcccgaacacggacagttccagggatctccaggaggagcttatggcacagctcaaccaccaccacattacggccccactcagcctgcatactctcctagccaacagctgagagctcctagcgcttttcccgcggtccagtatttgtcacagccccagccccagccctacgctgtccacggacattttcaacccacacaaaccggcttcctgcagcccgggggcgccctgtccttgcagaagcaaatggagcacgccaaccagcaaacgggatttagcgactcatcctctttgcggccaatgcacccacaggcgctccatcctgcaccagggttactggctagcccgcagttacctgtgcaaatgcagcccgccggtaagagtggcttcgctgccacatctcagcccggaccacgcctcccatttattcaacacagccagaatcctcggttttaccacaaatag

SEQ ID NO: 11829 - DNA, 912 bp, Artificial Sequence
  Description of Artificial Sequence: Synthetic coding sequence
atgcctgccctgctggagagacctaaactgtcgaatgccatggccagagccttacaccgccatattatgatggagagggaacgtaagcggcaggaagaggaggaagtggacaaaatgatggagcagaagatgaaggaagaacaggagcgcaggaagaaaaaagagatggaagagcggatgagtctagaggagacaaaggaacaaatactgaaactggaggagaagctactggcgttgcaggaggaaaaacatcagctcttccttcaactcaaaaaggtcctgcatgaagaggaaaagagaagaagaaaggagcagtcggacctaacaaccttgacctcagcagcataccagcagtcattaacagtccataccgggacccaccttctgtccatgcaggggtcccctggtggacacaatcgcccgggaacacttatggccgccgacagagccaaacagatgtttggaccacaggtcctgacgacaagacactacgtagggtccgcggcagcttttgccggaactccagagcacgggcagtttcaggggtccccgggcggagcctacgggacagcacagccacccccccattatggcccgacccagcccgcctactccccctctcagcaattgcgcgcgccctcggctttcccggccgttcagtacctatctcagccccagccgcagccgtatgccgtacacggccactttcagccgacacaaactggtttcttgcagccagggggggccctttccctccagaaacaaatggaacacgctaatcaacagactggcttcagtgactcgtcctctctccgtccaatgcacccacaggccctacacccggctcccgggcttctggcgtcaccgcagcttcctgttcagatgcagccagctggcaagactgcaccgtag

SEQ ID NO: 11830 - DNA, 1986 bp, Artificial Sequence
  Description of Artificial Sequence: Synthetic coding sequence
atgagcaagcgtcttcggagctctgaagtgtgcgctgactgctccggtcctgatcctagttgggcaagcgtcaatcggggtacttttctttgcgacgagtgctgttctgtgcacagaagcctcgggcgccatatcagccaggtccgtcacctgaagcacacgccttggcctccaacacttctgcaaatggtagagaccttatataacaatggggctaactcgatctgggagcatagcctgctcgaccctgcttcaataatgtccggccgtaggaaggctaatccgcaggataaggtccaccccaacaaagctgaatttatcagggcaaaataccaaatgctggcctttgtgcaccgcctgccttgtagggacgacgacagcgtcacagcaaaagacctatctaagcaacttcactcctcagtgcggacgggtaatctggagacctgtctgcgcctgctgtccctgggagctcaggccaacttttttcacccagaaaagggaaacacccccctccacgtggcttctaaggccggccagattctgcaggccgagctcctggctgtgtatggagccgaccctgggacacaggacagcagcgggaagacgccagtggattacgccaggcaggggggacaccacgaactggcagagaggctagttgagatacagtatgagctgacagataggctcgctttctatctgtgcggcaggaagccagaccataagaatgggcagcactttataatcccccagatggcagatagttcactggacctgagcgaactggccaaggctgcaaagaagaagctgcaatcactcagcaatcacctgtttgaggagctagccatggatgtgtatgatgaggtggatcggagagaaacagacgccgtgtggctcgcaacgcaaaatcatagcgccctggtgactgaaaccactgtggtgcccttcttaccggtgaatccagaatattccagcacaagaaaccagggccggcaaaagctagctaggttcaacgcccacgagttcgcaacactggtaatcgatatcctgagtgatgcaaagcgcaggcagcagggcagcagcctatcaggcagcaaggacaacgtggagctcattcttaagaccatcaacaaccagcattcagtggagagccaggacaacgatcagccggactatgatagcgtggcttctgatgaagacaccgacctggaaaccacagcaagtaaaaccaacagacaaaagtccctggactcagatctttctgacggtccagtcacagtacaggagtttatggaggtaaagaatgcattggtggcgtccgaggctaaaattcagcaactgatgaagattggacggtccgctctggtgacttcgtcaagcagcctgccctccttcccaagtactctctcttggagccgcgacgaatccgcaagacgtgctagcaggctggaaaagcagaacagcacgccagagtctgattacgacaacactccgaatgacatggaaccagacggcatgggaagctcaagaaaggggcgccagcggtctatggtgtggccgggggacggtttagtaccggacacagctgaacctcacgtggccccttcaccaaccctcccctcaactgaggatgttatcaggaaaactgaacagatcaccaagaacatacaggagcttctcagagccgctcaggaaaataagcacgactcatatattccatgcagtgaacgcatccatgtggcagtgaccgagatggccgccctttttccaaagaaacccaagagcgacatggtgcgaacatcccttcgtctcctcacaagttcagcctatcggctacagtctgagtgcaagaagactctacccggcgaccccggaagcccaaccgatgtgcagcttgtcactcagcaggtcatccaatgcgcttatgacattgcaaaggccgctaagcagctggtaacaatcaccaccaaggagaacaacaattag

SEQ ID NO: 11831 - DNA, 1950 bp, Artificial Sequence
  Description of Artificial Sequence: Synthetic coding sequence
atgtctaagcgactgcgtagctccgaggtgtgcgcagattgttcgggcccagatccttcttgggccagtgtcaatagagggaccttcctatgtgacgaatgttgttccgtgcaccggtcattgggacgccatattagtcaagtgaggcacctaaaacacacaccctggccccccacactgttgcaaatggtcgagaccttgtataataacggagctaacagtatctgggagcattctcttttagacccagcttccatcatgtccggacgtagaaaggccaaccctcaagataaagttcatccaaacaaggctgaattcatacgcgcgaaataccagatgctagcctttgttcatcgcctcccttgtcgtgacgatgacagcgttaccgccaaagacttgtccaagcagctccactccagcgttaggaccgggaacctcgaaacatgcctgcgacttctgtctctcggtgcccaggcaaatttttttcatccagagaaaggaaacacccctctccatgtagccagtaaagccggacagatcctgcaagccgagctgttggctgtgtatggcgcagacccgggcacccaggattcctcagggaagacccccgtcgactacgcacgtcagggaggacaccacgaactggcggaaagattggttgaaattcagtatgaactgacggataggttggccttttacttgtgtggaaggaaaccagaccataagaatggacagcactttatcatccctcagatggccgactcctcgctggacctgtccgaattagccaaagctgctaagaagaagcttcaatctctttctaatcacctgttcgaagagttagccatggatgtgtacgatgaagtggacaggcgcgagaccgatgctgtttggttagccactcagaaccacagcgccttggtgactgaaacaacagtggtcccatttctaccagtaaacccggaatattcgtccactcgaaaccaggggcagcctaagaagtcacttgatagtgacctgtccgacggaccagtgacagtgcaagagtttatggaagtgaaaaatgccctagtggcgtctgaagctaagatacagcagctgatgaaagtcaacaacaacctttccgacgaacttaggattatgcagaagaaactgcaaacactccagtctgaaaattccaacctgcggaagcaggccacgactaatgtttaccaggtccagacagggagcgagtatacagatacatctaaccacagtagcttgaagagaagacctagtgcccgcggatcgaggcccatgtctatgtatgagaccggcagcggccaaaaaccgtatctcccaatgggagaggcctcccgccctgaggaatctcgaatgagattgcagcctttccccgctcatgcatctagattagagaaacaaaacagcacccctgaatctgactacgataacactccaaacgatatggagcccgacggcatggggagttctaggaagggccggcagaggagtatggtatggccaggtgacggactggtgcctgacaccgcagaaccacacgtcgcacctagcccgacactgccaagcactgaagacgtgattagaaaaacagaacaaattacaaagaatattcaagaactgctgcgcgccgcacaggaaaataagcacgactcttacatcccttgcagtgaacgcattcacgtggctgtcacagagatggctgccctgttccccaaaaagcccaagtctgacatggtgcgcacgagcctaagactgttaacctcctctgcgtatcgactccaaagcgaatgtaagaagaccctcccaggcgacccgggaagccctacagacgttcaactagtcacacagcaagtgatccagtgcgcatatgacatagcaaaagccgcgaagcagctggtgaccatcactacgaaagaaaataacaattag

SEQ ID NO: 11832 - DNA, 2046 bp, Artificial Sequence
  Description of Artificial Sequence: Synthetic coding sequence
atgagcaagcgcctccgttcatccgaagtgtgcgccgactgctcggggccggacccttcttgggcaagcgtgaatcgcggcacattcctgtgcgatgaatgttgcagtgtgcatcggagcctggggcgccatatctcacaggttcgacatctgaaacatacaccctggcccccaactttgctccagatggtggaaactctgtataataatggtgcaaatagcatctgggaacacagtttgctagatcctgcgagcattatgtccggaaggaggaaagctaaccctcaggataaagttcatcccaataaggcggagtttataagagccaagtaccaaatgctcgcttttgtgcatagactgccgtgcagggacgatgattctgtgaccgcgaaggacctgtctaagcagttacacagcagcgtaaggacaggtaaccttgagacttgtcttcgcctgctgagtctgggtgctcaggcgaactttttccatcccgaaaagggcaatactccactgcacgttgcctctaaggctggacagattctccaggctgaacttctcgctgtttacggagctgatccaggcacccaggactcttctggcaagacccctgtcgattacgcccggcaggggggccatcacgagctcgccgagagactcgtggagatccagtacgagctgaccgaccggttggccttttatctttgcgggcggaaaccagatcataagaacggccagcatttcataatcccccagatggctgatcggaggtcctctctggacctctcggaactagctaaggccgctaagaagaagctacaaagcttgagcaaccacctctttgaggaactcgctatggacgtctacgatgaggtggacagaagggagacggacgctgtgtggcttgcaacacaaaatcatagcgcacttgtaactgagaccactgtcgtgccgttcttaccggtcaaccctgaatacagctccacccgaaatcaagggcgccaaaaactagccaggttcaatgctcacgaattcgcgactttggtcatagatatactcagcgacgccaagcggcgacagcaggggtcctcattgagcgggtccaaagacaatgtcgagctgatcctaaagactatcaataatcaacattctgtggagtcccaggacaatgaccagccagactacgactcggttgcttctgacgaggatacagacctggagaccacagcttcgaaaactaatagacagaaactccagacgcttcaaagcgagaattcaaatctgcgcaagcaggctacaacgaatgtgtatcaagtgcaaactggatctgaatataccgatacctccaatcacagcagcctaaagaggagaccctccgcccgtgggtcaagacccatgtccatgtatgagacgggtagtggacagaaaccatacttgccaatgggcgaagcatcaagaccagaggaatcgaggatgcgcctccagccctttccagctcatgcttctcgcctggaaaagcagaattcaacccctgaaagtgattatgacaataccccaaatgacatggagcccgacggcatgggaagttcgcgcaagggtaggcagagaagtatggtgtggcccggagatgggttggtgcctgatactgcggaacctcatgtggctccttctcccacgttaccatcaaccgaagatgtcataagaaaaaccgagcagattacaaaaaacattcaagaacttttgcgcgccgcccaggagaacaagcacgattcctacatcccatgctctgaaaggatacatgtggcagtcaccgagatggctgccctgtttcccaaaaagccgaagagcgatatggtaagaacatcactacggctacttacatccagcgcctatcgtctccagagcgaatgcaagaaaacattaccaggcgaccctggttcacctactgatgtacagctcgtgacccaacaggtaatccagtgcgcatacgatatagccaaggctgcaaagcagctagtgactattactacaaaagagaataacaattag

SEQ ID NO: 11833 - DNA, 2280 bp, Artificial Sequence
  Description of Artificial Sequence: Synthetic coding sequence
atgtccaagagactgcgctcatcagaggtctgcgccgactgctctggcccagacccatcatgggcttccgtgaatagaggaacttttctttgcgacgagtgctgcagcgtacaccgttcactaggccgacatataagccaagtgaggcacttgaaacatacaccttggccccctaccctcctgcagatggtcgagacactgtacaacaacggagctaacagtatctgggagcattccttactggacccagcctccatcatgagcggacgacgtaaagccaaccctcaggacaaagtacatcctaacaaggcagaattcatccgcgcgaagtaccagatgctggcctttgtgcaccgactcccttgtcgagacgacgacagcgttactgcaaaagacctgagtaaacagctgcacagcagtgtccgcactggtaatctggagacatgtctgcgtcttctatcattaggtgcacaggccaacttctttcacccagaaaagggcaacacgcctctgcacgtggcgagtaaagcaggccagatactgcaagccgagctcctggcagtgtacggggcagaccctgggacgcaagactcctccggaaaaacacccgtcgattacgcacgccaaggagggcaccatgagcttgccgagcgattagttgagatccagtacgagctgaccgaccgattggcattttatctgtgcggaagaaagccggatcacaagaacggccagcacttcattattccgcagatggcagactcctccctggatctctcagagttagccaaggccgccaaaaagaaattacagtctctcagcaatcacctcttcgaggagctagccatggacgtctatgacgaagtcgaccggagagaaacagacgctgtctggctggctacacagaatcacagcgcccttgtgactgaaacaactgttgtgccgttcctgcccgtcaacccagagtattcttctacgcggaatcaggggcggcagaaactagcgcgattcaatgctcacgagttcgctaccctggtaatagacattctcagcgacgccaaacggagacaacaggggtctagcctcagcgggagtaaggataatgttgaacttatacttaagactattaacaaccaacacagcgtggaatcgcaggataatgaccaacccgactacgatagtgtcgcatccgacgaggacactgacctagagaccacggcctcaaagaccaaccggcaaaaaagcctggacagcgatctgtccgacgggcccgtaaccgttcaggagttcatggaggtaaaaaatgcccttgtggcctccgaagccaagatccaacaactgatgaaagtaaataacaacctgtcagatgaactccgcataatgcagaaaaaactacaaacgcttcagtccgagaacagcaatctgaggaagcaggccaccaccaatgtgtaccaggtccagaccgggtcagaatacaccgacacttcaaaccatagtagcttgaaacgccgcccatctgctcggggcagccgccccatgagcatgtatgaaacaggcagcggacagaaaccctatctgcctatgggggaggcttcccggcctgaggagtccagaatgaggcttcaaccatttccagctcatatcggccggtctgcactagtgacgtcatctagtagcttgccgagcttcccttcgactttgagttggtcaagggacgaatctgcaagacgggcctctagactcgagaagcagaactcaacccccgagagtgactacgacaatacaccaaatgacatggaacccgatggcatgggcagtagccggaaggggcgccagcggtcaatggtgtggccaggcgacggcctcgtgccagacacagccgaaccacacgttgcacctagccctaccttgccgtcgaccgaagatgtcattcgaaaaacagagcagatcacaaaaaacatccaagaactcctgcgtgccgcccaggagaacaagcacgacagttacataccctgctctgagagaatccacgtagccgttaccgaaatggctgccctatttccaaagaagcctaaatctgacatggtgcgcaccagccttaggttgctgacctctagtgcctacaggttgcagtctgagtgcaagaagactctgcctggcgaccccgggtcacccactgacgtccaactggttactcaacaagtgatccagtgcgcctacgacattgccaaagccgccaaacagcttgtcaccataactactaaggaaaacaacaattag

SEQ ID NO: 11834 - DNA, 1941 bp, Artificial Sequence
  Description of Artificial Sequence: Synthetic coding sequence
atgtcaaagaggctgcggtcgtccgaagtgtgtgccgattgtagcggccctgacccctcttgggcttctgtaaaccggggcacctttttatgcgatgagtgttgctccgtccatcggagtctgggacgccatatatctcaggtgcgtcatttgaagcatacaccatggccacccactttgctccaaatggtcgaaaccttatacaacaatggggcaaactctatatgggaacactcattgctggaccctgcatcaatcatgtcgggtcgcaggaaggcaaatcctcaggacaaagtacatccaaataaagctgaattcatccgggcaaagtatcaaatgttagctttcgttcacaggctcccttgtcgagacgacgactctgttactgccaaggacctctctaaacagcttcattccagtgtgagaacgggaaatctcgagacttgtctccgcctgttgagcctcggagcgcaggccaattttttccaccctgagaagggaaacactccattacacgtggcctcaaaagcaggccaaattctccaggcagaactactcgccgtgtatggggcagaccccggcacacaggactctagcgggaagacacctgtagattatgctcggcaaggcgggcaccacgaactggccgagcggctggtcgagatccagtacgagttgactgatcgccttgcattctacttgtgcggcagaaagccagaccataaaaatgggcagcatttcatcatccctcagatggccgatagctccctggatctgagcgagttggcaaaggccgcgaaaaaaaagctgcagagtttgtctaatcacttgtttgaggagctagctatggatgtctatgacgaagtcgatcggagggagacagacgccgtgtggctggccacacaaaatcactccgcccttgtgactgaaacaaccgtagttccatttttgcccgtgaatcctgaatatagctctacccggaaccaggggcgccagaagcttgcccgctttaacgcgcacgaatttgcaaccctggtgatcgacatcctcagtgatgctaagcgtcggcagcaaggaagttcgctgtccggatctaaggataacgtagaattgatcctcaagacaattaataatcagcactctgtggagagtcaggacaacgaccaacctgattatgattccgtcgccagcgacgaagatacagatttagagactaccgcctccaagactaaccggcagaaatctttagactccgatctaagcgacggaccagtgactgtccaggaatttatggaggttaagaacgctctcgtcgcttcagaagccaagatacagcaactaatgaaggtgaataataatttgagcgacgaactccggatcatgcagaagaaagcctcacggctcgaaaaacagaacagcacgccagagagcgattacgacaacacccccaacgacatggaacctgatggaatgggcagtagtcggaagggccgccaaaggtctatggtgtggcccggggatgggctagtcccagatacagcggaaccccacgtggcaccatcccccaccctgcccagcaccgaagacgtcattcgtaaaaccgagcagattacaaaaaatattcaagaactgctgagagcagcccaagagaataaacacgattcatacattccctgtagcgaaagaatccacgtagcagtgacagagatggccgctttgttcccaaagaagcccaaatcagatatggtacggacaagcctgcggctgctgaccagctctgcataccggctgcaatccgagtgtaaaaagactcttcctggcgacccgggctcacccactgacgtgcagttggtcacacagcaggttatccagtgcgcctacgatatcgccaaggccgccaaacaacttgtgacaattaccaccaaggaaaacaataactag

SEQ ID NO: 11835 - DNA, 2130 bp, Artificial Sequence
  Description of Artificial Sequence: Synthetic coding sequence
atgtccaaaaggcttcggagttcggaggtgtgcgccgactgttcaggtcctgacccctcctgggctagtgtgaacaggggaacttttctgtgtgatgaatgctgttccgtccaccgtagtcttggcagacatatatcacaggtaagacacctaaagcacaccccatggccccccaccctgctgcaaatggtagagaccctctacaataatggggcgaacagcatctgggaacactcactcctggatcctgcctcaataatgtccgggcgccggaaggcaaatccccaggacaaggtgcacccaaacaaagccgaattcatcagagctaagtaccagatgctggcatttgtgcaccgactgccatgcagagacgacgactcagtcaccgctaaagacctgtccaagcaattacacagttcagtaagaaccggcaatctggaaacctgcctgcggctgctttctctaggggctcaggcaaacttctttcaccctgagaaagggaacaccccactgcacgtagcttccaaagcaggacaaatcctgcaggccgagctactggcggtgtacggagctgatcccggaactcaagactctagcgggaaaactcccgtcgactacgctaggcagggcggccatcacgagctggcagagcggctggttgaaattcagtatgagctcacagataggctggccttctatctgtgcggccgcaagcctgatcacaaaaacggccaacactttatcattccacagatggccgactccagcctggatctgtcagagttggcgaaggctgccaagaagaaactccaaagtttgtccaaccacctgttcgaagagttagccatggacgtgtacgatgaagtcgaccgaagggaaacagatgcagtctggctcgcgacgcaaaaccattctgccctggtaacagaaactacagtggtgcctttcctgccagtaaatcccgagtactccagcacccggaatcaaggacgacagaaattggcccgcttcaacgcccatgaattcgctactttggtaattgacattctgtccgacgctaagcggaggcaacagggcagcagcctatccggttcaaaggacaacgttgaactaattttaaaaaccatcaacaaccagcattccgtcgaatcacaggacaacgaccagcctgactacgactctgttgcatccgacgaggacacagacctggaaacaacggccagcaaaaccaataggcagaagctacagaccctacaaagtgagaactccaatctaaggaagcaggccaccacaaacgtctaccaagttcagacagggtcagaatatacggacacatctaatcactctagtttgaagcgacggcctagcgccagaggtagcaggcctatgagtatgtacgagacaggcagcggtcagaagccttatctgccgatgggcgaagcttccagacctgaagagtcgcgtatgagacttcagccctttccggctcacataggccggtcagccttggtgacgtcttcctcctccctaccttcctttccatccactctgtcttggtctcgtgacgagtccgctaggagagcctccaggcttgagaagcagaactctacacctgagtctgattacgacaatacccccaatgatatggagccagatggcatgggttcaagccgaaaagggaggcagcgcagtatggtctggccaggcgacgggctagttccagacactgccgagccccacgtagcccccagtcccactttgccttccaccgaggatgtgatccggaagaccgagcagatcactaaaaacatccaggagctgctgagggccgcccaggaaaacaaacacgactcctacattccttgtagtgaacggatccacgtagctgtgacagagatggccgccctattccctaaaaagcccaagtccgatatggtgagaaccagcctgagactcctgaccagctcagcttatcggctccagtcagagtgcaagaagactctgcctggggaccctggcagcccgactgatgttcagctagtgactcagcaggttattcaatgtgcgtatgacatcgctaaagcagctaaacaactggtcaccattactaccaaagagaataataactag

SEQ ID NO: 11836 - DNA, 2190 bp, Artificial Sequence
  Description of Artificial Sequence: Synthetic coding sequence
atgagcaaaaggctgaggagctcagaggtgtgtgccgattgcagtggtcccgatccgagctgggcatccgtgaaccgcggaacattcctgtgtgatgagtgttgtagcgtgcatagaagtctcggccgacacatctcgcaggtgagacacctgaagcacacaccatggccaccaaccctgctccagatggtcgagaccctgtataacaacggggctaatagcatctgggagcactctctgttagacccggcttctatcatgagcggccgccgaaaagctaaccctcaggataaggttcaccctaacaaggctgagttcattagagccaagtaccagatgctagcttttgtccaccgattgccatgccgtgacgatgactctgtgaccgctaaagatctgtcaaagcagttgcattcctcagtgcgcacaggcaaccttgaaacgtgtctccgactcctttctctgggcgcccaggccaacttctttcatccggagaagggtaacacacccctccacgtcgcctccaaagctggacaaatcctgcaggctgaactgcttgcggtgtacggggctgaccccggtacccaagacagttccggtaaaacaccagtagattatgcacgccaggggggccaccatgagctggcagagaggctagtagaaattcaatatgaactaactgatcgtttggctttctatctgtgcggtagaaagccggaccataagaacggacagcactttatcatacctcaaatggccgacagctccctggatctgtctgaattggctaaggccgcgaaaaaaaaactgcagtctttgtcaaatcatctgttcgaggaactggccatggatgtttatgacgaggttgataggcgcgagaccgatgcagtgtggctcgcgacccaaaatcactccgccctggtgaccgagacgaccgtggttcctttcttgccagtgaaccccgagtactcaagtactcggaaccagggtagacagaagctggcccgctttaacgctcatgagttcgctaccctcgttatagacatcttaagtgacgccaagaggcgccagcaggggtccagtctcagtggcagtaaggacaacgtcgagttgatcttgaagacgattaataaccagcactccgtggagtcccaggataatgaccagccggactatgacagtgtggcaagcgacgaagataccgatcttgagacaaccgcaagcaaaaccaataggcagaaatcccttgacagcgacttatcagacggccctgtaaccgtccaggaatttatggaggtgaaaaacgcactggtggccagtgaagctaagatacagcaactgatgaaggtgaacaataatttgtccgatgaactgaggattatgcagaaaaaacttcagacacttcaatcagagaatagcaacctgcggaagcaggcgaccactaacgtctatcaggtgcagacaggtagtgaatatactgacactagcaatcacagcagcctgaaaagacggcccagcgcaaggggatctcgtcccatgtccatgtacgagacaggctccgggcagaaaccttatctgcctatgggcgaagcttctagacccgaagagtccagaatgagactgcagccatttcccgctcacgcttcgaggctggaaaagcagaattccaccccagaatccgattacgataatactcccaacgacatggagccagacggaatgggctccagccgtaaggggagacagaggtctatggtttggccaggggacggtcttgtgccagacactgccgagcctcatgtggcaccatcacccacattgcctagtacagaggacgtcattcggaagactgagcagatcaccaagaacattcaggaactcctgcgggccgcgcaagagaacaaacatgatagttacatcccttgcagtgagcgtatccatgtggcagtaacagagatggccgcactgtttccgaaaaaacctaagagcgatatggtgcgaacttcactcaggctactcactagctcagcataccgcctgcagagcgagtgcaagaaaacgctccctggggaccccggctctcctactgacgtgcaattggtgactcagcaagtaatccagtgtgcctatgacatcgctaaagcagcgaaacagctcgttactattactactaaagagaataacaactag

SEQ ID NO: 11837 - DNA, 2046 bp, Artificial Sequence
  Description of Artificial Sequence: Synthetic coding sequence
atgagcaagcggctgcgcagctcagaagtatgcgccgattgttcagggcctgatccttcctgggcctctgtaaaccgcgggacattcctttgtgatgagtgctgctccgttcaccgttctctgggtcgccatatcagtcaagtccgacacttgaagcacaccccatggccacctacacttctgcagatggtggagactctgtataataatggagccaactctatttgggagcattcactgctggatcctgcatccatcatgagtggtcggcgcaaagctaatccacaggataaggtgcatccaaataaggcggagtttatcagggccaagtatcagatgttggcctttgtgcatcgtctgccttgccgcgacgatgactccgtcaccgccaaagatctaagtaaacaacttcacagcagcgtcaggaccggcaatttggaaacctgcctgcgcctcctgtctcttggtgcccaggcaaatttctttcaccccgaaaaagggaacacccccctgcacgtggccagtaaggccgggcagattctgcaggcagagctgcttgcagtgtacggagcagacccaggcacccaagatagctcgggcaagacacctgttgactatgcacggcagggcggccatcatgagctggcagagagactggtggagatccagtacgagctcacagaccggctggctttctatctatgtggacggaagcctgatcataaaaatggccagcactttattatcccacagatggccgataggaggctgagtcttgacctgagcgagcttgctaaggccgcaaagaagaaactccaatcactgtccaaccacctgtttgaggaactagccatggatgtatacgacgaggtggatagacgggaaacggatgcagtgtggctcgccacacagaaccactcagccctcgtgacggagactactgtggtcccattcttaccagttaaccctgagtactctagcacccggaaccaaggtcgtcagaagttagccagattcaacgcccatgaatttgcaacccttgttattgatatcctgagtgacgcaaagcggaggcaacagggctccagcctgtcgggtagcaaagacaacgtggagctaatactgaagactatcaataaccagcactcggtggagtcccaggacaatgaccaacccgactatgacagcgtagctagcgatgaggatacagatctcgagacaactgccagtaagacaaatcgccagaaactgcagaccttgcagagcgagaattctaatttacggaagcaggctactacaaatgtgtatcaggttcagacagggtccgagtacaccgacacctcgaatcactccagtctgaaaaggagaccctcagcgagaggctctcggcccatgtcaatgtacgagacaggcagcgggcagaagccctatctgcccatgggcgaggcttctagaccagaagagagtcggatgcggctgcagccctttccagcgcacgcaagccgattggagaagcagaattcaacccctgagagtgactatgacaacactcctaacgacatggagcccgatggaatgggaagctcacggaaggggcgccagcgtagcatggtgtggccaggcgatggcctggtccctgacacggcagaaccacacgtcgcaccatcccccactctgcctagcactgaagatgtgatcaggaagaccgaacagatcacaaagaatatccaggaacttttaagagctgctcaggaaaacaagcatgacagctatattccctgttctgagcgcattcacgtggccgtgaccgagatggccgccttgttcccgaagaagcccaaaagtgatatggtacgcacctcgctccgactcttaacttccagcgcctacagattacagagtgagtgtaagaaaaccctccccggagatccagggagccccaccgacgtgcagctcgtgacccagcaggtgatacaatgtgcatatgacattgccaaggctgctaaacagctggtaactattacgaccaaggagaacaataattag

SEQ ID NO: 11838 - DNA, 1806 bp, Artificial Sequence
  Description of Artificial Sequence: Synthetic coding sequence
atggttgaaacactttataataacggagccaatagcatatgggaacatagcttgctggaccctgcctcaatcatgtctggaaggcggaaagctaacccacaagataaggtacaccccaataaagctgagtttatacgcgccaaatatcagatgctggcattcgtccaccgcctgccctgcagagatgatgacagcgtgaccgcaaaggacttatctaaacagctccactcctctgtcaggacaggcaacctcgagacgtgtctgcggctgctgagtctgggggcacaggctaacttcttccatccagagaaggggaataccccactccatgtcgccagcaaggcaggccaaatcctgcaggccgaattacttgcagtctatggcgccgaccctggaactcaggattctagtggaaaaacccctgtcgactacgcgcgtcaaggtggacatcatgaactagccgaacgactcgtggagatccagtacgagctgaccgaccgactggcgttttacctgtgcgggagaaagccagaccacaagaacgggcaacacttcataattccccagatggctgattcctctctcgacctgtcagaactggccaaagccgcaaagaaaaagctgcagagcctttccaaccatctcttcgaggaactggctatggacgtgtatgacgaagtggacaggagagaaacagatgcagtgtggctggcaactcagaaccattcagccctagtgacggagacaaccgtggtacccttcctccccgtgaacccagagtactcaagcacaagaaatcagggtcgccaaaagctcgctagattcaacgcccacgaattcgctactctggtcatcgacatcctatccgatgccaagcggaggcagcaggggtcatcgctgtcaggaagcaaagacaatgtagagctgatcttaaaaacaattaacaatcagcactcagtggagtcccaggataacgatcagcctgattacgattccgtggcctctgatgaggacaccgacctggagaccaccgcttctaagactaatagacagaaatccctggattctgacctgtcagacggacctgtgacagtacaagagtttatggaggtaaaaaacgctctggtggcgtcagaggccaagatccagcagctgatgaaagtaaacaacaacctgagcgacgagctccggattatgcagaagaaactgcagaccctacagagcgagaattccaatttgaggaagcaagcaaccaccaatgtctatcaggttcaaactggctcagaatataccgataccagtaaccatagctcacttaagagacggccctcagctcgaggcagtaggcctatgtcaatgtacgagacaggatcaggccagaagccatacttgccgatgggagaggcatcaaggccagaggaatccagaatgcggctccagccctttcctgctcatgccagtcggctcgagaagcagaatagcactccagagtctgattacgataacactccgaacgatatggaaccagacggtatggggtcctcccgtaaaggccggcaacggtcgatggtatggccaggggacggattggtgccggacaccgctgagcctcacgttgcaccaagccctacccttccttctacagaggatgttattagaaaaactgagcaaataacaaagaatatccaggaactgttgcgggcggcccaggaaaataaacatgatagttacatcccctgcagcgagcgcattcatgtcgctgtcacagaaatggcggcactctttcccaaggagacacaggtatag

SEQ ID NO: 11839 - DNA, 1416 bp, Artificial Sequence
  Description of Artificial Sequence: Synthetic coding sequence
atgtcaaagaggctacgctcttctgaggtatgtgctgactgctctgggccggaccctagctgggcgagtgtgaaccgcggtacatttttgtgcgacgaatgttgcagcgtgcatagatcactcggtagacatatttcgcaagttaggcacctgaagcacactccatggcctcctaccctccttcaaatggtagagacactgtacaacaacggagctaattccatttgggagcatagcctcctggacccagcaagcattatgtccgggagaagaaaggcaaacccacaggataaggtccatcccaataaagctgagttcattcgggcgaaataccagatgctcgccttcgtccataggctgccttgccgagatgatgactcagtaactgccaaggatctgtctaagcagctccactcatccgtgcggacagggaatctcgaaacctgtctgaggcttttgtctctcggggcccaagctaatttctttcaccctgagaagggaaatacacccctgcatgtagccagcaaagcaggacagatcttacaggccgagctgttggcagtctacggcgccgatccgggcactcaggattcatccgggaagacgccggttgattatgcccgtcaaggggggcaccacgaactcgcagagcgtctggttgaaattcagtatgaactgacggacagacttgccttctacttgtgcgggaggaaacccgaccataagaatggacaacatttcatcatacctcagatggccgattcatccctcgacctgtccgaactcgcaaaagcagctaagaaaaaactgcagagcctgtccaaccacctttttgaggagcttgccatggatgtgtacgacgaggtagatcggcgggaaactgacgcagtctggttggccacacagaaccacagcgctctcgttaccgagaccactgtcgtgccattccttcctgtgaacccagagtactcatcaactagaaatcagggtagacagaaactcgctaggtttaatgctcacgagttcgccacgctggtcattgatattctgtctgatgccaagaggaggcagcagggcagcagtctgagcggatcaaaggacaacgtggagttgattctcaagactattaataaccagcacagcgtggagtcccaggacaacgaccagcccgattatgactcagtagcttccgacgaggacaccgacctcgaaacaaccgcaagcaagacgaatcggcagaaaagcctggactcagacctgagtgacggccctgtgaccgtccaggagtttatggaggtgaagaatgccctggttgcctccgaggccaagatacagcagttgatgaaagtgaataataatctgagcgatgagctccgcatcatgcagaagaaactacttgggaaagatgccaattag

SEQ ID NO: 11840 - DNA, 1896 bp, Artificial Sequence
  Description of Artificial Sequence: Synthetic coding sequence
atgtcgaagaggttgcgatcttctgaggtgtgcgcagactgttccgggcctgacccctcatgggccagcgtcaaccgggggacctttctgtgcgatgagtgctgctctgtgcacaggtccctggggaggcacatttctcaggtgcgtcacctgaagcatacgccttggccaccaacattgctccaaatggtcgagactctctacaataacggcgctaatagtatttgggaacactctctgttagatccggcgtctataatgagcgggcgcaggaaagccaacccccaagataaggttcacccgaacaaggccgagttcatcagggcaaagtaccaaatgctcgcctttgtccataggctcccttgccgggatgacgactcagttaccgcgaaagacctgtcgaaacagctgcattcctcagtgcgcacaggtaatcttgagacctgcttgagactgctaagcctcggcgctcaggcaaacttcttccaccccgagaagggcaatacgccactgcacgtggcatctaaggccgggcagatccttcaagccgaactcctggccgtgtatggggctgaccccggcacacaggacagctcaggaaagacaccggtggactacgccaggcagggcggacaccacgagctagcggaaaggctggtcgagattcagtatgagctaaccgatagactggccttttatttgtgcggacgtaaacctgatcacaagaacggccagcatttcattattccccagatggcagactcttcattggacttgagtgaactggccaaggctgctaaaaagaaactgcagtcattaagcaatcatctatttgaggaactcgcaatggatgtttacgatgaggtagacaggcgtgagaccgacgccgtgtggctggcaacccagaaccacagcgctcttgttaccgaaaccacagtagtcccttttctcccggtgaatcccgaatactcgagcacacgtaaccaaggaaggcagaagctcgctaggttcaatgctcacgaattcgccaccctcgtcatcgatatcctgagtgacgccaagagacgtcagcaaggatccagcctgtctggatccaaggacaatgtggaattgatcctgaagacgatcaataatcaacacagcgtggaatcacaggataacgatcagcctgattatgactctgttgcatccgatgaggatactgatcttgaaaccactgcaagcaagaccaaccgtcaaaaaagcctggacagtgacctgagtgatggccctgtaaccgttcaggaattcatggaggtgaagaatgctttggtcgcatccgaagcgaagatccagcagctgatgaaagcatccagactcgagaagcagaacagtacacctgagtcagactatgataacactccaaacgatatggaaccagatggaatgggctcatctcggaagggtagacagagatccatggtctggccaggtgacggactagtgcccgatactgccgaaccccatgtggcccccagccccacactcccctcaaccgaagatgtcattcgtaagactgagcaaatcacaaaaaacatacaagaattattgcgagcggcccaggagaacaagcacgattcttacataccctgttcagagaggatccacgtggcagtgaccgaaatggccgccctgtttcctaaaaaaccaaagagcgatatggttaggacctctctgcggctcctgacctcttcagcttaccggctccagagtgagtgtaagaagacgctgcctggggatccaggctccccaactgacgtgcagctggtgacccaacaagtgatccagtgcgcctatgatattgcgaaggccgctaagcagcttgtgacaataacgacaaaagagaataataactag

SEQ ID NO: 11841 - DNA, 1233 bp, Artificial Sequence
  Description of Artificial Sequence: Synthetic coding sequence
atgagcctcgtcgacctcgggaagcgcttactggaggcggcacgaaagggccaggacgatgaggtgaggaccctcatggctaacggtgccccttttaccaccgattggctgggaacctccccattacacctggcagcccagtatggacactacagtaccgcggaggtcctgttgcgggcgggtgtttctagggacgcccgaacgaaggttgaccgcacccccctacacatggctgcagccgacggtcatgcccatatcgttgaattgctggttagaaacggtgcagacgtcaatgctaaagatatgctgaagatgaccgcgcttcattgggccacagagagacaccaccgcgacgttgtggaactgctgatcaagtacggagctgacgtacatgccttttcgaagtttgacaaatcagctttcgacatagcactcgaaaagaacaatgccgagatcctggttatccttcaggaggccatgcagaaccaagttaatgtgaacccggagcgggcgaaccccgtaaccgacccagtgtctatggccgcgccgttcatttttacctctggagaggttgtgaacctcgcatctttaatcagcagcaccaatacaaagaccacttctgcaaatacagaggagatcattgagggtaatagcgtcgattccagtatccagcaggtgatgggctccgggggacagcgcgtcataaccatagtaacagacggagtgcctctaggcaatatccaaaccagtattcccacagggggaattggccaaccctttattgttaccgtacaggacggtcagcaggtccttaccgtgccagcagggaaggtagcagaggagaccgtaattaaggaggaggaggaagagaaactgccattgacaaagaagcctagaatcggagaaaagaccaattccgtcgaagaaagcaaggaaggaaacgagcgcgagctgcttcaacagcagctgcaggaagcaaaccgaagggctcaggagtataggcaccagctgctgaagaaagaacaggaagccgaacaatataggctgaagctagaagcaattgcgcgccagcagcctaacggtgtggatttcactatggtcgaggaggtcgccgaggtggatgctgtagtagtaaccgagggcgaattggaagaacgggaaactaaagtgacaggttccgccggtacaacagaaccccacactagggtgtctatggccacagttagctcttag

SEQ ID NO: 11842 - DNA, 1233 bp, Artificial Sequence
  Description of Artificial Sequence: Synthetic coding sequence
atgtcacttgtagacctggggaagagactgctcgaggctgcccggaaaggacaggatgatgaggtgcgaacgctcatggccaacggagcccccttcaccactgactggctcggcacttcccccctccacttggctgcccagtatggccattacagtactgccgaggtgctgttgcgcgctggcgtcagtagagatgctagaacaaaggtggaccggacgccattacacatggccgctgctgacggccacgcccatattgtggagctgctggtgaggaatggagccgatgtgaatgctaaggatatgttgaagatgaccgctctgcactgggccaccgaacggcatcaccgggacgtggttgaactactgatcaaatacggagctgatgtgcacgccttcagcaagtttgacaagtctgcatttgatatcgccttggaaaaaaataacgctgaaattcttgtgatcctgcaagaggccatgcagaatcaggtcaacgtgaatcccgagcgagctaatcctgttacggaccccgtgtcgatggcagccccctttatatttaccagtggagaggtggtgaacctcgcatcactcatctcctccacaaatactaagacgacttctgcaaacacggaagagattatcgagggtaattctgtggattctagcatacaacaagtcatgggctcaggcggccagcgcgtaatcacaattgtgacggatggcgtgccccttggtaatattcagacaagcattccgacgggggggatcggtcagccttttattgtcactgtgcaggatggacagcaggtgttaacagtacctgccggtaaggtcgcagaagagacagtgatcaaagaagaagaggaggagaaattgcccttgacgaagaaacccagaattggagaaaagactaattccgtggaggagtcaaaggagggcaacgagcgtgagctcttgcaacagcagctccaagaggctaaccggcgggcccaagaatacagacaccagttgttgaaaaaggagcaggaggcggagcagtataggctgaagttggaggcgatcgcccgccagcaacccaatggagttgattttaccatggtcgaagaagtcgcagaggtggacgcagttgtagtgaccgagggcgagctcgaggaacgggagactaaggttacaggctcagcgggcactactgaaccccacacccgtgtctcgatggccaccgtgagctcttag

SEQ ID NO: 11843 - DNA, 1347 bp, Artificial Sequence
  Description of Artificial Sequence: Synthetic coding sequence
atgagcctcgttgatctggggaaaaggttgttggaggcagctcgcaaaggacaggacgatgaagtgcggacacttatggccaatggagcgcccttcaccacagattggctgggcaccagccccctccatctggccgcacaatatgggcattatagcacagccgaagtgctgctgcgggccggggtgagccgcgacgcccgtacaaaagtagataggacaccactacatatggccgctgccgacgggcacgcacatatcgtggagctactggtgcgaaacggggcggatgtcaatgccaaggacatgctaaaaatgactgcactgcactgggcaacagagagacatcacagagacgtagtggaactgctcatcaaatatggtgcggatgtccacgcctttagcaaattcgacaaaagtgcctttgatattgcgctggaaaaaaacaacgccgaaatattggtcattctgcaagaggcaatgcaaaatcaggtaaacgttaatcctgaaagggccaaccccgtcaccgaccctgtgagcatggccgcgcccttcatattcacaagtggagaggtggtgaatctcgcaagcttgatcagctccaccaatactaaaactacaagcggcgacccgcacgcttccactgtccaattttctaactccactacctccgtcctggccaccctcgctgctttagccgaagctagtgtgccactgtcaaactctcaccgggcaaccgccaacaccgaagagataattgaagggaattccgtcgattcgagtatccagcaggttatgggtagcggtggccagagggtcattaccatagtgactgacggggtcccgctggggaatatccagacctcaatccccactggcggtattggtcagccctttatcgtgaccgtgcaggatgggcagcaggtgctcacagtgcctgccggcaaggtcgcggaagaaacagttattaaggaagaggaagaagagaagctgcctttgacgaagaaaccacgaatcggagagaagacgaactcagtggaagagtccaaggaagggaatgaaagagagctgttgcagcaacagctgcaggaggctaaccggcgcgcgcaggagtacaggcaccaattactgaaaaaagaacaggaggcagagcagtaccgattgaaattggaagccatcgcgaggcagcagcctaacggggtggatttcactatggtggaggaggtcgctgaagtggatgcagtagtggtgactgaaggagagctggaggagcgggaaactaaagtgacagggtcggcggggactactgaacctcatactcgagtgagcatggcgaccgtgagtagctag

SEQ ID NO: 11844 - DNA, 1188 bp, Artificial Sequence
  Description of Artificial Sequence: Synthetic coding sequence
atgagcctggtggaccttggaaagcggctgctggaggccgcgcgcaaagggcaggacgacgaagtcagaacactcatggcaaacggagctccattcaccactgattggtttagcaaactcagagtgtcctgtggatatatcggggacaattgcaagctgggcacaagccctttgcatctggccgcccagtatgggcattacagcaccgccgaggtgttgctcagagccggtgtctcccgagatgccaggacaaaggtggaccgaaccccattacatatggctgctgctgacggccacgctcatattgtggagcttctggtgcgaaacggtgccgacgtgaacgcaaaggacatgctcaagatgactgctttgcactgggccacagagaggcaccacagagatgtggtggagttgttaatcaaatatggggccgatgtgcacgctttttctaagttcgataagagcgctttcgatattgcgctggaaaaaaacaacgcggagattctggtaatcctgcaggaggccatgcaaaaccaggtcaacgtgaatcccgagcgggcaaacccggttaccgacccagtatctatggctgctcctttcattttcacctctggtgaagtggtaaacctggcctctctcatcagttctaccaacaccaaaactacatcaggggaccctcacgcttcaaccgtgcagttctctaacagcaccacatccgttctcgcaacactggctgcgctagccgaggcttctgtgcccttgtcgaatagccacagggcaactgctaacaccgaggaaactgtaattaaagaagaagaggaggaaaagctccctttaacaaagaagccgagaatcggggagaaaactaacagcgtcgaagagagcaaggaaggtaatgaaagagagcttttgcaacagcagctgcaggaagccaatcgacgggctcaggagtatagacatcaactgcttaagaaagagcaggaagcagagcagtatagactcaagcttgaggcaattgctcgccagcagcccaatggcgttgatttcacaatggtagaggaagtggccgaggtggatgccgtggtggtgactgaaggcgaattggaagagcgtgagaccaaagtaaccggatcagcagggacaaccgagccacatactagggttagtatggcaactgtcagtagctag

SEQ ID NO: 11845 - DNA, 1827 bp, Artificial Sequence
  Description of Artificial Sequence: Synthetic coding sequence
atgactgaggaagcatgtaggacgcggagccagaagcgagccctcgagcgggaccccacggaggacgatgtggaatccaaaaagatcaagatggagcggggccttttagcaagtgatctcaacacggatggtgacatgagagtcacccccgaacctggagcaggtccaacccagggcctgcttagagctaccgaggcgaccgctatggcgatgggccgaggggaaggcttggtgggggacggacccgtggatatgcgaacttctcactctgacatgaagtccgagaggcgcccacccagccccgacgtcattgttttgtcagacaacgagcaaccaagcagtccccgcgttaacggtctgaccacagtggccctgaaagaaacctcgaccgaagcccttatgaaatcaagccccgaagagcgggagcggatgatcaaacaactgaaagaagagctgcgccttgaggaggcaaagcttgtcctgctgaagaagctcagacagagccagatccagaaagaagctaccgctcagaagcctacgggctccgtcgggagcactgtgacaactcctcctccgcttgtgcggggtactcagaacatcccagcaggcaagcccagcctccagacatcatcagctagaatgcctggctctgtgattcctccacccctggtgcgaggcgggcagcaagcctctagcaagctcggtccacaggcctctagccaggtggtgatgccaccactcgtacggggcgcccagcagatccacagtatcaggcagcacagttctactggaccccctcccctgttactggctccccgtgccagcgtgccatccgttcagatccagggccagcgaataatacaacaaggcctgatcagggtagctaacgtgccaaacactagtctgctggtcaacattccacagccaactccagcctcgctgaagggtactaccgccaccagcgctcaggccaatagcacccctacctcggtagcttccgtcgtgaccagcgccgagagccctgcttcaaggcaggcagcagctaagttagcgctcaggaaacagctggagaagaccctgctcgagattcctccaccaaagccacctgctccagaaatgaatttcttgccctccgcggccaacaacgaattcatatatctggtcgggctcgaggaagtggtacagaatctcttagagactcaggggcgcatgtccgctgccactgttctgtccagagagccctacatgtgtgctcaatgtaagactgatttcacctgccggtggagagaggaaaaatccggcgcgataatgtgcgagaactgtatgaccacaaatcagaagaaggcattgaaagtcgagcacacttcacggctgaaggcggcctttgtgaaggcgctgcagcaagaacaggaaatcgagcagcgcctgctgcagcagggcacagctcctgcccaagccaaggctgaaccgaccgctgcccctcatccagtgctgaaacaggcatcctcccaattaagcaggggctccgccactacaccacgtggagttctccatacttttagcccgagtccaaagctgcagaacagcgcgtcggcaacagctctggtaagccgaacaggaaggcactcagaaaggacagtgtcagccggtaaaggctcggccaccagtaattggaagaaaacacctcttagcactgggggaacccttgcattcgtgtcccccagcctggcggtgcacaagtccagttccgctgtcgatcgacagagggagtatctgctggacatgatcccacctcggagcatcccacagtccgcaacctggaaatag

SEQ ID NO: 11846 - DNA, 1902 bp, Artificial Sequence
  Description of Artificial Sequence: Synthetic coding sequence
atgacggaggaggcatgtcggacccgcagccagaaacgagctttagaaagagaccccacggaagatgacgtagagagcaaaaaaattaaaatggaaagagggcttctggccagcgacctgaatacagacggcgatatgcgagtcacgccggaacccggagccggaccaacacagggcctccttcgagcaaccgaggctacagccatggccatggggcgcggcgaaggattggtaggggacggacccgtcgacatgcgcacctcacactctgatatgaaatctgaacggaggccccccagcccggatgtcatcgttctctccgacaacgagcagccctcaagccctagagtgaatgggctcacaaccgtggcactgaaagagacttccacagaggctctgatgaagagtagcccggaggagcgggagcgaatgatcaagcagcttaaggaggaactgaggctggaagaggccaagctagtcctcctgaagaagttgaggcagtcccaaatccagaaagaggccactgctcaaaaacctaccggctctgtggggtcaacagtgacaactcctccgcctctcgtgcgaggcacacagaatatacccgccggtaagcccagcctgcagacaagtagtgctcgaatgccaggatcggtgattcccccacccctcgtgcgcggtggtcagcaggcaagtagcaagctggggccacaggcctcatcccaagttgtgatgcctcccctagtgcggggtgcccagcaaatacactctatacgtcaacactctagcacggggcctccacccctactcctggctcctagagcgagtgtcccttcagtacagatacaagggcagagaatcatccaacagggacttatacgtgtggctaacgtccctaacaccagcctgctggtgaatatacctcagccgactcctgcctctctcaaggggaccaccgcaacatctgcccaggctaatagtacccccacctccgtcgcctccgtagtgacaagcgcggagagccctgcttctagacaggccgcggccaaattggcattgagaaagcaactggaaaagacacttctcgaaatcccccccccaaagccaccggcccccgaaatgaacttcttgcctagcgcagccaacaacgagttcatttatcttgtggggctggaggaagtggtgcaaaacctgctcgagacccagggcagaatgtcggcagccaccgtgctttcaagagagccctacatgtgcgcacagtgtaagaccgattttacttgccggtggcgagaggagaaatccggtgctataatgtgcgagaactgcatgactacaaaccaaaagaaagcactgaaagtggagcatacatcacgtcttaaggccgcattcgtaaaggcactgcagcaagagcaggaaatagagcaacgcctgctccagcagggaaccgctcctgcgcaggctaaggcagagcccacagccgccccgcacccagtcctgaagcaggttatcaaacctcgccggaagctagccttccggagcggggaagcccgtgattggtccaacggtgctgtcctgcaggccagcagtcagctctcccgcggcagtgcaactacacccagaggggtgctgcatactttctccccctctcctaagctgcagaacagcgccagtgcgactgcgctggttagccggacaggccggcactccgagcgcactgtttccgcagggaaaggctctgctaccagcaattggaaaaagacacctttatctacaggtgggactcttgccttcgtctccccgagccttgctgtgcacaaaagcagcagtgcggtggaccgacaacgcgaatacctcctggacatgatccccccaagatctattccacagtcagcaacctggaagtag

SEQ ID NO: 11847 - DNA, 1902 bp, Artificial Sequence
  Description of Artificial Sequence: Synthetic coding sequence
atgactgaggaggcttgtagaacacggtcccagaagagggccctcgaacgcgacccaacggaggacgatgtcgaatccaagaaaattaagatggagcgaggcttgttggcaagcgatctaaatacagatggggatatgcgtgttacaccagagccaggagcagggcccacacagggcctcttacgcgccacggaggccaccgcgatggcaatgggaaggggggaggggctggtaggggacggacccgtggacatgcggacatcccactccgatatgaaatccgagaggcggccccccagtccagatgtgattgtgctttcggataatgagcagcctagcagcccgcgcgtgaatggcctgaccaccgtggcccttaaagagacctccactgaagctcttatgaagagtagcccggaggagcgcgaaagaatgattaaacagctaaaagaggaactgcggcttgaagaagctaagttggtgttgttaaagaaactgcgtcaatcccagatccagaaggaagctaccgcacagaagcccactggcagtgtcggttctacggtgaccacccccccgcccctggtcaggggtacccaaaatattcctgcggggaagccgtctctgcaaacatcctctgccaggatgcccgggagcgtaatcccccccccacttgtgcggggcggacagcaagcaagcagcaaactgggcccccaggcttcttcacaagtggtaatgccacctctggtccggggcgcccaacagatacactcgatcaggcaacatagcagtacgggaccaccaccactgctgttggctcccagggccagcgtccctagtgtccaaattcagggccagcggattatccagcagggtctgatccgggttgccaatgtgcccaatacgtctctcctcgtgaacatcccacagccaactcccgcaagcctcaaaggcacaactgcaacttcagcccaggccaactcgacacccacaagtgtcgccagtgtggtgacttctgccgagtcccctgcctcccgacaggcagccgccaagctcgccctgcgcaagcagttagagaagaccctcctagaaatcccaccgcccaaaccaccagctccggaaatgaatttcctcccctccgcggcaaacaacgaattcatctacctggtcggactcgaagaagtggtccagaacttactggagacccagggcagaatgtccgccgctactgttttgtcaagggagccatatatgtgtgcacagtgtaagacagatttcacctgccgatggcgcgaagagaagagtggcgcaataatgtgcgagaactgtatgacgacaaaccagaaaaaggcccttaaggtcgagcacactagccgacttaaagcggccttcgttaaggctctacaacaggaacaggagatcgagcagaggctcctgcagcagggaacggcccctgctcaggctaaggcagagccaaccgctgctccccatccagtgcttaaacaggtgattaaacctagaagaaaattagcctttcggagtggggaagccagagactggagcaacggggctgtattgcaggcctccagccagctatctcgcgggtctgcaacaacccctcggggggtgctacatacattctcgcctagcccaaaactccaaaactctgcgagcgctactgccctggtgtctagaactggccgccattcagagcggacagtgtcagcgggaaaaggtagcgccacgtctaattggaagaagacgccgctgtccactggaggaacactcgcttttgtctcaccctctctcgccgttcacaaatctagcagcgctgttgacaggcagcgagagtatctcctggatatgattccccctcgtagcattccccaatcagctacttggaagtag

SEQ ID NO: 11848 - DNA, 534 bp, Artificial Sequence
  Description of Artificial Sequence: Synthetic coding sequence
atgacagaagaggcatgcagaacacgcagccaaaaacgggctctggagcgagatccgaccgaggacgatgttgagtcgaaaaaaattaagatggaaagaggtctactcgccagtgacctcaatacagacggagatatgagggtgacacctgaacccggcgccggccctactcagggcctcctccgagctaccgaggccactgccatggccatgggcagaggtgaagggctggtgggggatggcccagttgatatgcgcacctcccattctgacatgaagagcgagcgtcggccacctagtcccgacgtcatcgtgttatcagataacgagcagccctcctcacctagggtcaacggcctcaccaccgtggcgcttaaagagaccagcacagaagccttgatgaagagcagcccagaagagcgcgagagaatgattaagcagctgaaagaagaactgcggctcgaagaagccaagctggtgctcctgaaaaagctgcggcagtcccagatccagaaggaggccacagcccagtag

SEQ ID NO: 11849 - DNA, 381 bp, Artificial Sequence
  Description of Artificial Sequence: Synthetic coding sequence
atgactgaggaggcctgcaggactcgctcacagaaacgcgcgcttgagcgtgatccaacggaggatgacgttgaatccaaaaagattaaaatggagaggggtctgcttgcttctgacttaaacacagatggtgacatgagagtgacacccgaacccggcgcaggtccaacgcaaggcctgttgcgggccacagaagcgaccgctatggccatgggaaggggagagggcctggtgggcgacgggcccgttgatatgagaacttcacacagcgacatgaagagcgaacggcgcccacctagtccagatgtgatagttctgagtgacaacgaacagccttccagtcccagggtgaatgggctgaccacagtggcattgaagtag

SEQ ID NO: 11850 - DNA, 1311 bp, Artificial Sequence
  Description of Artificial Sequence: Synthetic coding sequence
atgattaaacaacttaaggaagagcttcgattagaagaggcaaagctggtactgctcaagaaactgagacagtcacagatccagaaagaggccaccgcgcagaaaacatcgtccgcccgcatgcccggaagcgtcataccaccacccctggtgcgcggcggacaacaggcctcatcaaaattgggacctcaagcctctagccaggtggtcatgccccccctggtcagaggcgcccaacaaatccattccatacggcagcacagcagcacagggcctccccctctacttctcgcccctagagccagcgtcccatccgtgcaaattcaagggcagcgcattattcagcaggggctgatcagggtcgctaacgtgcctaatacatccctactcgtcaatataccccagcccacacccgcctctcttaagggaaccacagccacgtcagctcaggccaatagcacgccaaccagcgtggccagtgttgtcacgtctgcagaatcccctgcatcccgacaggccgcagccaaactcgctctgaggaagcagctggagaagacactcctagagatcccgccgccaaagccccccgctccagagatgaactttctgccctccgctgcaaataatgagtttatctacctcgtggggctagaagaagtggtccagaaccttctcgagacccaagctggccgtatgtccgctgccaccgtgctgtcaagagagccatacatgtgtgcacagtgtaagaccgattttacatgccggtggagagaggaaaagtccggcgcgataatgtgtgaaaattgtatgaccactaatcagaaaaaggctcttaaagtggagcacacaagtagacttaaggcagcctttgtgaaagccctccagcaggagcaggagattgaacagcggctgctccagcaggggactgccccagcccaagccaaggctgagcccaccgcagcccctcatcccgtgctcaagcaggcatcatcccagctcagtcggggttctgcaactactcccaggggggtgctccatacattctcgcccagccccaagttacagaattccgcctctgccacggcattggtatcgagaacaggcaggcactcagagaggacagtttccgctggcaaaggctccgccacctctaactggaagaaaacccccctaagcaccggaggaacattggcattcgtcagcccatcccttgcggtccataagtcctcatctgccgtggatcgccagcgagagtacttgttggacatgatacctccccggagtattccacagagcgctacatggaaatag

SEQ ID NO: 11851 - DNA, 420 bp, Artificial Sequence
  Description of Artificial Sequence: Synthetic coding sequence
atgactgaagaggcatgtcggactagaagtcaaaagcgcgctcttgagagggaccccacggaggacgacgtggagtccaagaagatcaaaatggagaggggtcttcttgcaagcgatctgaataccgatggagacatgcgggtaaccccggaaccaggtgcaggtcccacacaaggcctgctacgggccacagaggctacagcgatggccatgggacggggcgaaggattggtgggggacggcccggtcgacatgagaacaagccactccgacatgaagagcgagcgtcgaccgcctagcccggacgtcatagttctatctgacaacgagcagccttcaagcccgcgtgtgaatgggctcacaactgtggcattgaaggagacctcaaccgaggccctcatgaagtcttccccagaatag

SEQ ID NO: 11852 - DNA, 282 bp, Artificial Sequence
  Description of Artificial Sequence: Synthetic coding sequence
atgactgaggaggcttgcagaaccagatcccagaagcgcgcactagagcgcgatccaaccgaagacgatgtggagtccaagaagatcaagatggagagaggccttctcgcgtctgatctgaatacagatggggacatgcgggtcactcccgagccaggagccgggcccacgcagggtctactgagggccactgaagccaccgcaatggccatgggtagaggagagggtctggtgggcgatggccccgttgacatgagaacaagccacagtgacatgaagtag

SEQ ID NO: 11853 - DNA, 57 bp, Artificial Sequence
  Description of Artificial Sequence: Synthetic coding sequence
atgtcactttggccttggccaactggaaggacctccacgccttacccagaagcttag

SEQ ID NO: 11854 - DNA, 507 bp, Artificial Sequence
  Description of Artificial Sequence: Synthetic coding sequence
atgaccgaagaggcctgccgcacccgatctcagaaaagagcccttgaaagagatcccactgaagacgatgtggaaagcaaaaagataaaaatggaaaggggactcctcgcttcagacttgaatactgacggtgatatgagggtaactccggagccaggcgcaggacctacccaggggctgctaagggctacggaagctactgctatggcgatggggcgcggagaaggactggttggggatggacctgtggatatgcgtacaagccatagcgatatgaaaagtgagagacggcccccatccccagatgtgatagtcttgagcgataatgagcagccctcctctccgcgggtaaacggactgacgaccgtcgccttgaaagaaacgagcaccgaggctcttatgaaaagcagtcctgaagagcgggagcgcatgatcaaacagctgaaggaggaattgcgtttggaagaggccaaactggtcctgttaaaaaaattgcgccagtcatag

SEQ ID NO: 11855 - DNA, 789 bp, Artificial Sequence
  Description of Artificial Sequence: Synthetic coding sequence
atgaactttctcccctctgctgctaataacgaattcatttatctggtgggcctggaggaagttgttcagaatctcctggaaactcaggcaggccgcatgtccgctgcaacagtgttgagcagggaaccatatatgtgtgcccagtgcaagactgacttcacctgtcgatggcgagaggagaagagcggcgcaatcatgtgcgagaactgtatgaccaccaaccagaaaaaggccttaaaagtcgagcatacgtcccgacttaaggctgctttcgttaaggccctgcaacaggagcaggaaatcgagcagagactgttacagcagggcaccgcacctgcccaggctaaggcagaaccgacagctgcccctcaccccgtcctgaaacaggtgataaagcctaggcgcaaactggccttccggtccggcgaagcccgcgattggtctaacggcgcagttctgcaagcgtcctcccagctttcacgcggcagcgctactacacctaggggtgtgctgcatacatttagcccatctcctaaactgcaaaattctgctagtgccactgctttagtgtccaggacaggtcggcacagtgagaggacagtctccgccggtaaaggatcagctactagcaattggaagaagacacccctcagtaccggaggcacgttggctttcgttagtccttcccttgccgtgcacaagagctccagtgcagtagaccgacagagagagtacttgcttgacatgatccccccccgctctattccgcagagcgcaacatggaagtag

SEQ ID NO: 11856 - DNA, 1782 bp, Artificial Sequence
  Description of Artificial Sequence: Synthetic coding sequence
atggacagaatgaccgaggacgccttgagactgaatctgctgaagcggtcccttgaccccgccgacgagagagacgatgttctcgccaagcgcctgaaaatggagggacacgaagctatggagcgtctgaaaatgttggcactcctcaaacggaaggacttagccaacttggaagtgccgcacgagcttcccacaaagcaggatggtagcggagtgaaaggctatgaggagaaacttaacggcaatctgaggccacatggagacaacagaacggctggacgccccgggaaagaaaacatcaatgacgaacctgtggatatgtccgcccgccggagcgagcccgaacgcgggcggctcaccccatcccctgacatcatagttctctcagacaacgaagcgtcctctcccaggagtagcagtcgcatggaggaacggctaaaagccgctaacctggagatgtttaaaggaaagggtattgaggagcgtcagcagctcattaaacaactgcgagatgaattgcggttagaagaggcccgacttgtgctgttgaagaagctgagacaatcccagctgcagaaggaaaacgtggtgcaaaaaacccctgtggtacagaatgctgcttctatcgtgcaaccatcacctgcacacgtcggccaacaggggctcagcaagctccctagtcgaccaggcgcacaaggcgtcgaaccgcaaaacctgcgtactctgcagggacacagtgtcattaggagcgctaccaataccaccttgccccatatgcttatgtcacagagagtgatagctcctaatcccgctcagctgcaggggcagcgaggtcctcccaagccaggactcgtgcgaacaaccacacccaatatgaacccagccatcaactaccagcctcaaagtagcagctctgtgccatgccaacggactacgagtagcgcaatctacatgaaccttgccagccatattcagcccgggacagtgaatcgggtgtcaagtccattgcccagcccaagtgccatgacagacgccgccaactcccaggctgcggcaaagctggccctccggaagcagttagagaaaacactgctggaaattccccctcctaagcccccggcacctctgcttcactttctaccctcagcggccaatagtgagtttatatacatggtcggattggaagaggttgtgcaatctgtcatcgattcccaggggaagagctgtgcctccctgctcagggtagaaccttttgtatgcgctcagtgccggacagactttacgcctcattggaaacaggaaaaaaacggcaaaattctttgtgagcagtgcatgacatctaaccagaaaaaagcacttaaagcagagcacacaaataggttgaagaatgcattcgtgaaggccctccagcaagagcaggagatcgagcagcgtctgcagcagcaggccgccttgagcccaacaaccgcccccgctgtcagcagcgtttcgaaacaggaaacaatcatgaggcaccatactctgcgccaagctccccagccccagtcctcccttcagagagggattcctacaagtgccagaagtatgttgtctaactttgcacaggcccctcagctaagtgtgcctggcggcctgcttggcatgccaggagtgaatatagcctacctaaacacaggcattgggggacataagggcccatccctggcagatcggcagcgggagtacctgctggatatgatccctccccgtagcatttcgcagtcgatctccgggcagaaatag

SEQ ID NO: 11857 - DNA, 1425 bp, Artificial Sequence
  Description of Artificial Sequence: Synthetic coding sequence
atggcacagcatgattttgttccagcttggttgaacttttcaaccccacagagcgccaagtcccccacggcaactttcgagaagcacggggagcacttgcctcgaggggaggggagattcggagtgtccagaaggagacacaactctagcgacggctttttcaacaacggccccctgaggaccgccggcgattcatggcaccaaccctctctctttcgacacgactccgtggacagcggagtctcgaaaggcgcttatgccggcatcaccgggaacccttctggctggcacagcagttcaagggggcatgacggaatgtcccagcggtcggggggtggtactggtaaccaccgccattggaacggcagctttcacagtcgcaaaggctgtgcttttcaggaaaaaccacctatggagattcgcgaggaaaagaaggaggacaaggtggaaaagttgcagttcgaggaggaggatttccccagcttgaatcctgaggcgggaaagcagcatcagccttgtcgcccgatagggacaccgagtggggtgtgggagaatcccccaagcgccaaacagccttctaagatgttggtgatcaagaaagtgagtaaggaagatccggccgctgcattttctgcggcctttacctcccctggctcgcatcacgccaacgggaacaagctttcttctgtggtgcccagcgtgtataagaacctggtcccaaaacctgtccctccacccagcaagcctaatgcttggaaagccaatcggatggagcataaatcagggtccctgagctcatctagagaatccgcctttacttcgccaatctccgttacaaagcctgtagtgttggcttctggtgccgctttatctagccccaaggagtctccttcttcaacaacaccaccgatcgagataagtagctctcggctcacaaaactaacgcgccgcacaactgatcggaaaagtgagtttctcaaaacactcaaggacgacaggaacggtgatttttccgaaaatagagattgcgataagttggaggacctcgaagacaattccaccccagaacccaaagagaacggagaagaagggtgtcaccagaatgggttggccctgcccgtcgtcgaggagggcgaagtgctgtcccacagcctggaagccgagcataggctgctcaaggcaatgggctggcaggagtaccctgagaatgacgaaaactgcctgcccctaacagaggatgagctcaaggagtttcatatgaagacggagcagctccggcggaatgggtttggaaagaatggtttcttgcaatcacggtcaagctccctgttcagtccatggcgatcaacatgcaaggccgagtttgaggattctgatacagagacgagttctagcgaaacatccgatgacgatgcctggaagtag

SEQ ID NO: 11858 - DNA, 1425 bp, Artificial Sequence
  Description of Artificial Sequence: Synthetic coding sequence
atggcacagcatgactttgttccagcatggcttaatttttccacgcctcagtcagccaaaagcccaaccgcaactttcgagaagcacggtgagcacctgcccaggggtgaaggtcgtttcggagtatctcggcggagacacaactctagcgatggttttttcaacaatgggccattgcgcaccgccggggacagttggcatcagccttcattgtttagacacgattctgtcgattcgggagtcagtaagggcgcctacgccggcatcaccggcaacccaagcggctggcactcttcatcgagaggacacgatgggatgtctcagagatctgggggagggactggcaaccaccgacattggaatggatcctttcacagccgaaaaggatgtgcgttccaggagaaaccacctatggaaatccgagaggaaaaaaaagaagataaagtggaaaagctccaattcgaggaagaagattttccaagtcttaatccagaagcaggcaaacagcatcagccctgccgacccatagggacacccagcggggtatgggagaatcctcctagcgccaaacagccatccaagatgttggtaatcaaaaaggtgtcaaaagaagaccccgcagccgccttttctgcagcctttactagcccgggctcccaccacgccaacgggaataagttgagctctgttgtgcccagcgtctataaaaacctggtgcctaaaccagtccctcccccttcaaaacccaacgcctggaaggccaacaggatggaacataagtctggcagtctcagcagcagtcgagagtccgcattcacgtccccgatttcagtgaccaaaccagtggtgctggctagcggagccgctctgtcttcccccaaggaaagtccgtcatccaccacacctcctattgagataagttctagcagattaacaaaattaacccgaagaactaccgatcgcaaatctgaattccttaaaactctgaaagatgacaggaacggcgatttttccgagaatagagattgtgacaaattggaagacctggaagataactctacgcccgaacctaaagagaatggggaggaggggtgtcaccagaatggactggctctcccagttgttgaggagggggaagtgctgtcacattccttggaggctgagcatcggcttcttaaagccatgggttggcaggagtatcctgagaatgacgagaattgcctccctctgaccgaggacgagctcaaggagttccatatgaaaaccgaacagctgcggagaaatgggttcggaaagaacgggtttctccagtctagatcctccagcctgttcagcccctggcgcagcacctgtaaagccgaatttgaagactccgacactgagacctctagcagcgagacctccgatgatgacgcctggaagtag

SEQ ID NO: 11859 - DNA, 2448 bp, Artificial Sequence
  Description of Artificial Sequence: Synthetic coding sequence
atgttccggaaagcgagaagagtcaatgtaagaaagcggaacgattctgaagaggaggagagagaaagggacgaggagcaggaaccacctcccctcctgcctcctcccgggaccggggaagaggcagggccgggggggggggaccgtgcccctggcggggagtcccttctgggtcccggcccctccccacccagtgccctcacacctggcctgggagccgaggcaggaggcggttttcccggtggcgccgaacccggcaatggcttgaaacctcgaaaaaggccccgcgagaacaaagaggtgcccagggcttccttactgtcctttcaggacgaagaagaggagaacgaagaggtttttaaggtcaagaaatcttcctatagtaaaaaaatagtgaaactgttgaagaaggagtataaagaggatctggagaaaagcaagattaagaccgaactgaattccagtgcagagtcggaacaacctttagacaaaaccggccacgtgaaagacaccaaccaggaagatggcgtcatcatctctgagcacggcgaagacgaaatggacatggagtcagaaaaagaggaggaaaagcctaaaactgggggggctttcagcaatgccttatccagcctcaacgtgcttcggcctggcgaaatccccgatgccgctttcattcatgccgctcggaaaaaaagacagatggcaagggaactcggggatttcaccccccatgataatgaaccaggcaagggtaggctagtcagagaagacgagaatgatgcctcagatgatgaggacgacgacgagaagcggagaatcgttttctcagtaaaagagaagtcccaaaggcagaagatagcggaggagatcggcatcgagggaagcgatgacgacgccctcgttacaggggagcaggacgaggagctgtctcgctgggaacaagagcagatccggaaggggattaacattcctcaggttcaagctagccagcccgccgaagtgaacatgtattaccagaacacttatcaaactatgccctacggtagtagctatggaatcccctattcctatacagcctatggctcctcggatgccaaatcacagaaaaccgacaatacagtccctttcaaaacgccttccaacgaaatgacaccagttacaattgacctcgtaaagaagcaactgaaggatcgactcgactctatgaaagaattacataagactaaccgtcagcaacatgagaaacatctgcaaagtcgggtagatagtacacgagctatcgaaagactggagggttccagtgggggaatcggcgagcggtacaaatttctacaggaaatgcgggggtatgtgcaagacctgttagaatgtttttcagagaaggttcccctcatcaacgaactggagagtgctatacaccagctgtataaacagcgtgcctcccgactagtgcagcggagacaggacgacatcaaggatgagagcagcgagttttcctcacacagcaacaaagctctgatggccccaaacctggatagctttggcagagatcgcgcgttgtatcaagagcacgcaaaacgccgcatagccgaacgcgaggccagacgcacaaggagaaggcaggcaagagaacagactggaaagatggccgatcaccttgagggcctttccagtgatgatgaagagacctctaccgatatcactaatttcaatctcgagaaggacaggattagcaaggaatccgggaaagtgttcgaagacgtgctcgaatccttttattccatagattgtatcaagtctcaattcgaagcttggcgctccaagtactatacctcttataaagacgcatacatcggactatgtctgccaaagctgtttaacccgcttattcgcttgcagcttctgacctggacccccctggaggccaagtgccgggatttcgaaaatatgctgtggtttgaaagcctgttattctatgggtgtgaggagcgcgaacaggagaaagacgacgtggacgtggcattactacctacgattgtggaaaaagttatcctcccgaagttaactgtgatcgccgaaaacatgtgggatcccttctccactacgcagacgtcacgtatggtcgggattacgttaaagctcatcaacggatacccgtctgtggtcaacgcagagaacaaaaacacacaggtgtatcttaaggcccttctgcttcggatgagacgaactcttgacgacgacgtctttatgcccttgtacccaaaaaacgtgctcgaaaacaaaaacagtggaccctatctgttcttccagcgccagttttggtcctcggttaaggtgataaaacctcctttccagcgggggtcatgtcccatacctaggcggaaggaatgttgcagcgagcgtccgcggcggatatggactgatcgcccctgtgttgtgttctcatag

SEQ ID NO: 11860 - DNA, 2754 bp, Artificial Sequence
  Description of Artificial Sequence: Synthetic coding sequence
atgttcagaaaggcaaggcgggtgaacgtaaggaaacggaatgacagcgaggaggaagagcgagaaagggatgaagagcaggaacccccccctctgctaccccctcccggcacaggcgaggaggccggtcccggcggcggggatcgagcgccaggtggagaatctctattgggccccggcccgagcccgccgagtgccttgacaccagggttgggagcagaggctggtggtggtttccctggtggagccgagccaggcaacggcttaaaacctcgaaagcggccccgcgaaaacaaagaggtgccaagggcttccctcctatctttccaagatgaagaggaagaaaatgaagaggtgtttaaggtgaagaaaagcagctattctaagaaaatcgttaaacttcttaagaaggaatacaaagaggacctcgagaagtccaagattaagaccgagttaaatagctcagccgagagtgagcaacccttggacaagactggccacgttaaagatacaaaccaggaggacggagtgatcatctccgaacacggcgaagacgagatggatatggaaagcgaaaaggaagaagagaagcccaaaactggaggggccttcagtaacgccctctcttccctgaatgtccttcgccctggggaaatcccagacgctgcctttatccacgctgccaggaaaaagaggcagatggcgcgggagctgggagattttaccccccatgacaatgaaccaggtaaaggacgcctggtgagggaggacgagaatgacgcttctgacgacgaggacgatgatgaaaagcggagaatcgtattcagtgtgaaggaaaaatcacagcgtcagaagatcgcagaggagattggcattgaggggtcagatgacgacgccctggtcaccggcgaacaggatgaagagctctcaaggtgggagcaagagcagatcagaaaggggatcaacataccccaggtgcaggcctcacagccagcggaagtcaatatgtattaccagaacacctaccagactatgccatatggctctagttatggaatcccttacagctatacagcttatggaagctccgatgcaaagagccagaagacagataacactgtgccctttaaaaccccgagcaacgaaatgactccagtcaccattgaccttgtgaagaagcagctgaaagaccggctggattctatgaaggaacttcacaaaaccaaccgccagcagcatgagaaacatttacagtctagagtagacagtacaagagctatcgagcgactggagggatcatcaggcgggatcggggagcgctacaagttcttgcaagagatgagaggttatgtccaagatctgctcgagtgtttcagcgagaaggtgcccctcatcaacgaactcgaaagcgccatacatcagctttataagcaaagagcttctcgtcttgtgcagcgcagacaggacgacatcaaagatgaatccagcgagttctcatcccatagcaataaggcccttatggctcctaatctagatagttttggcagggatagagcgttgtatcaggagcacgctaaacggagaattgccgaaagagaggcaagaagaacccgaagacgacaggcacgagaacagacaggcaagatggccgaccatcttgaggggctatcgtccgacgatgaggaaacttcaacagatattactaatttcaacctcgaaaaggaccggataagcaaggagagcggtaaggtatttgaagacgtactggagagtttttacagcatcgattgtatcaagagccagtttgaggcatggagaagtaagtattatactagctataaggatgcatacataggcctctgcctaccaaaattgttcaaccctttgatcaggctccagctcttaacctggactcctctggaggctaagtgcagggatttcgaaaatatgctttggtttgagtcactgctgttttacggctgtgaagagagagagcaggaaaaggacgatgtcgatgtagccttacttcctactatcgttgagaaagtcattctgccaaaactgacagtcattgcagaaaatatgtgggatcctttcagtactacgcagacaagcaggatggtgggcatcacactgaagctgatcaatggttatcctagcgtagtaaatgctgaaaataagaatactcaagtgtatctcaaagcccttctcctgcgtatgcgccgaacacttgacgatgacgtcttcatgcccctgtacccaaagaatgtgttggagaataagaattcgggcccatatttatttttccagcgacagttctggtctagtgtgaaactgctgggcaatttccttcagtggtacggcatcttctctaataaaactttgcaggagctttctattgacggacttctcaacaggtacattttaatggctttccagaacagcgaatacggcgacgacagtattaagaaggcacagaacgtgattaactgtttccccaagcaatggtttatgaatctgaaaggggaaaggaccatttcccaattggagaacttttgtcgttatttggttcatctggccgacacgatctaccgcaattccatcggatgttctgatgtggaaaaaaggaacgcccgggaaaacattaaacaaattgtgaaactcctcgcctccgtgagggctctagatcacgccatgtcggttgcaagtgatcacaacgtgaaagagtttaagagcctaatagagggcaaatag

SEQ ID NO: 11861 - DNA, 2346 bp, Artificial Sequence
  Description of Artificial Sequence: Synthetic coding sequence
atggctcaccgtcctaaacggacatttcggcagcgggccgctgattcctccgacagcgatggagccgaggaatcacccgccgaacccggtgccccacgtgaattacctgttcccgggagcgccgaagaagaaccaccatcaggaggaggccgggcacaggttgccggcctgccacatcgtgtgagagggcccagggggagaggcagagtgtgggcatcttccaggcgcgccaccaaagcagccccccgggccgatgagggttccgaatctcgtactctggatgttagcaccgacgaggaagacaagatccatcattccagtgaaagtaaggacgatcaagggctgtctagcgactcttccagcagtctgggtgaaaaggaattgtcctcaaccgtaaaaatccctgatgccgcatttatccaggctgcacggcgaaaacgggaactggctagagctcaggacgattacatcagtctggatgtccagcacacctccagtatcagtggaatgaagagggagtcggaggacgatccagagtcagagccagacgaccacgaaaaaaggatccctttcaccttgaggccacagacccttcgacagagaatggcggaagagtccatctcaagaaatgaggagacgagtgaagaatctcaggaggatgagaaacaggatacctgggagcaacaacagatgagaaaggctgtgaagatcattgaggaacgagacattgatttgtcttgtgggaatggatcatccaaggttaagaagtttgataccagcatctctttcccacccgtgaacctggagatcatcaagaagcaattaaacactcgactcactctgcttcaggaaacccaccgctcgcatctgcgggagtatgaaaaatatgttcaggacgtcaagagctctaaatctacaatccagaatctggaatcctcttcaaatcaggcgttgaactgcaagttttataaatctatgaagatctacgtggagaatttgattgactgcttgaatgaaaagattattaacattcaggagatcgagagcagcatgcacgctctgttgctcaaacaggccatgaccttcatgaaaaggaggcaggacgagctgaagcacgaaagcacgtaccttcagcagttgtcgcgtaaggacgagacttctacaagtgggaatttctcagtcgatgagaaaacccagtggatcctggaggagatcgagagtcgccgcactaagaggagacaagccagggtgttatctggaaactgtaaccatcaagagggcacatccagcgatgatgaacttccttcagccgagatgatagatttccagaagagtcagggagatatacttcagaagcagaagaaagtgttcgaagaggtgcaggacgatttctgcaatatccaaaacattctgctgaaattccagcagtggcgggaaaaattccccgattcttattatgaggcattcatcagcctgtgcatcccaaagctgctcaatcctctcatccgcgtacagttgatcgattggaatccgcttaaactggagtccaccggtctgaaggagatgccatggtttaaatccgtggaagagtttatggacagtagcgtggaggatagcaagaaggaaagcagttccgacaagaaggtgttaagcgccattattaataaaacgattattcctcggctgaccgatttcgtcgagttcttgtgggatccacttagcaccagccagacaacctctttaatcactcactgcagggtgattctggaggagcactcaacgtgcgagaacgaagttagtaagagtcgccaagacctcctgaaaagtattgtgagccgtatgaagaaggccgtggaagatgatgtgtttattccgttgtaccctaaatctgcggtggaaaacaagacctccccacattccaagttccaagaacgacaattctggagcggtctgaagcttttccggaatattcttctgtggaatggcctgcttacagacgatacccttcaggaactgggtcttggcaaactgttaaaccggtatcttattatcgcactgctgaacgccactccaggtcccgacgttgtcaagaagtgtaatcaagtggccgcatgtctccctgagaaatggttcgaaaatagcgccatgcggacgtcaataccgcaactggaaaacttcattcagttcctcctccagtcggcccataaactctctagatcagaattcagagacgaagtcgaagaaatcatcctgattctggtcaagatcaaggctctcaatcaggccgagagctttattggagaacaccatctagatcacctcaaaagcttaatcaaggaggattag

SEQ ID NO: 11862 - DNA, 2232 bp, Artificial Sequence
  Description of Artificial Sequence: Synthetic coding sequence
atggcacatcggccaaaacgcacctttagacagcgtgctgcagactccagcgatagtgacggagccgaggagagtcctgctgaaccaggggccccccgtgaactcccagtccccggcagcgccgaggaggagcctccaagcggcggcggccgggcacaggtcgcaggcctcccccatagagtgagggggccaagggggagaggaagggtgtgggcctcgtctcgcagagctaccaaagctgccccgcgggccgacgagggctctgaatctcgaaccctcgacgtatcgaccgatgaggaggacaaaatacatcacagttcggagtcaaaggacgaccagggcttgagcagcgacagctctagctcccttggtgagaaggaactctctagcacagtcaaaatcccagatgccgccttcatccaggccgcccgccgcaagcgcgagcttgcaagggctcaagacgactatatttcactggatgtccagcacacctcatccatctccgtgagccgcaacgaggagacgtcagaggaaagccaagaagatgaaaagcaggacacatgggaacagcagcagatgaggaaggcagtaaaaatcatagaggagagggacatcgatcttagctgcggcaacggaagcagcaaagtgaaaaagtttgacacaagcattagttttccccccgtaaatctggaaatcatcaagaagcagctgaacacccggctgactttgctccaggaaacgcaccggtcccaccttcgagagtacgagaaatacgtgcaggacgtaaagagcagcaagtcaactatccaaaatctggagagctcttccaatcaggcactgaattgcaaattttataagtcaatgaagatatatgtggagaacctgattgactgtcttaacgagaagattatcaatattcaggagattgagagctccatgcacgccctgctcctgaagcaggctatgactttcatgaagcgacgtcaagatgagttgaagcatgaatccacttacctgcagcagctgagccggaaggacgaaacttccactagcggtaacttctctgttgacgagaagacccagtggatcctggaagaaatagagtcacgaaggacaaagaggcggcaggcccgcgtgctttccggcaactgcaatcaccaagagggcacctcttcagatgatgaactaccgtcagcagaaatgatagatttccagaagtctcaaggagatattctacagaaacagaagaaggtattcgaggaagtacaggatgatttttgtaatattcaaaacatcctgctcaagtttcaacagtggagagagaaattccccgattcatattatgaggccttcattagtctttgtatcccaaaactactcaacccactcatccgggtgcagctcattgactggaaccctctcaagttagagtctactggacttaaggagatgccgtggtttaaatccgtggaggagtttatggactcctctgtagaagactccaaaaaagagagctcgtcagataaaaaggtgctttccgctatcattaataaaaccatcatccctcggttgaccgatttcgtggaatttctctgggatcctttgtccacgagccagacgacctcactcattactcactgtagagttattctggaagagcattctacctgtgagaacgaggtatctaaatcccgccaggacctgcttaagtcgatcgttagccggatgaaaaaagcagtcgaggatgatgtgttcatcccactatacccaaaatctgccgtggagaacaaaacgtccccccacagtaaatttcaggagcgccagttctggtccgggctgaagctgttcagaaacatcctactatggaacggcctacttaccgacgatacccttcaggagctgggcctaggtaaactgctgaaccgctacttgatcatcgcccttctgaacgccactccaggacccgacgttgtgaaaaagtgtaatcaggtggccgcttgcttgcccgagaagtggtttgagaattccgcaatgcgcacttctatcccgcagctggagaacttcattcaatttctgctgcagtcagcacacaagctttccaggtcagaattcagagatgaagtggaagaaatcatcctaattctggtgaaaattaaagcattgaaccaggccgagtctttcattggtgagcatcaccttgatcacctgaagtctctgattaaggaagattag

SEQ ID NO: 11863 - DNA, 765 bp, Artificial Sequence
  Description of Artificial Sequence: Synthetic coding sequence
atggctcaccgtcccaagcggaccttcagacagcgggctgcagatagttctgatagcgacggagccgaggaaagccccgctgaaccaggagcaccacgagagctccccgttccaggttctgccgaggaagaacctccatcaggtggtggccgcgcccaggtcgcaggactgcctcaccgcgttagaggacctagagggcgtggccgggtctgggcctctagcaggagagccacaaaggctgcccctcgtgctgacgaagggtctgaatcccgaaccttggacgtttcaaccgacgaggaggacaaaattcaccactctagtgagtcgaaagacgatcaaggactctccagcgactcctcatcctcgctgggagagaaagaactgagtagcacagttaaaatccccgatgcagcttttatccaggctgcaaggcggaagagggagctcgcgcgcgcccaggacgattacatctctttagacgttcagcacacatcctccatctcaggtatgaagcgcgaatctgaggatgaccccgagagtgagccagacgatcacgagaaacgaatacccttcacgcttcgtccacaaaccctgaggcagcgcatggcagaggagtccatcagccggaatgaagagacaagcgaggagagccaagaggatgaaaagcaagatacctgggagcaacagcagatgcgaaaagccgtgaagattattgagattaacattactaccgggaactctccactcacgccagaaggcgtctag

SEQ ID NO: 11864 - DNA, 504 bp, Artificial Sequence
  Description of Artificial Sequence: Synthetic coding sequence
atgtctgagtggatgaagaagggccccctggaatggcaagattacatctataaggaagtaagagtcactgcatccgaaaaaaacgagtacaaaggttgggtcctgactacagaccctgtatcagccaacatcgtcttggttaatttcctcgaagatggttctatgagtgtgaccggcattatgggccacgccgtccagacggtggagaccatgaatgaaggcgaccatagggtgcgggagaaactgatgcacctcttcacgtccggcgattgtaaggcgtatagcccagaagacctggaagaacgcaagaactctttaaagaaatggctcgaaaagaaccacattccaatcacagagcagggggacgctcctcgaaccctgtgcgtggccggtgtcctgacaatagaccccccgtacgggcctgagaactgttcatcatccaacgagatcatcctcagtcgtgtccaggatttgatcgagggccatcttacagcttcccagtag

SEQ ID NO: 11865 - DNA, 336 bp, Artificial Sequence
  Description of Artificial Sequence: Synthetic coding sequence
atgagtgagtggatgaagaagggccctctagaatggcaagactatatctacaaggaggtgcgggtcactgctagtgagaaaaatgagtataagggttgggttctcaccacagacccagtgtctgcaaaagttcttctttccccacggcttgaatgtagcggagagatttctgctctgtgtaacctacacctggctggttctagtgatagccctgcactcgcaagccgagtggcagggacaaccgggatatgtcaccacgtctggctcatcttcgttttttttgtggagaccggcttaaggcatgtggcacagtactgtccttgtgagctcccatag

SEQ ID NO: 11866 - DNA, 330 bp, Artificial Sequence
  Description of Artificial Sequence: Synthetic coding sequence
atggcctatcagctgtacagaaacacgacgctggggaattccctgcaggaaagcctggatgaattgatccaaagccagcagattacaccccagctggcgctgcaggtgctcctgcaatttgataaggcaatcaatgccgctctcgcccagagagtgcgcaatcgtgtgaactttagaggatctctgaatacttaccggttctgcgataacgtctggactttcgtgttgaacgatgtagaatttcgtgaggtaaccgagctcattaaggttgacaaagtgaaaatcgtggcctgtgacggcaagaacaccgggtctaatactaccgagtag

SEQ ID NO: 11867 - DNA, 330 bp, Artificial Sequence
  Description of Artificial Sequence: Synthetic coding sequence
atggcgtatcagctttaccggaatacgactttaggaaactctttgcaagagtccttagatgaactgatccagtcacagcaaattactccccagctggccctgcaggtgcttctccagtttgacaaagcgattaatgctgcactcgcccagcgagtaagaaacagggtgaatttccggggatcattgaacacttataggttctgcgacaacgtgtggacgtttgtcctgaatgatgtagagttccgcgaggtgacagagctgataaaagtggacaaagttaagatcgtggcttgtgacggtaagaataccggctcgaacaccaccgagtag

SEQ ID NO: 11868 - DNA, 330 bp, Artificial Sequence
  Description of Artificial Sequence: Synthetic coding sequence
atggcctatcagctgtataggaacactaccttaggtaacagcttgcaagaaagtctcgatgaacttatccagagccagcagattactcctcaactggccctacaggttctactgcagtttgacaaggcaatcaacgctgctttagcacagcgagtacggaacagggtcaatttcagaggtagcctcaatacatatcgcttttgcgataatgtttggacctttgtactcaacgatgtggagttcagggaggtaaccgagctgatcaaggtcgataaggtgaagattgtggcttgcgatggcaagaacaccggaagcaacacgacagaatag

SEQ ID NO: 11869 - DNA, 1320 bp, Artificial Sequence
  Description of Artificial Sequence: Synthetic coding sequence
atggccgatcctgacgtcctaaccgaggtgcccgcggcactgaagcggctggcaaaatatgtgattagagggttttatggcatcgaacacgccttggccctggacatacttattagaaactcatgtgtgaaggaagaagacatgcttgaacttcttaaattcgatcggaaacaactgagaagtgtgttgaataacctcaaaggcgacaaattcatcaaatgtagaatgcgagtcgaaacagcagccgatggcaaaacaacaaggcacaattattattttatcaactaccggactttggttaatgtggtgaagtacaagcttgaccacatgcgaagaaggattgaaacagacgagagggatagcactaatcgtgctagttttaagtgccccgtgtgctcctctactttcactgatctagaagctaaccagctgttcgaccccatgactggaactttccgctgcacgttctgtcacactgaggttgaggaagacgagtcagccatgccaaagaaggacgcgagaacactgctcgcccgctttaatgagcagattgaaccaatatacgccctattgcgcgagactgaagacgtcaacctggcctatgaaattctggagcccgaacctacagaaatcccggccctcaagcagtcgaaggaccacgcagccacaaccgccggagcagcctcactggcaggcggccaccatagggaggcgtgggcgactaagggacccagttacgaggacttatacacacaaaacgtggtgatcaacatggatgaccaggaagacctgcaccgcgcgtcccttgagggaaaaagcgcaaaagaacgtcctatatggctaagagagagtacagttcagggcgcttatggcagtgaggatatgaaggagggtgggatcgatatggatgcgttccaggagcgggaagaaggtcacgccggcccggacgataatgaagaggtcatgcgcgccctgctgattcatgagaaaaaaacgtctagcgccatggccggaagcgtgggtgccgctgcccccgtgaccgccgcgaatggctccgatagcgaatctgaaacatccgaatcagacgacgacagtccccctcggccagcagctgtagccgtgcacaagagagaggaagatgaggaggaggatgacgagttcgaagaagtggccgacgatcctattgtgatggtcgctggcaggccattctcttactcagaggtttcccagagacccgaacttgtggctcagatgacacccgaggaaaaggaggcctacattgcaatggggcaacgaatgtttgaggacctgttcgagtag

SEQ ID NO: 11870 - DNA, 150 bp, Artificial Sequence
  Description of Artificial Sequence: Synthetic coding sequence
atggcggaccctgacgtgctcacagaagttcccgctgcactcaagaggctggccaagtacgtcatcaggggattctatgggatcgaacatgccctcgccctggacatactcatccggaattcgtgtgtaaaggaagaagatatgctttag

SEQ ID NO: 11871 - DNA, 369 bp, Artificial Sequence
  Description of Artificial Sequence: Synthetic coding sequence
atggcagatccagatgtacttacagaagtacctgcagccctgaaaagactagcgaaatacgttatacgagggttctacgggatcgagcacgcgttggccctcgatattctcatccgaaactcttgcgttaaggaggaggatatgttggaactgctaaagttcgaccgcaagcaactgcgtagtgttttgaacaacctaaaaggcgataagttcataaagtgtcgcatgcgcgtggagacagcagcggatgggaaaactactagacataattactacttcattaattaccggacgcttgttaatgtggtgaaatataaattagatcacatgcgcaggcgcattgagaccgacgagagagactccacctag

SEQ ID NO: 11872 - DNA, 1188 bp, Artificial Sequence
  Description of Artificial Sequence: Synthetic coding sequence
atggacgaagagcctgagaggaccaagcgatgggaagggggatacgagaggacttgggaaattctaaaagaagacgagtcgggtagcttgaaagctactattgaagacatactgttcaaggccaagcgcaaaagggtgttcgagcaccatgggcaagtgagattgggaatgatgaggcatttatatgtggttgtggacgggagccggactatggaggatcaagacctcaaacctaatcggcttacctgcactttaaagctcctggagtatttcgttgaggagtattttgaccaaaaccctatcagtcagataggcatcatcgtaacaaaatccaagcgcgctgagaagctgacagagctttctggcaatcctagaaagcacatcacttctctgaaggaagcagttgatatgacctgccatggtgaaccgagtttgtacaactcgctgagtatggcaatgcagactcttaaacacatgcccggacatacatcaagagaggtcctgattatcttttccagccttactacctgcgacccaagcaatatttacgatctcatcaaaacgctgaaggctgctaaaatcagggtttcagttattggcctcagtgccgaggtccgggtatgcaccgtactggcccgcgagaccggcggaacctaccatgtgattcttgatgagtctcactataaggagttgctgactcatcatttgagccctccgccagcctcgagcagttctgaatgttcgctgattcggatgggatttccacaacacaccatagccagcctgagcgaccaggatgcaaagccttcctttagtatggcccatctggatggcaataccgagccaggcctcacactggggggctatttttgccctcagtgcagagccaagtactgtgagctccctgtagaatgcaagatttgcggactcactctggtttcagccccacatctggcaagatcctaccatcatctgttccctttggacgcttttcaggagattccgttggaagagtacaacggggaacggttttgttatggatgtcagggtgagctgaaggaccaacatgtgtacgtctgtgccgtgtgtcaaaatgtgttttgtgtggactgcgatgtgtttgtacatgacagcctgcactgttgcccaggctgcatccataagatcccggcaccatctggtgtgtag

SEQ ID NO: 11873 - DNA, 1017 bp, Artificial Sequence
  Description of Artificial Sequence: Synthetic coding sequence
atgcgccatctgtacgtggtggttgacggtagtagaacaatggaggatcaagacctgaaacctaatcgtttgacctgtaccctgaaacttctagagtactttgttgaggaatatttcgatcaaaacccaatctcccagatcggcattatcgtgacaaagagcaagagggccgagaagttgactgagctttcaggcaacccacggaagcacatcacgtccctgaaagaagcagtagacatgacatgtcatggcgagccttcactgtacaattccctgagcatggcgatgcagactctgaaacatatgcccggacatacatctagagaagtcttaatcattttttcatctttgacaacttgcgaccccagcaatatttatgatctgattaaaacactcaaagccgcaaagattcgggtgtcagtgattggtctctctgcagaagttagagtgtgcaccgtacttgcccgagaaaccggaggaacataccatgtgattctcgacgagtctcattataaagagcttctaacacatcatctgtccccccctcccgcttcaagttcctctgagtgtagcttgattcggatggggtttccccagcacactatagcttccctgtccgatcaagacgccaaaccttcctttagcatggctcacttagacgggaacacagagccaggcttaactctcggcggttacttctgtccacagtgtcgtgccaaatactgcgagcttccagtagagtgcaagatctgtggcctgaccctggtatccgccccccatttagcacgctcctaccatcatctgttccctctcgacgcatttcaggagatcccactggaagaatacaatggggagagattctgctacggatgccaaggtgaattaaaagatcagcacgtctacgtctgcgcagtttgccaaaacgttttctgcgttgattgcgacgtatttgtgcacgattcactgcattgttgcccagggtgcatccataagattcccgccccatctggtgtgtag

SEQ ID NO: 11874 - DNA, 1188 bp, Artificial Sequence
  Description of Artificial Sequence: Synthetic coding sequence
atggatgaagagcctgaaagaaccaagaggtgggagggaggttacgaacggacttgggaaattctaaaagaggacgaatcaggctcgcttaaggctactattgaggatattctgttcaaagcgaaacgaaaaagagtattcgagcaccatggccaggtccgactgggcatgatgaggcacctctacgtggttgttgatggaagcaggactatggaggatcaagacctcaagcccaaccgcctcacttgtacattgaaactgctggagtacttcgtcgaggagtattttgatcagaatcctataagccaaatcggcatcatcgtaacaaaatcaaaacgggcagagaagctgaccgagctgtcgggcaatccccggaagcatatcacaagcctgaaggaggcagtggacatgacctgtcatggtgagccttcactgtataactccctttcaatggccatgcagactctgaagcatatgccaggccataccagcagggaggtcttgataatcttcagcagtttgacaacatgcgatccctcaaacatttacgacctcatcaaaaccttgaaggccgcaaagatccgagtcagtgttatcggactcagcgcagaggtgagagtgtgtaccgtgctcgcccgcgaaactggtggaacatatcacgtgattttggatgaatcgcattacaaggagctgctcacccaccacttatctcccccacctgcatcttcatcctctgaatgtagccttatccgcatgggtttcccgcagcatactatagcctcactgtccgatcaggacgctaagccgtccttcagtatggcccatttagacggcaacaccgagcctggcctgaccctaggaggatacttctgccctcagtgcagggccaaatactgtgaacttcctgttgaatgcaagatctgtggcctgactttagttagcgcccctcatctggcgaggagctaccatcatctgttccccctcgacgcattccaggaaattccgctggaagagtacaatggagaacgcttctgctacggctgtcaaggggagctgaaggatcagcatgtctacgtatgcgcagtctgccaaaacgtgttttgtgtggattgcgacgtctttgtccatgatagcctccactgctgtccaggttgtattcacaagatacctgccccctcaggcgtgtag

SEQ ID NO: 11875 - DNA, 606 bp, Artificial Sequence
  Description of Artificial Sequence: Synthetic coding sequence
atgactgagaaggcccctgagccccatgtcgaggaggatgacgacgacgagctggacagcaagctgaactataagccaccacctcagaagtcattgaaagagcttcaggaaatggataaggacgacgagtctctcatcaaatataaaaaaactctgcttggcgatggaccagtggtgactgacccgaaggctcccaatgtcgtagtgacacggttaactctggtttgtgaatcagcacccggacctattactatggatctgacaggggacttggaggcgctgaagaaagagaccatcgttctgaaggaaggaagcgagtatcgcgtcaaaattcacttcaaggtgaatagggatattgtaagcggacttaagtatgtgcagcacacttatcgaaccggggtcaaggttgataaagctacttttatggttgggtcctacggacctcggcctgaggagtacgagttcctgactcccgttgaggaagccccgaaaggcatgctggcccgcgggacttaccacaacaaaagcttctttaccgatgacgataagcaagaccacctgtcgtgggagtggaacctgtctatcaagaaagagtggacagagtag

SEQ ID NO: 11876 - DNA, 777 bp, Artificial Sequence
  Description of Artificial Sequence: Synthetic coding sequence
atgaatcggtccaacaagttggcagttattgcttcccatatccaggaatccaggtttctgtatccgggtaagaatgggcggctcggcgattttttcggtgatccggggaatccacccgaatttaacccttccggctctaaagacggcaaatacgaactgctgacatctgctaacgaagtcattgttgaggagattaaagatctaatgacaaaatccgatatcaaaggccagcacaccgagactctactcgcaggctcccttgcaaaggcactgtgttatattcaccgcatgaacaaagaggtgaaagacaatcaggagatgaagtctcggattctggtcatcaaggccgccgaggattcggcgttgcaatacatgaactttatgaatgtcatcttcgcagcccagaagcagaatatattaatcgatgcttgtgtcctcgattctgattctggcctccttcaacaagcttgtgacatcacaggcgggttgtacttaaaagtaccccagatgccctcactcctccagtatctgttgtgggtgtttctgcctgaccaagaccagcgatctcaactgatcctgccgcccccagtgcatgtagattaccgcgctgcctgtttctgtcatagaaacctcattgaaatcggttatgtatgctccgtgtgtctctcaatcttctgcaacttctcaccgatatgcactacttgtgagaccgctttcaagattagcctcccccctgtgcttaaagcgaagaaaaagaagctgaaggttagcgcctag

SEQ ID NO: 11877 - DNA, 927 bp, Artificial Sequence
  Description of Artificial Sequence: Synthetic coding sequence
atggtttccgacgaggatgaacttaatctactcgtgatcgtggtcgacgctaaccccatttggtgggggaaacaggcacttaaagagtctcaatttacactgagtaagtgcatcgatgcggtgatggtgctagggaacagccacttatttatgaacaggagcaacaaattggctgtgattgccagccatattcaggagtctagattcctgtatcctggaaagaacggacgccttggtgactttttcggcgaccctggtaatccaccagagttcaatccatcagggagcaaagatggcaagtacgaattattaacaagtgctaacgaggtcatagttgaagagatcaaggaccttatgactaagtccgacattaaaggacagcatacagagacgctgttggccgggtctctcgcgaaggctctttgctatatacacagaatgaacaaagaagtcaaggataaccaagagatgaaatcgcgtatactcgtcattaaggccgccgaggattccgccttacagtacatgaatttcatgaatgtaatttttgcagctcaaaaacagaacattttgatcgatgcctgtgtgctagatagtgactcagggttgttgcagcaggcttgcgacattaccggcggcctgtatctgaaagtgccacagatgccgtctcttttgcagtatctgctctgggtgttcctgcccgaccaggatcagcgttcccagctcattctacccccacctgtgcatgtggactaccgcgcggcttgtttttgccacagaaatctaattgagataggctacgtatgttccgtgtgtctctccatcttctgtaactttagccccatctgcaccacatgcgagaccgcctttaaaatatccttgcccccagtgttaaaggccaagaagaaaaagctgaaggtatcagcttag

SEQ ID NO: 11878 - DNA, 6330 bp, Artificial Sequence
  Description of Artificial Sequence: Synthetic coding sequence
atggatgcgctcgaatccctcttagacgaggtggctctggagggcctggacggcctctgtttgcccgcgctgtggagccgactcgaaacccgagtgcctccatttcccttacccctagagccctgtacgcaggagttcctgtggagagctcttgctacacaccccggtatctctttttacgaggagccgagggagagacccgacctgcaactgcaggataggtacgaagagattgacttggagaccggcattctggagagtaggcgcgatcccgtggcccttgaggatgtctacccaatccatatgattctcgagaacaaggatggaatccagggcagttgccgctactttaaggaacgcaagaatatcacgaacgacataagaacgaagtcattgcagccacggtgtactatggtggaggcttttgatcgatggggcaagaaattgattatcgtcgcatcgcaagcaatgagatatagggctctgatcggtcaggaaggtgaccccgatctgaaactacccgatttctcatactgcattctagagcgccttggccggtcgagatggcagggcgagctgcaaagagatttgcatacaactgccttcaaggtggatgcggggaaactgcactatcataggaagatactcaacaagaacggcctgatcaccatgcaatcacacgttatacgactcccaacaggagcacaacaacacagtatcctgctgcttctaaacagatttcatgtggatagacggagtaagtacgatatcttgatggagaagttgtcagttatgttatccacccggacaaatcatattgaaaccctgggtaaattgcgcgaggagctgggtctgtgcgagagaacctttaagcgactctaccaatacatgctgaatgcaggcctggcaaaggttgtgtccttgcggcttcaggaaatccaccccgaatgcggcccttgcaagacaaaaaaaggaaccgatgtcatggtgagatgtctcaagctgctcaaggagtttaaaaggaacgatcatgacgatgacgaagacgaggaggtcattagcaaaacagtgccacccgttgatattgtgttcgagcgggatatgcttactcagacctatgacctgatagagaggcgcggtactaagggcatatctcaagctgaaattagagtggctatgaacgtcggaaaactggaagccagaatgctgtgcagactgctgcagcgattcaaggttgtgaagggctttatggaggacgagggaaggcagagaacaacaaaatatatcagctgcgtgttcgccgaagagagtgacctctctcgacagtaccagcgggaaaaggctcgttcggagctgcttacaactgtgtctctagccagcatgcaggaagaatctctccttccagagggggaggacactttccttagtgagtcagatagcgaagaggagcgctcttcttctaaaaggcgcggccgggggagtcaaaaagacacacgcgcgtcagccaacctgcgtcctaaaacccagccccatcattctactcctaccaaaggtggctggaaggtggtgaacctccaccctctgaagaagcagcctccttcattccccggagcggccgaagagcgtgcctgtcagtctttagcttctagggattccctacttgacacctctagtgtttctgagcccaatgtgtccttcgtatcacattgcgctgactctaacagtggcgatatcgctgttatcgaagaagttagaatggagaatccaaaagagtcctcgtcaagtctgaaaactggcaggcactcaagcggtcaggacaaaccgcatgagacatacagactgctgaaacgtaggaatctgattatcgaagcagtgacaaatcttcgattaatcgaatccctcttcacaatccaaaagatgattatggaccaggaaaagcaggagggagtgagcactaagtgctgcaagaaatccattgttcggctggtgcgtaatctcagtgaggaagggctcctgcgcctgtacaggaccactgttatccaggatgggatcaagaagaaagttgatctggtggtgcatccatctatggatcaaaacgatccgctggtcaggagcgctattgagcaggtgcggttcaggatctctaactcctccacagccaaccgagtgaaaaccagccagccaccagtgccccagggcgaagcagaggaagacagccagggtaaggagggtccctcagggagcggggattcgcaactctctgctagttccaggtctgagagcggcaggatgaagaaaagcgataataaaatgggtataacaccgctccgcaattaccacccaatcgtggtgccaggccttggcagaagccttggattcttaccaaagatgccgcgattgagggtcgtgcacatgtttctgtggtacctcatatacggccatcccgcatccaacactgtcgagaaacctagcttcatttccgagaggagaacgatcaagcaggagtccggacgggccggcgtccgccctagctcatctggcagtgcatgggaggcctgctctgaagcaccaagcaagggatcccaggacggggtgacttgggaagccgaggtcgaactggccacggagaccgtctacgttgacgacgcttcgtggatgcggtatatcccacccatcccagtacaccgagacttcgggttcggatgggctttggtttctgacattttactttgtctaccgcttagtattttcatccaaatcgtccaggtgtcttacaaggtggacaatttagaagagtttctgaacgaccccctgaagaagcatacgctaatccggttcctcccgaggcctatccgtcagcaattgctctacaaaagaaggtatatcttcagcgtagtggagaaccttcagagactgtgttatatgggcctcctgcaattcgggccgacagaaaagttccaggacaaggatcaggtcttcatcttcctgaagaaaaacgcagttattgtagacaccacgatctgtgacccgcattacaatcttgcacgctcctctcggccatttgagagacgattgtacgtactgaactctatgcaggacgttgaaaattactggttcgacctacagtgcgtctgcttaaatacccccctcggagtagtgcgttgcccccgagtgcggaagaatagctccactgaccaaggatccgatgaggagggaagtctgcaaaaagaacaagaaagcgctatggataaacataaccttgaacgcaagtgcgcaatgcttgaatacactacggggagtcgcgaggttgtcgatgagggcttgatccctggcgatggcctaggcgccgctggtctcgactcttctttttacgggcacctgaaacgaaactggatatggactagctacattattaaccaggctaagaaagagaataccgcagccgaaaatggtttgacggtgcggctgcagaccttcttgtctaagcggcctatgcccttgtctgcaagaggaaactcgcggctgaatatctggggggaggcccgggtgggatccgaactttgtgcaggctgggaggagcagttcgaagtggatagagaacccagccttgatagaaataggcgggtccggggcggcaagtcacaaaagaggaagcgcctaaagaaagatcctggaaaaaaaattaagcgcaagaaaaaaggggaatttcctggggagaaatccaaaaggctgagataccacgatgaagcagaccaatctgcgcttcagaggatgactcgcctgcgggtgacgtggtcaatgcaggaggacggtctacttgtattgtgtcgtatagctagtaatgtgctgaatactaaggtgaagggacccttcgtgacttggcaagtggtgagggatatccttcatgctacatttgaagagtcactggataaaacgtcacactctgtggggcgtagggcgcgatatattgtgaagaacccacaggcttacctgaattacaaagtatgcctggcagaagtttatcaggacaaggccctggtgggcgatttcatgaaccgtcgaggggactacgatgaccccaaggtctgtgcaaacgagttcaaggagtttgtagagaagttgaaagagaagttctcgtcggcgctccggaactcaaatctagagatccctgacaccctgcaggaactgttcgccaggtatcgcgtgctagcgatcggtgatgaaaaagatcagacacgaaaggaagacgaattaaattccgtcgatgatatccactttctggttctgcagaacctgatacagtccacactcgctctgagcgactcccaaatgaaatcctatcagtctttccagactttccggctgtatcgtgagtacaaggaccacgtccttgtcaaggctttcatggagtgtcagaaacgcagcctggtcaaccgtagacgggtgaatcatactctgggccccaagaaaaacagagccctgccttttgttcccatgagctatcagctgtcccagacttattaccgcattttcacctggaggtttcctagtaccatttgtactgagtcatttcaatttttggatcgaatgcgcgctgccgggaagcttgatcagccagatcgatttagctttaaagatcaggacaacaatgagccaaccaacgacatggttgcattcagtttagatggccccggcggcaattgcgtggctgttctgaccctgttcagcttaggtttaatctcagtcgatgtgcgaatacctgagcaaattatcgtagtggatagctctatggtggaaaacgaagtcattaagtcccttggaaaggatggctctttggaggacgacgaagatgaagaggatgatctcgacgagggagtggggggcaagaggcgaagcatggaagttaaacccgcccaggccagccacaccaattatctgctcatgaggggttactactccccgggcatagtgtctacacggaatctgaaccccaacgattccatcgtggtgaatagctgtcaaatgaaattccaactcagatgcacgccggtgccagcacgtttacgacccgcagccgccccactggaagagttgactatgggaacgagctgcctgccagacacctttacaaaactcataaacccccaggagaacacctgttccctagaggagttcgtacttcagctagaactgtctggttattcaccagaagacctgaccgctgccttagaaatcctggaagctataatcgccaccggatgtttcgggatagacaaggaggagcttcgaaggcgcttttccgccctggagaaagctggagggggcagaacacgcactttcgctgactgtatccaggctctccttgaacaacatcaagttttagaagtaggtgggaacacagctcgcctggttgccatggggagtgcttggccctggctgcttcactccgttagattaaaggatcgtgaggatgccgacattcagcgagaggatccgcaggccagaccccttgaggggtcatcatcagaagactctcctccagagggccaggcccccccttcacattctcctagaggcactaagagacgcgccagttgggccagtgagaacggtgaaaccgacgcggaaggcacgcagatgaccccagctaagagaccggccctgcaggatagtaacctggccccctctttgggacctggggccgaggacggggcagaagcgcaagccccaagtccccctccagcccttgaggacacagcggcagcaggcgccgcccaagaagaccaggaaggggtaggggagttcagcagcccgggccaagagcaactgtcgggacaggcccagcctcctgagggctccgaggaccccagaggcttcactgagtctttcggcgccgccaatatctctcaagcggctcgggagcgggactgtgaatcggtgtgcttcattggtaggccatggagagtggtggatggccatttaaatctgcctgtctgcaaaggtatgatggaagcaatgctgtatcatattatgaccagacctggcatcccggagtcctccctactgcgccactatcagggcgtccttcagcccgttgctgtgcttgaactgctacagggattagagtcacttggctgcatccggaaacgatggcttagaaaacctaggcccgtgtcccttttttctacacctgtggtggaggaggtggaagtgcccagtagtctggacgaaagtcccatggccttttacgagccaacattagattgtactctccgactcggtcgggtgttcccccacgaagtaaactggaacaaatggatacatctgtag

SEQ ID NO: 11879 - DNA, 5064 bp, Artificial Sequence
  Description of Artificial Sequence: Synthetic coding sequence
atggatgcactggagtctctgctggatgaggtggccctggagggtctggatgggctgtgtctgccagcattatggagcaggctcgagacaagagtccctccattcccgttacctctggagccttgtacccaggaattcctttggagagccctggctacccatccgggtatctcattttacgaagagcctcgagagcggcctgacctacaattgcaagaccggtacgaggagatcgaccttgagaccggtatcctcgagtctagacgggaccccgtggcccttgaggacgtctaccccatccacatgatcctcgagaacaaggatggaatccaagggagctgtagatactttaaggaaaggaagaacatcaccaacgacatcagaaccaagagtcttcagccaaggtgcactatggtggaggcttttgataggtggggaaagaagctgatcatctgcctgccaggacacgccgtacagggtctagaccgccccggtggcgggagccgccccgaagctgcccggttactactgctacacccgggcaccgctcggcctgtgcagcagggggagttacaacgggatctccataccactgcctttaaagttgatgctggaaaactgcactaccatagaaagatcctgaataaaaatgggctgatcaccatgcagagccacgtaattcgtctccccactggagctcagcagcacagcatacttctgctcctgaatcgctttcacgtcgataggcgctcaaagtatgatatcttaatggaaaagctttctgttatgctgtcaaccagaactaatcacatcgagaccctcgggaaactccgggaggaactgggactgtgtgaacggaccttcaaacgcctgtaccagtatatgctcaatgccggtcttgccaaggtggtttccctgaggctgcaggagatccacccagagtgcggtccgtgtaaaactaagaagggtacagatgtgatggtgagatgtctaaagcttctaaaggaattcaagaggaacgaccatgacgatgacgaagacgaagaggtaatctcaaagaccgttccacccgtagatattgtgttcgagagagacatgctgacccagacttatgatctgatagaaagacgcggtacgaaaggaatttcccaggccgaaatcagggtggcaatgaatgtgggcaagctggaggccagaatgctgtgccgcctgttgcagaggttcaaggtggtgaaaggatttatggaggacgagggccgccagcgcacaaccaaatatatcagctgtgtctttgccgaagagagtgacctaagtagacagtatcaacgggaaaaggcaaggtcagagttactgaccactgtttcacttgcttctatgcaggaggaatctttactaccagagggggaggatacgtttttatccgagagtgattccgaagaagaacgcagtagctcaaagaggaggggtcgggggagccagaaggacacacgcgccagcgccaacctgaggccgaagacacagccgcaccacagtaccccaaccaagggcggctggaaagtggtgaaccttcatccactgaagaaacagcctccttcgttcccgggtgccgccgaggagagagcgtgtcagagtcttgcaagccgtgattcacttctggacacctcctcagtgagcgaacccaatgtatcttttgttagtcactgcgctgattctaatagcggagatattgctgtgatcgaagaggttagaatggaaaacccaaaggaaagctccagctccctgaagacggggcgccacagcagcggacaggataagccgcatgaaacttatcgccttctaaagcgcaggaacctgatcatcgaagctgtgacaaatcttaggctgatcgagtcactcttcacgatccaaaagatgattatggaccaggaaaaacaagaaggtgtgagcacaaaatgctgtaagaagtcgattgttcgcctcgtgaggaacctctctgaagagggtctgttgaggctttatcgtacaacggttatccaagatggtatcaaaaagaaggttgatctagtggtgcatccatcgatggaccagaacgaccccttggtgcgatctgcaatagagcaggttcgatttcggatctctaactcatctacggctaaccgagtgaaaacttctcagcccccagtgccacagggcgaagctgaggaagacagccagggcaaagaaggacctagcggctctggtgacagccagctgtcggccagcagtcgctctgagagtggacgtatgaaaaaaagcgacaacaaaatgggaataacccctctgcggaactaccacccaatcgtcgttcctggtctggggaggagcctcggttttctcccaaagatgcccagattgcgggtcgttcacatgttcctttggtatctcatctacggccacccagcgtccaacactgtagagaaaccgtccttcatttccgagcgcaggactataaagcaagaaagcgggcgtgcgggtgtccgcccttcgtcaagtggatctgcgtgggaagcctgtagcgaagctcctagcaagggctcacaagacggagtcacatgggaagcagaggtcgaattagccacagagacggtctatgtcgacgatgcttcatggatgagatacataccaccgatccctgtgcaccgcgactttgggtttggttgggcccttgtgagcgatatcctgttgtgcctgcctctcagcattttcattcagattgttcaggttagctacaaagtggataacctcgaagagtttctgaacgacccattaaagaagcacactctgatccggttcttgcctcggccaatcagacagcaattactctataagagacgctacatattcagcgtggtcgagaaccttcagagactgtgttacatgggtctgcttcaatttggccccaccgagaagtttcaggataaggaccaggtcttcatcttcctgaagaaaaacgccgtcattgttgataccactatctgtgatcctcactacaatttggccaggtccagtcgtccattcgagcgccgattatacgtgctaaactctatgcaggatgttgaaaactactggtttgatctccagtgcgtgtgtctcaataccccgctgggagtggtccgctgccctcgcgtccgcaaaaactcgtcgaccgaccagggaagcgacgaggaggggtccctgcaaaaggaacaggagtctgccatggacaagcacaatcttgaacgcaaatgcgcaatgttagagtacacaacaggctctcgcgaagttgtggacgaaggtcttatccccggtgatgggctcggcgcaggctctatccccgcttccaccgacacatcttccgccaccgggagtggacctgctacatccagcacacggccaaaaaggcgaactttacctcaacgaatggacaccgtccgactgcagacatttctttcaaaaaggccaatgccactgagcgctagaggaaattcacgcctcaacatttggggtgaagcccgcgtaggtagtgagctatgcgctgggtgggaggaacagtttgaggtggacagggaaccgtctctagaccgaaaccggcgcgtgagaggaggtaaatctcaaaaaagaaagcgtttgaagaaagacccagggaagaagatcaagaggaaaaagaaaggggagttcccaggcgagaagtccaaaagattgcgctatcatgacgaagcagaccaatccgcactgcagcgcatgacgaggctgcgtgtgacctggtccatgcaggaagacggactattggtattgtgcagaatcgcatctaacgtgttgaacaccaaagtcaagggaccatttgttacctggcaggttgtgagagacattctccatgcaacattcgaagaaagcctggacaagactagtcactctgtgggcaggcgtgcccggtatatcgtgaagaacccgcaggcttatttgaattacaaggtgtgtttagctgaagtgtaccaggataaagctttggtaggcgattttatgaacaggaggggagactacgacgatccgaaagtctgcgcgaatgagttcaaggagttcgttgaaaaattaaaggaaaaattctctagcgccctgcgcaacagcaaccttgaaatccctgatactctgcaagagctgttcgcccgatatagggtgctggccatcggggatgaaaaggaccagacgaggaaagaggatgaactgaactctgtagacgatattcacttcctcgttctgcagaatctgatccagagtacactggcactgtctgactcacaaatgaagtcatatcagtccttccagacctttagactttatcgtgaatacaaagaccacgtcctagtcaaggcatttatggagtgtcagaagagatctctagtgaataggaggcgggtgaatcatacactgggacccaagaagaatcgcgccctgccctttgtgcctatgtcatatcaattgagtcagacttactacaggattttcacatggcgtttcccctctactatttgcaccgagagctttcaatttctggatcgaatgagggcagccggtaagctggaccagccggacaggttttcatttaaggaccaagacaacaatgagccaaccaatgacatggtcgccttcagtctggacggtcccggtgggaactgcgtcgcagtcctcacgttattttctctgggactcatttcagtcgacgttagaatcccagaacagatcattgtggtcgattcaagtatggtcgagaatgaagttattaaatcactgggtaaagacggaagtctcgaagacgatgaggacgaggaagatgatctggacgaaggcgtcgggggcaagcggcgctctatggaagtcaagcccgcccaggccagtcacaccaattacctcctgatgcgcggatactatagcccgggcatcgttagcacgagaaacctgaaccccaatgactctatcgttgttaattcttgtcagatgaagtttcaactacgatgtacaccggttccagcaaggcttagacccgcctag

SEQ ID NO: 11880 - DNA, 2736 bp, Artificial Sequence
  Description of Artificial Sequence: Synthetic coding sequence
atggacacctgcggggtgggctatgtagcgctgggggaggccggacctgttggcaatatgaccgttgtggatagtcctggacaagaggtccttaaccagctcgatgttaagaccagtagcgaaatgacttccgcagaggcatccgtggagatgtccttgcctacgcccctgcctgggttcgaggactctccagaccaaagaagacttccgcccgaacaggaatccctctcgcggctagagcagccagaccttagctccgagatgagcaaggtgtctaagccgagggcctcaaaacctgggagaaaacgaggtgggaggacccgcaagggccctaagaggccacagcagcccaaccccccctctgccccactggtgcctgggttactggaccaaagcaatcccctgtccacgccaatgcctaagaaacgtggtcgcaagtctaaggccgagctcctgcttctcaagctgagcaaagatttggacaggcccgaaagtcagtccccgaagcggccacctgaggatttcgagactccttctggcgagcgtccacggcgccgggctgctcaggtggctctgttgtatttgcaggagcttgctgaagaattgagcacagcactacctgcgcctgtctcctgccctgagggccctaaggtgtctagtcccaccaagcccaaaaagatccgacagcccgctgcctgtccagggggcgaagaagtcgatggagctccgagagatgaggacttttttctccaggtggaagccgaggacgttgaggagtcagaaggtccttctgaatcttcctcagaacccgaacccgtcgtcccaagatcaactcccaggggtagtactagtggcaagcagaagccccattgccggggcatggcacctaatggacttcctaaccacatcatggctcccgtttggaaatgcttgcatctcacgaaggatttccgagagcagaagcatagctattgggaattcgccgaatggattcccctggcatggaaatggcatttgctctccgaactggaggctgcaccttatctcccacaggaggaaaagagccccctgtttagcgtgcagcgcgagggactgcctgaggacggcaccttataccgaatcaatcgcttttcgtcaatcacggcacatcctgaacgctgggatgtgagttttttcaccggtggccccctgtgggccctggattggtgtccagtgcctgagggcgcgggagcaagccagtatgtcgccctcttcagttcccctgacatgaacgagacacaccccctgtcccagctacactcagggccgggactcctgcaactgtggggcctgggtactttacagcaggagagctgcccgggaaatcgggctcactttgtttacgggattgcctgcgataacggatgcatctgggaccttaaattctgcccatccggtgcttgggaattgcctggaaccccacgaaaagcgccgcttctgcccagactcggtctcctcgctctggcatgtagtgatggcaaggtcttgctcttttctctgcctcatcccgaggcgctcttggcccagcagcccccagatgccgtcaagcctgctatctacaaagtgcagtgtgtggcaactttgcaggtcggctccatgcaggctactgatccctccgagtgcggacagtgcttatcacttgcctggatgccaactaggcctcatcaacatttagcagccggctactataacggaatggtggtcttctggaacctccccaccaattcgccattgcagcggatccggttgtccgatggctcactgaagctgtatcccttccagtgtttccttgctcacgaccaggctgttagaacattacagtggtgtaaggccaattcccactttctcgtctccgcgggatctgatcgcaagatcaaattctgggacctgcgccgcccgtatgagcctattaactctatcaagcgctttttatcaacagagttagcctggctgctaccctataatggcgtgactgtggcacaggataattgctacgcctcatacgggctctgcggtatccattacatagacgctggctatttggggttcaaggcgtattttacagccccgcgcaaaggaactgtttggtccctgagtgggagtgactggctagggactatcgctgcgggggacatcagcggagaactcatcgcagcgatcctccccgatatggcacttaatcctatcaatgtgaagcggcctgtggaacggagattcccgatttacaaggcagatctgatcccgtatcaggacagcccggaagggcctgaccactcctcagccagttccggggtccctaaccccccgaaggcacgcacatacactgaaacagtgaatcaccattatttgttattccaggatacagatcttgggagctttcatgacctgctgcgccgggaaccaatgctcagaatgcaagaaggtgaaggccactctcagctgtgcttggatcggcttcagctcgaggccatccacaaggttcgattctcccctaatcttgactcttacggttggctggtaagcgggggccagtcaggcctcgtgaggattcatttcgtgcgtggcctggcctctcccctcggccataggatgcagctggagtccagagcccattttaatgcaatgtttcaaccctcgagccctacccgaaggccaggattttcgcctacatctcatcgccttctgcccacgccatag

SEQ ID NO: 11881 - DNA, 2736 bp, Artificial Sequence
  Description of Artificial Sequence: Synthetic coding sequence
atggacacctgcggggtcggctacgtcgcgctgggcgaggccggaccggttggcaacatgactgttgtggattcgccaggacaggaggtccttaaccagctggacgtgaaaacttcttctgagatgactagtgccgaggcgagtgtggagatgtcccttcccacccctctcccaggatttgaagacagcccagaccagcgcagactgcctcccgagcaggagtccctctcccgcttggaacagcccgacctcagtagcgagatgtccaaagtcagcaaaccccgggccagcaaaccaggacggaaacgcggaggcagaactcggaaagggcctaaaaggccgcagcagcccaacccccccagcgccccactcgttccgggcctgctggatcagagcaatccgctgagcacacctatgcccaaaaagcggggccgaaaatccaaggctgagctcctgctattgaagctctctaaggacttggaccggcctgaatctcagtctcccaagcgtcctcctgaggacttcgagactccctcaggggaaaggcctcgcagacgggccgcccaggtggcactgttgtacctgcaagagcttgcagaagaactctccacagcacttcctgctcctgtttcctgtccagagggaccgaaggtctcatccccgaccaagccgaagaagatccgccaacctgcagcatgtcctggcggcgaagaggtggacggagcgccacgtgatgaggacttcttcctgcaggtggaggccgaagatgtcgaggagagtgagggcccaagcgagtcatcatccgagcctgagcccgtcgtccctcgttccacacctcgcggatctacctccgggaagcagaagccccactgccggggaatggcccctaacgggttacccaatcatatcatggcccctgtctggaaatgtctgcatctaacaaaagacttccgcgagcagaagcattcctactgggagttcgccgagtggataccactcgcctggaagtggcatctgctgtctgaattagaagctgccccctatttgcctcaagaggagaagtcacctcttttcagcgtccaaagagaagggctgcctgaagatggcacactttacagaatcaatcggttctcatcaataacagcacatccagagcgctgggacgtgtccttctttactggcggtcctctctgggcactagactggtgccctgtccccgagggcgctggtgcgtcccagtacgtggccttgttcagttcacctgatatgaatgaaactcatcctctgtcacagctgcactcaggccctgggcttctccaattgtggggccttggaacacttcagcaggaaagctgccctggtaatagggcccacttcgtctacggtatagcatgcgataatggatgtatctgggatctgaaattttgtccatctggtgcatgggagctcccaggcactccccgcaaggccccacttttgcccaggctcggcctgctggcacttgcctgcagcgacggcaaggtcctcttattctcactgccccatcccgaagccctgcttgcacagcagccaccagatgccgtgaaaccggccatatacaaggttcagtgtgtggccacccttcaggtcggcagtatgcaggcgaccgacccctcagagtgcggacagtgtttgtccttggcctggatgcctaccaggcctcaccaacacctggcggccggctattataatggcatggtggtattttggaatctgccaaccaactctcccctgcagcgcatccggctgagtgatggtagccttaagctctacccctttcagtgtttcttagcccacgatcaggctgtgagaactctacagtggtgcaaggctaacagccattttctggtcagcgccgggagcgatcgaaagatcaaattctgggacttgcggcgtccctacgagcccatcaacagcataaaaaggtttctatccaccgagttagcgtggcttctcccatataacggtgtgactgtggcacaagataactgctatgctagctacggcttgtgcggcatccactatatcgatgctggctatctggggtttaaggcgtattttacagctccacgcaaggggacggtatggtccctgtcagggtccgattggcttgggacaatcgctgcaggagatataagtggtgagctgattgctgccattctgccggacatggctctgaaccctataaacgtcaagcggccagtagagcggcgatttccaatttacaaggcggatctgatcccatatcaagattcacccgaggggcccgaccactcatctgcctcttctggagttccaaacccgcccaaggcgcggacttacaccgagactgtgaaccaccactacctgctgttccaagacacagatctgggttcatttcatgatttgctccggagagagccaatgctccgtatgcaggagggggaagggcattctcaactgtgccttgaccgtctgcagttggaagccattcataaagtgcgcttcagccctaacctggattcttatggatggctggtatccggcgggcagagcggcttagtcaggatccattttgttcgcggactggcctcacccctgggtcacaggatgcagcttgagtcccgggctcacttcaacgcgatgtttcagccttctagccccactagacgccctggctttagtccaacatctcatcggcttctgccaaccccgtag

SEQ ID NO: 11882 - DNA, 225 bp, Artificial Sequence
  Description of Artificial Sequence: Synthetic coding sequence
atggatacttgcggcgtgggatacgtcgcgctcggtgaggcaggtcctgtaggaaatatgactgttgtagactcccccggacaggaagttctgaatcagctggacgtaaagacctccagtgaaatgacctcagccgaggcatcggtggagatgagtctgccaacacccttgcccggatttgaggattcccccgaccagcgcaggctcccccccgaacaagagtag

SEQ ID NO: 11883 - DNA, 408 bp, Artificial Sequence
  Description of Artificial Sequence: Synthetic coding sequence
atggacacttgtggcgtaggctacgtagctcttggagaagctgggccggtaggcaatatgactgtggttgacagccccgggcaggaagtgttgaaccagttagacgttaagacctcgtccgagatgaccagcgcagaagcaagtgtggaaatgtccttgcccacccccctacccggcttcgaggacagtcccgaccagcggcggctgcctcccgaacaggaaagcctgagccgtctggagcagcccgatctttcgagcgaaatgagcaaggtgtcaaagccccgcgcatctaagcccgggcggaagcggggcggaagaacacgcaaaggacctaagcgaccgcagcagcctaacccaccttcagctcctctcgtgccgggccttctcgatcagtccaatcctctctag

SEQ ID NO: 11884 - DNA, 2661 bp, Artificial Sequence
  Description of Artificial Sequence: Synthetic coding sequence
atgtccggcttctcccctgaactaattgactacttagaagggaagatctccttcgaagaatttgaaaggcgccgcgaagaacgcaaaacccgcgaaaagaagtccctgcaggagaaagggaagctcagtgccgaggaaaatccagatgatagtgaagtaccttcatccagcggaattaacagcactaaatcccaggataaggacgtcaacgagggagaaacctctgacggagtacggaaaagcgtccacaaggtatttgcctccatgcttggagagaatgaggacgacgaagaagaggaggaggaggaggaagaagaagaggaagaggaagagacgcccgagcagccaaccgcgggagatgtctttgtgctcgagatggtcctgaatcgggagacaaagaaaatgatgaaagagaagcgcccacgatcaaaattgccgcgcgcactgcgaggacttatgggagaggctaacattaggttcgcccgaggcgagagggaggaagcgatccttatgtgtatggagatcatccgacaagcccctctcgcatacgagccattttccaccctggctatgatctatgaggatcagggggatatggagaagagtctccaattcgaactgatagcagcgcacctgaatccatcggacactgaagagtgggtccggctggccgagatgtcgcttgagcaggacaatatcaagcaggctatattctgctataccaaagccctgaagtacgagcccacaaacgtgcggtacctatgggagcggagcagtttgtacgagcagatgggcgaccacaaaatggcgatggacggctatcgacgaatcttgaatcttttaagtccctctgacggggaacgcttcatgcagctggctcgcgatatggccaagtcttattacgaggctaatgacgtgacatcagctattaacataattgatgaagcattttccaagcatcaagggctagtgtccatggaagatgtaaacatcgctgctgaactgtacatcagtaataagcaatatgacaaggcccttgagatcatcactgacttcagtggaatcgtactggaaaagaaaacatctgaagaaggcactagtgaagaaaataaggcgcccgagaatgtaacgtgcaccattcctgacggagtccctattgacattaccgtgaaactcatggtttgcctcgtgcacctgaacattctcgagcccctgaatccactactgactacactagtggaacaaaacccagaggatatgggcgacctttacttagacgttgcagaggcttttttggacgtgggtgaatataacagtgccctgccactcctttcagcgctggtttgctcagaaaggtataatttggccgtggtctggcttcgccatgccgaatgcctaaaggctctcggttacatggagagagccgccgaaagctatggcaaggtagtggacttggctcctctgcatctggacgcgaggatctccctgtcaacactgcagcagcaactcgggcaaccagagaaggccctggaagctctcgaacccatgtatgatccggacacattagcccaggacgccaacgccgcacaacaggaactgaagctcctgctgcatcgaagtacccttctgttctctcagggaaagatgtacggctacgttgacaccttactaaccatgctagccatgctgttaaaagtggccatgaacagggctcaggtctgtcttatcagcagctctaaaagcggggaaaggcacttgtatttgattaaggtcagtcgagacaaaattagtgacagtaatgaccaggagtctgctaattgcgacgcaaaagcaatcttcgccgtgctgacgtctgtcctgactaaggatgattggtggaaccttctattgaaggctatctactctctgtgcgacctatcccgctttcaagaggcggagctgttagtagattccagcttagaatactattccttctacgatgatcgtcaaaaacgcaaggaactggagtattttggcttgtctgccgccatcctggataagaatttccgtaaggcatataattacatcaggattatggtgatggaaaatgtaaataagccccagctctggaatattttcaaccaggtcaccatgcactcccaggacgtgaggcatcatcgcttctgcctgcgactgatgctcaagaaccctgagaatcacgcactttgtgtgctgaacggacacaatgcctttgtgagtgggagcttcaaacacgccttgggtcagtatgtacaggctttcaggactcacccagacgagccactgtactctttttgcatcggcctgactttcatccatatggctagccaaaagtatgtgctgagacgccacgctctcatagtgcagggcttctcgtttcttaatcgatatctgtccctgaggggcccatgtcaagagtctttctataacctggggagaggattgcatcagctggggcttattcacttggcaatccactattatcagaaggctcttgagctccccccacttgtggtggaagggatcgagctggatcaactggatctccgaagagacattgcctacaacctgtctttaatctaccagagcagtggcaataccgggatggcccagacccttctctacacctattgctccatttag

SEQ ID NO: 11885 - DNA, 1242 bp, Artificial Sequence
  Description of Artificial Sequence: Synthetic coding sequence
atgagcggattttcacccgagctgatcgactatctggaaggcaaaatttcatttgaggagttcgagcgaaggcgcgaggagcgaaaaacccgggaaaaaaagtcactgcaggagaaaggaaaactgagtgccgaagagaacccagatgattccgaggtcccctcttcctctggaattaatagcaccaagtcacaggataaggacgtgaacgaaggcgagacctctgatggagtgcgaaaatcggtgcataaagtgttcgccagcatgcttggcgaaaacgaagacgacgaggaggaggaagaggaggaggaagaagaggaggaagaggaagagactcctgaacagcctactgccggagatgtctttgttctggagatggttctcaacagggaaacaaagaaaatgatgaaggagaaaaggccgagaagcaagcttccacgcgctcttagaggcctcatgggcgaggcaaacatccggtttgccagaggggagcgggaagaggcgatccttatgtgtatggaaattatccgccaggctcccctcgcttacgagccattttcaacccttgctatgatttacgaggaccagggagatatggaaaaaagtttgcaattcgagctgatagcagcccatctcaaccccagtgacaccgaagagtgggtccggctagctgaaatgagtctggagcaggacaatatcaagcaagccattttctgctacactaaggcccttaaatacgaacccacgaatgtgcggtatctgtgggaacgctctagtttgtacgagcagatgggagatcacaaaatggcaatggacggctacagacgcatccttaacctactgtcgccatcagatggtgaacggtttatgcagctggctcgggacatggctaagtcctattacgaagcaaacgatgtgacctcagccatcaatatcatcgacgaggccttctccaagcaccagggcctggtttcaatggaggacgtgaacattgccgccgagctgtacatctctaacaagcaatacgacaaagcgctggagattatcacagacttctcaggcattgttctggagaagaaaacatcagaggagggtacaagtgaggaaaacaaggcacctgaaaacgtgacctgcacaattcccgatggtgtccctatagacattaccgtcaagcttatggtatgcctggttcacttgaacatcctagagccactgaacgtctgtaataaaatctgtacctag

SEQ ID NO: 11886 - DNA, 2469 bp, Artificial Sequence
  Description of Artificial Sequence: Synthetic coding sequence
atgaacactgccgatcaagcccgggtcggacccgccgatgatggacctgccccctccggggaggaggaaggggagggaggcggcgaggccggcggtaaagagcctgctgcagacgctgctcccggaccaagcgccgcctttaggcttatggtaacacgtcgcgaaccagccgttaaactgcaatatgccgtgtctggcttggagcccctcgcctggtccgaggatcacagggtgagtgtcagcacagctcgaagtattgcagtactggagctcatctgcgacgtgcataatccaggacaggatctggtcatccatcggacttcagtccccgcgccactgaattcatgcctgttgaaagtgggaagcaagactgaggtggccgagtgcaaagagaaattcgcagctagtaaggatcctactgtgtctcagacatttatgctggatagagtgtttaaccctgaaggtaaagccctaccccccatgaggggctttaagtacacatcatggagccccatgggctgcgacgccaatggccggtgtttgctggctgctctcacaatggacaataggttaactatccaggccaatctcaatagattgcagtgggtgcaactggtagatctgaccgagatctatggcgaaaggctctacgagacgtcctatcggctcagcaaaaacgaggccccagaaggcaacctgggcgattttgctgagttccagaggcgccactccatgcagactccagtgagaatggaatggtcaggcatctgtacaacacaacaggtcaaacacaacaatgagtgccgcgacgttggcagtgtattactggccgttctgtttgagaacgggaacattgcagtttggcagtttcagctaccttttgtgggaaaagagagcatttcttcatgtaataccatcgagtccggaattacctcccccagcgtgctattttggtgggagtacgagcataataacaggaaaatgtccggcctgatcgttggttcagcttttggtcccatcaagattcttccagttaatctgaaagcagtcaagggctacttcacactgaggcagcctgtgattctgtggaaagagatggaccagcttccagtgcactccatcaagtgtgttcccctgtatcacccttaccaaaagtgtagctgtagcttggtggtggcagcccgcggttcttacgtgttctggtgtctgctcctaattagtaaagctggtctgaatgtgcataactctcacgttaccggcctccatagccttcccatcgtgtccatgaccgcagacaaacagaacggcacagtgtatacctgcagttcagatggcaaggttaggcagcttatacctattttcacggatgtagctctgaaatttgaacaccagctgatcaagctgagtgacgtctttggttccgtcaggacccatggtattgccgtctccccatgtggcgcgtatttggctattataactaccgagggcatgattaacggcttgcaccctgtgaacaagaattaccaggtacaatttgttaccctgaagaccttcgaagaagctgcggcgcaacttctcgaatcctctgtccaaaacctgtttaaacaggtcgatctgattgatctggtgcgctggaagattctcaaagacaagcatatcccccagttcctgcaggaggcccttgagaagaagatcgagtccagcggggtaacatatttttggaggtttaagcttttcctactccgcattctgtaccagtcaatgcaaaaaacccctagcgaagcattatggaagcccacgcatgaggattctaaaatcctgctggtggatagcccaggcatgggtaacgcggatgacgaacagcaagaagaaggcacttcttccaaacaagtggtgaaacagggcctgcaggagcgctctaaggaaggggacgtcgaggaacctacggacgacagccttcctactactggtgatgcgggtggcagagagccaatggaggaaaaactcctcgagatccagggtaagatcgaagctgtggaaatgcatctcactcgggagcacatgaagcgagtcctcggcgaagtgtacttgcacacatggatcactgagaacacttccatccctacaagaggcctctgcaacttccttatgtccgatgaagagtatgacgaccgcaccgcaagagtcttgattgggcatatctcaaaaaagatgaataagcagacctttcccgaacactgctcactctgtaaggagatcctgcccttcacagatcgaaagcaggccgtgtgttccaacggccacatctggttgagatgcttcttaacgtaccagagctgtcaaagtctcatctaccgccggtgtcttctgcacgatagcatcgcacgccatccagctcccgaagatcctgactggatcaagagattgctgcagtccccttgccccttttgtgactctcccgtcttctag

SEQ ID NO: 11887 - DNA, 1374 bp, Artificial Sequence
  Description of Artificial Sequence: Synthetic coding sequence
atggctgcggaagcagctgacctgggacttggcgcagctgtaccggtcgaactccggcgggagcgtcgcatggtgtgcgtcgaataccccggtgtagtcagggatgtggccaaaatgttgcctactttgggaggagaggagggcgtgtctaggatctacgccgaccccacaaagcgcctggagttatatttccgccccaaggatccctattgccaccctgtttgcgctaaccgcttcagtaccagcagcttgctgctgagaattagaaagcgcacccgacgccagaagggggtgctggggactgaagcccattcagaagtgacctttgatatggagatactggggattatctctacgatctataagtttcaagggatgagcgactttcagtatctggccgtccacacagaggctggggggaaacacaccagtatgtacgacaaagtgttaatgcttaggcctgagaaagaggccttctttcaccaggagctccctctgtacatccccccccccatatttagccgtttggatgccccagttgactacttttatcggccagaaacgcagcaccgagaaggatacaataacccacctatctctggcgaaaacctgatcggccttagtagggcacgacgcccacacaatgctatctttgtcaatttcgaagacgaggaggtcccaaaacacctgtggattagattcggctatgacccacggaaaaatccagatgcaaaaatctatcaagtcctcgatttccgcataagatgcggcatgaagcatgggtatgctccctcagacttgccggtgaaagccaaacgctccacttacaactacagtctccccatcaccgtaaagaagacatcatcacaactggtgacaatgcatgatttgaagcagggtctgggcccatcgggcacttccggggcccgcaagcctgcctcaagcaagtataagctgaaagttagcctccagaccttgagggactccgtgtatatcttccgcgagggagctctccctccctaccgacagatgttttatcagctttgtgacctcaatgtcgaggaactccagaagattattcacaggaacgatggagctgaaaattcctgtactgagagggatgggtggtgcttgcccaaaacatccgacgagctgcgtgacactatgtcattgatgattaggcagacaattagatccaaacgacccgcgctatttagcagctcagctaaggccgacggcggtaaagaacagctcacctacgaaagcggagaagatgaggaggatgaagaggaagaggaggaagaagaagaggacttcaaaccgagcgacgggtcagagaacgagatggagacggaaatccttgactatgtgtag

SEQ ID NO: 11888 - DNA, 834 bp, Artificial Sequence
  Description of Artificial Sequence: Synthetic coding sequence
atgctgcgaccagaaaaggaggccttctttcaccaggagttaccactgtatattccgcctcccatcttttctcggttggacgctcctgtggactacttttacagaccagagactcagcatcgcgaggggtataacaacccacccatctcgggtgagaacttaatcggcctgagtcgggctagaagaccacacaatgccattttcgtaaactttgaagacgaggaagtgccaaagcaacctctcgaggctgcagctcaaacatggcgcagggtgtgtacaaatccggtggaccgtaaagtcgaggaggagctgcggaaactgttcgatattcgacccatctggtctcgtaatgcggtgaaggccaacattagcgtgcaccctgataaactaaaggtcctacttccgttcatcgcctactatatgatcaccggcccatggaggtccttatggatcagatttggctacgatccccgaaaaaaccccgacgctaaaatctaccaggttctcgacttcagaattcggtgcgggatgaagcacggctatgctccgtctgacctgcctgtgaaggccaaaaggtctacgtacaactattccttgcctatcaccgtcaagaaaactagtagccagctcgtcaccatgcacgacctcaagcaggggctgggccccagtggaacgagcggtgctcgaaaaccagcttcctctaaatacaaattaaaagtgagtttacagaccacctcaggcgaggaggtggtgacctctctgagggaggtgtggcatcagcagctccacgtagtcgtgctgcttgagcccttcgggagcctgggccctcattag

SEQ ID NO: 11889 - DNA, 1239 bp, Artificial Sequence
  Description of Artificial Sequence: Synthetic coding sequence
atgtctgacttccagtatcttgctgttcataccgaagctggaggcaagcatacatcaatgtatgataaagtcctgatgcttcgaccagagaaggaggctttcttccatcaagagctaccgctttacattccccccccgattttcagcagattggacgcccctgtagactacttttatagaccagagacacagcacagagaggggtataacaatccccccatttcaggcgagaatctgatcggcctaagccgtgcccgtcgacctcacaatgccatttttgttaacttcgaggatgaagaagtgccgaagcagccgctcgaagccgcggctcagacatggcgtcgggtgtgtacgaaccctgtagatcggaaagtagaagaagagcttcggaaattgttcgatatccgacctatctggtctagaaacgcagtgaaggcaaatatctccgttcaccccgacaagctcaaagtgctgctgccattcatcgcctattacatgattaccggaccttggcggtctctgtggatccgatttggatacgatccccgcaagaaccccgatgcgaaaatctatcaagtgctggatttcaggatccggtgcggcatgaagcatggttatgccccatccgaccttccggtcaaggctaagaggtccacctacaactacagcctgccgatcacggtgaagaagacttcgtcccaactggtaaccatgcatgatctgaagcagggactgggtccttccggaactagtggagcccggaagcccgcctcttcgaagtacaaattaaaagtgagccttcaaacactgcgggtgcggactcgagttcagtccccacgtgccgtgtgcgtgggtgatatctggaggcgtggcggcgataaaagccaaggttctctggcccctgcagccgcttgtggctgtccatcccgggcactctgggaacctggcccccccctgtcacacgtcactactccgggcatgatcggaatcggccacacacaggaagacagggccagagcggggcacgtgggatgctcctgtggacgcagtctgaccggatcaaggtttagacagtgtggttgcccggccggagtggggggattccagagttgctctcacattcaagcaccggcctcccgttctacggctctgggtgaagcagaaaagggagccagtcgtacagttgagtcaccagctgagggtgttggcggcagagacgagtgtagcagagatggctag

SEQ ID NO: 11890 - DNA, 1560 bp, Artificial Sequence
  Description of Artificial Sequence: Synthetic coding sequence
atggcagcagaggcggctgatctagggctgggtgccgccgtccccgtcgaactgagaagggaacgcaggatggtgtgcgttgagtaccccggcgtggtgagagacgtggcgaagatgctgccaacactgggcggggaagagggagtttcccgaatctatgctgatcctacaaagcgccttgagctctactttaggccaaaagacccctactgtcacccggtctgcgcaaaccggttttcaaccagttctttattgctccgaatccgcaaaagaacaaggagacagaaaggagtgctcggaacagaagctcacagcgaagtgacctttgacatggaaatcttgggcattatctccacaatttacaaattccaagggatgagtgacttccagtacctcgcagtgcataccgaggccggaggaaagcacacaagtatgtacgataaggtcttaatgctccggcctgaaaaggaggccttttttcaccaggaattgcctctgtatatcccaccccccattttcagccgcctcgatgcccctgtcgattacttttaccgcccggagacacagcatagggagggctataataaccccccaatctccggggagaatctgataggcctctctcgggctcgccggccacacaatgctatattcgtgaatttcgaggatgaggaagtgcctaagcaacctcttgaggctgcggctcagacctggcggagagtgtgcactaacccggttgatcgcaaagtggaggaggaactaaggaagctgtttgatatcagaccgatctggagtcgaaatgccgttaaagcaaacattagtgtgcaccccgacaagttgaaagtcctcctaccttttatcgcctattacatgatcacaggcccgtggcgctccttgtggatcaggtttggttacgatcctaggaaaaaccctgatgctaaaatctaccaggttctagactttaggataaggtgcggcatgaagcatggatacgcaccatctgatctccccgtgaaagccaaacgatcaacatacaattatagccttccgataacagtcaaaaaaacttcgtctcagctggtcactatgcatgacctcaagcagggcttaggacccagcggcacgagcggcgctagaaaaccggcctcctccaaatataaacttaaggactcagtatacatatttagagagggcgctcttcccccctaccgccagatgttctaccagctgtgtgacttgaatgtggaggaactgcagaagattatccatcgcaatgacggcgccgaaaacagttgcacagagcgcgacggctggtgtctgcccaagacttcagacgaactgcgggatacaatgtcattgatgattagacagaccattagatcaaagaggcctgctctgttcagctcctccgccaaggctgacggcggaaaggaacaactgacctatgaatcaggcgaagacgaagaggatgaggaggaggaggaagaagaggaagaggactttaagccttcggatggcagcgaaaatgagatggagactgagattctcgattacgtctag

SEQ ID NO: 11891 - DNA, 1533 bp, Artificial Sequence
  Description of Artificial Sequence: Synthetic coding sequence
atggccgccgaggctgcagaccttgggttaggtgcggccgtgcccgttgagcttcggagggagcgtcggatggtctgcgtggagtaccctggggtggtccgggacgtggcaaagatgctccccacccttggaggagaagagggcgtcagcaggatatacgccgatccacctaaggacccctactgtcatcctgtgtgcgccaatagattttccacgtcttcgttgctgctgaggatacgaaaacgtacaagacggcagaagggcgtgctaggcacagaggcgcactccgaggtgactttcgatatggaaattctcggtataatctccacgatttacaagttccagggaatgtcagatttccaatatcttgccgttcatacagaagccggaggcaaacatacctcgatgtacgataaagttctgatgctgcgcccagagaaggaagctttctttcaccaggagttgccactctacattcctcctccgattttcagtaggctcgatgcacccgtagactacttctatcggccagagactcagcatagggaggggtataacaatcctcctatctccggcgaaaaccttatcgggctttcacgcgctcgcagaccacataatgccatcttcgtgaatttcgaagatgaggaagtcccaaagcagcccctcgaggccgccgcacagacttggcgacgggtttgcacaaacccagtggaccgaaaggttgaggaggagctccggaaactctttgatatccggccgatatggtccagaaacgcggttaaggctaacatcagtgtccacccagacaagttgaaggtgcttttgccattcatagcctattacatgattaccgggccctggaggagcctatggattcgtttcggctacgacccccgtaaaaaccccgacgcaaaaatctaccaggtgcttgacttccgaatcaggtgtggtatgaagcacggctatgctcccagcgacctgcctgtgaaggccaagagatctacatataattattctctgcccataactgtgaagaagacatcctctcaacttgtcactatgcacgatttaaagcagggattaggtccctcaggaacaagcggggccagaaaaccagcctcatccaagtataagctgaaagatagcgtttacatattcagggagggcgcactccctccgtaccgccagatgttctatcagctgtgcgaccttaatgtcgaggagctccagaagatcatccatcggaacgatggagccgagaattcttgcaccgagagagacggatggtgtctcccaaaaacctccgatgagctccgggatacaatgtcactcatgatcagacaaaccatccggagcaagagacccgctctcttttccagcagtgctaaggcagatggaggcaaggagcagctcacgtatgaatccggcgaagacgaagaggacgaggaggaggaggaagaagaggaggaggattttaagcctagcgatggaagtgaaaacgaaatggaaacagaaatcctcgattacgtatag

SEQ ID NO: 11892 - DNA, 1581 bp, Artificial Sequence
  Description of Artificial Sequence: Synthetic coding sequence
atggcagcggaggccgcagatttgggccttggtgccgccgtgcccgtcgagctaagaagagagaggcggatggtgtgcgtggagtaccccggcgtggttcgtgacgtagccaaaatgctgccaacactcggcggagaggagggcgtgtcccggatatatgctgacccaacgaagcgcctcgagctctatttccgtccaaaggatccctactgtcaccccgtctgtgcgaatcggttctcaacctccagcctgttactcaggatacgcaagagaacacgccgccagaaaggagtgcttggtacagaagctcattccgaagtaaccttcgacatggagatcctgggcattatttctacaatttataagttccagggaatgtccgacttccagtacttagccgttcataccgaggccgggggtaagcatacctccatgtacgacaaggtgcttatgcttagaccagagaaggaggctttctttcatcaggagttacccctgtatattcctcctccgatcttctctaggctagatgcacctgtggactatttttatcggcccgagacccagcatagggagggatacaataaccccccgatctccggcgaaaacttaattggactgtctagagcccggcgacctcacaacgccattttcgttaactttgaggatgaggaggtcccaaaacagcccttggaagccgccgcccagacctggcgacgggtgtgcacaaatccggtggacaggaaagtagaagaagagcttaggaaattgtttgatattcggcccatctggagcagaaatgccgttaaggctaatatctcagttcaccccgacaagctcaaggtcttgctccccttcatcgcctactacatgataacaggaccatggcgatcactgtggatcagatttggctacgatcccaggaaaaatcccgacgccaagatctaccaggtgctagactttcgcatccgctgcggcatgaaacacggctatgcacctagcgatctgccggtgaaagccaaaagatctacatacaactacagcctccctattacagtgaagaaaacctcatcccagcttgtaactatgcacgatctgaaacagggcttgggaccttctggtacttccggggcacggaaacctgcttcatcgaagtacaagttaaaggttagcctgcaaacactgcgtgatagcgtgtacatcttcagagaaggagctctacctccttatagacagatgttttaccaattgtgtgacctcaacgtggaggagctgcagaaaataattcatcggaatgatggggccgagaattcgtgcacggagagggacggatggtgccttcctaagaccagcgacgaactgagggatacaatgtctctcatgattagacagacaatcagatcaaaacgaccagccctgttcagtagttctgcgaaagcggacggcggtaaagaacagttaacatacgagtcgggtgaggatgaggaagatgaggaggaagaagaggaggaggaagaagactttaaaccatctgacggatctgaaaatgaaatggagacagagatcctggactatgtttag

SEQ ID NO: 11893 - DNA, 597 bp, Artificial Sequence
  Description of Artificial Sequence: Synthetic coding sequence
tgaccactcgaagccgccgcccagacttggagacgggtctgcacaaacccagtggatcggaaggtggaggaagagctccgtaagctgttcgacatcaggcctatctggtcgagaaacgcggttaaagccaatatctcggttcaccctgacaagctgaaagtcttattgccatttatagcctactatatgataaccgggccatggcggagcctctggatccgcttcggctacgatccacgtaagaacccagacgctaagatctaccaagtcctggattttagaatccggtgtgggatgaagcacggatatgctccctccgatcttccagttaaagccaagcgatcaacgtataactattcccttcccatcaccgtgaaaaaaaccagcagccagctggtcaccatgcacgatctcaagcaaggactcggaccatccggcacttcaggagccagaaagcccgcttccagtaagtataaattaaaggttagccttcagacatcaggtgaggaggttgtgacatcgttgcgcgaagtttggcaccagcagctgcacgtagtcgtcctgctggagcctttcggatcgctggggccacactag

SEQ ID NO: 11894 - DNA, 273 bp, Artificial Sequence
  Description of Artificial Sequence: Synthetic coding sequence
tgaattcggtgcgggatgaaacacgggtacgccccatcagatctgccggttaaggccaagcgctctacctacaattacagtcttccaatcaccgtgaaaaagacctctagtcagctggttactatgcatgatcttaaacagggtcttggcccaagtggtacctctggagcaaggaaacctgcctcaagtaagtacaaactgaaggtcggcgctcccgggggccaggagtggcgtggggggcttccttcctgggggagggccccatgtggctag

SEQ ID NO: 11895 - DNA, 675 bp, Artificial Sequence
  Description of Artificial Sequence: Synthetic coding sequence
atgtcggacttccaatatctggcggtgcataccgaggccggaggcaaacacacatccatgtacgataaggtgctcatgctcagaccagagaaagaggctttcttccatcaagaattacccttgtatatcccacccccgattttttccaggttggacgctccggtggattacttttatcggcctgagactcagcatcgcgaagggtataacaacccccccatctcaggcgagaatcttatcggcctgtcgcgggctagacgcccccacaatgcaatttttgtcaatttcgaagacgaggaagtccccaaacaacctctggaagctgctgcacaaacctggaggagagtctgcaccaaccccgtggaccggaaagtagaagaagaactccgtaaactatttgatatccggcccatctggagtaggaatgccgtaaaagccaacatctcagtgcaccctgacaaacttaaggttctgttgccattcatcgcatattacatgattactggcccttggagaagcctatggatccgcttcggctacgacccccgcaaaaatcccgatgcaaaaatctaccaagtgctagatttcaggattaggtgtgggatgaagcacgggtacgccccatccgacctgcccgtaaaagctaagcgatccacctataactacagcctttag

SEQ ID NO: 11896 - DNA, 735 bp, Artificial Sequence
  Description of Artificial Sequence: Synthetic coding sequence
atgacccgcgccatttacgcggatccaaccaagaggctggaactctacttcagacccaaagacccatactgccaccccgtgtgtgctaatcggttttccacttctagcctgttgcttagaatacgtaagcgtacacggaggcagaaaggtgtgttggggaccgaggcccactcagaagtgaccttcgatatggaaatcctcgggatcataagcactatctacaagttccagggtatgtcagattttcagtacctggctgtccatacagaagccggaggcaaacacaccagcatgtacgataaggtgttgatgcttcgtccagagaaggaggccttctttcaccaagaactgccactctatatccccccccctattttttctagattagacgctccggtggattatttctaccggcctgaaacacaacatagggagggctataacaatccccccataagcggcgagaacctgatcggcctctctcgtgcaagacgacctcataacgccatttttgtgaacttcgaagacgaggaggtccctaagcagcctctagaggccgcagcgcagacgtggcgccgagtctgtactaaccctgtggataggaaagtggaggaggagctgcgcaaactgttcgatatcagacctatctggagcaggaacgcagtgaaagccaacatctcagtacacccagacaagctcaaagtactgctcccgttcatcgcctactacatgtag

SEQ ID NO: 11897 - DNA, 1548 bp, Artificial Sequence
  Description of Artificial Sequence: Synthetic coding sequence
atgggtagcttaagcagtcgcgtgctgaggcagccccgtcctgcgttagctcagcaagcccagggagctcgagcaggcgggagtgcaagacgccccgacacaggtgacgatgctgctggccatggcttttgctattgtgccggctcccacaagcgtaaacggagctccggctcattttgttactgccatcccgattccgagaccgacgaggatgaagaagagggcgacgagcaacagcgacttctgaatacaccacgaaggaaaaagctgaagagcacaagcaaatacatctatcagactctttttttaaacggggaaaatagcgatattaagatatgcgccctgggagaagaatggtccttgcataagatttacctgtgtcaatctggttatttctctagtatgtttagcggatcctggaaagagtcttcgatgaatataatcgagctggagatacccgatcaaaatatagacgtagaggccttgcaggttgccttcggcagtctgtatcgggatgacgtgctgatcaagccttcacgagtcgtggccatcctcgctgctgcctgcctcctgcagctagacggactgattcaacagtgcggagaaaccatgaaagagaccgtaaacgttaaaaccgtatgcggctactacacctccgcaggtacatatggtctggatagcgtgaagaagaaatgcttagagtggctcctcaataaccttatgacgcaccagaacgtggagctatttaaggaactctctatcaacgtgatgaaacagcttatagggtcttctaatctgtttgtgatgcaggtggagatggacatttacactgccctgaagaagtggatgttcttgcagctggtcccatcctggaacggctctctcaagcagcttctgactgaaaccgatgtgtggttcagtaaacagcgcaaggatttcgagggcatggctttcctggaaaccgaacagggcaagccatttgtgtccgtgtttcgccatctgcgactgcaatacattatctctgaccttgccagcgccagaatcatcgaacaagacgcggtggttccctcagaatggctctctagtgtatataaacagcaatggttcgcaatgctacgggcagaacaggactcagaggtcggcccacaagagatcaacaaagaggagttagagggaaacagcatgagatgcggtcggaagctggctaaagatggcgaatactgttggcgctggaccgggtttaacttcgggttcgatctattggtgacatacaccaataggtatattatttttaaacgaaacactctgaatcaaccctgctctggcagtgtttcccttcagccaagacggagcattgcatttcgcctcaggcttgcatcgtttgactcttcgggaaaattgatttgcagcaggaccaccgggtatcagatcctcaccctggagaaagatcaggaacaggtggtaatgaacctcgatagccgcttacttatcttcccactttacatctgttgtaatttcctttatatctctccagagaaaaagaattag

SEQ ID NO: 11898 - DNA, 1311 bp, Artificial Sequence
  Description of Artificial Sequence: Synthetic coding sequence
atggagcccgatgacttcgactctgaagataaggagattctatcctgggatatcaatgacgtcaagttacctcagaacgtcaagaagacggactggttccaggagtggcctgatagctacgctaaacacatctacagcagtgaggacaagaatgctcaacgccacctttcttcttgggctatgaggaacactaacaatcataatagccgtatattaaagaaatcctgcctcggtgtggtagtgtgcggccgtgattgcttagccgaagagggcaggaaaatatatcttcgcccagcaatatgcgacaaagcgagacagaaacagcagaggaaacgatgtcccaactgcgatggcccgctcaagctgattccctgccgtgggcacgggggttttccagtaacgaacttctggcgacacgacggccgattcatttttttccaaagcaaaggggaacacgatcacccaaaaccagagaccaagcttgaggccgaagccagacgcgccatgaagaaagtgaataccgctccatctagcgtctccttgtcccttaaagggagcacagagacccgctccttgcccggcgagacccaaagtcaggggtcccttcccctgacttggtcattccaggagggggtgcagctgcccggcagttatagtggccatttgattgcaaacaccccacagcagaactctctcaacgattgcttcagtttctctaagtcgtacggcctggggggtatcaccgatctcacggaccagacatccacagtcgacccaatgaagctttatgagaaacgcaaactgagcagctctcggacatacagctccggtgacctcttgcccccctccgccagtggcgtttacagtgaccatggcgacctgcaagcctggagcaagaacgcagcgctgggccggaaccacctagcggacaattgttattcgaattaccctttcccactaacttcctggccatgtagttttagtccatcacagaactcgagtgagcctttctaccagcagctgcctttggaaccaccggccgccaaaactggatgccccccactgtggcctaatcccgctggcaatctgtatgaggaaaaggtccacgtcgactttaattcttatgttcagagtcctgcttatcactccccccaggaagatcccttcctctttacgtatgcaagccatccgcatcaacaatacagcctgccgagcaagagtagtaagtgggacttcgaggaggagatgacctatctgggcctcgaccattgcaacaatgacatgcttctgaacctgtgccctctgaggtag

SEQ ID NO: 11899 - DNA, 1521 bp, Artificial Sequence
  Description of Artificial Sequence: Synthetic coding sequence
atgccagccgcagctgtgcaggaggccgttggggtctgctcttacggaatgcagctgagttgggatattaacgacccgcagatgccgcaggaactcgctctgttcgaccagtttcgggaatggcctgatggttacgtgcgattcatttattcgagcgatgagaagaaggcacaacgacatctctcaggatgggcaatgagaaacaccaacaatcacaacggccacattctaaagaagagctgcctcggtgtcgtcgtgtgtactcaggcgtgtacgctgccagatggatctcggttacagctgagaccagcaatctgtgataaggcaagattgaagcagcaaaagaaagcttgcccaaactgtcattccgcgctcgagctgattccatgccgggggcacagtgggtatcctgttacgaacttctggcgattggacggaaacgctattttcttccaggccaagggtgttcacgaccaccctcggcctgaatccaagtccgagaccgaagcgagacgaagcgccatcaagcgccagatggcatcattctaccagccacaaaagaagcgaattagggaaagcgaggcagaggaaaatcaggactcctctgggcacttcagcaacatccctccattagagaaccccgaagatttcgacattgtgaccgagacaagtttccctatcccagggcagccgtgtccttccttccctaagtctgatgtttataaggcgacatgcgacctggctacctttcagggtgacaaaatgccgcctttccaaaaatactcaagccccaggatttatcttccccgcccaccttgttcgtatgaactggcaaaccctggatatactaactcaagtccttatcctacactatataaagactccactagcatacctaacgacactgattgggtccacctaaacacactgcagtgtaacgtcaatagctacagttcttacgagcgatcttttgacttcaccaataagcagcatggctggaaacccgcattgggcaagccatcactggttgaaagaaccaaccatggtcagttccaggccatggctacaagaccctactacaatccagaactgccatgtcgctacctgacgacgccaccccccggggcaccagctctacaaactgtcattaccaccacaacaaaagttagttatcaagcatatcagccaccggcgatgaagtacagtgactcagtgagggaagttaagtctctctcttcctgcaactacgcccctgaagacacaggcatgagtgtgtatcctgagccttggggaccccctgtgaccgtgactcgcgccgccagtcccagtgggccaccacctatgaaaattgccggggactgtcgggctataaggccgactgtagcaatcccgcatgagcccgtgtcttcacggactgatgaagccgagacctgggacgtgtgtctgagcgggctggggtccgcagtgagctattctgatcgggtgggtcccttttttacctacaataatgaagacttctag

SEQ ID NO: 11900 - DNA, 1863 bp, Artificial Sequence
  Description of Artificial Sequence: Synthetic coding sequence
atggcggaagcaagaacaagtctaagtgctcattgtagaggccctctggcgaccggactgcatccagatctcgatttgccgggaaggagcctcgcgactccagccccaagttgttatctcctggggagcgaaccctctagcggcttaggcctccagccagagactcatctgccagagggtagtttaaagaggtgctgtgttctgggtctccccccaacaagccccgcttccagttccccttgcgccagtagcgatgttaccagtattatccgcagctcacagaccagtctcgttacatgtgtgaatggcctgcggagtcctcccttgactggtgacctgggaggcccatcaaagcgagctcggcccggacccgccagtacggactcccacgagggcagtcttcagctggaggcctgccgaaaggcaagttttctgaaacaggaacccgccgacgaatttagcgaactgtttgggccccatcagcaggggctaccgcctccatatccactatcccagttaccacccgggcctagcctgggcggtctcggcctcggactggctggtagagtggttgcgggtcgacaggcttgtaggtgggtcgattgctgtgctgcttatgagcaacaggaggaactcgtgcgccatatcgaaaaatcccacattgaccagcggaagggtgaagatttcacatgcttctgggcaggatgcgtccgcagatataaaccttttaatgctcggtacaagctgttgatccacatgcgggttcactcgggagagaagcctaataagtgtatgttcgaagggtgctccaaagcgttctcccgtcttgaaaatctgaagattcacctgagatctcacactggcgagaagccctatttgtgtcagcacccgggttgtcagaaagctttcagcaactcgtctgatcgggctaagcaccaacgcactcatcttgatacaaaaccctacgcctgccagattccgggctgctctaaaaggtacacggacccatcttcactgcgaaaacacgtcaaggcacactctgctaaagagcagcaggtgcgaaaaaagttgcatgctggccccgataccgaagcagacgtgctgacagaatgcttagttctccagcagctgcacactagcacgcagctggcagcgtctgacggcaagggcggttgtggcctgggacaggaactcttaccaggagtgtacccgggcagcatcactcctcacaatggactggccagcgggctgctgcccccagctcatgacgtgccatcgaggcatcatcctctggatgccacgacgtcatctcatcatcatctatcacctctgccaatggccgagtcaacacgggatgggctgggccccggattgttgtctcctatcgtgagtcccctcaagggcttgggcccccccccgctgccaccttcatcacaatcccacagccccggtgggcagccatttcctaccttaccatccaagccttcataccccccatttcaatcacctcctcctcccccattgccaagcccccagggctaccaggggagtttccactcgatccagagctgcttcccttatggcgactgttataggatggccgagccggccgctggaggcgatggcctcgtaggagagactcatggctttaacccccttcgaccgaacggatatcattcactgtcaacaccactgccagctaccggttatgaggctctcgctgaagcgagctgcccaaccgctctccctcagcaaccttcagaggacgtcgtttcttcgggccctgaagattgcgggtttttccctaatggggcgtttgatcactgccttggtcacattccatccatttacaccgacacctag

SEQ ID NO: 11901 - DNA, 1662 bp, Artificial Sequence
  Description of Artificial Sequence: Synthetic coding sequence
atggctgcggtaagcttacggcttggagacctggtgtgggggaagttggggaggtatcccccttggcccggcaaaattgtgaatccccccaaggacctgaagaaacccaggggcaagaagtgtttttttgtgaaattttttggtacagaggatcacgcttggatcaaggtcgagcaactaaaaccctaccacgcccacaaggaagaaatgatcaaaataaacaagggaaaacgcttccagcaggcagtagatgctgtcgaggagtttttgaggagagctaaagggaaggatcagacaagctctcacaactcttcagacgacaaaaatagacgcaattcaagcgaagaacgtagtcgcccgaactccggagacgagaagcgcaagctctccctcagcgaaggtaaagttaagaagaatatgggcgaaggaaaaaagagagtctccagtggttcaagtgagcgtggatccaagtctccccttaagcgggcccaagagcaatccccccggaagcgtggccgacctcccaaagatgaaaaagacctgacaatacctgagagctccacggtgaaggggatgatggcgggcccgatggcagcttttaagtggcagcccaccgcgagtgagccagtaaaggatgccgatccacacttccaccactttcttctatctcagaccgaaaaacccgccgtgtgctatcaggcgatcactaaaaaactgaagatatgtgaagaagagaccggttcgacttcaatccaggccgccgacagcacggccgtgaatgggtccatcactccaacagacaagaagatcggattcctgggtctgggtctcatgggtagtggcatagtctctaacctcctcaaaatgggccatacagtaaccgtatggaatcgcaccgcagaaaagtgtgatctttttatccaggagggggcacggttgggacggaccccagccgaagttgtgtccacgtgcgacataacattcgcttgtgtcagtgaccccaaggcagccaaggatctggttctaggaccctctggcgtcctacagggaatcaggccagggaagtgctacgtggatatgtcaactgtggatgctgatacagtcacagaactcgcacaggtgattgtgtcacggggtggcaggtttctggaggcccccgtgtccggcaaccaacaattaagtaatgacggcatgctagtgatacttgcagcaggagacagaggactatacgaagactgtagctcttgctttcaggccatgggcaaaacctcattcttcctgggcgaagtgggcaatgctgccaagatgatgctgatagtgaacatggtgcaggggtcttttatggccacgatcgctgagggcctgactctcgcacacgtgacaggacagagccagcaaacattgttggacattctgaatcagggccagctggccagcatctttttggatcagaagtgccagaatatactgcagggaaatttcaaacctgatttttatctgaagtatattcagaaagacctacgacttgcaattgctctgggtgacgctgtgaatcatccaacacctatggctgctgccgccaacgaagtgtacaagcgagctaaagcccttgaccagtctgacaatgatatgtctgctgtctacagggcttacattcactag

SEQ ID NO: 11902 - DNA, 1611 bp, Artificial Sequence
  Description of Artificial Sequence: Synthetic coding sequence
atggctgcggtgagcctgaggctgggagatcttgtgtgggggaaactgggtcgctaccctccttggcccgggaaaatcgtgaaccccccgaaagacctaaaaaagccacgcggtaaaaaatgtttctttgtgaagtttttcggcacggaggatcacgcctggattaaggtagaacaactgaagccatatcatgcccacaaggaagagatgattaagattaataaaggcaagcgcttccaacaggccgtggacgccgttgaagaattcctgcggcgagcaaaaggtaaggaccagacatccagccacaatagcagcgacgataaaaacaggcggaactcctcggaggagcgcagtcgccccaactcaggggatgaaaagaggaagttgtctctgtcagagggaaaggtgaagaaaaatatgggcgagggtaagaaaagagtctcctcaggctccagcgaaagaggcagtaaaagccctctgaaacgggctcaagaacagagccccagaaagcgggggcggccaccgaaggacgaaaaagacttgaccatcccagaatctagcacagtcaagggcatgatggccggcccgatggccgcctttaagtggcagccaaccgcatctgagccggttaaggacgctgatcctcattttcaccactttctgctgagtcagactgagaaagagaccgggtctacgtcgatccaggctgctgactcaacagcagtcaacgggtccattacccccacggacaagaaaatagggttcctgggcctgggattaatgggatctggaatcgtgtccaaccttttgaagatgggccacactgtaactgtttggaacaggactgctgagaaatgcgatcttttcattcaggaaggagccagattagggcgcacaccagctgaagtggtctctacctgcgatatcacctttgcctgtgtctccgatcctaaagctgccaaagatctggtgctggggccctctggagttttgcagggtatccgcccaggtaagtgctacgtggacatgagcaccgtggacgcagacactgtcactgaactcgcacaggtgatcgtgtcacggggaggtcgctttttggaggcccctgttagcggcaaccagcaactcagcaacgatggaatgttggttatcttggccgccggtgaccgtggactgtatgaggattgcagcagctgctttcaggctatggggaagacctctttttttcttggggaagtaggcaatgcagctaagatgatgcttatagtcaatatggttcagggctccttcatggccaccatagcagaggggcttactttggcacacgtaactggccagagtcagcagaccctgctggacatactaaatcagggacagctcgcatctatctttctcgaccagaagtgtcagaacatcctgcagggtaacttcaagcccgatttttatctgaaatatatacagaaagacttgcgactggccattgccctgggcgacgctgtgaaccacccgacccccatggcagctgcggcaaatgaagtgtacaagcgcgctaaggcgctagatcagagtgacaatgacatgagcgccgtgtaccgggcgtatattcattag

SEQ ID NO: 11903 - DNA, 1419 bp, Artificial Sequence
  Description of Artificial Sequence: Synthetic coding sequence
atggcggcggtgagtcttcggctgggcgacctggtgtggggaaaattgggacgctaccctccgtggccgggaaagatcgtgaacccccctaaggacctcaaaaaaccaaggggaaaaaaatgcttcttcgtaaagttcttcggcactgaggaccacgcttggatcaaggtggaacagctcaagccataccatgcccataaagaggagatgataaagatcaacaaggggaagagattccaacaggccgtggacgccgtagaggaatttctgagacgcgctaaaggcaaagatcaagacctgaccatccccgagtcaagcacagtcaaggggatgatggcaggtccgatggctgcatttaagtggcagccaactgcgagcgaacccgttaaagatgctgacccccacttccaccactttctattaagtcagactgagaaaccagctgtttgttatcaggctattaccaaaaaactcaagatatgtgaagaggagaccggaagtactagtatacaggccgctgacagcacagccgtgaatggctctatcacaccaacagacaagaagattggtttccttggccttggtctgatgggatccggcattgtatctaacctcctaaaaatgggtcatactgtaacggtgtggaaccggaccgccgagaagtgcgacctgttcatccaagagggcgcgaggcttggaagaactcctgccgaggtagtgtcaacctgcgacattacttttgcatgcgtaagcgaccccaaggccgctaaggatctcgtgctggggcctagtggcgttctccaaggcattagacccggtaaatgctacgttgacatgagtaccgtggacgcggatacagtaacagaactcgcccaggttatcgttagcagaggtggacgcttcttggaagccccggtgtcagggaatcagcagctatctaacgatggaatgttagtgatcctggctgcaggcgaccggggactgtacgaggactgttcgagttgctttcaggccatggggaagacaagcttttttctcggcgaggttgggaacgccgcaaaaatgatgctcatcgtgaacatggtgcagggttccttcatggccacaatcgccgaagggctgaccctggcccacgtgactggacagagccagcagacactactggacatactaaatcagggacagttagcctccattttcctggatcaaaaatgtcagaacattttacaaggcaactttaaaccagacttttacctcaaatacatccaaaaagatctccgcctcgctatagccttgggcgacgcggtaaatcatcctaccccaatggccgccgccgccaatgaagtttataaacgtgccaaagcgctggaccaaagtgacaatgacatgtcagctgtctatcgtgcctacattcactag

SEQ ID NO: 11904 - DNA, 6723 bp, Artificial Sequence
  Description of Artificial Sequence: Synthetic coding sequence
atgctgccctgtaaaaaacgacggactaccgttacagagagcctccagcacaagggtaaccaggaggagaataatgttgacctggaatccgcggtgaagccagagagcgatcaagtgaaggacttaagctccgtcagcttatcatgggatcccagccatggccgtgtggctgggtttgaggtccagagcctccaggatgctggtaaccagctcgggatggaggatacaagcctgagctccggtatgctcacacagaacacaaacgtccccatattggaaggggtcgatgtggccatctcccagggtatcacactcccgagccttgagagttttcatccgctgaacatccatataggcaagggaaagctgcacgccaccggttccaagaggggtaagaagatgacccttaggcctggtcccgtaacccaggaggaccgctgtgatcatcttaccttgaaagagccattctctggtgagcctagcgaggaggttaaggaagagggaggtaagccacagatgaatagcgaaggagagattcccagcctaccttctggctcacagtccgcaaaaccggttagccagcctcggaaaagcactcaacctgacgtgtgcgcgagtcctcaggagaagcctcttcgcaccttattccatcagcctgaggaggagatagaggatggtggcttgttcatccctatggaggaacaggataacgaagagtcagagaaacgccgtaaaaagaaaaaaggcaccaaacggaagagggacggccgtgggcaggaaggcacgttggcctatgatttgaaactcgatgatatgctggaccgaacactggaagatggagctaaacagcacaatttaacagccgtgaatgtgaggaatatactccatgaggtgattacaaacgaacatgtggtggctatgatgaaggcagccatttccgagactgaagatatgcccatgttcgaacccaagatgactagaagcaaactgaaggaggtggtggagaaaggagtcgtcattcctacttggaatatctctcctattaagaaggcaaatgaaatcaagcccccccagttcgtggatatacacctggaagaagatgacagtagcgacgaggagtaccagccagatgacgaggaagaggacgaaacagccgaagaaagcctgcttgagtcggacgtggagtcgaccgctagttccccgagaggcgctaagaagagcaggttaagacagagtagtgagatgaccgagaccgacgaggaaagcggtatccttagcgaagcagaaaaggtgacaactcctgccattcggcatatcagcgcggaggtagtgccaatgggaccgcctccaccccctaaaccaaaacagaccagggactctacctttatggagaaactgcatgccgtggacgaggagctggcatcgagtcctgtatgtatggattctttccagccaatggacgacagtctcattgctttccggacccgatccaagatgcctttgaaggacgtccctctgggccagctcgaggccgagttacaagcgcccgatatcacccccgatatgtatgatcctaacacggcggatgatgaggactggaaaatgtggctgggaggtcttatgaatgatgacgttggcaatgaggacgaagcagatgatgatgatgaccctgaatataacttcctggaggatctagacgaacctgataccgaggacttcaggaccgacagagcagtcaggatcacaaaaaaagaagtcaacgagctcatggaagagctcttcgagacgttccaggacgaaatgggattcagcaatatggaagatgacggccccgaggaagaggagtgcgtcgctgagccacggcccaacttcaatacaccacaggccctgcgatttgaggagcctctggccaatctgttaaatgaacaacatagaactgtgaaggaactgtttgagcagctcaaaatgaaaaagtcctcagctaagcagcttcaagaggtagaaaaagttaagccccagtcagaaaaagtgcaccagactctgatactcgatcccgcacaacgcaaacgtttgcaacaacaaatgcaacagcacgtgcaactgttgacacaaatccatctgctggccacctgtaatcccaaccttaatccagaagcaaccaccacaagaatctttctcaaggaactggggacttttgcccagtccagtatagctcttcaccaccagtacaacccaaagtttcagaccctattccagccatgtaacctgatgggcgcaatgcagctgattgaagacttcagcacccacgtgagcattgactgcagcccccataagacagtgaaaaagaccgcaaacgagttcccttgcttacctaaacaggtggcttggattctggccacctctaaggtattcatgtaccctgagctgctccctgtatgcagtctgaaggccaagaacccccaagacaaaattgttttcacaaaagcggaagacaatctgctggctctggggctaaaacactttgaggggaccgagttcccaaatcccctcatctcaaaataccttctcacttgcaagacagcccatcagctcacagtccgtattaaaaatcttaatatgaatagagcccccgacaatattattaagttctacaagaaaaccaaacagcttccagtgttaggaaaatgctgcgaagagatccaaccacaccagtggaagcctccaattgaaagagaagagcaccgtcttccattctggctgaaagccagtctacccagcattcaagaagagctcaggcatatggcagacggcgccagagaggtgggaaacatgaccggaacaacagaaatcaactccgatcggagtctggagaaggataatctcgaactaggatcagaatctcgatatcccctgcttctcccgaagggagttgtcctgaaactgaagccagtagccactagattcccaaggaaagcctggcggcaaaaacgatccagtgttcttaagcccctcttgattcagccgtctccctctctgcagccaagtttcaacccagggaaaacaccagcacggagcacacactccgaggcccctccgtccaagatggtcctccgtatcccccaccccatccagcctgccacagttctgcagaccgtgcctggagtccccccattgggcgtatccgggggggaatccttcgagtcaccggccgcattgccggctgtacctccagaagcccgtacgtcttttccactgtctgagtcgcagacactgctgagctctgcacccgttccaaaggtgatgctgccatcgcttgctccttcaaagtttcgcaaaccttacgtccgcagaagaccttccaagaggcggggagttaaagcaagcccctgtatgaagcccgctcctgtcatccatcatcctgcttctgtcatctttactgtgcctgcaactacggtcaaaatagtgagtctgggtggaggctgcaacatgatccaacccgtcaatgccgctgtggcccagtcgccccaaaccatcccgattactactttgctggtgaatcccaccagctttccctgtcccctgaatcagtccctggtcgccagcagtgtgagtccactcattgtgtcaggcaactccgtgaatctgcctatccccagcacgcccgaagacaaggcccacgtgaacgtggatattgcttgtgcagtggccgatggggaaaacgcatttcagggcttggaaccaaagcttgagccacaagaactcagtcctctaagtgctacagtatttcctaaagttgagcattctccaggaccccctctggctgatgcagagtgccaggaaggcctgagcgagaattccgcctgtagatggaccgtggtaaaaacggaagagggccgccaagccctggaaccactccctcaaggtatacaggaatccctgaacaacccaacgcccggcgacttagaggaaatcgtaaaaatggagccagaggaggcaagagaggaaatcagcgggtcacctgagcgtgatatctgtgacgatatcaaagttgagcacgctgtcgagctggatacaggcgccccttccgaagagcttagtagtgctggcgaggttacaaaacagaccgtgctccagaaggaggaggaacggtcgcagcccaccaaaactccaagttcctctcaggaacctcccgacgagggcaccagcggcactgatgtgaataaagggtcttcaaaaaacgcactgagcagcatggaccccgaggtccgcttgtcgtcccccccaggcaaaccggaggacagttcatctgtcgacgggcagagtgtgggcacaccagtcggccctgagacagggggcgagaagaacgggcctgaagaagaagaggaggaggatttcgacgacctgacccaggacgaggaggatgaaatgtcaagcgctagcgaggaatctgtgctgtcagtccctgaactacaggaaactatggaaaagcttacctggctcgcctcagaacggcggatgtcccaagagggagagtctgaggaagagaactctcaggaggagaattccgagccagaagaggaagaagaggaagaggctgagggtatggaatccttgcagaaagaagacgaaatgacagatgaagccgtgggcgacagcgcagaaaaacccccaactttcgccagtcccgaaacggccccagaggtagaaacatccaggactccgcccggagagtccattaaggctgccggtaagggacgtaacaatcatagagcgagaaacaagaggggttcacgggcccgtgccagtaaagatacaagtaaacttttgcttctctatgatgaggatatcctggaacgcgaccccctaagagaacagaaagacctggcgttcgcacaggcctacctgacccgcgtgagggaagctctgcagcacatccccggtaaatacgaagacttcttacaggtaatatatgagtttgagtcaagtactcaacgtcgcaccgcggtggacctgtacaagagtctgcagattttattacaagactggccccagctattgaaagatttcgccgccttcctgctgcctgagcaagcccttgcctgcgggctgtttgaagaacagcaggccttcgagaaaagtcgcaaattcctgcggcaactcgaaatttgcttcgccgagaatccaagccaccaccagaagataattaaggtcctgcagggctgcgctgactgtctgcctcaggagattacagaactgaaaacacaaatgtggcaactcctgaagggtcatgaccacctacaggacgaattctccatattttttgatcaccttcgaccagccgcctcccgcatgggagatttcgaagaaataaattggactgaggagaaagaatacgaattcgatggctttgaggaggtggccctgccagacgtcgaagaagaggaggagcctcctaagataccaacagcttccaaaaataaaagaaagaaggagatcggagtacagaatcatgacaaggagactgagtggcctgatggggccaaggactgcgcatgctcctgccacgaagggggccctgattcaaagctgaaaaagtcaaagagaagaagttgctctcattgcagctcgaaggtgtgtgactctaaatcctacaagtcaaaagaacctcacgaactggtcgggagctccccacaccgcgaggcaagcccaatgccgggcgctaaggaggccgggcagggaaaggatatgatggaggaggaagcacccgaagaaagagaatccacagaagcaacccaatcgagaacagtgagaaccacccggaagggggaaatgccagtgtcaggtctggccgtaggaagcacgttaccatccccccgcgaagtgaccgtgactgaacgcttgcttcttgatggcccccctccccatagtcccgaaactccgcagttccctccgaccacaggcgcagttctctacaccgtcaagcgcaaccaggtggggcctgaagttaggagctgtcccaaggcaagccctagactgcaaaaagagcgcgagggtcaaaaagcagttagtgaatcagaggccctgatgctggtgtgggatgccagtgaaactgagaaattaccaggtacagttgagccgcctgcctcattcctttcgcccgtgtcatcgaaaacacgggacgcaggccgcagacatgtatccgggaaaccagatacccaggaaaggtggcttccttccagtcgcgcacgggtgaagaccagagatcgcacctgtcctgtccacgagtccccctccggtattgacacctccgaaaccagtcctaaagctcctcgaggcggcctcgccaaggatagcggcactcaagccaagggacccgagggggagcagcaacccaaggccgcggaggcaactgtttgcgccaacaactcgaaagtcagctcaacaggcgagaaggtcgttttgtggacaagggaagccgatagagtcatccttacaatgtgtcaggaacaaggtgcacagccacagacattcaacatcatcagccagcaactcggaaacaagaccccagccgaagtgagccacaggtttagggagctgatgcagctgtttcatacagcctgcgaagcgtctagtgaggatgaggacgacgcaacaagcacatcaaatgcagaccaactgtccgaccacggtgacctcctgagcgaagaggagctcgatgaatag

SEQ ID NO: 11905 - DNA, 4590 bp, Artificial Sequence
  Description of Artificial Sequence: Synthetic coding sequence
atgctcccttgtaaaaagagacgtaccacggtgaccgagagcttgcagcacaaggggaaccaagaggagaataatgtggatttagaatctgcagtgaagccggaaagcgaccaggtgaaggacctctctagtgtaagcctttcatgggatccgtcccacgggcgggttgctggctttgaggtccagtcgctgcaggacgccggaaaccagcttggtatggaagacacatcgctgagctccggcatgctgactcagaataccaacgttcctatcctagagggcgtagacgtggcaatctctcaggggatcacattaccctcgctggaaagttttcatccccttaacatccacatcggtaaaggcaagttgcacgccaccggttcaaaacggggaaagaagatgacccttaggccaggccccgtgacacaagaagaccgatgcgatcatctcacactgaaagagcccttctcaggcgagcctagtgaagaagtaaaggaggaagggggaaagcctcagatgaactccgaaggggagattcccagcctgccttctgggagtcagagcgcaaaacctgttagccagcccaggaaaagcacacaaccagacgtctgtgcatctccgcaggaaaaacctctcagaacactattccatcaacctgaggaagaaattgaggatggagggctcttcatccccatggaggagcaggacaatgaagagtccgaaaaaaggcgcaagaaaaagaaagggactaaacgcaagagggacggcagagggcaggaaggcacccttgcctacgatctgaagctggacgacatgcttgatagaacgcttgaagacggcgccaaacagcataatttgactgccgtgaatgttagaaacatcttacacgaggtcatcactaatgagcacgtggttgcaatgatgaaagccgctatctccgaaacagaagatatgccaatgttcgaacctaaaatgacgcgttcaaagctaaaggaggttgtggagaagggggtggtcatcccaacatggaacatcagtcctatcaaaaaggctaatgagatcaaacccccccaatttgttgacatccacctggaggaagatgactctagcgatgaggagtaccaacccgatgatgaggaagaggatgagaccgcggaggaatcactgcttgagtccgacgtggagtccactgcgtcctcaccaaggggcgccaagaaatcccgtctgcgccagtcatctgagatgactgaaacggacgaggagtccgggattcttagtgaggccgaaaaggtcaccacacccgccattcggcacattagcgcagaggtcgttcctatggggcccccccccccgccaaaacccaaacagacaagagactccacttttatggaaaagttacacgccgtggatgaagagttggcatcctctccagtgtgcatggactcctttcagccaatggatgattccctcatcgccttccgcaccagatcaaagatgccactgaaagatgtccctctgggtcagctggaagctgaactgcaggcccccgatattacccctgatatgtatgatccaaacaccgctgacgacgaagattggaaaatgtggctggggggactcatgaacgatgatgtggggaatgaggatgaagctgacgacgacgatgatcctgaatataacttcctcgaagacttggacgagccagacactgaagacttccgcacggacagagctgtgaggatcacaaagaaggaggttaacgagttgatggaggagctgttcgagacatttcaagatgaaatgggctttagcaacatggaagacgacgggccagaggaagaagagtgtgtggctgaacccagaccgaactttaacaccccccaagccctgaggtttgaagaacccctagcaaatctcctgaacgaacaacaccgcacagtgaaagagctatttgagcaactcaagatgaagaaaagttcagcaaagcagctgcaggaagtagaaaaagtgaaaccccagtccgagaaagtgcatcagacactgattttagatcccgcgcagaggaagagactccagcagcaaatgcagcagcatgtgcaactgctgacacagattcacctgctcgctacctgtaaccccaatctgaacccagaggccaccaccacccgtatattcctgaaagagcttggaaccttcgcgcagtcttccattgccttgcaccatcagtacaaccctaagtttcagacattattccagccatgcaatctgatgggcgccatgcagctgatagaagactttagtacacatgtttctatcgactgctcgccgcataaaactgtgaagaagactgctaacgagtttccctgcttgcctaaacaggtcgcctggatcctggcgacctctaaagtgtttatgtacccggagctactgccagtctgttcactgaaagctaaaaatccgcaggataaaatcgtgtttacgaaagctgaagacaatctgctggccttgggactcaagcacttcgaaggaactgaatttcccaatcccctgatctctaagtatctgctaacatgcaagactgcccatcagctgaccgttagaattaagaatctgaacatgaatagggcccccgacaatatcattaagttttataagaaaactaaacaactccccgttttgggtaagtgttgtgaggagatacagccccatcagtggaagcctccaatcgaaagggaagaacatcgactgcctttctggcttaaggcgagcctgccctcaatccaggaagagctccggcatatggcagacggcgctagggaggtgggaaatatgactggcacgactgaaattaatagtgataggtctttggagaaggacaacctcgagctgggtagcgaaagtcgataccctttgcttctgcctaagggcgtggtcttgaagcttaagccagttgccacacgcttcccaagaaaagcatggcggcagaaacgaagttccgttcttaagcccttgcttatccagccatcacccagtctgcagccaagctttaaccctggcaaaacaccggccaggtccactcactccgaggcccccccatcaaagatggtcctgagaataccgcacccgatacaacccgccaccgtgctccagaccgtgccaggcgtccctccacttggggtttcagggggcgaaagcttcgagagccccgccgccctgcccgccgtccctccggaagcgaggacctcttttccactttccgaatcgcagacgttgttgagcagtgcgcccgtgcccaaggttatgttgccctctctggcaccgagcaagttccgcaagccctatgtgcggagacgaccaagcaagaggcgtggagtgaaggctagcccatgcatgaagcccgcgcccgttatacaccacccagcaagcgtgatcttcaccgtgcctgccacaaccgtgaaaatcgtctccttaggcggcggttgcaatatgattcagcccgtcaacgccgcggtggctcaaagtccacagaccataccaattaccactctcctggttaacccgacgtcattcccctgcccgctgaatcaatccttggttgcctcttccgtgagccctctgatcgtctccggaaattccgttaatcttcccatcccctcgacccccgaggacaaagcccatgtcaacgtcgacatcgcttgcgcggtggctgatggagaaaacgcatttcagggcctcgaacccaaacttgagcctcaagaactcagtcctctaagtgccacagtatttccaaaggttgagcattctcccgggccaccattagcggatgcagagtgtcaggagggtttatctgaaaattcagcctgtagatggaccgtggtgaagacagaagaaggcagacaggccctggagcctctcccccagggcatccaggagtcccttaataaccccacccctggcgatctggaggaaatcgttaaaatggagcctgaagaagccagggaggagatctcaggcagccccgaaagggatatctgcgacgatattaaagtggaacacgccgttgagttggataccggcgcccctagcgaagagctgtcatcagcgggagaggtcacgaagcaaaccgtcctccagaaagaagaagaaagatcccagcctaccaaaaccccgtcctcgtcacaagaaccccctgacgaggggacatcaggtacagacgttaataaggggagcagcaagaacgccctctcttctatggatccggaagtcagactgagctccccccctgggaagcccgaagattcttctagcgtcgacggacagagcgttggcacccctgtagggcctgagacaggcggcgaaaagaatgggccagaggaagaagaggaggaggacttcgatgaccttactcaggatgaggaggatgagatgtccagcgctagcgaggagtccgtgctcagtgtgccagagctgcaggtacgggctggcgaatactctcaggtgtttagggggctgagcaatatgtatcatctgctgatttgccacttgcttgcatgctgcacaatggactcacctaagataatttgcatctag

SEQ ID NO: 11906 - DNA, 726 bp, Artificial Sequence
  Description of Artificial Sequence: Synthetic coding sequence
atgtacgacccgaacacggcggacgacgaggactggaaaatgtggctggggggcctgatgaatgacgacgttgggaacgaagatgaggctgatgacgatgacgacccagagtataacttcctggaggacttagatgaacctgacaccgaagattttaggaccgacagagcggtccgtattaccaagaaagaggtcaatgagcttatggaggaactcttcgagacctttcaggacgagatggggttctctaacatggaagatgatggccctgaggaggaagagtgcgtggcagaacctcgccctaatttcaatacacctcaagctctgcggtttgaagaacccctggcgaacttgctcaatgagcagcatagaactgtgaaagaactgtttgaacaactgaagatgaagaaatcctctgctaagcagctgcaagaggtcgaaaaggtcaagcctcagtccgaaaaagtgcatcagacactgatcctggaccccgcccagcgcaagagactgcagcagcagatgcagcagaaggagctgggcacctttgcgcagtctagtattgccctgcatcaccaatacaatccaaagtttcagaccctgttccagccctgcaatctgatgggggccatgcagctaatcgaagatttttctacccacgtctctattgactgctcccctcacaaaaccgttaaaaagaccggacgccggcaaatgtgccagctctag

SEQ ID NO: 11907 - DNA, 6726 bp, Artificial Sequence
  Description of Artificial Sequence: Synthetic coding sequence
atgcttccctgcaaaaaaaggcggactactgtcactgaaagcttgcagcataaaggcaaccaggaggaaaataatgtcgacttggaatctgcagtgaagccagagtctgatcaggtgaaagacctgtcttctgtctctctaagttgggatccctcccacggccgggtggcgggtttcgaagtgcagtcgctccaagatgccggaaatcagctgggaatggaggatacgagcctgtccagcggaatgctcacccaaaacaccaatgttcccattctggagggggtcgacgtcgcaatctcccagggcatcacgttaccatccctagaatctttccaccccctcaacatacacataggcaaggggaaactgcacgccacaggaagcaaaaggggcaaaaaaatgactctaagacctggtcctgtcactcaggaggaccgctgtgatcacctgacccttaaggaacctttctcgggagagccatcagaagaagtaaaagaagaaggtgggaaaccacagatgaatagcgaaggggagattccttcgttgccatccggaagccagagtgcaaagcctgtgtcccaacctcgcaagtccactcaaccagatgtgtgcgcctctcctcaagaaaaaccgctgcggaccctttttcatcagcccgaggaggagattgaggatggaggcctattcatccctatggaggagcaggacaacgaggaatcagagaaaagaagaaagaaaaaaaagggcacaaagcggaagagggacggaagggggcaggagggaaccctcgcttatgacctgaagctggatgatatgcttgaccgcactctggaagatggtgctaagcagcataacctgacggccgtgaacgtgcgcaacatccttcacgaagtgattaccaacgagcatgtggttgcaatgatgaaggctgccatcagtgagaccgaggatatgcccatgtttgaacctaagatgacacgcagcaaattaaaggaagtcgtggagaagggggttgtgatcccgacctggaatattagtccaatcaagaaagccaatgagatcaagccgccgcaatttgttgacattcacttggaggaggacgattcttccgatgaagaatatcagccagacgatgaggaggaagatgaaacagcagaggagtcgctcttggaatcggatgtggagtccaccgcaagctccccacggggtgctaaaaagtctaggctgcgtcaaagctctgaaatgaccgagaccgatgaggagagtgggattctttctgaggctgagaaagtaaccactcctgcaattaggcatatcagcgcagaggtcgtccccatgggaccccctccaccccctaaaccaaaacagactcgcgattccaccttcatggaaaagctgcacgcagtcgacgaggagctcgcctcttcccctgtctgcatggattcctttcagcctatggatgactccctgatagcttttcgcacgcgctccaagatgcctctgaaggatgtccctctgggtcagctcgaagctgagctgcaggctcccgacatcacccctgatatgtacgaccccaacaccgccgacgacgaggactggaagatgtggctgggcgggctcatgaatgacgatgtcggcaacgaagatgaagctgatgacgatgatgatccggaatataactttctggaggacctggatgaacccgacaccgaggattttaggacggatcgtgctgtgcgaatcaccaaaaaagaagtcaatgagctcatggaagaactgttcgagacctttcaggacgaaatggggtttagtaacatggaggacgacggcccggaagaggaagagtgtgtggcggaaccgcgccccaacttcaatacaccccaggccctgcgcttcgaggagccactagctaatttacttaacgagcagcatagaacagtcaaggagctgttcgagcaattgaagatgaagaaaagcagtgctaaacagctccaggaggttgagaaggttaaaccacaatccgaaaaagtacatcagacgctaattctggaccctgcccagcggaagaggttgcagcagcagatgcagcagcacgtacagctgttgacccaaattcacttgctggcaacatgtaatcccaatctgaatccagaggcgacgacgacaaggatctttctgaaggaacttggcacgttcgcccaaagttctatcgcactgcaccaccagtacaatccaaagttccagacactgtttcagccatgtaatcttatgggggctatgcagctgatcgaggatttttcgacccatgtttcaattgactgttcaccacataaaactgtgaagaaaaccgcgaatgagttcccctgcttacccaagcaagtggcatggatcctggcaacctctaaagtctttatgtaccccgaactgttaccagtctgtagcctgaaagcgaaaaacccccaggataaaattgtgtttactaaagccgaagataacctgttggcccttggcctgaagcattttgagggcactgaattcccaaatcctctcatatccaagtacctgttaacttgcaagaccgcccaccaactgacagtgaggatcaagaacctgaacatgaatcgcgctcctgataacatcatcaaattctacaagaaaactaaacagctgcccgtgcttggaaagtgctgtgaggaaattcaacctcatcaatggaagccgcccattgaaagggaagaacataggcttcctttctggcttaaggcatccttgccttctatccaggaggaactgaggcatatggccgatggcgcccgggaagttggcaatatgactggcaccacggaaataaactccgaccgctccctcgagaaggataacctcgagctgggctccgagagccggtaccctttgcttctgccaaaaggtgtcgtgttgaaattaaagccggtcgcaacaaggtttccacgcaaggcctggagacagaagagatccagcgtgctgaagcctttactgatccagccttcgccctcactacagccctcgttcaacccgggcaagacccccgcacggagcacacatagcgaagcgcctccatcaaagatggtcctgcgaatcccccatccaatccagcccgcgaccgtgctgcaaacagtccccggcgtaccccccctcggggtgtccgggggcgaatcatttgaaagcccggccgcactgccagccgtccccccagaggccaggacctctttccctctcagcgagagccagaccctgcttagcagtgccccagtgcctaaagtcatgctccccagcctggcaccatctaaatttagaaaaccctacgtacggcgcagacccagcaagagacgtggcgtcaaggcctccccttgcatgaagcccgcaccggtgattcatcaccctgcttctgtgatctttacagtgccagctacaactgtgaagatagtaagcctcgggggtggttgcaatatgatccagcctgtgaatgccgccgtagcacagtcacctcagacaatccccatcactaccctgctggtcaatcccaccagtttcccatgccctctcaatcagtccctggtagcatccagtgtctcccccctgatcgtgagcgggaactcagtcaacctccccattcccagcactccagaagataaggcccatgtgaatgtagatatagcctgtgccgtcgccgacggcgagaacgctttccagggacttgagcccaaactggaacctcaagaactatccccattaagtgccactgtctttcccaaggtggaacacagtcccggcccccccctcgcggacgcagagtgccaggaaggactgtcagagaacagcgcctgtagatggacagtggttaagacagaagaaggaagacaggccttagagccactgccgcagggcatacaagagagtctgaataatcccacccctggtgaccttgaagagatcgtcaagatggaacccgaagaagctcgagaagaaatctcggggtctccagagagagacatctgtgacgatataaaggtcgagcacgccgtggaattggacacaggcgctccctcggaagagctcagtagtgccggcgaggtaactaagcagaccgtgctgcagaaagaggaggagagatcacagccaacgaaaacgccctcaagtagccaagagccccccgatgagggcacttccggcaccgacgtgaacaagggaagcagcaagaacgcactgtctagcatggatccagaggtgaggctaagcagtcccccaggcaagcccgaggatagcagttccgttgacggccaatctgtgggcactcctgtcggaccggagacagggggtgaaaagaatgggcccgaggaagaagaggaggaagactttgacgatctcacacaggatgaagaagatgaaatgtcaagcgccagtgaagaatctgtgctgtccgtcccggagctgcaggaaactatggagaagctgacctggcttgcatccgagaggaggatgtcacaggagggagagtccgaagaagagaacagccaggaagagaactcagagccagaagaagaagaggaggaggaagctgaggggatggagagtctgcagaaggaggatgagatgaccgatgaggccgttggagactcagctgaaaaacctccaacgttcgctagccctgagacagcgccagaggttgagacgagccgcaccccacctggcgaatccataaaggccgctgggaagggaagaaataaccatcgggcccgaaacaaacgggggtcccgggcccgggcctccaaggacacctctaagctcctcctcctttacgatgaggacattttggagagggaccctctgcgcgagcagaaggacctggcgttcgcccaggcatacctgaccagggtgcgagaagccctgcaacacatcccaggcaagtatgaggatttccttcaggtgatatacgaattcgagtctagcacacagcgacgcactgctgtcgacctgtataagtctttgcagattctgttgcaggactggccacagctcctgaaggatttcgcagccttcttgctccctgagcaggccctggcctgcggtctctttgaggaacagcaagcatttgagaagagccgcaaattcctaaggcagttggagatttgctttgctgagaatccttcacaccaccagaaaatcattaaggtgctgcagggttgcgctgattgtctgccacaagaaatcacggagttgaagacgcagatgtggcaactactgaaaggccatgatcacctgcaggatgaattctccattttttttgaccatcttagacccgcggcgtccaggatgggggacttcgaggagatcaattggacggaggaaaaggagtacgaattcgacgggttcgaggaggtggctctgcctgacgtggaagaggaagaagagccgcctaaaatcccaaccgccagcaaaaacaagcgaaaaaaggagatcggggtgcagaatcacgacaaagagaccgaatggccagacggcgccaaggactgcgcttgttcctgtcacgaaggcgggccagattcgaagctgaaaaagtctaagcggaggagttgttcccactgcagtagtaaggtgtgcgacagtaaaagttataagagcaaagaaccacacgagctagtgggatcaagtccgcatcgtgaggcatctcctatgcccggggctaaagaggcaggacagggcaaggacatgatggaggaagaggctcccgaagagagggagtccaccgaagctacacaatctaggaccgtgcgcactactcgtaaaggcgagatgcccgtgtctgcaggtctggcagtgggtagcaccctcccctccccgagggaggtgaccgttaccgaacggctcctgctggatggcccaccaccccattcgcctgagaccccgcagtttcctccgactaccggcgcggtactgtacacagtgaagaggaatcaagtgggccccgaagtcaggtcatgcccaaaggcgagcccccgcctgcagaaagaacgtgagggtcagaaggccgttagtgagtccgaggccctgatgttagtctgggatgccagcgagacagaaaaattacccggtaccgtggaaccaccagcgagcttcctgtcacccgtgtccagtaagactagggatgccggccgccgccacgtgtccggcaaaccagacacccaggagcggtggcttccgagttcccgcgctcgggtgaaaaccagggaccggacgtgtcctgttcacgaaagcccctcaggcattgacactagcgagactagcccaaaggctccacgggggggactagcgaaagactccgggacccaggcgaaggggcccgagggagagcagcagcccaaagcagccgaagcaaccgtatgtgccaacaacagcaaagttagcagtacaggagagaaggtcgtactgtggacgcgggaggcagaccgtgtgattttgacaatgtgtcaggagcagggagcccagccacagaccttcaacatcatctcccaacagcttggaaataagactcctgctgaagtgagccacaggtttcgggaactgatgcaattattccacactgcttgtgaggccagctccgaagatgaagacgacgccacttcaaccagcaacgcagaccaactgagcgaccatggtgacttattgtcggaggaggagctggacgaatag

SEQ ID NO: 11908 - DNA, 6723 bp, Artificial Sequence
  Description of Artificial Sequence: Synthetic coding sequence
atgctgccttgcaagaaacgtcggacaactgttacagagtcccttcagcataaaggtaatcaggaagagaataatgtggacttagaatctgcagtgaagccagagagtgaccaggtgaaagaccttagttcagtttctctgtcatgggatccttctcacgggagagttgccggtttcgaagtgcagtctctgcaggacgcaggtaatcagttaggcatggaagataccagtctgtccagcggtatgctgactcagaataccaacgtacccattctggaaggagtggacgtggctatcagtcaggggattacactccctagtctggaatcattccaccctcttaacatccatattggaaagggaaagctgcacgcaacgggctccaagcgaggcaagaagatgaccctaaggccagggcctgttacccaggaggacagatgcgaccatctcaccttgaaagaacctttctctggagagccgtccgaggaggtaaaggaggaggggggcaagcctcagatgaactcggagggcgaaattccatcactacccagcggatctcagtctgcgaaaccagtcagtcagcctcggaagtcaacacagcctgacgtctgtgcttcaccccaggagaaaccgctccgtacactcttccaccagcccgaggaggagatcgaggatggtggtctgttcatccctatggaagaacaggataacgaggaatccgaaaaacggaggaaaaaaaaaaagggtacgaaaagaaaacgcgacggacggggccaggagggcaccctcgcgtatgacctgaagctcgatgatatgcttgatcggacccttgaggacggggctaagcagcacaacctaacagccgtaaatgtgcggaacatcctgcatgaggtgatcactaacgagcacgtggtggcaatgatgaaagccgcaataagcgagactgaggacatgccgatgttcgagcctaagatgacacggtcaaagttaaaggaggttgtggagaagggagtcgtgattccaacatggaacattagtcctatcaaaaaggccaatgaaattaagcccccacaatttgtggacatacatctagaagaggacgacagctctgatgaagagtaccagcccgacgatgaagaagaagacgaaacagcagaagagtccctgctagaaagtgacgtagagagcaccgcaagcagccctcggggtgcaaagaaatcaaggctccgacagtcatcagagatgaccgaaactgatgaggagtccggaattctttctgaggcagaaaaagttaccactcctgcaattagacatatctccgcagaggtggtacctatgggcccgccacctcctccaaagccaaaacaaactcgggactccaccttcatggaaaagctgcacgcagtggacgaggaactggcaagtagcccagtgtgcatggactcatttcagcctatggacgacagtctgattgcatttcgtactcgctcaaagatgccgctgaaagatgtccctctgggtcaattggaggctgaactgcaggctccagacatcacacctgacatgtatgacccaaacacggcggacgatgaggactggaagatgtggctcggcggcctcatgaacgatgatgtgggtaacgaggacgaggcagatgacgacgatgatccagagtacaactttctcgaagacctggatgaacccgacaccgaagacttcagaactgatcgcgctgtgaggattaccaagaaagaggtgaatgaactgatggaagaacttttcgaaacttttcaggacgaaatgggttttagcaacatggaggatgatggacctgaagaggaggaatgtgtggcagagcctagaccgaactttaatactcctcaggcactaagattcgaagagccattagctaacctacttaatgaacagcacagaacggtgaaagagctcttcgaacaactcaaaatgaagaagagtagcgccaagcaattacaggaggtcgagaaagttaagcctcagagtgaaaaggttcaccaaacactcattctggatcccgcccaacgtaaacggttacagcagcaaatgcaacagcacgtgcagttactgactcaaatacaccttctggccacctgtaaccctaacctcaaccccgaagcgacaaccacacgtatattcttgaaagagttggggacattcgcccagagttctatagctttacaccaccagtacaacccaaaatttcagactttattccaaccctgcaaccttatgggcgccatgcagttgattgaagatttttctacccacgtgtctatcgactgttctccacataagactgtgaagaaaactgccaatgagttcccctgtcttcccaagcaggtagcatggatcctggcaacttccaaggtcttcatgtacccagagttactgcccgtgtgctccttgaaagccaagaatccgcaggataaaatcgtcttcacaaaggcggaggacaacttgctggcacttggtctgaagcattttgaagggactgaatttcctaaccccttaattagcaaatacttgctgacatgtaagactgctcatcagctgaccgtacgcatcaagaacctgaatatgaatcgagcgcctgataacattatcaaattttacaagaaaactaagcaattacccgtgctgggcaaatgctgcgaagagatacagcctcaccagtggaaacctccaatcgaacgagaggaacatcgacttccattttggctcaaagcttccctgccaagtatccaggaggagcttcgccatatggcagatggggctagggaggttggaaacatgacaggcaccacagaaatcaactccgatcgatccctcgaaaaggacaacctggagctcggaagcgaaagtcgctacccgctcctgcttcctaagggcgtggtgctgaagctgaagccagtggcgacacgctttccccggaaggcttggcgccaaaaaagatcctcagtgttgaaaccattgcttatccaaccttcaccatctttacagcctagtttcaatcccggtaagacccccgctagaagcacccattccgaagcaccccccagcaaaatggtcttgcgcatcccacaccctatacagccagctacggtactacagactgtgcctggagttccccctcttggggtttctggtggcgagtccttcgaaagcccggctgccctacccgccgtaccacctgaggctaggacttcatttccattatctgaaagtcaaaccctgctgagttctgcccccgtgccaaaggtaatgctgcccagcctggcaccttccaaatttcggaagccttatgtgaggagaaggccaagcaaacgcagaggcgtgaaggcctcaccatgcatgaaaccagcccccgtaattcatcatcctgcctcagtgatctttacagtgccagccaccacagtaaaaatcgtgtctcttgggggtggatgcaatatgatacagccggttaatgcggccgtggcgcagagcccacagactatccccatcacaaccttgctggtgaatcccaccagcttcccctgtcctttgaaccagtccttagtggcttcctccgtgagcccgcttattgtgagcgggaactccgtaaaccttcccatcccttccacaccggaagataaggctcacgtaaacgtggacatcgcctgcgctgtcgcagacggcgaaaacgcatttcagggactcgaacctaagctggagccccaggagctcagcccattaagcgccaccgtcttccctaaggtggaacacagccccggtccccctctcgccgatgctgaatgtcaagagggtctcagcgaaaattcggcgtgtaggtggactgtggtcaagacagaagaaggccgccaagctctggagccgctacctcagggtattcaggaatccctgaataaccccacccccggcgatctggaggaaatcgtcaagatggaaccagaagaggcgcgagaggaaatctcaggtagccctgagcgagacatctgcgacgacatcaaagtggagcatgctgtagaattggacacgggtgcacccagtgaggaattatcgagtgccggggaagttaccaagcaaacagtcctccagaaggaagaggagcgaagtcagcccacaaaaaccccctcatcctcccaggagccccctgacgagggaaccagtgggacggatgtgaacaagggttcttctaaaaacgctctgtctagtatggaccccgaggtacggctgtccagccctcccgggaagcccgaagactcttcaagtgtcgacggacaaagcgtgggaaccccagtcggacccgaaacaggcggcgaaaaaaatggcccagaggaggaggaagaagaggactttgatgatttgacgcaagatgaggaggacgagatgagctcggcatcagaggaatcagttctatcagtgccagagcttcaagagaccatggagaagctcacgtggctggcaagcgaacggcggatgagccaggagggagagtccgaagaagagaactcgcaggaggagaacagcgaaccagaggaggaagaggaggaagaggcagaagggatggaatcactacagaaagaagatgagatgaccgatgaagcggtgggtgactccgcggagaaacctccaacctttgctagccccgagactgccccagaggtggagacgtcgagaacccctcccggagaatcaatcaaggccgctggcaaggggaggaacaaccaccgtgctcggaacaaaaggggatcaagggccagggctagtaaggataccagtaaacttctgctgttgtatgacgaagacatcctcgaaagggacccgctgcgggagcagaaagacctggccttcgctcaggcctatctgacaagagtgcgggaagcgctccagcacattccaggaaagtatgaggatttcctacaagtcatctatgagttcgaatcttcaacccagcgtagaaccgccgtagacctctacaaatctttgcaaatccttctacaagactggcctcagttgcttaaagatttcgctgcgttcctgttgccagagcaggctctggcctgtgggctgtttgaggaacagcaggctttcgaaaagtccagaaagtttctccgtcagttagagatttgttttgccgagaaccctagccatcaccagaagatcatcaaagtgctccagggctgcgcggattgcttgccccaggagatcaccgagctgaaaacccagatgtggcagctgcttaagggacatgaccatctccaagatgagttcagcatcttctttgatcacctgcggcccgcggcctctagaatgggggactttgaagagattaattggacagaggagaaggagtacgagtttgacggcttcgaggaagttgccctgccggatgttgaggaggaagaagaaccacctaagattcctaccgcgtccaagaacaagagaaagaaagagattggggttcagaaccacgacaaagagacagaatggccagatggcgctaaggactgcgcatgctcgtgtcacgaaggaggaccagatagtaaacttaagaagtccaagcggcgttcctgttcacattgttcctcaaaagtttgtgatagcaaatcatataagagtaaagaaccgcatgagctggtaggaagttcacctcatcgggaggctagtccaatgcccggggccaaggaggcgggccagggcaaagatatgatggaggaggaggcacctgaggagcgggaatccactgaagccacccaaagtagaaccgtgcggaccactagaaagggagagatgccagtctcagggctggcagtgggcagcacccttcccagcccacgcgaggtgaccgttactgagaggctgctactagacggaccacctccacactctcctgagaccccacagtttccgcccaccacaggcgctgtgttgtacactgtaaaaagaaatcaggtgggacccgaagttcggagctgcccaaaggcaagtccaaggctgcaaaaagaaagagagggacagaaagcagttagcgagagcgaagccctgatgctggtctgggatgcttccgagacagaaaaactgcccggtaccgtagagccccccgcctctttcctttctccagtctcttccaaaacacgggacgctggacggcgacatgttagtgggaagccggacacccaggaaaggtggctgcctagcagccgagctcgtgtcaaaaccagggaccgcacatgcccggtacatgaaagtccaagtggaatagacacctccgaaacaagccccaaggctccgcgcggaggcctggccaaagattccggcacccaggctaaggggcccgaaggcgaacagcagcccaaagccgctgaggctacagtgtgtgctaataattcaaaggtgtcaagtacaggtgagaaggtggtcctctggactcgtgaggccgatagagtgatcctgacaatgtgccaggaacagggggcgcagccccagacattcaacatcatcagccaacagttaggcaacaaaacaccggccgaggtgagtcaccgttttagagaactcatgcagctgtttcatactgcatgcgaggcatcctctgaggacgaagatgacgcaacatcaaccagtaatgccgatcaactttccgaccatggagacctgctcagtgaggaagagctcgacgagtag

SEQ ID NO: 11909 - DNA, 2913 bp, Artificial Sequence
  Description of Artificial Sequence: Synthetic coding sequence
atgcttccttgcaagaagcgccgcaccacggttacggagagcctgcagcataagggtaatcaggaggagaacaacgtggacttggagtctgccgtgaagcccgaatccgaccaggtgaaggacttaagctccgtcagtttgtcatgggacccatcccatggacgcgttgcaggctttgaggtccagtccctgcaggatgctggaaaccagctgggaatggaggacaccagcttgagtagtggaatgttgacgcaaaacacaaacgttccaatcctggagggggtggatgtagcaatctcacaaggaatcacactgccatcactggagtcgttccatcctctgaatatacacattggaaaaggaaagctacatgccacagggagtaagcgaggcaagaaaatgacattgagacccggacctgtgactcaggaagatcggtgcgaccacctcacactgaaggaacccttcagcggagagccctcggaagaggtcaaggaggaaggcgggaagccacagatgaatagtgagggcgagataccaagcctgccaagcggttcacagagtgccaaacccgtgtctcagcccaggaagagtacacagcccgacgtttgtgcgtctccccaagagaagccgctgcgaactctcttccatcaacctgaggaagagatcgaagacggcgggctatttatccctatggaagagcaagacaacgaggagtccgaaaagagaaggaaaaaaaagaagggcaccaaacgaaaaagagacggccgcggacaggaaggcaccctggcctacgatttgaagttggacgatatgctggatcggactttggaggacggggccaagcagcacaatcttaccgccgtaaacgtgaggaacatccttcatgaagtgatcactaacgagcacgtcgtcgccatgatgaaagctgcaatatctgaaaccgaagatatgcctatgtttgaacccaagatgacacgtagtaaattaaaagaagtagttgaaaagggtgtcgtcattcctacgtggaacatctctcccattaaaaaggcaaatgagatcaagccaccacagttcgtagacattcacctggaggaggatgattcgtccgacgaggaataccagccagatgatgaggaagaggatgaaactgccgaagaatcactgctcgagtccgatgtggagtcaaccgcgtcgagcccaagaggtgcaaagaagtcacgcctaagacagagctccgagatgaccgagactgacgaggagagtgggatactctctgaagctgagaaagtcaccacacccgccatcaggcacataagcgccgaagtcgtccctatggggccccctccccctcccaaaccaaaacagactcgagattcgacgttcatggaaaagctccacgcggtcgatgaagagcttgcttcaagccccgtttgcatggattccttccagcctatggacgatagcctcatcgcgttccgtacacggagtaagatgcccttgaaggacgtacccctgggccagttagaggcagagctgcaagcccccgacataacaccagacatgtatgatcctaataccgcagacgacgaggattggaaaatgtggctggggggtctaatgaacgatgatgtgggcaatgaggacgaggccgacgatgatgacgatccggagtataattttttggaagatctcgatgagccagataccgaggattttagaacagatagggcggtgcgcatcacgaagaaagaagtgaacgaactcatggaagaactgtttgaaaccttccaggacgagatggggttctcaaacatggaggacgacggcccagaagaagaggagtgtgtggcagaacctaggcccaactttaacacaccacaggctctgaggttcgaggagccactggccaatctgctcaatgagcagcatagaacggtgaaggagttgtttgagcagctgaagatgaagaaatcatctgctaaacagctgcaggaggtagagaaggtgaagcctcagagcgagaaggtgcaccagaccctcatattggaccctgcccagcgaaaacgtttgcagcagcagatgcagcaacatgtgcagttgctcactcagatccacctgctggctacatgtaaccccaatctgaatcccgaggccacaaccacccgaattttcctcaaagaactggggaccttcgcacagtccagcattgcactgcaccatcagtacaaccccaagttccagacactgttccagccatgcaatttgatgggcgccatgcagctgatcgaggatttctcaacccatgtaagtatcgattgcagccctcacaaaacagtgaaaaagaccgccaacgagttcccatgtctccctaagcaagtggcctggatactggcaacttcaaaagtgttcatgtacccagaattgctgccggtatgttcactcaaggccaagaatccccaggacaaaatcgtattcacaaaagccgaagataacctgctagctttgggtctcaagcatttcgagggcacagagttccctaatccccttatctctaaatatcttctgacttgcaagactgcacaccaactcaccgttaggattaagaatctaaacatgaatagggccccagataatattatcaagttctataaaaaaacaaagcaactgccggttctgggaaagtgctgtgaggagatccagccgcatcaatggaagccacccatcgagcgcgaggaacatcgtctgccattttggttgaaggcctccctgcccagcatacaggaggagttacgccacatggcagacggagcgcgccagagttacagaagaaagagaagaggagttagccagttgaaacccttacaccttttgaagtccccactgatgaaggagccgcagggacagatgtag

SEQ ID NO: 11910 - DNA, 618 bp, Artificial Sequence
  Description of Artificial Sequence: Synthetic coding sequence
atggccgccgcagccggaggggcagcttcaagacgtggagcaggtagaccatgccccttctctattgagcacatattgtccagcctgccggagcgctcactgccagccagggccgcttgtccaccccagccagccgggcgacagtcgcccgccaagccggaggagcctggggccccagaggctgcaccatgtgcctgctgctgctgttgtggccctcgggcggcaccttgtgggccaccagaagcggcagcaggcctgggagcgagactggcctggcccttgagacttgggcctgccgtgcccctcagccttggcgcaccggctggcgggagtggcgcacttcccggagcagttgggccaggttcccagagacgcactcgcaggcacagaacaatcttctctgaagaacaattacaggctctggaagcactattcgtgcagaaccagtatcccgacgtcagtactcgggagcgcctagccggacggattaggctgagggaggagagggtggaagtgtggtttaagaatagacgggcaaagtggcgacaccaaaaacgggcctctgcttctgctcggctgttacctggagtgaaaaaatcacccaaaggtagctgctag

SEQ ID NO: 11911 - DNA, 1824 bp, Artificial Sequence
  Description of Artificial Sequence: Synthetic coding sequence
atgtggatgaactcaatcctgcccattttcctctttcgttccgttcgcttgcttaagaatgaccccgttaacctgcagaagtttagctacacgagcgaggatgaggcctggaaaacatatttggaaaatccccttacggccgcgacaaaggctatgatgcgagtgaacggggatgacgattccgtggctgccctgtctttcctgtatgactactacatggggcccaaggaaaaacggattctgagctcttcaacgggtggaagaaacgatcaaggcaagaggtattatcacggcatggagtacgagactgacttaacacctctcgaatccccaacgcacctgatgaagttcctgacagagaacgtaagcgggacgcccgaataccccgatttgctgaagaaaaacaaccttatgtccctcgagggcgcactgcccactcctgggaaagcagccccactccccgctggtccatccaagctggaggctggatcagtggacagttacctgctgcccactacagacatgtatgataacggctccctaaattctctctttgaatcaattcacggtgttccccctacccaaaggtggcagcctgattccaccttcaaagatgatcctcaggagtctatgcttttccccgacatcttgaaaacctcccccgaaccaccgtgcccagaagattaccccagcctgaagtctgacttcgaatacacacttggctctccaaaggcaatccatatcaagtcaggtgaatcacctatggcctatctgaacaagggtcagttttatcccgtgacattgcgcactccggcgggcggaaaggggctggcgctgtcctcaaacaaggtcaaaagcgtcgtgatggtcgttttcgacaacgaaaaagtcccagtcgagcagttaaggttctggaaacactggcacagcaggcagccgacagcaaaacagcgcgtgattgacgtggcagactgtaaagagaattttaacaccgtcgaacacatagaagaagtggcctataacgccctgagtttcgtgtggaatgtgaacgaggaggcaaaggtcttcatcggtgtcaattgtctgtccaccgactttagttcccagaagggcgtgaaaggagtgccgctcaacttacagatcgatacctacgactgtggtctgggcacagaacggctggtccaccgggccgtctgccaaatcaaaatcttctgtgataagggcgcagagcgcaaaatgagggatgatgagcggaaacaattccggaggaaggtgaagtgcccagacagtagtaactctggcgttaagggttgtctgctgagtggattcaggggtaacgagaccacatacctgaggcctgaaactgacctggagaccccgcctgtactgttcatcccaaatgtccacttcagcagtctgcagcggtctggcggtgccgccccttcagctgggccctcctcaagtaatcgcctaccgctgaaaagaacctgctccccgtttaccgaagaatttgaaccattaccctcaaagcaggctaaggagggcgatttacagcgggtcctcttgtacgtgagacgggaaaccgaggaggtattcgatgctctgatgctgaagactccggacctgaagggcctccgcaatgctattagtgagaagtacggattcccagaggaaaatatatataaggtctacaagaagtgcaaaagagggatcctcgtcaacatggacaacaatattattcagcactattcaaaccacgtggccttcctcctggatatgggcgagctcgatggcaaaatccagattatcctgaaagaattatag

SEQ ID NO: 11912 - DNA, 1530 bp, Artificial Sequence
  Description of Artificial Sequence: Synthetic coding sequence
atggagtatgagactgacttgactccattggagtctccaacacatctgatgaaattcctgaccgaaaatgtgtctggcacaccagagtaccccgacctgctgaagaagaacaaccttatgtctctggagggcgccctgcccacacccggcaaggccgctcccttacccgccggtccctcaaagctcgaggctggtagcgtggactcttacttgcttcctaccactgatatgtatgacaatggaagcttgaactccctctttgaatcgatccacggtgtaccccctacacaacggtggcaacctgacagcacgttcaaggatgacccccaggaatccatgctgttcccggacatccttaagacgagccccgagcccccttgtcccgaggactatccttctttaaagtcagactttgaatacacactgggatcaccaaaggcaatccacatcaaatctggggaatctccaatggcctacctgaataaaggtcaattctatccggtcacactgcgaacaccggctggcggcaaaggtctggcactctcttctaacaaagtcaaaagcgtagtaatggtggtcttcgacaatgagaaagtcccggtagaacaactccgcttctggaagcactggcactcaagacaacctaccgctaagcagagagtcatcgacgttgcagactgtaaggagaactttaatactgttgagcacattgaggaagtcgcttataacgccctaagcttcgtgtggaatgttaatgaagaagccaaagtatttatcggagtaaactgcctgtcaacagacttctcttcacaaaaaggcgtaaaaggggtaccgctgaaccttcagatcgacacatatgactgtggactcggtacagaaaggttggtgcatcgagcggtgtgccagatcaaaatcttttgcgataagggagccgaacgtaaaatgcgagatgacgaaaggaagcagttcaggaggaaagtgaaatgcccggactcctccaatagtggtgtgaagggatgcctgctgtctggcttccgaggtaatgagaccacttacctgcgtcccgagaccgatcttgagacgcccccggtgctgttcattccaaacgtccactttagtagtctacaaagatcagggggggcagccccaagcgccgggccctcttcaagtaataggctgcctctgaagcggacctgcagtccattcacggaggagtttgagcccctgccttccaagcaagccaaagagggagatctgcagcgggtgctactgtacgtgcgaagagaaactgaggaggtgtttgacgcactaatgctgaagacaccagatctgaagggcctgagaaacgctatcagcgaaaagtatggcttccctgaagagaacatatataaggtgtataagaagtgtaagcgcgggatcttggtaaacatggacaataatatcattcagcattattcaaaccacgtcgcttttttactcgatatgggagagctcgatgggaagatacagataatcctgaaagaactttag

SEQ ID NO: 11913 - DNA, 1881 bp, Artificial Sequence
  Description of Artificial Sequence: Synthetic coding sequence
atgtcgaacgagctggactttcggagcgtgagactgctaaaaaacgacccggtcaacctccagaagtttagttatacctcagaggacgaagcttggaaaacatatcttgagaacccattgactgctgctacaaaggctatgatgcgggtcaatggcgatgacgacagcgtggccgcactgtcttttctgtatgattattatatgggcccgaaggagaaacgaattctgtctagtagcactggcggccgcaatgaccaaggcaaaagatactaccacggtatggaatacgaaaccgacctcacccctcttgaaagcccgactcacctcatgaaattcctcactgagaatgtgagcggaacgcccgagtatccagacctactgaagaagaataacctcatgtcccttgaaggggctctccctacgccgggcaaagcagcacccctgcctgctggcccctctaagctggaggctggcagcgttgacagctaccttttaccaacgactgacatgtatgacaatggcagtctgaactccctgttcgagagcattcacggggtcccgccaacgcagcgctggcagccagacagcacctttaaagacgatccgcaggaaagtatgcttttccccgacatattaaagacaagtcccgaacccccttgtccggaggattatccttccctgaaatctgactttgaatacacactgggttcacctaaagctatacatattaaatcaggtgaaagcccaatggcatacctgaataaaggccagttctacccagtgactctgcgcacacccgccggggggaagggcctggcccttagcagcaacaaagtcaaatcagttgtcatggtggtatttgataacgagaaagtgccagtggaacagctgcgtttctggaaacattggcacagccggcagccgacagccaaacagcgcgtaatagacgttgctgactgtaaagagaattttaacacagtggaacacattgaggaagttgcgtataacgctctgagcttcgtgtggaatgtgaacgaagaggctaaagtgtttatcggggtaaactgcctgtccaccgacttttccagtcagaaaggtgtaaagggcgtccccttgaaccttcaaattgacacatacgattgcggactgggcactgagcggctggttcatcgggcagtgtgtcagattaaaatattttgcgataaaggagccgaaagaaagatgcgcgatgatgaaagaaagcagttccgccgcaaggtcaagtgtccggattccagcaattctggcgtaaagggatgtttgctgagtggtttccgcggcaacgaaaccacctacttgcggcctgaaaccgatttagagacccctcctgtactgttcatccccaacgtgcatttttcatctctgcagagatccgggggagcagccccgtcagctggcccctcctcctcgaatcggctgcctctgaaacggacctgcagcccttttacagaggaatttgagcccctgccatctaaacaggccaaggagggcgacctgcagcgtgtgctgctctacgtacggcgcgagaccgaggaggtgttcgatgcccttatgcttaagaccccagacttgaagggtctgcgaaatgcaatttcagaaaagtatggttttccagaagaaaacatttacaaggtgtataaaaagtgcaagcggggggaaacatccctgctgcatccgagactcagccgccatcccccacccgattgtctggagtgtagtcaccccgtaacacaggtcagaaacatgggatttggggacggattttggagacagagggatctggactctaatccatcgcccaccactgttaatagcctgcactttacggtcaattcggaatag

SEQ ID NO: 11914 - DNA, 1671 bp, Artificial Sequence
  Description of Artificial Sequence: Synthetic coding sequence
atgatgagggttaacggcgacgatgattcagtcgcggctctgtcatttctgtacgattattatatgggccctaaggagaagcgtatcttgagctcatcgactgggggtcgaaatgatcagggaaagcgatattatcacggtatggaatacgagactgacttgaccccactcgaaagtcctacacacctcatgaaattcctcacagaaaacgtctcgggcacccctgagtatccagacctgctgaaaaagaataacctcatgagcctggaaggggccctgccaactcctggtaaagcagcaccgctccctgccggaccatcaaagctggaggctggatccgtggacagctatctgctgcctacaacggatatgtacgataacggatccttgaactctctgtttgagtctattcacggcgttccccctacccagagatggcagcccgacagcacctttaaggatgacccacaggagtctatgctgtttcccgacatcctgaagacaagccccgagccaccatgtccagaagactatccatcacttaagtctgatttcgaatatacccttggcagcccaaaagctatccatattaaaagcggagaatcccccatggcttacctgaataaggggcaattctatcctgtgacacttcgcacccccgctggcggcaaaggcctggcgttatcatcaaataaagtgaagtcagtggtcatggtggtttttgacaatgaaaaggttccagtagagcaactacgtttttggaaacattggcattcacgccagcctaccgccaaacagcgggttatcgacgtggcagactgcaaggaaaacttcaacactgtggagcacattgaagaggtagcatataacgcattgtccttcgtgtggaatgtgaacgaagaagccaaggtgtttattggcgtgaactgcttgtctacagacttcagtagtcagaagggcgtgaaaggtgtgccccttaacttgcaaattgacacctacgattgcggcctcggcaccgagcgactggtacatcgggcggtttgccaaattaagatcttttgcgataagggtgccgagagaaagatgcgagacgacgagcgaaaacagttccgcagaaaggtaaaatgccctgacagttcaaactcgggagtgaagggttgcctactgagtggcttcagggggaatgagaccacctacctgcgtcctgaaactgacctcgaaaccccacctgtgctctttatacctaacgtccacttttcatcactccagagaagtggaggggcagctccaagtgcggggcctagttcctccaatagactccctctaaagaggacttgtagcccctttaccgaagagtttgaacccctgccttccaaacaggcgaaggaaggggacctgcagagagtcctcctgtatgtgcggcgcgagacagaagaagtcttcgatgcgctgatgctgaagacccccgacttgaaagggttaaggaacgccatatccgagaaatatggttttccggaggaaaacatctacaaagtgtacaagaagtgcaaacggggaatcctggtcaacatggacaataacattatccagcactactccaaccatgttgcatttctcctcgacatgggggaactcgacggtaaaattcagatcattctcaaggaactgtag

SEQ ID NO: 11915 - DNA, 1809 bp, Artificial Sequence
  Description of Artificial Sequence: Synthetic coding sequence
atgagtaatgagctcgacttccgctctgtgcgcctgctcaagaacgatccagttaacctccaaaagttctcttatacctctgaggatgaggcgtggaagacgtacctggagaatccactgaccgctgccactaaagcaatgatgcgcgttaacggtgatgacgatagcgtagcagccttatcattcctgtacgactattacatgggccctaaagaaaagcgcatcctgtcatcaagtactggaggacgcaatgaccagggcaagagatactatcatggtatggagtatgagactgacttaacaccccttgagagtcctacccacctgatgaaatttctgactgaaaatgtatcagggactcccgaatatcctgacctgctcaagaagaacaacctgatgtccctcgaaggcgctctgcctacgccaggaaaagccgctcctctgcccgcaggcccatccaaattggaagctggctctgtggattcgtatctgctgccgacaacagacatgtacgacaatggatctttaaattccctgtttgagtcaattcacggcgtccctccgacgcagagatggcagccggattccaccttcaaagacgatcctcaagaaagcatgttgttccctgacattctgaaaacttctcccgaacccccttgccctgaggactacccatctctgaagtcagattttgagtatacattaggctcacctaaagctatacatattaaaagtggggaaagtcccatggcctatctgaacaaaggccagttctacccagttaccctccgcacacctgccggggggaaggggttagcactgtcatccaacaaggtgaagagcgtcgttatggttgtgtttgataatgagaaggttcctgtcgagcagctgaggttctggaagcactggcactcccgacagcctactgccaaacaaagggttattgacgtggcggactgtaaagagaacttcaatactgtggagcacatcgaggaagtagcctacaatgccttgtccttcgtttggaatgtgaatgaggaagcgaaagtgttcatcggcgtgaactgccttagcacagacttttcatcccagaaaggagttaaaggtgtccctttgaatttgcagatcgacacctatgattgtggtctgggcaccgaacggttggtccaccgagcagtttgtcagattaaaatcttctgtgacaaaggagccgagcggaagatgagagatgacgaaaggaagcagtttcgccggaaggtgaagtgtcctgactcatctaattcgggggtcaaggggtgtcttttaagcggctttagagggaatgaaactacatatctcaggcccgaaactgacctggagacgccgcccgtgctcttcatacctaacgtgcactttagcagtctccagagaagcggaggggccgcaccatcagccggccctagctccagcaacaggttgccactgaagcggacctgctccccattcaccgaggagtttgagcctctcccgagtaagcaagctaaagaaggagatttacagagggtgcttctatacgtccgtcgggaaaccgaagaagtgttcgatgctctgatgctgaaaacaccagacctgaagggcctgagaaatgcaatttcggagaaatacggctttcccgaagagaatatttataaagtgtataagaagtgcaagagaggcattctggtgaacatggataacaacattattcagcattatagtaatcacgtcgcttttctgttggatatgggcgaattagacggaaaaatccagattatcttgaaggaactatag

SEQ ID NO: 11916 - DNA, 795 bp, Artificial Sequence
  Description of Artificial Sequence: Synthetic coding sequence
atgccgaggagcttcctggtagatagcctggttctcagggaagctggtgagaagaaggcaccggaagggagtcctcctcctctcttcccatacgccgttccccctcctcacgcactacatggactgagccccggggcctgtcatgccagaaaggctggtctcctgtgcgtctgtcctttatgtgtgaccgctagtcagctccatggcccccctggacctccagcactgcccctgctcaaggccagcttccccccatttggaagtcagtactgccatgcacctttaggacgacaacactccgcagtatctccaggtgtggctcacggtccagctgcagctgcagcagctgctgctctctatcagacttcctatccactgcctgaccccaggcagttccactgcatcagtgtagattccagcagcaatcagttgccttcatctaaacgtatgaggaccgctttcaccagcacccagttgctggaacttgagcgcgaatttgcgagcaatatgtatttgtccaggctgagacgaatcgaaattgctacctatctcaatctctccgaaaaacaggtaaagatctggtttcagaatcgtcgtgtaaagcacaaaaaagagggaaaaggcagtaaccacaggggaggggggggtggcggtgcggggggcggcgggagtgccccacagggctgcaaatgcgccagtttgtcctcggctaagtgttcggaggatgacgatgagctgcccatgtccccctctagctccgggaaggacgatagagacctcacggttactccctag

SEQ ID NO: 11917 - DNA, 915 bp, Artificial Sequence
  Description of Artificial Sequence: Synthetic coding sequence
atgagccggtccttttacgtagacagtctcatcatcaaagataccagccggcccgcacctagtctgcccgaaccccatcccggtccggatttttttataccgctggggatgccaccccctctggttatgtccgtgtctgggccgggatgccctagccgcaaaagtggggccttctgcgtgtgtcccttgtgtgtgaccagccatctgcatagctctaggggatcagtgggagccggctccggaggcgctggagccggcgtgacaggggctggtggcagcggagttgccggagcagccggagctctgccacttttgaagggacagttctcttctgccccgggtgacgcccagttctgccctcgcgttaaccatgctcaccaccaccaccatcctccgcagcaccaccaccatcaccaccagccgcagcaaccggggtctgctgctgcagccgccgctgccgcagcagcggcggccgccgccgctgctttaggccatcctcagcatcatgctccagtttgtaccgctaccacatacaatgtagccgacccacgacggttccattgtcttactatgggcgggtcggacgccagccaggtccctaacggcaagcggatgaggaccgcctttactagcactcagctgttagaattagaaagggagttctcatccaacatgtacttgtcacggctgaggcgcattgaaatcgctacatatttgaacctctcagagaaacaggtgaaaatctggtttcagaacagacgcgttaaacacaagaaagaaggtaaggggacccagcggaattctcacgcaggttgcaagtgcgtgggtagtcaggtccactacgctagatcagaagatgaggatagtctgtcacctgcttctgccaatgacgacaaggagatctcacccctttag

SEQ ID NO: 11918 - DNA, 2850 bp, Artificial Sequence
  Description of Artificial Sequence: Synthetic coding sequence
atggcacaagtggctgtctctacattgcccgtcgaggaagagtccagtagtgagacgaggatggtggtaactttcctggtgagcgccctggaaagtatgtgcaaggagctggcgaagtcaaaagccgaggtggcgtgtatcgcagtatacgagactgatgtcttcgtcgtgggtacggagcgggggtgtgcatttgtgaatgcaagaaccgatttccagaaagatttcgcgaagtactgcgttgctgaggggctatgcgaggttaagcctccttgccctgtcaacggcatgcaggtgcactccggggagacggaaatacttaggaaggccgtcgaagactacttctgtttttgttacggtaaggctcttggaactaccgtcatggtcccagtcccctacgagaagatgctccgagatcagtcagccgtggtagtccagggtctgcccgagggcgtagcctttcagcaccccgagaactacgatcttgcaacgttaaaatggattctcgaaaataaggctggcataagctttatcattaaccggccattccttggccctgagagtcagctggggggcccaggtatggtcactgatgccgaacggtcgatcgtgtctccctcagagtcatgtggccccatcaacgttaagacagaaccaatggaagatagtggcatctcactgaaggcggaggctgtatccgtaaaaaaagaatcagaggaccccaactactaccaatacaacatgcagggttctcaccccagcagtacttcaaatgaggtgatcgaaatggagctccctatggaggactctacacctttggtgccctcagaggaacccaacgaggacccagaggcagaggtgaagatcgagggaaacacgaatagctcatctgtgactaattcagccgctggggtggaggatctgaacatagtccaggtgaccgttcctgacaacgagaaggaaagactgtcctctatcgagaaaattaagcagttgagggagcaggtaaacgatctattctcccggaaatttggggaggcaattggtgtggatttccctgtgaaggtgccctatcggaaaattaccttcaaccccggctgtgtggtcatcgacgggatgccacctggagtggtgtttaaggcaccagggtacttggagatttcgtcgatgagaagaattctggaggccgccgaatttattaagttcacagtaattcggccactgccagggctcgagctgtctaatgtgggtaagcggaaaatcgaccaggaagggagagtcttccaggaaaagtgggaaagagcttatttcttcgtggaggtgcagaatatcccgacttgcctcatctgtaaacagtccatgtctgttagcaaagagtataatctgcgcagacactatcagacaaaccattccaagcattatgatcaatacatggagagaatgcgcgacgagaagctccatgagctgaaaaagggcctgcgaaagtacctcttggggctgtccgacaccgaatgcccggaacaaaaacaggttttcgcccacccttcacctacacagaagagccccgtccaacccgttgaggatctggctggaaatctgtgggaaaaactgagagagaagatcaggtcttttgttgcatatagcatcgccatcgatgagattaccgacattaacaacactacacagctagcaatcttcattagaggagtggatgagaatttcgacgtcagcgaggagttacttgacaccgtgcccatgactggaactaaatcaggcaatgagatttttagccgtgtagagaagtccctcaaaaagttctgtatagattggagtaagctcgtgtctgtggcttcaactggaacgcctgccatggtagacgcgaataatggactggtgacaaagctcaagagcagggtagccacgttttgcaagggagctgaactgaaatccatttgttgcattatacaccccgagagcctatgtgcccagaagctgaagatggatcacgtaatggacgtggtggtaaaatcagtgaattggatatgtagccgtgggctgaaccactccgaatttacaacccttctgtatgaactcgactctcagtacggctccctgctatactataccgaaatcaagtggctgagtcggggactggtgctaaaacgattctttgagagcctggaagaaatagattctttcatgagctcccgggggaagccacttcctcaattgtcatccattgactggattcgcgatcttgcctttttggtggacatgaccatgcacctcaacgcgctgaacatctcgcttcagggacactcacagatagtcacacagatgtacgacctgattcgcgcattcctggcaaagctttgcctttgggagacccacctgaccaggaataatctcgcccattttcccactctgaaactggcgagcaggaatgaatccgatggccttaattacatcccaaagatcgccgagctgaaaactgagttccaaaaacgcctctctgactttaagctgtacgagagcgagctcaccctcttctcctcccccttttccactaaaatcgattctgttcatgaggagctgcagatggaggtcatcgacctgcagtgcaataccgtgctgaagactaagtatgataaggtggggattccggaattttacaaatatctgtggggctcttatcctaagtataagcaccattgcgccaagattctgtctatgttcggaagtacctatatttgtgagcagctgtttagtatcatgaaactttcgaagacaaaatattgctcccaactgaaggactctcaatgggacagcgtcctgcatattgctacatag

SEQ ID NO: 11919 - DNA, 1491 bp, Artificial Sequence
  Description of Artificial Sequence: Synthetic coding sequence
atgtcagtctctaaagaatacaatttgcggagacattaccaaaccaaccactccaagcactatgaccagtacatggagcgcatgcgggacgaaaaactgcacgagctgaagaaaggactccggaaataccttctgggcctgtccgacactgagtgcccggaacagaagcaggtgttcgctcaccctagccccacccagaaatcgccagtacaaccagttgaagacctcgcaggaaacctttgggaaaagctgcgagagaaaattagatcttttgtggcatactctattgccatagatgagatcacagacatcaacaacaccacccagctggcaatcttcatcaggggggtcgatgagaacttcgacgtcagcgaagagttattggacactgttccgatgaccgggaccaagtctggcaatgagatcttttcccgagtggaaaagagtttaaagaagttttgcatcgattggtcgaagttggttagcgttgcaagtaccgggacgcccgctatggttgatgctaacaacggcttggttacaaaactcaaaagcagagtggctaccttttgcaagggtgccgagcttaaatctatatgctgcattatccatccagagtcactgtgcgcccagaagttgaagatggaccacgtgatggatgtcgttgtcaaatccgtcaattggatatgctcaagaggcttgaaccattctgagtttaccaccctcctgtacgaactcgactctcagtacggaagtctgttgtattacactgagatcaaatggttgagcaggggactcgtgctgaaacgatttttcgaaagtctggaagagatcgatagctttatgagttcgagagggaagcctttgccgcagctgtctagcatcgattggattcgggatctcgcatttctggtagacatgactatgcacctaaacgcacttaacatcagcttacagggccattcgcagattgtcacccagatgtacgatctcattcgagcgttcctcgccaagttgtgcttgtgggagacacatctgacgcggaacaatctggctcacttcccaactctgaaactcgcttcccgcaacgagagcgacggcctgaattacatcccaaagattgcagagcttaagacggagtttcagaaacgcctttcagacttcaaactctatgagtccgaactaactctcttctcttccccgttctccacgaagatcgacagcgtccatgaggaactgcagatggaggtgattgatctgcaatgcaatactgttttgaaaactaagtatgataaggtcggtattcctgaattttacaagtacctgtggggttcctaccccaagtataaacaccactgcgcgaaaattctctccatgttcgggtccacctatatttgtgagcagctcttttcaataatgaagctgtcaaagacaaagtactgttcccaactgaaagattctcagtgggacagtgtgttgcacatagctacctag

SEQ ID NO: 11920 - DNA, 681 bp, Artificial Sequence
  Description of Artificial Sequence: Synthetic coding sequence
atggcccaggtggcggtgtcaaccttgcccgtcgaggaagagagcagttccgagacgaggatggttgtgaccttcctcgtttccgctttggagagcatgtgcaaggaactggcgaaaagtaaggccgaagtggcatgcatcgccgtatatgaaaccgacgtgttcgtagtcggtacagaacgcgggtgtgctttcgtaaacgcgcgaaccgacttccaaaaagattttgcaaaatattgcgtggcggaagggctttgtgaagtaaagcctccttgccccgttaatggaatgcaggtacactcaggcgagaccgagatccttcgaaaggcggtcgaggactacttctgcttctgttacggcaaggcattgggcaccaccgtcatggtgcccgtgccatacgaaaagatgcttcgcgatcaatcggcagtggtggttcaggggctccccgagggagtggccttccagcaccctgaaaactacgatcttgccacactgaagtggatcttggaaaataaagccgggatctcttttataattaacaggccgtttctgggccccgaaagtcagctcggtgggcctggtatggtgacagacgcagagcgcagtatcgtctctcctagtgaacgacacttcaccgagagtcggtcgtgcctgtctcaggagagaatccgtcgctcctag

SEQ ID NO: 11921 - DNA, 2850 bp, Artificial Sequence
  Description of Artificial Sequence: Synthetic coding sequence
atggcgcaggtagcagtgagcacattaccagtggaagaagagtcttccagcgaaacccgcatggtggtgacattccttgtctccgccttagagagtatgtgcaaggagctcgccaaatccaaagctgaagtcgcttgtatagccgtatacgaaaccgatgtcttcgttgtcggcacggagcgaggctgtgccttcgtaaacgcaagaacagacttccagaaggacttcgccaagtactgcgtggccgagggactgtgtgaggtcaagccaccctgtcccgtgaacggtatgcaagtgcattccggagaaacagaaatcctcaggaaggccgtagaagactatttttgcttctgctacggcaaggccctcggaactaccgtgatggttcccgtgccctatgagaaaatgcttcgggatcaatctgctgtggtggtgcaaggactacccgaaggagttgccttccagcaccccgagaattacgatctcgccactctgaagtggattctggaaaacaaggctggaataagctttataataaatcgcccttttctggggccagagagtcaacttggaggtcctggaatggtcacggatgctgagcggtctattgtctccccttccgaatcttgtggacccattaacgtcaagacagagcctatggaagactccggtatttctctgaaagccgaggctgtctcagtcaagaaggaaagtgaagatccaaactattatcagtacaatatgcagggctctcaccctagctccacaagcaatgaggtgatcgagatggaactgccaatggaggactctacacctctcgtgccatctgaagaaccaaacgaggatcctgaggccgaggttaagatcgaaggaaacacaaactcatcaagtgtcacaaacagcgcggctggcgtagaagacctgaacattgtacaggtcactgttccggacaacgaaaaggagcggttgtcgagcatcgaaaagatcaagcaactgcgcgagcaggtcaacgatctcttttcccgaaaatttggtgaggccattggcgtcgatttccccgttaaggtgccctatagaaaaattactttcaatccggggtgtgtggtcattgatggtatgccccctggtgtggtattcaaggccccaggctacctggagattagttccatgcgccgcatcttggaagccgccgaatttatcaaatttaccgtgattcgccccctccccggactagagctttctaacgtgggaaagcgcaaaatagatcaggagggccgagtttttcaggagaaatgggagagagcgtactttttcgtggaagtgcagaacattcctacctgcctcatatgtaaacagtctatgagtgtgagcaaggaatataacctccgtcgacactatcaaactaatcactccaaacattacgatcagtatacagagagaatgcgggacgaaaaactgcacgagctaaagaaagggctgcggaagtatctcttagggtcgtccgacactgaatgccctgaacagaaacaggtcttcgctaatccatctcctacacagaaaagtcccgtccaaccagtggaggaccttgcgggcaacctctgggagaagctgcgggaaaaaattagatcttttgtcgcatacagtattgctatcgacgagatcacagacattaacaacacgactcaattggctatttttattagaggagtcgatgagaatttcgatgtatccgaggagcttctggacactgtacccatgaccggaacgaaatctgggaatgagatattcctgagagtggaaaagtcactgaagaaattttgtataaattggagtcggctcgtgtctgtggccagtactggtacccctgctatggtggatgccaataacggccttgtgactaagcttaaaagtcgcgtcgctaccttttgtaagggcgctgagttgaaaagcatctgctgtataattcatcctgaaagcctctgcgcgcagaaattaaagatggatcatgtgatggatgtcgttgttaagtctgtgaactggatctgctcccgcgggctgaatcactccgagtttaccacattgctctatgagttagactctcagtatggatccctgctttattacactgagattaaatggctcagtcggggtctggtacttaagaggttttttgaatctctcgaagaaattgattcatttatgagttcccgggggaaacctttgccgcagctttcaagcattgactggatcagggacctcgcgttcctggtggatatgactatgcacctgaacgcactcaatatctctttacaggggcactcccaaattgttacacagatgtatgatttaatcagggcttttcttgctaaactctgcctatgggaaacccacttgacacgaaataacctggcacattttcctacattgaaactcgtgtccagaaatgagtctgacggcctgaactacattcctaagattgccgagctcaaaaccgaattccagaaacggctgagcgactttaagttgtacgaatcggagttaacgctgttttcgagtccattttccacgaagatcgacagcgttcatgaagagcttcagatggaggtcatcgatttgcagtgcaacacagtgttgaaaacaaaatacgacaaggttggcatcccagagttttataaatatttgtggggaagctatcccaagtacaaacaccattgtgcaaagatcctgagcatgttcggatctacctacatctgcgagcaactcttcagcatcatgaaactttctaagacaaaatactgctctcaactgaaagactctcagtgggactccgtcctccacatcgctacctag

SEQ ID NO: 11922 - DNA, 1095 bp, Artificial Sequence
  Description of Artificial Sequence: Synthetic coding sequence
atgacaggaactaaatccggtaacgaaatcttcctgcgggttgagaaaagcctcaagaaattctgtataaattggagccggttggtctctgtggcatccaccggaactcccgctatggtggacgcaaacaacggactcgtcacaaaattaaagtcacgcgtggctactttttgtaagggtgcagagctcaaatcgatttgttgcattatccacccagagtcgttgtgtgcgcagaaattgaagatggaccacgtgatggacgtcgtagtcaaaagcgtaaactggatctgtagccgggggctgaatcactcagagtttactacgctactctatgagctggattctcagtatggaagcctgttatactacacagagataaagtggctgagcagaggactggtgttgaaaaggttcttcgaatcattggaggaaatcgacagctttatgtcttctcgagggaagcctctcccccagctgtcttctattgactggatcagagacctggctttcctcgtcgacatgaccatgcacctcaacgcgctaaatatttccttacagggacacagccagatcgtaacccagatgtacgacctcattagagccttccttgcaaagctgtgtctctgggaaactcatctcacccggaacaacttggcacactttccaaccttaaagctcgtatccaggaacgagagcgatggactgaactacatcccgaagatagccgaactcaagacggaattccaaaagcgactatctgattttaaactgtatgagtctgaactgaccctattcagcagcccattctccacaaagatcgacagtgtgcacgaggagctacagatggaagtgattgacctccaatgcaatacggtgctcaagactaagtatgacaaggtcggcatccctgagttctacaaatacttgtggggatcctatcccaagtacaaacaccattgtgcgaaaatactcagcatgttcggctcaacatatatctgtgagcagttgttctccattatgaagctcagcaagactaaatactgcagtcaactgaaagatagccagtgggattcagtccttcatattgctacatag

SEQ ID NO: 11923 - DNA, 1491 bp, Artificial Sequence
  Description of Artificial Sequence: Synthetic coding sequence
atgtccgtcagtaaggagtacaacttgagacgtcattaccagaccaaccacagtaagcattatgaccaatatacagaacgaatgcgtgatgagaagcttcacgagctgaaaaaaggcttgcggaagtatttgctgggctccagcgatacagagtgtccagagcagaaacaggtgtttgccaaccctagccccacccagaaatcacctgttcagccagtcgaggacttggccggcaacctgtgggagaagctaagagaaaagattcgttccttcgttgcctacagcattgccatcgatgagattactgacatcaacaatacaacacagctagccatttttatccgcggagtagacgaaaattttgacgtgtcggaagagcttctcgacacagtccctatgaccggcacgaagtccgggaacgagatattcctccgggtggagaagtcactgaagaaattttgtatcaattggagcagattagtctccgttgcatctacagggacccctgccatggtcgacgctaacaacggactcgtgacaaagttgaagagccgggtagcaaccttctgcaaaggcgcagaacttaaaagcatctgttgcatcatccacccggagtccctatgtgcacagaaactgaaaatggatcatgtcatggacgtcgtcgttaaatcagtgaactggatctgttcccggggactcaatcattccgagttcacaactttgctatacgagctggactcccagtacggctcgttactgtactacaccgaaatcaaatggctatcacgcggactggttctcaaacgcttcttcgagagcctggaggaaatcgactcctttatgtcctctagggggaaaccactgccacagttaagctctattgactggatcagggacttggcctttctggtggacatgacaatgcacctgaatgcactgaatatttcacttcagggacactcccagattgttacacagatgtacgacttgatcagggcgttcctggctaaactatgcttgtgggagactcatctgactaggaataacctcgctcacttccctacacttaagctcgtgtcccgtaatgagagcgatggactgaattacatccccaagatcgcggaactgaagacagaattccagaaacgcctaagcgacttcaaactgtatgaatccgagttgaccctcttctcatccccttttagcacaaagatcgatagtgtgcacgaggagttacagatggaggtgattgacttgcagtgtaatactgtgctaaagaccaaatacgacaaagtgggcatccccgaattttataagtacctatggggcagctacccaaaatacaagcatcattgtgctaaaatcctcagcatgttcggctcaacctatatatgtgaacagctattctccatcatgaaattaagcaagacgaagtactgcagccagctgaaagatagccagtgggacagcgttctgcatatcgctacgtag

SEQ ID NO: 11924 - DNA, 681 bp, Artificial Sequence
  Description of Artificial Sequence: Synthetic coding sequence
atggcccaggtcgcggtttctacactccctgtggaggaagagagtagttcagaaacgcgtatggtggtgacattcctcgtgtctgctctagagagtatgtgtaaggaactggctaaatctaaagccgaggtggcatgcattgccgtctatgaaacagacgtgttcgtcgtcggcacagagagaggatgcgcctttgtaaacgcccgaaccgactttcagaaggacttcgccaaatattgtgtcgccgagggcctttgtgaagtcaaaccaccctgtccagtgaatggtatgcaagtgcattctggggagaccgaaattcttaggaaggctgtagaagattacttttgtttctgttacggaaaagcgctcggcacaacagtgatggttccagttccatacgagaagatgctccgagaccaatctgccgtggtggttcagggactccccgaaggcgtggcatttcaacacccggaaaattatgatctggccaccctcaaatggatcctagagaacaaggccggcatctccttcattatcaaccggcccttcctggggcctgagtcacagctcggcgggcccgggatggtgaccgacgccgaacgcagcatcgtttccccgtcggaaagacatttcactgagagccgctcctgcttaagtcaggagaggattcgtcgttcatag

SEQ ID NO: 11925 - DNA, 768 bp, Artificial Sequence
  Description of Artificial Sequence: Synthetic coding sequence
atggaacaagctctaaccggcgaggcacagagccggtggcccaggcggggcggctctggcgcgatggctgaggctcctgggcctagcggcgaaagtcgaggacacagcgccactcagctccccgccgaaaaaaccgtggggggaccatcaagggggtgcagctccagtgtacttagagtgagccagctggtgctgcaggctattagcacacataagggcctgactctcgcggctctgaaaaaggagctccgcaacgcgggatacgaagttcggcgtaagtcgggccgccacgaggccccacggggccaagcaaaagccactctattgcgggtgagcgggtcagacgcagcaggatatttccgcgtctggaaggtgccgaagccacgccggaagcccggtcgggctcgacaggaggagggcacaagagctccctggagaaccccagccgcacccaggtctagcaggcggagacgccagcccttacggaaggccgctcgcaaagctagagaggtatggagaagaaacgcgagggccaaggctaaggccaacgctcgggctaggaggactagaagagcccgccccagggccaaggaacccccatgcgctcgggcgaaggaggaagctggagctaccgccgccgatgaaggcagagggcaggcggtgaaggaagatacaaccccccgatctggcaaagacaagcgccgttccagcaagccaagggaagagaaacaggagcctaaaaagcccgcacaaaggaccattcaatag

SEQ ID NO: 11926 - DNA, 642 bp, Artificial Sequence
  Description of Artificial Sequence: Synthetic coding sequence
atgtccgtcgaactcgaagaagccctccccgtgacaaccgccgaggggatggccaagaaagtgacaaaagctgggggctccgccgccttaagtccgtctaagaagcgaaagaacagcaaaaagaaaaatcagccaggtaaatatagccagttagtagttgagacgattcgtagactgggcgagcggaatggaagttccctggccaaaatctatacagaggccaaaaaggtgccatggtttgaccagcagaatggcaggacatacttgaaatattcaattaaagcattggtgcaaaacgacacactgttacaagtaaagggaactggggctaacggttcgtttaaattaaatcggaagaagctggagggagggggagagagacggggcgcccccgccgccgcaaccgcaccagccccgaccgctcacaaagctaagaaagctgcacctggagctgccggatctaggagagctgataagaaacccgctagaggccagaaacctgagcagcgaagccataagaaaggagccggagcaaagaaggataagggaggcaaagccaagaagactgcagccgccggaggcaaaaaggtgaagaaagctgcaaagccctccgtgccaaaggttccaaagggcagaaagtag

SEQ ID NO: 11927 - DNA, 1467 bp, Artificial Sequence
  Description of Artificial Sequence: Synthetic coding sequence
atgttcgccgctgggctggcgccattttacgcctccaacttctccttgtggagtgctgcttattgtagcagcgccggacccggcggctgcagctttcccctggatcccgcagccgtcaagaagcccagtttttgtatcgctgatattctacacgctggtgtcggcgacttaggcgctgcccctgagggactcgccggcgcttcagcggctgcattgaccgcccaccttggcagcgtacaccctcatgcaagctttcaggctgctgctaggtccccactgcgccctacccctgtcgtggcaccaagtgaggtgcccgccgggtttccacagcgcctgtcccctcttagcgcagcatatcaccatcaccaccctcagcagcaacagcagcagcagcaacctcaacaacaacagcctccacccccccctagggccggggctctgcagcccccagcttcaggcactagggtggttccaaacccccaccactccggaagcgcgcccgctccatccagcaaagacctgaagttcggaattgaccgcatactgtctgccgagtttgatcctaaagtgaaagagggaaacacgctgagagacttaaccagtctgctgacaggtggacgtccagccggggttcatctgtcgggccttcagccttctgccggccagttctttgcctccctggatccaatcaatgaagcgagcgcaattttgagcccactgaattccaatccacggaattcagtccagcatcaattccaggatacattcccaggaccctatgctgtgcttactaaggataccatgccacagacgtataagagaaaacgaagttggtctagggccgttttttccaaccttcagcgaaaaggattggaaaaacggttcgaaatacagaaatacgttacaaaacccgataggaaacagctcgcagctatgttggggctgacagatgctcaggtgaaggtgtggtttcagaatcggcgaatgaaatggcgccactcaaaagaggcccaagctcagaaggacaaggacaaggaggctggcgagaagccgtctggtggagccccggccgccgacggagagcaggacgagcgctctccaagccgttccgagggggaggctgagtccgagagcagtgacagcgaatctctagacatggctccttcagatactgagcggaccgaaggaagcgagaggtccctccaccagactactgttattaaggcacccgttaccggcgccttaatcacagcaagcagcgcaggcagcgggggcagttcaggagggggaggcaacagcttttcatttagcagcgcgtcttccctgagctcatcctctacttccgcagggtgcgcctcctcactggggggcggtggcgcaagcgagctgttgccggctactcagccaaccgcaagttccgcccccaaatcccctgagcccgcccagggcgccctgggatgtctgtag

SEQ ID NO: 11928 - DNA, 1116 bp, Artificial Sequence
  Description of Artificial Sequence: Synthetic coding sequence
atgagttcacgaggggggaaaaaaaagtctactaagacttctaggtcagccaaagcgggcgttattttcccagtcgggagaatgctccgctatattaaaaaaggtcatcccaaataccggatcggagtgggagcccctgtttatatggcagccgtcctggaatacctgaccgcagagattcttgaactagccggcaatgctgcgagggataacaagaaagggcgcgtcacaccccggcatatcctgctggcggttgcgaacgacgaagagctcaaccagctccttaagggcgtcacaatcgccagcggcggggttttacctaatatccatccagagctgcttgcaaagaagcgaggttccaaaggaaagctggaagctattatcacccccccacccgcaaagaaggctaagtcacctagccaaaaaaagcctgtaagtaagaaggcaggcggcaagaaaggtgctagaaaatccaaaaaacagggagaggtgtctaaggcagcttccgccgacagcacaaccgagggcacgccagctgatgggttcaccgtcctgagcactaagtctctgttcctcgggcagaaactaaatcttatccatagcgaaattagtaatctggccggcttcgaagtcgaggcaatcatcaaccctactaatgctgacatcgatctcaaggatgacctcgggaacaccctggagaagaagggagggaaggaatttgttgaagcggtactagagcttcgaaagaagaacgggccgctagaagtcgccggcgcagcggtttccgccggccatggcctacccgctaaatttgtgattcattgcaatagtcccgtgtggggagccgataagtgcgaagagctgctggagaaaactgtgaagaattgtctcgctcttgcagacgataagaagcttaaatccattgccttcccgtccataggctctgggaggaatggattccccaaacagactgcggcacagctgatcttaaaggccatctcgagttacttcgttagcaccatgagcagcagtattaagacagtgtatttcgtgctgttcgactctgagagtataggtatatacgtccaggaaatggccaagttggacgccaattag

SEQ ID NO: 11929 - DNA, 348 bp, Artificial Sequence
  Description of Artificial Sequence: Synthetic coding sequence
atgcccaggaggaggcggcgaagggggtctagcggagccgggggacgtgggcgaacctgttcaagaactgttcgcgccgaactgtcgtttagcgtatcacaggtcgagaggtcattgagagagggtcactacgcccaaagactctcacggactgcccctgtgtacctcgcggcagtgatcgaatatctgacagctaaggtgccggaactcgcaggaaacgaggcacaaaactcaggcgagaggaacatcactcccctgttactcgatatggtcgttcataatgatcgccttctttccaccctgttcaatactacgacgatctctcaagtcgctcctggcgaggattag

SEQ ID NO: 11930 - DNA, 348 bp, Artificial Sequence
  Description of Artificial Sequence: Synthetic coding sequence
atgcctcgtagacgccgtcgcaggggctcaagtggagccgggggaagagggcgtacctgtagtcgtactgtacgggcagaactcagtttttccgtgtcccaggtggagcgttcactaagggaggggcattatgctcaacggctttcccggaccgccccggtttatctggccgccgtgatagaatatttaaccgcgaaggtcctggagcttgcggggaacgaggcgcaaaactctggtgagcggaatattacacccctgctgctggatatggtggtacacaacgatagactgctgtccaccctcttcaacacgaccaccatcagccaggtggcacccggcgaggactag

SEQ ID NO: 11931 - DNA, 348 bp, Artificial Sequence
  Description of Artificial Sequence: Synthetic coding sequence
atgcctaggcgcagacgcaggcgcggatcaagtggagcgggcgggagaggcagaacctgctcccggacggtcagagctgagctgagtttcagcgtgtctcaagtggaacggtctctcagagagggccattatgcccagcgtttaagtaggaccgcccctgtgtacttggccgccgtgattgagtatctgaccgcaaaggtgttggagctagctgggaacgaggctcagaactcgggtgagcgtaatatcactcccctgctgctggacatggtggtccacaacgacaggctgttgagtactctgttcaacacgacgacaatctctcaggtcgcccctggggaagactag

SEQ ID NO: 11932 - DNA, 3264 bp, Artificial Sequence
  Description of Artificial Sequence: Synthetic coding sequence
atggatctttactccactccagctgccgccctagaccgtttcgtcgcccgccgtctgcagccaagaaaagagtttgtagagaaagcccgccgtgcactgggagccctggcggcggctcttcgagagagaggtggccggctaggtgctgccgccccccgcgtgctgaagaccgtgaaaggcgggtctagtgggcgcggaacagctcttaagggtgggtgcgatagcgaactggtaatattcctcgattgtttcaagtcatatgtcgatcagagagcccggcgcgccgaaatcctgtcagagatgcgcgcttcccttgagagctggtggcagaacccagtccctggtctccggctcacattcccagagcagagtgtgcccggagcgctgcaatttcgtctgacaagcgtcgacttggaggactggatggacgtctctttggtgccggccttcaacgttcttggtcaagctgggtctggagtcaagccaaaaccgcaggtgtactcaacactcctcaactccggttgtcagggaggagagcacgctgcctgtttcaccgagttaagaagaaattttgtgaacattcgccctgccaaactcaagaatctgattctgctcgttaagcactggtaccatcaggtttgcctacagggactctggaaggaaacattaccacccgtctacgcactcgagctgctgaccatcttcgcctgggaacagggatgtaaaaaagacgcattcagcctggctgaagggctgcgcactgtcctcggcttaattcagcagcatcagcatctgtgcgtgttttggacggtgaattatgggttcgaggacccagcagtgggtcagttcctccagcgccagcttaagcggccccggcccgtgattctagatcccgcagatccaacttgggatctcggtaacggcgcagcgtggcactgggacctgctggctcaggaggctgcttcttgttacgaccatccttgctttcttaggggcatgggtgatccagtgcagagctggaagggtccaggtcttccccgcgccggctgcagcgggttgggtcacccaattcagctcgatcctaatcagaagaccccagagaatagcaagtcgctcaatgccgtttaccctagggccggtagcaagcctccatcttgtcctgcccctggacccaccggcgcggcctcaatagtccccagcgtccctggaatggcattggatctgtctcagattccaacaaaggaactagacagattcattcaagaccacctcaaaccgtccccccagttccaggagcaggttaaaaaggctatcgacatcatcctgagatgtctgcacgagaattgtgtccacaaagcctctcgcgtatctaaaggtggaagttttggtcgcggcactgacctgagagatgggtgcgacgtagagctcatcatttttctgaactgttttaccgactataaggaccagggacctagaagggccgagattctggatgaaatgcgagcacagctcgaaagctggtggcaggaccaggtgccctctctatccctgcaatttccagagcagaacgtaccagaggccctgcagtttcagctggtgtctactgcgttgaagtcctggactgacgtgagcctattacctgccttcgatgcagttggacagctcagcagcgggaccaagccaaatcctcaggtttatagccgactcctcacttccggatgccaggagggagagcataaggcctgcttcgccgagctccggagaaatttcatgaacatccgccccgtgaaactgaagaacttgatactcctcgtgaaacattggtacaggcaagtggctgctcagaataaaggtaaggggccggccccagccagcctccctcctgcttacgcactcgaacttttgacaatctttgcctgggaacaaggttgtagacaagactgttttaacatggcgcaaggcttcaggactgtgttagggcttgtccagcagcatcagcagctctgcgtgtattggactgtaaactattccaccgaagaccctgctatgcgaatgcacctgctggggcaactgcgcaaaccaagaccactggtgctcgatcctgcagatcccacatggaacgtgggccacggaagttgggagctgctagctcaagaggcggcagcgttggggatgcaagcttgcttcttaagcagagatggaacaagcgtccagccttgggacgtcatgcccgccctactgtatcaaacgcccgcaggtgacctagataagttcatcagcgaattcctgcaacctaacaggcagtttttagcccaggtgaataaggcggtagatacgatttgtagcttcctcaaggagaattgcttccggaacagcccaattaaggtcatcaaggtcgtgaagggaggtagcagcgctaaaggaactgcactgcggggacgatctgacgctgatctggtcgtgtttctgtcctgtttttcacaattcactgagcaaggtaacaaaagggcagagattatcagtgagatcagagctcaacttgaggcttgtcaacaggaacggcagtttgaggtgaaattcgaggtcagcaagtgggagaaccctagagtgctcagctttagtctgacgtctcagacaatgttagatcagtcagtggatttcgatgtgctgcctgcattcgacgctctagggcaactagttagcggcagccgcccctccagtcaggtgtacgtcgaccttatccattcatatagcaatgccggtgaatatagcacctgcttcaccgagctgcagagggacttcatcatctcaaggccaacaaaactgaaaagcctgattcggttggtcaagcactggtaccagcagtgcaccaagatttcaaaggggcggggctcactgccacctcagcatggactggagctgctgaccgtgtacgcttgggaacagggaggaaaagactctcagtttaacatggcagaaggatttcgtacagtccttgaattggtgacccaatacaggcaactgtgcatctattggactattaattataatgctaaggataaaactgtgggcgactttctcaaacaacaactgcaaaaacctcgccctataattctggatccggctgatcccaccggaaacctcggtcacaatgccagatgggatctgctggccaaggaagcggccgcttgcacatccgctttgtgctgcatgggaagaaatgggatcccaatacaaccttggccggttaaggctgccgtttag

SEQ ID NO: 11933 - DNA, 390 bp, Artificial Sequence
  Description of Artificial Sequence: Synthetic coding sequence
atgtctggacgtggcaaacaaggtggtaaggtgcgcgccaaagctaagtcccgctcatctcgcgccggcttacaatttccagtgggacgcgtgcaccgcttgctccgtaaaggcaattacgctgaaagagtcggagcaggagctcccgtgtatttggccgccgtacttgagtatctcaccgccgaaatcctggagctggctggcaatgctgctagggacaataagaagacccgtatcatccctcgccacctgcaactagctattcggaatgacgaggagctcaacaagctgcttggcaaggtgaccatcgctcagggcggggtgctgcctaacattcaggctgttttattgccaaagaaaaccgagagccagaagacaaagtctaagtag

SEQ ID NO: 11934 - DNA, 390 bp, Artificial Sequence
  Description of Artificial Sequence: Synthetic coding sequence
atgtctggaagggggaagcagggaggaaaggttagggctaaggccaagtcaagatctagtcgagccggactgcaatttcctgtgggacgggtgcacagactccttcggaaaggtaactatgctgagcgggtcggggctggagccccagtatacctggctgccgtgctggagtaccttacagccgaaattctggaacttgcgggtaacgcagccagagacaataagaagactcgcatcatcccccgccatctgcagctggcgatcagaaacgacgaggagttaaacaaactgcttgggaaagtcacgatcgctcaaggcggcgtgctcccaaatatccaggccgtccttctgccgaaaaagactgaatcccagaaaactaagtccaagtag

SEQ ID NO: 11935 - DNA, 591 bp, Artificial Sequence
  Description of Artificial Sequence: Synthetic coding sequence
atggaaataattagttccaagctatttatcttgctgactctcgctaccagttccctattgacctccaacatcttttgcgccgacgaactcgtcatcagcaacttacattctaaagagaattatgataaatactcggaaccgaggggctatccaaagggagagaggtctctgaacttcgaagagttaaaggactggggcccaaagaatgtgattaaaatgtctacacccgcagtgaataaaatgcctcattcttttgctaacttgccactccgcttcggccgcaacgttcaggaagaaagatccgcaggcgccacagccaacctgccgctgagaagtgggagaaatatggaggtgtccctcgtccgaagagtgcccaatctgccacagcgattcggcagaacgacgacggccaaatccgtgtgccggatgctctcagatctgtgccaggggagtatgcactcaccttgtgccaatgacctcttctatagtatgacctgtcagcatcaagagatccagaaccctgatcagaagcagagccggcgcctcctgtttaaaaagattgatgatgctgagctcaagcaggagaaatag

SEQ ID NO: 11936 - DNA, 387 bp, Artificial Sequence
  Description of Artificial Sequence: Synthetic coding sequence
atggcaggtggcaaggccggtaaggactctgggaaggccaaggccaaagccgtctccagatctcagcgagccgggctgcagttcccagtggggaggatccatcggcacctgaagacgcgcaccacctcacatggaagggtgggggctacggctgccgtgtattccgcagcaatcctggagtatcttacagccgaggtgctggagctggcgggaaacgcttcaaaagacctcaaggtaaaaaggattacccctcggcacttacagctcgccatcaggggcgatgaggaactcgactctctgattaaggccaccatcgccgggggtggggtcattccccatattcacaaaagtcttattggaaagaaaggccagcagaagacggcctag

SEQ ID NO: 11937 - DNA, 273 bp, Artificial Sequence
  Description of Artificial Sequence: Synthetic coding sequence
atggcaggggggaaggctggaaaagacagcggaaaggctaaagccaaggccgtctctagatcgcagcgagccggcctccaggtgctggaactggcaggaaatgcgagtaaggatcttaaggtgaagcgaattactcccagacacctccaactggcaatccgtggcgatgaggaactcgattcacttattaaggctactattgcaggaggaggcgtcatcccccacatccacaagagcctcatcggaaaaaaagggcagcagaaaacagcatag

SEQ ID NO: 11938 - DNA, 309 bp, Artificial Sequence
  Description of Artificial Sequence: Synthetic coding sequence
atgtttccagtagggcgaatccacaggcacctgaagaccagaactactagccacggacgcgttggagccacagccgccgtgtactcagccgccattctggagtacctgactgccgaggtccttgaattggccggaaacgcaagcaaggacctaaaggtgaagcgaatcacccccaggcatctgcaattagcaatcaggggcgatgaggagttggattctttaatcaaggctaccattgccggcgggggcgtcatcccacatatccacaagtcattgatcgggaaaaaaggccagcagaaaacagcctag

SEQ ID NO: 11939 - DNA, 201 bp, Artificial Sequence
  Description of Artificial Sequence: Synthetic coding sequence
atggcaggcgggaaggcaggaaaggactccggcaaggcgaaggccaaagcggtatctcgctcacagcgagccgggcttcaattccccgtgggcagaatccaccgccacttaaagacgcgcaccacctcacacggtagggtgggggccaccgctgccgtctactcagccgctatcctagaatacctgaccgcagaggtgtag

SEQ ID NO: 11940 - DNA, 1110 bp, Artificial Sequence
  Description of Artificial Sequence: Synthetic coding sequence
atgagctctaggggagggaagaagaaatcaacaaaaacaagcagaagtgcaaaagctggcgtgatatttccagtcggaaggatgctgcgttacataaaaaaaggacatccaaaataccgcattggggtaggcgcccccgtgtatatggctgccgtactagagtacttaaccgctgagatcctagaacttgccggtaacgcagctcgcgataataaaaaggggcgggtcacaccacgccatatcctgctcgccgtagccaacgatgaggagctgaatcaactccttaagggcgtaactattgcctctggtggggtgctccccaacattcacccagagctcttggcaaaaaaacgagggtccaaaggcaaacttgaagcaatcatcacaccccctccagccaagaaagctaagtcaccctcccagaaaaaacctgtctccaaaaaggccggcggaaaaaagggtgcgcgaaaatcgaagaaaaagcaaggcgaagtgtccaaggccgcatccgcagactccacgaccgaggggacacccgctgacggattcacagttctgagtaccaaaagcctttttttggggcagaagctgcaggtggtccaggccgacatagcttccatcgatagcgatgccgtcgtccacccaacgaacacagatttctatatcggcggggaggtgggaaacacgctagagaagaagggcggcaaagaatttgttgaggccgtgctcgagctcagaaaaaagaatggccctctcgaggttgctggggctgcagtttccgcaggccatggactccctgctaaatttgtgattcattgcaactcccctgtttggggagctgacaagtgtgaagaactactggaaaagacagtgaaaaattgtctcgccttagccgatgataagaagcttaaatcaattgcatttccaagcattggaagcgggcgaaatggatttccaaaacagacggctgcccagcttatccttaaagccatatcctcgtactttgtgtctacaatgtcaagctctattaagacagtatactttgtcctattcgacagcgaatctatagggatctacgtccaggagatggcaaaactcgacgctaactag

SEQ ID NO: 11941 - DNA, 603 bp, Artificial Sequence
  Description of Artificial Sequence: Synthetic coding sequence
atgtccagtaggggcgggaagaagaagagtacgaaaacttcccgctcagccaaagccggggtcattttccctgtgggacgcatgttgcgttatatcaagaagggtcacccgaagtacaggatcggagtgggggcgccagtgtatatggctgctgtcctcgagtatcttactggaaatactctggaaaagaaggggggcaaggaatttgtggaagcagtcttggaactccgcaagaagaatggacccctggaagtggcaggggccgccgtctccgctggacatggtttgccagccaagttcgtgattcactgtaactctcctgtatggggcgcggacaaatgcgaggaacttctcgaaaagactgtgaagaattgtctggctttggccgatgacaagaagctgaagtctatcgccttccctagcattggtagcggcaggaatggatttcctaagcagactgcggcccagctaatcctgaaagctatctcctcatattttgtgagcactatgagcagttcaattaaaacagtgtattttgtgctatttgattctgagagcataggaatctacgtgcaggaaatggctaagctcgatgctaactag

SEQ ID NO: 11942 - DNA, 1119 bp, Artificial Sequence
  Description of Artificial Sequence: Synthetic coding sequence
atgtccagcagagggggcaagaaaaagtccaccaagacatcgaggagtgctaaggccggggtgatttttcccgttggacgcatgttaagatatatcaaaaaaggtcaccctaagtaccgcataggcgtgggcgcaccggtgtatatggccgccgtcctcgaatatctcacagcggagattctcgaacttgctggcaacgcggcaagagataacaaaaaagggcgcgttactcctcgccatatcctgttagccgttgcgaacgatgaagagctcaatcagctcctgaaaggcgttaccattgccagtggaggcgttttaccgaacatccaccctgagctgcttgctaaaaaacgagggtcgaagggcaaattagaggccatcatcacaccccctccggcaaagaaggcaaaaagccccagtcaaaagaagcccgtgtcaaaaaaggccggtggaaagaaaggagctagaaaatcgaaaaagaagcagggcgaagtctcaaaggccgcctccgcggacagtactacggagggcacacccgccgacggctttacagtgctatccacaaagagtctctttctcgggcaaaagctcaacctcattcactctgaaattagcaatttagcgggcttcgaggtagaagccatcataaatcctaccaacgccgatatagatctgaaagacgacttggggaacacactggagaagaagggagggaaagagttcgtggaagccgtccttgaactgaggaagaagaatggacctctggaggtagcgggtgccgccgtgagtgcaggtcatggactgcctgccaagtttgtgattcactgcaactcacctgtctggggagcggacaagtgcgaagagcttctggaaaagactgttaagaactgtctggctttggccgatgacaagaagctgaagtccatcgcgttccctagtatcgggagcggcagaaatggcttccccaaacagacagccgcacagctgatactgaaagctattagcagctacttcgtgtcgaccatgtctagcagcattaagaccgtttactttgtactgttcgatagtgagtcgatcggcatttatgttcaggagatggcgaagctcgacgcaaattag

SEQ ID NO: 11943 - DNA, 1119 bp, Artificial Sequence
  Description of Artificial Sequence: Synthetic coding sequence
atgtcatctcgtgggggcaagaagaagtccacgaagacctctcgctccgcgaaagcaggggtaatctttcctgtcgggaggatgctgcggtacattaaaaagggccaccctaaataccgcataggagtgggagcccctgtttatatggccgctgtcctggagtatcttacggccgaaatcctcgagctcgcgggaaatgccgctcgtgacaacaagaagggaagggtgacaccgagacatattcttttggcagtggccaatgacgaagagctgaatcaactgctgaaaggcgtgactatagcctctggaggcgttctaccaaatattcaccctgagttgctggccaaaaagcggggcagcaagggtaaactcgaggccatcattactcctcctcctgctaaaaaggccaagtctcccagccagaaaaagccagtcagcaaaaaagccggcggcaagaaaggcgcgaggaaaagtaaaaaaaagcagggtgaagtcagtaaggctgcatccgctgactccactacggagggtaccccggctgacggctttaccgtcctctccacaaagtctttgttcctagggcagaagttgaatctgatccactctgagatctccaatctagccggattcgaggtcgaggcaattattaatcccaccaacgcagatatcgacctgaaggacgatttagggaacacactcgagaagaagggcggaaaggaattcgtagaggcggtgctagagctcagaaagaagaatggaccgcttgaggtggccggcgccgctgtaagtgctggacacggattgcccgccaagttcgtgatccactgcaactctcctgtgtggggagctgataaatgtgaggagttgcttgaaaaaactgtgaagaactgcctagccttggccgacgacaagaagctcaagagcatcgcctttccaagcattgggagcggacgcaacgggtttcctaaacaaacagcagctcagttaatcttaaaggcaatttcatcttacttcgtttcgaccatgtcttctagtattaagactgtatatttcgtgctctttgactctgaatctatcgggatttacgtccaggagatggctaaactagacgcaaactag

SEQ ID NO: 11944 - DNA, 1119 bp, Artificial Sequence
  Description of Artificial Sequence: Synthetic coding sequence
atgtcggggcgttccggaaaaaagaagatgtctaaactcagcagatccgcgcgcgccggcgtgattttccccgtggggcgattaatgcgctacctgaaaaagggcactttcaagtaccgaatctctgtcggtgccccagtgtacatggccgcagtcatcgagtacttagcagcagaaatactggaactcgccggtaacgcagcacgtgataataagaaggcccgcatcgctcctagacatattttgctggctgtcgctaatgatgaagaattaaaccagctcctgaagggggtcacaatcgcgtctggcggagtcctcccacgaatacaccctgagctgcttgccaagaagagggggacgaaaggaaagagtgaaaccattctttctccaccacccgaaaagagagggcgcaaggctacgtccgggaaaaaagggggcaaaaagtcgaaagcagccaagccccggacaagcaagaaatctaagcccaaggacagtgacaaggagggaacctccaattccacaagcgaggatgggccgggggacggattcacaatcttatcctcaaaaagtctggtcctagggcagaaactttccttgacccaatcggacattagtcatatcggttctatgcgtgtcgagggcatcgtgcatcctacaactgcggagatcgaccttaaagaggatatcggcaaagcattagagaaagccggaggaaaagagttccttgagacagtcaaagagctgcgaaagagtcaggggcctctggaagtggctgaggctgcggtatcccaatcctctgggcttgctgctaaatttgtgattcattgtcatattcctcagtgggggagtgataaatgtgaggagcaactcgaggaaacaattaagaactgtctctccgcagcagaagataaaaagctgaagtcggtggcgtttccaccatttccttcaggtcgcaactgctttcccaagcagactgccgcccaggtgactctcaaggctatctccgcacatttcgacgattcttctgctagcagtctaaagaacgtgtatttcctcctttttgatagtgagtctattggcatttacgttcaggaaatggcaaaactggacgccaagtag

SEQ ID NO: 11945 - DNA, 732 bp, Artificial Sequence
  Description of Artificial Sequence: Synthetic coding sequence
atgtcagggaggagcggaaagaagaaaatgagcaagttgagccgcagtgcccgtgcaggggtcatcttccctgtgggcagattgatgagatatttaaagaagggtacgttcaagtatcgtatttctgttggggctcctgtctacatggctgccgtcatcgaatatctggccgctgagattttagaactagccggaaacgccgcaagggacaacaagaaagctcgaatcgcgccaagacacatactcctggcggtggccaatgacgaggagctcaatcagtcgaagccaaaagactccgataaggaaggaaccagtaacagtacctccgaggacgggccaggagatggttttactatcctctccagcaagtcccttgtactgggccagaaactgagtctgacccaaagcgatatatcacatatcggttccatgcgggtggaaggaatcgtgcacccaaccacagccgagattgatttgaaggaagacatcggtaaagctctcgagaaagcgggaggcaaagagtttctcgagactgtgaaggagctgcgtaagagccaggggccacttgaggtggctgaagcggccgtgtcacagagctctggacttgcagctaagtttgtgatccactgtcacataccccagtggggctctgacaaatgcgaggaacagctcgaggaaacaatcaagaattgcttgtctgccgcagaagacaaaaagctgaaatctgtgtag

SEQ ID NO: 11946 - DNA, 732 bp, Artificial Sequence
  Description of Artificial Sequence: Synthetic coding sequence
atgagcggcaggagcggcaaaaaaaagatgtctaaacttagcaggtcagcgcgagcgggagttatatttcctgtggggcgtctgatgcggtacctgaagaagggcactttcaaataccgcatatcagtgggcgcccctgtttacatggccgccgtcattgaatacctggccgccgagatccttgaactggcaggcaacgcggcgcgggataataagaaagcgcgtattgcacccaggcacatcttgttggcagtcgcaaatgacgaggaacttaatcagagcaagccgaaggatagtgacaaggaggggactagtaactctacctcagaggatgggcccggcgacggatttacgatcttaagcagtaaatccctggtgctaggccaaaaactaagcctgacccagtcagatatctcccatattggctctatgagagtcgagggcatcgtgcaccccacaacagccgaaattgatctaaaggaagacatcgggaaggcactagaaaaagcagggggtaaggaattcctagaaactgtcaaggagctgagaaaaagtcagggaccattggaggtcgcagaggctgcggtgtcacaaagttccggactagcagccaagttcgtgatccactgccacattccacagtggggaagcgacaagtgtgaggaacagctcgaggagacaatcaagaattgcctgtctgccgccgaggataagaagcttaaatctgtgtag

SEQ ID NO: 11947 - DNA, 387 bp, Artificial Sequence
  Description of Artificial Sequence: Synthetic coding sequence
atggcaggggggaaagccgggaaggacagtggaaaggctaaaaccaaggccgtgtctaggagccaacgggccggcctgcagttcccggtgggacgcatccatcgccatttgaaatctagaacaaccagccatggccgggttggtgccacggcagcagtgtatagcgccgctattctggaatacttgaccgcggaggtgctggaactggctggaaatgcttcaaaagacttgaaggtgaaaagaattacaccacggcacctgcagttggccatacgtggagatgaggaactggattctctgattaaggctaccatagccggagggggagtgatcccccatattcacaagtcgctgattgggaagaaaggccagcagaagactgtctag

SEQ ID NO: 11948 - DNA, 774 bp, Artificial Sequence
  Description of Artificial Sequence: Synthetic coding sequence
atgaagtgccacgccggctctctttcggctaacctgcccgcgctgaaggtcactggctggtccagatgcgtggccagtcgccagccaataacagtgggggtttgtgggcctaagagaccattgtggccatcttccgagaagccctttaacttccacactctggccaagctgcacgatatcggtctgggtaacgatttcttagatatgacactgaaggcccagcagcagaagcagaaaagccatgccacgattccaaagtgtcccccattgccatggagtcccacagtcaccctctgcagctgttacctaatggccgccgcttctgcgatggcggaggcgtcctctgagaccacttcagaagaagggcagtcgatccaagaaccaaaggaggccaactctactaaggcacagaagcaaaaacgccgaggatgccgtggatctcggcgtcggcacgcaaatcggagaggagattctttcggggacagtttcaccccgtattttccaagggtgttgaagcaggtccaccagggccttagcttgagccaggaagcagtcagtgtgatggacagcatgatccatgatatattggatcggatagccacagaggcaggtcaattggctcattataccaagcgggtcaccattacaagccgcgacatacaaatggccgttcgcctgctgctgccgggaaaaatgggaaaattagccgaggcccaggggacaaatgctgcgctgcgcacttctttatgtgccatatggcagcagcgaaagtag

SEQ ID NO: 11949 - DNA, 465 bp, Artificial Sequence
  Description of Artificial Sequence: Synthetic coding sequence
atggccgcggcgagcgctatggcagaggctagtagcgagactacatctgaagaaggccaaagcattcaggagccaaaggaggccaacagcactaaagcccaaaaacagaagcgccgcggatgcaggggtagccgacggcgccacgcgaaccggcggggagactcatttggcgattctttcaccccttatttccccagagtattgaaacaagtccaccagggactttctctgtctcaggaggccgtcagcgtgatggatagtatgatacacgatattcttgatcgcatcgccacagaagccgggcagctggctcactatactaagcgggtcacaattacatcaagggacattcagatggccgttagacttttgctccccgggaaaatgggaaaattggccgaggctcagggcaccaacgccgctctgaggacatctctctgcgcaatctggcaacaacgaaaatag

SEQ ID NO: 11950 - DNA, 1026 bp, Artificial Sequence
  Description of Artificial Sequence: Synthetic coding sequence
atggccacctggagacgagatggtagactcactgggggccagcgcctcctttgtgccggtttagcaggcaccctgtctctcagcctcacggcccctcttgaactggccacagttctcgcccaggttggcgtggtccggggacacgcaaggggcccatgggcgactggccatcgagtttggagagcggagggcctgagagctctctggaaaggcaatgccgtggcctgtctcaggctgtttccttgcagcgcagtccagttagccgcttacaggaagtttgtggtgctgtttacagatgacctcggtcatatctcacagtggagttcaattatggctggctcactggccggtatggtaagtacaatcgttacataccccaccgatctcataaaaacccgtctgatcatgcagaatattcttgagccgtcctacagaggattactccacgccttctcaactatctaccaacaagagggctttctagctttataccgtggggtgagtcttacagtggtgggtgctctgcctttttcagccgggagtcttctcgtctatatgaacctggagaagatttggaacggccccagggaccagttctcactgccccagaacttcgccaacgtgtgtctggcagcggccgtgacacagaccctgagtttccctttcgagaccgtgaagcgtaagatgcaagcacagagtccataccttccccacagcggcggggtggatgtccatttttcaggagcagttgattgcttccgacaaattgtgaaagcccagggggtcctgggtctgtggaacgggttgacagccaatcttctaaagattgtgccatactttggaatcatgttcagtacgtttgaattttgtaagagaatctgcctgtaccagaacggctatatacttagtcccctcagttacaagctgacccctggcgtggaccagagtttacaaccccaagaactacgtgaattgaaaaaattcttcaagaccaggaaaccaaagcctaaaaaaccaacactttag

SEQ ID NO: 11951 - DNA, 408 bp, Artificial Sequence
  Description of Artificial Sequence: Synthetic coding sequence
atggcaagaacgaagcagacagctcgtaaatctaccggcggcaaggcgcctcgaaagcagctggcaacaaaggcagcccgtaagagtacaccaagcacatgtggagtgaagccccacaggtatcgtcctgggacagtggcgctaagggagatcaggaggtatcagaaatctaccgaactattgattcgaaagctcccctttcagcgtctggtgcgcgagatcgcacaagatttcaatacggatctcagatttcagagtgcagccgtgggagccctccaggaggcctccgaagcatacctggtcggacttctcgaagatacaaacctgtgtgcaattcacgctaaaagagtcaccataatgcctaaggacattcagctggctaggcgcattaggggcgagcgagcttag

SEQ ID NO: 11952 - DNA, 363 bp, Artificial Sequence
  Description of Artificial Sequence: Synthetic coding sequence
atgacttctttggcccagcagctccagaggctggctctgccacaatctgacgcttcactcttgtcgcgcgatgaagtggcgtccctactgtttgatcccaaggaagccgccacaatcgaccgggatactgcctttgcgatcggttgcacgggcttagaggaactcctgggaattgacccatctttcgagcagttcgaggcaccactcttctcacagctagctaaaaccctggaaagatccgttcagaccaaagctgtgaacaaacaactcgacgagaacattagtttgtttctgatccatcttagcccatacttcctgctgaagcctgcccagaagtgtctggaatggctgattcatagatag

SEQ ID NO: 11953 - DNA, 6192 bp, Artificial Sequence
  Description of Artificial Sequence: Synthetic coding sequence
atgaccagcctggcacagcagctgcagcggctggccttgcctcaatccgacgcctctcttctgtctagagatgaggtggctagcttactcttcgacccgaaagaagccgccactattgaccgcgatactgcctttgccattggatgtacaggattggaagagttgctgggtattgaccccagctttgagcagtttgaagcccctcttttttcccagctcgccaaaacattagagaggtcagttcagactaaagctgtaaacaagcagctggacgagaatatttcacttttcttgattcacctttcgccctatttcctgttgaaacccgctcagaagtgcttggagtggcttatccatcgctttcacatccatctttataatcaggatagcctgatcgcttgcgtgctaccctatcatgagacacgcattttcgtgcgggtgattcaactgcttaaaatcaacaacagtaaacatcgatggttctggctgctgcctgtaaagcaatccggggtgcctttggccaaggggaccctcataacacattgctataaagatctgggcttcatggacttcatttgcagcctggttaccaaatctgtaaaggtctttgcggagtacccagggtccagcgcacagcttcgggttctgctcgcgttttatgccagcacaatcgtaagcgctctggtggcagcggaggacgtgtcggataacataatcgctaagctgtttccctacatccaaaaaggactaaagtcaagcctgcctgattatcgggctgccacatatatgatcatctgtcagatatctgtgaaagtgacgatggagaatacattcgtgaattctcttgcttcccaaattatcaaaactcttactaaaatccctagtttgatcaaggatgggctgtcatgcctaatcgtgctgctgcaacgccagaaacctgaatcactcggcaagaaaccgtttccccatctttgtaatgtgcccgatctgataaccattctgcacggcataagcgaaacctatgacgttagtcctcttctgcactatatgctgccgcacctggtcgtgtccattattcaccatgttaccggagaagagacagaaggaatggatggtcaaatctacaagaggcatctggaagcgatcctcaccaaaatcagcctgaaaaataacctggaccatcttctcgcgtcgctcctgttcgaggagtacataagctattcttcacaggaagaaatggatagcaacaaggtgagtctgttgaacgagcagttccttcccctgattaggctgctggaatcaaagtaccctagaacactggatgtggtgctggaagagcacctgaaagaaattgcagacctgaagaagcaggagctgttccaccaatttgtgtctctgtccacctctggggggaagtaccagttccttgcggactccgacacatcgttaatgctgtccctgaaccatccactggctcctgttcgtatcttggcaatgaatcacctgaagaagataatgaagacgagtaaagaaggggtcgacgaatcatttataaaggaggcggtactcgcccgcctcggggatgacaatattgatgtcgttttgagcgccatctcagcgttcgagatctttaaggagcatttcagttcagaggtcactattagcaacctcctgaacctgtttcagcgcgccgaacttagtaagaacggtgagtggtacgaagtgttgaagatcgccgcagatattttgattaaagaggaaatcctgtccgagaacgaccaattatccaaccaggttgtggtgtgtctcctccctttcatggtcatcaacaacgatgacaccgagtctgccgagatgaagatcgccatctatttgtctaagtctggcatctgttctctgcaccctctgttgcgtgggtgggaagaggctctggaaaatgtgatcaagagcacgaaaccaggcaagttgattggcgtggctaatcaaaaaatgatcgaactcttggcagacaacataaatctgggggatccctcatctatgctgaagatggttgaagacctcatttccgttggtgaggaagaatcttttaatctcaagcaaaaagtgaccttccatgttatcctgtccgtacttgtctcctgttgttccagcctgaaggaaacccatttcccttttgctattcgagttttcagcctgctccagaagaagataaaaaagttggaatctgttatcactgccgtagagatccccagtgagtggcacattgagctcatgctagacaggggtatccctgtggaactatgggcacactatgtcgaggaacttaacagtacccagcgggtggccgtcgaggatagtgtcttcctggtcttttccctgaagaagtttatctatgcactgaaggcacctaaaagtttccccaagggcgatatctggtggaaccctgagcagctgaaagaagatagtcgcgattacctgcatctgctcatcgggctgtttgaaatgatgcttaatggcgccgacgcagtgcactttagagtgctgatgaagctgttcatcaaggtgcacctggaggatgtctttcagttgttcaagttctgctcagttctgtggacatatgggagctccttgtccaatcctctaaattgcagtgtaaaaacggtgttacaaacccaggccctgtatgtgggttgcgctatgttatcgagccaaaagacccagtgcaaacaccagctggcgtcgatcagctctccagtggtcacgagtctgctcatcaaccttggctctcccgtgaaggaggtgcgccgtgccgctatacaatgcctacaagcactgtcaggcgttgctagtccattttatctgatcattgaccacttgatatccaaggccgaggaaattacctccgatgccgcgtacgtgatccaggacctggcgactctgttcgaggaattgcagcgtgaaaagaagcttaaatctcatcagaagttatctgaaactcttaaaaatctgttgtcctgcgtctacagttgtccctcatatattgcgaaagatttgatgaaagtcctccagggagtgaacggagaaattaccaaacctttttttgccgccatttctgacgagaaggtccagcagaaactgttgcgcatgctttttgatcttctcgtaaattgcaagaatagccattgcgctcagacggtgtcgtccgtcttcaaggggattagtgtgaacgctgaacaggtgcgcattgagttagagccccctgacaaggctaagcctctggggacagtacagcaaaaacggaggcaaaaaatgcagcagaaaaagtcccaagatctggaaagtgtccaggaggtaggcggatcatattggcagcgagtgaccctgatactcgagctactgcaacataaaaagaagctccgaagccctcaaattctcgtccctacactgttcaacctgctgtcgagatgtttggaacctttaccccaggagcagggcaacatggagtacactaagcagcttattcttagctgtctcctcaacatatgccagaaactcagcccagatgggggaaagatccccaaagacattctcgacgaagagaaatttaatgtggagttgattgtccagtgcatcaggctgagcgaaatgccacagacacatcaccacgccctcctgctgcttggtacggtggctgggatttttccagataaggttttgcacaatatcatgtccattttcacattcatgggcgcaaatgtgatgcgtctcgacgacacatattcattccaggtaatcaataaaactgttaagatggtcatcccagcactgatacagtcagattccggggactctatcgaggtgagccgcaacgtggaagagattgtggtcaagatcatttccgtctttgtcgatgctctccctcacgtgccagaacacagacgccttcctattctggtccagttagtcgacacactgggcgccgagaagtttctgtggatcttactgatcttgctgttcgaacagtacgtgaccaaaaccgttctggccgctgcttacggggagaaggatgcaattttggaagccgatactgagttctggttcagtgtctgctgcgagttttcagtgcagcatcagatccaaagtctgatgaatattcttcaatatctgctcaaactcccagaggagaaagaagaaaccataccaaaggccgtttccttcaacaaatctgaaagtcaggaagagatgctgcaggtgttcaacgtggaaacccacacaagcaaacaactgaggcacttcaagttcctttcagtgagtttcatgagtcagctgctctcgtccaataattttttgaaaaaggtggtagaatctggcggcccggaaattctcaaggggctcgaagagaggctgctggaaacagtacttggatacatctctgcggtcgcacaatcaatggagaggaacgcagacaaactgactgtcaagttttggcgcgccctgctcagcaaggcttatgatctgctggacaaagtgaacgccctcctaccgacagaaacctttataccggttatcaggggactagtcggaaaccctttgccctccgttcggcgcaaggccctggatctattgaataataaactgcaacagaatatttcttggaagaagactattgtgactcgatttctgaaacttgtgcctgacctcttagctatcgtccagcggaagaaaaaggaaggagaggaagagcaggctattaacagacaaactgccctgtatacgctcaagctgctctgtaagaacttcggagcagagaatcctgacccattcgtgccagttctcaatacagccgttaagctcattgcgcccgagcgcaaggaagagaaaaatgttctagggtctgcgctgctatgcattgctgaagtgacatcaaccctcgaagctttagccatcccgcagctgccctctctgatgccctcactactcactaccatgaagaatacttctgagctcgtgtcctcggaggtgtacctgctgagcgccctggctgctctgcagaaggttgttgaaactcttccgcacttcatctccccatatcttgagggcatactgagtcaggtgattcatctcgaaaaaatcaccagcgaaatggggtcagcttctcaggcgaatatcagactcacaagcctcaaaaaaacccttgctactacactggctccacgcgtgttgcttcccgcaatcaagaaaacctataaacaaatcgagaagaactggaagaatcacatgggcccatttatgtcaatcctgcaggaacatataggagttatgaaaaaagaggaactgaccagtcaccagtctcagctgacagcctttttcctggaagcgctggactttagggcccagcattccgagaatgatctggaggaagtcggcaagacagagaactgtatcattgactgtttagtcgccatggtcgtcaagttaagcgaggtgactttccgcccgctctttttcaagctgttcgattgggccaagactgaagacgccccaaaggacaggctacttaccttctacaatctcgccgattgcattgccgagaagctcaagggtctgtttaccctgtttgcaggccacttggtgaaaccctttgcagataccttaaatcaggtgaacatatccaagaccgatgaggcgtttttcgactccgagaacgatcctgagaaatgttgtttgctgctccagttcatcctgaattgcctgtacaagatctttttgttcgatacgcaacactttatctcaaaggaaagagcagaagcccttatgatgcctcttgtagaccaactcgagaacagactcggaggagaggaaaaattccaggagcgagtgactaaacaccttattccatgtattgcccaatttagcgtcgcaatggcagatgattccttgtggaaaccactcaattatcagattctcctcaaaacacgggactccagtcccaaagtgcgctttgccgctttgatcactgtgttagccctggcagagaagctgaaggagaattacatagttctgctacccgaatccattccctttttggccgagctgatggaagatgagtgcgaggaggtggagcatcagtgtcagaaaacaatccagcaactggaaacggttctgggagagcctctgcagtcctacttctag

SEQ ID NO: 11954 - DNA, 6435 bp, Artificial Sequence
  Description of Artificial Sequence: Synthetic coding sequence
atgacaagcctggcacaacaactccagcggcttgctctacctcagtcggatgcatctctgctttcgagagacgaggtggccagtctactattcgaccccaaggaagccgcaaccatcgatagggacaccgccttcgctattggatgtacaggactggaggaactgttaggcatcgacccttccttcgaacaattcgaggccccactgttttcgcagctggcaaagacactggaaagatccgtccagacgaaggccgtgaataaacagttagacgaaaatatttcgctctttctaatccatctttccccgtattttctcctgaagccggcccagaagtgcctggaatggcttatccatcggttccacatacacctgtataaccaagacagtttgattgcgtgtgtgcttccataccacgagacacggatcttcgtccgggttatccagcttcttaaaattaataactcaaaacaccgctggttttggctgctccccgtcaagcagagtggcgtacccctggccaaaggcacattgatcacgcattgctacaaagacctgggcttcatggactttatctgctctctggtcacgaagtctgtcaaggtgtttgccgagtacccaggaagctcagcccagttacgcgtgttgcttgctttttatgcgtctaccattgtgtccgccctggttgcagccgaggatgtctctgacaacataatcgccaaactgttcccctacatccagaaggggctgaagagttctctgcccgactaccgggcggccacttatatgattatctgccaaatcagtgtgaaggtgaccatggagaataccttcgtcaactctcttgcgtcccaaataataaaaacattgaccaagattcccagccttattaaggacggcctcagttgccttatcgtgctgctccagcggcagaagccggagtctctggggaagaaaccctttccacatctatgcaatgttccagatctcatcaccattctccacgggatcagcgagacatatgacgtgtcccccctgctgcattacatgctgccgcaccttgtggtgtcgattattcaccacgtaacaggggaagaaacggaaggaatggatggccagatttacaagaggcatcttgaagcgatcctcacaaaaatttctctgaaaaacaatctggaccatctgctcgcgtccctactctttgaggaatatatatcgtattccagccaggaggagatggattctaataaggtatcgttactcaatgagcaattcctgcctctcattagactcctggaatcaaagtacccccgcaccttggatgtggtgctcgaggaacacttgaaagaaatcgccgatctcaaaaaacaggaactgtttcaccagttcgtaagcctctcaacaagcgggggtaagtatcagtttttagcagactccgatacatctttgatgctgtcactaaatcaccccctcgcccccgtgcgaattttagccatgaaccacctgaagaagatcatgaagacttccaaggaaggagtggacgagagcttcataaaggaagcagtgctggctcgtctgggcgatgataatattgatgtggttctttcagccatatctgcttttgaaatcttcaaggaacatttcagtagcgaagtaacaatctctaacctgctgaacctcttccaaagggcagagctgagcaagaacggcgaatggtatgaggtcctgaaaatcgctgccgatatactcattaaagaggaaattctctcggaaaacgatcagttaagtaaccaagtggttgtgtgtctgctgcccttcatggtcataaataacgatgacacagagtcagctgagatgaaaatcgccatttatcttagtaaatcagggatttgtagtctccaccctctgctgagggggtgggaagaagccctggaaaatgtgattaaaagtacaaagccgggcaagcttatcggtgtggccaaccaaaaaatgattgaactattggctgacaacatcaacttgggggaccctagttcaatgcttaaaatggtcgaggacctcatctccgtgggcgaggaggaaagtttcaatttgaagcagaaggtaacttttcatgtgattctgtccgttctggtgtcctgctgctctagtctaaaagagacccatttcccatttgctattagggtattttcactgttgcagaaaaagattaaaaagctggaaagcgtcatcaccgctgtagagattcctagtgagtggcatatcgaattgatgctggacagggggattccagtggagctctgggcccattacgtggaagaactcaacagcacacagagggtagccgtggaggattcagtctttttggtgttctcgttgaagaagtttatctatgcactcaaagcccctaagtcctttcccaagggggacatctggtggaaccccgaacagctcaaggaggacagccgagactacctgcacttactgataggactcttcgagatgatgctgaacggggctgacgccgtccactttagagtgctgatgaaactgttcattaaagtccatttagaagacgtatttcagctgttcaagttctgttcagtgctctggacttacggatccagtctgagcaaccctctgaactgctcggtcaaaactgtgcttcaaacacaggccctttacgttgggtgcgcaatgctttctagtcagaagacccagtgtaagcaccagctcgcctcgatcagcagccctgtggtcaccagcctgctgatcaacctaggctcacctgtcaaggaggtgagaagggcagcaatccaatgcctgcaggccctgtccggggtcgcctcgcccttctacctcatcatagaccacttgatcagcaaggccgaggagataacttcagacgccgcatacgtcattcaggatcttgctacccttttcgaagaactgcagagagagaaaaaattgaagagccatcagaaactgtctgagaccctgaagaacttgctgagctgtgtgtactcctgccccagctatatagccaaggacctgatgaaggtcctgcagggagtcaatggcgagatggttctatctcagctgctacctatggccgaacaactgctagaaaagattcagaaggagcctaccgcggtgcttaaggacgaggctatggtgctgcacctgacgcttggcaaatacaatgaattctccgtcagcctgctgaatgaagatccaaagagtctggacattttcataaaagcagtgcataccacaaaggagctctatgcaggcatgccaacgattcagatcaccgccttggaaaaaatcaccaagcctttctttgcggccatttcagatgaaaaagtgcagcaaaagcttctgcgaatgctgtttgatttactagttaactgtaagaatagccactgtgcccaaaccgtgagctccgtttttaagggtattagtgttaatgccgagcaagtacgcattgaactcgagccaccagataaggcgaaacccctgggtactgtccagcagaaaaggcgtcagaaaatgcaacagaaaaagtctcaggacctggagagcgtccaagaagtgggcggctcatattggcagcgggttacactgatattggagctgttgcagcacaaaaagaaactgagaagcccccaaattctcgtccctacactttttaatctcctatcccgctgcctggagcccctgccccaggagcaggggaacatggagtatacaaagcagctgatattgtcctgcctccttaatatatgtcagaaactttctcccgatgggggcaagatccccaaggacatcctagacgaagaaaaattcaatgtggagctaatagtgcagtgcatccgactgtctgagatgcctcaaacccatcatcacgcacttttgctgctcgggaccgtggccggcattttccccgataaagtgctgcacaatattatgtccatttttacattcatgggcgctaacgtcatgaggctagacgacacctactcctttcaggtgatcaacaagacagtgaagatggtgattccagccctcatccagtctgacagtggtgactccattgaagtcagccgaaacgttgaagaaatcgtggtgaagatcatatcagtcttcgttgatgcattgcctcacgtgccagaacatagacggctacctatccttgtgcagctcgtggacaccctcggcgcggaaaagtttctatggatcctcctaattctcctgtttgaacaatatgttacaaagaccgtgctggccgccgcttacggcgagaaggacgcaatattggaagcagacaccgagttttggtttagcgtctgctgtgaattctccgttcagcaccagatccagtcgctaatgaacatcctgcagtaccttctaaagctcccagaggagaaggaggagaccattcctaaggctgtgagttttaacaaaagcgagtctcaagaagaaatgttgcaggtgttcaatgtggaaactcacacgtctaaacagctccgtcacttcaaattcctctcggtttcatttatgagtcaactattgtctagtaataactttctgaagaaagtggttgagtccgggggtccagagatcttgaaaggactggaagaacggctactcgagaccgtactgggctacatctctgccgtcgcgcagtcgatggaacgcaacgccgataaactcacagtgaagttttggcgcgcacttttatctaaggcgtacgatctcctggataaagtgaatgctctgctgcccacagaaacctttatccctgtgatccgtgggctggtaggcaacccattgccttccgtaaggagaaaggcgttggatctgctgaataacaaactgcagcagaatatcagttggaagaaaactattgtcactcgcttccttaaactcgtgccagacctgctggcaatcgtgcagagaaagaagaaagagggcgaggaggaacaggccatcaatcgtcagaccgctctgtacacgctcaagctcctgtgcaaaaacttcggagccgaaaatcctgatcccttcgttccggtattaaatacggccgtgaaactcatcgcacctgagcgaaaagaggagaaaaacgtgttgggttctgccttactgtgcatcgcggaggtgacctcaacgttggaggcactcgctatcccacagctgccaagtttaatgccttcactgttgacaacaatgaaaaacacatccgaactggtctcctctgaagtgtacctgctaagcgcgttagcagctctgcagaaggtggtcgaaacccttccgcacttcatctccccctatttggaggggattctcagccaagttattcatttagaaaaaattacttccgaaatggggtcagcctcacaggcgaatatcagattgaccagcctgaagaagacgttggctacaacgctcgccccaagagtcttgttacctgccattaagaaaacttacaagcaaattgagaagaactggaaaaaccatatggggccattcatgtctatcctccaggagcacatcggtgtcatgaagaaagaggagctcactagccatcagagccagctgacagcattctttctggaagcccttgattttcgggctcagcacagcgaaaacgatctcgaggaggttgggaaaactgaaaattgtatcatcgactgtttggtcgctatggtggtgaaactgtctgaggtgacttttcggccattgttcttcaagctgtttgattgggcgaagactgaggacgcccccaaagaccgcctgctcaccttttacaacctggcagattgcatcgccgagaagctgaagggtctcttcaccctttttgctggccatctggtgaagccctttgctgacaccttgaatcaggtgaatatcagtaagacagatgaagcgttcttcgattctgaaaacgacccggaaaagtgttgcctgctactgcaattcattctgaactgcctatataagatcttcctgtttgacacccagcactttattagtaaagagcgcgctgaggccctaatgatgcccttggttgaccaattggagaatagacttggcggggaagagaaattccaggaaagggttactaagcacctaatcccctgtatcgcccaatttagcgtcgccatggctgacgactcactgtggaagcccctgaactatcaaattctgctcaagacgcgggactctagccctaaagttcggttcgctgctctgatcactgtgctggcccttgccgaaaagctgaaggagaactacattgtcctactgccagagtcgatccctttcctggcggagttgatggaggacgaatgcgaagaggtcgagcatcagtgtcaaaagactatacagcaacttgaaaccgtgcttggagagccgttacagagctacttctag

SEQ ID NO: 11955 - DNA, 231 bp, Artificial Sequence
  Description of Artificial Sequence: Synthetic coding sequence
atggcagagaccgatcccaagacagtccaggacctcacctcagtggtgcaaacgctgttacagcagatgcaagacaagtttcagacgatgtccgatcagatcatcggtcggatagatgacatgagctccagaatcgatgacctcgaaaagaacattgccgatttgatgacccaagcgggggtggaagaattggagagtgagaataagattcccgcaactcaaaaaagctag

SEQ ID NO: 11956 - DNA, 1791 bp, Artificial Sequence
  Description of Artificial Sequence: Synthetic coding sequence
atggaggccttgctgtccactcccatcaaccctaataatttcccagcaaagctgtggagattagttaattctccacgctaccgctccatccgatgggatggcagaggcgagggactcttgatcgaccagcccctgttcgaggcagagttgctgagtccacctggcccaggaggcgggggaggcaccgccggggccggcgctgagccagaactctttaagactacctcattcacaagctttatcaggcaactaaatctgtatggctttcgcaaagtcgtcctcggcggtcccggcggcgggaagccagctgggaatgggccactgcaccatttccacaatccgcacttccgtcgggatcaacctcagctgctggtccacctaaagcgcttaacttcggcaaacaaagcaaaattagccgcaggcctggaagtgccctgtcgcccaccaaatcggtttcagcgcctgctgattacctctgcgtccgcagcgactgcccctttgcagcaccagcagcccccccccccagccggcccgagacccgagccgcacggtccggtggcagtcggacaatttcacagaagcttccggcgagattccctcagtccttacagttgtgtgtcaaccccctctcacgaccactcgacttatcctctgaagggcctggatcggactccagtgcctcaccgaatttggcagaatagtttgggcatgcatcctggccaggtggagactagtccaacgtttagcgataaaggggtaccctttcctgtgctgcaaagatttcccaccgaggtcacttatactctccaaccaagcacaacttccgtgcacgtgcagcaaggaccgcagacaatggttagctcttcccagaagtacagtaactacacaccaagtgcccaatattctcaagcatactacccgaccgccgtactgcagtgctgtagcccaacgcatatggatgccctgtcgtcatgcgtgacccccaacgcctcctcctacgcccactgtaattactttcagaacccaagcatgcagagttcttaccccgtcgagtttcttccctctaactggccttgtagtacaacagacgagaatacaaaaacagaggtgaacctcgaagccgtcttccagatcgtggatgagcttcacagctcccctaaacttgagatggtgaaagtggagcctgtggagaaccaatgcccaacctcaccctcgtaccgcggtcaacatatactggcaaatagcaacaacagcaacccttgctcggccagccaagcctcccaattggagcccctgacgcctgtcggatccgacatcatgtcatttgtggtggggacggaacaagctgtggcctgctccctccctcagtctcccgaatacatatatacaattcatacagcacaaccagtagaaaactccaccattcaggagtcagccgccatccagcaggcacatgtcaaattaaaggagcacctgaatcacaacccctctcccagcagtgtcgttttcgttcaggaaggtccacctttctcaactcatcaagtggatgccaatatcaagtgtcagacatcctccagagaaaatatcctgcccagtgagcagatggggttcttgatcagtgagatgggaccggctagcaagccaagcgaggacacaggtctggccacccctgcaagatacagggaacacaggagcaactcacagcaggggaagtcacccgatctgcacctgttagtggatgtggcctgcaagcaggaaaggtttccaaaggaagaggagctgaaggaatag

SEQ ID NO: 11957 - DNA, 1491 bp, Artificial Sequence
  Description of Artificial Sequence: Synthetic coding sequence
ggcggcatcgaaaatggcgtgggtgagctcggctcgggcggtgaggcaccagcccggcgcggcgatggaggcgcggctttacatccacatcagccacaacagctaccccgtcaggcagtggctccaggcgaacagccggctcttcctctccaccccctcggcagaccacggagaggggctgcatacagatccgccgcccttagaggtcgagctgctcagccccccgccggtccacggcccgagccacacgggcctgtggcagttggccagttccacaggagcttccgccgggactctcttagcccttattcctgcgtcagtactcctagccacgatcactccacctatcccctgaaaggcttagatcggacccccgtaccacacaggatttggcaaaattctcttggaatgcaccccggccaggtcgagacctctcccactttttcagataaaggtgtgccgtttcccgtccttcaaagatttccaacagaagtaacatacacactacagcccagcaccactagcgttcacgtacaacagggacctcagacaatggtttcaagctcccagaagtattccaattataccccatcggcacagtactcacaggcctattatcccacagccgtgctgcaatgttgtagccccacacatatggatgctttgagcagctgcgtgacacccaacgcatcatcatatgcccactgtaattactttcaaaatccctctatgcagagcagttaccccgtcgagttccttccgtcaaactggccatgttccaccactgacgaaaatacaaaaaccgaggtgaacctagaggcggtgttccagattgtggacgagttgcactcttcccccaaattggagatggttaaggttgagccagtagaaaaccagtgtccaacctcaccaagctatcggggacagcacattttggccaattcgaataattcaaacccctgttccgctagccaggcgagccagttggagcccctgactccggtggggtcggatattatgagttttgttgtgggcactgaacaagccgttgcctgtagcctcccacagagtccagagtatatttataccatccacacagcccagccagtggagaactcaacaattcaagagtcagccgctatccagcaggcgcacgtgaagctgaaagaacatttgaatcataaccctagcccctctagcgtcgtgtttgttcaggagggtccacctttctctactcaccaagtggatgcaaatatcaaatgccaaacctcaagtcgggaaaacatacttcctagcgagcagatggggtttctgatctccgagatgggccccgccagcaagccctcagaggatacagggttggcaacgccagcacggtatagggagcatcggagcaacagtcaacaaggtaaatctcctgacctacacttgctagttgatgtggcctgtaagcaagagaggttcccgaaggaggaggagctcaaggaatag

SEQ ID NO: 11958 - DNA, 3264 bp, Artificial Sequence
  Description of Artificial Sequence: Synthetic coding sequence
atggccaggtcaagcccgtatttgaggcagctgcagggtccgcttttgcccccgcgggacctggttgaggaagacgatgactacttgaatgatgacgttgaggaagacgaggagtcagtctttattgatgccgaagagctttgctcagggggtgtgaaggcaggctcgctgcctggatgcttaagggtgagcatatgcgatgagaacacacaagaaacatgtaaagtatttgggaggttccctatcacaggggcctggtggcgggtgaaggtacaagttaaaccagttgtgggtagccgaagctaccagtaccaagtgcaaggttttccctcttactttctgcagtccgatatgagcccaccaaatcagaagcacatttgcgcactgttcctgaaagagtgcgaggtatcaagcgacgacgtgaacaagtttctgacatgggtaaaagaggtgagtaactataagaacctgaattttgagaatctgcgggaaaccctgcggaccttccacaaagagacgggacgaaaggatcagaaacagcctactcagaatggccaggaggaactgttcctggataacgaaatgtcccttccccttgagaacaccatccctttccgtaatgtgatgacggccctgcagttccccaagattatggagtttcttcccgtactgctgcccaggcatttcaaatggatcatcggaagtggctccaaggagatgcttaaagagatagaagagatcctaggaacgcacccatggaagctgggcttcagcaaaatcacatatagggagtggaaactcctgcggtgcgaagcaagttggatcgccttctgtcaatgcgagtccctactgcagctgatgaccgatctggagaaaaatgcactaattatgtatagcagactcaagcagatctgcagggaggatggccacacctacgtagaagtgaacgacctgacattgactcttagtaaccatatgtccttccatgctgcctcggaatccttaaagttccttaaggatattggcgtcgtcacgtacgaaaaaagttgcgtgttcccgtatgacttataccatgccgagagagcgatcgcgtttagtatctgcgatctcatgaaaaaacctccatggcacctgtgcgtcgacgttgaaaaagtcttagccagcatacacacgacgaagccggaaaattcttccgacgacgcactgaacgagtccaagccagacgaggtgaggttagagaaccccgtagacgtggttgacactcaagacaacggcgaccatatatggaccaatggcgagaatgagatcaacgcggaaatttccgaggtgcagttggaccaggatcaggtcgaagtgccactggacagagatcaggtcgcggcgctcgagatgatttgttctaaccccgttactgtgatcagtggaaaaggcggttgtgggaagactacaattgtgtcacgactctttaagcacattgagcagctggaagagcgggaggtcaagaaagcttgcgaagacttcgagcaggatcagaatgctagcgaggaatggataacattcacagagcagtcacagctggaagcggataaggccattgaggttcttctgacagcccctacaggcaaggctgctggattgctcaggcagaaaaccgggcttcacgcgtataccttgtgccaagttaactatagcttttattcctggacacagactatgatgacaaccaataagccttggaaattctcttcagtccgcgtgttggtcgtggatgagggtagcctggtcagtgtggggatctttaaatcggtgctgaatctgctgtgtgagcattccaaactgtccaagttgattatattgggcgatattcgtcagctgccaagtatcgagccgggaaacttgcttaaggacctgtttgaaactttgaagtccagaaattgcgctatagaactgaagactaatcacagagcggagtcccagctaattgtcgataacgcaacacggataagcagaagacagttccctaagtttgatgctgagcttaacatcagtgacaatccgactctgccaataagcattcaggataagacattcatttttgtcagactcccagaggaggacgcctcgtcccaaagttctaagactaaccatcatagctgcctgtactccgccgtgaagacgctgctgcaggaaaataatctccagaacgctaagaccagtcagtttatcgcgtttaggaggcaggactgcgatctgataaacgactgctgctgcaagcattatactggccacctgacaaaggaccatcagtccagactggtatttggcattggcgacaagatctgttgtacacgcaacgcttatttatccgatctactacccgagaacatctcagggtctcagcagaataacgacctagacgccagctcagaggacttttctggaacccttccagactttgcgaagaacaaaagggacttcgaaagtaatgtgcgcctgtgtaacggagagatcttcttcattactaatgatgttaccgatgttacattcggcaaaagaagatccttgacaattaacaacatggccggactggaagtgacagtggactttaagaaactcatgaagtattgccggataaagcacgcatgggccagaaccattcacactttccaaggttccgaggaacagacagtggtatatgttgtgggaaaagccggaagacaacattggcagcacgtatatacagccgtaactcgcggacggtgccgagtgtatgttatagcagaagagtctcagctcagaaatgccatcatgaagaattcttttccgcggaagacccgactgaagcattttttgcagtccaagctgtcatcgtccggagcaccccctgcagatttcccctccccaaggaagagctcaggagattcaggtggtcctagcacaccttccgcctcccctctgccagtcgttactgaccacgccatgacgaacgatgtgacctggtcagaggccagctcaccggatgagcgcaccttgacatttgcggagcgctggcagcttagtagccctgatggtgttgataccgatgacgacttgcctaagagccgggctagtaagcggacctgtggtgtcaatgatgatgagtcacctagcaagatcttcatggttggggagagcccacaggtgtcaagtcgcctgcagaacctcaggcttaataacctgatcccccgccagttattcaagcccactgacaatcaggaaacctag

SEQ ID NO: 11959 - DNA, 3264 bp, Artificial Sequence
  Description of Artificial Sequence: Synthetic coding sequence
atggcacgatcatctccatatttacggcagcttcagggcccccttctgcccccacgcgatctggtcgaagaggatgacgattacctcaacgacgatgtagaggaagatgaggaatccgtgttcattgatgcagaagaactgtgctctggaggagtgaaggcaggttcccttccagggtgcctgagggttagcatttgtgatgagaacactcaagaaacttgtaaagtcttcgggagatttccgattactggagcatggtggcgggtaaaagtgcaggtgaagccggttgtcggcagcagaagctatcagtatcaagttcagggttttcctagttatttcctccaatcagacatgtccccgccaaatcagaaacacatttgtgccctgtttcttaaagagtgcgaagtttctagtgatgatgtcaacaagttcctcacatgggtgaaggaagtgagcaattataaaaaccttaactttgagaatctgcgagagaccctaaggacattccacaaagagacaggcagaaaagatcagaaacagcccacccaaaatggacaagaggagctgttcttggacaacgagatgtccctccccctggaaaacactatcccattcaggaacgtgatgacggcactgcagtttcctaagatcatggaattcctgccagttctcttgccacgccattttaaatggattatcgggtccgggtcaaaggaaatgctcaaggaaatcgaggaaattctggggacccatccctggaagcttgggtttagcaagattacttatagggagtggaagctgctaaggtgtgaagcttcctggatagctttttgtcagtgtgagtctctgctgcagttaatgacggacctggagaagaatgcattgatcatgtattctaggctgaagcagatctgccgagaagacggccacacctacgtggaagtgaacgatctgaccctgactctttctaaccacatgtcttttcatgcggctagcgaaagtttaaagttcctgaaagacataggggttgtgacctacgaaaagtcgtgcgtcttcccctacgacctataccacgccgagagggcaattgctttttcaatctgtgatcttatgaaaaaacctccttggcatctgtgcgtcgacgtggaaaaggtgctcgcgagtatccataccactaaacctgaaaatagttctgatgacgccctgaacgagagcaaaccagacgaagtgcgactggagaaccctgtcgatgtggtggatactcaagacaacggggatcatatatggaccaatggtgagaacgagataaacgcagagatttctgaagttcagctagaccaggaccaggtcgaggtgcctttggatcgggaccaggtggcggcgcttgagatgatctgttccaatccagtcacagtgatttccggaaagggcgggtgcggtaagaccacaattgtttctcgcctcttcaaacacatcgaacagctggaagagcgggaagtgaagaaagcctgtgaggatttcgagcaagaccagaacgcatcagaggagtggatcacctttactgagcagagccagctcgaagccgacaaggcgattgaagtgctcctcaccgcccctaccggaaaagctgctggacttctccgccagaaaactggtcttcatgcatacactctgtgtcaggttaactatagtttttattcctggacacagacgatgatgaccactaataaaccctggaagtttagctcagtacgtgtgctggtggttgacgagggcagcctggtatccgtaggcatttttaaaagcgtcctgaatcttctttgcgaacattccaagctgtctaaactgattattttgggagacatacgtcagctgcctagcatcgaaccaggaaatttactgaaggacctgttcgagactctgaaatcacgcaactgcgctattgagctcaagaccaatcaccgtgcagagtcgcagttaattgtggataatgccacaaggatctcccgtaggcagtttcccaagtttgatgccgagcttaatatttcggataatccaacgctgcctatctctattcaagacaagacattcatctttgtaagactcccagaagaagacgcatcaagccagtcatccaaaacaaaccaccactcttgcctgtatagcgctgtgaaaacgcttctgcaggaaaacaacttacagaatgcgaagacgtcacagttcatagcattccgacgacaggactgcgacctcataaacgattgttgctgcaaacactacacagggcacctgacaaaagatcaccagtcacggctggttttcggaatcggggacaaaatatgctgcacaaggaatgcttacttgagcgacctgctacctgagaacataagcggctcacaacagaacaatgacttggacgcatcctcagaggacttctccggaactctccctgatttcgccaagaacaagcgcgactttgagagtaacgtccgcctctgcaatggggagatattctttataaccaacgatgtgacagatgtgaccttcggcaaacggcgcagtcttacaatcaataacatggccggcctagaggtaactgtggacttcaaaaagttaatgaaatattgtcggatcaagcacgcctgggcccggacgatacatactttccaggggagtgaggaacagaccgttgtatacgtggtcggtaaggctggcagacagcactggcagcatgtctacacggcagttaccagaggacgttgtcgtgtctacgtaattgctgaggaaagccaactgaggaacgccatcatgaagaacagttttccccggaaaactcggctgaagcactttctgcagtccaaactgtcctcatccggggctccccccgcagatttcccctcaccgaggaaatcctcaggggattccggaggtccctccaccccgtctgcttcacctctgcctgtcgtgactgaccacgccatgacaaatgatgttacttggtcagaagctagcagcccagatgaacgaaccctcacttttgctgaaagatggcagcttagttcccccgacggtgttgacacagatgacgatctgcccaagagccgcgcgagcaagcgcacatgtggtgtcaacgacgacgagtccccatcaaaaatcttcatggtgggagagtcaccacaggtgagctcaaggttgcagaacctccgcctaaacaatcttattccccgtcagcttttcaagccaaccgacaaccaggagacatag

SEQ ID NO: 11960 - DNA, 3030 bp, Artificial Sequence
  Description of Artificial Sequence: Synthetic coding sequence
atgagctggatgtttaagcgtgaccccgtctggaagtacctccaaaccgtgcaatacggagtgcacgggaacttccctcgcctttcttatccaactttcttcccacgatttgaattccaagacgtgatcccgcccgacgacttcttgacaagcgatgaagaagtggactctgtgcttttcggttcgctccgcgggcatgtggttggcttgcgatactataccggtgtcgtgaataataacgagatggtggctctccaaagagatcccaacaacccatatgacaagaacgccatcaaagtgaacaacgtcaatggtaatcaggtgggccatttgaaaaaggaactggccggtgcactggcctacatcatggataacaaactggcacagattgaaggggtagtgcccttcggggctaacaacgccttcaccatgcctttgcatatgacgttctggggaaaagaagaaaaccgaaaggcagtgagcgatcaactgaagaagcacggctttaaactcggccctgcccccaagaccctgggattcaatcttgagagcggatggggctccggccgagctggaccctcctactctatgcccgtccatgctgccgtgcagatgaccaccgagcaactcaaaaccgaattcgataagttgttcgaggatctaaaagaggacgacaaaacgcacgaaatggaaccggcggaggcaattgaaaccccactcctcccacaccagaagcaagcactggcctggatggtttctagagagaacagtaaggaattgcccccgttctgggaacagcgcaatgacctgtattataatactataaccaacttttcagagaaagaccgcccggagaacgtccacgggggcatacttgccgatgatatgggactggggaaaactttgactgcaatcgctgtgatccttacgaacttccacgatggccggcccctcccaatcgagcgggtgaaaaaaaatctgttgaagaaagagtataacgttaacgacgattccatgaaacttggagggaacaacactagcgagaaagcggacggcctaagcaaagacgcttccagatgtagcgaacagcctagtatatctgatattaaggaaaaatctaaattccgaatgagcgagttaagcagcagccggcccaagaggcggaagacagcggttcagtacatcgagtcctccgacagtgaggagattgagacctccgaacttccccagaaaatgaaaggaaagctcaaaaatgtgcagagtgagactaaggggagagcaaaggctgggagcagcaaagtaattgaggatgtcgctttcgcttgtgccctaacttctagtgtgcctaccacgaagaagaagatgctcaagaagggtgcctgtgctgtggaggggagcaaaaagacagacgtcgaagaacggcctcggaccactctcatcatctgcccacttagcgtgttatccaactggattgaccagttcgggcaacacatcaagagcgacgtccacctcaacttttatgtctactacggccctgatcgaatcagagaacctgccctactctccaaacaagatattgtcctgaccacttataacatccttacccacgactatggcaccaaaggagattcaccattgcacagcattcggtggcttcgagttatacttgacgaagggcatgcaatccggaatccaaacgcccagcagacaaaagcagtgctggatctggaatcagaaagacgctgggtcctgaccggcaccccgatccagaattccctcaaagatctctggtctctcctgtccttcctcaagcttaaacccttcattgaccgcgaatggtggcaccggacaatccagcggccggtgaccatgggtgacgaaggaggacttcggcgcctgcagtccctgatcaagaacattacgcttcgaagaactaaaactagcaagattaagggaaaacctgtgctggagttacccgagcgtaaggtattcattcagcacattacactttctgacgaggagcggaagatctatcagtcagtgaaaaacgagggcagggctactatcgggagatatttcaatgaaggcacagtgcttgcccattacgcagatgttctaggactactgttgcgtctgcgccaaatctgttgccacacctacttgctcaccaatgccgtttcgagcaatggtccgtctggcaacgacacacccgaggaactccgaaagaaactgatacggaaaatgaagctgattctctctagcggatcagatgaggaatgtgccatctgcctggacagtctgacagtgcccgttatcacccattgtgctcatgtgttctgcaagccttgcatctgtcaggtgattcagaatgaacagcctcacgctaaatgtccattgtgcaggaatgacatccacgaagataatctgctagagtgtcctcctgaagaactggcccgcgatagcgaaaaaaagagcgacatggagtggacaagctctagcaaaataaacgctctgatgcatgcattaactgacctgcggaagaaaaaccctaatatcaagagcctggttgtctcccagtttaccaccttcttgagcttgattgaaataccactgaaagcaagcgggttcgtgtttacgaggctggatggttccatggcccagaagaaaagagtcgagagtatacagtgttttcaaaacacagaagccggcagtcctaccatcatgctgctgtccctcaaggcagggggggtgggactaaacctaagtgccgcctcgagggtgtttcttatggatcccgcctggaacccagctgctgaagaccagtgttttgatcggtgccatcggctgggccagaaacaggaggtaattatcaccaaattcatcgtcaaggatagtgtcgaagagaatatgctgaaaatccagaacaaaaaacgtgagctagctgcaggtgccttcgggacaaagaagcctaatgccgacgaaatgaagcaggccaaaattaatgaaatcagaaccctcatcgatttgtag

SEQ ID NO: 11961 - DNA, 3030 bp, Artificial Sequence
  Description of Artificial Sequence: Synthetic coding sequence
atgagctggatgtttaaaagagatccagtctggaaatatttgcagactgtgcaatacggagtgcatgggaactttccccgcctgagttacccaacctttttcccccgtttcgagttccaggatgtgattccgcctgacgattttctgaccagcgacgaagaggtagactccgtgctgtttggctccctgcgcggtcatgtggttggactaagatactatacgggggtcgtgaacaataacgagatggtggcgctccagagagatccgaataacccatacgataaaaatgccattaaggtcaacaatgtcaatggtaaccaagtgggccatttgaagaaagaactggcaggcgccctggcatacatcatggataacaaacttgcacagattgagggagtggtcccattcggagcaaataacgcctttacaatgccgctccacatgacgttttggggtaaagaagaaaaccgcaaggccgtctcagaccagctgaaaaagcatgggtttaagcttggtccggctccgaagaccctaggattcaatctggagagcggttgggggagcggaagggccgggccaagctacagcatgcctgtgcatgctgctgttcagatgacgactgaacagctcaaaactgaatttgataagctgttcgaagacctgaaggaggatgacaagacacacgagatggagccggctgaggcgatcgaaacccccctcctgccccaccagaaacaggcactggcctggatggtgagtcgggagaattcaaaggaactgccccctttctgggagcagcgcaatgatctatattacaataccatcactaactttagcgaaaaggacagaccagaaaacgttcacggggggatcctggcagacgacatggggctgggaaaaacccttaccgccattgccgtcatcctgaccaatttccacgacgggcgcccattgccgatcgaaagagttaaaaaaaacctactcaaaaaggaatataatgtcaacgatgactccatgaaactggggggcaataatacttcagaaaaggctgacggactgtccaaggatgcctcccggtgttcagagcagccctctatcagcgacatcaaggagaaatcaaaattcaggatgtctgagctgtccagtagccgccctaagcgccgcaaaacagctgtgcagtatatagagtcctcggacagcgaagaaatagaaaccagcgagctgcctcagaagatgaagggaaaactgaaaaacgtccagtcagagacaaaaggcagggccaaagctggatcttccaaagttatcgaagacgtcgccttcgcttgtgcacttacgtcctctgtccccacaaccaaaaagaagatgctgaaaaagggagcttgcgctgttgaaggctccaagaaaacggatgttgaggagagaccgcgcaccaccttgattatatgcccactgagcgtgttgagcaactggatcgatcagttcggccagcacataaagtccgacgtccatctgaatttctacgtgtactatggacctgaccgcatcagggagcccgcgctgctgtccaagcaggatattgtgcttacgacctataacattttaactcacgactacgggactaaaggggactctccgctccactctatacgatggttacgggtcattcttgatgagggacacgcaattcggaaccccaatgcacagcagactaaggcagttctggatctcgaaagcgagcgtcgctgggtgctcactgggactcctattcaaaacagcttgaaggatctttggagtctgctgtcattcctgaaattaaagcccttcatcgaccgcgagtggtggcacaggacaatccagaggcctgtgacgatgggagacgagggcgggctgcgaaggctgcaatctctgatcaagaacataacgttaaggcgaactaaaaccagcaaaataaagggaaagcctgtgttggagctgccggagaggaaggtgttcattcaacatatcaccttaagcgacgaggaaaggaaaatttatcaatctgtgaagaacgaaggaagggcaacaataggacgctacttcaatgaaggcactgtcctggcccattacgcagacgtccttggactcctcctgcggctacgccaaatttgttgtcacacgtacctgctgactaacgcggtgagtagcaacggaccaagcggtaatgatacccccgaagagctgagaaagaagttgattcgaaagatgaaactgatcttatcatccggctccgacgaagaatgcgctatctgcttggacagtttaaccgttccagttatcacacattgtgcacacgtcttctgcaaaccatgcatatgtcaggtaatccagaacgagcagccacacgctaagtgccctctatgtcggaatgacatacacgaggacaacctgctggaatgtccgccagaggagttagcaagagactcagaaaagaagtccgacatggagtggaccagttcctctaaaatcaacgctctcatgcacgcactcactgatctcaggaagaaaaatccaaacattaaaagcctcgtggtgagccaattcacaacctttttatctctgatcgagatacctctgaaggcctcaggcttcgtctttactcgactggacggttcaatggctcagaaaaaaagggtcgaaagtattcaatgcttccaaaataccgaggccggaagcccaactattatgttgcttagcctcaaggccgggggtgttggccttaacctgagcgcagcgtcacgcgtttttctaatggacccagcttggaatccagccgcggaggatcaatgttttgatcggtgccatcggctggggcagaagcaagaagttatcattacgaagtttatcgtcaaggacagcgtggaggagaatatgctgaaaattcagaacaagaagagggagctggcagcaggtgccttcggcacaaaaaaacccaacgccgacgagatgaaacaagcgaagataaatgagatccgtacccttatcgatctgtag

SEQ ID NO: 11962 - DNA, 1179 bp, Artificial Sequence
  Description of Artificial Sequence: Synthetic coding sequence
atgtttaaacgcgaccctgtgtggaagtatttgcagaccgtacagtacggagtccacgggaactttccacggctgtcttaccctaccttttttccacgctttgaatttcaggatgtgatccctcccgatgattttctgacctctgatgaggaggtggatagtgtgctgttcggcagcctgagaggtcacgtcgtggggctccgttattacaccggtgtggtgaataacaatgagatggttgcactgcagcgggacccaaataacccctacgacaagaacgccataaaagtgaacaatgtgaatgggaaccaagtgggacatctcaagaaagagctggctggcgcactcgcctacataatggacaataagctcgcccagattgaaggcgtggtgccttttggcgctaacaatgcttttactatgcccctgcacatgactttctggggaaaggaagaaaacaggaaggcggtgagtgaccagctaaaaaagcacggtttcaagcttggaccagccccaaagaccctggggttcaacctagaatctgggtggggctccgggagggccggcccctcgtattcgatgcccgtgcatgccgccgtacaaatgactacggaacagctcaaaaccgaatttgacaaactatttgaggatctgaaagaggacgacaaaacccacgaaatggaacctgccgaagctattgaaacaccacttcttccccaccagaaacaggcattagcatggatggtatccagggagaatagcaaggagctgcccccattctgggagcaacggaatgatctgtattataatacgattacaaactttagcgagaaagatcgaccagagaacgtccacggtggcatcctggccgatgatatggggctggggaagactctcactgctatagccgtgatcctcacaaacttccatgatggtcgtcctctcccaattgagcgagttaaaaagaacctgctcaagaaggagtataacgtgaatgacgactctatgaagttgggagggaataatactagtgagaaagcagatggattaagcaaagacgcttcaagatgcagtgagcagccctcaatctcggatatcaaggaaaaatcaaagtttcgaatgtctgagttaagcagctccaggccgaaaagtcagaaaaaaaagaagaaaagagagtag

SEQ ID NO: 11963 - DNA, 1374 bp, Artificial Sequence
  Description of Artificial Sequence: Synthetic coding sequence
atgtttaagcgggatccagtgtggaaatacttgcagacagttcaatacggggtccatgggaacttccctcggctttcttaccctacgttcttcccgaggtttgagtttcaggatgtgattccgcccgacgattttcttaccagcgacgaagaagtcgatagcgtactgtttgggtcattgcgtggtcacgtggtaggcttacgttattacaccggagtagttaataacaacgagatggtcgcacttcagagggaccccaacaacccttacgacaagaatgcaataaaagtaaacaacgtgaatggcaatcaggtgggtcacctgaagaaggagttggcaggtgcccttgcatatatcatggacaataaactggctcaaatcgagggggtcgtccctttcggagcaaataacgccttcactatgccccttcacatgactttctggggcaaggaagagaaccgcaaagccgttagcgaccaactgaagaaacacgggttcaagctgggcccggcacccaaaaccctcgggttcaacttagaatcgggatggggatctggccgggcaggacctagctacagtatgccagtgcatgccgctgtgcagatgacaactgaacagctgaaaacagagtttgacaagctcttcgaggacctgaaggaagacgataaaacccacgaaatggagcccgccgaggctatagaaacaccacttctcccacaccagaagcaggctctcgcttggatggtcagccgagagaatagtaaggaactgcccccattctgggaacagaggaatgacttatattataatactattacaaacttttcggagaaggaccgacctgaaaatgtccatggcggaatactggccgacgacatggggctgggcaaaaccttaacagcaattgccgtgatactgaccaactttcacgatggtaggccacttccaattgaacgggtcaagaagaacttgctgaaaaaggagtataatgtgaatgacgacagcatgaagctaggcggaaacaatacgtccgaaaaagccgatggcctcagtaaggacgcctcacggtgctcggaacagccttctatatctgacatcaaggaaaaaagcaagtttcgaatgtctgaactgagctcttcacgtccaaagcgaagaaagaccgccgtccagtacattgaaagttctgactccgaggaaattgagacaagtgagctaccacagaagatgaaaggcaaactgaaaaatgttcagtccgagacaaagggcagagcgaaggcaggttctagtaaggtcatcgaggatgtagccttcgcatgtgcactgacgagttcagtacccacgaccaagaagaaaatgttgaagaaggtgaagtag

SEQ ID NO: 11964 - DNA, 3030 bp, Artificial Sequence
  Description of Artificial Sequence: Synthetic coding sequence
atgtcctggatgtttaagcgggatcctgtctggaagtatctacagacagtgcagtacggcgtccacggcaattttcctaggctctcttacccgaccttttttccaaggttcgaatttcaggatgtgatacctccagacgacttcctcaccagcgatgaagaggtggactctgttctgtttggttcgctgcgaggacatgtggtgggtttacgctattatacgggtgtggtgaacaacaatgagatggtagcattgcagcgtgacccaaacaatccttatgataaaaacgccattaaggtgaacaatgtcaacgggaatcaagtgggccatctgaagaaagaactggcaggtgctttggcatatatcatggacaacaagctggcccagatcgagggagtggtccctttcggcgcaaataatgccttcacaatgccactgcatatgaccttttggggaaaggaggagaacaggaaagcggtgtccgatcaactcaaaaagcacggttttaagctcgggcctgctccaaagacccttggatttaacctcgaaagcggctggggcagtgggcgcgcgggcccttcctacagcatgccggtccacgcagcagtccaaatgacaactgaacaactgaaaactgagtttgataaactgttcgaggatcttaaggaagacgacaagactcacgaaatggagcccgcggaagcgatcgagacccctctcttgcctcaccaaaaacaagccctcgcctggatggtttctagagaaaacagtaaggaacttccccccttttgggaacaaagaaatgatctgtattataataccataaccaatttctccgagaaagacagacccgagaacgtccacggcggcattctcgccgacgatatgggactgggaaagaccctcaccgccatcgccgtgatactgactaactttcatgacgggcggccgttgcctattgagagagttaagaaaaatctgttgaagaaagagtataacgttaacgatgattccatgaaacttgggggcaacaacacgagcgagaaagccgatggcctcagcaaggatgcatccaggtgctccgagcagcccagcatcagcgacatcaaggagaaatcaaagttccgcatgtcagagctctcttccagtcgcccaaagagaagaaagacagcggtgcagtacatcgaatcttctgacagcgaggagattgaaacttccgagctgccccagaagatgaagggaaaactgaaaaacgtgcagtccgaaactaagggtcgcgcaaaagctgggagtagcaaggtgattgaagatgtcgccttcgcttgcgctttgaccagtagcgttcccacaaccaagaaaaagatgttaaagaaaggagcttgcgccgttgaaggctccaagaaaactgacgtggaggaacggcccagaacaactctcatcatttgtcctctgagtgtcctttccaactggattgatcagttcggccagcatatcaaaagtgacgttcacctcaatttttacgtgtactatgggcccgacagaatcagagagcctgccttgttgtctaaacaggatattgtccttaccacttacaatatcctcacccacgattatgggactaaaggggactccccactccattctattagatggctccgcgtgattctcgacgaaggtcacgctatccgcaaccctaacgcgcagcagacaaaagccgtgctcgacctggagtccgagaggaggtgggtcttgactgggacccccattcagaattctctaaaagatctgtggagcctccttagtttcctaaaactcaagccttttatcgatcgcgaatggtggcatcgcactatccagagacccgtgaccatgggcgacgaaggcggcttgagaagactgcaatcattaatcaagaatattacgctgcggagaaccaaaacatccaaaatcaagggaaagccagtgctggaacttccagaaagaaaggtctttatacagcatatcaccctgtccgacgaggagcggaagatctatcagtcagtgaaaaacgagggaagagctactatcggacgttattttaatgaaggaaccgttctggctcattatgcagacgtgctgggactgctactgagactcaggcagatctgctgccatacttatttgctgactaacgcggtgtcatccaatggtccctcaggaaatgacaccccggaggaactccggaaaaaactgatcaggaaaatgaagcttatactaagctcagggagcgatgaagagtgcgcaatctgcttagatagcctcacagtgcctgtcatcacacattgcgcccacgtattctgcaagccctgcatctgtcaggtcatacagaacgagcagccgcatgccaaatgtccactttgtagaaatgacattcatgaagataatcttttggaatgccctcctgaagagctggccagggatagtgagaagaaatccgatatggagtggaccagctcgtcgaaaatcaacgccttaatgcacgctttgaccgacttgagaaagaagaaccccaacatcaagtcccttgtggtcagccaattcacgactttcctgtcattgatcgagatccccctcaaggcctccggctttgtgttcaccagattagacggtagcatggctcaaaagaagcgggtcgagtcaatccaatgctttcagaatacagaggccggaagtccgacgatcatgctgctcagcctgaaggctggcggcgttggcttaaacctctctgccgccagccgcgtgttccttatggacccggcctggaaccctgccgccgaagatcaatgttttgatagatgtcacaggttgggccagaagcaggaggtgattatcacgaagttcatcgtcaaggactcggttgaagaaaacatgttaaagatccagaacaaaaaaagggagctcgcagcaggagccttcggaactaagaaacctaacgctgatgaaatgaagcaggctaagattaacgagatccgtaccctgatcgacctttag

SEQ ID NO: 11965 - DNA, 984 bp, Artificial Sequence
  Description of Artificial Sequence: Synthetic coding sequence
atgtctgataagctgaaggaacggaaggtctcaaggctgagccccaacggaacttgcgccttggtcgtcgaggccagcgatagccccactagacacttgggaggaccaatggccggaaaatgtccccacggcactctgtctgtcgaagagagtcgggtgaggacccctgttagccacaaagtcattgagaagcgcaggagggataggatcaatcgttgcctgaatgagctcgggaagacagtgcctatggcactggccaagcagggcgagccgcaggaggcattagcccagatcaggtccagagtccggtccctcgtgctcagttcggcaacggtgcctgaccagcaggccctgggtaggtgcgaagggcccttcctactccttcagtcgtcggggaagttagagaaagctgagatcctggaaatgactgtgcaataccttcgcgcactccattctgccgactttccgcgaggtcgggagaaggctgaactgctggctgagtttgccaactactttcattatggatatcatgagtgtatgaagaatttggtccattatctgacgacggtggagcgtatggagaccaaggataccaaatacgctagaatcttagcgtttctgcaaagtaaggctcggctgggggcagagccagccttcccacctctcggtagtcttccggagcccgacttcagctaccagctgcacccagctggtcccgagtttgccggtcattcacctggagaggcagctgtgtttccccagggcagtggggccgggcccttcccttggccccccggagctgctaggagtcctgctctgccttatctgccctctgccccggtcccgctggcaagccccgcacagcagcattccccgttcctgacgcccgtccaaggccttgatcggcattacctgaatctgattgggcacgcccacccaaacgccctgaacctacacacacctcaacacccgcccgtcttgtag

SEQ ID NO: 11966 - DNA, 726 bp, Artificial Sequence
  Description of Artificial Sequence: Synthetic coding sequence
atgtctgataaactcaaagaacgaaagaggaccccagtttcacataaagtaattgaaaagcggcgccgggacaggattaacagatgcttaaatgaactggggaaaaccgtcccgatggcgctggcgaaacagtcttctggaaagctggagaaggccgaaattctggaaatgaccgttcagtacctgcgggccctgcacagtgccgacttccctcggggcagagaaaaagaattgctggctgagtttgctaattactttcattacggctaccatgagtgcatgaaaaacttggttcattatctcacgaccgtggagcggatggagacgaaggataccaaatacgcccgcatactggctttcttgcagagtaaagctcgactaggcgccgaacctgccttcccgccgcttggctctcttccggaaccagacttctcatatcaactgcacccagctgggcctgagtttgccggacactctcccggagaggcagctgtgtttcctcaaggcagcggagccggcccgtttccatggccacccggggccgcaagaagccctgcactgccatacctgcctagcgcgcccgtccccttggcttcccccgcgcagcagcactccccttttctgacccctgtgcaggggctcgataggcattacttgaaccttatcgggcatgcgcaccccaacgctctgaatcttcacaccccacagcacccacccgtgctgtag

SEQ ID NO: 11967 - DNA, 729 bp, Artificial Sequence
  Description of Artificial Sequence: Synthetic coding sequence
atgtctgataaattaaaagagcggaagcgaaccccagtgtcacacaaagttattgagaagcgtcgacgcgataggattaaccgatgcctgaatgaactcgggaaaacagtgcccatggccctcgctaagcagtcctctgggaagctcgaaaaggcggaaattctggagatgacagtgcagtatcttcgggcactccactctgcagactttccaagaggaagagagaaggccgaactcctggccgagttcgctaactacttccattatgggtaccacgaatgcatgaaaaatctggtgcattacctgacaacagtggagcgaatggagactaaggacaccaaatacgcccggatcctcgcttttcttcagtctaaagcacggcttggcgctgaaccagcttttcccccgcttggctcactccccgagcctgactttagttatcagttacacccagcaggccctgagtttgctggccacagtcccggggaggctgccgtgttccctcagggcagtggcgccggcccttttccctggccacctggcgccgccagatcccctgcactgccctatctgcccagtgcccctgtgcccctcgctagcccggcacaacaacattctccttttcttactccggtgcaaggcctggaccgccattacttgaatctgattggccatgcccatcctaacgcccttaatttgcatacgccccaacatccaccagtcctgtag

SEQ ID NO: 11968 - DNA, 2031 bp, Artificial Sequence
  Description of Artificial Sequence: Synthetic coding sequence
atgccacatgctttcaaaccaggggatctcgtcttcgcaaaaatgaaagggtacccacattggccagctcgcattgacgacattgccgacggggctgttaaaccaccgcccaataaatacccaatattctttttcggcactcacgagactgccttcttaggaccaaaagacctcttcccatacgataaatgcaaggacaagtatggcaagcccaacaaacggaaaggtttcaacgaaggcctctgggagatccagaacaatccacacgcatcgtactccgcaccgcccccagtgtcatcctccgactccgaagcacctgaagcaaacccagctgatggcagcgacgcagatgaggatgacgaagaccggggagtaatggccgttaccgcagtgaccgccactgcagccagcgatcggatggagagcgatagtgattcagacaagagctctgacaactcaggcctgaaacgcaagaccccagctctcaaaatgtctgtctcaaagagagccaggaaagcatcttccgacttggatcaggcgagtgtaagcccctctgaggaagaaaactcagaaagctcctctgaaagtgagaagacaagcgatcaggactttacacctgagaaaaaggccgcggtgcgtgcccctcgccggggacccctgggcggacgcaagaagaaaaaggcgccctccgctagtgactccgatagcaaagctgattccgacggcgctaaacctgagcccgtcgctatggctcgtagcgctagtagctccagcagttcgagcagtagcagcgatagtgatgtttccgtaaaaaagcctcctcgtgggagaaagccagcagaaaaaccattgcccaaacctcggggcaggaagccaaagcccgagcgccccccatcgagctcttctagcgacagcgacagtgatgaggttgacagaatcagcgagtggaagcggagagatgaggccaggcgccgagagcttgaagctcgcagacgaagggagcaggaggaggaactgaggcgccttcgggaacaagagaaagaagagaaggagagaagaagggagagagctgatcggggggaagcagaaaggggctcgggcggcagcagtggcgatgaactgagggaggacgacgagcccgtgaaaaagagagggcgaaaaggacgagggcgggggccaccctcctccagcgactccgagccagaagctgagctggaacgcgaagcaaaaaaatctgcaaaaaaaccccagtcttcttccaccgagcctgcccggaagcccggccagaaggagaagcgggtgcgcccagaggagaaacaacaggcgaaaccagtcaaggtcgagaggacccggaaacgcagcgagggctttagcatggacagaaaagtcgagaagaagaaggaacccagtgttgaggagaagttgcagaagctgcattcggaaataaaattcgccctgaaagtcgatagtcccgatgttaaacgctgtctcaacgctttggaagaactgggtaccttgcaggtgacttcccagattctgcagaaaaacaccgacgttgtcgccaccctgaaaaagatcagaaggtataaggcaaataaagacgtcatggagaaggccgcagaggtgtacacaaggttaaagtctagggttcttggccctaagattgaggccgtgcaaaaagtgaataaggcagggatggaaaaagagaaagcagaggaaaagctggccggggaggaacttgccggggaggagctggccggagaagaggccccacaagaaaaagccgaggataagccatccactgacctgagtgctcccgtgaacggagaggcaacctcccagaaaggcgaaagcgctgaagataaggagcacgaggagggcagagattctgaggagggacccagatgcggatcctcagaagaccttcacgattccgtaagggagggaccggatctcgacaggccagggagcgatcgtcaggaaagagaacgcgcccggggtgattccgaagccctggacgaggagtcgtag

SEQ ID NO: 11969 - DNA, 1524 bp, Artificial Sequence
  Description of Artificial Sequence: Synthetic coding sequence
atgaagggataccctcattggcccgctcgtatcgatgatattgccgacggagcagtcaaaccgccacctaataagtaccccatcttcttctttggcacccacgagacagccttcctcgggccgaaagacttatttccctacgacaaatgtaaagacaagtatggaaagccaaacaagagaaagggtttcaatgaaggtttgtgggagatacaaaacaacccccacgcctcttatagcgctccacctcccgtcagttcctccgattcggaagctcctgaggccaaccccgccgacggaagtgatgcggatgaagatgacgaagaccgtggagtcatggctgtcacagccgtcacagctaccgccgcctctgacagaatggagagcgattcagatagtgacaaatcttctgacaactcaggtttaaaacgtaagaccccggccctaaagatgtcagtttccaaacgggcccggaaggccagttccgacctggatcaggcctcagtttcacccagcgaggaggagaacagcgagtcatcatccgaaagcgagaaaaccagcgatcaggattttactcctgagaaaaaagctgccgtgcgagctccccggcggggaccactgggaggacggaaaaaaaagaaggcgccatcagcatctgacagtgattcaaaggccgattctgacggagccaaacccgaacctgtggctatggcacgcagcgcatccagttcttcctcttctagctctagtagcgactccgatgtgagtgttaagaagccgccaaggggcagaaaaccagcggagaagcccctcccgaaaccaagaggccggaaacccaaacctgagaggcccccctcgagttcttcaagtgatagtgacagcgacgaagtagatcgcatctcagaatggaagcgaagggatgaggcccggcggcgagagctcgaggccaggagacggcgcgagcaggaggaggaactgagaagattgcgcgagcaggagaaggaggaaaaagagaggagacgcgagagagccgaccgaggagaagcagaacggggaagtggtgggtcctcgggggacgaactgcgtgaggatgatgaacccgtgaagaaacgggggcgcaaggggagagggcgggggccgccaagtagctccgacagtgaaccggaagctgagctggagcgggaggctaagaagagtgcaaaaaagcctcagagctcctccactgagcccgcacggaaacccggacagaaagaaaaacgcgtccggcccgaggagaaacagcaggctaaattagaatgtaatggcgtgatttctgcacattgtaatttgcggctgccagggagcagcgactcaccagcttctgctctcccctcatcatgggattaccggcatcctccccctcgcctagctaacttctgctgtttcagcagacatggcgtgagctcctgttggcccgggtggagccgaagcccggaccccgtgatctgtcctccacagcccccgaaggtgcttggccttcaagtctag

SEQ ID NO: 11970 - DNA, 1662 bp, Artificial Sequence
  Description of Artificial Sequence: Synthetic coding sequence
atggccaccgacacatcgcagggagagcttgtccatcctaaggccctcccactgatagtaggggcgcagctgatccacgctgacaagctgggggagaaagtcgaggactccaccatgccaattcggaggaccgtaaattcaacccgggaaacccctccgaaatctaaactggcagagggcgaagaagagaaacccgaaccagatatttcaagtgaagaaagcgtgagtactgtggaagagcaggagaacgaaactccgcccgcaacctcctctgaagctgagcagccgaagggtgaaccagagaatgaggagaaggaggaaaataagtcttccgaggaaactaagaaggacgagaaagaccagtctaaggaaaaggagaaaaaggtgaagaagacaatcccttcttgggctactctctccgcaagccagctggccagggctcagaagcagaccccaatggcaagcagcccgagacctaagatggacgctattctaaccgaggccattaaggcttgcttccagaagagcggggccagtgtggtggctatcaggaagtatattatccacaaatatccatctctggagctggaaagacgcggttacctcctgaagcaggcgttgaaacgcgaactcaatcggggagttataaaacaggtcaagggcaaaggagctagtggaagctttgtggtggtgcagaaatcccggaaaaccccgcaaaaaagcaggaatcgcaagaatcggtcctccgccgtggacccagagcctcaggtcaagctggaagacgtgcttcccctcgccttcacccggctctgcgagcctaaggaggcgtcgtactcactgataagaaaatacgtgagccaatactacccaaaactacgggtcgacatccggccccaactcctgaaaaatgcactgcaaagagctgtggaacgcggccagttagagcagataacgggcaaaggagcatccggcacttttcagcttaagaaaagcggtgagaagccgctgctgggcgggtccctgatggaatatgctattctaagcgcgatagctgctatgaatgaacccaagacttgctctaccacggctctgaagaagtatgttctggaaaaccatcctggaaccaactcaaattatcagatgcatctgctgaagaaaacactgcagaagtgtgagaagaatggctggatggaacagatttccggaaagggcttcagcggcacttttcaactgtgtttcccctattaccctagcccaggggtgcttttccctaagaaagagcctgacgatagtagagatgaggatgaggatgaagatgagtcttccgaagaggacagtgaggacgaggagccaccccctaagcgacggctgcaaaagaagacccctgccaaatcacccgggaaagccgcctccgtgaaacaacggggctctaagcccgcaccaaaggtttcggcggctcagcggggcaaggcgagaccactaccaaagaaggcaccccctaaagctaagacccccgcaaagaaaactcgtccttcctctaccgtgatcaaaaagccctctgggggatcaagtaaaaaacccgctaccagtgctcgaaaggaagttaaattacccggtaaggggaaaagcacaatgaagaaaagcttcagggtgaaaaagtag

SEQ ID NO: 11971 - DNA, 402 bp, Artificial Sequence
  Description of Artificial Sequence: Synthetic coding sequence
atggctactgatacctcccagggggaattggtgcacccgaaggcgctgccgttaatcgtgggagcccagctcattcatgcagataaattgggggagaaggtcgaggattccaccatgcccatcagacgcacggttaactccacacgagagaccccccccaaatcaaagctcgctgagggggaggaagagaagcccgagcccgatatctcctcagaagagagcgtgagcacagtggaggagcaggaaaacgaaacaccacccgccacttctagtgaggcggagcaacccaaaggcgaacctgaaaatgaagagaaggaagaaaataaatctagcgaggagacgaagaaagagagggcagacagcatccatagtaccctgtttatcatcggccaaaactcatag

SEQ ID NO: 11972 - DNA, 1206 bp, Artificial Sequence
  Description of Artificial Sequence: Synthetic coding sequence
atggcttctagcccccggcccaagatggatgctattctcactgaggcaattaaggcgtgcttccagaaatctggtgcctctgtagtggccatccgcaagtacattatacacaagtaccccagcttggagctggagagacgggggtatttgctgaagcaggctcttaagagggaactgaacagaggcgtcattaaacaggtgaagggcaaaggtgccagcgggagcttcgtggttgtgcaaaagagtaggaaaactccacagaaaagtcgcaatcggaagaatagatcctctgctgtagacccggagcctcaggtgaagctcgaggacgtgttgcccctggcctttactagactgtgtgaaccaaaggaggcaagctattcactgatccgaaagtacgtgtcccagtactatccgaagctgcgggtggatatacggccccagctgttaaaaaatgctcttcagcgtgccgtggagcggggacagctagagcaaatcacaggtaaaggcgcctcggggacatttcagttaaaaaagtctggcgagaaaccactccttggcggttccctgatggagtatgctattcttagtgcaatagccgccatgaacgaacctaaaacatgtagcacaactgccctgaaaaaatacgtgctggaaaatcatcccggaactaattccaattaccagatgcacctgcttaaaaaaactctgcagaaatgcgaaaaaaacgggtggatggaacaaatatccggcaaaggtttctctggtacctttcagttatgttttccgtattatccgtcacccggtgttctttttcctaagaaggaacctgacgatagtagagacgaagacgaggatgaggacgagtctagcgaggaagactccgaagacgaagagcccccccccaaacggaggctacaaaagaagaccccagcaaaatctcccgggaaagccgcgtcggtaaaacagcgcggctcgaaacccgcacctaaggtgagtgccgctcagagaggaaaagcccgacctttacctaagaaggctccccccaaggccaagactccagcaaaaaaaactagacccagcagtacagttataaagaagccatcggggggttcatctaagaagccagctaccagcgcccggaaggaagtgaagttgccggggaaaggcaagagcacgatgaagaaatcattccgcgtgaaaaagtag

SEQ ID NO: 11973 - DNA, 1548 bp, Artificial Sequence
  Description of Artificial Sequence: Synthetic coding sequence
atgcctattaggcgcaccgtgaatagcacacgcgaaactcccccaaagagtaagctcgccgaaggagaggaggagaaacccgaaccagacattagcagcgaagagtctgtgtccacagtcgaagaacaggagaacgagacaccacccgctacctcgagcgaggccgagcagcccaagggcgagcccgagaatgaagaaaaggaggaaaacaagtctagcgaagagacgaaaaaagacgagaaggaccagtcaaaggaaaaggaaaagaaagtcaaaaagaccattccgtcttgggccaccttatcagcatctcagttggccagagcccagaagcaaactccgatggcttctagtccacgacccaaaatggatgccatccttaccgaggccataaaagcttgcttccagaagagcggagcatccgttgtggccataaggaaatacataatccacaaataccctagcttggaactggaacgtcggggttatttgctgaagcaggctctgaaaagggaacttaatcgcggggttatcaaacaggtcaaggggaaaggtgccagtgggagttttgtagtggtacagaagagtcgtaagactcctcagaagtccagaaacaggaagaataggagtagcgctgttgaccccgaacctcaagttaagttagaggacgtgctacctctggcctttacccgattgtgtgaacccaaagaggccagttatagcttgattcggaaatatgtctctcagtactatcccaaactgcgagtggacatccggccccagctgcttaagaacgctctccaaagggccgtggagcgtgggcagctagagcaaataaccggcaaaggagcatcaggaacatttcagctcaaaaaatctggggaaaaaccactcctggggggaagcctgatggagtacgctatcctatcagccatcgccgccatgaacgagccaaaaacctgttctactactgccctgaagaagtatgtcttggagaaccatcctggcacaaatagtaattaccagatgcatctgcttaaaaaaaccctgcagaagtgtgagaagaacgggtggatggagcaaatatctgggaagggattttcaggtacttttcagctctgttttccttactaccccagtcctggcgtcctgttccccaaaaaggaacccgacgattccagagacgaagacgaggacgaggatgagtcaagtgaagaggattcagaggacgaggagccccctccgaaacgaaggcttcagaaaaaaacccccgcaaagtctccaggaaaggccgctagtgtgaagcaacggggctccaagccagcgcccaaggtgagtgctgcccagagaggcaaggcgcgccctctacccaagaaggccccccccaaggccaagacacctgccaaaaaaactcgtccctcatccactgtcatcaagaagccctccgggggatcctccaagaaacccgcaacttctgctaggaaggaagtgaagctgcctgggaaaggcaaatccactatgaagaaatccttcagggttaagaaatag

SEQ ID NO: 11974 - DNA, 231 bp, Artificial Sequence
  Description of Artificial Sequence: Synthetic coding sequence
atggcgaccgacacatcacagggcgagctggtacatccaaaggccctgcctctgatcgtgggcgcacaactgattcacgccgacaagttaggagaaaaagtcgaggactcaacgatgcctatcaggcggaccgtaaatagcacgcgcgagaccccaccaaaaagcaaattggcggagggcgaagaagagaagccagaacctgacatttcctcagaggaaagtgtaagctag

SEQ ID NO: 11975 - DNA, 375 bp, Artificial Sequence
  Description of Artificial Sequence: Synthetic coding sequence
atggccaccgataccagtcaaggggagctagtgcatccaaaagccctgcccctgatcgtcggcgcgcagttgatccacgccgacaaattgggagagaaggtggaagattcaacaatgcctataaggcgcacagtgaacagcactagagagacgcctccgaaatccaaactggctgagggcgaggaggagaagccggagccggacatttctagtgaagaaagtgtttcaacagtggaggagcaggagaacgaaacaccaccggctactagctcagaggctgaacagcccaagggtgaaccggaaaatgaggaaaaggaggagaacaagagctctgaggaaacgaaaaaggacgagaaggaccaaagtaaagaatag

SEQ ID NO: 11976 - DNA, 123 bp, Artificial Sequence
  Description of Artificial Sequence: Synthetic coding sequence
atgcctatccgtcgaaccgtcaatagcacccgcgaaactcctccaaaatctaagctggccgaaggagaggaggagaaacctgagcctgacatttctagcgaagagagcgtgagtaccgtgtag

SEQ ID NO: 11977 - DNA, 762 bp, Artificial Sequence
  Description of Artificial Sequence: Synthetic coding sequence
aaaaaagacgagaaagaccagtccaaggaaaaggagaagaaggttaagaaaactattccgagttgggcaactctgtctgccagccagctggccagggcccagaaacaaacgcccatggcttcttccccacgccctaaaatggacgcgatcctgaccgaagctatcaaggcctgcttccaaaagtctggtgcgtcagtggtcgccatacgcaagtatatcatacacaagtacccttcgctggagctggagcgacggggatacctcctgaaacaggcccttaagcgggaactcaaccggggggtgattaaacagaaccgctcctctgcagttgacccagaaccacaggtcaagctagaggatgtgctgcccctggcttttactaggctttgcgagcccaaggaagcctcctactcactgattagaaagtacgtgtctcaatactaccctaagctgagagtggatatccgcccacagctgctcaagaacgcgctgcaacgtgccgtcgagcggggtcagctggagcagatcaccggaaagggggccagcggaacctttcagctgaaaaaaagcggcgagaagccccttctggggggcagcctgatggagtacgccatactgtctgccattgcagccatgaacgagcccaagacatgctccaccactgccctgaaaaaatacgtgctcgaaaatcacccgggcacgaatagtaattatcagatgcacttgctgaagaaaacgttgcagaaatgcgaaaaaaattag

SEQ ID NO: 11978 - DNA, 837 bp, Artificial Sequence
  Description of Artificial Sequence: Synthetic coding sequence
atgcccataagacgcaccgtgaacagcacaagagagactccccccaaatcgaagctcgctgagggagaggaggagaagcctgagcctgatatttccagcgaggaaagtgtttctaccgtcgaagaacaggagaacgaaaccccccccgcaacctctagtgaggccgaacagccaaaaggggagccggagaacgaggagaaggaggagaataaaagctcagaagagactaaaaaagatgaaaaggatcagtctaaggaaaaagagaagaaagtaaagaagaccataccatcctgggctaccttgagcgctagtcagttagcaagggcccagaagcagaccccaatggcatcatctcctaggccaaagatggacgcaattctgacagaagctattaaagcctgctttcagaagagcggggcttcagtggtcgctattcggaaatatattatccataagtatccctcccttgagctcgaaaggcgcgggtatttgctgaagcaggccctcaagcgtgaattgaaccggggggtcatcaaacaggtgaaagggaagggcgcatccggcagttttgttgttgtacagaagagtaggaaaactccacagaaatcgagaaaccggaagaataggagtagcgctgtggatccagaaccacaggttaagctcgaggacgttcttccactcgcatttacgcggttatgcgagccaaaagaagctagttacagcttgattcgcaagtatgttagtcagtattatccaaaactcagagttgatatccggccccaactgctgaaaaacgccctgcagagagcagttgagagagggcaactcgaacaatag

SEQ ID NO: 11979 - DNA, 138 bp, Artificial Sequence
  Description of Artificial Sequence: Synthetic coding sequence
atgccgatccgtagaacggtcaactctacgagggagacgcctcccaaatcaaaactcgctgagggggaagaggaaaagccagaacccgatatcagcagcgaagagtctgtgtctactgtggaggagcaggaaaattag

SEQ ID NO: 11980 - DNA, 984 bp, Artificial Sequence
  Description of Artificial Sequence: Synthetic coding sequence
atggcaaccgataccagccagggtgagctcgtccaccctaaagcactgccattaattgtgggcgctcagctcattcacgcagataagctgggcgaaaaagtggaagacagcactatgcccattaggcgtactgtcaactcaacaagagagactcctcccaaaagcaagcttgcagagggagaggaagagaagcccgaaccagatatttcctccgaagagtccgtcagcaccgtcgaagagcaggaaaacgagacgccgccggccacatcatccgaggccgagcagccgaagggagagccagagaacgaggaaaaggaggaaaataagagcagcgaggagactaagaaggacgagaaggaccaatccaaagagaaggagaaaaaggtgaagaagaccataccaagttgggcaactttgagcgcttctcagctagcacgcgcccagaaacagacaccaatggccagtagtcccaggcccaagatggacgcaatcctaacggaggccattaaggcttgtttccagaagagcggggcctccgtggtggccataagaaagtatatcatacataagtatccttcactcgaattagaaaggcgaggttacctgctcaagcaggcactcaaacgcgaactgaatcggggggtaattaaacaagtcaagggcaagggcgctagcgggtccttcgtggtcgtgcagaagtctcgcaaaacaccgcagaagtcacggaatcgcaaaaatcgaagttcagccgtggaccccgaaccccaggtaaaacttgaggacgttctgccccttgcttttacacggctgtgcgagcctaaagaggccagctactccctcatccgcaagtacgtgagtcagtactacccgaaactccgggtcgatatccgtcctcagttgctgaaaaacgctttacagcgagccgttgagagggggcagctggaacagattactgggaagggggccagcggcaccttccagtag

SEQ ID NO: 11981 - DNA, 60 bp, Artificial Sequence
  Description of Artificial Sequence: Synthetic coding sequence
atgcctataagaagaactgtgaatagcacacgtgagactccgcccaaaagcaaactgtag

SEQ ID NO: 11982 - DNA, 918 bp, Artificial Sequence
  Description of Artificial Sequence: Synthetic coding sequence
atggaaaattcccagctatgcaagttatttatcggtggtctgaacgtgcagaccagtgagagcggtttgcgcggccacttcgaggccttcggcactcttacggattgcgtggtcgtggttaatcctcagacaaagcggagcagatgttttggtttcgtgacatattctaacgtggaggaggctgatgctgcaatggcagccagccctcacgcggtggacggcaacaccgtcgagctgaagcgtgcagtaagcagggaggactccgcccgacccggcgctcatgccaaagtcaagaagctctttgtgggaggcctcaaaggcgacgtagctgagggtgacctaatagagcattttagccagtttggtaccgtcgagaaggcggagatcattgcggataagcaatcagggaaaaagcgggggtttggctttgtctacttccagaatcatgacgccgccgataaggccgccgtggtaaagttccaccctattcaggggcacagggtggaggtgaaaaaagctgtccctaaagaggacatctactcggggggcggtggcgggggttctagaagcagcagaggtggcagagggggtaggggcagaggcggaggcagagaccaaaacgggttgtccaaaggcgggggaggcggctataatagctatggtggctacggaggtgggggagggggaggttacaatgcatacggaggaggcggtgggggatcctcctatggcggatcagactatggtaacggtttcgggggatttggctcatactctcaacaccagtcaagttacggccctatgaagtcgggtggaggcggcggcggcggcggatcatcctgggggggaaggtcgaattccggaccatacagaggggggtacgggggcggaggaggttatggtggttctagcttctag

SEQ ID NO: 11983 - DNA, 1107 bp, Artificial Sequence
  Description of Artificial Sequence: Synthetic coding sequence
atgggaactcccccaggtctccaaaccgactgtgaggccctgctgagtcggtttcaggaaacggacagtgtccgcttcgaggactttacagaattatggagaaatatgaagtttgggacgatcttctgtggcagaatgcgcaacttagaaaagaatatgttcactaaagaagctctggccctggcctggcgctattttcttccaccatacaccttccagatcagggtgggagccctctatttactgtatggcctctataacacccagctgtgtcaaccaaagcagaaaatccgcgttgcgctcaaagactgggatgaggtcttgaagttccaacaggacttggtgaacgctcagcatttcgacgccgcctacatattcagaaagctgcgacttgacagggcttttcacttcaccgccatgcctaaattactgtcatacagaatgaagaagaaaatccaccgcgctgaggtgacagaagagttcaaggaccctagtgatcgcgtaatgaagctcattacatcagatgtgctagaggagatgctcaatgtgcacgatcattaccaaaatatgaagcacgtcatttccgttgataagtccaagcccgacaaggctctctccctgatcaaagacgacttttttgacaacataaaaaatattgtgctggagcatcagcagtggcataaggacagaaagaatccctcactcaagtccaagaccaatgatggagaagagaaaatggagggaaactctcaggaaaccgagcgctgtgaacgcgccgagagtttggcaaaaattaaatcaaaagccttttccgtagttattcaggcctccaaatcacgccggcacaggcaagtgaaactggactcatccgactctgatagtgccagcggccagggccaggtaaaagctacgcgcaagaaggagaaaaaggaaaggctgaagccagctgggcgtaagatgtcactacgaaataagggaaacgtgcaaaacatccacaaagaagataagccactatcactcagcatgccagtgatcaccgaggaagaggaaaacgagagcctgagcggaaccgagtttactgcgtccaagaaacgtcgtaaacactag

SEQ ID NO: 11984 - DNA, 921 bp, Artificial Sequence
  Description of Artificial Sequence: Synthetic coding sequence
atggccagtaatgtgacaaacaaaacagaccctcgctcaatgaactcacgggtcttcattgggaatctgaatacactcgtcgtgaagaagtcagatgtagaggccatcttctctaagtacgggaagatcgttggttgttcagtgcacaaaggtttcgcctttgtccagtatgtcaatgagaggaacgcaagagccgccgtggccggggaggacgggagaatgatcgctggccaagtcctggacatcaacctagctgccgaaccaaaggtaaatagaggtaaggccggcgttaaacggtctgcagccgaaatgtacggctccgtgacagaacacccatctccctctcctttactgtccagctctttcgacctggactacgatttccagagagactactacgaccgaatgtacagctaccccgcaagggttccacctccgccccccatagcacgagccgtagttccatccaagcggcagcgggtgagcggtaatacatctcgccgagggaagagcgggtttaactccaagagcggccaacgagggtcttctaagagcggtaaactgaagggggatgacctgcaggcaatcaagaaagagctaacccagatcaagcagaaagtggattcactactcgagaaccttgagaagatagaaaaagagcagagcaagcaggcggtggaaatgaagaacgataaatccgaggaggagcaatcctcttcctctgtcaaaaaagacgagactaatgtgaaaatggaatccgaggggggcgccgacgattcggccgaggaaggggaccttctggatgacgacgataacgaggaccgtggagatgaccagctggagttgattaaggacgacgaaaaagaggctgaagagggcgaggatgaccgcgacagtgccaacggggaagatgacagctag

SEQ ID NO: 11985 - DNA, 309 bp, Artificial Sequence
  Description of Artificial Sequence: Synthetic coding sequence
atggcttcaaacgtcaccaacaaaaccgaccctaggtccatgaacagtcgagtcttcataggaaacctcaacaccttagtcgttaagaagagcgacgtagaagccattttttccaagaaggatgagacaaatgtgaagatggagagcgaggggggcgcggacgacagtgccgaagagggcgatctcctggatgacgacgacaatgaggacaggggtgatgatcagttagagctaatcaaggacgacgaaaaggaagccgaagaaggtgaagacgatcgcgatagtgcaaatggagaagacgatagttag

SEQ ID NO: 11986 - DNA, 921 bp, Artificial Sequence
  Description of Artificial Sequence: Synthetic coding sequence
atggcctccaacgtgaccaacaagaccgatccccgctccatgaacagcagagtgtttattgggaatcttaatacccttgtggttaagaagagtgatgtggaagccatcttcagtaagtacggcaaaatagtggggtgttctgtgcataagggcttcgcctttgtccagtacgtgaacgagagaaatgcgcgcgccgcggtggctggcgaggatggacgcatgatcgcgggccaagtactagacattaaccttgctgctgaacccaaggtcaacaggggcaaagctggggtcaaacgaagcgccgccgaaatgtatggaagtgtcacagagcacccgagcccaagcccactgctgagttcgagctttgaccttgactatgatttccaaagagattactacgatagaatgtatagttacccagcccgcgtccccccccccccccctatcgcaagagctgtggtcccgtctaagcggcagcgtgtctctggtaacacctctcgccgtggcaagtccggctttaatagtaagagcggtcagcgcggcagtagcaagtccggcaagctgaagggcgacgatctccaggcgattaagaaagagcttacccagataaagcagaaggtggatagtctgcttgagaatctggagaagatagaaaaggagcagtctaaacaggccgtagagatgaagaacgacaagtccgaagaagagcagtcctcgtcttctgtcaagaaggacgagacaaatgtgaaaatggaaagcgaaggaggcgccgacgacagcgccgaggagggagatttgctggatgatgatgataatgaagaccgcggtgacgaccagctcgagttaatcaaggatgatgagaaggaagctgaagaaggtgaggatgatagggacagtgccaacggtgaggacgatagctag

SEQ ID NO: 11987 - DNA, 882 bp, Artificial Sequence
  Description of Artificial Sequence: Synthetic coding sequence
atggctagtaacgtaacaaataagacggatcctagatctatgaattcaagggtgttcatcgggaacctgaataccttagtggtcaagaagagcgacgtggaggcaatcttttccaagtacgggaaaatcgtgggctgtagcgtgcacaaaggctttgcattcgtccaatacgtgaacgaacggaacgcccgtgccgctgtggcaggtgaagatggtcggatgatcgctgggcaggtactggacataaacttagcggccgaaccaaaagtgaacagagggaaagccggcgtgaagcgatctgctgccgaaatgtatgggtcctcgttcgacctagattacgacttccaacgggactactatgaccgcatgtatagttaccctgctagagtccctccccccccgcccattgccagagccgtggtgcccagcaagagacaacgagttagcggcaacacgtccaggaggggaaagtcaggattcaactccaagtccggccagagaggatcttcaaagagtggcaagttgaagggagacgatctccaagcgatcaaaaaggaactgacccaaatcaagcagaaagtggattccctcctggaaaacctggaaaaaatcgaaaaagagcagtctaagcaggccgtggaaatgaaaaatgacaaatctgaagaggaacagtcttcctcatctgttaaaaaagacgaaacaaacgtgaaaatggagagcgagggcggagctgacgacagcgccgaagagggggatctgttggacgatgacgataatgaggacagaggagacgatcagctggaactaataaaagacgacgaaaaggaggctgaggagggcgaggacgaccgtgactcggcaaatggagaggacgattcctag

SEQ ID NO: 11988 - DNA, 912 bp, Artificial Sequence
  Description of Artificial Sequence: Synthetic coding sequence
atggccagcaatgtgaccaataagacagatccacggagcatgaactccagggtgtttattggcaacttgaatacgctcgtggttaagaaatccgacgtggaagcaatcttctccaagtacggaaagatcgtgggttgcagtgtgcataaggggtttgcgttcgtgcagtacgtgaatgagaggaacgccagggcagccgttgctggagaggacggtcggatgattgccggacaagtgctcgatataaatcttgctgccgaacctaaagtcaaccgaggcaaagcaggagttaagaggtccgcggccgagatgtacggctccgtgaccgagcacccttctcctagccccctcctgtcctcctctttcgacttggactatgatttccaaagagattactatgatcgaatgtactcgtatccagcccgcgtaccacctcctccacctatcgcgcgggctgtggtcccaagcaagcgacaacgggtctccggcaacacgtccaggcgagggaaaagcgggtttaactcaaaaagtggccaacgcggctcatctaagtccggtaagctgaagggggatgatcttcaggcaatcaagaaggagttaacccaaataaagcagaaggtggattctctcctcgaaaatctcgaaaagatcgagaaagagcagtctaagcaggcagtggagatgaaaaacgataaaagtgaagaagaacagtcctcatcttcagtcaagaaagatgagaccaacgttaagatggagtcagagggaggggcagacgactcagcagaggagggcgacctcctcgacgacgatgacaacgaggaccggggagacgaccaactagagctcatcaaagacgatgagaaagaagccgaggaaggggaggacgatagagactcagccaatggcggctag

SEQ ID NO: 11989 - DNA, 882 bp, Artificial Sequence
  Description of Artificial Sequence: Synthetic coding sequence
atggcttccaacgtcacaaataaaacagacccccggtctatgaacagtagggtgtttattggcaacttgaacacactcgtggtgaagaagtctgatgtggaagcgattttcagcaagtacggcaaaattgtgggctgctccgtccataaaggatttgccttcgtgcagtatgtgaacgaaagaaacgctagggcagccgttgccggggaagacggtcggatgatcgccggccaggtgcttgacatcaatctagcggcagagcccaaagttaaccgaggaaaggccggtgttaagagatctgcggccgaaatgtacggatcttcattcgatctggactatgacttccaacgggattattacgaccggatgtacagttatcctgccagagtgcctcctccaccacccatcgcgagggccgtggtgccgtcaaaacgccagagagtcagcggcaacacttccagacgggggaagtccggcttcaactcaaagtctggccaaagagggtctagcaagagcggcaaactcaaaggagatgatctgcaggcaataaaaaaggagctgacccagataaagcaaaaggtggacagtctcctggagaacctcgagaaaattgaaaaagagcagtcgaaacaggcggtggagatgaaaaacgacaaaagtgaggaagaacaatcctcctcatccgtcaagaaagacgaaactaatgtcaaaatggaatccgagggtggcgccgacgacagcgctgaggaaggcgatctgctcgacgacgatgacaatgaggaccgcggagacgatcaactcgaactgataaaggatgacgaaaaggaggctgaggaaggcgaggatgaccgggatagcgctaatggggaagatgactcttag

SEQ ID NO: 11990 - DNA, 444 bp, Artificial Sequence
  Description of Artificial Sequence: Synthetic coding sequence
atggctagcaacgtgacgaataagactgatcccagatccatgaactctagagtgtttatcggaaatctgaacactcttgtggttaaaaagtctgacgtggaggccatcttctccaaatatggtaaaatcgtaggatgtagcgtgcacaaagggtttgcgttcgttcagtacgtaaacgagcgcaatgcacgggcagccgtggcaggcgaagacggaagaatgatcgcaggacaggtgctggatataaacctcgctgctgagccaaaagtcaacaggggtaaagccggcgtgaaacggagcgcagccgaaatgtatggttcagttactgaacatccatctcctagcccgctgctgagcgtgtaccaagaaactcttcacgagggcgccaaggtggccagcattcttcgcgttgactccggcgatctgcccagtcttgaatcttag

SEQ ID NO: 11991 - DNA, 882 bp, Artificial Sequence
  Description of Artificial Sequence: Synthetic coding sequence
atggcctccaacgtgacaaataaaacggatccaagaagcatgaactctagagtgttcattggcaatttgaatacactagtggtcaaaaaaagcgacgtcgaagccatattctcaaagtatgggaaaatcgtggggtgttctgtgcataagggtttcgcctttgtccagtatgttaacgaaagaaacgccagagctgcggtcgctggggaggatggacgaatgattgccggacaagtactcgacataaacttggcagccgaacccaaggtgaatcgaggcaaggccggggtgaagcgttcggcagccgaaatgtatggctcaagtttcgatctggattacgatttccaacgggactactacgataggatgtacagctaccctgctcgcgtgcctcctcctcccccaatcgcccgcgccgtcgttccaagtaagaggcagcgcgtttcgggaaatacttccaggcgaggaaaatcagggttcaactcaaaatccggccaaaggggctccagcaaatctggcaagctcaaaggagacgacctgcaggccattaagaaggagctgacacagattaaacaaaaagtggactctctactggagaatctggagaagatcgagaaggagcaaagcaaacaggccgtggagatgaagaatgacaagagcgaggaggagcaatcgagtagcagcgtgaagaaggatgagactaacgttaagatggaatccgaagggggagcagatgactcagccgaggagggggacctcctcgatgacgacgacaatgaagaccgcggcgacgatcaactggaactgataaaagacgacgaaaaagaggccgaggaaggagaagatgaccgggatagcgctaacggggaggatgattcatag

SEQ ID NO: 11992 - DNA, 789 bp, Artificial Sequence
  Description of Artificial Sequence: Synthetic coding sequence
atggctagcaacgttaccaataagaccgacccacgcagcatgaactcaagggtattcatcgggaacctgaataccctggtcgtgaagaagagcgacgtggaagccatcttcagtaaatatggtaaaatcgtaggctgttctgtacacaagggattcgcctttgtgcagtatgtgaatgagcggaacgctagggcagccgtagcaggagaagatggaaggatgatagcagggcaggtgctggacattaacttagctgcagagcccaaggtgaacaggggtaaggcaggcgtcaagcgcagtgcagccgagatgtacggcagctcctttgacttagactacgacttccagagagattactatgacaggatgtattcctaccctgccagggtaccaccaccaccgcctattgcaagggccgttgttccctccaaaaggcagcgggtgtctggcaatacctcgcgaagaggaaaatccggcttcaacagcaaatccggacagaggggaagcagcaagtctggcaaactaaaaggggacgatctgcaggcgatcaaaaaggagctgacacagataaagcaaaaggtcgattctctcctggagaacctggaaaaaatagagaaggaacaatcaaagcaggccgtagaaatgaaaaatgacaagtcagaagaggagcagagctcctcttccgtgaagaaggatgaaactaacgttaagatggaaagtgagggcggggctgacgattcagcggaggaaggtgacctcttggatgatgacgacaacgaggacagatag

SEQ ID NO: 11993 - DNA, 921 bp, Artificial Sequence
  Description of Artificial Sequence: Synthetic coding sequence
atggccagtaatgtcacgaataaaacggacccaagaagtatgaactcccgcgttttcattgggaatctcaatactctcgtggtcaagaaatcagatgttgaggctatcttctctaaatatggtaagattgtggggtgctctgtacataagggttttgcatttgtccagtatgttaatgaacgcaatgcacgcgccgctgtcgctggagaggatggaaggatgatcgctggacaagtgctggatataaacctggctgcagaacccaaagtgaatcgtgggaaggctggcgttaaacggtctgcagccgaaatgtatggcagcgtcacggagcatccaagtccatctcctcttttgtcttccagttttgatctcgactacgactttcagagagattattatgaccgaatgtactcctatcctgcccgggtaccaccaccccctcctatcgctagagccgttgtcccaagcaagcgtcagcgagtatccggaaatactagccgccggggaaaaagtggctttaactctaagtccggccaacgcggatcttccaaaagcgggaagctcaaaggggatgacttgcaagccattaagaaagagttgacacaaataaaacaaaaagtcgacagcctgctggagaatctcgaaaaaattgagaaagagcagtctaaacaggctgtagagatgaaaaacgataagtctgaagaagaacaaagctctagtagcgtgaagaaagatgaaacgaacgtaaagatggagagcgagggtggcgcagatgattcggccgaagaaggggacttgttggatgacgatgataacgaagataggggcgacgatcagttggagttgatcaaggatgacgagaaggaggctgaagagggagaagatgacagggacagtgcgaatggtgaggatgacagttag

SEQ ID NO: 11994 - DNA, 381 bp, Artificial Sequence
  Description of Artificial Sequence: Synthetic coding sequence
atggcctcaaacgtgacaaataaaactgaccctaggagcatgaactcaagagtctttattgggaatttaaataccctggtggtgaagaaatccgacgtcgaggctatattttctaagtacgggaagattgtcgggtgttcagtgcacaagggatttgcatttgttcagtacgttaatgaacgaaatgccagggccgctgtagccggtgaagacggcagaatgatcgccggacaagtactagacattaatttagcagccgagccaaaggtgaacagaggtaaggccggtgtgaaaagatcagcagcagagatgtacggaagctcgtttgacctcgattatgacttccagcgcgactactacgaccgcatgtattcctactag

SEQ ID NO: 11995 - DNA, 882 bp, Artificial Sequence
  Description of Artificial Sequence: Synthetic coding sequence
atggcctcgaacgtgactaacaaaactgatccacgctcaatgaatagtagggtgttcatcgggaaccttaatacacttgtggtgaaaaaatctgatgtggaggcgatctttagtaagtacggcaaaatagtagggtgtagcgtgcataagggctttgctttcgtccagtacgtgaatgagagaaatgcgcgagcggcggtagcgggtgaggatggccgtatgattgctggacaggtgctggatattaatttagcagccgagccgaaagtaaataggggaaaggctggcgtcaagagatcagctgccgaaatgtacggtagttcctttgacttggactacgacttccagcgcgactattacgacagaatgtactcttatcccgctcgcgtgcctcctcccccgcctatcgctagagctgtagtaccttcaaaaagacagagggtgtccggaaacactagcaggcggggcaagagcggatttaattcaaagagtgggcaaaggggctccagtaaaagtggtaaactgaaaggcgatgacctgcaggctatcaagaaggaactgactcagattaagcaaaaagttgactctttgctcgagaacttagaaaaaatcgagaaggagcagagcaagcaagcagtggaaatgaagaacgataagagtgaagaggagcaaagtagttcatctgtcaaaaaggacgagacaaatgtgaagatggaatccgaaggcggagctgatgacagcgccgaggagggagacttgctcgatgacgacgacaacgaagatcgcggagacgaccagttggaacttatcaaagacgatgaaaaggaggcagaggaaggagaggatgatcgggacagtgccaacggtgaagacgatagctag

SEQ ID NO: 11996 - DNA, 528 bp, Artificial Sequence
  Description of Artificial Sequence: Synthetic coding sequence
atggcgtccaatgtaaccaataagacagaccccagaagtatgaattcacgcgtcttcatagggaatctaaacacgctggttgtgaaaaagtctgatgtggaggctatctttagcaaatacgggaaaattgtgggttgttcagtccacaagggatttgcattcgtccagtatgttaatgaacggaacgccagggctgctgttgcaggggaggatggaagaatgatcgcgggtcaggtcttagatatcaacctggccgctgagcccaaggtgaacagagggaaagcaggggtgaaacgctcagcagcggagatgtacggttctgttaccgagcacccttcccctagtcctctcctcagcagttcctttgatctggactatgatttccagagggactattacgatcggatgtactcatacccagctcgggtcccaccaccaccaccgatcgcccgggcagtggtccccagcaagcgacagcgggtgagtggaaatacatctcggcgtgggaagagcgggttcaattcctag

SEQ ID NO: 11997 - DNA, 354 bp, Artificial Sequence
  Description of Artificial Sequence: Synthetic coding sequence
atggccagcaacgtgactaataagactgacccacgcagcatgaactctcgagtttttataggtaatctcaacactctggtagtgaaaaagtctgatgtggaggccattttctcaaaatacgggaagatcgtcggctgctcggttcataaaggattcgcctttgttcaatatgtgaatgagagaaacgcacgcgccgccgtcgcgggagaggacgggcggatgatcgccggccaggtgctggatatcaacctagccgccgaacccaaagttaataggggcaaagcaggcgtgaagcggagtgccgccgagatgtatgggtcctcttttgacctagactatgattttcagcgttag

SEQ ID NO: 11998 - DNA, 564 bp, Artificial Sequence
  Description of Artificial Sequence: Synthetic coding sequence
atggcatctaatgtcactaataagactgatccaagatccatgaattcgcgggttttcatcggcaacctcaatactctcgtggtgaaaaagagcgatgtggaagctatatttagcaaatacggcaagatcgtagggtgttctgtccacaaaggatttgcatttgttcagtatgtgaacgagagaaacgccagggctgctgtggctggcgaagacgggcgtatgattgctggacaggtgctggacataaatctggctgccgagccaaaggtgaaccgtggcaaggccggggtgaagagaagcgctgcagagatgtatggtagtgtgactgagcatccaagcccaagtcctctgttatccagcagcttcgaccttgattatgacttccaaagagactactatgataggatgtacagctacccggcacgagtgcccccaccgcctcctatcgccagagctgttgtaccctctaaaagacaacgcgtgtctggcaacactagtcggcgaggaaagtcggggttcaacagcaagagcgggcagcgtggtagctctaaatccggaaaatag

SEQ ID NO: 11999 - DNA, 753 bp, Artificial Sequence
  Description of Artificial Sequence: Synthetic coding sequence
atggcatcaaacgtgacaaacaagaccgacccacggtccatgaactcgagagtgttcatcgggaacctgaacaccttggtggtaaaaaagtccgacgtcgaagccatcttctccaaatatgggaaaatcgtgggctgcagcgtgcacaagggttttgctttcgtgcagtatgtgaatgagcggaacgcccgagccgccgtggccggagaagacggcagaatgattgcaggccaagtcctggacatcaacctcgccgctgagcccaaggtcaaccgaggcaaagcaggggtgaagcgcagtgccgccgaaatgtatggctcaagttttgacctggattatgattttcagcgagactattatgaccgaatgtattcatatcccgcacgggtgcctccaccgccgccaattgcccgcgctatcaagaaggaattgacccagatcaagcagaaggttgacagcctgttggagaatctagagaaaatcgagaaagagcagtcaaaacaggctgtggagatgaagaatgacaaatcagaggaggaacagagctctagtagtgttaagaaggatgagacaaacgtcaagatggaaagtgagggtggggcggatgacagcgctgaggagggggacctactcgacgatgatgataacgaagacaggggcgacgaccagctcgaattgatcaaagatgacgagaaggaagctgaggaaggcgaagatgacagggattccgctaacggagaggatgactcctag

SEQ ID NO: 12000 - DNA, 366 bp, Artificial Sequence
  Description of Artificial Sequence: Synthetic coding sequence
atggctagtaacgtcacgaataagaccgacccccggtccatgaattcgcgagttttcatcggaaacctcaacactctggtcgtcaagaagtccgacgtcgaagctatattctctaagtatggaaaaattgtcggatgttctgtacacaagggttttgcatttgtgcagtatgtgaatgaacgcaatgccagagctgctgtcgcaggggaggatgggagaatgattgccggccaagtccttgacattaatctggccgccgagcctaaagttaaccgcggcaaggccggtgtgaaaagaagtgcggccgaaatgtatggatctagctttgatcttgactatgactttcagcgcgactactacgattag

SEQ ID NO: 12001 - DNA, 681 bp, Artificial Sequence
  Description of Artificial Sequence: Synthetic coding sequence
atggcttcaaacgtgaccaacaaaactgatccccgctcaatgaactcccgcgtcttcattggaaatctgaataccctggtcgtcaaaaaaagcgacgtggaggcaatcttttccaattcaagcttcgatttggactacgattttcaacgggattactacgacagaatgtattcgtaccctgccagggtgccacctcctccccctatcgcgcgtgcggtggtcccctccaagcgtcagcgagtatccggaaacacctccaggcgcggcaagagcggcttcaactccaagtccggccagaggggtagttccaagagcggtaaactgaagggtgacgacttacaggctattaaaaaggagctgacccagattaaacagaaggtggacagccttttggaaaacctcgagaaaatagaaaaagagcagtccaagcaggccgtggagatgaagaacgataagtcagaagaggaacagtcttcctcatccgtcaagaaggacgagaccaatgtgaaaatggagtcggaaggcggcgccgacgactcagcagaggagggggatttgttggacgacgatgataatgaggacaggggggacgatcagttagaacttattaaggacgacgaaaaagaggccgaagagggagaagatgatagagactccgccaacggtgaggatgactcctag

SEQ ID NO: 12002 - DNA, 882 bp, Artificial Sequence
  Description of Artificial Sequence: Synthetic coding sequence
atggcaagtaatgtgacgaacaagacagacccccgctctatgaattcccgggtgttcatcggaaacttaaacacccttgtggtgaagaagtccgacgtggaagcgatctttagcaagtacgggaagatcgtgggatgcagcgttcacaaaggattcgctttcgtgcagtacgtgaatgagaggaacgcccgggcggctgtggcgggagaggacgggcgcatgattgctggtcaagtgctggacataaatttggccgctgagcctaaggttaaccgcggcaaagccggtgtaaagcggagcgctgcagagatgtatggcagctccttcgacctggattacgactttcagcgggattactacgacagaatgtattcttacccagcccgcgtaccgccaccaccaccaatagcacgagccgtggttccatctaagcggcaaagagtgagtggaaacacatcgcggagaggcaaaagtggctttaatagcaaatcggggcagaggggttcctctaaaagcggtaaactgaaaggcgacgatctgcaggccataaaaaaagaactgacacaaataaaacagaaggtggatagcttgcttgagaacctggagaaaatagaaaaggagcagagcaagcaggcggtagaaatgaaaaatgacaagtcagaagaggagcagtctagttcctcagtgaagaaggatgagaccaatgttaaaatggaaagtgaagggggtgctgatgattcggcagaagaaggtgatcttctcgacgacgatgacaatgaggatcgcggagacgatcagttggagctcattaaagatgacgagaaagaagctgaggagggcgaggatgatagggacagcgccaatggagaagatgattcttag

SEQ ID NO: 12003 - DNA, 921 bp, Artificial Sequence
  Description of Artificial Sequence: Synthetic coding sequence
atggccagcaacgtgacaaataagaccgatccgcggtccatgaattctcgagtcttcattgggaacctgaataccctcgttgtaaaaaaaagtgacgtcgaggccattttctctaagtatggtaagattgtcggatgtagcgtgcacaaaggattcgctttcgttcagtatgttaatgaacgcaatgcccgagccgctgtagcaggagaagatggccgcatgatcgcaggccaggtactggacatcaatttagcagcagagcccaaagtcaaccgcggaaaagccggtgtgaagaggagcgccgcagaaatgtacggatccgtcactgaacatcctagcccgagccctttgctgagcagcagcttcgatttagattatgacttccaaagagactattacgatcggatgtattcataccctgcccgggtgcccccgcctcccccaatcgctcgagcagtcgtgccctcaaaacgccagcgagtgtcagggaacacctcaagaagggggaagagtggttttaatagcaaaagtggacaacgcggtagcagcaagtccggtaagctgaagggtgatgatctgcaagccattaagaaagaactaacacagatcaagcaaaaggttgatagtctgcttgagaatctggagaaaatcgagaaggaacagtccaaacaggccgtggagatgaaaaatgataagagcgaggaggagcagagctcctcctcagttaagaaagacgagacaaacgtaaaaatggagagcgaaggcggggctgatgacagcgctgaagagggggacttgttggacgacgatgacaatgaagatcgcggggacgatcagctggagctgattaaggatgacgagaaggaggcagaggagggtgaggacgatagggacagcgcaaacggcgaggacgatagctag

SEQ ID NO: 12004 - DNA, 201 bp, Artificial Sequence
  Description of Artificial Sequence: Synthetic coding sequence
atggccagcaacgtgaccaacaaaactgacccgcgatccatgaattcacgcgttttcatcggcaatttaaatactctggtggtgaagaagtcagatgtggaggcgatcttttccaaatatggcaaaatcgtcgggtgtagcgtgcataaaggctttgcctttgtgcaatacgttaacgagagaaacgcccgagcggcctag

SEQ ID NO: 12005 - DNA, 444 bp, Artificial Sequence
  Description of Artificial Sequence: Synthetic coding sequence
atggcctcaaatgtgactaacaagaccgacccccggagcatgaattctcgggttttcattggaaacctcaacactctggtcgtaaagaagtccgacgtggaagccatattttccaaatatggaaaaatagtcggctgttcggtccacaagggtttcgcgtttgtccaatacgtcaacgaaaggaacgccagggctgcagtggctggcgaagacggaagaatgattgccggacaggtcctcgacataaatctggccgccgagcccaaggttaaccggggcaaggctggggtcaaacgttctgcggcagagatgtatggttccgtgacagagcatccctccccatctccactgctcagcgtgtatcaagagactctgcacgagggagcaaaggtggcctccatcctgagagttgacagtggggacctccccagcctcgaatcttag

SEQ ID NO: 12006 - DNA, 165 bp, Artificial Sequence
  Description of Artificial Sequence: Synthetic coding sequence
atggctagcaacgtgacaaataagaccgatccacggtctatgaactctagagtattcataggaaacctgaacacgctagttgttaagaagtccgacgtggaggcgatctttagcaaatacggcaagatagtaggctgtagcgtgcataaaggttttgccttttag

SEQ ID NO: 12007 - DNA, 882 bp, Artificial Sequence
  Description of Artificial Sequence: Synthetic coding sequence
atggctagcaatgtcacaaataagatggatccacactccatgaattcccgggttttcatcggcaacctgaacaccttagtggtcaagaagtccgacgtcgaggccatctttagcaaatacggaaaaattgctggctgttctgtgcacaagggattcgcgttcgtgcagtacgacaaggagaagaacgctagagctgcggtcgcaggtgaggatgggcgtatgatagcaagccaggtggtcgacattaatctagccgccgaacccaaggtcaatcgggggaacgccggcgtcaagagaagcgctgctgaaatgtacggatctagctttgacctagattatggatttcaacgggactattacgacgggatgtactcttttccggcgagggttccacctcctccccccatagcactggccgtcgtgcccagtaaaaggcagcggctgtccgggaataccagtaggcgggggaaaagtggtttcaactcgaagtcaggcaagaggggctcatctaaatcgggaaagctgaagggggacgaccttcaggccattaagcaagagctcacccaaattaagcagaaggtggactcacttctggaaaacctggaaaaaattgagaaagagcaaagcaagcaggaggttgaggttaagaacgcaaagagtgaggaggagcagtcctccagttccatgaaaaaggatgagactcacgtgaagatggagtctgaaggtggagctgaagactctgcagaggaaggcgaccccctcgacgatgacgtgaatgaggaccagggtgacgatcaactggagttgattaaagatgatgaaaaggaagccgaggagggggaagatgacagggactcgacgaatgggcaagacgattcatag

SEQ ID NO: 12008 - DNA, 1041 bp, Artificial Sequence
  Description of Artificial Sequence: Synthetic coding sequence
atggattgggtcatgaaacacaacggacccaacgatgcgtccgacggaacggtgcggctcaggggacttcctttcgggtgcagcaaagaagaaattgtgcaattctttcagggactcgaaatagtcccaaacggaatcactctgacaatggattaccaaggaaggagcaccggcgaggcctttgtccaattcgcatccaaagaaattgctgagaatgcccttggaaaacataaagagaggatcggtcacaggtacattgaaattttccggtcatcacgatccgaaataaagggcttttatgatccacctaggcggctgctggggcagaggcctggcccctatgacaggccaattggcggtagaggcgggtattacggagcagggaggggttcaatgtatgaccgcatgaggagaggaggagacggctatgacgggggatacgggggctttgacgactacgggggctataataattatggctacggcaacgacggatttgacgatcgaatgagggatggaaggggtatgggcggacacggctatggcggggctggcgatgcttcttccgggtttcacgggggccacttcgtgcatatgcgaggcttacctttccgcgccaccgaaaatgacatcgccaattttttctcacctctcaaccctattcgagtacatatcgacataggcgctgacggacgggccactggagaggctgacgtcgagtttgtgacacatgaagacgcggtggccgccatgagcaaggacaagaacaacatgcagcacaggtacatcgaactttttcttaattctactcccgggggcggatccgggatggggggaagtgggatgggtggatacggcagagatggtatggataaccaaggcggttacggatcagtgggccgcatgggaatgggcaacaattatagcggaggctatggcacccctgatggactcggagggtacgggcgcgggggcggcggaagcggcggctactacggccagggaggaatgtccgggggcgggtggagaggtatgtactag

SEQ ID NO: 12009 - DNA, 996 bp, Artificial Sequence
  Description of Artificial Sequence: Synthetic coding sequence
atggattgggttatgaagcacaacggacctaatgacgcctctgacgggacagtgagacttcgcggactcccgttcggctgttctaaagaggagattgtgcagtttttccaggggctggagatcgttcctaatggcatcacactcaccatggattaccagggtaggtctacaggcgaggctttcgtgcagtttgcatccaaggaaatcgctgaaaacgccctgggcaaacataaggagcgcatcgggcacaggtacatcgagatcttccggtccagtagatccgagattaagggattttatgaccccccaagaaggttgctggggcagcgtcccgggccttatgatcggccaatcgggggccggggtggatattatggagctggaaggggctcatacggcggcttcgacgactacggagggtacaataattatggatatggcaacgatggcttcgatgacaggatgagagatggcagaggtatgggaggccacggctatgggggcgctggcgacgcatcctcagggttccacggaggacactttgtgcatatgagaggtcttcctttcagggccactgagaacgatatcgccaattttttttcaccattgaaccctatcagagtgcatattgacatcggcgccgatgggcgcgccaccggcgaagcggatgttgaattcgtaacacacgaggacgccgtggccgctatgtcaaaggataagaataacatgcagcatagatacattgagcttttcttaaatagcacacctgggggtgggagcggtatgggtggtagtggcatggggggctatgggagagatggtatggataaccagggtggctatggatccgttggcagaatgggaatgggtaacaattattctggcgggtacggcacccctgatggtttgggaggttatggacgcggaggtggcgggagtggtggctattacggccagggcggcatgtctggaggcggttggcgtggtatgtattag

SEQ ID NO: 12010 - DNA, 717 bp, Artificial Sequence
  Description of Artificial Sequence: Synthetic coding sequence
atggattgggtgatgaaacataacggccctaatgacgcctctgacggtacagtgcgtctgagagggctgcccttcgggtgctccaaggaagagatcgttcaattctttcagggatacggcggtttcgatgattacggcggatataataactatggctatggtaacgatggattcgacgatcgtatgcgcgatgggagagggatgggcgggcacggatatggaggggccggcgacgcctcctccggattccacggtggacactttgtgcacatgcggggattacccttccgggccacagaaaacgatatagccaatttcttctccccccttaatccaataagggtccacattgacataggagccgatggtagagccacgggcgaagctgacgtggaatttgtgactcatgaagacgcagtggcggcaatgtccaaggataaaaacaacatgcaacatagatacatcgaactcttcctgaacagcactccgggtgggggcagtgggatgggaggctctggaatggggggctatggccgggacggtatggacaatcaaggaggttacggatccgtgggccgcatgggcatgggcaataattactctggcggctacggtactccagacggattgggggggtacggtcgtggtggcggcgggtctggggggtactatggacagggggggatgagtggcggcgggtggagaggcatgtattag

SEQ ID NO: 12011 - DNA, 1392 bp, Artificial Sequence
  Description of Artificial Sequence: Synthetic coding sequence
atggagaccgagcaaccagaggagaccttccctaataccgaaactaacggagagttcgggaaaaggcctgctgaagatatggaggaagaacaagcatttaagcgcagtagaaacacagatgagatggtggagctgaggattctgcttcagtccaagaatgccggagctgtcatcggaaaagggggtaagaacattaaagccttaaggactgattataacgccagcgtgtccgtgcccgacagctctgggcccgagcggatccttagtatctcagcggacatcgagaccattggggaaatactgaagaagataattcctactttggaggaagggcttcagctcccctctcccacggcaaccagccagcttccactcgagagtgatgcagtggaatgcctgaactaccagcattacaaagggtctgatttcgattgtgaactgcggctgttgatccatcagtccctggccgggggcataatcggagtgaagggcgccaagataaaagaactccgcgagaatactcagacgacaattaagttatttcaagagtgttgtccccatagtaccgatagggtagttctgatcggtggcaaacccgatagggtagttgagtgtataaagattatactcgacctgatatctgagtctcccatcaaaggccgcgcccagccttatgatcccaacttttacgacgaaacctatgactatggcggtttcaccatgatgtttgacgacagacgcggacgccccgtgggcttccctatgcggggacgtggcggctttgatcgcatgcctcctggtaggggtggtcgaccaatgccccccagtaggcgcgactatgatgacatgtcacctaggaggggcccacctccgccccccccagggagaggaggacgcgggggctctcgggcccgcaatctgccactgcctcctccccccccacctagggggggcgatctgatggcttacgacaggcgggggcgtcctggagatagatacgatgggatggttgggttttctgcagacgaaacctgggacagcgccattgacacatggtccccttctgagtggcagatggcttacgagccacagggcgggagcggatacgattatagttatgcaggcgggagaggctcgtatggtgatctcggcggcccaattatcactacacaagtcactattcccaaggacctcgccgggtctattatcgggaagggaggacagcgaatcaagcaaattcgtcatgagagcggtgcatcaatcaagatcgatgagcccctggaagggtctgaggaccgaataatcactatcactgggacccaggatcagatacaaaacgcccagtacctgttacagaactcagtgaaacaatattccggcaaattcttctag

SEQ ID NO: 12012 - DNA, 1392 bp, Artificial Sequence
  Description of Artificial Sequence: Synthetic coding sequence
atggaaactgagcaacctgaagagacatttccaaacaccgagactaacggcgagtttggcaaacgaccagcagaagacatggaggaagaacaggcctttaagcggtcacgcaacaccgacgagatggtggagctccggatcctgctgcagagtaagaatgctggagcggtaatcgggaagggtggcaagaatatcaaagctctccggaccgactataacgcgagtgtgtccgtgcccgattcctccgggcctgagcgtattctgtcaatctccgccgacattgaaaccatcggggagatcctgaaaaaaattatccctacccttgaggagggcttgcagctccccagccctacagcgacgtcgcaactccctctggagtccgacgctgttgaatgtttgaactaccagcattataaagggtctgatttcgactgcgaactgcgcctcctgattcaccagtctcttgctgggggaattatcggggtgaagggagccaagattaaggaattaagagagaatacccagaccactattaaacttttccaggaatgctgcccccactctactgatcgagtggtgttaatcgggggcaagcccgatcgagtggtggagtgcatcaaaatcatcttggatctcatttccgaatcccccatcaagggcagagctcaaccttacgacccaaacttttacgacgagacttacgactatggagggtttacaatgatgttcgacgaccgaagaggtcggccagtcggcttccctatgcgaggccgtggcggttttgaccgcatgccacctggtcgcggagggcggcccatgcctccatcccgccgcgactatgacgatatgtccccacgacggggaccacccccacctccccctggaagaggaggacgagggggaagccgtgcccggaacttacctttaccgccccctcctcccccgcgcggcggcgatctgatggcgtacgatcggagaggaagacccggcgaccgttacgatggcatggtcggtttttccgccgatgaaacatgggactccgctatcgacacgtggagtccctccgaatggcagatggcctacgagccccaaggaggtagtggttacgattattcctatgctggaggtcgcggtagctatggggacctcggaggtccaataattactacacaggtgaccattccaaaggatttagcaggcagcatcataggcaagggaggccagcggatcaaacagatcagacacgaatcaggagcgagcatcaagatcgatgagccactggaagggagtgaggacagaatcatcacgataactggcactcaggaccagattcagaatgctcagtatctccttcagaatagtgtaaaacaatatagcggcaagtttttctag

SEQ ID NO: 12013 - DNA, 921 bp, Artificial Sequence
  Description of Artificial Sequence: Synthetic coding sequence
atgcagtataacgccagtgttagtgtgcccgatagctctggcccagaaaggatcctcagtatcagtgctgacatcgaaaccatcggagagatactcaaaaaaattatccctacgctggaggagggcttgcagttgcctagtccgaccgccacttcccagttacccctggaaagtgatgccgtggaatgtcttaactatcagcactacaaagggagcgacttcgattgcgagcttagactgctcatccatcaatcactcgctggaggtatcatcggagtgaaaggtgctaagatcaaggaactgcgcgaaaatacacagacaactattaagttatttcaggagtgctgcccacactccaccgatcgggtagttcttatcgggggaaagcctgaccgggtggtagaatgtatcaagatcatccttgatctgattagtgaatcgccaataaaggggagagcacagccttacgacccaaacttttacgacgaaacatacgattacggcggtttcaccatgatgttcgacgatagaaggggacgccccgtgggcttccccatgaggggacgaggcgggttcgaccgtatgccaccaggtcggggtgggcgacctatgccccctagtcggcgggattacgacgacatgtcccccagacgtggacccccccctccacccccagggcggggaggccggggagggtcaagggcccgtaacttgccactaccacctcccccgcctccccgcgggggggacctgatggcatacgatcgtcggggacgccccggagacagatatgacgggatggtggggttttccgccgatgagacgtgggactcagccattgatacctggtcaccctccgaatggcagatggcctatgagccccaggtagagtaccacagctgttcttgtgtatatcagtag

SEQ ID NO: 12014 - DNA, 1380 bp, Artificial Sequence
  Description of Artificial Sequence: Synthetic coding sequence
atggaaactgagcagccagaggagacgttcccaaacaccgagacaaatggtgaattcggcaaacgtccagccgaggatatggaggaagaacaggccttcaaacgttctagaaatacagatgaaatggtggaactgcggattcttcttcaatcaaaaaacgctggtgccgtcatcggcaaagggggcaaaaatatcaaggccttacgcaccgactattaccttgttttcgttgtctttgatagcattctctcaattagcgctgatatcgaaacgataggcgagattctgaagaaaattattccaacactggaggaggggctgcaacttccatctccaacagccaccagtcagttgccgctggagagtgacgctgtagaatgcttgaattaccagcattataagggaagtgatttcgactgtgagcttaggcttcttattcaccaatctctggcgggaggaatcatcggggtgaaaggcgcgaaaattaaggagttacgagagaacacccaaactacaatcaaactgtttcaggagtgttgtcctcattcaacggatagagtagtcctaatcggtggcaaacccgacagagttgtcgagtgcatcaagatcattctggatttgatttccgagagcccaataaaaggccgtgcacaaccttacgaccccaatttttacgacgagacatatgactatggcggttttaccatgatgttcgatgaccgccgcggaagaccagttggcttccctatgcggggccggggtgggttcgatcgaatgccacccggtaggggtggccgccctatgcccccgagtcggagggactatgatgatatgagcccccggcggggaccaccccccccaccacccgggagaggcggtcggggcggcagtagagctcggaatctgccactgccccctccgccccctccacgcggtggagacctgatggcctatgacagacgcgggcggcccggagaccgatacgacggtatggtgggtttcagcgcagacgaaacctgggacagcgcaatcgacacttggtcaccttctgagtggcagatggcttacgagccacagggaggatcgggctacgattattcctatgcaggtggacgcggaagctatggagatttgggcggacctataatcacgacacaggtgactatacctaaggatttggccggctccatcatcggaaagggcgggcagcggattaaacagatcaggcatgagagcggggcctcaattaaaatcgatgagccactagaaggttctgaagatcgcatcataaccattactggcacccaggaccaaatacagaatgcacagtacttactgcaaaactctgttaagcagtacgccgacgtagaaggcttctag

SEQ ID NO: 12015 - DNA, 1395 bp, Artificial Sequence
  Description of Artificial Sequence: Synthetic coding sequence
atggagacggagcagccagaagagacatttcctaatacggaaacaaatggggaattcggaaaaaggccagccgaggacatggaggaggagcaggcgttcaagagatccaggaatactgatgaaatggtcgagctgagaattttgctgcaaagcaagaacgctggggcggtgatcggtaaaggcggaaaaaatatcaaggcactgagaaccgactacaatgcttccgtgtctgtgcctgatagttctggtccagagaggattctcagcataagtgctgacatcgagaccatcggagagatcctgaaaaaaataattccaactctcgaggaaggattgcagttgccgagccccacggctaccagtcagctgcccctagaatctgatgcagttgagtgtctgaattaccagcactacaagggctccgattttgactgcgaattaagactgttgatccaccaatctcttgccggcggaatcatcggggtgaagggagctaagataaaggagctgagggaaaacactcagacaactattaaactgttccaggagtgctgtccccatagcaccgaccgcgtggttcttataggaggtaaacccgaccgggtcgtcgagtgcatcaagatcatcttagatctgatttctgagtccccgatcaaaggaagagcccaaccctacgacccaaacttttatgatgagacttacgattatgggggcttcacaatgatgttcgatgatcggcgcgggcgcccagtaggattcccaatgcgcggacgtgggggcttcgatcgtatgccaccagggcgcggaggaaggcccatgcccccgagccgtcgggactacgatgatatgtctcctcggcgggggcccccgcctccaccgcctggtcgtggaggaagggggggatctagagcacgcaatctccccttaccaccaccacctcctccccggggcggtgacctcatggcttacgatcgcagaggacgacccggggaccgttacgacggtatggtgggcttcagcgctgacgaaacatgggatagtgcaatagatacctggagcccttcagagtggcagatggcttatgagccgcaggggggctccgggtacgactactcttacgccggtgggcggggctcatatggcgaccttggcggtcctatcatcaccactcaggtcaccattcctaaggatctggccgggagcatcattgggaaggggggccagaggatcaaacagatcagacatgagtctggggcgtcgatcaaaatcgatgagcccctggagggctcagaggaccgcatcattacaatcaccggaacccaagatcagatacagaatgcccagtacctgttacaaaattctgtgaagcagtacgccgatgtggagggcttttag

SEQ ID NO: 12016 - DNA, 1392 bp, Artificial Sequence
  Description of Artificial Sequence: Synthetic coding sequence
atggaaactgagcaacctgaagaaacatttcccaacacagaaaccaacggtgagtttggaaaacggcccgccgaagacatggaagaggaacaggcttttaaacggagtcggaacacagatgagatggtggagctgagaatccttttacagtctaagaatgctggggcggtgatcggtaagggtggtaaaaatattaaggcgctaagaaccgactacaacgccagtgtctctgtgcccgattccagtggccctgaacggatattgtctattagcgctgatatagaaaccataggcgaaatccttaagaagatcattcctacactggaagaaggattgcagctcccttctcccaccgcaactagtcagttgcccctagagtcagacgctgtcgagtgtctcaattatcagcactataaaggtagcgatttcgattgcgagctcaggctgctgatccatcagtccctcgcaggcggcattataggcgttaaaggagctaagattaaagagctgcgtgagaatactcaaacgaccattaaactgtttcaagaatgctgtccacattctacagaccgggtcgtgctgattggcggcaaaccagatagagtggtggagtgcatcaagattatcctggatctgatctccgaaagcccgatcaaagggagggcacagccatacgatcccaacttttacgatgagacttatgactacggaggattcactatgatgtttgatgaccgacgcgggcgacccgtgggatttcccatgcgcgggcgcggagggttcgataggatgcctccaggtcgcggtgggcgacctatgcctccgagcagacgggattacgatgatatgagccctagacgcggaccccccccccccccccctggacgggggggtcggggtggatccagggctagaaacctgccacttcctccacccccgcccccgagaggcggcgatctcatggcctacgaccggaggggccggccaggtgaccggtatgatggcatggtgggcttcagtgctgatgaaacctgggattcagcaatcgacacatggtccccttccgaatggcagatggcttacgagccacaaggaggttcaggctacgactacagctatgccggcggccgaggcagctacggcgaccttggcgggcccatcatcactacacaggtaaccattccaaaggacctagctgggtcaataataggcaaaggcggtcagcgcattaaacagattaggcatgagtccggtgcctccataaagatcgatgagcccctcgaaggcagtgaagaccgcataattacaatcactgggacccaggaccagattcagaacgcacagtatctgctccagaacagcgtgaagcaatatagtgggaaattcttctag

SEQ ID NO: 12017 - DNA, 1395 bp, Artificial Sequence
  Description of Artificial Sequence: Synthetic coding sequence
atggaaaccgagcagcccgaggagacatttccgaacaccgaaacaaacggtgaattcggtaagcgccccgcagaggacatggaggaggagcaggcctttaagcggtccaggaataccgatgagatggttgagctgcgtatattgctgcagagtaagaacgcaggcgcggttatcggcaagggagggaaaaatatcaaagcactgcggactgattacaatgcatcggtgtcggtccccgattccagcgggccagaaaggattctaagcatctctgccgatatcgagacaattggtgaaatactgaagaagattatacctaccttggaagaaggtttgcagctgccgagtcccactgccacttctcagttgccgctggagagtgacgccgtggagtgtctaaattatcaacactacaaaggctctgatttcgattgcgaattgcgactgctgatccatcaaagccttgctggcggaataatcggtgtgaaaggcgcaaaaatcaaggaactgcgagagaatacccagaccacaatcaagctctttcaggagtgttgtcctcatagtacagatagagtcgttctgatcggtgggaagccagaccgagttgtcgagtgcatcaagatcattctggacctaatttcagaatcccctatcaaggggcgagctcaaccctatgatccaaacttctatgatgagacttatgactatgggggttttactatgatgttcgacgatagaagaggaagacctgtcggatttcctatgcgcggccgggggggctttgaccggatgcccccaggaagagggggccggccgatgccaccaagtcgacgtgattatgatgatatgtcccctcgtaggggaccacctcccccacctcccgggagggggggccggggtggaagcagggcaagaaatcttcctctgcctccaccgccaccccctcgggggggggacctgatggcatacgatagaagggggagaccaggtgacagatatgatggaatggttggattctccgccgacgagacgtgggattctgccattgacacctggagtcccagtgagtggcagatggcctacgagccccaaggtgggtccgggtacgattacagctacgcaggcggcagagggtcctatggagatctgggcgggcccataatcaccacgcaggtgaccatcccaaaggatctggctggctcaatcattggtaagggcggacaacggatcaagcaaatccgccacgagtcgggagcatctatcaagatagacgaacccctggagggatctgaagaccggataattaccatcacaggtactcaggaccagatccagaacgctcagtatctgctgcagaattccgtcaagcagtatgccgatgtggagggcttttag

SEQ ID NO: 12018 - DNA, 1395 bp, Artificial Sequence
  Description of Artificial Sequence: Synthetic coding sequence
atggagaccgaacaaccagaagagacgttcccaaacaccgagaccaatggcgaattcggcaaacggcctgccgaagatatggaagaagaacaggccttcaaacgctccagaaacaccgatgaaatggtggaactaagaattttattgcagagcaaaaatgctggggccgttataggtaagggtggaaaaaacatcaaggcccttagaactgattacaatgccagtgtctcagtaccggattctagcggtccagagagaattctctccatcagtgcggacatcgagaccataggcgagatcctgaagaaaataatccctacccttgaggagggtttacagcttcccagccccaccgcgacctcccaactccctctcgagtcagacgccgtggagtgtttaaattatcaacactacaaggggagcgattttgattgtgagctccggttactgatacaccagagtctggccggtgggattatcggcgtgaagggcgcaaagataaaagaacttcgggagaacactcagacaacaataaagttattccaggagtgctgtccccattcaaccgaccgtgtcgtgctcattggtggcaagccggacagagtggtggaatgtattaagatcatcttggatctcataagcgagagcccgattaaaggcagagcccaaccctatgacccaaatttctatgacgaaacatacgattatggaggttttaccatgatgttcgacgatagaagaggccgacctgtgggcttcccgatgcggggacgggggggattcgatagaatgccgccgggacggggcgggaggcccatgccgccttcccggagggactacgacgatatgtctccacgccgtgggcctcccccacctccacccggccgcggaggtcgaggcggcagtcgtgcaagaaatctgcctctccccccccccccacctcctaggggcggcgacctgatggcatatgatcgccgaggcagacctggcgatcgctacgatggaatggtcggctttagtgcagacgagacgtgggactcggctatcgacacatggagcccctcggagtggcagatggcgtatgaaccccagggcggctcggggtacgactacagctatgctggaggccggggatcttatggcgaccttggcggacccattatcactactcaggtaactattcctaaggaccttgccggctcgattataggaaagggcgggcagcgtatcaaacagattcggcatgaatcaggagcttccattaagattgatgagcccctggaaggctcggaggaccggataataacgattactggtacacaagatcagatccaaaacgcccagtaccttctccagaactctgtcaaacagtatgccgatgtcgagggtttttag

SEQ ID NO: 12019 - DNA, 1287 bp, Artificial Sequence
  Description of Artificial Sequence: Synthetic coding sequence
atggaaacagaacagccggaggaaaccttcccgaatacagagaccaacggcgagtttgggaaaagaccggcagaggacatggaggaagaacaagcatttaaacgtagccgcaacaccgacgaaatggttgaattgcgtatacttctccagagtaaaaacattaaggccctgcgcacagactataatgctagtgtgtccgtgccagactccagtggacccgagcgcattcttagtatttctgcagatattgagacgatcggagaaatacttaagaaaatcataccaacactcgaagaataccagcactacaaagggtctgatttcgactgcgagctgcgcttgctcattcaccagtccctcgctggtgggatcattggggtaaaaggggccaagatcaaagaacttagagagaacactcagacaactatcaaactgttccaggaatgctgtccacactccaccgaccgagtggtattgatcggcggcaagcctgatcgcgtggtggaatgcataaagattatactggacctgatctccgagtcacccattaaagggcgcgcccagccatatgaccccaatttctacgatgagacttacgactatggtggatttaccatgatgtttgacgacagacggggaagaccagtgggtttccctatgagaggccgaggggggttcgaccgcatgcctcctggccgtggcggccgtcctatgcctccctcacgtcgcgactacgatgatatgtcgcccagacgtggccccccaccaccccctccaggtcgggggggacgcggtgggtccagagcacgcaacctgcccctgcccccacccccgccaccacgggggggtgacctcatggcctatgatcggcgcggcaggccgggagaccgttacgacggaatggtgggcttctcggccgacgagacgtgggacagtgccatcgatacctggagtcccagcgaatggcagatggcgtatgaaccccagggtggctccggctacgattatagctatgccggcggacgtgggagttacggcgacctgggcgggcctatcataacaacacaggtgacaatacccaaagatctagccggatctattatcggaaaaggaggccaacggatcaagcaaattcggcacgagagtggcgcttcgattaagatcgatgagcctctggaggggtctgaagataggattatcacaattacaggcacccaggaccaaatccagaatgcacaatatctgctgcaaaattccgtgaaacagtattcaggcaaattcttctag

SEQ ID NO: 12020 - DNA, 1140 bp, Artificial Sequence
  Description of Artificial Sequence: Synthetic coding sequence
atggagaccgagcagcccgaagagacattccccaatacggagaccaatggagagtttggcaagagacctgctgaggacatggaggaagagcaggccttcaagcgaagccggaataccgacgaaatggttgaacttcgaatcctcctacaaagcaagaatgcgggcgcagtcataggtaaaggcggcaagaacattaaggcacttaggacagattataatgcgtctgtttctgttccggattcttctggtcctgaaaggatcctgtcaatttcagctgatatagagacaattggggagattctcaagaagatcattccaaccctggaagagtaccagcattacaagggttctgacttcgattgcgagctaaggctcttgattcatcagtccctggctggcggcattatcggcgtgaagggcgccaaaataaaggaactaagagagaatacacaaaccacgattaaactgttccaggagtgttgccctcactccacagaccgagtggtgttgataggcggtaaaccggacagagtggttgaatgcattaaaataatactggatttaatcagtgagtcacccattaagggtagggcacagccctacgatcctaatttttacgacgagacatacgattacggagggttcacaatgatgttcgatgataggcgggggcgacctgttgggttccccatgcgtggtaggggaggctttgacagaatgccacccgggcgagggggaaggcccatgccgccaagccgccgcgattatgacgatatgtctcctagacggggacctcctcctccacccccaggtcggggcggtagaggagggtcccgagcccgcaacctgcctctcccgcctccgccaccacctcgcggcggcgatctgatggcgtacgaccgccgcggacgccccggggatcgctacgacgggatggtcggcttctcagcagacgagacatgggactcagccattgacacgtggtctccttcagagtggcagatggcttacgaaccacaggggggttctggatatgactattcttacgccggaggccgtggctcttatggagacctgggcgggccaataattaccacccaggtcacgattcctaaggacctggcgggcagcatcatctag

SEQ ID NO: 12021 - DNA, 987 bp, Artificial Sequence
  Description of Artificial Sequence: Synthetic coding sequence
atggctgccggcatcgttgctagccgaaggctgcgtgatctgctgacgcgcagactgaccggttcaaattatccgggtctgtcaatttccctccgcctgaccggaagctcggcgcaggaggaagccagcggagtagcactaggggaggcaccggaccacagctatgagagtctaagggttacatccgcacagaaacacgtgctgcatgtgcagttgaatcggcccaacaaaagaaacgccatgaacaaggtcttctggcgcgagatggtggagtgcttcaataagatctcacgggacgctgactgcagagcagtggtcattagtggtgccggaaagatgtttactgcaggtatcgatctaatggacatggctagcgacatccttcagccaaaaggagatgatgtggcgaggattagctggtacctgagagatatcataacaagataccaggagacattcaacgtgatcgaacgatgcccaaagccggtcatcgctgccgtgcacggtgggtgcattggcggaggggtggatctcgtgactgcatgtgacatccggtactgtgcacaggatgctttttttcaggtcaaggaagtggatgtgggcctggcggctgacgtcggaacacttcaacggctgcccaaggtaatagggaatcaatctctcgtgaatgagctcgcgtttacggcaaggaagatgatggccgatgaggcacttggatcaggcctggtgtcccgcgtgttcccagacaaggaggtcatgctcgatgccgcactggccctggctgcagaaatctcgtcaaaaagtcctgtcgcagtgcagtctactaaagttaatctcttgtactcacgggaccattccgtggcggagtccttgaattacgtggcttcttggaacatgtctatgctccagacccaggatctggtgaagtccgttcaggcaaccactgaaaataaggaactcaagactgtgacctttagcaaactgtag

SEQ ID NO: 12022 - DNA, 1371 bp, Artificial Sequence
  Description of Artificial Sequence: Synthetic coding sequence
atgcccaagaagcgtcaggcactcgtggaatttgaagatgtgctcggcgcttgtaacgcagtgaattacgcagccgacaaccagatatatatcgcaggacatcctgcttttgtaaactattctacctcccagaagatttcgaggccaggcgatagtgacgactctaggagtgtaaatagcgttttattatttacaattctcaaccccatttacagcatcaccacagacgtactgtataccatttgtaacccctgcggcccagttcaacggattgtgattttccgtaaaaacggcgtgcaggctatggtcgagttcgattctgttcaaagtgcgcaacgggccaaggccagtctgaatggcgcagacatctacagtggttgctgcactctcaaaatcgaatatgccaagccaacccggctaaatgtatttaagaacgaccaggacacatgggactacaccaacccaaacctgagcgggcaaggagatccaggaagcaatcccaacaaacgccaacgtcagccccctctgctgggcgaccacccggccgagtacggggggccccacggcgggtatcattcgcactatcacgatgagggctacggcccacctccacctcactacgagggccggagaatggggcctccagtaggaggtcatagaaggggaccctcccggtatgggcctcaatacggacatcctcctcccccaccccccccgcccgaatacgggccccatgcggacagtccagttctcatggtatatggcttagatcagagcaagatgaattgtgaccgggtattcaatgttttttgtctgtacgggaacgtggagaaagtgaaatttatgaagtcaaagcccggggctgcgatggtggaaatggctgacgggtacgctgtggacagagccattactcacttaaacaataacttcatgttcggacagaagctgaatgtctgtgtgtccaaacagcctgccatcatgccggggcaatcatatgggctggaagacggaagttgctcctataaggacttctctgagagtaggaataatagattttccacaccggagcaggccgccaagaaccggatccagcacccctccaatgttctgcacttcttcaatgcaccactggaggtgacagaggagaacttcttcgagatttgtgatgagctgggagtaaaaaggccctcaagtgtcaaggtgttttccggaaaaagcgaacgttccagttcaggcctgttggaatgggaatccaagtcagacgcgctcgagactttgggattcctgaaccactaccaaatgaagaatcctaatggcccctatccttacactctgaagttgtgtttttcaacggcccagcacgcctcctag

SEQ ID NO: 12023 - DNA, 1371 bp, Artificial Sequence
  Description of Artificial Sequence: Synthetic coding sequence
atgcccaagaaacggcaagcattagttgaattcgaggatgtcttgggcgcttgcaacgctgttaattatgccgccgataaccagatctacatcgctggacacccggcttttgtaaactatagtacctcacagaagattagtcggcctggtgactccgacgatagccgctcggttaatagcgtgctactattcacaattctcaatcccatctactcaattactaccgacgtgctgtacactatttgcaatccttgcggacctgtacagcggattgtcatctttcgcaagaacggagtgcaggctatggtcgagtttgatagcgtccagtctgcccagcgggccaaggcatctctgaatggggccgacatctatagcggctgctgcacgctgaagatcgagtatgcaaagccaacgcgccttaacgtttttaagaacgatcaggatacatgggattatacaaatccaaacttgtcagggcagggggatcctggatcaaatccaaataaaagacaacgccagccgccactgttaggggatcaccccgccgaatatgggggcccccacggaggataccactcacattatcacgacgaaggctatgggcctcctcctccacactatgaggggcgccgtatgggacccccagtaggaggacatcgtagaggaccaagccggtatggcccgcaatacggccacccacctcctcctccaccccccccggaatacggtccccacgccgacagcccagtgcttatggtgtacgggctggaccagagcaagatgaactgcgatagagtgtttaacgtattttgcctttacggaaatgttgagaaagtgaagtttatgaaaagcaagcccggggccgcaatggtggaaatggcagacgggtacgcagttgaccgggcgatcacacacctcaacaacaacttcatgtttggacagaagcttaatgtctgcgtgagcaaacagccagccattatgcccggccagagctacgggctggaagatgggtcctgctcctacaaggacttctccgaatcacggaataataggttctctactcctgaacaggctgcgaagaatcggattcagcatccttcaaatgtcctgcattttttcaatgcaccactcgaagtgacggaggagaatttcttcgagatctgcgatgaactgggggtgaaaagaccctcctcagtcaaagtgttttcaggcaaatcagagagatcctcgagcggtctgttagaatgggaaagtaagtctgatgcactggagacactgggcttccttaatcattaccagatgaagaatcctaatgggccttatccgtatactttgaaactgtgcttcagtacagcacagcatgcttcctag

SEQ ID NO: 12024 - DNA, 540 bp, Artificial Sequence
  Description of Artificial Sequence: Synthetic coding sequence
atgccgaaaaagcgccaggccctagtcgagtttgaggatgtcctgggggcttgtaacgccgtcaattacgccgcagataatcagatttacatcgcaggtcaccctgccttcgtgaactattcaactagccaaaagatatctcggccaggggacagtgacgacagtcgcagcgtcaactccgttctactttttaccattttgaaccctatttacagtatcaccactgatgtcctgtatacaatttgcaacccttgcggaccggtacagaggatagttatttttagaaagaacggcgtgcaggctatggttgagtttgacagtgtccagagcgcccagcgggctaaggccagtctaaacggcgctgatatctacagcggttgttgcacactgaaaatagagtacgcgaaaccaacccgcctcaacgtcttcaagaacgatcaagacacttgggactacacgaacccaaacctgtccggtcaaggttcccagtgcatgtttgacggaaccccctcgttcaggacggtgttgacgcactgctag

SEQ ID NO: 12025 - DNA, 723 bp, Artificial Sequence
  Description of Artificial Sequence: Synthetic coding sequence
atggtaaagatggctgctgccggcgggggcggtggcggtgggaggtattatggtgggggtagtgaaggagggagggcccccgcgtcacctgtggtacatatccgcggactaatagatggagtggtcgaagccgacctcgtggaagccttacaggaattcgggcctattagctatgtcgtcgtgatgcccaagaaaagacaggcgctcgtggagttcgaggatgtgttaggagcctgtaacgccgtcaattacgcagcagacaatcagatatatatcgctggacatccggcgttcgtgaattactctaccagccagaagatatcaaggcccggagattcagatgactctcggtcagtgaactctgtgcttctgttcactattctaaacccaatatactccataacaacagacgttttgtacactatctgtaacccttgcgggccagttcagcggatcgtgatctttcgcaaaaacggcgtgcaagctatggtcgagttcgactccgtgcaatcggctcagcgggcaaaggcgagcttgaatggtgcggacatttatagcgggtgctgtacccttaaaattgagtacgccaagccaacccggttgaatgtgttcaagaatgaccaggatacctgggattacaccaaccctaacctcagcggccagggtagccaatgcatgtttgacggaacaccaagcttcaggactgtgctgacacattgttag

SEQ ID NO: 12026 - DNA, 849 bp, Artificial Sequence
  Description of Artificial Sequence: Synthetic coding sequence
atgtcttcgagttcttcatcacctagagagacatacgaagaggatcgtgaatacgaaagtcaggcaaaacggcttaagacagaggagggtgagatcgactacagtgcggaggagggggaaaaccgacgcgaggcaacacctcgggggggaggcgacggcggcgggggagggcggagcttcagtcaaccagaagccggcggatcccaccataaggtctcagtgagtcccgtggtacacgtgagaggtctctgcgaaagtgttgtggaggcagatcttgtggaggcccttgaaaagtttgggacaatctgctacgtgatgatgatgccgtttaagcgccaggccttagtggagttcgaaaatattgattccgccaaagaatgtgtgacctttgcagcagacgaacccgtgtatatagccgggcaacaggcgttttttaactactctacgtctaagcgcattacgcgtccgggcaacacggacgatccgtccggaggcaataaagtactgttgctgagcattcagaatcccctgtaccctattaccgtggacgttctctacactgtatgtaaccctgtaggcaaggtacaacggattgtgatttttaaacggaatggcatccaggctatgctgatgttcgaatctgtactgtgcgcccagaaagcgaaggccgctctcaatggcgccgatatctacgctggatgttgtaccctcaagatcgagtatgcccggcccacccgcctgaatgttatccgtaatgacaacgattcgtgggattacaccaaaccttacctgggacgccgaggatgctgttggctcatgctcaaactgcttgaacgttccccattatag

SEQ ID NO: 12027 - DNA, 1527 bp, Artificial Sequence
  Description of Artificial Sequence: Synthetic coding sequence
atgtctagctcttcatcctctccgagggagacctacgaagaggatcgagaatatgagagccaggccaaacgtctgaaaactgaggaaggggagatcgactacagcgcggaagagggggagaataggagggaggccaccccacgaggaggcggagacgggggggggggaggccggagcttctcacagccagaagccggtgggtcccatcacaaagtcagcgtatcaccagtggtacacgtacgcggcctctgtgagagcgttgtggaagctgatttagttgaggctctcgagaaattcgggacaatctgctatgtcatgatgatgccattcaaaaggcaggcactggttgagttcgaaaatattgatagcgcgaaagaatgcgtcactttcgccgccgatgaaccagtatatattgcaggccagcaagcattcttcaactatagtacgtcaaaacgcatcacgagaccagggaataccgacgatcctagcggtggaaataaggtgctgctgttaagcattcaaaatcccctttaccctatcacagtcgatgtgttgtacacagtgtgtaaccctgttggcaaggtgcagcggatcgtaatttttaaaaggaatggaatccaggccatgcccacgcgcttgaatgtgattcggaatgataatgattcttgggactataccaaaccttaccttgggcgccgggatcggggtaagggaagacagaggcaggctattttaggtgaacatccctccagttttagacacgatgggtatggcagccatggaccgctattgccgttacctagtcgctaccgcatgggatctcgtgatactccggagctggtggcctaccccttaccgcaagcctcatcttcttacatgcacggcgggaacccctctgggagcgtggtgatggtaagtgggctgcaccagctgaagatgaactgtagccgggtgtttaacctgttctgtctctatggcaatattgaaaaagtcaaattcatgaagaccatccctggcacagccctggtggaaatgggcgacgagtacgcagtggagcgggcagtgacacacctgaacaatgtcaaactttttggtaagaggctaaacgtctgcgtgagtaaacagcacagcgtggtgccatcccagattttcgagttggaggatgggacaagcagctacaaagatttcgccatgtcgaagaataatcgattcacttccgccgggcaagcttccaagaacatcatccagccaccgtcctgtgttctccattattacaacgtaccgctgtgtgttaccgaagaaactttcaccaaactctgtaacgaccacgaagtgctaactttcattaaatacaaggtctttgacgcaaagccgagcgcgaaaactttaagtgggctactagagtgggaatgtaagaccgacgctgtggaggccttgaccgcattgaatcactaccagatccgcgtgccaaacgggtccaacccatacaccctcaagttgtgcttcagtacgtcttcacacttatag

SEQ ID NO: 12028 - DNA, 1527 bp, Artificial Sequence
  Description of Artificial Sequence: Synthetic coding sequence
atgtctagctcctcctcctcaccccgtgaaacttatgaagaagatagagagtatgagagccaagccaaaagactgaaaacagaggagggcgagatcgattactcagctgaagaaggagaaaatagaagagaggcaacacctcgcggcggtggggatggcggaggaggggggaggagcttctcacagcctgaggctggaggatcacaccataaggtttcagtcagtccagttgttcacgtcagaggcctctgtgagagtgttgtggaagctgacctcgtggaggctctagagaaatttggcactatatgctacgtaatgatgatgccattcaaaagacaggcccttgtggagttcgagaatatcgatagtgcgaaagagtgtgttacctttgcagcagatgagcccgtgtacattgcaggtcaacaagccttcttcaattactcaaccagtaaaagaattacacgtcccggaaatacggatgacccctccggagggaacaaggtgctgctgctgtccatacagaatccgttgtaccctataacagtcgatgtcctttatacggtctgtaaccccgtcgggaaagtgcagaggattgtgatattcaagaggaatggtatccaggccatggtggaccggcttaatgtgatcagaaatgataacgactcttgggactacaccaagccctacctgggtcgaagagaccgcggcaaggggcgtcagagacaggctattctgggggagcacccatcttcttttcgacacgatgggtatggttctcacggccccctcctccctttgcctagccgctaccgaatgggcagccgcgatacacctgaactagttgcgtaccccctgccccaggcctctagttcgtatatgcacggaggcaacccaagcggtagtgttgttatggtttccgggttacaccaactgaagatgaactgcagccgcgtgttcaatctgttctgtctctacggaaatattgaaaaagtaaagtttatgaagaccatccccggcacggccctggtggagatgggagacgagtatgcggtagaaagggctgtcacacaccttaacaatgtgaagctgttcggcaagagactgaacgtgtgcgtgagcaagcagcactccgtcgtgccttcacagatttttgaactggaagacggcacctcttcttataaagattttgccatgtctaagaacaatcgcttcacctccgccggccaggcttcaaaaaatatcatccaaccccccagttgcgtgttacattactacaacgtgccgctgtgcgtgacagaggagacattcacaaaattatgcaacgatcatgaagtgcttaccttcatcaaatacaaagtcttcgacgccaagccgtctgccaagactcttagtggactgctcgagtgggagtgtaagactgacgctgtcgaggccctcacggccctgaatcactatcagatccgggtgccaaacgggtccaacccttatacccttaaattatgctttagcaccagttctcatctgtag

SEQ ID NO: 12029 - DNA, 1614 bp, Artificial Sequence
  Description of Artificial Sequence: Synthetic coding sequence
atgctagcccgggaaacgtacgaggaagatagagagtacgagtcacaagcaaagagactgaaaaccgaggagggagaaatagactacagtgccgaagaaggcgagaaccgtagagaggctactcccaggggtggaggcgatgggggcggcgggggacgctccttcagccaacctgaggcagggggaagtcaccacaaagtgagcgtgtctcctgtggtccatgtgagggggctgtgtgagagtgtggtagaagctgatttggttgaggccctggagaaattcgggaccatttgttacgtcatgatgatgccgtttaagcgccaggccctcgtggaattcgagaatatcgattccgctaaagagtgcgtaacatttgctgctgacgagccggtatatatagcaggacagcaagcattcttcaattactcaaccagcaagagaatcacacgcccaggcaatactgatgatccaagcgggggcaataaagtgctcctcctcagtatccaaaatccactgtaccctattactgtcgacgtactgtacactgtatgcaatcctgtgggaaaggttcagcgaatcgttattttcaaacggaatggtatccaggccatggtggaatttgagagcgtgctttgtgctcagaaggccaaggctgctctcaacggcgcagacatttacgccggatgttgcacccttaagatagagtatgctcgaccaacccggctgaacgtcattaggaacgataacgacagctgggattacacaaagccctacctgggtcgacgtgataggggaaaaggaaggcagagacaggccatcctcggggagcaccctagttccttcagacacgacggatatgggtctcacggaccattattgcccttgccaagtcggtatcggatgggcagccgggatacacccgagctggtagcctatccgcttcctcaagcttctagcagttatatgcatgggggtaacccttccgggagcgtggtgatggtgtctggtctgcatcagttaaagatgaattgtagtagagtgtttaacctgttctgtctctacggtaatatagagaaggttaagttcatgaagaccattccgggcaccgctcttgtagagatgggagatgagtacgcagtcgagcgagccgtcactcacttgaacaacgtaaaattgtttggtaagagattgaacgtgtgcgtttctaaacaacattctgtagtgccgagtcagatcttcgagctcgaggacgggacttcttcttacaaggattttgccatgtctaaaaataataggttcacgtctgccggccaggcctctaagaacattatacaaccacctagctgtgtgctgcactattataatgttcccctgtgcgtaacggaagaaacgtttactaagctctgcaatgatcacgaagtcctgacctttattaagtacaaagtgtttgatgcaaagccctccgccaaaacattgtctggattgttagagtgggaatgtaagacagacgccgtggaggccctgactgcccttaaccactaccagatcagagtgccaaacggttccaacccctacaccctgaagctttgcttttcgactagttcccatctgtag

SEQ ID NO: 12030 - DNA, 828 bp, Artificial Sequence
  Description of Artificial Sequence: Synthetic coding sequence
atgcttgcccgcgaaacctatgaagaagatcgagaatacgagagccaggcaaagagactcaaaaccgaagagggagaaattgattactccgcggaggaaggcgaaaaccggagggaggctacccctaggggcggcggggatggcggcgggggggggagatctttttcacagcctgaggcgggcggatctcatcataaggtgtccgtgagtcctgtggttcacgtgcggggactgtgcgaaagcgtggtggaggcagatctcgttgaggcactggagaagtttggcactatctgttacgtcatgatgatgccttttaagcgtcaggccctcgtggaattcgaaaacattgatagcgccaaagagtgtgttacattcgctgccgatgagcccgtttatatagccggccagcaggccttctttaattacagtacttccaagcggatcacacggcccgggaatactgatgacccatccggaggaaataaagtcttactgctgtccattcaaaacccgctataccctattacagtagatgtcctgtatacagtctgtaaccctgtcggaaaggtccagcggatagtgatcttcaaacgcaacggcatccaagcgatggtggagtttgaatctgtgttgtgtgctcagaaagccaaagcggctctgaatggagctgatatttacgctgggtgttgcactcttaagattgagtacgcacgacctaccagattaaatgtgatcaggaatgacaatgactcttgggactataccaagccttacctcggacgtcgcggtcggtacttcattcactttcggatgtacttgatctgctag

SEQ ID NO: 12031 - DNA, 1629 bp, Artificial Sequence
  Description of Artificial Sequence: Synthetic coding sequence
atgagcagttccagctcctcccctagggaaacttacgaagaggaccgcgagtacgagtctcaagcaaaaagactgaaaacagaagaaggcgagatcgattattctgccgaggagggcgaaaatcggcgcgaggcaactccaagaggtggcggagatgggggcggggggggccggtccttttcgcagccagaagcaggcgggtcccatcataaggttagcgtgagtccggtggttcacgttagaggtctatgtgagagtgtcgtggaggctgatttagtggaagcccttgaaaaatttgggaccatctgttatgttatgatgatgcccttcaagcgccaggctctcgtcgagttcgaaaatatagatagcgcaaaggagtgcgtgacctttgccgccgatgaacccgtctatattgccggccagcaagcttttttcaactatagcaccagcaaacgtatcactcgacctggaaataccgatgatccttctggaggaaacaaagtgttgcttctgtcgatacagaaccctttgtatcccatcaccgtggatgtcctgtacaccgtgtgtaatcctgtcggcaaggtgcagcgtatagtaatttttaagagaaatggtatccaggcaatgttaatgttcgagtcagtgttgtgtgcacagaaagcaaaggcagcacttaacggtgctgatatatacgccggctgctgcacactgaagatcgagtatgcgcggcccacaaggctcaacgtaatccgcaatgataacgacagttgggactacaccaagccctacctcggcaggcgcgacaggggtaagggacgccagcgccaagccatcctgggtgaacaccctagctccttccggcatgacggatacggatcccacggacccctgttaccgttgccttctcgttatcgaatgggaagccgcgacactcctgagctggttgcttaccccctcccccaagcaagcagctcctacatgcatggcgggaaccccagcgggtccgtggttatggtgtccggcctacatcaattgaaaatgaattgttcccgtgttttcaacctattttgtctgtatggcaatattgagaaagtgaagttcatgaagacgatccctggtactgcacttgtggaaatgggcgacgaatacgctgttgagcgcgctgttacacatctgaacaacgttaagcttttcggcaagcgtctgaacgtttgtgtgagcaagcagcattcagttgtgcccagccagatctttgagctggaagatgggacctcgtcatacaaggacttcgcgatgagtaaaaacaacagattcacaagcgctggccaggcctcgaagaatatcattcagcccccaagttgtgtcctgcactattacaatgtgcccctctgtgtcaccgaggagacgttcaccaagctctgcaatgaccacgaggtgttgacatttattaagtataaggtgttcgatgcaaaaccctcagctaagacattgtcagggctgctggaatgggagtgcaagacggacgccgtggaggccctgacagcactgaatcactaccaaatccgggtacctaacggcagtaacccgtatacactcaagctgtgcttcagcacttctagccacctttag

SEQ ID NO: 12032 - DNA, 2244 bp, Artificial Sequence
  Description of Artificial Sequence: Synthetic coding sequence
atggaagtaaagcgccttaaagttaccgagctgcgcagcgagcttcagcggaggggcttagacagccggggactgaaggtcgacctggcacaacgcctccaggaggccttagatgccgagatgctagaagatgaagcgggtggtgggggcgccgggcccggaggggcttgcaaggctgaaccccggcctgtagctgcctctggcggcggtcccggcggagacgaagaggaagatgaggaggaagaggaggaagacgaggaggccttgctcgaggacgaagatgaagaaccaccacctgcccaggcactaggccaggccgcgcagcctccgcccgagccaccagaggcggcagccatggaagccgccgccgagcccgacgcgagcgaaaaacccgcagaggcgaccgccggaagtgggggggtgaacggcggagaggagcaagggttgggcaaacgcgaggaagatgagcctgaagagcgctccggcgacgaaactcctggatccgaagtaccgggcgacaaggccgcggaagagcagggcgatgaccaggattcagagaagtccaagccggcgggctctgatggcgagcgcaggggggtaaaaagacaaagggacgagaaggacgagcatggccgcgcctactacgagttcagagaggaggcctaccacagcaggagtaaatctccgctgccaccagaagaagaggcgaaagacgaggaggaggatcagaccctcgtgaacctagacacctacacgtcggaccttcattttcaagtatcaaaagatcggtatggaggacagccgttattttccgagaaatttccaacactttggtctggtgctcgctcaacctacggcgtgactaaaggaaaggtgtgtttcgaggccaaggtaactcagaacctgcccatgaaggaggggtgtactgaagtcagcttgctgcgcgtcggatggtcggtggactttagccgaccacagttaggtgaggacgagttttcctatgggtttgatgggcgcgggctgaaagccgagaacgggcagttcgaagaatttggacaaacattcggtgagaatgatgtgatcgggtgtttcgcaaactttgaaacagaggaagtcgagcttagtttctctaagaacggcgaggacctgggagtcgctttctggatctctaaggactcactggctgacagggccctgcttccacacgtgctttgtaagaactgcgttgtcgaactgaactttggccagaaggaagagccattttttcctccgccagaagaattcgtattcatacacgccgtgcctgtggaggaacgcgtccgaactgccgttccacctaaaaccatcgaggagtgtgaggtgattttaatggtgggtttaccaggttccggcaagacacaatgggccttgaagtacgcaaaggagaacccggaaaagcggtacaacgttctcggcgccgaaacggttttaaaccagatgcgtatgaaagggctggaagagccagaaatggaccccaaatctagggatctactggtccagcaggccagccagtgcttatcgaaactggtgcagatcgcaagtcgcaccaaacggaattttatattagatcagtgcaatgtgtacaattcagggcagagaagaaaactgctgctattcaagacattctcccgtaaggtggttgtggtcgtgccaaatgaagaggattggaagaaaagattggaactccgcaaagaggttgaaggcgacgatgtccctgagagtatcatgctcgaaatgaaggcaaatttttcactgcccgaaaagtgcgactacatggacgaagttacctacggcgaactcgagaaggaggaagcgcagcccatcgtgaccaaatataaggaggaggcaagaaaactcctgccaccgtcagagaaacggacaaaccggcgtaacaacagaaataaacgcaatcgccagaatagatcccggggccaggggtatgtgggcggccagagacggggttatgataacagggcgtacggtcaacagtattggggccagcctggcaaccgtggcggttacagaaatttttatgacagatacaggggggattacgatcggttctatggaagggactacgagtataatcgctatagagactactatagacagtacaatcgagactggcagagttactactatcaccatccccaggacagagataggtattacaggaattactacggataccagggatatcgctag

SEQ ID NO: 12033 - DNA, 561 bp, Artificial Sequence
  Description of Artificial Sequence: Synthetic coding sequence
atgggaaaagagatacagcttaagccgaaggctaatgttagcagctacgttcactttctcttgaattacagaaataaatttaaggagcagcaacctaacacttacgtaggattcaaggaattcagcagaaagtgttcggagaaatggcggtctataagcaaacacgaaaaagctaagtatgaagcacttgcaaaactggataaagctcgttaccaggaagaaatgatgaattacgtcgggaagcggaaaaaacgccggaagagagacccccaagagccacggcgccccccctcaagtttcttattgttttgtcaggaccattatgctcagctgaagcgcgaaaaccccaactggtccgtggttcaggtggcaaaggctaccggaaagatgtggagcaccgctacagatctcgagaagcacccttatgaacagagagtagcgctgctgcgggccaagtacttcgaggagttagaactataccggaaacagtgcaatgcaaggaaaaagtaccgcatgtctgcacggaaccggtgtagggggaaacgcgtgcgccagtcatag

SEQ ID NO: 12034 - DNA, 561 bp, Artificial Sequence
  Description of Artificial Sequence: Synthetic coding sequence
atgggtaaagagatccagctaaagcccaaagccaatgtgagctcttacgtacactttctgctgaactatcggaacaagtttaaagaacaacagccgaacacctacgtggggtttaaagagttttccaggaagtgttctgaaaagtggcgctccattagtaaacacgaaaaggccaagtacgaggccctggccaaactcgacaaagcaagataccaagaggagatgatgaactacgtgggcaagcgtaagaagcggcgaaaacgagatccccaagaaccccgcagaccgccctcttctttcctgctgttttgccaagaccattatgcccagttgaaacgggagaatcccaattggtctgttgtccaggtagctaaagctaccggaaagatgtggtccaccgctacagacttggaaaagcatccttatgagcagagggttgctctgctcagagctaagtacttcgaagaactagaattgtatcggaaacaatgtaacgcacgcaagaaataccgcatgtccgccagaaaccggtgcagggggaaacgggttagacagtcctag

SEQ ID NO: 12035 - DNA, 273 bp, Artificial Sequence
  Description of Artificial Sequence: Synthetic coding sequence
atgccaaaacgaaaggccaaaggagacgcaaagggggataaagctaaggtgaaggacgagcctcagcggaggtctgcacgtctgtccgctaagcctgccccacctaagcctgagccacgacctaagaaggcctctgctaagaaaggcgagaagctaccaaagggccgtaaagggaaagccgacgccggcaaggacggtaacaaccccgctaaaaaccgggacgcctctacccttcagagtcagaaagcagaaggcacgggggacgctaagtag

SEQ ID NO: 12036 - DNA, 273 bp, Artificial Sequence
  Description of Artificial Sequence: Synthetic coding sequence
atgccaaaacgtaaagccaaaggggatgcaaagggcgataaagccaaggtcaaggacgaaccccagcgaagatctgcccggctctccgccaagcctgcaccccccaagccagagccgcggcctaagaaagctagcgccaagaagggagaaaagttgcctaaaggacggaaaggtaaagctgatgccggcaaagacggcaataaccccgcaaaaaatcgggatgcctctacactgcagagccagaaggcagaagggaccggagatgctaagtag

SEQ ID NO: 12037 - DNA, 849 bp, Artificial Sequence
  Description of Artificial Sequence: Synthetic coding sequence
atgcccaagcgcaaggcggctggccagggagacatgaggcaggagccaaaacggagatccgctcggctaagtgctatgctcgtgcctgttacacccgaggtgaagcccaaaagaactagctcttcccgaaaaatgaagacgaaaagcgatatgatggaggagaatatcgacactagcgcccaggcagtagctgaaactaaacaggaggctgtagtggaagaagactataacgaaaacgccaaaaacggagaagctaaaattactgaggcaccagcttcagagaaggaaatcgtggaagtgaaggaagagaacatagaggacgcaacagaaaaaggtggagagaagaaagaggcggtcgcagccgaagttaagaacgaagaggaagaccagaaggaggacgaagaggatcagaacgaagaaaagggggaggccggcaaagaggataaggacgaaaagggagaggaagacggcaaggaagacaaaaatgggaatgagaaaggggaggacgccaaagagaaagaagacgggaaaaagggggaggacgggaaggggaatggtgaagacggtaaggaaaagggcgaagacgagaaggaggaggaggaccggaaggaaacaggcgacggcaaggagaacgaggacggaaaagagaaaggggataagaaggagggtaaagacgtaaaggtgaaagaagatgagaaggagagagaagacggaaaagaagatgaggggggcaatgaagaggaggccggcaaggagaaggaggacctgaaagaggaggaggagggaaaggaagaggacgagatcaaagaggacgacggaaagaaggaagagcctcaatctatagtgtag

SEQ ID NO: 12038 - DNA, 486 bp, Artificial Sequence
  Description of Artificial Sequence: Synthetic coding sequence
atgccaaagagaaaaccaaaaagacgcagtgctcgtctgtccgcgatgctggtgccagtgacaccagaagtgaagcctaagcggactagttcgtcccgtaagatgaagaccaagtcagacatgatggaagagaatatcgacacatccgcccaagccgtggcggagacaaagcaggaggccgttgtcgaagaagactacaacgagaacgccaagaatggtgaagccaaaatcacagaggctcctgcttctgagaaggagatcgtggaggttaaggaggagaacatagaagatgccactgagaaagggggcgaaaagaaggaagctgtcgccgcggaagtcaagaacgaagaggaggaccagaaggaggacgaagaggatcagaacgaggagaaaggagaggctggcaaagaggacaaagatgagaagggcgaagaagatggaaaagaggacaagaatggcaacgagaaaggggaggacgcaaagtag

SEQ ID NO: 12039 - DNA, 447 bp, Artificial Sequence
  Description of Artificial Sequence: Synthetic coding sequence
atgcctaagaggaaggctgctgggcagggagacatgcggcaggaacctaagcgtcgctcagctcggctgagtgcaatgctggtgccagtaactcccgaggtcaagcctaagcggacctccagctcgagaaaaatgaaaactaaaagcgatatgatggaagaaaacatcgacacgagtgcccaggccgtcgccgaaactaagcaagaggctgtggtggaggaggattataatgaaaatgctaagaacggggaggctaaaatcaccgaggcacccgcaagcgaaaaagagatcgtggaagtgaaggaagagaacattgaggatgccacggagaagggaggtgaaaaaaaagaagccgtcgccgcggaagtgaaaaatgaagaggaagaccagaaagaggatgaagaagaccaaaacgaagagaaaggagaagcggggaaggaagattag

SEQ ID NO: 12040 - DNA, 309 bp, Artificial Sequence
  Description of Artificial Sequence: Synthetic coding sequence
atgccaaagagaaaagcagctggccagggtgacatgagacaagaaccgaaacgcaggagcgccagattaagcgccatgctggtgccggtcacccctgaagttaagccgaagaggacctcaagttctaggaaaatgaagaccaaaagtgacatgatggaagaaaatatcgacacatccgcacaggccgttgccgaaacaaaacaggaagccgtggtggaagaggattataacgaaaatgcaaaaaatggtgaggccaaaattacggaagcaccagcctctgagaaagagatcgtggaggtcaaagaatag

SEQ ID NO: 12041 - DNA, 606 bp, Artificial Sequence
  Description of Artificial Sequence: Synthetic coding sequence
atgcctaaacgcaagatgctcgtcccagtgacccccgaagtcaagcctaaacgcacttctagcagcaggaagatgaaaacgaaatccgacatgatggaggagaatatagatacgtctgcacaggctgtcgctgaaaccaaacaagaagccgtggttgaggaggattacaatgaaaatgccaagaatggcgaggccaagattaccgaggcccccgcatctgagaaagagattgtcgaggtgaaggaggagaacatagaagatgccaccgagaaaggcggcgagaagaaagaagcagtcgctgccgaggtcaaaaacgaggaggaagaccagaaagaggatgaagaggaccagaatgaagaaaagggagaagcgggcaaggaggacaaggatgaaaagggagaagaagacggaaaggaagataagaacgggaacgaaaagggcgaagatgcaaaagagaaggaggatgggaagaaaggtgaagacggcaaaggaaacggcgaggatggcaaagagaaaggcgaggatgagaaggaggaggaagatcgaaaagagacaggggatggaaaagaaaatgaggatggtaaggagaagggtgataaaaaatag

SEQ ID NO: 12042 - DNA, 270 bp, Artificial Sequence
  Description of Artificial Sequence: Synthetic coding sequence
atgccaaagcgaaaggctgccggacagggagatatgagacaggagccgaagagaaggtccgcccgactgtctgccatgttagtgcctgtaacacccgaggtcaaacctaagcgaactagcagcagcagaaagatgaaaacgaaaagtgacatgatggaagagaatatcgacactagcgcccaggccgttgcagaaacaaagcaggaggccgtggtggaagaggactacaatgagaacgccaaaaacggggaggccaaaatcactgagtag

SEQ ID NO: 12043 - DNA, 2073 bp, Artificial Sequence
  Description of Artificial Sequence: Synthetic coding sequence
atgaacctccgcagcgtgttcacagtggaacagcagaggatcctccagcggtactacgaaaacggcatgacaaatcaatccaaaaattgttttcagctcatcctgcagtgcgcacaggaaaccaagctggatttttccgttgttcgcacttgggtaggcaacaagaggcggaaaatgagctcgaaaaacagcgagtccggaactgccactaccggcacaagcttaagtgcccccgacattacagtgaggaacgtggtgaatattgctagacccagcagccagcagtcatcctggacctctgcaaataacgatgtcatagtgacagggatctattctcccgcttcgagctccagccggcaggggactaacaaacatacagacactcaaatcacagaagcacacaaaatacccatccaaaagaccgcgactaaaaacgataccgaatttcagctacatatacctgtacagaggcaggttgctcactgcaagaacgcatctttactgctgggagagaagaccattatcttgtcacgtcagacaagcgtgcttaacgccgggaatagcgtgttcaatcatgctaaaaagaactatggaaacagtagtgtgcaggccagtgagatgaccgtaccacaaaagccttctgtctgccaccggccgtgcaaaattgagccagtgggcatccagcggtcatataaacctgagcacacaggacccgctttgcataacctttgtgggcaaaaaccgaccattcgcgacccatattgccggactcaaaacttggaaattcgagaggtcttctccttggctgtgtcagactacccacagcgcatcctgggcggcaacgcgccccagaagccatcatctgcagagggtaactgtctgtctattgctatggaaactggagatgctgaagacgagtacgcacgagaggaggaacttgcaagcatgcgagcccagattccgagttattcacgattctatgagagtgggtcctctctgcgcgcagaaaaccagagtaccacccttcccggaccaggacgcaacatgcctaactcacaaatggtgaatattcgcgatatgtccgacaatgtactgtaccagaatcggaattatcacctcaccccgcgcactagtctgcacaccgcatccagcactatgtacagtaacaccaatccactaagatccaacttttctcctcacttcgccagctcaaatcagttgcggctctctcagaaccaaaataattatcagatttccggaaacctaaccgtgccttggattacaggctgcagtaggaagcgcgccctgcaggatcgaacacagttttcagatcgtgacctggcaacccttaagaagtactgggataacgggatgacaagccttggttctgtttgtcgcgaaaagattgaagccgtcgccacagaactgaacgtcgactgtgaaatcgtgagaacttggattggaaaccgacggaggaaatatcggctcatgggtatcgaggtgccacccccccgcggtggcccggctgatttctctgagcaaccagaaagcgggtcacttagtgccctgactccgggagaggaggccggtcctgaggtgggagaggacaatgacaggaacgatgaggtgtccatatgtctttctgaaggaagcagccaggaagagcccaatgaggttgtgcctaatgacgcccgagcccacaaagaggaagaccatcacgctgttactacagataacgttaaaatcgagattatagatgatgaagaatctgatatgatttctaactccgaggtcgaacaggtcaacagttttctggactacaaaaatgaggaggtgaaattcatcgagaacgaactcgaaatccaaaagcagaagtatttcaagctccagactttcgttcgttcacttatattagcaatgaaggcagatgataaggaacaacaacaagccctgctgagcgatctgccaccagagctcgaggaaatggacttcaatcatgcctcactggagcccgacgatacttccttttccgtgtcctccctgagcgaaaaaaacgtttcagaaagcctgtag

SEQ ID NO: 12044 - DNA, 1899 bp, Artificial Sequence
  Description of Artificial Sequence: Synthetic coding sequence
atgagtagcaaaaatagcgagtcagggaccgccaccactgggactagtctgtccgctcccgatataactgtgagaaatgtggtgaatattgccagaccgtcctcccagcagtcctcctggacatccgccaataacgacgtgattgtgactggcatatatagcccagccagctcctctagccgacagggaaccaacaagcataccgatacacagataacagaggctcataagatccccatacagaaaacagccacaaagaacgatactgaattccagctccacatccccgtacagcggcaggtggctcactgcaagaacgcttcccttttgctcggagaaaaaaccatcatcttgtctagacagacatccgtgttaaatgcgggtaattctgtctttaaccatgccaagaagaactatggcaactctagcgtccaggcctccgagatgacagtgccacagaagccaagcgtctgccaccgaccgtgcaaaattgaacccgtcggaatccaaagaagttacaaaccggagcataccggccccgctctgcacaatctgtgcggacagaaacccactatacgcgatccatattgccggacacagaatcttgagatcagggaggttttctccctcgcagtgtctgattatcctcagaggatcctgggcgggaacgcaccccagaaaccttcgagcgctgaaggaaactgtctgagtattgcaatggagactggagatgccgaggacgagtatgcccgagaagaagaattggctagcatgcgagcccagatcccctcatactcacgcttctacgagtcagggtcctccctcagggcggaaaatcagtccaccacactgcccggacccggccggaatatgcctaactctcagatggttaacatccgcgacatgtccgacaacgtgttgtatcaaaatagaaactatcatttgacacccagaactagcctgcacacagccagtagtaccatgtactcgaatacgaaccctctaaggtctaactttagccctcacttcgcctcgtctaatcagctgcgactgtcacagaaccagaacaattatcaaatctctgggaatctgaccgtgccatggattacaggttgttctcggaagagagccctacaggatcgcactcagttcagcgatcgcgaccttgcgactctcaagaaatattgggacaacggaatgacctccctgggttccgtgtgccgtgagaaaatcgaagccgtcgctacggagctgaatgtggattgcgagattgttagaacctggatcggcaaccgaagacggaagtacaggttgatgggcatcgaggtgccccctcctaggggcggacccgccgacttctccgaacagccagagagcgggtctctgtcggcattaacaccgggggaggaggctggtccagaagttggtgaggataatgacagaaatgacgaggtgagtatctgtttgtcggagggatcttcacaagaggaaccaaacgaggtggtccccaacgacgcccgggctcacaaagaagaggaccaccacgctgtgacaaccgataatgtgaaaatcgagattatagacgacgaggagagcgacatgatatccaacagcgaggtagagcaggttaattccttcctcgactataaaaatgaggaagtgaagttcatagagaacgaactggagattcagaaacagaagtactttaaattacagacgttcgttcgctcactgatcctggcaatgaaggccgacgataaagaacaacagcaggccctgttatcggacctgcctccagagttagaggagatggatttcaatcacgcctcactcgagcccgacgatacttcattctcagtgtcatccctgtctgaaaaaaacgtgagcgaatccctgtag

SEQ ID NO: 12045 - DNA, 624 bp, Artificial Sequence
  Description of Artificial Sequence: Synthetic coding sequence
atgagctctaaaaatagcgaaagcgggacagcgaccactgggacctctttaagcgcacccgatatcactgtgcgaaacgtcgtcaacatcgcccgcccatcaagccagcagtcctcttggacaagcgcgaacaacgatgttattgtgactggcatctactcaccagcttcatcgtctagcagacagggcacaaacaagcataccgatacccagattactgaggcacacaagatccctatacagaagacggcaacgaaaaacgacaccgagttccagttgcatatacccgtgcagcgccaggtggcccattgcaaaaatgcctcgctgctccttggtgaaaagaccataatcctatcacgccaaacatccgtcctgaacgctggtaatagcgtgtttaaccacgcaaaaaaaaactatggaaattctagcgtgcaggctagcgagatgacagtcccccaaaaaccttctgtctgccatcgtccttgcaagatagaacctgtcgggatacaaaggtcctataagccagagcacacaggcccagcactgcacaatctttgtggccagaagcccacgatcagggacccttactgtagaacccagaacctggaaatcagagaggtttag

SEQ ID NO: 12046 - DNA, 2073 bp, Artificial Sequence
  Description of Artificial Sequence: Synthetic coding sequence
atgaacctgaggtcagtgtttactgttgagcaacaaagaattcttcagcgctactacgaaaacggtatgaccaaccagtccaagaattgtttccagcttattcttcagtgcgctcaggagacaaaacttgactttagcgtggtaagaacatgggtcgggaataagcggcgcaagatgtcatcgaaaaactccgagtccggcactgctaccaccggtacctccttgagcgcacctgacatcactgtgcgcaacgtagtgaacatcgcaagaccgtcttctcagcaatccagttggacctcagccaacaatgacgtgatcgtgactggcatttactcccctgcatctagctcttcgcggcaaggcactaacaagcatacggatacacagataacagaagctcataagatacccatccagaaaaccgcaacgaagaatgatactgagtttcagttacacatcccagtgcaacgacaggtagcgcattgtaaaaacgcaagcctgcttctgggagagaaaaccataatcctgtcgcggcaaacttccgtcctgaacgctgggaatagtgtattcaatcacgcaaagaagaactatggcaattcaagcgtgcaagccagcgaaatgacggtaccccaaaaaccatcagtatgtcaccggccttgcaaaatagagccagtggggatacaaaggtcttacaagcccgaacacacaggaccagcactgcataatttgtgcggacaaaagccgaccattcgagatccatactgccgcacacagaatctggaaatcagggaagtgttctccctcgctgtgagtgattatccacagcgaatcttgggcgggaatgctcctcagaaaccttcttccgcagagggcaactgtctgagcatcgccatggaaactggggacgccgaggatgaatatgcccgcgaggaggaacttgcttccatgcgtgcacaaatcccttcctacagccggttttacgaatccggcagttccctgagggccgagaatcagagcactaccctgccaggccccggcaggaatatgccgaacagccagatggtgaatatcagagatatgagcgataacgttctatatcagaacaggaactaccacctgactccgcgcacttctcttcacactgcctccagcacgatgtattccaataccaaccccctccggagcaacttctctccccacttcgcttctagcaatcagcttagactcagtcagaaccaaaataactaccaaatttccggcaacctgaccgtgccttggatcacaggctgctccagaaagcgagccttgcaggaccgcacccagttctccgatcgagacctcgctaccctaaaaaaatactgggacaatggaatgacttcccttggctccgtgtgtcgtgagaaaatagaggcagtagccactgaattgaatgtcgattgtgagatcgtgcggacatggatcggcaaccggcgtcgcaagtaccgattgatgggcatcgaggtaccacccccacgaggaggacctgctgatttctccgaacagccagagtccgggtcactcagcgccctcaccccaggtgaggaggccggcccagaagtgggcgaagataatgaccgcaatgacgaggtgagtatctgcctcagcgaaggctctagccaagaggaacccaacgaggtggtgcctaacgatgcacgggctcataaggaagaagatcaccatgccgtgaccaccgataacgtcaaaatcgaaatcatcgatgacgaagaatccgacatgattagtaactctgaggtcgagcaggtcaattcattcctggactataagaatgaggaggtcaaattcattgagaacgaattggaaattcagaagcaaaaatactttaaactgcagacctttgtgagatcattgatactcgccatgaaagcagacgacaaagagcagcagcaggcacttctgtccgacctgccacccgaacttgaagagatggatttcaatcatgcctcgctagagcctgacgacactagttttagcgtatctagtctgtcggagaagaatgtgtccgaatccctttag

SEQ ID NO: 12047 - DNA, 1671 bp, Artificial Sequence
  Description of Artificial Sequence: Synthetic coding sequence
atggcaagagaaaaggagatgcaagaatttacacgatccttctttcgaggcaggcctgacctgagtactctcacccacagcattgtgagaagaaggtatctcgcccactccggtaggtcgcacctcgaacctgaagagaagcaggcccttaagcggctggttgaggaggaactgttaaagatgcaagtggatgaggctgcatctcgggaagacaaacttgatctcaccaaaaaaggaaaaaggccaccaaccccatgcagcgatcccgaaagaaaacggttcagattcaattctgagagtgagtctggcagcgaggcctcctccccagactacttcgggcctccagctaagaatggggttgccgcggaagtctcccctgctaaggaagagaatcctcggagagccagcaaggcagtcgaggaatcttctgacgaagagcggcagcgcgacttaccagcccagaggggcgaggaatcctccgaagaggaggagaagggctacaagggaaagacacggaagaagcctgtggtaaaaaagcaggcccccggcaaagcctcagtgagcagaaagcaggccagggaggaatccgaggaatccgaggccgagccagtgcagcgaacggccaagaaagtggaaggaaacaaaggaacgaagagtctcaaagagtcagaacaggagagcgaagaagagattttggcccaaaagaaagagcagcgcgaagaagaggtggaggaggaagagaaggaggaggacgaagaaaagggagactggaagccccggactcggtcgaatggccgtagaaagagcgctcgcgaagagaggagttgcaagcagaagtcccaagccaagaggttactaggagatagtgactccgaagaagaacagaaggaggccgcaagcagcggcgatgatagcggcagagaccgagaacccccagtgcagagaaaatccgaagaccgcactcagctcaagggtgggaagaggctctcggggtcatccgaggatgaggaggattcaggtaagggagagcctacggcaaaaggcagcaggaagatggccaggctggggtccacaagtggtgaagagagcgacctggaacgggaggtgtccgactctgaggctggggggggaccccagggggagcggaaaaaccggagctcaaagaagagttccaggaagggtcggacccggtcgagctcctcctcaagtgacggatctccagaggctaaaggagggaaggccggaagcggcagaaggggggaggaccaccccgccgtgatgcgactgaaaaggtatattcgagcatgtggagcacacaggaattacaaaaaattgttaggctcatgctgtagtcataaagaaagattgagtattctgcgagctgaattggaagcattggggatgaagggaaccccatcacttgggaaatgtagagcgttgaaagagcagcgcgaggaagctgccgaagtggcgagtctcgacgtggccaacataatctccgggtctgggaggccaaggcgtcgcacggcgtggaacccactcggtgaggccgccccacccggagagctgtaccgacggaccctggactccgatgaagagcgcccccggcccgcccctcccgattggtcacatatgcgagggattatatcatccgatggtgagtctaattag

SEQ ID NO: 12048 - DNA, 732 bp, Artificial Sequence
  Description of Artificial Sequence: Synthetic coding sequence
atggcgagagaaaaagagatgcaggagtttacgcgctccttctttaggggtcgaccagatctcagcactctcactcactctattgtacgcagaagatatttagcccacagcggccgctcacaccttgaaccggaggagaaacaggcacttaaaaggcttgtggaggaagaattactgaagatgcaagtggatgaggctgcctcacgggaggacaagctcgacctaacaaaaaagggaaaaagacctccaaccccctgttctgaccccgagaggaagagatttagatttaattctgaatcggcagggagcggacggcggggtgaggaccacccggcggtaatgaggcttaagaggtacattcgagcttgcggtgcccaccggaattacaaaaaacttctcggatcctgttgcagtcataaggaaagattgtctatactgcgggccgagctcgaagccctcgggatgaagggcacgccatcacttggcaagtgtcgggccctgaaagaacagcgagaggaggccgccgaggtggctagtctggatgttgctaacatcatctctggctccggtcggccacggcgacgcacagcttggaaccctttaggcgaggccgccccccctggcgagctatatagacggacactggacagcgacgaggaaagacctcgtcctgctccgcccgactggtcccacatgcggggaatcatctcatcagacggagagtccaattag

SEQ ID NO: 12049 - DNA, 1362 bp, Artificial Sequence
  Description of Artificial Sequence: Synthetic coding sequence
atggaacgcgcgccccccgatggcccccttaacgcttcaggggccctcgccggtgaagctgcagcagctggtggagcacgcggtttctctgcagcttggactgcagtcctcgccgcgctgatggcactgttgatcgtagccaccgtgcttgggaatgcccttgtgatgctggcatttgtggccgattcttcgcttcgcacacaaaataacttcttcctactgaacctggctattagtgacttcctagtcggcgctttctgtattcccttatatgtcccctacgttctgaccggacgctggacattcgggagagggctttgcaagctgtggctagtggtcgactacttgctgtgtaccagcagcgctttcaacattgtccttatttcctatgatagatttctgagcgtcaccagggcagtgagctaccgagcacagcaaggcgatacaagacgcgccgtccggaagatgctgttggtctgggttctcgccttcctgctgtacgggcctgcaatcttgtcttgggagtacctgagcggcggtagcagcattccagagggccactgctacgcagagtttttttacaactggtattttttgattactgcaagcacactcgagttttttactccttttctgtctgtcactttctttaacctgtccatctacctgaatatccagcgtcgaacccggcttcgactggacggggccagggaggccgcagggccggaacccccacccgaggctcagccctcaccaccccccccgccagggtgctggggatgttggcaaaaaggacacggagaggccatgccactgcataggtatggcgtgggcgaggccgctgttggcgccgaagcgggtgaggccacactcgggggtggaggagggggaggttcagtcgcttccccgacatcatcatccggaagctcatccaggggaaccgaacgcccccgatccttgaagcgtggctcgaaaccgtctgcatcctctgcgagcttagaaaaacggatgaagatggtgagccaatctttcacccagcgctttagactgtctcgggataggaaagtcgccaagtccttggcagtcatagtcagcatttttgggctgtgttgggcaccctacactcttctgatgatcatcagagctgcctgccacgggcattgtgtacctgattactggtatgagacaagtttctggttactctgggctaattcagctgtcaaccctgtgttgtatcctctgtgtcaccattcttttcgccgagctttcaccaagctcctgtgcccccaaaagctgaagattcagccacactcttccttagaacactgttggaaaaagatgaagaagaagacttgcctgtag

SEQ ID NO: 12050 - DNA, 1338 bp, Artificial Sequence
  Description of Artificial Sequence: Synthetic coding sequence
atggaaagagcgccccccgatggccccctgaacgctagcggagccctcgctggggaggctgcagcagccggcggagctagaggattctctgctgcatggactgccgtccttgccgccctgatggccctgttgattgtggccacagttctcggtaacgcactagttatgctggcattcgtggctgatagctctttaaggacgcaaaataacttctttctgttgaatctggccatcagcgacttcctcgtgggggcgttctgcatccccctgtatgtaccatatgtgctgacaggcagatggacatttggccgcggcctttgcaaactgtggttagtcgtcgattatcttttatgcacatcttctgcatttaatatcgttcttatttcttatgataggtttctgtcggtcactcgagcggtctcctacagagcacagcagggagacacacgtcgggcagttaggaagatgcttcttgtgtgggttctcgcctttctgctctacggaccggcgatcctcagctgggagtacttgtccggaggctctagcatcccagaaggtcattgctatgctgaattcttctacaactggtatttcttgatcactgctagcactctggagttctttacgcccttcctcagcgttaccttttttaacttatccatctatctgaacatccagcgacggactcgattgcgactggatggggcaagggaagcagctggtccggagcctccccctgaagcccaacctagtcctcctccaccccccggttgctggggctgttggcagaaagggcatggtgaggctatgcctctgcatcgatacggagtaggggaagcggctgtaggcgctgaagcaggagaggcaaccctggggggcggtggggggggaggtagcgtggctagcccgactagctctagcgggtcatcgtcccggggcacagaacgtccccgctccctaaaacgtgggtcaaagccgtccgcttcatccgctagcctggagaaaaggatgaaaatggtgtcccagtcatttacgcagaggttccgcctgtccagggatagaaaggtggccaagtccctggccgtgatcgtctccatcttcggcttgtgttgggcaccatatacactcttaatgattatcagggctgcatgccatggccactgtgttcccgactactggtacgagaccagcttttggctcctgtgggctaattcagcagttaatccagttctgtaccccctctgtcatcattccttccggcgggccttcacaaaactcctgtgtccacagaaattgaagattcagccacattcaagcctggaacactgctggaagtag

SEQ ID NO: 12051 - DNA, 1248 bp, Artificial Sequence
  Description of Artificial Sequence: Synthetic coding sequence
atggaacgggcgcctcccgacgggccacttaatgctagcggcgcacttgctggcgaagccgcagctgccggtggcgccaggggcttcagtgcagcttggaccgcagtgcttgcagccttaatggctttgctaatcgtcgctactgtgctggggaatgctttggttatgttagcattcgttgctgatagctctcttcggacccagaataacttttttcttctaaacctcgcaatctccgattttctcgtcggcgctttttgcatcccactgtacgtgccatatgtcctgaccggccggtggacgtttggccgcggattgtgcaagctatggcttgtggtggactacctgctgtgtacgtcttcagcattcaacattgttcttatcagctatgatcgctttctctccgtgacacgagcagtgagctatcgcgcacagcagggcgacacccggcgcgctgtcagaaagatgttattagtctgggttctggcatttctgctatacggccctgcaatcctgtcctgggagtatctttcaggaggttctagcatccctgaagggcactgttatgccgaatttttctataattggtattttctcatcacagcttcaactttggaattcttcactccttttctgagcgtcaccttcttcaatctgtctatttatttaaatatccagcgaagaacccggttacggctgaaagggcacggggaagcaatgccactccaccggtatggagtgggggaggctgcggtgggggccgaggctggcgaggcaacgctggggggaggcggtggtggggggtccgtggcctcccctacatcctcgtccggtagctccagccggggaactgagcggccacggtcacttaagagagggagcaaaccaagtgcgtcaagtgcatctctcgagaaacgtatgaagatggtctctcagtctttcacccagagatttcggctgagcagagatagaaaggtcgctaagagtctcgctgtcatcgtgtcaatctttggactatgctgggccccctacactctgctcatgataattcgtgctgcctgccatggccactgcgtccctgattactggtatgagacttcattttggttgctgtgggcaaatagtgccgtgaatcccgttctgtaccccctctgccatcacagttttcgtcgtgccttcactaagcttctctgtcctcaaaaactcaaaatacaaccacatagcagcctcgaacactgctggaagtag

SEQ ID NO: 12052 - DNA, 396 bp, Artificial Sequence
  Description of Artificial Sequence: Synthetic coding sequence
atgagcggcagggggaagcaggggggtaaggcccgggccaagtccaagagcagatcatcaagggccggactgcagtttcctgtgggacgcattcaccgcctcctcaggaaaggtaactatgcggaacggatcggggcgggcgcacctgtgtatctggctgcagtgttggagtatctgacagccgagatcctcgaactggccggtaatgcttctagggacaacaagaaaaccaggatcattccacggcatttacagctggctatacgcaacgatgaagagttgaataaactactcgggggcgtcactatcgcccaggggggagtgctgcctaatattcaggcagtgttgttacccaagaagaccgagtcccaccaccataaggctcaaagtaagtag

SEQ ID NO: 12053 - DNA, 393 bp, Artificial Sequence
  Description of Artificial Sequence: Synthetic coding sequence
atgtcgggaaggggaaagcagggaggcaaagcacgcgctaaggcaaagactcggagcagtcgggctgggctgcagtttccagtgggacgagtgcacagactccttcgcaagggtaactacgctgaacgggttggcgcgggcgcgccggtgtacttggctgccgtcctggagtatttgacggccgagatattagagctggctgggaatgccgcacgcgataataaaaaaacccgtataatacctcgccacctgcagttggcgattcgcaatgatgaggagctcaataagctgttgggcaaggttaccattgcccaggggggagtgctgccgaatatccaggcagtgctgctgccaaagaagactgaaagtcatcataaggccaaaggtaagtag

SEQ ID NO: 12054 - DNA, 387 bp, Artificial Sequence
  Description of Artificial Sequence: Synthetic coding sequence
atgagtggcagagggaaacaaggggggaaagcacgcgcaaaggcgaagactaggtcaagccgggcaggcctgcagtttccagtgggcagagtccatcggcttctgcggaaaggcaattacgccgagagggtgggggccggagcccccgtctatctggctgcagtcctagagtacttaacagcggagattttggaactggctgggaacgccgctcgggacaataagaagactcggatcattcctaggcacttgcagctggccattcgaaacgacgaggaattgaacaagctgctaggaaaggtgacaattgctcaggggggtgtgcttcccaacattcaggccgtcctcctacccaaaaaaaccgagtctcatcacaaagcgaagtag

SEQ ID NO: 12055 - DNA, 381 bp, Artificial Sequence
  Description of Artificial Sequence: Synthetic coding sequence
atgcccgagcccgctaagtccgcacccgcgcctaagaagggcagtaagaaagccgtaacaaaggctcagaagaaagacgggaagaagcgaaagcggtctcgaaaagagagttactctatctatgtttataaggtcctgaaacaggtccaccccgataccggcatttcatcaaaggccatgggtatcatgaattctttcgtcaacgatatattcgagaggatcgccggtgaggcatcccggcttgcccactacaataagagaagtacaatcacttccagggagattcaaactgcggttagactgctcctgcctggcgagttggccaagcatgcggtgtctgaaggaaccaaggctgttaccaagtacacctcagccaagtag

SEQ ID NO: 12056 - DNA, 381 bp, Artificial Sequence
  Description of Artificial Sequence: Synthetic coding sequence
atgcccgagcccgcaaagtcagcccccgcaccgaaaaaggggtctaagaaggctgtaactaaggcccagaagaaggatggtaagaaaaggaaacgaagccggaaggagtcgtacagtatttatgtgtacaaggtgctgaaacaagtccatcctgatactggcatctctagtaaggccatgggaattatgaacagcttcgtgaacgacatttttgagagaatcgctggggaagccagcagactggcacattataacaagcggtctacgattaccagtagagagattcagactgccgtgagactgttgttacccggagaattggctaagcatgctgtctctgaggggacaaaggccgttactaagtatactagcgccaagtag

SEQ ID NO: 12057 - DNA, 381 bp, Artificial Sequence
  Description of Artificial Sequence: Synthetic coding sequence
atgcctgaacccgcgaagtctgctccagcgccaaaaaaaggctctaagaaggcagtcactaaggcacagaaaaaggacggcaagaaacgaaagagaagcaggaaggagagctacagcgtctatgtgtataaagtgttgaagcaagtgcaccccgacaccggaatttcctccaaagctatgggtataatgaactcttttgtcaatgacatcttcgagcggatcgcaggagaagctagtcgcttagcccactataataaacgctctacaattacatcacgggaaatacaaactgccgtgcggttgttgcttcccggcgaattggccaaacacgccgtgagcgagggaacgaaggctgtgacgaagtatacttccgcgaagtag

SEQ ID NO: 12058 - DNA, 381 bp, Artificial Sequence
  Description of Artificial Sequence: Synthetic coding sequence
atgcccgagccggccaaatccgcaccggcacctaagaagggttccaaaaaagctgtgacaaaggcgcagaaaaaggatggcaaaaagcgcaagaggtcaagaaaagagagctattccgtttacgtctataaggtcctcaagcaggtccatcccgatactggcattagcagtaaggctatgggcattatgaactcttttgtgaatgatattttcgaacggattgccggtgaggcctctaggctggcccattacaacaagcgtagcaccattacatcgagagaaattcaaaccgccgtccggttgttgcttcccggcgagctggccaagcatgcagtaagcgagggcactaaagcagttaccaaatacacgtcggcaaaatag

SEQ ID NO: 12059 - DNA, 393 bp, Artificial Sequence
  Description of Artificial Sequence: Synthetic coding sequence
atgagtggacgaggcaaacagggagggaaggctcgggctaaagctaagtcacgttcctcacgcgccggtctgcaattccctgtgggccgggtccataggctactgcgaaagggaaactacgcagagcgggtcggcgctggggctccagtttatatggccgccgtgttggagtacttaaccgccgagattcttgaactcgctggtaatgcggcccgcgacaataagaaaaccagaataatcccccggcacctgcagctggcaattcgcaatgacgaggaattgaacaaactgctgggaaaggtcaccattgctcaaggcggcgtgctccccaatatacaggccgtcctcctgcctaaaaaaacggagagccatcataaagctaagggaaagtag

SEQ ID NO: 12060 - DNA, 393 bp, Artificial Sequence
  Description of Artificial Sequence: Synthetic coding sequence
atgtcaggccgcggcaagcaggggggcaaggcacgcgccaaagccaagagcaggtcaagtcgggccgggctccagtttcccgtggggcgagtccaccgacttctgcggaaaggaaactatgcagaaagggtgggtgccggcgcgccagtgtatatggctgccgttctggagtatctcaccgccgagatcctggaacttgccggaaatgccgccagagacaataagaagacccgtatcatacccaggcatcttcaattagctatcagaaacgacgaggagttgaacaaactgcttggcaaagtcacaatcgcacaggggggagtcttgcccaatatccaggcagtactcctgcccaagaaaactgagtcccaccataaggcaaagggaaagtag

SEQ ID NO: 12061 - DNA, 393 bp, Artificial Sequence
  Description of Artificial Sequence: Synthetic coding sequence
atgagtggacgaggcaaacagggtgggaaggctcgggcaaaagctaaaagtagaagctccagagcaggtctacagttccctgtgggccgcgtgcatcgactactgaggaaaggtaattacgcagagagagtaggcgccggtgcccccgtttatcttgctgccgtgctggagtatctcacagctgaaatattagagctggccggcaatgctgcccgcgataataagaagacccgcattattcctcgacatctgcagctcgccgttcggaacgatgaggagttgaacaaactgttaggtggcgttaccattgcacaaggcggagtgttgcctaatatccaggcagtgttgctgccgaaaaaaacagagtcacacaagccaggcaaaaataaatag

SEQ ID NO: 12062 - DNA, 381 bp, Artificial Sequence
  Description of Artificial Sequence: Synthetic coding sequence
atgccagaccccgcgaaaagtgcaccagcgccaaagaaaggctccaagaaggcggtgaccaaagttcaaaaaaaagatggtaagaagcgaaagagatcgcggaaggaatcctactccgtgtacgtatacaaggtcttaaaacaggtgcaccccgacaccgggatttcctctaaagccatgggcatcatgaatagctttgtaaacgatattttcgagcggatcgcgggggaggcgtcacggttggctcactacaataagcgcagtaccatcacaagtcgtgagattcagacagcagtgaggctactgttgcctggggaactggcaaaacatgctgtgagcgagggcaccaaagcagtgacaaagtataccagttctaagtag

SEQ ID NO: 12063 - DNA, 501 bp, Artificial Sequence
  Description of Artificial Sequence: Synthetic coding sequence
atgccagacccagctaagtccgctccagccccaaaaaaggggtccaagaaggccgtgactaaggtacagaaaaaagatggcaagaagaggaagcggagcagaaaggaaagttatagtgtatatgtgtataaagtcttgaagcaggtccaccctgataccggcatttcttcaaaggccatgggaatcatgaattcatttgttaatgacatcttcgaaagaattgccggggaagcaagcaggcttgcccattacaacaagcggagtacgattactagccgggaaattcagaccgctgtgcgcctgctgctccccggagagttggcgaagcatgccgtgtctgaaggcacgaaggctgtgacgaagtacaccagcagcaatcccagaaacctgagccccacaaagcccggaggatcagaagacaggcagccaccgccctcacaactctccgctatcccccccttttgcttggtgctgagggcgggaatcgccggccaagtatag

SEQ ID NO: 12064 - DNA, 405 bp, Artificial Sequence
  Description of Artificial Sequence: Synthetic coding sequence
atgcctgacccagcaaagagcgccccggctcctaagaaggggtccaagaaagctgtgaccaaggtgcaaaagaaggacggcaaaaaaaggaagcgttcacgaaaggaatcgtacagcgtgtacgtgtacaaggtacttaaacaggtccaccccgatacgggcattagttcaaaagcaatggggataatgaattccttcgtgaatgacattttcgagaggattgccggggaagcttcccggctggcccactacaacaagagatcaacgattacaagtagagaaatccagactgcagtcagattactcttgcctggcgagcttgcgaagcatgccgtttccgaagggaccaaggccgtcaccaaatatacaagtagcaaactaattggtccaatcctatggaagtag

SEQ ID NO: 12065 - DNA, 411 bp, Artificial Sequence
  Description of Artificial Sequence: Synthetic coding sequence
atggccagaacaaaacagacggctcgtaagagcacgggggggaaagcgcccagaaagcagctggctacgaaagccgcgcgtaagtccgcccctgcaaccggaggcgtcaaaaaaccccataggtatagacccgggaccgtggcactgcgagagatccgaagataccagaaatccaccgagctgcttatccgaaagctccctttccaaaggctggtgcgcgagatagcccaggagtttaagaccgacctacggttccagtcttctgccgttatggcactgcaggaggcacgcgaggcttatctcgtggggctgtttgaggacactaatctttgcgctattcatgctaagagggttactattatgccaaaggatatccagctggtgagtaggatacgcggggagcgtgcttag

SEQ ID NO: 12066 - DNA, 393 bp, Artificial Sequence
  Description of Artificial Sequence: Synthetic coding sequence
atgtctgggcggggaaaacagggtggcaaggccagagccaaggcaaagagtagaagctctcgagccggtctgcagtttcccgtcgggagagtccacagactcctgcggaaaggtaattacagtgagcgcgtgggggctggcgcccctgtttacttagcagccgtcctagagtatctgaccgctgaaattttggaactggccggcaatgccgccagggataataagaaaacaaggatcatcccaagacatttgcagctggccatccggaacgacgaggagcttaacaaacttctgggtcgcgttacgatcgctcaaggcggcgttctgcccaacatccaggccgttcttctgcctaaaaagactgaaagtcatcacaaggcgaagggaaaatag

SEQ ID NO: 12067 - DNA, 381 bp, Artificial Sequence
  Description of Artificial Sequence: Synthetic coding sequence
atgccggacccttcaaaatcagccccagcacccaagaaagggagcaagaaagcagtcacaaaagcccaaaagaaggatggtaaaaaaagaaaacgagggagaaaagaatcatattccatatatgtgtacaaggtgttaaaacaggtccatccagacacaggtatctccagtaaagctatgggtatcatgaactcctttgttaacgacatttttgagaggattgccagtgaggctagtcgcctcgcccactataacaaacgatccaccattacatcgagagaagttcagactgccgtaagacttctgctcccgggtgagctcgctaagcacgcggtatcagaagggactaaggcagtgacgaagtacacaagctcgaaatag

SEQ ID NO: 12068 - DNA, 1554 bp, Artificial Sequence
  Description of Artificial Sequence: Synthetic coding sequence
atgccacctcctggaaaggtgcccagaaaggagaatctgtggctgcaatgtgagtgggggtcctgttcttttgtatgttccactatggaaaaattctttgagcatgtcacccagcatctgcagcagcaccttcacggctccggtgaagaggaggaggaagaagaagaggacgatcccctcgaggaggagtttagctgtttgtggcaggagtgtgggttttgctcccttgattcctcagcagacttaataagacacgtatactttcactgttaccacactaagctcaagcaatggggcctgcaggcactgcaatctcaggccgacctgggtccctgcattcttgactttcagtctagaaatgtcattccagacattccagaccacttcctgtgtctctgggaacactgtgaaaatagcttcgataatcccgagtggttttatcggcacgtcgaggctcactccctttgttgtgagtatgaagccgtggggaaagataatcccgtggtgctatgtggatggaaaggctgtacctgtacatttaaggatcgaagtaagctgcgcgagcacctgcgctcccacacccaggagaaggtggtcgcttgcccaacctgtggcggcatgtttgctaacaatacgaagtttctggaccatatccgccgccagaccagccttgaccaacagcacttccagtgcagccactgtagcaagcgctttgccacggagcggttgcttagagaccacatgcgcaaccacgtaaaccattacaaatgtccactctgtgatatgacctgcccgttaccgtcctcgttacgaaaccatatgaggtttaggcatagcgaagatagacctttcaagtgtgattgctgcgattactcctgcaagaacctgatagacctccagaagcatttagacactcactccgaagaacctgcgtataggtgcgacttcgaaaactgcacattcagtgcgcggagtctttgctcaattaaatcacactacagaaaggtgcatgagggagattccgaaccacgttataaatgtcacgtctgcgacaaatgttttactagaggaaacaacctgactgtccacttgaggaaaaagcaccagtttaagtggccctccggacatccgcggttccgctataaagagcatgaggacggatacatgcggctccaactcgtgcgctacgaatcggtggagttgacacaacaactgctccgtcaaccccaggaagggtctgggctgggaacgagtctgaacgaatcttcactccagggtatcattctggagaccgtgcctggtgagccgggaagaaaggaagaggaggaagagggaaaggggtcagaggggactgcacttagcgcctcccaggataatcccagcagcgtaatacacgtggtgaatcagaccaacgcccagggccagcaggaaatagtatactatgttctgagcgaggcccctggagaaccccccccagccccagagcctccgagcggaggaataatggagaaactacaaggcatcgcagaggaaccagagatccagatggtttag

SEQ ID NO: 12069 - DNA, 1260 bp, Artificial Sequence
  Description of Artificial Sequence: Synthetic coding sequence
atgccaccaccagggaaggttccgcgaaaggagaacctctggttgcagtgcgagtggggctcgtgcagttttgtgtgctccacaatggaaaagttcttcgagcacgtgacgcagcacctgcaacaacaccttcacggcagtggagaggaagaggaagaagaggaggaagatgacccactcgaagaggaattctcctgtctttggcaggaatgcgggttttgtagcctcgattcaagtgcagacctcatccgtcatgtgtactttcattgttaccacactaagctgaagcagtggggcctgcaggctctgcaatctcaagccgacctgggcccctgcatcctggacttccaatcccgcaatgttatccccgacatccccgatcacttcctgtgcctctgggagcactgtgagaatagcttcgacaatcccgagtggttttatcggcacgttgaggcgcacagtttgtgctgcgagtacgaggcggtaggtaaggacaacccggttgtcctgtgtgggtggaagggttgcacatgtacatttaaggatcggtccaaactgcgggaacatttgagaagccatactcaagaaaaggtagttgcttgccccacatgcggaggaatgttcgcaaataacaccaagttcttggatcacatcagacggcagacctcgctggaccaacagcacttccagtgtagccattgttcaaagcgcttcgcaacagaacgccttcttcgagatcatatgcgaaaccacgtcaatcactataagtgtcccttgtgcgatatgacgtgtccccttcctagcagcctccggaaccacatgcgatttaggcacagcgaggatcgccctttcaaatgtgactgttgcgactattcctgtaaaaaccttattgatttacagaaacacctggacactcattctgaggaacccgcctaccgttgtgattttgaaaactgtacctttagtgccaggtccctctgctctatcaaaagtcattaccgcaaggtgcacgaaggcgacagtgaaccccggtacaagtgtcatgtctgcgacaaatgctttacacgtggtaacaacttaaccgtgcacctcagaaagaagcaccagttcaagtggccttccgggcatccgaggttccgcctcgggcacttttgcatcccgctccccgggttcgcagccctctacgcacccactagcccgggcacccggaacatgaagatggccatttgcggatgtagttggtttgctacgagggtgtag

SEQ ID NO: 12070 - DNA, 306 bp, Artificial Sequence
  Description of Artificial Sequence: Synthetic coding sequence
atgaaccttgagcgtgtgagtaacgaggagaaactcaatttgtgtcggaaatattacttggggggtttcgccttcctcccctttctttggcttgtcaatatcttctggttttttagagaagcctttctggtccctgcctatactgagcagtcgcagatcaaaggctacgtttggcgaagtgcagtcggattcttattttgggtgatcgtgctgactagctggattacgatctttcagatttacaggccaaggtggggagccttaggagactacctgagcttcaccatcccgctcggtactccatag

SEQ ID NO: 12071 - DNA, 1749 bp, Artificial Sequence
  Description of Artificial Sequence: Synthetic coding sequence
atggcggctgcggcaggaggtgggtcctgtcccggaccagggagcgcccgaggccgcttccccggacgccctcgaggtgctgggggaggcggggggcgcggcggacgcgggaacggcgctgaaagagtccgcgtggcccttagaagaggtggaggagccaccggaccaggaggggcggagcctggcgaggacacagcccttttaagacttctcgggctgcgaaggggccttcggagactcaggaggctctgggccggtccgagggtccagcgtggaagaggcaggggccgtgggcgcggctggggcccatctcgcggttgtgtgccagaggaggagagttcagacggggagtctgacgaagaggagtttcaggggtttcatagcgatgaagatgtggccccgagctctttacgaagtgcccttcgcagccagcggggccgggctcctagagggcggggccgtaaacataagactactcctctgcctccacccagactcgcggacgtcgcaccgacgccgcctaaaacaccggcacggaagcggggggaagagggaactgagcggatggtacaagccctaacggagctgctgcgccgcgcccaggcgccccaggcgccgcgatcacgagcatgcgagcccagcacacctagaagaagccggggaagaccccccggcaggcccgctgggccatgtaggaggaaacagcaggctgttgtggtggccgaagccgctgtaacaatccccaagcctgaaccgccaccacccgtggttcctgtgaagcaccagacggggtcatggaaatgtaaggaaggccctggccccggcccaggaacaccccgtcggggcggccagtcatctagaggaggacggggcgggcgcggaagaggcaggggtggtggcttacctttcgttattaagttcgtgtctcgcgccaagaaggtgaaaatgggacagcttagcctcggccttgaatcaggtcaaggtcagggacagcatgaagagtcttggcaagacgtgcctcagaggcgcgttggaagcgggcaaggaggttctccatgttggaaaaagcaggagcagaaactggatgatgaagaagaggaaaaaaaggaagaggaggaaaaggacaaagagggggaggaaaaggaagaacgcgctgtggctgaagaaatgatgccagctgcggagaaggaggaagccaagctgccccctcccccgctgacccccccagctccgagccccccccctccattgcctccaccctccacaagccctcccccccctctgtgcccacctcctccccccccagtgagcccccctcccctgccaagcccccccccaccccccgcccaggaagaacaggaagaaagccccccacctgtcgtcccagctacatgctcccggaagagaggcagacctcccttaacacctagtcagagagccgagagggaggctgccagagccggcccggaaggaacatccccccccaccccgaccccttccactgccaccggcggccctcccgaagacagcccaaccgtcgcaccaaagagcaccaccttcctgaagaatattcggcaatttatcatgccagtcccactgtcacagtcactgctcctgcccatgaccctgcagctgagcctgagcctggggcaatgggccgcccctactaccagcgcctgccttgactcacccttatggtcaccactgctgctccggccacggtgcccacttactggcttgcagctgtag

SEQ ID NO: 12072 - DNA, 8148 bp, Artificial Sequence
  Description of Artificial Sequence: Synthetic coding sequence
atggctgcagcagccgggggaggtagctgtcccgggcccgggagcgcccggggcaggtttcctggacggcctaggggtgccgggggcggtgggggcaggggtggccgcggaaacggcgctgaacgtgtgagggtggcactgagaagaggcggcggtgcaactggtcctggcggtgccgagcccggtgaagatacggccctcctaagactcttgggattgaggcgcggcctgagacgcctcaggcgcttgtgggcaggtcctcgtgtgcaacgaggtagaggccgtgggagaggacggggctgggggcccagtcgaggatgtgtccctgaggaagaatcctcagacggggagagcgatgaagaagagtttcaggggtttcactccgacgaggatgtggccccctcctcactgagatctgctctccgaagccagaggggccgggcgcctagagggcgaggacggaagcataagactacacctttacccccacctagactcgcggatgtggcgcctacccccccaaagacccctgcaagaaaaaggggcgaagaaggtaccgagagaatggtgcaggctttaacggagctgttaaggagggcacaggcacctcaggcccccaggtcaagagcttgcgagccctcgactccccggcgctcgcgtgggagaccacctggacgccccgctggaccgtgccgtcggaagcagcaagcagtcgtggtggccgaagcggcggtcacaattccaaagcccgaaccacctccccctgtggtacccgtgaagcaccagactggtagctggaagtgtaaggaaggcccaggacctggtcctggaacaccccggcgaggcgggcagtcgtcaaggggcggccgcgggggcaggggccggggcagagggggtggcctgccctttgtaattaagttcgtgtcccgagcgaagaaggtgaaaatgggccagctctcacttggattggagtctggacagggtcaaggtcagcatgaagagtcttggcaggatgtgccacagcgcagggtcgggtctggccaggggggctctccctgctggaagaaacaggagcagaagctcgatgacgaggaggaagaaaagaaggaggaagaggaaaaagacaaagaaggggaagagaaggaagagcgggccgtcgctgaagagatgatgccagccgccgagaaggaggaggctaagttgcccccaccacccttgacaccccccgccccttcgccacctcccccactaccaccacctagtacttcaccaccaccccctctttgccccccgcctcccccaccagtttctccccctccattaccatcccccccaccgccaccagctcaggaggagcaggaagagtccccaccccccgtggtgcctgccacctgcagccggaagcggggcagaccacctctgactccatcccaaagagcggagcgggaggcagcccgggcgggaccagaaggcacatcccccccaaccccaaccccgagcactgccactgggggaccccccgaagattcccccacggtcgcccccaaaagcacaaccttcttgaagaacatccgtcagttcatcatgcctgtggtatctgcccgtagttccagagtgatcaaaaccccacgtaggtttatggacgaagacccccctaaacctcccaaagtcgaggtgtcaccagtcttaagaccccctataaccaccagtcccccagtaccccaggaacccgctccagtaccatcccctccacgggcaccaacaccacccagcactcccgtaccgctgcccgagaagcgccgctccatattgcgggagcctacatttcgctggacgtcactcacccgcgagctcccgccccctccccctgcccccccccccccacctgcccctagtcctccccccgcccccgccacaagtagcaggaggccccttcttctcagggctccgcagttcactccttccgaggctcacctgaaaatttacgaaagtgtcctgaccccgcctcccctgggagcaccagaggcaccagaacccgagccaccacccgctgacgactctcccgccgagcccgaacccagagccgtgggccgcacgaatcatctctcactccctcgatttgcgccagtggttaccactccagtcaaggctgaggtgtcacctcatggagcgccagccctgagcaatggaccccagacacaagctcagctgttgcaaccactgcaagctctccagacccagctgctcccccaggcactcccccccccgcagccccaactccagcccccaccctccccacagcagatgccaccactcgaaaaagctaggattgccggcgttggttcacttccactttccggtgtcgaagagaaaatgttttccttactgaagagggctaaggttcagctgttcaaaatcgatcagcagcagcagcagaaggtagctgcctccatgcccctttctcccggagggcagatggaggaggtggcgggagccgttaagcagatctctgatagggggcccgtgagaagtgaagacgaaagcgtggaggctaagagggaaaggcccagtgggcctgagagtcccgtacaaggaccccgcatcaaacatgtatgcagacacgccgctgtggcattggggcaggcgcgtgccatggtgcccgaagatgtgcccagactgagcgctctgcccctgcgggacagacaggacctggcgaccgaggatacctcatccgcgagtgagacggaatccgtgccctccagatcccgacgcgggaaggtcgaggccgcgggtcccgggggggaaagcgagccaacaggcagcggcggtaccctggctcatacaccccggagatccctccctagccatcacggaaagaaaatgcgtatggcccggtgcggccactgtagaggatgtctacgcgttcaggactgtggctcttgtgtgaattgccttgataagcctaagtttggcggcccaaatacaaaaaagcagtgctgcgtgtatagaaagtgcgataaaattgaggcccgcaagatggagcgactggcgaaaaaggggcgcacaatagttaaaaccttgctgccatgggactccgacgagtctcctgaagcaagtcctgggccacctggacctaggcggggtgccggcgccggcggccctcgcgaagaggtagttgcccatccgggcccagaggaacaagatagtctgttgcagagaaaatccgcccgtagatgtgtcaagcagcgaccatcctatgacatttttgaagactctgacgattcagaacccggaggcccaccagctcccaggcggcgtacacctcgcgagaatgagctaccgctccctgagccagaggagcagagcagacctagaaaacccacactgcagcctgtcctgcagctaaaggcacgacgcagactggataaggacgctcttgccccgggcccttttgcaagcttccctaacggctggaccggcaaacagaagtccccagatggcgttcaccgggtgcgggtcgacttcaaagaggattgtgatttggaaaacgtctggcttatgggcggcctctctgtccttaccagtgtccctggcggacctccaatggtctgtctcctctgtgcatccaagggcctgcatgaactggtgttttgccaggtatgttgcgatcctttccatcccttctgtctggaagaggctgagcgccccctgcctcagcatcacgacacttggtgctgccggaggtgtaagttctgtcacgtgtgcggtaggaaggggcgtggttcaaaacacttgcttgagtgcgagaggtgtagacacgcctaccatccagcctgtctggggcccagctatccaaccagagccactcggaaacggcgacattggatctgtagtgcatgcgtgagatgcaaaagttgcggtgccacaccagggaagaactgggacgtcgaatggtcgggggactactcactttgcccacgctgcacccaactgtacgaaaaggggaactactgcccaatctgcacaaggtgctacgaggataacgactacgagtctaagatgatgcagtgcgcccagtgcgaccattgggtgcacgcaaaatgcgagggactgtcggacgaggactatgagattttgtcaggtctgcccgacagtgtgctatacacatgtggtccctgtgcgggtgccgcgcagccacgctggcgcgaggccctatccggcgccctccaggggggtctccgccaggtgttgcaagggttgctcagcagcaaagtggtgggtccactcttactgtgcacacagtgtggacctgatgggaaacagctgcaccccggcccctgcgggttacaggcggtaagccagaggtttgaagacggtcattacaagtccgtccatagctttatggaagacatggtgggaattctcatgagacatagcgaggagggggagactcctgatagacgcgccggagggcagatgaagggattattactcaagcttctcgagagcgccttcgggtggtttgatgctcacgatcccaagtactggagaaggagcacaaggttaccaaacggcgtcctgccgaacgctgtgctccctcctagtctggaccacgtctatgcgcaatggcgccagcaggaaccggaaacacccgagtctggacagcctccaggggacccctccgccgctttccaggggaaggatcctgctgctttctctcaccttgaggacccgaggcagtgcgcactgtgtttaaagtacggcgatgctgactcaaaagaggcaggacgtttactgtatattggccagaacgagtggacccacgtgaattgcgctatctggagtgccgaagtgtttgaggaaaacgatgggagccttaagaatgttcatgccgcagtggctcgagggcggcagatgcgatgcgaactttgcctcaagccaggcgccacggtgggctgttgtctttcctcctgcctcagcaatttccattttatgtgtgcacgagcaagctactgcatcttccaagatgataagaaggtattttgccagaaacacacggaccttctagacgggaaagaaattgtgaaccccgacggattcgatgtgctcagaagagtgtacgtggactttgaaggtattaacttcaaacgcaagtttctcaccgggctcgagcctgacgcaattaacgtgttgatagggagcatcaggattgactccctgggaacactgagtgacctgagcgactgcgaagggcggttgttcccaatcggttatcagtgttcaaggctgtactggagcactgtcgatgcgcgccgccggtgttggtataggtgtcgaattttggaataccggccctgggggccgcgggaagagcccgcccacttagaagcagccgaagagaatcagactatcgtgcactctcctgcaccttccagtgaaccgcccggcggagaagacccgccgctagataccgacgtgctggtgccaggcgcccccgaaagacacagcccaatacaaaatctggatccgcccctgcgtcctgattctggcagtgcccctcctcccgctcccagaagcttctcaggcgcacggattaaagtgccgaactactcccccagcaggaggccactgggaggtgtatcttttggaccgttaccttccccaggttcacccagttctctgacacaccacatcccaaccgtaggggatccagatttcccagctccaccacgccggtcaagaaggccaagcccattagctccaaggccgccacccagtcggtgggcctccccccctttgaaaacctcacctcagcttcgagtacccccccctactagcgtcgtgacagctctaacacctacaagtggagaactggccccccccggacccgccccatcacccccacccccagaggatctgggccccgactttgaagacatggaggtagtttccggtctcagcgcagctgatttggacttcgccgcatccctccttggaacagagcctttccaggaggaaattgtagccgccggcgctatgggtagttcccatggcggaccgggcgattcttccgaagaggaaagcagcccgacgtccagatatattcatttccccgttactgttgtgtctgcaccaggactggccccgtccgccacccctggagcacctcgcatagagcagctggatggtgtcgatgacggcaccgattcagaggcagaagccgtgcaacaacctagggggcaggggacacctccctctggcccgggagtggtccgtgcgggagtgctgggtgccgcaggggacagagcaagacctccagaggatctcccgtccgaaatagtggatttcgtcttgaagaaccttggcgggcccggtgatggaggagcagggccgcgcgaagagtctctgcctcccgctcctcctctagctaacggatcccagccctctcagggactgactgcatcacccgctgaccccactaggacattcgcctggttgcccggcgctcctggagtcagagtgctctcgctgggacccgctcccgaaccacctaagcctgccacaagcaagatcatcctggtgaacaagttgggacaagtgtttgtcaagatggccggcgagggcgagcccgtgccccccccggtgaagcagcctcctctgccacccacaatcagccctaccgcccccactagttggaccttaccaccaggccccttactcggagtcttacctgtggtgggtgtagtgcgcccggccccaccccctccaccaccacccctcactttggtgctaagctctggtccagcctctcctccccgccaggctatacgggtgaagagggtctctaccttctccggaagatccccccccgcccctcccccatacaaggccccacggctggacgaagacggggaagcttccgaagacactccgcaggtgcctggcttaggttccggtgggtttagtcgagtcagaatgaagacgcctaccgtgagaggcgtcctggatctcgacaggccaggggaacccgctggcgaggaatcgccaggccccttgcaggaacgtagtcccttactcccactgccagaagacggacctccacaggttccagacgggccgcccgacctcctgctggaatcccagtggcaccactactcaggggaggcctcctcatccgaggaagagcctccttccccagacgacaaagagaatcaggctcccaagagaaccgggcctcatctgcgctttgaaatttcctcagaagacggtttctccgtggaagctgaatcacttgagggggcatggagaaccttaatagagaaggtccaggaggcacgaggtcacgccaggctgcggcacctaagtttctctggcatgagcggtgcgaggcttctcggaattcaccatgatgccgtcatctttctggctgagcaactgcccggagcgcagaggtgccaacattacaaattccgttaccatcagcagggtgagggacaggaagagccccccctgaaccctcacggggccgctagagctgaagtctacctccgaaagtgtacattcgatatgtttaacttcctggcctctcagcaccgagtcctcccagaaggggccacttgtgacgaggaggaggacgaggtgcagctgcggtccacacgccgcgccacaagcctcgaactgcccatggccatgcgattcaggcacctcaagaaaacttcgaaggaggcggtgggggtgtaccgctcggccattcatgggagggggctcttttgcaaacggaatattgacgcaggcgaaatggtcatcgaatactccgggatagttatccggagcgtactgactgataagcgggaaaaattctacgatggtaagggcattggatgctatatgttccgaatggatgatttcgacgtcgtggacgcgacgatgcacggtaatgccgcacgcttcatcaaccacagttgcgagccaaactgcttctccagagtcatccacgtggagggtcagaagcacatcgttatcttcgcactgagaagaatccttagaggggaagagttgacatacgattacaagtttcccattgaagacgcatccaacaagctgccatgcaattgcggtgcaaagcgatgccgaaggttcctcaactag

SEQ ID NO: 12073 - DNA, 2892 bp, Artificial Sequence
  Description of Artificial Sequence: Synthetic coding sequence
atggccgtggcgccgcgcttattcggtggtttgtgcttcaggttccgcgaccagaatccagaggtcgcagtcgagggtcgcttgcccatttctcactcttgcgtgggttgccgccgggagcgaacagcgatggctacggtagctgctaacccggcagccgcggccgccgccgtggccgcagcagccgcagtgacggaggatcgggaaccccagcacgaagaacttccaggcctggacagccagtggcgccagattgagaatggtgaaagcgggagagaacgcccgctacgcgctggcgagtcctggttcttggtagagaaacattggtataaacagtgggaggcgtacgtccaaggtggagatcaggattcctcaacattcccagggtgtattaataatgccacgttgttccaagatgagattaattggcgtctcaaggagggcctagtggaaggcgaagattacgtcctgctacctgcagcagcctggcattatctcgttagctggtacggactggagcacgggcagccccctattgaacgaaaagtgatagaacttcctaatattcagaaagtggaagtttaccccgtagaattgctcctagtccgccataacgacctgggcaaatcccacactgtgcagttcagccataccgacagtattgggttggtcctaagaacagcccgcgagcgctttctcgtggagccccaggaagacacccggctgtgggccaagaactctgaagggtcgcttgaccggttgtacgacacacacatcacagtgttagatgctgcactggagaccggtcaactcataattatggagaccaggaagaaagacggcacatggcccagtgcacagttgcatgtcatgaacaataatatgagcgaggaggacgaggacttcaagggtcaacctggcatttgtggcttgactaacctggggaatacctgctttatgaattccgccctgcagtgcctgtctaacgttccacaactgactgagtacttcctaaacaattgctacttagaagagctcaatttccggaacccgctgggaatgaagggcgagattgcagaagcatacgccgacctggttaagcaagcatggtccggccaccacagaagtatcgtacctcacgtttttaagaacaaagtgggccacttcgcaagtcaatttctcggataccagcagcacgatagccaggagttgctgtcattcctgctcgacggtctacacgaagacctcaatagagtcaagaagaaagaatacgtcgaactctgtgacgctgccgggcggccagatcaggaagtggcccaggaggcctggcagaaccataagaggaggaacgactctgttatagtcgatacctttcacggactctttaagtccacattagtatgtccggactgcggcaacgtctccgtgacattcgaccctttctgttatctttcagttcctttgccgattagtcataaacgggttctcgaggtgtttttcattccaatggatccaaggcggaaaccagagcagcacagacttgtggtccccaaaaaggggaaaatttcagatttgtgtgtcgccctcagtaagcacaccgggatttcacccgagaggatgatggtagccgatgtcttctctcataggttctacaaactgtatcagctggaggagcctctcagttccatcctcgacagagatgacatcttcgtgtacgaagtgagcggccgaatcgaagcaattgaggggtcacgtgaggacatagtcgtgcctgtttacctaagggaacggacgcctgcaagagactacaataactcatattacgggttgatgttattcggccatcccctgctggttagcgtccccagagataggttcacgtgggaaggactctataacgtgctgatgtatcggctgtctagatatgtgaccaagccgaattcagatgatgaagacgacggcgacgagaaagaagacgacgaggaagataaagacgatgttcctggcccaagtacgggaggatctctgagggatcccgaacccgaacaggctgggccgagctcaggcgtgacaaacagatgtccgtttctgctcgataactgcctggggacctcccagtggcccccacggcggcggagaaagcaactctttactctccagaccgtgaacagtaatggaacatctgaccgaacaacaagccctgaagaggtccacgctcaaccatatatcgccattgactgggagcccgagatgaagaagcgctactacgacgaggtcgaagctgaaggctatgttaagcacgactgtgtaggctatgtgatgaagaaggctcctgtgcggctccaggagtgtattgaattgtttaccacagtcgaaactctggagaaggagaatccgtggtattgccccagctgtaagcagcatcagcttgcaacaaagaagcttgacttgtggatgctcccggagattctcatcattcacttgaagcggttctcttataccaagttctctagggagaagctcgacacattggtggagttccctatcagggatttagacttctcggaattcgtcatccagcctcagaatgaaagcaacccagagttgtacaaatacgacctgattgccgtttccaatcactacgggggcatgcgggacgggcattacacgacatttgcctgcaacaaggacagcggacagtggcactacttcgatgataattctgtgtctccagtgaacgagaaccaaattgagtccaaggctgcctacgttctgttctaccagcggcaagacgttgctcgacgtctcttatcacctgctgggtctagtggtgcgcccgccagccctgcatgttctagcccccccagtagtgagtttatggatgttaactag

SEQ ID NO: 12074 - DNA, 2166 bp, Artificial Sequence
  Description of Artificial Sequence: Synthetic coding sequence
atgtcgggaactaatctcgatggtaatgacgagttcgacgaacagctgagaatgcaggagctgtatggcgatggaaaggatggggatacccagacagatgccggcggagaaccagacagccttgggcagcaaccaactgacaccccctatgaatgggaccttgacaaaaaagcgtggttccctaagattacagaagatttcatagctacttaccaggctaactacgggttcagcaatgacggagccagctctagcaccgccaatgtagaggatgtacacgccaggaccgcggaagaacctccgcaggagaaggcacctgaaccaactgacgctcggaaaaaaggggagaagcgcaaagccgaaagtggctggtttcatgtggaagaagatcgcaatacaaacgtttacgtgtccggcctgcctcctgatattaccgtggacgagttcatacagctgatgagcaaattcggcattattatgcgcgatccccaaacagaggagtttaaagtcaaactctacaaggacaatcagggaaacctgaaaggggacggactgtgctgttacctgaaaagagagtccgtggagctggctctgaaattactggatgaagacgagattcgggggtataagctacacgtagaagtggctaaatttcagctgaagggcgaatatgacgcctccaagaaaaagaaaaaatgcaaggactacaaaaaaaagctgagcatgcagcagaaacagttggactggcggccagaaaggagggcgggcccctcacggatgcgtcatgagcgagtggttatcattaagaatatgttccaccccatggattttgaggatgatcctctggtcctgaatgaaatccgcgaagacctgcgagtggagtgtagcaaattcgggcagattaggaaactgctgctgtttgatcgccacccggacggggtggcctccgtatcgttccgggaccctgaagaggcggattactgcatccagactctcgatgggcggtggtttggggggagacaaatcactgctcaagcttgggacggcacaactgattaccaggtcgaggaaacgtccagggaacgagaggaaaggctaagaggttgggaggccttcctcaatgcccccgaagccaatagggggctacggcgtagtgactccgtcagtgcctctgaaagggcgggccccagtcgtgccaggcactttagcgagcatccatccacgtccaaaatgaacgcccaggagacagccaccggcatggctttcgaggagccaattgatgagaagaagttcgaaaaaaccgaggacgggggggaattcgaggaaggggcttcagagaataatgctaaagaaagctcccccgagaaagaggctgaggaaggctgtcctgagaaggagtccgaagaaggctgtccgaagcggggtttcgaaggttcgtgctctcaaaaagaaagtgaagagggaaaccccgtacgcgggtccgaggaagattctcccaaaaaggaaagcaaaaaaaaaacgctgaagaacgattgcgaagaaaacggactggctaaggagtctgaggacgatctgaataaagaatccgaagaagaagttgggcctaccaaagagagcgaggaagatgacagtgaaaaagaatcggacgaagattgctctgagaaacagtcagaggacggttcggagcgagaattcgaagagaacggattggaaaaggaccttgacgaagaaggcagcgaaaaggaactccatgagaacgtgctggacaaagagcttgaagagaacgactctgagaattccgagtttgaggacgacggcagcgaaaaagtcctagacgaggaggggagcgaacgtgagtttgacgaggattccgatgagaaggaagaagaagaagacacctacgagaaggtatttgacgacgagtcggacgagaaggaggacgaagatgccgacggaaaggaagttgaggacgcggacgagaagttattcgaagatgacgattcaaacgagaagctatttgacgaggaggaggacagcagcgaaaagctgtttgacgacagcgatgaacggggtacgctgggcggctttggctcagttgaggaggggccacttagtactgggtcctctttcatactgtcctctgacgacgatgacgatgacatctag

SEQ ID NO: 12075 - DNA, 672 bp, Artificial Sequence
  Description of Artificial Sequence: Synthetic coding sequence
atgtccggaaccaatttggacggaaacgacgagttcgatgagcagctacggatgcaggaactgtacggggatgggaaagacggtgacacacagactgacgcgggcggcgagccagatagcttaggtcagcagccaacggatactccatatgaatgggaccttgacaagaaagcctggtttcccaagataaccgaagactttatcgcgacgtaccaggccaattacggtttctctaacgacggcgcctcctctagtaccgccaatgtcgaagacgttcatgctcggacagccgaggaaccgcctcaggaaaaagcccctgaacctaccgatgcacgtaagaagggggagaaaagaaaagcggaatcagggtggttccacgtggaagaggaccggaacactaacgtttatgtgtctggtctacccccagatatcacagttgacgagttcattcagttgatgtcgaaattcggcatcattatgcgcgacccccaaactgaagaatttaaggtcaagctgtataaagacaatcaaggcaacttgaaaggtgatggactctgttgttatctgaagagagagtccgtggaacttgcactcaagcttctggatgaagacgagattagaggttataaactgcatgtggaagtggcaaagttccaactcaaaggggagtag

SEQ ID NO: 12076 - DNA, 735 bp, Artificial Sequence
  Description of Artificial Sequence: Synthetic coding sequence
atgtccggcactaatctggatggcaatgacgaattcgatgagcaactgaggatgcaagagctgtatggcgacggcaaagacggcgacacgcagacagatgcgggaggagagcccgactccctggggcaacagccgacggacacaccctacgaatgggatctggataaaaaggcttggtttccaaagatcaccgaggatttcatagccacctatcaggccaattatggctttagtaacgacggtgcttctagtagtactgcgaacgtcgaggacgtccacgcgcgcactgctgaagagcctccacaagaaaaagcccctgagcctaccgatgcgagaaaaaaaggtgagaagcggaaggctgaaagtggctggtttcatgtggaggaggaccgtaacaccaatgtctatgtgtccgggctccccccagacatcacagttgacgaattcattcagcttatgtccaagttcggcataattatgagagatccacaaactgaggagtttaaggtgaaactgtacaaggataaccagggcaatctcaagggtgacggcctctgctgttatctcaagagagagagcgtagagctggccctcaagctgctggatgaggacgagataagagggtacaagttgcatgtggaggtggccaaattccaactgaaaggagaatatgacgcctctaagaagaagaagaaatgtaaagattacaagaagaaacttagcatgcaacagtag

SEQ ID NO: 12077 - DNA, 2268 bp, Artificial Sequence
  Description of Artificial Sequence: Synthetic coding sequence
atgtctggcaccaatctggacggaaatgacgagttcgacgaacagttacgcatgcaggaactgtacggcgacggtaaagacggagacacacagacagatgctgggggagagcctgacagcctcggccagcaacctaccgatactccatacgaatgggatcttgataaaaaggcctggttcccaaaaatcaccgaggatttcattgctacttatcaagcaaattacggattctccaacgacggcgccagcagtagcactgccaatgttgaggatgttcacgccagaactgccgaggaacctcctcaggagaaggcgcctgaacccacagatgctcgcaagaaaggtgaaaagcggaaagcagaaagcgggtggtttcacgtggaagaggatcgcaacaccaacgtgtatgtgtccggcttaccccctgacatcactgttgacgagttcattcagttgatgtctaagtttggtattattatgagagatccccagaccgaagaattcaaggtgaaattgtacaaagataaccagggcaatttgaagggcgatggcctgtgctgctacctgaagcgcgaatccgtggagctcgccctcaagctcctggatgaagatgaaatccgcggctacaaattacatgtagaggtagccaagttccagctgaagggtgagtacgacgcaagcaaaaagaagaagaaatgtaaagactataagaaaaagttgtccatgcagcaaaagcagttggactggcgccctgagcggcgggccggcccttcaaggatgcggcatgagcgagtggtcataataaagaatatgttccaccctatggatttcgaggatgacccacttgtcctgaatgaaatcagagaagatctgcgtgtggagtgttctaagttcggtcagattagaaagctgctcctcttcgacagacaccctgacggcgtcgctagtgtgagttttcgcgaccctgaggaggcagattactgcatccagacactcgatggcagatggtttggggggcgtcagattacagcccaggcttgggacggcactactgactatcaagtggaggaaacctctagggagagagaggagcggctccgcggctgggaggccttcctaaacgctcctgaagccaacaggggcttgcgccgatccgactcggtatctgcctcagagagagcaggaccaagtagagcccgccatttctcagagcatccctcgacctccaaaatgaacgcacaggagaccgccaccggaatggccttcgaggaacccatcgacgaaaaaaagttcgaaaagaccgaggacggcggagaatttgaggagggggcttcagagaataatgcaaaggagtctagtccagagaaagaggcagaggagggatgccccgagaaggaatccgaggaggggtgccctaaacgcggcttcgagggcagctgttcccaaaaggagagcgaggaggggaatccggttcggggaagcgaggaagacagccctaagaaggaaagtaagaaaaagacactgaaaaacgactgtgaggaaaatgggttagccaaagagagtgaggacgacctaaataaggagtcagaggaggaggtgggtcctactaaggagtcggaggaggacgatagcgagaaagagtctgacgaagactgtagtgaaaaacagagcgaggatggtagtgaaagagagttcgaagagaacgggctagagaaagaccttgatgaagagggctctgagaaggaactccatgagaacgtcctcgacaaggagcttgaagaaaacgacagcgagaattccgagttcgaggacgacgggtccgaaaaggtcttagatgaagaaggttcagaacgagagtttgatgaggattcagacgaaaaagaagaagaagaagacacttacgaaaaggtctttgacgatgagtctgacgagaaagaagacgaagagtacgccgatgaaaagggcctggaagccgcagacaaaaaagccgaggagggcgatgcggatgagaagctgttcgaagagagtgacgataaggaggatgaggacgcagacggaaaagaagtcgaggatgccgatgagaagctctttgaggatgacgattctaacgaaaaactgttcgacgaggaggaggactcttccgagaaacttttcgacgattcggacgaaagaggaaccctggggggcttcggcagcgtggaggaagggcctttgagcacaggctcctccttcatcctgtcaagcgatgacgatgacgatgatatctag

SEQ ID NO: 12078 - DNA, 3879 bp, Artificial Sequence
  Description of Artificial Sequence: Synthetic coding sequence
atggacgctagctacgacggaaccgaagttaccgtcgtcatggaagaaatagaagaagcatattgttatacctcacctgggccgcccaaaaaaaaaaaaaagtacaagatccacggtgagaagactaaaaagccaaggtcagcctatctcctctactactatgatatctatctcaaagtgcagcaggaactgccacacctcccccaaagcgaaatcaataagaagattagcgagagctggcgactgctgagtgttgccgaacgctcctactaccttgagaaagcaaagctagagaaagagggactggatcccaatagcaagcttagcgcactcacggccgtcgtccccgacattccaggatttagaaaaatcctacccagatctgattatataatcatccccaaatcttccctgcaggaggatcgctcatgcccccaactagaactctgtgttgcccagaatcagatgagtccgaagggcccacctctggtgtctaatacggccccagagacggttcctagtcacgcggggatggcagagcagtgccttgcagtagaagcattagctgaagaggtcggagccttaacacagtccggagcggtccaggaaatcgctaccagtgaaattctgagccaggatgtcttgctggaagacgcaagcctggaggttggcgagtcccaccagccctaccagacttctctggtcattgaagagacccttgtaaatggttcgccggatctgccaaccggcagcttggccgttccgcatccacaggtgggggagagtgtcagcgtcgtcaccgtgatgagagactcctccgaatcaagttccagcgcccctgctacccaatttataatgctaccactgccggcatattcggttgtcgaaaaccctacatccattaaactcacaaccacttatacaaggcgcggacacggtacctgtacctcccctggttgtagttttacttacgtgacacgtcacaaaccccccaagtgcccaacatgtggtaatttcctgggcggcaagtggatccccaaggagaaacccgcgaaagtgaaggtagaactggcctcaggcgtaagtagtaagggatccgttgttaaaagaaatcaacagccagtgaccactgagcagaacagctccaaggaaaacgcctcaaagttaaccctggaaaatagcgaggccgtgtcacagctgctcaatgtagctcccccaagagaagttggcgaagaatcagaatgggaagaggtcattatttccgatgcacacgtcctggtcaaagaagcccctggaaattgcggcactgctgttaccaaaacccccgtagttaagtcaggagtacaacccgaggtcacactcgggactacagataacgacagccctggtgctgatgtgcccactccctctgaaggcacatctacatcttccccacttcctgccccaaagaagcccaccggcgcagacttgctgacccccgggtctcgagctcccgaacttaaaggccgggcccgcggcaaacccagcttattagcagcggcgcgtcccatgcgggcgattttgccagctcccgtgaatgtggggaggggatcgagcatgggactgcctcgggcacggcaagctttctctctatccgacaagactccgtccgtgaggacttgtggcctaaaaccctcaacgttaaagcagctcggacaacccatccagcaaccatccgggccgggtgaggtgaagctgccgtccggcccctctaatagaacaagtcaggtcaaggtggtggaggtgaagcctgatatgttccctccgtacaagtactcttgtactgtgactttggacctcggcctggcaacctctcggggccgagggaaatgcaaaaatccgtcctgcagttatgtgtacacaaataggcataaacctaggatttgcccttcatgtggggtgaacctggccaaggaccgcacggaaaagaccactaaggctattgaggtttcatctcctttgccggacgtcctcaatgccaccgagccactctcgacagcccagcgggagatccagcgtcaatctactctgcaactcctgcgaaaagtgttgcaaataccggagaacgaatctgaactggctgaggtcttcgccctcatacatgaactgaactcatccaggttaattttgagtaatgtatcagaggagaccgtcaccatcgaacagacctcctggagcaactattatgagagcccctccacccagtgtctgctgtgctcaagtcctctgttcaagggaggacagaacagtctggctgggcctcaggagtgttggttgttaacagcctccaggcttcagaccgtaactgctcaggtgaaaatgtgtcttaacccccactgcttagccttgcatagttttatagatatttatacggggttattcaacgtgggaaataagctgttagtcagcctggatctcctgttcgcaatacgcaatcagatcaaattgggagaggatcctagggtaagcatcaatgtggtattaaagtccgtccaggaacaaactgaaaagacactcacctcagaggaactgtcccagctgcaggagttgctgtgcaatggctactgggcttttgaatgtttgacggtgcgcgattataatgacatgatctgtggcatttgtggagtggcccccaaggtcgagatggcgcagagatctgaagaaaatgtgctggcccttaaaagcgtggagtttacgtggcccgagttcctggggagtaacgaggttaacgtcgaggatttctgggccactatggagaccgaggtgattgagcaggtagccttccctgcttccatcccaattactaaattcgatgcctccgtgattgccccctttttcccccccctcatgcgaggagccgtggttgtgaacactgagaaagacaagaatctggacgtccagccagtgcctggatccggctcggcattagttcgactgttacaggaaggaacctgcaagcttgacgagatcggctcttactccgaagaaaaactgcaacacctgctgagacagtgcggcatcccctttggggcagaagatagtaaagaccagctctgtttttccctgctggccttgtacgagtcagtacagaacggagcccgcgccataaggcctccacggcactttaccggtggaaagatatataaggtttgtccccaccaggtggtgtgtgggtcaaaatatttggtccggggggaaagtgcccgtgaccatgtggacctgctggcgtcctctagacactggcccccagtctacgtagttgatatggccacctctgtggccctttgtgcggacctgtgctaccccgaactcactaatcagatgtggggtagaaaccagggatgtttcagtagcccaaccgaacctcccgtgagcgtgtcttgtcccgagctgcttgaccagcattatacagtcgacatgaccgaaactgagcattctatccaacatcccgtaactaaaaccgccacccggcgaatcgtacacgcgggcctgcagcccaaccctggagatccatccgctgggcatcactctctagccctgtgccctgaacttgcaccctatgcaacaatcttggcctctatcgtcgactccaaacccaatggggtcaggcagagacccattgcctttgacaacgctacgcactactatctgtacaaccggttgatggacttcctcacgtccagagaaatcgtcaatagacagatccacgatatagtccaatcttgtcaaccaggagaagtggtgattcgcgacaccctttatcggttgggcgtggctcaaattaaaacagagacagaggaggaaggagaagaggaggaggttgcagcagtggccgaatag

SEQ ID NO: 12079 - DNA, 2310 bp, Artificial Sequence
  Description of Artificial Sequence: Synthetic coding sequence
atgtgtggcagcgccctggcattcttcaccgcagcatttgtgtgcctgcagaatgaccgcaggggccccgctagctttttgtgggccgcttgggtcttttccttagtgctagggctggggcagggtgaagataatagatgtgcctccagcaatgctgcatcctgtgcacgatgtctggcattgggacccgagtgtggctggtgcgtgcaagaggatttcatctctgggggctctagaagtgagcgttgtgacatcgtgtccaacctgatctctaaagggtgcagcgtggatagtatcgaatacccatccgtccatgtgatcatccctaccgagaacgagattaacacgcaggttaccccaggggaagtcagcatacagctacgacccggggctgaggctaacttcatgcttaaagtgcatccattgaagaagtacccagtggacttgtattacctcgttgatgtcagcgctagcatgcacaataacatcgagaaactaaactccgtgggtaacgacctgtccagaaagatggccttcttttctagagatttccgtctagggtttggctcctatgtcgacaagaccgtgtcaccttatatctccatccacccagagcgcatccataatcagtgctcagattacaatctcgactgtatgccccctcacggttatatccatgtgctgtctttgaccgagaacataactgaatttgaaaaggcagttcatagacagaaaattagtggaaatatagacactccggagggtggatttgacgccatgttacaagctgccgtttgcgaaagtcacattggatggcgtaaagaggccaagcgcctgctcctggtcatgaccgatcaaaccagccatctggcattggactctaaattggcaggcatagtcgttccgaacgacggaaattgtcatctgaaaaacaatgtatacgtcaagtccactacgatggaacatccgtcactcggccaattgtctgaaaagctgattgacaacaatatcaatgtcattttcgctgttcaggggaagcaattccattggtacaaagacctgctgccccttctgccagggacaatagctggggaaatcgaatccaaggccgctaatctaaataatttagtagtggaggcataccagaagttgatcagtgaggtgaaggttcaggtggagaaccaggtccagggtatatactttaatattacggctatttgtcctgacggtagccgcaagcctggcatggaaggttgtcggaacgtcacctccaatgacgaggtcctctttaacgtgaccgtgacgatgaagaagtgtgacgtcacaggaggaaagaattacgccatcatcaaacctatcggattcaatgagaccgctaagatacatatccacaggaattgctcttgccagtgcgaagacaatcgcggacccaaggggaagtgcgttgatgagaccttcctcgactccaagtgcttccaatgcgatgagaataaatgtcactttgatgaagatcagttttcctctgaaagctgcaaaagtcataaagatcagccagtgtgctctggccgcggtgtctgtgtgtgcggcaagtgttcctgtcacaaaatcaaactgggcaaggtgtacggcaagtactgcgaaaaggatgatttcagctgcccatatcatcatggaaacctgtgtgcgggtcacggcgaatgcgaggccggcaggtgccagtgcttctccggatgggagggtgatcggtgccagtgtcctagcgccgcagcccagcactgcgttaattcaaaagggcaggtgtgtagcggccgcgggacttgtgtctgcggcagatgcgaatgtactgacccaaggtctattggccgcttttgcgagcactgtcccacttgttacaccgcctgtaaggaaaattggaattgcatgcaatgtctccatccccacaatctctcgcaggccattttggatcagtgtaagacttcgtgtgctcttatggaacagcaacattatgtggatcagacttcagagtgtttctcctctccctcctatcttaggatcttttttatcattttcatagtcacattcctaatcgggttgcttaaggtgctgataatccgacaggttatcctccaatggaattccaataaaatcaagtccagctctgactacagagtgtctgcttccaagaaagataaactgatcttacaaagcgtttgtacgcgggccgtcacctataggcgcgagaagcctgaagagatcaaaatggacatctcaaagctgaacgcacacgagacctttaggtgtaacttctag

SEQ ID NO: 12080 - DNA, 375 bp, Artificial Sequence
  Description of Artificial Sequence: Synthetic coding sequence
atggtgtgggaagtgaagacgaaccagatgccaaatgccgttcagaagctcctgctggtgatggacaagcgcgcatcaggcatgaacgattctttggagcttctgcagtgcaatgagaaccttccgagtagccccggctacaatagctgcgacgagcatatggaactcgacgatctcccagagctgcaggccgtgcagagcgacccgacccaatctggaatgtaccagctgtccagtgacgtgtcacatcaggagtatcctcggtcctcttggaaccagaacacctccgacatccccgaaaccacttaccgagagaacgaggtggattggctgactgaactggccaacatcgccacatctccacagtcaccatag

SEQ ID NO: 12081 - DNA, 87 bp, Artificial Sequence
  Description of Artificial Sequence: Synthetic coding sequence
atggtctgggaggtgaaaacaaaccagatgcccaacgcagtgcagaagctgctcctcgtcatggataagagagcatctggcatgtag

SEQ ID NO: 12082 - DNA, 1545 bp, Artificial Sequence
  Description of Artificial Sequence: Synthetic coding sequence
atggtatgggaggtaaagaccaatcaaatgccaaatgctgttcagaagctgctcctggtcatggataaacgcgcgtcaggaatgaatgacagcctggaacttctccaatgcaatgaaaacctgccctcatcacctggttataactcatgcgatgagcacatggagcttgacgacttgcccgagctccaggcggtgcaatctgaccctacccagagcggaatgtaccagctgagcagcgatgtctcccaccaggaatacccgcggagctcctggaatcagaatactagtgacatcccggagaccacctacagagaaaacgaggtggactggctgacggagctggccaatattgccaccagcccacagagtcctcttatgcagtgtagcttctataatcgatccagccccgtccacatcatcgctacaagcaagtctttacattcatacgccagaccaccacccgttagcagcagctccaaatctgaacccgctttcccgcatcaccattggaaagaggagacacccgtgcgccacgagcgggccaattccgagtcagaatcagggattttttgcatgtcctcactgtcggatgacgacgatctcggatggtgtaactcttggcccagcactgtatggcactgttttctgaagggcacacgcctttgctttcacaaagggtccaataaggaatggcaggacgtcgaggattttgctagggctgaaggttgtgacaacgaagaagatctgcagatggggattcataaaggctacggcagcgacgggttaaaactgcttagccacgaggaatctgtttcattcggcgagagcgtgctgaagttgacgtttgaccccggaactgtagaagacggccttctgactgttgaatgtaaacttgaccaccctttttatgttaagaataagggttggagctccttctatccatccctcaccgtcgtccagcatgggattccgtgctgcgaggttcacattggagacgtttgtttgccccctggacatcccgacgccatcaatttcgacgacagcggggtttttgacacctttaagagctacgatttcacacctatggactcatctgctgtgtatgtacttagttccatggcaagacagcgtcgggcatctctgtcttgcggtggacccggggggcaagactttgccagatctgggtttagtaaaaactgtggaagccctggttcctcccaattgagctccaactccctttacgcaaaggctgtaaagaatcacagttccggaaccgtgtcagctaccagccctaacaagtgcaaacgccctatgaatgccttcatgctcttcgccaagaagtatagagtggagtacacccagatgtacccaggtaaggacaaccgggccataagcgtgatactgggggataggtggaaaaaaatgaagaacgaagaacgccgcatgtataccctggaagctaaggccttggccgaagagcaaaagcgactgaaccccgattgctggaagcgcaaaaggacaaatagcgggtcacagcagcattag

SEQ ID NO: 12083 - DNA, 213 bp, Artificial Sequence
  Description of Artificial Sequence: Synthetic coding sequence
atggtctgggaggtgaagactaatcagatgcctaatgccgtccaaaagttattgttggtgatggacaagagagcctctggcatgaacgactctctcgaacttctgcagtgtaatgaaaacctccctagctcccccgggtacaatagctgcgacgagcacatggagctggatgatctgcccgaactacaggccgtgcagagcgatccaacctag

SEQ ID NO: 12084 - DNA, 336 bp, Artificial Sequence
  Description of Artificial Sequence: Synthetic coding sequence
atggtttgggaggtgaagactaatcagatgccgaacgctgtgcaaaaattgctgcttgtaatggacaaaagagcttccgggatgaacgactccctcgagcttcttcagtgtaatgaaaacctgccttctagcccaggatacaattcttgtgatgaacatatggagctcgacgacctccccgagttgcaagcagtgcaatcagaccctactcagtcaggtatgtaccagctgagctcagacgtgtcacaccaagagtacccgaggtcttcctggaaccagaatacaagcgatatacccgaaaccacttacagagagaacgaagtcgattggctgtag

SEQ ID NO: 12085 - DNA, 1545 bp, Artificial Sequence
  Description of Artificial Sequence: Synthetic coding sequence
atggtctgggaggtgaagacaaatcagatgcccaacgctgtgcagaagctgttgctggtgatggataagagggcaagtggtatgaacgattccctggagctgcttcagtgtaatgagaacctgccatcctcccccggatacaattcatgtgacgaacatatggagcttgatgatctgcccgaattacaggccgtccaaagcgatccaacacaaagcggcatgtatcagctgagctctgacgtgtctcatcaggaatatcccagaagttcctggaaccagaatacttcagacatccctgaaacaacttatagggaaaacgaggtggattggctgacagaacttgctaatatcgcgacctcaccccagagtccacttatgcagtgttccttttataatcggagcagcccagttcatataatcgctacctctaagagtctccacagctacgccaggccaccacccgtgagttcctcctcaaagagcgagcccgcctttccacaccaccactggaaggaggaaaccccggtcaggcatgagcgcgcaaacagcgagtccgagagtggcattttctgcatgagctctctgtcagatgatgacgacctagggtggtgtaattcttggcctagcaccgtttggcattgctttttgaagggaacacggctgtgcttccacaaagggtccaacaaggaatggcaggacgtcgaggattttgctagagccgaggggtgtgataacgaggaagacctacagatgggaatacacaagggttacggctccgacggcctgaaattgctgtctcatgaagagagtgttagtttcggtgaaagtgttttgaaactaactttcgaccccggaacagtcgaagatgggctgctcacagtggaatgcaagctggatcatccattttacgtgaaaaacaagggctggagtagcttttatccgtctttaaccgtggttcagcatggcatcccatgttgcgaggtgcatatcggtgatgtctgtctcccccctggccaccccgacgccatcaactttgatgattccggagtgttcgatactttcaagtcctacgatttcactcccatggactctagtgccgtgtacgtgctttcctctatggcgcggcagcggagggcctccctgtcttgtgggggccccggcggccaggacttcgcccggagcgggtttagtaaaaactgtggctctcccggcagctcccagcttagctccaactctctgtatgcgaaggctgtgaagaaccacagcagcggcacagtaagtgcaacctccccgaacaagtgcaagagacctatgaatgctttcatgctattcgctaaaaagtacagggtggagtatacacagatgtaccctgggaaggacaatcgagccatctctgttattctgggtgatagatggaagaagatgaaaaatgaagagcggagaatgtatacgctggaggctaaggccctggccgaggagcaaaagcgactgaaccctgactgctggaaacggaagcgcaccaacagtggatcacagcaacattag

SEQ ID NO: 12086 - DNA, 327 bp, Artificial Sequence
  Description of Artificial Sequence: Synthetic coding sequence
atggtttgggaagtaaagacaaatcaaatgccaaacgccgttcagaagctgctgcttgtcatggacaaacgggcgagcgggatgaatgattctttagagctccttcagtgtaacgagaatttgccgagttctcccggctataatagttgtgacgagcacatggagttggatgacctgcctgaattgcaggcagtgcaatccgacccgacgcaatcgggcatgtaccagctcagctccgacgtttcacaccaggagtacccacgttcttcatggaatcaaaataccagcgatatacctgaaacaacctatagggaaaacgaagtttag

SEQ ID NO: 12087 - DNA, 1365 bp, Artificial Sequence
  Description of Artificial Sequence: Synthetic coding sequence
cagatgcccaatgctgtccaaaagctcttactggttatggataagcgcgccagcggcatgaatgactcactggaactcctacagtgcaacgaaaatttacccagttctcctggatacaatagttgcgatgagcacatggagctggatgatctcccagaactgcaagccgtgcaatctgatcctacccagagtggaatgtatcagttgtcttccgatgtctcgcaccaggaatatcctaggagctcatggaaccagaatacatctgatattcccgagaccacctatcgcgaaaacgaggtggattggctcacagagctggctaatatcgccacatctcctcagtccccactaatgcaatgcagcttttacaacaggtcctcccctgtgcacatcatcgctacctccaagagtcttcactcttacgcccgcccacctcctgttagcagtagcagcaagagcgaacccgcctttccacaccaccattggaaggaagagactccagtgcgccacgagagagctaactccgagagcgaatccggtattttttgcatgtctagcctgagcgacgatgatgacttaggttggtgcaattcatggccaagcacggtgtggcactgcttcctgaagggcactcgtctgtgcttccataaaggctctaataaggagtggcaggatgtggaggattttgcgagagccgaagggtgtgacaacgaggaggatctccaaatgggaatacataagggctacggcagtgatggccttaagcttctgagccatgaggaatccgtgtccttcggagaatcagtcctgaaactcacattcgacccaggaactgtcgaggacgggctcctgaccgtggagtgcaaattggaccatcccttctacgtaaagaataagggctggagttccttttatccctcgctgaccgttgttcagcacggtatcccatgttgtgaggtgcacataggagatgtttgcctcccacccggacatcccgatgcaatcaactttgatgattctggggtgtttgacacttttaagagctacgacttcacacccatggattcatccgcagtgtacgtcctctccagcatggcacggcagcgcagagccagtttatcttgtgggggccccggcggccaggattttgctcgctctggtttttctaaaaattgtggatcaccaggcagctcccagctgtcctccaactctctctatgctaaggctgtcaagaatcactcgagcgggacagtcagtgctacttcacctaataaatgcaagagaccaatgaatgcttttatgttgtttgcaaaaaaataccgcgtcgaatacacccagatgtaccccggcaaggacaatagatag

SEQ ID NO: 12088 - DNA, 1332 bp, Artificial Sequence
  Description of Artificial Sequence: Synthetic coding sequence
atgcagaaggccacttactacgactctagcgcaatctatggcggctatccttatcaagccgcaaacggctttgcttacaatgcgaatcagcagccatatcctgccagtgccgctcttggcgccgatggagaataccacaggcccgcctgtagtttacagtcaccttctagcgcaggaggacaccctaaagcccacgagctgtctgaagcttgcttgaggacgctgtcagctcccccttcgcaaccacccagcctgggcgagccaccgctccatccgcccccacctcaggctgctcccccagctccacaacccccccagccagcaccacaaccacccgcgcccaccccagccgctcctcccccgccctcctctgcttcccctccccagaacgccagcaacaaccccaccccagctaacgcagctaaaagccctctgttaaattcccccaccgtggcgaaacagatcttcccctggatgaaggagtcacgacagaatactaagcagaagaccagcagttcatctagcggagaatcatgcgcaggcgataaaagtccaccaggccaggcttcttcaaagcgtgcacgaacggcttacaccagcgctcaactcgtcgaactggaaaaggagttccactttaaccgctatttatgtcggccccggagagtcgagatggcgaacctcctgaacctgacagagcgccagattaagatttggtttcagaaccgtcgcatgaaatacaagaaggaccagaaagggaaagggatgctgacaagttccggaggccaatctccatctcggagccccgtgcctccaggagccggaggctacctgaactcaatgcactccctcgtgaacagcgtgccatacgagccgcaatccccccctccgttcagtaaaccaccgcaggggacatatggattgcctccagcctcctaccctgcttccctaccatcgtgtgcaccccctccgcctcctcaaaagcggtataccgccgccggcgctggagctggcggcactcccgactatgacccccatgcacacggactccagggaaatgggtcatatggtaccccccacatccagggaagccctgtgtttgtgggcgggagttatgtggagccaatgagcaactccgggccagccctgttcggattgacacacttacctcacgccgcctctggagctatggattatggcggagccggccctctaggcagcggccatcatcacggcccaggcccaggggaaccacaccccacatacactgacctaactggacaccatcccagccaagggagaattcaggaagctcctaagttgactcatctgtag

SEQ ID NO: 12089 - DNA, 858 bp, Artificial Sequence
  Description of Artificial Sequence: Synthetic coding sequence
atgaaggagtcgaggcaaaacaccaagcagaaaacaagctctagcagcagcggcgagagctgcgccggcgataagtctcccccaggtcaggcatcgagcaaacgggctaggactgcttacaccagtgcccagttggtggaactggaaaaagaatttcatttcaaccgctacttatgtagaccccgccgcgtcgaaatggccaacctgcttaacttgactgagaggcaaatcaagatttggtttcagaatagaaggatgaagtacaagaaagatcagaagggcaaggggatgctaacctcctctgggggacaatctccctcccgctcaccggttccccctggagctggaggctacctcaactccatgcatagtctggtgaactccgtgccctacgaaccacagtctccacccccattttctaagccacctcagggaacctacggtctgccccctgcttcttatcctgcttcccttccaagctgcgcaccaccgccacccccacagaaacggtacacagccgcaggagctggagccggcggaacaccagattatgatccccacgcccatgggctgcagggcaatggaagctatggaactccgcacatccaaggctcccctgtcttcgttggggggtcctacgtcgagccaatgagcaactctggtcccgctttatttggactaactcaccttccgcacgccgcctcgggagctatggactacggtggtgctgggcccctaggatcgggccaccaccatggtcccgggccaggcgagccacacccgacctataccgatctgaccggccaccatcctagtcagggtcgcattcaggaggccccaaaactgacacacctctag

SEQ ID NO: 12090 - DNA, 1332 bp, Artificial Sequence
  Description of Artificial Sequence: Synthetic coding sequence
atgcagaaagctacatattatgactcttccgccatctatggggggtacccttaccaggccgcgaatgggttcgcttacaacgccaatcagcagccatacccagcctctgctgccttgggcgctgatggagagtaccacaggcctgcttgtagcctgcaaagcccctcgtccgcgggcgggcacccaaaggctcatgaactgtctgaagcctgtctgcgaacactatcagcaccaccgtcacagcccccctccttaggtgaacccccactacaccctccgccacctcaggctgccccccctgcaccccaacccccgcagcctgcgccacagcctcctgcccccacccctgccgcaccaccacccccaagttcagcgagcccgccccagaatgcaagcaacaatcccaccccggctaacgccgccaaatctcctcttcttaatagcccaacggtcgctaaacagatctttccatggatgaaggaaagccgccagaatactaaacagaaaacatccagcagcagttcgggcgagagctgcgccggcgacaagagtcccccagggcaggcatcatcaaaaagggcccgaacagcctacacaagcgctcaactggtcgaactagagaaagaatttcattttaatagatatctatgccgcccccgccgggtggaaatggcgaatctcctgaacctcacagagaggcagatcaaaatatggtttcaaaacagacgcatgaaatacaaaaaggaccaaaagggtaagggtatgctgacgtcctcgggtggccagtctccctcccgatcccctgttccccccggcgctgggggctatctgaattctatgcactctttagtgaacagcgtgccttacgaaccccagtcacctccgccctttagcaagcccccacaggggacctacggcttgccacccgcatcataccctgcatctctgccttcatgcgccccccctccccccccccagaagcgctacacagcggctggtgccggcgccgggggcacccccgattatgatcctcacgcacacggcctgcaaggaaacggttcctacggcacccctcacatccagggatcacccgtgtttgtgggagggagctacgtcgaacccatgagcaactctgggcccgctctgtttggactgacccacctcccacacgcggcaagtggggcaatggattacggcggggccggaccactcggttccggacaccatcacggtcctgggccgggtgaaccccaccctacctacactgatctgaccggacaccatccctctcagggacggatacaagaagcccctaagttgactcacctatag

SEQ ID NO: 12091 - DNA, 39 bp, Artificial Sequence
  Description of Artificial Sequence: Synthetic coding sequence
atgcagaaggctacctactacgactctagtgctatctag

SEQ ID NO: 12092 - DNA, 165 bp, Artificial Sequence
  Description of Artificial Sequence: Synthetic coding sequence
atgcagaaggcaacctattacgactcctccgctatctatggcggttacccctaccaggctgctaacgggtttgcctacaatgctaaccagcagccttatcctgcatccgcagcactaggggccgatggtgagtatcaccgccctgcttgttctctgcaatcctag

SEQ ID NO: 12093 - DNA, 255 bp, Artificial Sequence
  Description of Artificial Sequence: Synthetic coding sequence
atgcagaaagccacatactacgacagctccgccatttacggcggctatccgtaccaggccgcaaacggatttgcatacaacgctaaccagcagccctaccccgcatcagctgcactcggcgctgacggcgaataccacagaccagcctgttcactccagagtccgagctctgcaggaggtcacccgaaagctcatgagctcagcgaagcttgtctgcgtaccctcagcgcacctcctagccaacctcctagttag

SEQ ID NO: 12094 - DNA, 1653 bp, Artificial Sequence
  Description of Artificial Sequence: Synthetic coding sequence
atggtacgggggtgggagcctccgcccggtctggactgtgctatatccgaagggcacaagagcgaaggaacaatgccacctaacaaggaggcttccgggctatcctcctctccagccgggttgatatgcctcccacccattagcgaggaattgcaactggtgtggacccaggccgctcagactagcgaactcgactccaacgaacatctcctcaagacattttcttacttcccctatccttccctcgcggatatcgccctcctgtgcctccgttatggacttcagatggagaaggttaaaacgtggttcatggctcagagactgagatgtggtatctcatggtctagtgaagagatcgaagaaacccgcgcacgagtcgtctacaggcgggaccagctgcacttcaaaagccttctgagcttcacacaccacgcgggaaggcctccggaggaggtgcccccacctccggtacccgcccccgagcaggtcggaatcggaatcgggcccccaacactgtcaaagcccacccaaactaaaggcctgaaagttgaacccgaggaaccgagtcaaatgcccccgctcccccagagccaccaaaagctaaaagaatcactgatgacgcccgggtccggcgcttttccttatcaatcggacttttggcagcatctgcagtccagcggcctttcgaaggagcaggccgggcggggacccaaccagagtcacggtattggaacagcctcctggaaccatagcactacagtgcctcaacctcaggcccgcgacaagcctcctcctatcgccctcattgcctcctcgtgtaaagaggagtcagcttcttctgttacccctagtagttcaagcacttctagttccttccaagtgctggccaacggagcaacagccgcctctaaaccattacagcctctagggtgtgttccgcagagcgtttctccgagcgaacaggccctgcctccgcatctggaaccagcttggccccaggggctcaggcataattccgtgcctggccgtgtgggaccgacggaatacctctcgcccgacatgcagagacagcgtaaaactaaaagaaagacaaaggaacagttggcgatcctgaagtcctttttcttgcagtgccagtgggccaggcgggaggattaccagaaactcgagcagattaccggtctaccccgccccgaaataattcagtggttcggagacactcggtatgccttaaaacatggacagctcaaatggttcagggacaacgctgttcccggggcaccctcttttcaggacccagccatcccgactccccctccctctaccagatctctgaatgagcgcgcagaaactcctcctctgccgatccccccacctcctccagatatacagcccctggagcgatattgggcggctcaccagcagctacgcgaaactgatataccacagcttagtcaggcctcgcgcctgtccacgcagcaggtgttggattggttcgattcgcgtctcccccagcccgctgaagtcgtcgtctgcttagatgaggaggaggaggaggaggaggaggagctccccgaggacgacgaagaagaggaggaggaggaggaagaagacgatgatgacgacgatgatgatgtgattatacaagactag

SEQ ID NO: 12095 - DNA, 1032 bp, Artificial Sequence
  Description of Artificial Sequence: Synthetic coding sequence
atgtccagagccggaagctgggatatggatgggctgagagccgatggagggggcgccggcggagctcctgcttccagcagctcaagctccgtggcagcagctgccgcaagcgggcagtgccggggtttcctcagtgccccagtgtttgccggcacccattctggccgagccgctgccgccgccgcagctgctgccgccgctgccgccgccgccagtgggtttgcttatccagggaccagcgagcgaacgggttcaagctcttccagctcgagctcagcagtggtggccgctcgaccggaggccccccccgccaaagagtgcccagctcccactcccgcggcggccgcggcagctccgccatcagcgcctgctttggggtatggctaccattttgggaacgggtattatagttgtagaatgagccacggggtggggctccaacagaatgctctgaagtcctcaccccatgcatcgctgggtggctttcctgtcgaaaaatacatggacgtctcaggtttggctagctcttcagtacctgcaaatgaggtgccagctcgcgccaaggaggtttctttttaccaaggatacacgagcccataccagcacgtgccaggctacattgatatggtctctacgttcgggtccggggagccacggcacgaagcttatatttctatggagggatatcaatcttggaccttagccaacggatggaactctcaggtgtactgcactaaggaccaaccccagggttcacatttctggaagtcatccttccccggcgacgtagccctgaaccagcccgacatgtgcgtataccgcagagggcgaaaaaagcgcgtgccctacaccaagctgcaattgaaggagctcgaaaacgaatatgcgataaacaagttcataaacaaggataaaagacgccggattagtgccgcaactaatttgagtgagcgccaggtcactatctggtttcagaatcgaagagtgaaggataagaagatcgtctctaagttgaaggacacagtcagctag

SEQ ID NO: 12096 - DNA, 924 bp, Artificial Sequence
  Description of Artificial Sequence: Synthetic coding sequence
atggcgacagcacagctgtctcactgcatcacgattcacaaggcttccaaggagaccgtgttcccatcccagattaccaacgagcatgagtcattgaaaatggtgaagaaactgtttgccacctctatctcttgtattacatatttacgcgggctctttccggaaagcagttacggcgaaagacacctcgatgatctgtctttgaaaatattacgtgaggacaagaaatgtccaggctctctccatatcattcgatggatccaggggtgttttgacgctcttgaaaaacgctacctgaggatggctgtgctgacgctgtatactgaccctatgggttctgagaaagtcactgagatgtaccagtttaagttcaagtacacgaaggaaggagccaccatggatttcgactcacatagctcttcaacctcctttgaatcaggcacaaacaatgaagacatcaaaaaagccagtgtccttttaatacgcaagctgtacatactcatgcaggatctggagccgttgcctaacaacgtggtgctaaccatgaagctgcactactataacgccgtcacaccccacgactaccaaccactcggctttaaggaaggcgtcaacagccacttcctgcttttcgacaaagaacccattaatgtgcaagtgggctttgtgagcactggctttcacagcatgaaagtgaaggtgatgaccgaagcgaccaaggtgatcgacttagagaacaatctttttagagagaactccaccacagagatcgctcaccaaggactggattgtgatgaggaggaggagtgtaacgaccatatccagcgcatgaactttgtatgctcccagcagtccagcgagtgcagccgcaagaagaggaaagtttctgagccagtgaaggtcttcatccccaacaggaagtag

SEQ ID NO: 12097 - DNA, 924 bp, Artificial Sequence
  Description of Artificial Sequence: Synthetic coding sequence
atggctacagctcaactgagccattgcatcaccatccataaggcttccaaagagacggtttttcccagtcaaatcaccaatgagcacgaaagtttaaagatggtcaagaaattattcgcaacaagcatctcttgcatcacctacctccgaggcttgttccccgagagttcctacggagagagacaccttgatgacttgagcctgaaaatactgagggaagacaagaagtgccctggtagtctccatatcattaggtggattcagggctgcttcgacgctctggaaaaaaggtatttacgaatggctgttctgaccctgtataccgatcctatggggtcagagaaggtgactgagatgtaccaattcaagttcaagtacactaaggaaggtgccaccatggatttcgactcacattcctcctccacctccttcgagtctggcactaacaacgaagatatcaagaaggccagtgtgctgttaatcagaaagctgtacatcctgatgcaggacttggagcctctcccaaataacgtggtcttaactatgaagctgcactattataatgccgtgaccccgcacgattaccaacctcttggattcaaggaaggagtgaatagtcacttcctgctgtttgataaggaaccgattaatgtgcaagtggggttcgtgtcgaccggatttcattctatgaaagtgaaagtaatgactgaggcaactaaagtgattgacctcgagaacaatctgttccgtgagaatagcacgaccgagattgcacatcagggcctggattgtgatgaggaagaggagtgtaatgatcacattcagcgcatgaacttcgtgtgtagccagcagtcttcagaatgttcacggaaaaaacgaaaggtttcagaaccagtgaaggtgttcattcctaacaggaaatag

SEQ ID NO: 12098 - DNA, 1074 bp, Artificial Sequence
  Description of Artificial Sequence: Synthetic coding sequence
atgcaggcacgcgctcttctgctggctgccctggctgccctggccctggctcgcgagccaccagccgccccatgtcctgcccgatgtgacgtttctagatgcccttctccacggtgtccaggtggttacgtgcccgatctctgcaattgctgcctggtgtgcgccgcgtcggagggggaaccatgcggcggcccccttgattctccgtgtggagagtcgctggagtgcgtcaggggtctgtgccggtgtcggtggtcacacgcagtctgtggcacagacggtcatacctacgcgaatgtctgcgcattgcaagcagccagcaggcgagcgctgcaactgagcgggaccccagtgcggcaactgcagaagggcgcatgccctctcggactgcatcagctgagcagccccagatacaaattcaatttcattgcggacgtagtggaaaagatcgcgcccgctgtcgtgcacatcgagcttttccttcgtcatccgctgtttggacgcaatgtccccctatccagtggctctgggtttatcatgtccgaagccggactgattataaccaatgcccacgtggtttctagtaactccgccgcacccggaaggcagcaacttaaagtccagctccagaatggcgactcctacgaggctacaatcaaggacattgacaaaaaaagcgatatcgccaccattaaaatacatcccaagaaaaaactgcctgtgctcctgctgggacactccgcagacctcagaccaggtgaatttgtggtcgccattggctcaccctttgctctccagaacacagtgacgaccggtatcgtaagtaccgcacagagggagggccgggaactcggattacgggactcggacatggactatatccagaccgacgcgatcatcaactatgggaactcgggaggcccactggtcaacctggacggggaggtgatcggaattaacaccttgaaggtcaccgccggcattagcttcgcaattccttcggaccgcatcactcgatttctgaccgagtttcaggacaaacagattaaagcaccctctctggctgttcactag

SEQ ID NO: 12099 - DNA, 1599 bp, Artificial Sequence
  Description of Artificial Sequence: Synthetic coding sequence
atgcactgcacacttacaatggagacggaggcaatcgacggctacataacatgcgacaatgagctgagtccggagcgagaacattccaacatggcgatagatctcacaagcagtacgccaaatggtcaacacgcttccccaagtcacatgactagcaccaactcagttaagctggaaatgcagagcgacgaggaatgcgaccgcaaaccattgtcgcgggaagatgaaataagagggcacgacgaaggatcatctctggaggaaccactcatcgagtcatccgaagttgccgacaatcggaaagtacaggaactgcagggagagggcggcatccgattgcctaatggaaagctgaagtgcgatgtatgtggaatggtgtgtattggcccaaacgtactcatggtgcacaaaagaagtcacacgggagagagaccttttcattgtaaccagtgcggtgccagttttacccagaaaggtaacctgctccgccatataaaactccattcgggcgagaaacccttcaaatgtcctttctgctcttacgcatgtagacgcagagatgcactgacgggtcacttacggacccacagcgtgggcaagccacacaagtgcaattattgtgggcgctcctataagcagcggagctcactggaagaacataaggaacggtgtcacaattacctgcaaaatgtctctatggaagcagctggacaggtaatgtctcaccacgtcccacccatggaggattgtaaggagcaggaacctattatggataacaatattagcttagtgccatttgaacgtcctgccgttatcgagaaattgactgggaatatggggaagcgcaaaagtagcacaccacagaagtttgttggcgagaagctcatgcgattctcctatcctgatatccattttgacatgaatctgacctacgagaaggaggccgaattgatgcagagtcatatgatggatcaggccataaacaatgccatcacatacctgggggccgaggcccttcatcccctgatgcaacacccgccctctaccattgccgaggtggctcccgtcattagttccgcgtactctcaggtgtatcatcctaataggatcgagcggccaatctctagagaaaccgccgacagccacgaaaacaacatggacggtccgattagtctaataagacctaagagccgaccacaggaacgagaggcttcacccagcaacagttgcctggattccacagacagcgaatcttctcacgacgatcaccagagttaccagggtcatccagccctaaatccgaaaaggaaacagtcacccgcttacatgaaggaagatgtaaaggcgcttgacaccaccaaggctcctaagggcagtctgaaagatatctacaaagtcttcaacggcgagggcgaacaaatcagggcgtttaaatgtgaacactgccgggtgttatttttggaccatgtcatgtacaccatccatatgggctgtcatgggtatcgggaccctctggagtgcaacatctgtggctacaggtctcaggaccgttacgaatttagcagtcatatcgtccgaggggaacacaccttccattag

SEQ ID NO: 12100 - DNA, 1503 bp, Artificial Sequence
  Description of Artificial Sequence: Synthetic coding sequence
atggaaactgaagcaatcgacggctatataacatgtgacaatgaactgtccccagaaagagaacatagtaacatggcgattgacctgactagctccactcctaacggtcaacacgcatccccctcccatatgacctccaccaactctgtcaagctggagatgcagtccgacgaggaatgcgatcgcaagcctctgtcccgcgaagatgagatcaggggacacgacgagggaagttctctagaggaaccactgatcgagtcttccgaggtggcggataacaggaaagtgcaagagctccaaggcgaaggggggattagactgcccaacggcgagagaccatttcattgcaatcaatgtggcgcgtcttttacacagaaagggaacctcttgcggcacattaagctacattccggcgagaagcctttcaaatgtcccttctgcagttatgcctgccgtcggcgcgatgcactgaccggacacctcaggactcacagtgtgggcaaaccacacaagtgtaattactgtgggcgtagctataagcagagatcttcactcgaagaacataaggaacgttgtcataattatctccagaatgtctctatggaggccgctggacaggttatgtcacaccatgtgccaccaatggaagactgtaaagagcaggaaccaatcatggataataacatttcattggtcccgtttgagcgcccggccgtgattgaaaaattaacggggaatatggggaagaggaaatcaagtacgccacagaaattcgttggcgagaagctgatgcgattcagttaccccgacattcacttcgacatgaacctgacctacgagaaagaagccgaacttatgcagagccatatgatggaccaagccatcaacaacgctattacctacctaggagccgaggcacttcacccgttgatgcaacatccaccatcaacgattgcagaggtggctcccgtgatcagctcagcttactcccaggtataccacccaaatagaattgagagacccatttcgagagagaccgccgacagccatgagaacaacatggatggcccaatcagcttgattcgccctaagtctcggccccaggagagggaggcgtctcccagtaattcatgcctggactctaccgatagtgagagctcacatgatgaccaccagagctatcaaggtcaccccgctttgaaccctaaaagaaagcagtcccctgcgtatatgaaggaagatgtgaaagcactggataccaccaaggcaccgaagggctcgctaaaggacatctataaagtcttcaatggtgagggcgagcagattcgagcgtttaagtgcgagcactgtcgcgttttatttctggaccatgtgatgtatacaatacatatgggctgccatggttatcgggaccctttggaatgtaacatctgcgggtaccggtcccaggatcgttacgaattctcatctcacattgtgcggggagaacacacgtttcactag

SEQ ID NO: 12101 - DNA, 1146 bp, Artificial Sequence
  Description of Artificial Sequence: Synthetic coding sequence
atggagacagaagcaattgatggatacatcacctgtgacaatgagctctcccctgaacgcgagcactccaatatggcgatcgacctgaccagctcgacgcccaatggccaacatgcatctccatcacatatgacaagtatgggtaaaccacataagtgtaattattgcggtaggagctacaagcagagatcttcactggaggagcacaaggaacgctgtcataactaccttcagaacgtgtctatggaggccgctggacaggtgatgagtcaccatgtcccgcccatggaggattgtaaggagcaggagcccataatggacaataatattagcctcgtccctttcgagcgaccagccgttattgaaaagcttacaggcaatatggggaaacgcaagtcctccacccctcagaagtttgtgggagaaaaacttatgcgcttctcttatcctgatatccactttgacatgaacctgacttacgaaaaagaggccgaacttatgcaaagccacatgatggaccaagctatcaacaacgccattacctacttgggggcagaagccctacaccccctcatgcagcatcccccctccacgatcgctgaagtcgcccccgtgatttcgagcgcctacagccaggtttaccacccaaatcggatagaaaggccaatatctcgggagaccgcagacagccatgagaacaacatggacggcccgattagcctgatccggcccaaatcccggccccaggaacgggaggccagccccagcaacagctgtctggactccacggacagcgagtcctcgcacgatgaccatcagtcataccaggggcaccccgctctaaacccgaagagaaagcaatctccagcatatatgaaagaagatgtgaaggccctagatactacaaaggcacccaaaggcagcctaaaggacatctataaggtgttcaacggagagggcgaacagattagagccttcaagtgcgaacattgcagagtgttatttctggatcacgtcatgtatactattcatatggggtgccacggttaccgagatcccctcgagtgcaacatatgcggataccgttcccaggacagatacgaattcagcagtcatattgtgaggggtgagcataccttccattag

SEQ ID NO: 12102 - DNA, 720 bp, Artificial Sequence
  Description of Artificial Sequence: Synthetic coding sequence
atggagaccgaggccattgatggatatatcacctgcgacaacgagctgtcacctgaaagagaacatagcaatatggctatcgaccttaccagtagtacacctaacggacagcatgcctcgccaagccatatgaccagcactaattccgtgaaactcgagatgcagagcgacgaggaatgtgatcgcaaacccctgtctcgtgaagacgaaatccgcggccacgatgaggggtctagtctggaggagcccctgattgaatcttccgaggtggccgataatcgtaaggtccaggagctccagggcgaaggtggaattagacttcccaacggtaaactcaagtgcgatgtgtgcgggatggtctgtatcggtcccaacgttctgatggttcacaaacggtcacatactggcgagagaccctttcattgtaaccagtgtggggctagcttcacgcagaagggtaatcttctaaggcacatcaagctacactccggagagaagcccttcaaatgcccattttgctcatatgcctgccgcagaagagacgcgctcaccggccaccttcggacccattccgttggtaagcctcacaagtgtaactattgcggccgctcctacaagcagaggagttcattggaggaacataaagagagatgtcacaattatctacagaacgtgtccatggaggcggctggccaagtgatgtcccaccatgacagttag

SEQ ID NO: 12103 - DNA, 1359 bp, Artificial Sequence
  Description of Artificial Sequence: Synthetic coding sequence
atggaaactgaagcaattgacgggtacattacctgcgataatgaactgtcacccgagagagaacattctaatatggctatagatctcacctccagtacgcccaacgggcaacacgcttcgccatcacacatgactagtaccaattccgtcaaactagagatgcagtctgacgaagaatgcgaccgcaagccactttccagggaggatgaaatacgcggccacgatgagggcagctctttagaagaacctctcatcgagagcagtgaggtagctgataatagaaaggtgcaggagctgcagggagaagggggaattcgccttccaaacggcgagaggccgttccattgcaatcagtgcggggcctccttcacgcagaaggggaatctactccggcacataaagctgcattctggggagaagccattcaagtgtcccttctgcagttacgcatgtcgaagacgggacgccctgaccgggcacctcagaactcacagcgtgggaaaaccccacaaatgcaattactgcgggaggagctataagcagaggtcttccctcgaggaacacaaagagagatgccataactacctgcagaacgtgtccatggaagccgccggccaggtgatgtcacatcacggggaaaagcttatgcgattctcgtacccagacatccacttcgacatgaatctcacctatgagaaagaggcggagctcatgcagagccacatgatggaccaagcaatcaataacgccattacatacctcggagctgaggcattacacccactcatgcagcatcctcctagtacaattgcagaagtggctcccgtcattagctccgcatatagccaggtgtatcatcctaatagaattgagagacccatatcaagagaaaccgctgactcccacgaaaacaacatggatggccccatttctctgatcaggcccaaatcacggccccaggagagggaagcttcaccctctaacagttgtctcgacagcacagatagtgagtcaagccatgacgatcaccagtcatatcaaggtcatccagcgttgaatccaaagcgaaagcagtctccggcttacatgaaggaggacgtgaaagcccttgacactacgaaggcacccaaggggtctctaaaagatatatacaaagtgttcaatggcgagggagagcagattcgtgcttttaagtgtgagcactgccgcgtactctttttggaccatgtgatgtacacgatccatatgggctgtcatggctatcgggaccccctggaatgcaacatctgcgggtatcgctcacaggaccggtatgaattctcatctcatattgtcaggggcgagcacacgttccattag

SEQ ID NO: 12104 - DNA, 720 bp, Artificial Sequence
  Description of Artificial Sequence: Synthetic coding sequence
atggagaccgaagccatcgacggctatatcacttgtgataacgagctttcacccgagcgagaacacagtaacatggctatcgacctaacctccagtacacctaacggccaacacgctagtccttcacacatgacatctacaaattcagttaaacttgaaatgcaaagcgatgaggaatgtgatcgcaaaccattgtcacgagaggatgaaatcagaggccatgatgagggatcaagcctggaggaaccactcatcgagagtagcgaggtggccgacaacaggaaagtgcaggagcttcagggcgagggggggattcggttgcctaatggcaagctgaaatgcgatgtttgtggtatggtttgtattggccctaacgtgctgatggtgcacaagcgctcccataccggagagcggccttttcactgcaatcaatgcggggctagctttacccagaaaggcaatctgctgagacacatcaaacttcacagcggtgagaagcctttcaagtgccccttttgctcatacgcatgtcggcgccgcgacgcattaactgggcacttaagaacccattctgttggcaaaccacacaagtgcaattactgtggcaggtcttataaacagcgctcgagcctcgaggaacataaagagcgctgccacaactacctccagaatgtgtccatggaggcagcaggccaggtaatgtcccaccacgatagctag

SEQ ID NO: 12105 - DNA, 381 bp, Artificial Sequence
  Description of Artificial Sequence: Synthetic coding sequence
atgcactgtaccctaacaatggagacggaagctatcgacggctatataacctgtgataacgagttgtcccctgagcgcgagcatagcaacatggccatcgacctcacaagtagcacacctaatggtcagcacgctagccccagccacatgacttccacgaactccgtgaagcttgaaatgcaaagcgatgaggaatgcgatagaaagccactctcacgcgaggacgaaatacgaggacatgatgaagggtccagcctcgaggagcccctgattgaaagttctgaggtggcagataatcgaaaagtgcaggagttgcagggcgaaggcggtattagactgcccaatggcgagcgtccttttcattgtaatcagtgtggatag

SEQ ID NO: 12106 - DNA, 1581 bp, Artificial Sequence
  Description of Artificial Sequence: Synthetic coding sequence
atggagacagaggcaatcgacggttacattacctgtgacaatgagttgtcgcccgagcgggagcactcaaatatggccatcgatctgacttcatctactcctaacgggcagcatgcaagcccaagtcacatgacttcaactaatagcgttaaactggagatgcagtccgacgaagagtgcgaccggaagcccctgagcagggaggatgagattcggggacacgatgaggggagctcgctcgaagagccgctgatagagtccagcgaagtggccgataatcgcaaggtgcaagagctgcagggtgaaggtgggattcgcctgcctaatggaaagctgaaatgcgatgtatgcggcatggtgtgtataggtcccaacgtgttgatggtgcataagaggtctcatacgggtgagaggccattccactgcaatcagtgcggtgcgtccttcacccagaaaggaaacctgctgcggcacatcaagttgcacagcggagagaagccattcaagtgtcccttctgtagttacgcgtgtcgacgccgcgacgctctcacaggtcatctgagaacccattccgtaggcaaaccacacaagtgtaattattgcggccgcagctataagcaacgctcctccctggaggaacacaaggagagatgccacaactatctgcaaaacgtctccatggaagctgctggtcaggtcatgtcacaccatgtgcctcccatggaagattgtaaggaacaggagccaattatggacaacaacatcagcctggtgccctttgaacggcccgcagttatagagaaattaacagggaatatgggcaagcgcaaaagctccaccccacaaaagttcgttggcgagaagctcatgaggtttagctaccctgacatccacttcgacatgaatctgacgtacgagaaggaggctgagctgatgcagagtcatatgatggatcaggccataaataacgctataacgtatcttggtgctgaggcgctgcatcccttgatgcagcaccctccctcaaccatcgctgaggtggccccagtgatttcatctgcatacagtcaagtgtatcatccaaatagaatcgaacggccaatcagtagagagacagccgacagccatgagaataacatggatggcccgattagtcttattaggccaaaatcccgaccacaggaaagggaggccagcccttccaactcatgtcttgactctactgactccgagtcttcccacgacgaccaccagtcctaccagggacatcctgctttaaaccctaagagaaagcagagtccagcctacatgaaagaagatgttaaggccttggatacaacaaaggctccaaagggaagtttgaaggatatatataaggtgtttaacggagaaggggaacagatccgcgcgttcaagtgcgaacactgtagagtactgttcctggatcacgttatgtacactatacatatgggatgccacggctaccgtgatcccttggaatgcaacatctgcggatatcggagtcaggaccggtatgagtttagctcccatattgtaagaggagaacatacattccactag

SEQ ID NO: 12107 - DNA, 447 bp, Artificial Sequence
  Description of Artificial Sequence: Synthetic coding sequence
atggaaaccgaggcaatcgatggctacatcacgtgtgacaacgagctgtccccagagcgggagcattcaaatatggccatagatctgacgtcgtccacaccaaacgggcaacacgcatctcctagtcatatgacctctactaacagcgtgaagctggagatgcaatcggacgaagaatgtgatagaaagcctctgagtcgagaggatgaaatccgcggccatgacgaaggctcttccctggaggaacccctgattgagagctctgaagttgctgacaatagaaaggtgcaggagctacaaggggaggggggaatccgccttcctaatgggaagttgaaatgtgacgtgtgtggaatggtatgtatcggtccaaatgttctcatggtgcacaagagatctcatacaggagtggctgtggtgaagaccacgtttagcgaattttgctag

SEQ ID NO: 12108 - DNA, 1365 bp, Artificial Sequence
  Description of Artificial Sequence: Synthetic coding sequence
atggagactgaagcaatagatggatatattacctgtgacaatgagcttagcccggagagagagcatagcaatatggccatcgacctgacgagctctacccccaatggacagcatgcatcacccagtcatatgaccagtaccaactccgtcaagctggagatgcaaagcgacgaggaatgtgatagaaagcctttgtctcgagaagacgaaattcgaggacacgacgaagggtcttcgctagaagagccattaattgagagttctgaggtcgcggacaatcgcaaggttcaggaattacagggggagggtggcatccgtctccctaatggtgaacggccatttcattgtaaccagtgcggcgcctcatttacacagaaaggaaatctgctgagacatattaagctccactcaggcgaaaaaccctttaaatgtccattctgctcctatgcctgccgtagacgcgacgcgctaacaggccatcttcgaacccacagtgttccccctatggaagattgtaaggaacaggaaccaattatggacaacaacatttcgctggtcccctttgaaagacccgctgttatcgagaaattaactggaaacatgggaaaaaggaaatcgtccactccacagaagttcgtgggcgaaaaactgatgagatttagctatccagacatacattttgatatgaatctcacctacgaaaaggaggcggagcttatgcagtcccatatgatggatcaggcgattaataacgcaattacatatttaggcgcagaggctcttcaccccctgatgcagcaccctccttccacaattgccgaggtcgcgcccgttatttcttccgcttattcacaggtctaccaccctaatcgcattgagaggccaatctcccgtgagaccgctgacagtcatgaaaataatatggatgggccaatatcactgatacggccaaaatctcggccgcaggagcgggaagcttcaccttcaaacagttgccttgactctaccgattccgagagcagccacgatgatcaccagagctatcagggacaccctgcactgaatcctaagcgtaagcaatctcctgcctacatgaaagaggacgtgaaagccctcgacacaactaaggctccaaaaggcagcctgaaagacatctacaaggttttcaacggagagggtgagcagattcgcgctttcaagtgtgaacactgccgcgtcctgtttctcgatcatgtgatgtacactatacatatgggatgtcacggatatcgcgatccactcgagtgtaacatttgtggctatagaagccaggatcgatacgaattctcttcacacattgtcaggggcgagcacacctttcactag

SEQ ID NO: 12109 - DNA, 252 bp, Artificial Sequence
  Description of Artificial Sequence: Synthetic coding sequence
atggagacagaagcaattgatggctacattacctgcgataacgaactttccccagagagagaacacagtaacatggctatcgacctcacttcgtctactccaaacggacagcacgccagtccctctcacatgaccagtaccaactctgtcaagttagagatgcagagcgatgaggagtgtgacaggaaaccactatcacgtgaagatgagatacggggccatgatgaaggttccagtttggaggagccgtag

SEQ ID NO: 12110 - DNA, 1581 bp, Artificial Sequence
  Description of Artificial Sequence: Synthetic coding sequence
atggaaactgaagcaatagacggctatattacgtgtgacaatgagttatcccctgaaagggagcatagcaacatggctatcgatctgacctctagcacccccaatggccagcatgcttcgccctcacatatgacttcaacaaattcagtgaaactcgagatgcagtctgacgaagaatgtgatagaaaacccctttccagagaagacgaaattcggggccatgatgagggtagctccctggaggaacccttaattgagtcttcagaggtggccgataaccggaaagttcaagaattacaaggcgaaggggggattcggcttccaaatggtaagctgaagtgtgatgtgtgcgggatggtctgtattggaccaaatgtgctgatggtccacaaacgatcccacaccggagagaggccttttcattgtaaccagtgcggggcctctttcactcaaaaaggtaaccttctccggcatattaagctgcacagcggcgagaaaccatttaaatgccccttctgctcgtatgcatgcagacgcagagacgccctgactgggcatctgcgtactcactccgtgggtaaaccccacaaatgcaactactgcgggcggtcatacaagcagaggtcttctcttgaggagcataaggaaagatgccataactatctgcagaacgtgagcatggaagcggccgggcaggtcatgtctcaccacgtccctcctatggaggattgcaaagaacaggagccaattatggacaacaatatatccctggttcccttcgagagacccgcagtgattgagaagctgacgggaaacatgggtaaaagaaaatcaagcactcctcagaagttcgtgggggagaagctaatgcgcttcagctatccagatatccattttgacatgaacctgacctacgaaaaagaggcggagctgatgcagagccacatgatggatcaggcaataaacaacgcgattacgtatctgggcgccgaggctctacaccccctgatgcagcatcctccgtccacaatagccgaggtggcccctgtgatatcgtcggcctattcccaggtctatcatcctaaccgcattgagcgccccatttctagagagactgccgactcccacgagaataacatggacggccccatatccctcattagacctaagagtagaccacaggagcgcgaggctagtcctagcaactcttgtctcgactccacagattccgaatcaagccacgatgatcatcagtcctaccagggccaccccgccctgaacccgaagaggaaacagtcccccgcctacatgaaagaggacgtcaaggccttggacacaactaaggccccaaagggctcgctgaaagatatttacaaagtctttaatggggagggggagcagattagggcatttaaatgtgagcattgtagagtgctcttcctggatcacgtcatgtatacgattcacatggggtgccacggctacagagaccctttagagtgtaatatttgcggataccgcagccaggaccgctacgaattctccagccacattgtgcggggcgagcatacatttcactag

SEQ ID NO: 12111 - DNA, 693 bp, Artificial Sequence
  Description of Artificial Sequence: Synthetic coding sequence
atggagaccgaggccatcgacggatacatcacctgtgataatgagttaagtccagaacgcgagcactctaatatggcaattgatcttacctctagcacaccaaatgggcaacatgcttctccctcacatatgacttctacgatagccgaagtcgcgccagtgatatcatctgcttattcgcaagtgtaccaccctaacagaatcgaacgcccaatcagtagggaaactgcagattctcatgagaataacatggatggtcctatttctcttatcaggccaaagagcaggccccaagagagggaggcatctcctagcaatagttgtcttgattcgacagatagtgaaagtagtcacgacgatcaccaaagctatcagggtcacccagcactgaacccaaaaaggaaacaaagccccgcttatatgaaagaggatgtcaaggctctggacacaacaaaggcccctaaaggcagtcttaaggacatctacaaggtctttaacggtgaaggcgagcagatacgggcgttcaaatgtgaacactgcagggtgctttttcttgatcacgtaatgtacacgatccacatgggctgccacggctacagagacccgctggagtgtaacatctgcgggtacagaagtcaggatcgttatgaattcagcagccacatcgtaaggggtgaacatactttccactag

SEQ ID NO: 12112 - DNA, 1260 bp, Artificial Sequence
  Description of Artificial Sequence: Synthetic coding sequence
atgggcgaaaagaagcctgagcccctggatttcgtgaaggatttccaagagtacctgacacagcagactcaccatgttaacatgatctccggtagcgtgtctggggataaggaagctgaagctctgcagggagcaggcacggatggcgaccagaatggtcttgaccatcccagcgtggaagttagcctcgacgagaatagcgggatgctggtagacggttttgaaagaactttcgatggtaaattgaaatgtcgctattgtaactacgcttctaaggggacagcccgcctgatcgaacatatccggattcacactggggagaaacctcatcgctgccatctctgcccttttgcctcagcctacgaacggcacctcgaggctcacatgcgatcccacaccggggagaaaccttacaaatgcgagctgtgttcgtttaggtgtagcgatcgatcaaatcttagccatcaccgtagacggaaacataagatggttcccatcaaaggcactcgaagcagtctctcaagtaagaagatgtggggtgtgctccagaagaaaacttccaatctgggctattcacgacgtgcccttattaacctcagcccgccatccatggtggtacaaaaaccagactatctcaacgacttcacccatgagataccgaacatccaaacagattcgtatgagtccatggccaagaccactccaaccggagggttacctagagacccccaggagctcatggtggacaaccccctgaatcagcttagcacactcgctggccagctcagttccttgccacccgaaaatcaaaatcccgcgagtccagacgtagtgccctgtcccgatgagaaacccttcatgatccagcaaccctctactcaggcagtagtatccgccgtcagtgccagcatcccgcagtcttccagcccgacctctccagagcctcggcccagtcattcccaaaggaattactcccccgtggcgggtccatcatcggagccatcggcccacacaagcacacctagcattgggaactctcagccctccacacctgctcccgccctcccagtgcaggacccccagttactccatcactgccagcattgcgacatgtacttcgccgacaacattctttacaccatccacatgggctgtcacggatatgagaacccattccagtgtaatatttgcgggtgcaagtgtaaaaataaatatgatttcgcttgtcactttgccaggggtcagcataaccagcactag

SEQ ID NO: 12113 - DNA, 1542 bp, Artificial Sequence
  Description of Artificial Sequence: Synthetic coding sequence
atgagggagggagcctgcaaactattagccgcctgtagccaaagggagcaagctctggaggcaacaaagtcactactggtgtgcaattcaaggatcttaagttatatgggggaactgcagcgacgaaaggaggcccaggtgttggggaaaacatctagacggcctagcgattctggtccaccagcagagcgctccccttgtcgcggaagagtgtgcataagcgacctcagaatccctctgatgtggaaggataccgaatactttaagaataagggggatctgcaccggtgggccgtgttcctgctgctccagcttggtgagcatattcaggataccgagatgatcctcgttgacagaacactgacagacatcagcttccaaagcaatgtgctattcgctgaagctggacctgactttgagctgcgtctggaactctacggcgcttgtgtggaagaggagggagccctcacgggcgggcccaaacgcctagcaaccaagctttcatctagccttggacggagctcaggcaggagggtgagggcctccctggactccgccggggggtcggggtcaagccccatactactgcctactcctgtggtgggcggccctaggtatcacctacttgcccacaccacgctgaccctggcagccgtgcaggacgggtttcgaacgcatgatctcaccttagcttctcacgaagagaatcctgcttggttaccattgtacgggagtgtgtgctgtcgactggcggcccaaccactgtgcatgacccagccgaccgcttccggcacactgcgcgtgcaacaggccggcgagatgcaaaattgggcacaggtgcatggagtactcaaggggacaaacctcttttgctaccggcagccagaggatgctgacacgggcgaagaaccgctgctgaccatcgccgtaaacaaggaaaccagagtcagggcgggggagctcgatcaggccctcggacggccattcacattaagtatctcgaaccagtatggggacgatgaagttactcacaccctgcaaaccgagtcaagagaagcgctgcaatcttggatggaagcgctgtggcaattgtttttcgatatgtctcaatggaagcagtgctgtgatgagatcatgaaaattgaaacacccgcacctagaaaacctcctcaggcactagctaaacaaggctccctgtaccacgagatggctattgagccactggacgacatagcagcagtcactgatatactaacacaaagggagggagcgagactggaaacgcctcccccatggttggcaatgttcacggatcagccagccctgccgaatccgtgctctcccgcgagcgtggccccggctccggactggactcaccccctgccctgggggcgacccaggacttttagtttagatgctgttcctccagaccactcgcctcgcgctcgctccgtagcccctctccctcctcagcggtcacctcgtaccaggggcttgtgctcaaaaggccaaccgaggacatggttacaaagtcctgtatag

SEQ ID NO: 12114 - DNA, 1092 bp, Artificial Sequence
  Description of Artificial Sequence: Synthetic coding sequence
atgagtaaactctggcgtcggggttcgaccagcggagccatggaggcaccggaacccggtgaggctctggagctgtctctcgcaggggcacacggacacggagtacataagaagaagcataagaaacataagaaaaaacacaaaaagaagcatcaccaggaggaggacgccggccctacacagcccagccctgcaaagccgcagctaaagcttaaaattaagctcggtggccaagtcctcggcaccaaatcggtcccaacctttacagttatccctgaaggcccccggtccccctccccgttaatggtggtcgacaacgaggaagagccaatggagggagttcccctggagcaataccgggcatggttggacgaagatagcaacctttctccttctccccttcgggacttgtcagggggcctgggagggcaggaggaagaggaggagcagcggtggttagacgccctcgaaaagggcgagcttgacgataacggagacctgaagaaagagataaacgagagactccttaccgccagacaaagggcgttgttacaaaaggcaagaagccaaccatcacctatgctgccactgccagtggcagaggggtgccccccaccagccttgaccgaagagatgctactgaagcgggaggaacgagcccgcaagcgaagactgcaggctgcccgccgcgccgaggagcacaagaaccagactatcgagagactgaccaagaccgccgctacttccgggcggggtggacgtggcggtgcccgtggtgagcgtcgtgggggccgggctgccgctccagcacccatggtcaggtactgctcaggcgcccaggggagcacgctatctttcccgcctggggtgcccgccccaacggccgtctctcagagaccaagcccttctgggcctcccccccgatgttcagtgccaggctgcccacatcccaggagatacgcttgctcgagaaccggacaggcgctctgctcccttcagtgttatcgcatcaacttgcagatgcggcttggtggccctgaaggtcccggttcaccgttgcttgcaacattcgagtcttgcgctcaggaatag

SEQ ID NO: 12115 - DNA, 594 bp, Artificial Sequence
  Description of Artificial Sequence: Synthetic coding sequence
atggccgcacagatacccattgtggctactacttcaacccccgggattgttagaaatagtaaaaaacggccggctagccccagccacaacggttcctctgggggcggctatggcgcaagtaagaagaagaaggccagcgcttctagtttcgctcaggggataagtatggaagctatgtccgaaaataagatggtgccctcggagttttctacgggtccggttgagaaggccgccaaacctctgccattcaaggatcctaattttgtccattccggacacgggggagccgtcgccggcaagaagaatcggacatggaagaatctgaaacagattctggcgtctgagagagcccttccttggcagctgaatgaccccaactatttctctatagatgcacctcccagcttcaagcctgcaaaaaaatactccgatgtctcaggactgctggagccgcccaattgcttcccccaacggctgcaccagttgacttttccactggctatggacgagggatccaacttttcaagatgttctccaaccctcgtaaatttcggatttgttttcataatggctattctggtgggtgtgaaatag

SEQ ID NO: 12116 - DNA, 579 bp, Artificial Sequence
  Description of Artificial Sequence: Synthetic coding sequence
atggccgcccagatacccattgtggccactacctccaccccgggaatcgtgagaaattcaaagaagcggcccgccagcccttcccataatggctcttctggcggcggctatggcgcttcaaagaaaaaaaaagcttcagcaagctcgtttgcccaggggatctctatggaggcaatgagcgaaaataagatggtcccctcagagttttctaccggcccagtggaaaaagctgccaaacctctccctttcaaagacccgaacttcgtgcacagcggccacgggggagcagttgcagggaaaaagaaccggacttggaaaaacttaaaacagatcttggcttctgagagagcactgccctggcagctgaatgatccaaactacttttccatagatgccccaccatcatttaagcccgccaagaaatatagtgatgtgtctggactgctggcgaattatacggatccccagagcaaactacggttttccacgatcgaggagtttagctacattcgcaggttacctagcgacgttgttactgggtacctcgcattgcgcaaggctacatctatcgtcccgtag

SEQ ID NO: 12117 - DNA, 687 bp, Artificial Sequence
  Description of Artificial Sequence: Synthetic coding sequence
atggctgctcagatcccgatcgtcgccactacatccactcctggaatcgttagaaactcgaaaaagaggccagcatctccttcccacaacggcagtagtgggggcgggtacggggcgagtaagaagaaaaaagcttccgctagctcttttgcccagacttgcttgtccccgagcaccatgatcgtacgtcccccccagccacgcggcacaacttgtctactcccgtctgctatgatcgttcgtccaccccagcctagaggaaatggaatcagtatggaagccatgagtgaaaacaaaatggtgccctcggagttcagcacaggccccgtggagaaggcggccaagcctctgcctttcaaagatccaaattttgtccatagcggccacggcggcgcagtcgctggcaaaaaaaatcgcacttggaaaaatctcaaacagatactcgcatcagaacgcgccctgccatggcagctcaacgaccctaactacttcagtattgatgctcctccctctttcaaacctgccaaaaagtacagcgacgtctcaggactcctcgccaattatacagacccgcagagcaagcttagattctcaaccatagaggaattcagctatattagacggctgccatctgatgtagtgaccgggtatttggcattgcgtaaagcgacttctattgtcccctag

SEQ ID NO: 12118 - DNA, 13692 bp, Artificial Sequence
  Description of Artificial Sequence: Synthetic coding sequence
atggatcctcctaggccagccttgttggctttacttgctctccctgccctgctgctgctgctgttagcaggtgcgcgcgcggaagaagaaatgctcgagaacgttagccttgtgtgtccgaaggatgccacacggtttaagcacctgaggaaatacacatataactacgaggccgagagttcatcaggagtgccagggactgcagattctagaagcgctacccgtattaattgtaaagtggagttggaggtgccacaactctgctcatttattcttaagacttcacagtgcacactgaaagaagtctatggattcaatcctgagggaaaggcactgttaaaaaagacgaagaactccgaggagttcgccgcggccatgagtagatacgagctgaagctggcaatcccagaaggcaaacaggttttcctgtatcctgagaaggatgagcctacctatatcctcaatattaagcgcgggattattagcgcactgttagttcccccggagactgaagaagccaagcaagtgctctttctggacaccgtctatggcaattgcagcacacactttaccgttaagacccgcaagggtaacgtagctactgaaattagtaccgagagagaccttgggcagtgtgacaggtttaaacccattcgaaccggcatcagcccattggccctcattaagggtatgaccagacccttatccacgctcatttcttcttcccagtcttgccaatatacactcgacgcaaaacgaaagcacgttgccgaagcgatctgcaaagagcagcacctgttccttcccttttcatacaagaacaagtacggcatggtggcccaggtcacccaaaccctcaaactggaggatactccaaagatcaacagcagattctttggagaggggactaagaaaatgggactggccttcgagtcaaccaagtccacatcacccccaaaacaggcggaagctgtgctgaagactttgcaggagcttaagaagctcacgatatctgagcagaacattcaacgcgctaacttattcaacaaactggtcacagagctaaggggcctgtctgatgaggcagtgacctctctgctgccgcaacttatcgaggttagcagcccaattaccctccaagctcttgttcaatgcggacagcctcagtgtagcacgcacatactacagtggctaaaaagagtgcacgccaacccgctcttgatcgatgtcgtgacataccttgtggctttaatccctgagccctctgcacagcagctccgtgaaattttcaatatggcccgagaccaacgctcccgtgccaccctgtacgcactgtctcatgccgtcaataactatcacaaaacaaacccaacgggcacccaggagctgctggacatcgccaactaccttatggaacagatccaggatgactgcacgggcgacgaagattacacctatcttatcctgagagtaattggtaatatgggccagacaatggagcagctcactcccgaacttaaatcaagtatcctaaaatgcgtgcaaagtaccaaacccagcctgatgatccaaaaggccgcgatccaggctctaagaaaaatggaaccgaaagataaagaccaggaggtattactgcagacatttctcgatgacgcaagcccgggggataaaaggctcgccgcatatctgatgttaatgcggtcaccttctcaagcagacattaacaagattgtgcagattctcccatgggaacaaaacgagcaggtgaagaacttcgtggcgtctcacattgccaacattcttaactccgaggagttggatattcaagatctaaaaaaactagtgaaggaggccctgaaggagtctcagcttccaactgtcatggatttccggaaatttagccgaaattaccaattgtacaaatccgtttctctcccgtcattggatccggcaagtgccaagatcgaaggtaacctgatcttcgatcccaataactacctcccgaaggagtctatgctgaaaaccacgctcacagccttcggattcgcgtcagcggaccttatagagattggcttggagggcaaaggctttgagccaacccttgaagccctcttcggcaagcaggggttttttccggactcagtaaataaagccctctactgggtaaacggacaagtgccggatggcgtctcaaaagttctggtcgaccatttcgggtatacaaaggacgacaagcacgaacaggacatggtaaacggtataatgctgtccgtggagaaactcattaaagacctcaagtcaaaggaagtcccagaggcgagggcatacctgcgcatactgggtgaggagctgggctttgcctctctccatgatctgcagctccttggcaaactcttgctgatgggagctagaaccctgcaaggcattccgcagatgatcggggaggtgattaggaagggttctaaaaatgatttctttctgcactacattttcatggagaacgctttcgagcttccaacaggggctggccttcagttgcagatctcctcgtccggtgtgatagcccccggcgcgaaggcaggcgtgaagctggaagtcgccaatatgcaagctgagctggtcgccaaaccttcagtgtctgtagaatttgtaactaacatgggaattattattcccgactttgccaggagcggtgtccagatgaataccaatttctttcatgagtctggactcgaagcacacgtggccctcaaagcagggaagctcaagttcattatcccatcacccaaaaggcctgttaagttgctatcaggaggaaatacactccacctggtgtcgactacaaagaccgaggtcatcccaccccttattgaaaatcgtcagtcttggtctgtgtgcaagcaggtgttccctgggctgaactactgcacatcgggagcatactctaacgccagctcaactgatagcgcttcctactaccctttaaccggggatacacggcttgaactggagctgcgcccaactggggaaattgagcagtactccgtgagtgctacctacgaactgcaacgagaggaccgagctttggtcgacacactgaagtttgtgactcaagctgagggggctaaacaaactgaggccacaatgacattcaagtacaatcgccagagcatgaccctgagctcggaagtgcagatcccggatttcgacgtggatttgggcactattttgcgcgtaaacgacgaatcaactgagggtaagacctcatatcgcctcactctcgatatccagaataagaagatcaccgaggtagcgctaatgggccacctctcctgtgataccaaagaagagagaaagatcaaaggggtgatttccatacctcgccttcaggctgaggcacgcagcgaaatcttggcccactggtccccagccaagttgctactgcaaatggacagttccgccaccgcctacggtagtaccgtgtcgaaacgtgtggcttggcactacgatgaggagaagatcgagtttgaatggaacacaggaaccaacgtggatactaagaagatgacttcaaacttccccgtcgacctgagcgactacccaaagtccttgcatatgtacgccaaccgcctcctcgatcatcgagtcccccagacagacatgacctttcgacacgtgggctccaagctgattgtcgccatgtccagttggttacaaaaggctagtgggagcctgccttacactcagaccctccaagatcacctcaattccctcaaagagttcaatctgcagaatatggggttgccggactttcacatccccgaaaaccttttcctgaagtccgacgggcgtgtaaaatacacactgaataaaaattctcttaaaatcgagatccccctgccatttggaggcaagtcctctagggacctgaaaatgctggagactgtcaggactcctgcgctccattttaagagtgttgggttccatcttccttccagagaattccaagtccccacattcactatccccaagctctaccagctccaggtaccactcctcggcgtgctggatctgtctactaacgtctattcaaacctatacaattggtctgccagctatagcgggggcaatacctccaccgaccatttctccctccgcgccagataccatatgaaggcggactctgtcgtggacctcctttcctataatgtccagggttctggagaaacaacgtatgaccacaagaataccttcacattgagctatgatggctctctgcgccacaaatttctggactcaaatatcaaattctcacacgtcgaaaagctcgggaacaatccagtgtcaaaagggcttctgatctttgacgcttcttcttcatggggcccccagatgtctgcttccgttcatctcgactctaagaagaagcagcacctgttcgtgaaggaggtgaagattgacggtcagttcagggtgtcttcattctatgccaagggaacctatggactttcttgccaacgagatccaaacacagggcgcctgaacggcgagtcaaatttgcgcttcaactcgagctacctgcagggcacgaatcagattaccgggcggtacgaggacggcacactcagcctgacaagcaccagcgacctccaatcaggtattatcaagaacaccgcctcactgaaatacgagaactatgagcttaccctgaaaagcgataccaacggcaagtacaagaacttcgccacaagtaacaagatggatatgaccttttccaagcaaaacgcacttttacggtccgagtatcaggccgactacgagagtctccggttcttctctttgctctctgggtccctgaacagtcatgggctggagttgaacgccgatatcttgggcaccgataaaattaactccggagcccacaaggcaaccctcaggatcggccaagatggaatctctacgtctgctactacaaatctgaagtgtagcctgttggtgttagagaatgagcttaatgcagagctcggcctctctggagcttctatgaaattaacaactaacgggcggtttagagagcacaatgcaaaattttcccttgacggcaaggcagcactgacagaactcagcctgggcagtgcctaccaggccatgattctgggtgttgattcgaagaacatcttcaactttaaggtgagccaggaaggtcttaagctgagtaacgacatgatggggagctacgccgagatgaagtttgaccacacgaactcactcaacattgctggactgagcctggacttctcgagcaaacttgacaacatttatagtagcgacaagttttataaacaaactgtgaacttacagttacagccttactctttagtcacaaccctgaactccgacttaaagtacaacgctctggatctcacaaataacggcaaacttcgcttagagcccttgaagctacatgtagctggcaatctgaagggcgcatatcagaataacgaaatcaaacatatctatgccatttcctctgccgccctgagtgcatcctataaagcggacacagtggcgaaagtgcagggggtcgaatttagtcatcggttaaacactgatattgccggactggcctcagctatagacatgagtaccaactacaacagtgattcgttgcatttctcgaacgtgtttagaagcgtgatggcgcccttcactatgaccattgatgctcatactaatggtaatgggaagttggccttgtggggcgagcacacgggccaactgtactcaaagtttctgcttaaagccgagcccctggcattcaccttcagtcacgactataaaggctcaacgtcgcaccacttagtgagtagaaagtcgatcagcgccgctcttgaacacaaggtttctgccttactcactcctgctgagcaaactggcacatggaaactgaaaactcagtttaataacaacgagtattcacaggacttggacgcttacaatacaaaagataagatcggcgtggagctgacggggcggactttggccgacctaacactgctggattcgcctataaaggttcctctgcttttgagtgagcccatcaacataatcgacgctctcgagatgcgcgatgctgtcgaaaagccccaggaatttaccatcgtcgcatttgtgaagtatgacaaaaaccaggacgtacattccattaatcttcccttttttgaaactctacaggaatattttgaacgtaatcggcagactatcatcgtcgtgctggaaaacgtgcagcgaaacctgaaacatataaacatcgatcagtttgtgcggaaatacagagctgccttgggtaagctgcctcagcaggctaacgattacttaaacagctttaattgggagcgtcaggtatcccatgccaaggagaagctgactgctctgacgaagaaatatcggattaccgagaacgacatccagatcgcccttgatgatgccaaaattaattttaatgaaaaacttagtcaactccaaacctatatgattcagttcgatcagtatattaaggactcatatgaccttcatgatctgaaaattgctatagcaaacatcattgacgaaataatcgaaaaactgaaatctctggatgagcattatcatatcagggtgaatctggtcaaaactattcatgacttgcatctctttattgagaatattgattttaataagagcggcagcagtaccgcttcctggatccagaatgttgacaccaaatatcagatacgaatacagattcaggaaaagctccagcagctgaaaagacacatccagaatatcgatatacagcacctcgccggaaagctgaagcagcatattgaggccatcgacgttagggtgctgctggatcaactgggaactaccatcagtttcgaaagaatcaatgatatcctcgagcacgtgaaacactttgtgattaacctgataggggactttgaagtcgccgagaagataaatgcctttagagccaaagtccacgagctcatagaacggtacgaggtcgaccaacagattcaagtgctgatggataaattagtggaactcgctcaccagtacaaacttaaagagactatccagaaactctccaacgtgctgcagcaagtgaagatcaaggactactttgagaagctggtggggtttatcgacgacgccgtcaaaaaacttaacgagctcagtttcaagacttttatcgaagacgtgaacaagttcttggacatgctgatcaagaaattgaagtccttcgactatcaccagttcgtggatgaaaccaacgataaaatccgagaagtgacacaacggctgaacggagaaattcaggccctagaactaccccagaaagccgaggcgctgaaactcttcctcgaggagaccaaagctacggtggccgtgtatctggagagccttcaagatactaaaattaccctgattatcaactggttacaggaggctctgtcctccgctagccttgcacatatgaaagcgaagttccgggagacgctggaggatacaagagataggatgtatcaaatggacattcagcaggaacttcagcggtacctgtctctagtaggccaggtatatagcactctggttacgtatattagcgactggtggactctcgccgcaaaaaaccttaccgatttcgcagaacaatattcgattcaggattgggctaaacgtatgaaggcccttgtcgagcaggggtttacggtgcctgaaatcaaaaccatacttgggacaatgccagctttcgaggtgtccctccaggcactccagaaggccactttccaaacacccgacttcattgtgcccctgacggacctccgcattccctcagtccagattaatttcaaggatcttaaaaatatcaaaatccccagtcgcttctctacaccggagttcactatccttaacacttttcacatacccagtttcaccatagacttcgtggaaatgaaggtcaagataatccgtaccatagatcaaatgcttaactccgaacttcaatggccagtccctgacatataccttcgcgacctgaaggtggaggacataccattggccaggattaccctccctgacttccggctgcccgagattgctatccctgagttcatcattccgactttgaacttgaatgatttccaggtgccagatctgcatatccctgagttccagctgcctcatatcagccatactatagaggtgccaacatttggtaagctgtattcaatcctgaaaatccagtcccctctcttcaccctcgatgcaaatgccgacattgggaacgggactacctctgccaatgaggctggtattgccgcctctattacagcaaaaggagagagcaagctcgaggtccttaatttcgactttcaggcaaatgcccagctgtccaatcccaagattaacccgctggccctcaaggagagcgttaaattctccagcaaatacttgcggaccgaacacggaagcgaaatgctttttttcggcaacgcaatagagggaaaaagcaacactgtggcctcactgcacacagaaaaaaataccctcgagctgtctaacggggtcatcgtgaagataaataatcaactgacactcgactcaaataccaaatactttcacaagctcaacataccaaaacttgatttcagtagccaagcagatctgcgcaacgaaattaaaacattactgaaggccggtcatatcgcgtggacctcctcagggaagggctcgtggaaatgggcctgccctagattttcagatgaagggacgcacgagtcacagatatcatttactattgaagggcccttaacttcattcggattaagtaacaaaatcaactcaaagcatcttagggtgaatcagaatttggtctacgagtcaggtagtctgaatttctcaaaactcgaaatacaatcacaggtagattcacagcacgtgggccattcggtgttgacagccaagggcatggctctgttcggcgagggcaaggccgagtttactgggcgccatgatgctcacctgaacggcaaggttatcggaacgctgaagaacagcctcttttttagtgctcagccattcgagattacagctagtacaaacaacgagggcaatctgaaggtccgctttccgctccgacttacgggcaaaatcgatttcctgaacaattacgcattattcctgtcccctagtgctcaacaggcaagttggcaagtatctgctcgattcaatcaatacaagtacaatcagaacttctcggctggcaataacgaaaacataatggaggcacacgtgggtattaacggggaggccaatttagactttctcaatatacctttgactatccccgagatgcggctaccctacaccatcatcacgacccctcccctgaaggatttctccctctgggagaagactggtctaaaagaatttctcaaaaccactaaacagtccttcgatctgtccgtgaaggcacagtataagaagaacaaacatcgtcatagcattacaaatcccctcgctgtgctctgtgaattcatcagtcagagtatcaagtccttcgataggcatttcgagaaaaatcggaataacgctctagatttcgtgaccaagtcctacaacgaaaccaagatcaagtttgataagtacaaggctgaaaagtcacacgatgagcttcccaggacctttcagattcccgggtacactgtgccagtggtgaacgtcgaggtatccccttttaccattgagatgagtgcctttgggtatgtattccctaaggcagtgtccatgccctcattctctatcctcgggagtgacgtgcgggtgccgtcctacacccttatcctgcctagcctcgaacttcctgttctccatgtgccaaggaatcttaagctgagtctgcccgatttcaaagaactgtgcacgatctctcacattttcattcccgcaatgggcaacattacctatgatttttccttcaagagttcagtcattactctcaacactaatgctgaactctttaaccagtccgacattgtggcacatttattatcttcgagttccagtgtgatagacgcgctgcagtacaagcttgaggggaccaccagattgactcggaagaggggcctcaagctagcaactgcactgagtctctctaacaagttcgtggagggttctcataactccacagtttcgttgactactaaaaacatggaggtcagtgtggctaccaccaccaaagcccagatccctatcctgaggatgaacttcaaacaggaattgaacggtaatactaagtccaagcccacagtcagctcatccatggagttcaaatatgattttaatagcagcatgctgtatagtaccgctaaaggagccgtcgaccacaagctgtccttggagtctctcacctcctactttagcattgagtccagtactaagggcgatgtgaagggaagcgtgcttagtagagagtattcgggcactattgcctccgaagccaatacatacctgaatagcaaaagtacccgtagttcggtgaagctgcaggggacctctaagatagatgatatatggaatctcgaggtgaaagaaaactttgctggcgaagccactctccaaaggatttatagcctctgggagcactctactaagaatcatcttcagctcgaggggcttttttttaccaacggtgagcatacgagcaaggccactctggagctctccccgtggcaaatgtctgccttggtccaggtccatgcctcgcagccatctagcttccacgacttcccggatctgggacaggaagtagccctaaacgccaatactaaaaaccaaaagattcgttggaagaatgaggttcgcattcactccggttccttccagtcccaggttgaactgtccaacgaccaggaaaaagcgcacctggacatcgctggttcgctggagggacacctgaggtttctcaagaacatcattctgccagtgtacgataaaagcttgtgggacttcctcaagctggacgtgactacctccatcggacgacgacagcaccttcgtgtgtccacggcctttgtctacacaaaaaatccaaatggatattccttttccatccccgtaaaggtgctggctgacaaatttatcatcccgggtcttaaattaaatgacctaaattctgttctcgtgatgcctaccttccatgtcccctttaccgatctgcaggtaccttcttgcaaactggatttccgagagattcagatctacaagaaactcagaacatctagctttgccctaaaccttcctaccctcccggaggtgaagtttcccgaggtggatgtgctcaccaaatacagccagcctgaagattcactgatcccttttttcgaaattaccgtacccgaaagtcagttgactgttagccagttcacactccctaagtccgtgtccgatggaatcgcagcactggatctgaatgcggtcgcaaacaaaattgccgacttcgagctgcccactatcattgtcccagagcagacaatagagatccccagcataaagttttctgttcccgcaggcatagttattccctcctttcaagctctgacagccaggttcgaggtcgactctcctgtgtataatgctacatggtcggcatcattaaagaacaaggctgactacgtggaaacggtcctggactccacctgctcctccacggtacaattcctggaatatgaactgaatgtccttgggacacacaaaattgaggatggcacacttgcctcaaagactaagggtacattcgctcacagggacttcagcgcggaatacgaggaagacgggaaatatgagggtctccaggaatgggagggcaaggctcacctgaatatcaagagccccgccttcaccgaccttcatctccgataccaaaaggataagaaaggcatcagcacctccgcggcttcaccagctgtgggtacggtcgggatggatatggacgaggacgatgacttcagcaagtggaatttttattacagcccacagtcttcaccagataagaagctgactattttcaaaactgaactgcgtgttagggaatccgatgaagagactcaaatcaaggtcaattgggaagaagaggctgccagtggcctgctgaccagcctaaaggataacgttccaaaggcgacaggtgtgttgtacgattacgtcaacaagtaccactgggaacacactgggctgacgcttcgggaagttagctccaagcttcgccgcaacctgcagaataatgccgagtgggtttaccaaggggccataaggcagatagacgatattgacgttaggtttcagaaagccgcttcggggacaaccggcacctatcaagaatggaaggacaaagcgcagaatttataccaggagctactgacacaagagggccaagcctcctttcaaggcctgaaggacaacgtgttcgacggcctcgtgagggtcacccaggagttccacatgaaagtcaagcatctgattgactccctcatcgactttctgaattttccacgcttccagttccccggcaaacctggcatctatacacgcgaggagttgtgcacaatgttcattcgtgaggtaggtacagtgctgtctcaggtctatagcaaggtgcataatgggtcagagattctgttttcctacttccaggacctggtcattacgctacccttcgaattacgaaaacacaagctgattgatgtgatcagcatgtatcgcgagctgctgaaggacttatccaaagaggcccaggaagtattcaaagccattcagagtctcaagacaaccgaggtcttgaggaacctgcaggatctcctgcagtttatttttcaactgatcgaggacaacattaaacagctgaaagaaatgaagtttacctatctaataaattacattcaggatgagattaacaccatcttcagcgactatatcccgtacgtctttaagctgctgaaagagaacctttgtttaaatctgcacaagtttaatgaatttatccagaatgaattacaagaggctagtcaagagttgcagcaaatccaccagtatatcatggccctccgagaggaatatttcgacccttctattgtggggtggacggtgaaatattacgagctagaggaaaagattgtctctttgattaagaatcttctggtggcgttgaaggatttccactccgaatatatcgtctccgcatccaactttaccagccagctgagctcgcaagtggaacagttcttgcatcgtaacattcaggagtacctgagtatcctcacagaccctgacggcaaaggaaaggagaagatagcagaacttagtgctacagcccaggagatcattaagagccaggccattgccacaaagaagatcattagtgattaccatcagcaattccggtacaagctgcaggatttctctgatcagctgtcggattattacgagaaatttatcgctgaatcaaaaaggttaatcgatctgtcgatccagaattatcatacgttcctgatctatatcacagagctactgaagaaactgcagagtacgacagttatgaatccttatatgaagctggcccctggtgagctgaccattatcctttag

SEQ ID NO: 12119 - DNA, 3084 bp, Artificial Sequence
  Description of Artificial Sequence: Synthetic coding sequence
atgtacgaagggaagcatattcatttctccgaagtggacaacaagccattatgctcgtattcacctaaactatgcaaacaaaggagactaaatggttacgcattctgtattcggcatgttttagaagacaagactgcccccttcaaacagtgcgagtatgtggccaaatacaactcacagcgctgtacaaatcccatccctaaatcagaagacaggaggtattgcaattcgcacttgcaggtgctgggctttattcccaaaaaggaacgcaaaaaaaagaatgacccaatcgatgaagtgaaagtgagacaccagatggacacgatggccttttctctgaccgtacctacgttggcactgaagatgccgaacggccttgatggcatgtcattgtctcctcctggggctagagttcctcttcactacctcgaaacagagctggaagaccccttcgccttcaacgaagaggacgatgacctgaaaaaaggcgcaaccgtcaggaagaaactgcaatcaaaactcgcacagaaccgacagcgtcagcgcgagaccgagatcctcaaggtgaggcaggagcacttcagccctccacccgcaccgtcccagcagcagccccctcagcagcattcacatctgagtccattatctacctctctgaaaccaccggctcccccccagggcagtgtttgtaaaagccctcaacctcagaacactagcttgccaatgcaaggtgtggctcccacgacccacacaatcgcacaagcccgtcaactgtctcacaagaggccactcccgttgctaccgtctagcagggcccccaccgtagaccctccacgaacagataggattttgatgaaggccacagctttctctccgcatttcagttgcatttcccggctgcaacgccttgtcaaattatgcacccaaaagcaccaacttgacactgatctcttcccacatcttggtttggactggtccgaagagtctggggaagaaccagaagattctgagcaggccagcccttatcaagtggcctggtcaatacgggagaccctgagataccagagacacgctagcgatgatgacgatgctgaatcccggtcatccagggtcacccagctttgcacatattttcagcagaagtacaagcacctgtgcaggctggagagggctgagtcaagacagaagaaatgtcgccacacatttagaaaagccctgctgcaggcagccagcaaagagcctgagtgcaccggacagctcatccaagaactgcgccgcgcggcgtgttcaagaacgtccataagtaggaccaagttgagagaagtagagcctgcagcctgtagcggcacggttaaaggggagcagtgcgcgaacaaagctttgccctttacgcgacactgcttccagcatattttactgaatcattcacagcagctattctcaagttgcaccgctaagttcgccgatggtcagcaatgtagtgtgcccgtgtttgacattactcatcagacccctctctgtgaagagcatgctaaaaagatggataacttccttagaggtgacaactccaggaaggtgcagcaccagcagcaacggaagcctcggaagaaaaccaaacctcccgcactgactaagaaacataaaaaaaaacgtagaaggggaccccgtcgaccccaaaaaccaattcccccagccgtgccacagggcaatttgtcaatgccagcatcagtgagcttacccgtcgaggcgtctcatattagatcaccttctactcctgagctttcagccgacgagttacccgatgacatcgccaacgaaattacggatatccctcacgatctggagcttaaccaagaagacttctccgatgttttaccccggctgcccgatgacctgcaggactttgattttttcgaaggaaagaatggtgacctactaccaacgactgaggaggccgaagagctggagcgagccttgcaggccgtcactagcctggagtgcctctccaccatcggggttctggcccaatcggatggtgtacctgtccaagagctgtctgatcgcgggattggcgttttcagcacagggaccggtgcgagcggtatccaatccctatctagggaggtgaacaccgatttgggggaactcctcaacggaaggatagtccatgataacttcagctcgctagagctggatgaaaacctgcttagatccgccacactctcaaacccacctacccccctcgccgggcaaattcagggacagttttccgcacctgcgaacgtcgggctcacctccgctactctcatttcgcagagcgcccttggcgaacgcgcattccctggccagttccacgggctccacgatggcagccatgccagtcagcgcccccacccagctcagctcctctccaaggccgacgacctgataacctcgaggcagcagtacagctccgatcattcacactcctcaccccacggctcccattacgactcagaacatgtacccagcccttattccgatcacataacatctccacacaccacttcctactcaggggataatatggcggctacttttagcgctgaaatgcccattatggcacagcatctcttgcctacacagctggaagtgccccttggcggcgtggtgaaccccagaactcactggggcaatctgcccgtcaatctgggagatccatcacccttttcaaacctcctcggagctgatggccatttgctgagcacctccctgtccacaccacccacaactagcaactctgagactacgcagcccgcgtttgccaccgtgacaccctcctccagctccgtgctgcctgggcttccacagactagcttctccggcatgggaccttcggcagagctgatggcctccacatcccctaagcagcagctcccccagtttagcgccgctttcggccaccaactgtcatcacactcaggtataccaaaggatctgcaaccttcccacagtagcattgctcctccaacagggttcactgtcaccggagctacggctaccagcaccaacaatgcttcgtccccatttccaagccccaactag

SEQ ID NO: 12120 - DNA, 114 bp, Artificial Sequence
  Description of Artificial Sequence: Synthetic coding sequence
atgtacgagggtaagcacatacattttagcgaagtagacaataagcccctgtgttcttacagccccaagttgtgcaagcagcggcggctgaacggatatgcattttgcatctag

SEQ ID NO: 12121 - DNA, 735 bp, Artificial Sequence
  Description of Artificial Sequence: Synthetic coding sequence
atgaacggtccagccgatggagaggtcgactacaaaaagaaatataggaatcttaaacgcaagcttaaattcctcatttatgaacatgagtgcttccaggaggaactcaggaaggcccagcgaaaactcctgaaggtcagccgggataaatcatttctgctggaccgattattacagtacgagaatgtggatgaggatagttccgactctgacgcaaccgcctcctccgacaactccgagaccgagggtactcctaaattgtcggataccccagcacctaagagaaagaggagtccaccccttggcggagcccctagcccttcatccctctccttgccacccagcactggattccccttgcaggcctctggagtgccctctccttacctttcctctctcgcctccagcagatatcctccatttcccagcgactaccttgcccttcagctacccgaaccttcccccctgaggccaaagcgggagaagagacctcgcctcccccgaaagctcaaaatggctgtgggtccacccgattgtccggtgggagggcctctgacttttcccggaagaggatccggggctggagtcggtacaacactgacacctctccccccaccaaaaatgccgccacctacaatattgtcaacagtgcctaggcagatgttcagcgatgccggcagcggtgacgatgccctggacggcgacgacgacttggtgatagatatacctgaatag

SEQ ID NO: 12122 - DNA, 486 bp, Artificial Sequence
  Description of Artificial Sequence: Synthetic coding sequence
gctggggccgcccgccaacccttattaggcgtggctgggggccaaacgctgggtgcaacccccgggccagtcatgaacgggccggcggatggagaggtagattacaaaaagaagtacaggaacctcaagcgcaaacttaagtttctgatctacgaacatgagtgtttccaggaggagttgcgaaaggcacagcgtaagctgctgaaagtttcgagggataagtccttcctcctcgaccggttgcttcaatatgagaacgtggatgaggattcatcagacagcgacgccaccgccagttccgataactcagagactgaggggactcctaaactgtctgatacgccggctccaaagcgtaagcgatccccacccctaggcggggcgccgagcccttcaagcctgagtctgcctcctagtactggcttccccctgcaggcttccggggtcccatctccttacctgtctagcgagaggggccaggcgtag

SEQ ID NO: 12123 - DNA, 414 bp, Artificial Sequence
  Description of Artificial Sequence: Synthetic coding sequence
atgaacggtcccgccgacggcgaagttgattataagaagaagtaccgcaacttgaagcgcaaactgaagttcctgatatatgaacacgagtgctttcaggaggaactgaggaaggcccaacgcaagctgcttaaggttagccgcgataaatcatttctgctggacagactgctgcagtatgagaatgtcgatgaggactcctccgatagcgacgccaccgcctcctccgataactctgaaaccgaaggaactcccaagctctccgatacccctgccccaaagcgaaagagatctccccccctgggcggcgctccaagcccatcatcactatccctgcctccctcaactgggttcccactccaagcatctggggtgccatcaccatatctctctagcgagcgaggccaggcctag

SEQ ID NO: 12124 - DNA, 735 bp, Artificial Sequence
  Description of Artificial Sequence: Synthetic coding sequence
atgaacgggccagcagatggagaggtggactacaagaagaaatacaggaacctgaaaaggaagctgaagttcctgatttacgaacacgaatgcttccaggaagagctgagaaaggcccagagaaagttactgaaggtaagcagagataagagtttcctgttggatagactcctgcagtacgaaaatgtagacgaggactccagcgactcggacgcaactgcctctagcgacaattcagaaaccgaaggtactcccaagcttagcgacaccccagccccgaagcggaagcgttcaccccctctgggcggagccccgtctccttctagcctctcccttccacccagcacaggattcccattgcaggcatccggagtgccgtccccgtatcttagctccctggccagtagcagatacccgccatttccgagcgactatttggcactgcaactccctgaaccgagtcctctgcgccctaaacgggaaaagagaccgcggctcccgcggaaactcaaaatggcagtgggaccacccgattgtcccgtcgggggacctttaacattccctggccgggggagtggagcgggcgtgggcactacattaactcccctgcctcccccaaagatgccccccccaactatcttgtccacagtaccaaggcagatgttctcagatgctgggagcggggatgatgcgctagatggggatgatgacctcgtaatcgacattcccgagtag

SEQ ID NO: 12125 - DNA, 2133 bp, Artificial Sequence
  Description of Artificial Sequence: Synthetic coding sequence
atgagtgcacagggggattgcgaattcctcgtgcagcgggctcgagaattggttccccaggatttgtgggccgccaaggcttggctgattacagctcggtccctgtatcccgccgactttaatattcagtatgagatgtatactattgagaggaacgcggagcgtactgccactgctgggcgccttctttacgacatgttcgtgaactttccagaccagcccgtcgtttggcgggagatctccatcataacctccgccctgcggaacgactcacaggacaagcagacccagtttcttcggagtttgttcgaaacgcttccaggacgggtgcagtgcgagatgctgctgaaggtgactgaacagtgcttcaacacacttgagcgctccgagatgttgctgctattactccgtaggttccctgagaccgtggttcagcacggggtcggcctgggagaagcactactggaggcggagactatcgaagaacaggaatctcccgtcaattgcttccggaaactgtttgtctgcgacgtcctacctctcatcatcaataatcacgacgtacgtctccctgcaaatctgctgtacaaatacctcaacaaggctgccgagttctatatcaattacgtgaccaggagtacacagatcgagaatcaacatcaaggcgctcaggacacctcagacctaatgagtccttctaaacgcagtagtcagaaatatataattgagggccttacagaaaagtcaagccagatcgttgacccatgggagagattgttcaagattttaaatgtggtcggcatgaggtgtgaatggcagatggataaggggaggaggagctacggggacatactgcacaggatgaaggacttgtgccgctacatgaataatttcgactcagaagcacacgcaaagtacaagaaccaggtcgtgtattccacaatgctcgtcttcttcaagaacgccttccagtatgtgaacagcatccagccgtcactgttccaggggccaaacgctccttcacaagtccccctggtactgctggaagatgtgagtaatgtgtatggcgacgtggaaatagacaggaacaagcacattcataagaagcgcaagctggctgagggcagggagaaaaccatgagctccgacgatgaggattgcagcgccaagggacggaaccgccacatcgtcgtgaacaaggcggagttggcaaactctaccgaggtgctggaaagctttaagctagctcgtgagagttgggagctcttatacagtctggagttcctggacaaggagtttacccgaatatgcctcgcatggaaaactgatacatggttgtggctgcggattttcctgactgacatgataatatatcaagggcagtacaaaaaagcaatagcttcccttcatcaccttgcagcccttcaggggagtatatcacagccacagattaccggacagggtaccctcgagcaccagcgcgccttgatccaactggccacgtgccacttcgccctgggggagtatagaatgacatgtgagaaagtgctagacctcatgtgttatatggtcttaccaattcaggatggcggtaagagccaggaggagccctccaaggttaagccgaagtttcgaaagggcagcgatttgaagttgctcccttgtactagtaaggccattatgccctattgcttgcacctgatgctggcctgctttaaactgcgggccttcacagataaccgtgatgatatggccttgggacacgtgattgttctgctgcagcaggaatggccgcgtggagagaacctgttcctaaaagccgttaataaaatctgccagcagggcaactttcagtacgaaaacttctttaattatgttacgaatatcgacatgttggaggaattcgcctatctccggacccaggaaggcggaaagatacacctcgagctccttccaaaccagggtatgctaattaaacatcacacagtaactcgggggattaccaagggggttaaagaggacttcaggctggccatggaacgccaagtgtcacgctgtggcgaaaatttgatggtcgttcttcacagattttgcataaacgagaagattctgctcctgcagacactgacttag

SEQ ID NO: 12126 - DNA, 1389 bp, Artificial Sequence
  Description of Artificial Sequence: Synthetic coding sequence
atggcagctacagttaatttggaactcgaccctatattcctaaaggctctgggcttcttacactcaaagtccaaagactcagctgagaagctcaaggccctccttgacgagtctctggcacggggaattgactcctcctatcgcccttcacagaaggacgtggagccccctaaaatctcctcaaccaaaaatatctcgattaagcaggagcccaaaatttcctcctccttgccatccggcaacaataatggaaaagttttgactaccgagaaggtgaaaaaggaggctgaaaagaggcctgccgacaagatgaaatctgacataaccgaaggagtggacatccccaagaagccgcgactggagaaacctgagacccagagtagccctataactgttcagtcatctaaggaccttccaatggctgatctgagttcctttgaagaaacaagtgcagatgattttgccatggagatgggattggcttgtgtagtgtgtagacagatgatggtggcatccggcaaccagctggttgagtgtcaggaatgccataacctgtatcatcgcgactgtcacaagccacaggtcacagacaaggaggccaatgatccacggctcgtctggtactgcgccaggtgtactagacagatgaaaaggatggcacagaaaacccagaaaccaccgcaaaagcccgcacctgcagtggtgtctgtgactcccgctgtgaaagaccctctcgtgaagaaacctgaaaccaagctgaagcaggagaccacatttctggcttttaaaagaactgaggttaaaacgtccacggtcatctcaggtaattcaagttctgccagcgtgtctagttctgtgacatccggtctcaccggctgggcagccttcgcagccaaaacctccagcgccggtccttccacagctaagctatcttctaccactcagaacaataccggaaaacctgccaccagttctgctaaccaaaagccggtgggactgaccggtcttgcaacctcatcaaaaggaggcatcggatcgaagattggttctaataacagtacaacgcctaccgtcccactgaagccaccccctcctctgactctgggaaaaactggcctgagtcggagcgtgtcatgcgacaacgtgtcaaaggtcgggctgccgagcccatcatctttggttccgggctcaagctcccaattgtcagggaatggcaacagcgggacgagtgggccgtctggcagcacaacgtctaagaccaccagtgaatcatcctcaagtccaagcgcatcactaaaagggcctacctcacaagagtcacaactcaatgctatgaagcgcttacaaatggtcaagaaaaaggcagctcaaaagaagctgaaaaaatag

SEQ ID NO: 12127 - DNA, 1389 bp, Artificial Sequence
  Description of Artificial Sequence: Synthetic coding sequence
atggcggcaactgtcaatctcgagctggacccgatcttcctgaaagcactgggtttccttcactccaaatccaaggactctgccgaaaagctgaaagctttacttgatgaatcactggctagagggattgacagttcttaccgtcccagtcagaaagacgttgaacctcccaaaatctcttcgacaaagaacatttccatcaagcaggaacctaagatctcctcttctttgcctagtggcaataacaacgggaaggtgctgacgacagagaaagtgaagaaggaggctgagaaacggccagcagacaagatgaagagtgacatcaccgagggggtcgatatcccgaagaaaccacgactcgagaagcccgaaacacagagctcccccataacagtgcaaagctccaaggatctgcccatggctgacttaagctcattcgaggagacaagcgcagatgacttcgctatggagatgggtttagcctgtgtggtttgtcgtcagatgatggtagcttcaggcaaccagctcgtggagtgccaggaatgtcacaacctatatcacagggactgtcacaagccacaggtgacagataaggaagccaacgacccccggttggtgtggtactgcgctaggtgcacccgccaaatgaagagaatggcccagaagacgcagaagcctccgcagaagcctgctcctgccgtggtctccgtgacccccgcagttaaggacccccttgttaaaaagccggagaccaaacttaaacaggagactacttttttagcctttaaacgaacagaggtaaaaacaagtaccgtcattagtgggaactcctccagtgcaagcgttagcagttccgttacttctgggttaacaggatgggctgcattcgcagctaaaacgtcctctgccggcccttcaaccgccaagctcagtagtaccacccagaacaacacaggcaaacctgctacttccagtgccaaccagaagcccgtgggtttgaccggtctggcgacatcgtccaaagggggaatcggcagcaagatcgggtctaacaactctaccacccccacagtgcccctgaaacctccccctccactgaccctagggaaaacagggctgagtcgctcagtgagctgcgacaacgtctccaaagtgggtttgcctagccctagtagtcttgtgcctggctccagctcccagctgagcggcaatggcaacagcggcacaagtggcccttccgggtccactacctctaagactacctcagagagctcttcctctcccagtgcaagtcttaaagggcctacgagtcaagaaagccagcttaacgccatgaagcggctccagatggtcaaaaaaaaggctgcacagaagaaattgaaaaaatag

SEQ ID NO: 12128 - DNA, 267 bp, Artificial Sequence
  Description of Artificial Sequence: Synthetic coding sequence
atggctgccactgtcaatctggaattggaccccatctttctgaaagctttggggtttttgcattccaagagcaaggactctgcggaaaagctgaaagcgctactggacgaatccctggctagggggatcgattctagctaccgaccgagccagaaagatgtggaacccccaaagattagctcgaccaaaaacatttcaataaagcaagagcccaagatttcctcatccctgcccagcgggaataacaacgggaaagtgctgacatag

SEQ ID NO: 12129 - DNA, 399 bp, Artificial Sequence
  Description of Artificial Sequence: Synthetic coding sequence
atggccgccacagtaaatctggagctggatcctatctttctgaaggctctcgggttcttgcactctaaatcaaaagatagcgcagagaaattgaaagcacttctagacgagagtcttgccagggggatcgatagctcgtatcgcccaagtcagaaggacgtcgagcctccaaaaatcagctctacgaagaacatatccataaaacaggaacccaaaatcagctctagcctgcctagtggcaataataacggaaaagtgctcacaacagagaaggtaaagaaggaagccgagaagcgaccagccgataagatgaagtcggacatcacggagggagtcgacattcccaaaaagccccggctcgagaaacctgagactcagtcatctcccattacagtttag

SEQ ID NO: 12130 - DNA, 267 bp, Artificial Sequence
  Description of Artificial Sequence: Synthetic coding sequence
atggccgcgaccgtgaacctcgaattggacccaatcttcctgaaggcgcttgggtttttgcattcgaaatcaaaagactcagccgagaagttaaaagccctgcttgacgagagcctggcgcgcggaatcgactcttcatatcgtccatcccagaaggacgtggaacctccaaaaatttcctccaccaagaacatcagtatcaagcaggaacctaaaatttcatcctctttaccttcggggaataataacggcaaggtcctcacatag

SEQ ID NO: 12131 - DNA, 1389 bp, Artificial Sequence
  Description of Artificial Sequence: Synthetic coding sequence
atggctgctaccgtgaatctcgagcttgacccaatctttctcaaggccttaggatttctccattcaaagtctaaggattcagctgagaagctgaaggctctgttggatgaaagtttggctcgggggatcgattccagttacagacccagccagaaagacgttgagccacccaaaatctctagtaccaagaatatttcgatcaagcaggagcctaagatctcctcttccctgccatccggaaacaacaatggaaaagtgcttacaacagaaaaggtgaaaaaagaggccgagaagaggccagctgacaagatgaaatctgacatcacagaaggcgttgacatacccaaaaagcccaggttagagaagccggaaacccagtcaagcccaatcaccgtgcagtcctctaaggatctccccatggctgacctgagctctttcgaggagacgtcagccgacgactttgcaatggaaatgggactagcctgtgttgtgtgcagacaaatgatggtggcatccggaaaccaactggtggagtgccaagaatgtcacaatctgtatcatcgtgactgtcacaaaccccaggtgactgacaaggaagcaaacgatcctaggctggtatggtattgcgcccgatgtacgcgccagatgaagcggatggcccagaagacccaaaagcccccacagaagcccgctccggctgttgtgtctgtgactcctgcagtcaaggatcctcttgtcaagaagcccgagacaaaacttaagcaggaaaccactttcttggccttcaagcgaaccgaagtgaagacatcaacagtgatctcaggaaactcgtcttcagctagcgtttcaagttccgtgacaagcgggctgacgggctgggctgcattcgccgcaaagactagttccgctggaccttccacggctaagctttcatcaaccacccaaaataatacaggcaagccggccacctccagtgctaatcagaaaccggtcgggttgactggactggccacctcttctaagggaggcataggcagcaagatcgggtctaataattccacaacccccactgtgccattgaaacccccacctcctttaaccctggggaaaacgggcctgagtaggagcgtcagctgcgataacgtgtccaaagtgggattgccttctccttccagcctcgtgcccgggtcgagcagtcagctgtccggaaacgggaacagtggcacgagtgggccttctggatcgaccacctctaaaacgacgtctgagtctagctcttcgccttccgcctcactcaagggacctacctctcaagagagccagctgaacgctatgaagaggctccagatggttaaaaagaaggcagcccaaaagaagctcaaaaaatag

SEQ ID NO: 12132 - DNA, 480 bp, Artificial Sequence
  Description of Artificial Sequence: Synthetic coding sequence
atggccgcaacggtgaatctggaattagatcctattttcctgaaagcgctagggttcctgcactccaaatctaaagactcagccgaaaaattgaaagccctgttagacgagagcctggctcgaggcatcgactcctcatacagacccagccagaaagacgtggagccgcccaagatttcctctactaagaacatctctataaaacaagaaccaaaaatttcctcctcgcttcccagtggcaacaacaatggaaaagtgctcaccaccgaaaaggtgaagaaggaagctgagaaacgtcctgccgacaagatgaaatctgacattacagaaggagtagacattccgaagaagccacgcctcgaaaagccggagacccagtcctctccgattaccgtgcagtcctccaaggaccttccgatggctgacctgtcttcatttgaggaaacatccgctgatgacttcgcgatggagatgggttag

SEQ ID NO: 12133 - DNA, 57 bp, Artificial Sequence
  Description of Artificial Sequence: Synthetic coding sequence
atggcggccactgttaacttggagctggatccaattttccttaaggcactcggatag

SEQ ID NO: 12134 - DNA, 3129 bp, Artificial Sequence
  Description of Artificial Sequence: Synthetic coding sequence
atggagctgcagaaaggtaagggagcggccgctgcagccgcagccagcggcgccgcaggcggggggggtggcggcgcaggggccggggctcccggcggcggtcggctactgctgagtacgtcactggatgccaaggatgagctagaggagcgcctggagaggtgcatgtctatcgtaactagcatgacggcgggcgtctctgagagagaggccaacgacgctttgaatgcgtatgtgtgcaagggcctcccgcagcatgaggagatttgcctcggtctatttacgcttattcttacagagcctgcacaggctcagaaatgttatagggacctggctctggtctccagggacggcatgaatatcgtattaaataagattaatcaaatcctgatggagaagtatctgaagctccaggacacgtgccggacacaactagtttggctcgtgagggaactcgtgaagagtggcgtgctcggagcagatggcgtatgcatgacttttatgaaacagatcgccggaggtgacgtcaccgctaagaacatatggcttgccgagtccgttctagacatcctgacagagcaacgggagtgggtgttgaagagttccattctgattgccatggcggtctatacatatttgcgactgatcgtagaccatcatggaactgcacagttgcaggcactcagacagaaggaagtggatttctgcatatctcttctgcgcgaacgattcatggaatgtttgatgatcggacgcgacctggtccgacttttacagaatgttgctcggatcccagagtttgagcttttgtggaaagacattattcacaacccgcaggcgcttagcccccagttcacaggtattcttcagctattgcagtcacgaacctcaaggaagtttctggcttgtagactgaccccggatatggaaaccaagctcttgttcatgacttctagagttaggtttggacagcagaaaaggtatcaggactggtttcagcgccaatatctctctacccccgactctcagtcactgcgatgtgatctgattcggtacatctgcggagttgtgcaccctagtaatgaggtactttcgagtgatatcttgcctcgttgggccattatcggatggctattgaccacctgtacaagtaacgtggcagcttccaacgccaagctggctctgttctatgactggttgttttttagtcccgacaaggacagtatcatgaacatcgaacccgccatcctggtgatgcaccactccatgaaaccccacccggctattacagcaaccctgctcgactttatgtgtcgcataattccaaacttttatccacctcttgagggccatgtgcgtcaaggcgtcttcagctcacttaatcatatcgtcgaaaagagagtcctggctcatttggcgcccttgtttgacaacccaaaattggataaggaattacgtgccatgctacgcgaaaaatttcccgagttctgctcctcaccttcccctccggtcgaggtgaaaattgaggagccggtcagcatggagatggacaaccacatgagcgacaaggatgagtcgtgctatgataacgcagaggccgctttcagcgatgacgaggaggacctgaacagcaagggcaaaaaacgggagttcagatttcatccgattaaggagacagtagtggaagaaccagtcgatattacgccttatctcgaccagctggacgagtccttgcgggataaagtgctgcaactccaaaagggctccgacacggaagctcagtgcgaggtcatgcaggaaattgtggaccaggtcctggaggaagactttgattccgaacaactgtctgttctggctagctgtcttcaagagctgttcaaagcgcattttaggggggaagtgctgccagaggagattacagaggaatcgctggaggagtcagtgggtaagcctctttacctgattttccgcaacctttgccaaatgcaggaagacaattcttcattcagccttctcttagacctgctttcagagttataccaaaaacagccaaaaattgggtaccatttattgtactatcttagggcatctaaggctgccgctggaaaaatgaacttgtatgaaagcttcgcacaggccacccagctcggagacctccacacctgcctgatgatggacatgaaagcatgtcaggaggacgacgttagactgttgtgtcatttaactccttccatctataccgaatttcccgatgaaacccttcgtagcggcgagctcctaaacatgatcgtggccgtaatcgactctgcccagctgcaggaactggtatgccatgtgatgatgggaaatctagtgatgttcaggaaggattccgtgctcaacatcttgatccagagcctcgactgggagaccttcgagcagtactgcgcatggcagctttttctggcccacaatattcccctggagactataatacctattcttcaacacctaaagtacaaggagcatccagaggcattgagctgcctgctgttacaactcagaagagaaaaacctagtgaagagatggtgaaaatggtgctctctcgcccttgtcatccagacgatcaattcaccactagcatactgcgacactggtgtatgaaacacgatgagttactcgccgaacatataaaaagcttgctgatcaagaacaacagcctgccccgcaaaagacaaagtcttagaagttctagctccaagctcgcacagcttaccctggagcagatccttgagcacctggacaacctccgactgaatctgaccaatacaaagcagaacttcttctctcaaaccccgatactgcaggcactgcagcacgtccaggccagctgcgatgaagcccataagatgaaatttagcgatctttttagcctggccgaggaatatgaagattcctccactaagccccccaagagccgccggaaagccgctttgtcttcgccaaggtctcgcaaaaacgccacccagccccccaacgccgaggaagagagtggcagttcctctgctagcgaggaagaagacacaaagcctaaacccacaaagaggaaacgaaaaggatccagcgccgtcggctctgactctgattag

SEQ ID NO: 12135 - DNA, 3129 bp, Artificial Sequence
  Description of Artificial Sequence: Synthetic coding sequence
atggagctgcagaaaggcaagggcgccgccgccgccgcggccgcaagtggggccgccggaggggggggtggaggcgccggagccggcgcccctggcggtgggcgactgctgctgtccacatcactagacgctaaggacgagttagaggaaagactggagagatgcatgagcatcgtgacgtcaatgaccgccggcgtgagcgagcgggaagccaatgatgcactcaacgcatatgtgtgtaaggggctaccacagcacgaggagatctgcctgggtcttttcaccctgattcttactgaacccgcccaggcccagaagtgctaccgggatttagctttggtctcccgagatggcatgaatattgtactcaataaaattaaccaaatattgatggagaagtatcttaagctgcaggacacctgtcgaacacagctggtgtggctggtgagggaactagtcaaatcaggggtcctcggtgcggacggagtgtgcatgacatttatgaagcagatcgcagggggcgacgtgaccgccaagaacatctggttggccgaaagcgttcttgatattctgaccgaacagcgcgagtgggtattaaaaagctcgattcttattgccatggcggtgtacacgtatctcaggctaatcgtggaccatcatggaacggctcagctgcaggcactgcggcagaaagaagtagatttttgcattagtctgttacgcgaaagattcatggaatgcctcatgattgggcgggacctcgtgcggctgctgcagaatgttgccagaattcccgaattcgaactcctatggaaggacatcatccataatcctcaggcactgtcccctcaatttaccggcatcctccagttactgcaatcacgcaccagccggaagtttttggcttgccggttgacccctgacatggagaccaaactgctcttcatgacatccagggtgcgctttggccagcagaaaagataccaggactggttccagagacaatatcttagtacgccggatagccaatcactccgctgtgaccttatccgctatatttgcggtgtggtgcatccatctaatgaggtactaagttccgacatcctcccccgatgggccattatcgggtggcttctgactacctgtacgtccaacgtcgcagcctccaatgctaagcttgctttgttctatgactggctctttttttcgcctgacaaggatagcatcatgaatattgaaccggctattttggtgatgcatcattccatgaaaccccaccccgcaattacagcgacactgttagatttcatgtgtcggatcatccccaatttctaccccccactcgagggccacgtgcgacaaggggtcttttcttccctgaaccatattgtcgagaagcgcgtactcgcccacttggctcctttgtttgataaccccaaactggataaagagctgcgagccatgctgagagaaaaatttcctgaattctgctcaagccccagcccgcccgtggaggtgaagatcgaggaacccgtttccatggaaatggataatcacatgtcggacaaagatgagtcatgctatgacaatgctgaagcagcctttagtgacgatgaggaagaccttaactctaaggggaaaaaacgggaattcagatttcatcccattaaagagacagtggtcgaagagccagtggacattaccccgtatctggatcagctcgacgaaagcctgcgggataaggtgcttcagctgcagaagggtagcgacactgaagcgcaatgcgaagtcatgcaggagatagtggatcaggttttggaggaggacttcgattccgagcaactatccgtgctggcttcttgcctgcaggagctcttcaaagctcatttcagaggcgaggtactgcccgaagaaatcaccgaagaatccttggaggaatctgtcgggaaaccactttatctaatctttcggaacctgtgccagatgcaagaggataacagcagttttagcttattgctggatttgctgagcgaactttaccagaaacagccaaaaatagggtatcaccttctttattatttgagagcctctaaagcagccgccggcaaaatgaatctatatgaatcctttgcccaggctactcagctgggggacctgcatacatgcttaatgatggatatgaaggcatgccaggaagatgacgtgagacttctgtgtcacctgacaccaagtatttataccgagttccccgacgaaaccttgcggtccggtgaattgctaaatatgattgtcgccgtgatcgattcagcgcagcttcaggagctggtgtgtcacgttatgatgggtaacctcgtcatgtttcggaaagactctgtgctaaacatactgatccagagcttagactgggagactttcgaacagtactgtgcatggcagctgtttctggctcacaacatccctcttgagacaatcatcccgatactacagcacttaaaatataaagagcaccccgaggcgctttcttgtttattgttgcagctgcggagggaaaagcctagtgaggaaatggtaaagatggttctgagccgcccttgccatcccgacgaccagtttaccacctctatccttcggcattggtgtatgaagcacgatgaactcctggcagagcacataaaaagcttgctaatcaagaataatagtcttccccggaagagacagagtctgaggagttcctcaagtaagctggcccagttgacacttgaacagatattagaacatctcgataacttaaggctgaatcttaccaataccaaacaaaacttcttcagccaaactcccatcttgcaggcccttcaacatgtccaagcttcctgcgacgaggcgcataagatgaagtttagcgatctttttagccttgccgaggagtatgaagactccagcactaagcctcctaagagccgccgcaaggccgcgctgagtagtccccgatctagaaaaaatgcaacacagcctcccaacgctgaggaagagtcaggcagctccagcgcgtctgaggaggaagacacgaaaccaaagcctactaagagaaagcgaaaaggttcaagtgcagttgggtctgactcagactag

SEQ ID NO: 12136 - DNA, 2709 bp, Artificial Sequence
  Description of Artificial Sequence: Synthetic coding sequence
atggcggtgtacacctacttgagattaattgtggaccatcatggtacagcacagttgcaggccctccggcaaaaggaagttgatttttgcattagcctgcttagggagcggttcatggagtgcctgatgattggccgagacctggtgaggttgctccaaaatgtggcacgtatccctgagttcgagcttctgtggaaggatatcattcacaaccctcaagccctctcgcctcaattcaccggtatcctgcagttgcttcaatcacgtacttctaggaagtttcttgcttgtaggctaaccccggatatggagaccaagctcctgttcatgacatcccgtgttcgttttggccagcagaagcggtatcaagattggttccaaaggcaatacctaagcacacccgattctcagtcccttaggtgtgacctaatacgctatatttgcggagttgtccaccctagtaacgaggtcctctcgtcagacatcctgccgcggtgggccataatcggttggctgctgacaacctgtacgtcaaatgtggccgcatccaatgccaagctcgccctgttttacgactggcttttctttagcccagacaaagacagtatcatgaatatcgagccagcgatactggtgatgcaccattccatgaaacctcaccctgcgattacggctacattacttgacttcatgtgtagaataatacctaacttttatccaccattggaaggccacgtaagacagggcgttttctcttctctgaaccatatcgtcgagaagcgggtgctggctcacctcgcccccctattcgataatccaaagttagacaaggaattgcgcgccatgttacgagagaagttcccagaattctgcagctccccctctcccccagtggaggtgaaaatcgaggaacccgttagcatggagatggataatcacatgtctgacaaagatgagtcatgctacgataacgctgaggcagccttcagtgacgacgaggaggacttgaatagcaagggcaaaaaacgagagttccgtttccatcccatcaaggagaccgttgttgaggagcccgtcgacatcacaccctatctagaccaactcgatgaatcgctaagggataaggtccttcaactgcaaaagggtagcgataccgaagcacagtgtgaagtgatgcaagaaatcgtagaccaagtcctggaggaggactttgacagcgagcagctgagtgttctcgccagctgcctgcaggaactgttcaaagcccacttccgcggagaggtcctgccagaggagattaccgaggaaagcttagaagaatcagttggtaaaccactgtaccttatatttaggaacctgtgccagatgcaagaggacaatagctccttctccttactacttgacctcctgtcagagctctaccaaaaacaaccaaagatcggctatcacctgctatactatcttagggcttcgaaggctgccgctggtaagatgaatttatacgaaagtttcgcacaggctacacagctgggtgacctacatacctgcctgatgatggatatgaaggcttgccaagaagacgatgtgcgcttactctgccatttgaccccgtctatctatacagagttccctgatgagactcttcggagcggcgagctactgaacatgatagtggccgtcattgatagtgcacagctacaggaactggtgtgccacgtcatgatgggcaacctcgtgatgtttcgaaaggattccgtgctcaatatcctgattcagagtttagattgggagacattcgagcagtattgcgcatggcagctgtttttggcccacaacatacctttggaaactattatacccattctacagcatttgaagtataaggagcaccctgaggctctcagttgtctcctacttcagttgcgaagggagaaaccttccgaagaaatggtgaagatggttctatctcggccctgccatcccgatgaccagttcactacctccatactgagacattggtgcatgaagcatgatgaattactggccgagcacattaaaagtctgctgatcaaaaacaactcccttcccaggaagcggcagtctctgcggagtagcagctctaaattggcacagctgacattggagcagatattggagcatctcgataacctcaggctcaatttgactaataccaagcaaaattgcatgccatccaccttaggcgttcaatgccgcagatgctgtcccggacctgattacgcgtggtcccaagctggcggaagaggccgcacccccggcgctactacccacaccagagacaaaactacgtgcgcctgctgcctcataagttcacaaacctcagactgtttctctttcccagcccttccatttctaccactcgtattctcccagactccgatccttcaggccctccagcacgtgcaggctagttgtgatgaggcccacaaaatgaagttctccgacctgttctccctggccgaggaatacgaagacagctctactaaacccccaaagtcaaggcggaaggccgccctgtccagcccccggtcccgtaaaaacgccacgcagccacctaatgccgaggaggaatctggctcctcctcagcctccgaagaagaagacactaaaccgaagccaacaaaaagaaaaagaaaaggcagcagtgcagtcgggagtgattctgactag

SEQ ID NO: 12137 - DNA, 2709 bp, Artificial Sequence
  Description of Artificial Sequence: Synthetic coding sequence
atggcggtttatacctacctgaggttgattgtcgaccaccacggcaccgcccagttgcaggccctgcgccaaaaagaagtagacttctgtatctcactgcttcgggagcgcttcatggagtgtttaatgatcggccgcgacctggtccgtctcctccaaaatgtggctcggataccggagtttgaactgttgtggaaggatatcatacataatcctcaggccctctccccacagtttacaggtatccttcagctcctacaaagtcgcacaagccggaagttcctcgcttgtcgcctgacaccagatatggagacaaagttattattcatgacatctcgggtgagatttggtcagcagaagcggtatcaggattggttccagagacagtacttgtctaccccagatagtcagagtttgagatgtgacttgattaggtacatctgtggcgtggtccatccttctaatgaagtcttgagctcagacattcttccccgctgggccatcatcggatggctgttgaccacctgtaccagcaacgtggctgcctcgaatgctaagctcgccctgttttacgactggctcttcttttctccggacaaagacagcatcatgaacatcgaacccgccatcctggtcatgcaccactccatgaaaccacaccctgctataacggcaaccttgctggattttatgtgcagaattatcccgaatttttaccctccattagagggtcatgtacgccagggcgtgttctcatccttgaaccacatcgtggagaaaagagtgctggcccatctagcccctctcttcgataacccgaagctggacaaagagctaagggcaatgttgagggaaaaattccctgaattctgttcatcccccagcccaccggtggaggtcaaaattgaagagccagtatctatggagatggataaccacatgtctgacaaggatgagagctgttatgataatgccgaagctgcctttagcgatgacgaggaagacttaaatagtaaaggtaaaaagcgagaattcaggttccacccaatcaaagagacagtggtcgaagaacccgtcgatatcaccccttaccttgaccagctggatgagtcccttagagataaagtactgcagctgcagaaggggagtgacacggaggcacagtgcgaagtcatgcaggagatcgttgaccaggtcctagaggaggactttgactcggagcagctgtcagtgcttgcctcatgtctccaggagctgttcaaagcccattttaggggggaggtcttaccggaagagatcactgaagaatcccttgaagagtcggtgggtaagcctttgtacttaattttccggaacctgtgtcagatgcaggaagacaatagctccttttcattactgttggatctgttgtccgaactctaccaaaagcagccaaagattggctatcacctgctgtattacctcagagcatccaaagccgccgccgggaaaatgaatctgtatgaatccttcgctcaagctacacagctgggcgaccttcatacctgcctgatgatggatatgaaggcttgtcaggaggatgacgtgaggctgttatgtcatttgaccccttcaatttacaccgagttccccgacgaaacacttcgcagtggtgaactgttgaacatgattgtcgccgttattgacagtgctcaattgcaggagttagtctgccacgttatgatgggaaatttggtgatgttcagaaaggattctgttctgaatattcttattcagtccctagattgggagacattcgaacagtattgtgcatggcagctctttcttgcccacaatatacctcttgagaccattatacctatcctgcagcatttgaaatataaagagcatcctgaggcccttagttgcctcctgctgcagctgaggcgagagaagccctctgaagagatggttaaaatggtgttaagtcgcccctgccaccccgacgaccagtttaccacctccatattgaggcattggtgtatgaaacatgatgaactcttggctgaacacattaagagtcttctgatcaagaacaattctcttcctcgcaaaaggcagtccctccggtccagttccagcaagctggcccagctgaccttagaacaaatcctcgagcacctcgataaccttaggctgaacttgacaaacactaagcagaattgtatgccctctacgctaggtgtgcagtgcagacggtgttgtcctgggcctgattatgcctggtcacaggccgggggaagaggccggaccccaggggcaactacccacaccagggacaagactacatgtgcctgctgcctgatcagctcccagacatcggattgcttcagtttcccagctctcccatttttgccattggtgttttctcagactcccattctccaggcactgcaacacgtgcaagcatcttgtgacgaggctcataagatgaaatttagcgaccttttcagtctagctgaagagtacgaagatagcagcaccaagccccctaagtcccgacggaaagccgccttgtcttcccccagatctagaaaaaacgccacccaaccacccaacgccgaggaggaatccgggagctcatccgccagcgaggaggaagatacaaaacctaagcctactaagcggaagcgcaaggggagctccgccgttgggagcgactcagactag

SEQ ID NO: 12138 - DNA, 1530 bp, Artificial Sequence
  Description of Artificial Sequence: Synthetic coding sequence
cccaacagtatatgcaggcacttacatctgacggacacatcacatggtgtccggaacaagtgtctacagttgctggggaatctgggtagtttggaaaagtctgtcacaaaggatgcagaaggcctggctgcaagggacgtacaaaaaatcataggggattatttctcagaccaggacccccgagtccggaccgcagccatcaaggctatgctgcagttacatgaacgtggcctgaagctgcatcagacaatatacaatcaagcttgcaaactcctgagtgacgattatgaacaggtcaggagcgccgccgtgcagctcatctgggtggtcagccaactctacccggaaagcatcgtgccgatcccctcatcgaacgaggagatccgcttagtggatgatgctttcggaaagatatgtcacatggtgtccgatggctcttgggtcgtacgtgtccaagccgcaaagctgctgggttccatggagcaggtatcctctcactttctggagcagactttggacaagaaactcatgagcgacctcaggagaaagcggaccgcgcacgaaagggctaaggagctgtatagcagtggcgagttcagctccggcagaaagtggggagatgacgccccaaaggaagaggtggatacaggagctgttaaccttatagagtctggggcatgcggggccttcgtccatggactggaagacgaaatgtatgaggtcaggatagccgcggttgaagccctctgtatgctggcccaaagttcaccatcttttgctgaaaagtgcctagatttcctagtggacatgttcaacgatgaaattgaggaggtgcgcctacagtctatccacacaatgcgaaagatcagcaacaacattaccctgcgcgaagatcagctggacaccgtgttagccgtcctcgaggattcctcccgggatatcagggaggcgctccatgagttactgtgctgtacgaatgtctccaccaaggaaggcattcacctggcactggtcgaactattaaagaacctgaccaagtatccaaccgaccgtgacagcatctggaagtgcctgaaatttctgggttctaggcaccccacattggtcctgcctctggttccagagctgctatctacccacccattctttgacacggccgagcccgatatggacgaccccgcgtacattgcggtgcttgtgctgatcttcaatgccgccaaaacttgtcccacgatgcccgctctcttctcagatcacacattcagacattatgcctacctgagagattctttgtcccacctggttcccgcacttcgtctgccgggtagaaagcttgtgagttcagccgtgagccccagtatcatcccccaggaggacccctcgcagcaatttctccagcaatctctcgagcgcgtgtattcactgcagcatttagatcctcagggcgctcaggagctactagagtttactatccgtgtggaagttagcccatggtggcctgggtggagtcaaacaccagaactgaagtag

SEQ ID NO: 12139 - DNA, 2892 bp, Artificial Sequence
  Description of Artificial Sequence: Synthetic coding sequence
atggctgctcacctgaagaaacgcgtttatgaggagtttaccaaggtcgttcagccccaggaggagatcgccacgaagaaactgaggttaactaaaccttcaaagtctgcagccctgcacatcgacctgtgcaaagctacaagccccgcagatgctttacaatacctgctccagttcgcacgcaaacctgtggaggctgaatctgttgaaggtgtagtgaggatcttgctggagcactattacaaggaaaacgatccgtccgtgcggctcaaaatagcaagcctgttgggtctgctgagcaagaccgccggcttcagtcccgactgtattatggacgacgcaatcaatatcttgcagaatgagaaatcgcaccaggtcctggcccagctgctcgatacccttctcgctatcggaaccaaacttcccgagaatcaggccatacagatgagactggtcgatgtggcctgcaagcaccttacagacacatcccacggtgtaagaaacaagtgtctgcagctgttgggcaacttagggtccctggagaagagtgtaactaaggacgcagagggactggcagcccgtgacgtgcaaaagataataggtgactattttagtgatcaggatccacgggtcagaacagcagcaattaaggccatgctgcagctgcatgaacgcggtctcaaactgcaccagacgatatacaaccaagcctgcaagcttctttcagacgattacgaacaggttcggtcagccgcggtgcagctcatttgggtggtatcccagctgtaccctgagtctattgtgcctataccttcaagcaacgaggagattagactggtggacgacgcgtttggtaaaatttgtcatatggtatcagatggttcctgggtggttagagttcaagccgccaagctgcttggttcaatggagcaggtttcgtctcactttctggaacagacactcgataagaagttaatgtctgatttacggcgcaaacgcacagcgcacgagcgggccaaagagctgtacagtagcggtgaattttcctcaggtcgtaagtggggcgatgacgcgcccaaggaggaagtcgatactggcgccgttaacctgatcgagtctggagcttgcggcgccttcgtgcatgggctggaagatgagatgtatgaagtcagaatcgctgccgtagaagctctgtgcatgcttgctcagtctagtcctagcttcgctgagaaatgcctcgatttcctcgttgatatgtttaacgacgagattgaagaagtgcgccttcagagtatacatacaatgagaaagatctctaacaatatcacccttagagaagatcagcttgacactgttcttgcggtcctcgaagacagctcccgcgatatcagagaggccttacacgagctgctctgttgcactaatgtgtctacgaaagaaggaatccacctcgctcttgtggaactgttgaagaatctcaccaaataccccacagatcgcgactcgatctggaagtgtttgaagtttcttggttcgaggcaccccaccctagtgctccccctggtgccagagctgttaagcacccaccccttctttgacacggctgaaccggacatggatgatcctgcctacattgccgtcctggtgttgatctttaacgctgctaagacatgccccaccatgcccgccttgttttctgatcacacatttagacactatgcgtatctgagggatagcctctcccacctggtgcctgcacttaggcttcctggcagaaaacttgtcagctccgcagtaagtcctagtatcatcccacaggaggatccgtcgcagcaattcctgcagcagagccttgaacgcgtgtatagcctgcagcacctcgacccacagggcgcccaggagctgctggaattcacaatccgggatttacaacggctgggggagctgcagagcgagctggctggtgtagctgatttctctgctacttacttacgctgtcagctgttgctgattaaagccctccaggagaagctttggaacgtcgctgcgcccctgtacttgaagcagagcgacctcgccagcgccgccgcaaaacagatcatggaagaaacatacaaaatggaattcatgtacagcggcgtggagaacaaacaggtggtgatcattcatcacatgcggctccaggcaaaagcccttcagctgatcgtgaccgctcgaacaacgagagggctcgacccgttgttcgggatgtgtgagaaatttcttcaggaagtggactttttccagcgctattttatcgccgacctgcctcaccttcaggattccttcgtggataagctgttagatctgatgcctcggctcatgactagcaagccagccgaggtggtcaaaatattgcagactatgctgagacaaagcgcttttctgcacctgccactgccggaacagattcataaagcttcagccactatcattgaacccgcgggagaaagtgataacccattacgttttacatccggactggtggttgcgctcgacgtggatgctacactcgagcatgtgcaagatccacagaacaccgtgaaggtgcaggtgctgtatccagatggccaggcccaaatgattcacccaaagccagctgacttcaggaaccccggtcccggaaggcaccggctgattacacaagtctatctttctcacaccgcatggaccgaagcctgtcaggtagaagtccggctccttctcgcatacaactcttccgcacggattcccaaatgcccctggatggaaggaggggagatgagcccccaagtggagacctcaattgagggcaccattcctttttctaagcctgttaaagtttacattatgcctaagcccgcacgtaggtag

SEQ ID NO: 12140 - DNA, 1017 bp, Artificial Sequence
  Description of Artificial Sequence: Synthetic coding sequence
atgcccgccctcaaacagaccgccagccaggtgacacagacgttgcgggatctgcaaagactgggcgaactgcaatccgagttggccggggtggctgacttctctgctacttatctcaggtgtcagcttttactgattaaggccctgcaggaaaaactatggaacgttgctgcgccgctatatctcaagcagagtgacttagcctcagccgccgctaagcaaattatggaggagacatacaaaatggagttcatgtactcaggtgttgagaacaaacaggtcgtcattatccaccacatgagactgcaggctaaggcactccaattgatcgtgactgcgcgtacaacacgaggcctcgatcctttatttgggatgtgcgagaaatttctacaggaagttgatttctttcagcgatacttcatcgcagatctgcctcacctgcaggactcatttgtagacaagctgctcgatctcatgccgaggttgatgacatccaagcccgcggaagtggtgaagatcctgcagacgatgttgcgacagtctgcatttctgcacctgccattacctgaacagattcataaggcttccgcaactattatcgagccagctggtgagagcgacaacccactgcggttcacctctggcttggtggtcgctctggatgtggatgccacgctggaacatgtccaggatcctcagaatactgtaaaggtgcaggtcctttaccctgatggacaagcccagatgatccaccctaagcccgccgacttcaggaaccccggtcccgggagacaccgcctgatcactcaggtgtacctgtctcacactgcctggaccgaagcttgccaggtcgaagtacggctactgttggcgtacaatagttccgctagaattccaaaatgcccctggatggaaggcggcgagatgagcccacaggtagaaacttctatcgagggtacaattccatttagtaagcccgtaaaagtttatatcatgcccaaaccagcaagacgatag

SEQ ID NO: 12141 - DNA, 2829 bp, Artificial Sequence
  Description of Artificial Sequence: Synthetic coding sequence
atggcttccaattcaaccaagtcctttcttgccgatgccggatacggcgagcaagaacttgacgctaatagcgctctcatggaacttgataaaggcttgcgatcagggaaattgggggagcagtgcgaggctgtggtcaggtttccgcgcttattccagaaatacccctttcctatactcatcaattctgccttcctcaaattggcagacgtctttcgggtgggcaataatttcctgagattgtgtgtgttgaaagtgacccaacaatcagagaaacatctcgaaaagatactgaatgtggacgagttcgtaaagagaatcttctcggtaatccatagcaacgatcccgtggcaagggccattaccctccgtatgttgggttccctggcctctattataccagagaggaagaatgctcaccacagcattaggcaatccctcgattcgcacgataacgtggaagttgaagcagccgtcttcgccgccgcaaacttctcagcccagagcaaggacttcgctgttggcatttgtaataagatctctgaaatgattcagggtttagcgacaccagttgacttaaaactcaaactgatacccatcttgcagcacatgcaccatgatgccattctcgcatcctccgcgaggcaactgctccaacagcttgtcactagctaccctagtacaaagatggtcatcgtatctctccatacattcacactactcgcggcatccagtctcgtggataccccaaaacaaatccagctgctgctacagtacttgaagaatgatccgcggaaagccgtcaaacgactggctatccaggaccttaaactgctggctaataaaaccccccacacctggagcagggagaatatacaagctctttgtgagtgcgccctgcagactccctacgattcactcaagctcggaatgctctccgtgctatccacactctccggcaccattgctatcaaacattatttttctatcgtacctggcaacgtatctagctcccctcgcagttcagatttggtgaaattggctcaagagtgttgttatcataacaatcgtggaatcgcagcccacggcgtcagggtgctgaccaatattacagtcagttgccaagagaaggacctgctggcactcgaacaagatgctgtgtttggcctggagtcactgctggtattgtgcagccaggacgacagtcctggagcccaagctaccctaaaaatcgctcttaactgtatggttaaactggccaagggaaggccacacctgtcccagtcagtggtcgagaccctgctcacacagctccattccgcacaggatgctgccagaattctgatgtgccactgtctggccgcaatcgccatgcagctccctgtcttgggggacggaatgctgggtgacctgatggagctgtacaaggtgatcggccggtctgccaccgataagcagcaagagctcctggtgagcttggccaccgtaatattcgtggcgtctcagaaggccttgtccgtagaatcgaaggctgtaatcaagcaacagctcgaaagtgtgagtaacggctggactgtataccgcattgcccggcaggcatccaggatgggaaaccacgatatggcaaaggaactgtatcagtcgctcttgacacaagtggcaagcgaacacttttatttttggctgaactccttgaaagagttttcacatgctgagcagtgccttacgggcttgcaggaggagaattatagctcagccctatcctgcattgcagaaagtctgaagttctatcacaagggaatcgccagcctgacagccgcttctactccgttaaaccccctctctttccaatgcgagttcgttaaacttagaatcgatcttctgcaagccttttcccagctgatctgtacttgcaatagcctgaagacctcacccccacctgcgatagccacgacgatcgctatgactttggggaatgatctccagcggtgcggtaggatctctaaccaaatgaagcagtctatggaggaatttcgcagcctcgcatccaggtacggcgatttgtaccaggcttcgttcgatgctgactctgctacactgaggaacgtcgagcttcaacagcagtcctgcctactgatttcacatgccattgaagctttgatcctggatcccgagagcgcctcgtttcaggaatacggatcaaccggcactgcccacgctgattcagaatatgagagacggatgatgtccgtctacaatcacgtccttgaggaagtggagtcccttaatcgcaaatatacacccgtgtcctatatgaggtatttttttcagaagctccaaagcacttctatcaaactggctctgtccccaagtcctagaaaccccgctgaaccaatcgccgtccaaaataatcaacagctggcactgaaggttgagggggtcgtgcagcacgggtccaaaccaggtctttttaggaaaattcagtccgtgtgtctcaatgtgtctagcacactccaatcaaagagtgggcaggactataagatcccaatcgataacatgactaatgaaatggagcagcgagtagaacctcataacgattacttcagtacccagttccttctgaacttcgcaatccttgggacacataatatcactgtagagagttcagtcaaggacgcgaacggaatcgtgtggaagacagggccccggacaacaatcttcgtgaagtcactcgaggacccttactctcagcagatacgattgcagcagcagcaggcccagcagccactgcaacagcagcagcaacgcaacgcctatacccgattttag

SEQ ID NO: 12142 - DNA, 2847 bp, Artificial Sequence
  Description of Artificial Sequence: Synthetic coding sequence
atggcatcaaatagtactaagagtttcctcgcagatgccggctatggcgaacaggagctcgatgcgaactccgctctcatggagctggataaaggcctgaggtccgggaagctgggtgagcaatgcgaggccgtcgttaggttccccaggctttttcaaaagtaccctttcccaatcttgatcaacagtgctttcttaaagctggccgatgtgtttagggttgggaacaatttccttcggttgtgcgttttgaaagttacccagcagtccgaaaagcatctggagaaaatcctgaatgtcgatgagttcgtcaagaggatctttagcgtgatacacagcaatgacccagtggctagagcaatcaccctgagaatgctggggtctctggcttccatcattccggagaggaagaatgcccaccactctattaggcagagtctggacagccacgacaatgttgaggtggaagctgccgtcttcgcagctgcgaacttctccgcccagagcaaagactttgcggtcggaatctgtaacaaaattagcgagatgatccaaggtttagcgacccccgttgatctgaaactgaagttaattcccatcctgcagcatatgcaccacgatgcaatattggcaagtagcgcccggcagttactgcagcagctcgtgactagctacccgagtaccaaaatggttatagtgagtctccacacttttaccttgctggctgcctcttctctggtagatacacccaagcagatccagctacttctgcagtacctgaaaaacgaccccagaaaggctgtgaaaagattagcaatccaggacctgaagctgctggccaacaaaactcctcacacatggagccgagagaatattcaagccctgtgcgagtgcgctctgcagacaccctatgactcgttgaagctcggtatgctgagcgtactgagcactctgtcagggaccattgcaatcaaacattatttctcaatagtacctggaaacgtcagctcttccccccgatcttctgatttggttaagttggcacaggagtgctgttatcacaacaatcggggcatcgccgcccacggagtgagggttcttaccaatatcaccgtgagttgtcaggaaaaggacttactggcactcgagcaggacgctgtgttcggtctggagtccctgctcgtcctgtgttcacaagatgacagccccggggcccaggcgacactaaaaattgccttaaattgtatggtaaagcttgccaaagggcgaccacatctctcccaatctgttgttgaaactctgttaactcagttgcactccgcccaggacgcagcacggatcttgatgtgccactgcctcgcagccatcgcaatgcagctccctgtgctgggtgatgggatgttaggggatctgatggaactctacaaggtgattggccgcagcgctacagataaacagcaagaactcctcgtctcattggccacagtgatttttgtggcatctcaaaaagctctgtccgtggagagtaaggccgtgatcaagcagcaactcgagtccgtcagcaatgggtggactgtttaccggattgccagacaagcctccaggatggggaaccacgatatggcgaaagagctctatcagtcgcttctgacacaggtagcatcagaacacttttatttctggttgaactctctgaaggaattctcccatgccgagcagtgcctcacgggcttacaggaggagaactattcatcggccctgagttgcatagcggagagtctcaaattttatcacaaagggatcgccagcctgactgccgcgtccactccactgaatcctcttagtttccagtgcgaatttgtcaaattacgcatagaccttctgcaagccttcagtcagctcatttgtacctgtaacagcctaaagacaagtccaccccctgcaatcgccacgaccatcgcaatgactctcgggaatgacctgcagcgatgtgggaggattagcaaccagatgaaacagtccatggaggagttccgatcactagcctccagatacggtgatctttaccaggcaagttttgatgcagacagcgctacgctgaggaacgtggaattacagcaacagtcctgcctcttgatctcccatgccatagaggccctgatcctagatccagagtcggcctctttccaggaatacggttccacaggcactgctcacgcagactcagaatatgaacgacggatgatgagtgtctataaccatgtgcttgaggaacacactgcctgcctctgcaacgccatcatcgcccttctaaaagtgcctctgtccttccagagatatttttttcagaaacttcagtccacatccataaagctcgccctttcaccatctccacgaaatccagctgaacccattgccgttcagaacaaccagcaactggccctcaaggtggaaggagtggttcagcacgggtccaagcccggactgtttcgtaaaatccagtctgtttgcctgaacgtttccagtacccttcagtcaaaaagcggacaggattacaagataccgatagacaacatgacgaacgaaatggagcagcgcgtagagccacataacgattatttttccactcagttcctgctaaacttcgctatcctgggaacacataatattacggtagaatctagcgtgaaggacgcaaatgggattgtctggaaaaccggcccacggactacaatcttcgtcaaatctctggaagacccatactctcagcaaatccgtctccaacagcagcaggctcaacaacctctgcagcagcagcagcaacgaaatgcttacacacgattctag

SEQ ID NO: 12143 - DNA, 2889 bp, Artificial Sequence
  Description of Artificial Sequence: Synthetic coding sequence
atggcgtccaacagcacaaagagcttcctggccgacgccgggtatggtgaacaagagctggacgctaacagtgcacttatggagctggacaagggactgcgctccggtaaattaggtgagcagtgcgaggctgtggttcggtttccgcggctgtttcagaagtatcctttcccgattcttattaattcagccttccttaagctggcggatgtcttccgggtggggaataacttcctgcgactgtgcgtcttaaaggtcacacagcagtctgaaaaacacttagagaaaattctcaacgtcgacgagttcgtgaagagaatcttttccgtcattcattctaatgatcctgtagctagggccattaccttaaggatgctcggcagtcttgcctcaattattccagagagaaaaaatgcccaccacagcatacgccagtctcttgattcacacgacaatgtggaagtggaagctgcagtcttcgcagcggctaacttttccgctcagagtaaggactttgccgtcggaatctgcaataaaatctccgagatgattcaaggactggccactccagtggacctcaagttgaaactgattcctattcttcagcatatgcaccacgacgcaatcttggccagcagtgcaaggcagttgctgcagcagcttgtaacctcatacccctcaactaaaatggtgatcgttagtctccacacattcacattgctggccgcatccagtctcgtcgatacacctaagcagatccagctgctactgcaatatctcaagaacgatccacggaaagcagtgaagaggctggccatccaggacctcaaactgttggccaacaagacgccgcatacgtggtctcgcgaaaacattcaggctctgtgtgaatgcgcgctgcagactccgtacgacagtctgaaactgggcatgctgtctgttctgagcactctcagcggcactattgcgattaaacactattttagtatcgtccctggtaatgtatctagctccccccgatcaagcgacttagtgaagttagcccaggagtgttgctaccataataaccggggcatagccgctcacggcgtgagagtgctgaccaacataaccgtctcctgccaggaaaaagacctcctggctctggagcaagatgcggttttcggcctggagagtctgctcgtcctctgttcccaggatgacagcccaggagcccaagctacccttaaaatcgcactgaactgtatggtgaaattagctaagggacggcctcacttaagtcagtctgtggtggaaacactgctgacgcagttgcactctgcgcaggacgccgcgcggattctgatgtgccactgcctcgcagcaatcgctatgcagctgccagtcctaggtgatggtatgctcggagatttaatggaattgtacaaagtgatcggtagatccgccacagacaagcaacaggaacttcttgtgtctcttgccacagttattttcgtggccagtcagaaagccctgagtgtggaaagtaaggcagttattaagcagcagctcgaatccgtctctaacgggtggacagtctacaggatcgcccgtcaagcaagccgcatgggcaaccacgatatggccaaagaactgtatcagagtctactgacgcaagtagcttcagaacatttctatttctggttgaattctctgaaggaattcagccacgctgaacaatgtcttactggattgcaggaggagaactactcttccgccttgtcttgtatcgccgagtcgctgaagttctaccataagggcatcgcttccctgacagccgcgagtacacccctcaaccccctttcgttccagtgtgagttcgtaaaactgaggatcgacctgctccaggcattctcacaactgatatgtacatgcaattccttgaagacttcacccccgccagctattgccacaacaattgccatgactctgggcaacgaccttcaacggtgcgggagaatctccaaccagatgaagcagagcatggaagagtttcgaagcctggccagccgctatggggacctttatcaagccagctttgacgccgattctgcgacactccggaatgtggaactgcagcagcagtcttgcctgttaatttctcatgccattgaagccctgattttagaccctgagagcgccagctttcaggagtatgggtccaccggaaccgcccatgccgattcggagtatgaacgccgcatgatgtctgtatataaccacgtgttggaagaggttgaatcgctgaacaggaaatatactccggtgtcctacatgcataccgcttgcctgtgtaatgccataattgctcttctcaaagtacctctgagcttccagcggtacttctttcagaaactgcagagtacgagcatcaaattagctttatccccctccccccggaatcctgctgaacccatcgcggtacagaataaccagcagcttgctctgaaagtagagggcgtggttcagcatggcagtaagccgggactgtttcggaagatccagtcagtgtgtctgaacgtgtccagcacactgcagagcaaatccggccaggactataagattccgatagacaatatgacaaatgaaatggagcagcgtgttgagccccataatgactacttttccactcagttcctgctcaatttcgctattctaggtacacacaatatcaccgtggagtcctctgttaaggacgccaatggtatcgtttggaagacaggtcctcgcaccaccatatttgttaaaagcctcgaggacccttactcacagcagattcggctccagcagcagcaggctcagcagcctctgcagcagcagcaacagcgcaatgcctacacacggttctag

SEQ ID NO: 12144 - DNA, 2742 bp, Artificial Sequence
  Description of Artificial Sequence: Synthetic coding sequence
atggcctccaatagcaccaaaagctttcttgcagatgccggctacggagagcaggaacttgatgccaacagcgctctcatggaacttgacaaggggctccgaagcggaaagttgggagaacagtgcgaagccgtcgtacgttttcctcggctttttcaaaagtatccctttcctatcttaattaactcagcctttctgaagttagccgacgtgttccgcgtgggcatgctcgggtccttagcttctataatcccagaacgcaaaaacgcccaccactcaatccggcagtccctcgactctcacgacaacgtggaagttgaagctgcagtctttgctgccgctaacttctccgcccagtctaaggatttcgctgtcggcatttgtaacaaaatttccgagatgattcaggggctcgctacacccgtcgacctgaagctgaaactcatcccgatccttcaacacatgcaccacgacgccattctcgcttcatcagcccgccagttgcttcaacagcttgtcacgagctaccctagtactaagatggtgatagtttccttacacaccttcaccctgctggccgctagttcgttggtggacaccccaaaacaaatccaactgctgctccagtacttaaaaaatgatccaaggaaagcagtcaagaggctggccattcaggatctaaagttactggctaacaagacaccccatacctggagtcgggaaaatatccaggccttgtgcgagtgcgccctgcagacaccgtatgatagcctgaagttaggcatgctgagtgtgctgtccactctgtctggcactatcgcaatcaagcattatttctcaattgtgcccggtaacgtgtctagtagccctcgaagcagcgatctcgtgaagctggcccaggagtgctgctaccataacaatagggggattgctgctcacggtgtacgagtgcttacaaacatcacagtcagctgccaggagaaggaccttctggccctggaacaggacgctgtgttcggactcgaaagccttcttgtgttgtgctctcaggacgacagtccaggagctcaggcaacactgaagatcgctctcaattgtatggtgaagctggccaaaggtaggccccacctgtcccagtccgttgtggagacgctgctgacccagttgcattctgcacaggacgcagcacggattttgatgtgccattgtcttgctgctatagcaatgcagctgcctgtgctgggagacggcatgctgggagacctcatggaattgtataaggttataggtcgcagcgctaccgacaaacaacaggaactgctggtctcacttgctacagtcatattcgtagcttctcagaaagcactatccgtggaaagcaaggctgtcatcaaacagcagctggaaagtgtgtctaacggttggacagtgtatcgcatcgcccggcaggcaagtagaatgggcaaccatgacatggccaaagagttgtatcagtccctgctcacccaggttgcctccgaacatttttatttttggctcaacagtctgaaggaattcagccatgccgagcaatgcttgactggcctccaggaggaaaattactctagtgccctctcctgtatcgcagagtccctcaagttctatcacaagggcatcgcgtcattaaccgcagcttccactcctctcaatccccttagttttcagtgtgaattcgtcaagctccgcattgaccttttacaggccttcagtcagctcatctgcacctgcaatagtttgaaaactagcccacctcctgcaatagccactacaatcgctatgaccctcggcaatgacctgcagcggtgtggaaggataagtaatcagatgaaacagtcaatggaagaattccgcagcttagccagccgctacggggacctctatcaggccagctttgacgcggatagtgccacactgagaaacgtggagctgcaacagcagtcatgcctgctgatttcccatgctatagaggctctcattctagaccctgaaagcgcatcattccaggagtacgggtccaccgggacagctcatgccgactcagagtatgagcgcagaatgatgagcgtgtacaatcatgtgctcgaggaagtggaatctctgaaccggaagtatactcctgtttcctacatgcacaccgcttgcctttgtaatgccatcatcgccctgctcaaagtgcccctgtctttccaacgctatttcttccaaaagctccagtcaactagcattaagctcgccttgtctccctcacctaggaatcctgctgagcctattgcagtgcaaaataatcaacagctggcgctgaaagtggaaggtgtggtccagcacggctcgaagccgggactgttccgcaagattcagtccgtttgtcttaacgtttcgtcaactcttcagagtaaatccgggcaggactacaaaattccaatcgacaatatgaccaatgaaatggagcagcgagttgagccacacaacgattacttctctacgcagtttttgctgaatttcgctatcctggggactcataacatcactgttgagagtagcgtgaaagatgccaacggaattgtgtggaagaccgggccccgcacaacgatctttgtgaaaagtttagaagacccttattctcagcagatccggctacagcagcagcaagctcagcagccccttcagcagcagcagcagcgcaatgcatacaccaggttttag

SEQ ID NO: 12145 - DNA, 2937 bp, Artificial Sequence
  Description of Artificial Sequence: Synthetic coding sequence
atgtccgccgaggccgcagatagggaggctgcaacaagttccaggccctgtactccaccccaaacgtgctggttcgaattcctcctcgaggaaagcctgctggaaaagcatctgcgaaaaccatgtcctgaccccgcacctgtgcagttgatcgtccagttcctggagcaagcctccaagccttcagtaaacgaacagaaccaggtgcagccccctccggacaacaagcgcaatagaattttgaagctgctagccctcaaggttgctgcccatctcaaatgggacttggacatcctcgagaagagtctgagcgtgcccgtgttgaatatgctgcttaacgagctgctctgcatctcgaaagtgccgcccggaacaaagcacgtcgacatggacctggcgactttaccccccacgacggctatggccgttctgctctacaatcggtgggccatccgcactattgtgcagtcctccttccccgtgaaacaggccaaacccggacccccccaactgtccgtgatgaatcagatgcagcaagagaaggagttgacagaaaacattctcaaggtactcaaagagcaagccgccgacagtatcctcgtgttggaggcagcactcaaactcaataaagacctttatgttcacacaatgcgcacactggatttactggcaatggaacccgggatggtaaacggcgagacagaaagttcgaccgcgggtcttaaggtgaaaacggaagagatgcaatgccaggtgtgttatgacctgggggctgcatactttcagcaaggctctactaatagcgcagtctacgagaatgcaagagaaaaatttttccgaactaaagaactgatcgcagaaatcgggtctctgtctctgcactgcaccatcgacgagaagcgcctggccggatactgccaggcgtgtgacgtgctggttccgtcgtcagattcaacctcccagcagctgaccccatactcacaggttcatatttgtttaagaagcggcaattatcaggaggtcattcagatcttcatcgaagacaaccttacccttagcctgcccgtgcagtttcggcaatctgtattacgagagctgttcaagaaggcgcagcaaggaaacgaagctctggacgagatctgcttcaaggtgtgcgcctgcaatactgtgagggacatacttgagggtagaaccatctccgtacaattcaaccaactctttctccggcccaacaaggagaagatagatttcctccttgaggtctgttccagaagtgttaatctggagaaagcctcagagtctcttaagggaaacatggcggccttcctgaagaacgtgtgcttagggctggaagatctgcagtacgtgttcatgatcagcagccatgaactctttataaccttgctgaaggacgaagaaaggaagcttttggttgatcaaatgcgcaagagatctccccgggtcaatctgtgtatcaaacccgtcactagtttttacgatatacctgctagtgcaagtgtgaacattgggcagctggagcaccagctgatcctgagtgtcgacccatggcggatccgccagatcctgatcgaattacacggcatgacatccgagcgacagttttggacagtttccaacaaatgggaagtaccgagcgtctacagcggtgtaatcttgggtattaaagataatctgacccgagaccttgtctacattctcatggccaagggcctgcactgttcaaccgttaaagatttttcccacgcaaaacagctgtttgctgcctgtctcgaacttgtcaccgaattctcgccaaagttaaggcaggtaatgctgaacgaaatgttgctgctcgacattcacacacacgaagctggaactggccaggctggagaaagacccccaagcgacctcatttcacgggtcaggggctacctggagatgcgcctccctgacatccccctgagacaggtgattgcagaagaatgtgtggccttcatgcttaactggcgcgagaatgaatatttaactctccaagttcccgcctttctgcttcagtctaacccatacgtgaagctcggccaattgttggcagccacgtgcaaggaactgcccgggcccaaggagtctcgaaggacagctaaagatctgtgggaagtagtcgttcagatctgctcagtcagtagccaacacaagagggggaacgatggcagggtgagtttgatcaaacagagggaatcaaccttggggatcatgtatcgtagtgaactgctgagctttatcaagaagctacgagaacctctggtactgaccatcattctcagccttttcgttaagctgcacaatgtgcgggaggacatcgtcaatgatatcacggccgaacatattagtatctggccgagtagcatcccgaacctccaaagtgtagacttcgaggctgtcgctatcaccgtgaaagagctggtgcgttatacgctctctatcaaccccaacaaccactcttggctaattatccaggctgacatctactttgccaccaatcaatattcagccgctttgcactactatctgcaagctggtgccgtctgcagtgattttttcaataaagctgtccctcctgacgtgtacaccgaccaggtagccatcctctgtcagttcctgcgcgagatagactacaagacagcatttaaaagcctgcaagagcagaatagtcatgacgctatggattcatactatgactacatatgggatgtaactatcctcgaatacctcacttatcttcatcataagcgaggagaaaccgacaaacgccagatcgctatcaaagccattgggcagaccgagttaaatgcgagcaaccctgaagaggtgcttcagctcgccgcacagcggcgcaaaaaaaaatttcttcaggccatggctaaactatatttctag

SEQ ID NO: 12146 - DNA, 2988 bp, Artificial Sequence
  Description of Artificial Sequence: Synthetic coding sequence
atgagcgcagaggcagccgacagggaagccgcaacctcctcccgcccttgcactcccccacagacatgctggttcgaattcctcctggaggaaagccttttggaaaagcacctgaggaagccttgccccgatccagctcctgttcaattaatcgtccaatttttagaacaggccagcaagccttccgttaacgagcagaaccaggtccagccaccacctgataataaaaggaatagaatcctgaagctacttgcattgaaagtcgccgctcatctgaaatgggacctggatatcttagagaaatcgcttagcgttcccgtgcttaacatgttgctgaacgagctcttgtgtatctccaaagtgcctcctggaacgaaacacgtggatatggacctcgccacgttacctccaaccaccgcaatggccgtgctcttatataatcgctgggcgatcaggaccattgttcagtcttcctttcctgttaaacaggccaaaccggggcctcctcagctctcagtcatgaatcagatgcagcaggagaaggagcttactgagaacatcctgaaagtgctcaaggaacaggccgcagacagcatccttgtgctggaagcagctctcaagctcaacaaggacctgtacgtgcacaccatgaggactcttgatttgctcgcaatggagcccgggatggtcaacggcgaaaccgagagcagcacagctggtttaaaggtgaagacagaagagatgcagtgccaggtatgctatgacctgggggccgcctatttccagcagggcagtaccaacagcgctgtgtacgaaaatgcgcgggagaaatttttccggaccaaggagcttatcgcggaaatcggttctctgagcctccactgcactatcgatgaaaaacgcttagcgggctattgtcaggcctgcgacgtcctggtgccatctagcgattccaccagccaacagcttacaccttacagccaggtccacatttgcttgcgttctggaaattatcaggaagtgatccagatcttcatagaagataatctgaccctgtctctccctgtgcaattccgccagagtgtgttacgagagctcttcaagaaggctcaacagggtaatgaagctttggatgagatttgcttcaaggtgtgtgcatgcaataccgtgcgcgatatcttagaggggcgaaccattagcgtgcagtttaatcaactgtttctgaggcctaacaaagagaaaatcgactttcttctggaggtatgctcccgcagcgtcaatttagagaaagcatcggagagtctgaaaggcaacatggcagctttcctcaagaatgtctgcctgggcctggaagacctgcagtatgtgttcatgatctcttctcacgaactctttataactctccttaaggacgaggagcgcaaacttttggtagatcaaatgcgaaaacgcagccctcgagtgaatctttgtatcaagccagttaccagcttctacgacatcccggcttcagccagcgtgaacatcgggcaactcgagcaccagcttattttgtctgtagatccatggaggattcggcagatcttgatagagctgcacggcatgacctctgagaggcagttctggactgtctccaacaagtgggaagtgccatcagtgtatagcggagtgattctcggcattaaggacaacctgacacgggacttggtgtacatcctgatggccaaaggcttacattgcagtaccgtaaaagatttctcccatgccaaacagctgttcgccgcctgcctggaactcgtcaccgagttttctccgaaactcaggcaggtgatgctcaatgagatgttactgctggacatccacacacacgaagcaggcaccggccaggctggagagaggcctccatccgatctgatatcacgggtgcggggctacctggagatgcgtcttcccgacattccactcaggcaagttatagccgaggagtgcgtggccttcatgctgaactggagggagaacgaatacctcactctccaagtccccgcctttctgctgcagtcaaacccctacgtcaagcttggtcaattactggccgctacctgcaaggagctgcctggccccaaggagagtagaaggactgccaaagatctgtgggaggtagtcgttcagatttgttcagtgagcagccagcataaacgaggtaacgacggccgtgtctccctgatcaagcagcgggagtctactttaggcataatgtacagaagcgagctgctcagctttattaaaaagctccgcgaacccctggtgttgacaatcatcctgtctctatttgtaaaacttcacaatgttcgcgaggatattgtaaacgacataactgccgaacatatttccatctggccttcatctattcccaacttgcaaagcgttgatttcgaggcagtggccatcaccgtgaaagagttagtcagatatactttaagtattaaccccaataaccactcctggctgatcatacaagctgacatctattttgcaactaatcagtactctgcagctctccactattatctgcaggcaggagctgtttgttccgatttcttcaacaaggcggtccctccagacgtttacacagatcaggtaattaagcgcatgattaagtgctgtagtctgcttaactgccacacccaggtcgccatattatgccaattcctaagagaaatcgattacaagactgcttttaagtccttacaggagcagaatagccatgacgccatggacagctattatgactacatctgggacgtgactattttggagtacctgacctacctgcatcataagagaggggagacggataagcggcagattgctataaaggccatcggtcagactgaactgaatgcctcaaatcctgaggaagtgctccaactggccgcacagaggcggaagaagaagtttctccaggccatggctaaactttacttctag

SEQ ID NO: 12147 - DNA, 1659 bp, Artificial Sequence
  Description of Artificial Sequence: Synthetic coding sequence
atgatggccctgccttatataactgaacataccggatttaccggcacagtctacgcgacagagcccaccgtacagattggtcggctgctcatggaagagttggtgaattttatagagagggtgcccaaggcacagagcgccagcttatggaaaaacaaggatattcagagactattgccgtcccccttgaaagacgctgtcgaagtgtccacctggaggagatgttacacaatgcaggaagtgaactccgcactctctaaaatccagctcgttggctattcccaaaaaatcgagctgtttggagctgttcaggtcacaccactctcctcaggttatgctctgggcagctctaactggataatccaaagccactacgaaaaagtttcatacgtgtctgggagctcactactcacaacccatccccaacccatggaccaggcttctcttaagaacagtgacgtgctcgtcttaacgggtctaacacaaattcccacagcaaacccagatggcatggtgggcgagttctgtagcaatctggctctgacagtaaggaacgggggcaacgtcctggtgccctgctacccatccggtgtgatctatgatcttctggaatgcctgtaccagtatattgattccgctggcctctctagtgttcccttatattttattagcccggtagccaacagttcactcgagttcagccagattttcgctgaatggctgtgtcacaacaagcagtcaaaggtgtatctgcccgagccaccatttccccacgctgaactaattcagaccaacaaactcaagcactatccctcaatacacggggacttcagtaatgatttccgacagccatgtgtggtattcaccggccatccatcgctgcgcttcggggatgtagtccactttatggaattgtgggggaaatcgagtttgaatactgtcattttcacggagcctgatttcagctacttggaggctctcgccccttaccagcccctggccatgaagtgtatttactgcccaatagacacccgactgaacttcatacaggtgtccaagttattgaaggaagttcaaccgctgcacgtggtctgtcccgaacaatacacacagccgccccctgcgcaatctcatcgcatggaccttatgattgattgccaacccccagcaatgtcttatcgacgggccgaagtccttgccttaccttttaagaggcgctatgagaaaatagaaattatgccagaactcgccgattccctggtaccaatggagatcaaacctggcatttcactcgccacagtttctgccgtcttgcacaccaaggataataaacacctactccaacctcctccccggccggcccagccaaccagcgggaagaaacggaagagagtgtccgacgatgtgcctgactgcaaagtcctgaagccattactgtctggttcaattccagtggaacagttcgtacaaacacttgagaagcacggattctctgacatcaaggtggaggacacggccaaaggacacatagttctccttcaggaagccgaaaccctcatacagatcgaggaggatagcacccatataatctgcgataatgatgagatgctgagagtccggctgagagaccttgtactcaaattcttgcagaagttctag

SEQ ID NO: 12148 - DNA, 1977 bp, Artificial Sequence
  Description of Artificial Sequence: Synthetic coding sequence
atgaagctgtactgcttgtccggccacccgaccctcccctgtaacgtgctgaagtttaaatctaccacaatcatgctagattgcgggttagacatgacatcgaccttaaactttctacccctaccactggtgcagtcgccacggctatctaatcttcctggctggagtttgaaagatggcaacgcttttctcgataaggagctcaaggagtgtagtggtcatgtctttgtggacagcgtccccgagttttgcctacccgaaaccgagttgatagacctttctaccgtcgacgtcatcttaatcagcaactaccactgtatgatggctctgccatatataactgaacacaccgggttcactggcacagtgtatgccaccgagcccaccgttcagatcggccgactgctcatggaagagctggttaatttcattgagagagtacctaaagcgcagagcgcctccctttggaaaaataaggatatccaacggctgcttccctccccactgaaagacgctgttgaggtgtctacctggcgtaggtgctacacaatgcaggaggtgaacagtgctttaagcaagatccagctcgtcgggtattcccagaagattgagctgttcggcgcagtgcaggtaacacccctgtctagcggctacgcactaggaagttccaattggatcattcagtctcattatgagaaggtctcttacgtctcagggtcatctttattaaccactcatccccagccaatggaccaggccagcttgaaaaattccgatgtgctggtgttgacaggactgacacagatccctaccgcaaatcctgacggtatggttggcgaattctgttcaaatctggcactgacggtccgtaatggcggaaacgtgctggtcccgtgctacccttctggggtgatctacgatctgttagagtgcctgtatcagtatatagatagcgccggcctcagctccgttcctctatactttatatcacccgtagccaactcctcactggaattctcccagatcttcgccgagtggctgtgtcacaacaagcagagcaaagtatatctgcctgaaccccccttcccgcacgctgaattgatccagacaaataaactgaaacattacccttcaatccacggcgacttttccaacgacttcaggcagccgtgtgttgtatttaccgggcaccccagtctgagattcggcgacgttgtacattttatggagttatggggcaagtcatcgctcaataccgtaatctttaccgagccggatttctcttatctggaagccctggctccctaccaacctctcgctatgaagtgcatttactgtcccatcgacacgcgccttaactttatccaggtgtctaaactcctgaaggaagtgcagcccttgcacgtggtgtgcccagaacagtacacccagcctccacctgctcaatcccatcgaatggatcttatgattgactgccaaccccctgccatgagttaccgccgggcagaagtccttgcgctgccatttaagcgccgctatgagaaaattgagatcatgcctgagctagcggattcactggtgcccatggaaattaaacctgggatttccctggccactgtgtcagccgtgttgcatacaaaggacaataaacacctcctgcagccacctcccagacccgcgcagccaacctccggtaagaagaggaagcgggtgtcagacgatgtgccagactgcaaagttctcaagccattgctaagtggaagcattccggtggagcagttcgtgcagacgcttgagaaacacggcttttccgatattaaagtcgaggatacagcgaagggccacatcgtgctgctgcaggaggccgaaaccctcatccagatcgaggaggattcgacccacattatttgcgacaacgacgaaatgttgcgcgttcgtctgcgggatctcgtgctgaaattcttgcaaaagttctag

SEQ ID NO: 12149 - DNA, 1509 bp, Artificial Sequence
  Description of Artificial Sequence: Synthetic coding sequence
aagatctactgtctcagcggacaccccactttgccttgtaatgtactgaagttcaagtccacctggagaagatgttacacaatgcaagaggttaattctgccctcagtaagatacagctggtcggttactctcagaagattgagctgtttggcgctgtacaggtgaccccattgagtagtggctatgcgctcggctcctcaaattggatcattcaatctcattacgagaaagtctcctatgtttccggcagttcgttactcaccacacacccacagcctatggaccaggctagcctgaagaacagtgatgtccttgtgctgaccggactgacccagattccaactgcaaatcccgacggaatggttggcgagttttgtagtaacctcgcccttaccgtgaggaatggaggaaatgttctcgttccctgttatcctagcggggtgatctacgacctgttagagtgcctctaccagtatatagatagtgctgggctgtccagcgtgccattgtatttcatcagcccagtggctaattcatcactcgagttctctcaaatctttgctgagtggctatgccacaacaagcagagcaaagtgtacctccccgagccgccattccctcatgcagaactgattcagactaacaaactaaaacactatccatccattcacggtgatttttcaaacgattttaggcagccttgtgtcgtgttcacgggacacccatctttgaggttcggggacgttgtgcactttatggagctgtggggaaagagctccctcaacacagtaatcttcaccgagccggacttcagctacctggaagccctggccccctaccaaccccttgccatgaagtgcatttactgtcctatcgacactcgtttaaactttattcaagtttctaagctgctaaaggaggttcagcccctccacgtcgtttgtcccgagcagtacactcagcccccgcccgcgcagtcccaccgtatggacctgatgattgattgccagccgcccgccatgtcgtataggcgagccgaagtcctggcacttccattcaagcgcagatacgaaaaaatcgaaatcatgccagagctggccgattccctggtgccaatggaaatcaaacctggtattagtctggcaacagtgtctgcggtgttgcacaccaaagataataagcacttgctccagcctccaccaaggcctgcccaaccaacctccggaaagaagagaaagcgggtctccgatgacgtgccagattgcaaggtcctgaagcctctcttgagtggctccatacccgtcgaacagttcgttcagaccttagaaaagcatggtttcagtgacatcaaagtggaagataccgctaagggacacatagtgctcctccaggaggccgaaacgcttatccaaatagaagaggattccacacacataatctgcgacaacgacgagatgttacgagtccgcctgcgggatctagttcttaagtttcttcagaaattttag

SEQ ID NO: 12150 - DNA, 1914 bp, Artificial Sequence
  Description of Artificial Sequence: Synthetic coding sequence
atgaaactatactgtttgtctgggcatccaacactgccgtgtaatgtcctgaaatttaaatctacaacaattatgctggactgcggcctggatatgacatccacccttaactttctgcctctgcctctggtgcagtctccgcggctatcgaaccttcccggctggagtctcaaggacggaaatgcgtttctggacaaaacagaactgatagacctgtcaaccgttgacgtgattttaatctctaactaccattgtatgatggctcttccatacattactgagcacaccggcttcacaggaactgtatatgccaccgagcctacagtgcagattggcaggctcctgatggaagaactcgttaatttcattgagcgagtgccaaaagcccaaagcgctagcttgtggaaaaataaagatatccagaggctactgccctctccactgaaggatgcggtggaggtttccacatggcgaagatgttacaccatgcaggaggttaactcagcactttccaaaattcagttagttggttatagccagaagatcgagctcttcggggcggtgcaagttacacctctgtcttcagggtatgctctggggagctccaattggatcattcagtcccactacgagaaagtgtcctatgtatctggcagctcgctcctgacgactcacccgcagcctatggatcaagcctccctcaagaactccgacgtccttgttctcacaggtttaacccagatccctacagcgaacccagacggcatggtcggagagttctgtagcaacttggctctgactgtgcgtaacggcggcaatgttctcgtgccttgttatccatccggagtgatctatgacctgttggaatgcctctatcagtacatcgactcggctggcctgagctctgttcctctgtatttcatatcccccgtcgccaacagttctttagaattctctcagatatttgcggaatggctttgtcacaataagcagagcaaggtgtatctgccagaaccccccttcccccatgctgaactcattcagaccaataagctcaaacattacccaagcattcacggcgacttctccaacgatttcaggcagccctgtgtggttttcacaggccacccctccctcagatttggggacgtcgtgcacttcatggaactgtggggcaagtcctcccttaacaccgtaatctttacggagccagatttctcttacctggaggcactggcgccataccagcccctcgccatgaagtgcatatactgccccatcgacacaaggcttaatttcatccaggtgagtaaactgctgaaggaagtgcagccccttcacgttgtgtgtcccgaacagtacacacagccacctcctgcccagagccacagaatggacctgatgatcgattgccagcctccagctatgagctacaggcgggcagaagtgttggccctgcccttcaagagaaggtatgagaagatcgaaattatgcctgaactggcggactctctggtgccaatggagattaaacccggcatctccctggcaacggtctccgctgtcctgcacaccaaagacaataaacatctcctccaacctccccccagacccgcccagcctacgtctggtaagaaaagaaagcgcgtgagtgatgatgttccagactgtaaggtgctcaaaccattattgagtggcagcattcccgtggagcaatttgttcaaacactggaaaaacacgggtttagtgatatcaaggtcgaggataccgccaagggtcacatagtcctgttgcaggaagccgagactttaatacagatcgaagaagactcaacacacatcatctgtgacaacgacgagatgctgagggtgaggcttcgggaccttgtgttgaaatttctccaaaagttctag

SEQ ID NO: 12151 - DNA, 1905 bp, Artificial Sequence
  Description of Artificial Sequence: Synthetic coding sequence
atgttagactgcggcttggacatgaccagcaccctgaacttcctcccacttccccttgtgcagtctccacgattgtcaaatttacccggatggtccctgaaagacggcaatgctttcttggataaagaactcaaagaatgttccggacatgtgttcgtggattctgtgccggagttttgtctacctgaaaccgagctgatagatttgagcactgtggacgttattcttatcagcaactatcactgcatgatggcactgccgtatatcaccgagcatactgggttcaccggaacagtgtatgctaccgagcctaccgtgcagattgggcgcctgcttatggaagaactagtaaacttcattgagcgcgtgccaaaagcccagtccgcgagcctgtggaagaataaggacatacagcggctactaccttctcccctgaaagacgcagtggaggtgtccacctggcgtcggtgttacactatgcaagaagttaattccgccttgagcaagatccagttagtaggttatagccagaagatcgagctcttcggtgctgtgcaggttacccctctttccagcggatacgcgcttgggagcagcaattggataatacagagccactacgagaaggtcagctatgtctctggaagttcacttctgacaacacatccccagccgatggaccaggcctccctcaaaaattcagatgttttagttctcaccggcctcacccagataccaacggcaaatccagatggaatggtcggggaattttgcagcaacctggccttgaccgttcggaatggtggtaacgtactagtgccttgttacccgagcggggtgatatacgatctcctggagtgtctgtatcaatacatcgactctgcaggcttgagtagtgtccctctctattttatctcccctgtggctaatagcagcttggaattcagccagatcttcgcagagtggttgtgtcataacaagcaaagcaaagtttatctgcctgaaccccccttcccgcacgccgagctcatccaaaccaataagctgaagcactacccctccatccacggtgacttctctaacgacttccgccagccttgcgtcgtgttcaccgggcacccctctttacgcttcggagacgtggttcacttcatggaactgtggggtaaatccagcctgaacaccgtgattttcaccgagcctgatttttcatatctcgaagccctggcaccttatcagccacttgccatgaagtgcatttactgccctattgacactaggctcaattttatccaggtaagcaaacttctaaaggaagtgcagccattgcacgtggtttgcccggagcagtacacccagccacccccagcgcaatcacacaggatggacctgatgatagattgtcaaccgcccgctatgagctaccgtagagctgaagtgctggcactgccctttaagaggaggtatgagaagatcgaaatcatgccagaattggccgattcgctggtgccaatggagataaagcctggcatctcacttgcaacagtaagcgcagtgctccacaccaaagacaataaacacctactacagccccccccccgtcctgcccaacctacttccggcaagaaacgcaagcgggtaagcgacgacgtccccgactgtaaagtccttaagccccttctatccggcagtatcccggtggagcaattcgtgcagactttggagaaacacggattttcagacattaaggtggaggatactgcaaaaggccacatcgtcttgcttcaggaggccgagacactgattcagatcgaagaggattctactcatattatctgcgataacgatgaaatgcttcgggtgcggcttagggatcttgtgctgaaattcctgcagaagttttag

SEQ ID NO: 12152 - DNA, 1755 bp, Artificial Sequence
  Description of Artificial Sequence: Synthetic coding sequence
atggcctccgtgcaggcttcgcgaaggcagtggtgttatctctgtgatctgcctaaaatgccctgggcaatggtctgggatttctctgaagccgtgtgcagaggatgtgtgaactttgaaggggcggaccggatcgaattattgatcgatgccgctagacaactcaaacgaagccatgtcctccccgagggccggtctcccggacctcccgctttaaaacaccccgcgactaaagacctcgccgctgccgcagcccaggggccccagctgcccccacctcaggctcagccccaacctagcggcaccgggggcggggtgtccggacaggatcggtatgatcgggcgacgtcctccggacggctgccattgcccagtcccgcgttggagtatacactgggctccagattagccaatgggctgggcagggaagaagcagttgccgagggtgctcgccgggccttgctgggatctatgccaggtctcatgcctcccgggctgcttgccgcggctgtgtcaggcctcggttctaggggcctgaccctggcacccggacttagccccgctcggcccctcttcgggtccgactttgaaaaggaaaaacagcaacggaacgcagattgcctggccgaactgaacgaggcgatgcggggtcgagcagaggaatggcacggccgccccaaggcagtgagggaacagctcctcgcactttctgcctgtgcgcccttcaacgttcgatttaaaaaagaccatggcctggtaggtagggtcttcgcattcgatgctactgcacgcccgcctggctacgagttcgagctgaaactgtttaccgagtatccatgcgggtctggcaacgtgtatgcgggagtgctcgcagtagccaggcaaatgtttcatgacgccttgcgggaaccaggtaaggcccttgcgagcagcggcttcaaatacctagaatatgaaagaagacatggatcgggcgaatggcgtcagctgggagaacttcttaccgacggggttaggtcttttcgggagccagcacctgccgaggccctgcctcagcaataccccgaacccgcacccgctgctctctgcggcccacccccacgagcaccctcgagaaacctcgcccccactcctcgcaggcgcaaagcttctcccgaacccgagggagaggctgccggcaagatgacaactgaggaacagcaacagcgccactgggtcgcccccggcgggccctattctgccgagaccccaggggtgccatcacctatcgcggctcttaagaacgttgcagaggcgctaggccactcgccgaaggaccccgggggaggaggcgggcctgtgcgggctggcggcgcaagcccagccgcctcctccacggctcagccgcccactcaacacaggctggtagccagaaacggagaagccgaagtaagccctaccgcaggagctgaagccgtaagcggaggcggatccggcaccggggcaaccccaggggctcccctgtgctgcaccttgtgtcgcgaacggctggaagacacacattttgttcaatgtccatcggtgccaggccataaattctgctttccctgttcaagggaatttatcaaggctcaaggtcctgccggggaagtgtattgtccctccggtgataaatgtcctctggtggggtcatctgtcccctgggctttcatgcagggcgaaattgccacgattctcgccggtgacattaaagtaaagaaagaacgggacccttag

SEQ ID NO: 12153 - DNA, 1764 bp, Artificial Sequence
  Description of Artificial Sequence: Synthetic coding sequence
atggctgccgccgtggcagttgcggccgccagtcggcggcaaagctgctacctgtgcgacctgcctcgcatgccatgggctatgatttgggattttactgaaccagtgtgcagggggtgcgtcaactacgaaggagctgatcgcgttgaatttgtgattgagacggccagacagttaaagcgtgcacatggatgcttcccagaaggccggtctccaccaggggcggcggcgtctgccgcggccaagccccctcccctaagcgcgaaggatatcctgctccagcagcagcaacaactcggccatgggggccctgaggcagcacccagggccccgcaggcgctggagagatatccactcgcggccgccgccgaaagaccgcctagactcggttcagactttgggagttccagacctgcagcatcactggctcagcccccgacccctcaaccacctccagtcaacgggatccttgtgcccaatggattctcaaaactggaagaacccccagaattgaaccgccagtcccctaacccccgacgcggtcacgccgtgcctccaacactggtcccactgatgaacggtagtgcgacaccgctccccactgcgctcggactcggggggcgagctgccgcctccttggccgctgtgagcggcactgctgccgcttctctgggctccgctcagcctactgacctgggcgcccataaaagacccgcgtctgtgagtagttcagccgctgtggaacacgaacagcgggaagccgccgccaaggagaagcagcccccgccaccagcacacagaggtcccgctgacagcctcagcacagccgccggcgccgctgagctcagtgccgagggagccggcaaatcccgcggtagtggcgagcaagactgggtaaacagaccgaagacagtgagagacacccttcttgcacttcatcagcatgggcatagcggtcctttcgagtctaagttcaagaaagagcctgcactgaccgcaggccgcctcttgggcttcgaggcgaacggcgctaatgggtcaaaggcagtagccagaactgcccggaaaagaaagccatcccccgagcctgaaggagaggtgggtcctcctaagataaacggcgaggcccagccctggctgagtacttctaccgaggggctcaagatcccaatgacacctacctccagtttcgtgagccctcccccacccacagcctctcctcatagtaacaggactacacctccagaagctgcacaaaacggtcagtcgcctatggcagcactcatcctggtcgctgacaacgcgggagggtcgcatgctagcaaagatgctaaccaggtgcacagcacgactcgtcgaaatagcaattccccccctagcccctcaagtatgaaccagcgacggctcggtcctagggaggtggggggccaaggagctggtaacaccggcggcctggagccagtccatcccgcttcgttacccgacagctcattggcgacttctgctccgttgtgttgcaccttgtgccacgagcgactcgaggatacacactttgtgcagtgcccaagcgtccctagccacaaattttgtttcccctgcagtcgacagtctattaagcagcagggtgcttccggagaggtatactgcccatctggcgaaaagtgtccgctggtgggctccaacgtgccgtgggccttcatgcagggcgagatagctacaatccttgctggtgacgtcaaggtgaagaaggagcgcgactcctag

SEQ ID NO: 12154 - DNA, 1716 bp, Artificial Sequence
  Description of Artificial Sequence: Synthetic coding sequence
atggcggctgccgtagccgtggcagccgcatccagacgccaatcctgttatctgtgcgacctgccacgcatgccctgggcaatgatctgggattttacagagccagtttgccgtggatgcgtgaactatgaaggcgccgaccgagttgagtttgttattgagactgccagacaactgaagagagcacatggttgtttcccagagggacggagcccgccaggcgcagccgcaagcgccgcagccaagcctccccccctgtcagccaaagacattcttcttcagcaacagcagcaactgggccatggcggacccgaggctgctcctcgcgcccctcaagctctcgaacggtatcctctggcagctgcagccgaacggcccccgcgtctcggcagcgatttcgggtcctcaagaccagcagcctcccttgcgcagccccctacaccgcagccaccacccgtcaacgggattctcgtgcctaacggattctctaaactagaagagccacctgagttgaatcgccaatcccctaatccccgtcggggccacgccgtgccgccaacactcgtgccactcatgaatggcagtgctacccccttaccaaccgcgctgggtttgggcggccgggcggccgcctccctcgcagctgtctcagggaccgccgctgcttcactggggagtgctcagccgacagatctaggggcccataagcgcccagcgtccgtctcgtcctccgccgcagttgagcatgagcagagagaagccgctgccaaagagaagcagccaccacctcctgcccaccgggggcctgccgattctctctcaaccgcggctggcgcagccgaactaagcgctgagggtgctggaaaaagcagaggaagcggggaacaagattgggtaaatcgccccaagactgtgcgggacacactgttagctttacaccagcacggccacagcggaccgtttgagtctaaattcaagaaagagccagccttaaccgcagttgcgcgcacagccaggaaacgaaagccaagccccgaaccagagggagaagtggggccccctaaaatcaacggggaagctcagccgtggcttagtacaagcacagaggggttgaaaataccaatgacaccgacttcctcattcgtgagtccacctcccccgactgcttcgccacactctaatcggacaactcctcctgaagccgctcagaatgggcagagccctatggctgcactgattctcgtggctgacaatgctggtggaagccatgcgtccaaagatgctaaccaggtgcactccacgacacgtcgaaattccaatagtcccccctccccctcctcaatgaatcagcggagattgggccccagagaggtcgggggacaaggggcaggaaatactggaggcctggaaccggtgcaccctgcatccctccccgattcttctctagctaccagcgctcctctttgctgcactctgtgccatgagagactagaagacacccattttgtccagtgcccctctgtgccctcgcataagttttgtttcccttgcagtcgccaatccattaagcaacagggcgcctccggcgaggtgtattgcccatcaggagaaaagtgccccctcgtgggctccaacgtgccctgggcatttatgcagggcgaaattgctacgatcttagctggagatgtgaaggtgaaaaaagagcgcgactcctag

SEQ ID NO: 12155 - DNA, 2391 bp, Artificial Sequence
  Description of Artificial Sequence: Synthetic coding sequence
atgtcggccgctcaagtgagtagttctcgtcgccaatcatgttacctctgtgacctacctagaatgccatgggccatgatttgggacttcagcgagcctgtgtgccgtggctgcgtcaactatgaaggcgcagaccgtatcgaattcgtgatcgagacggcaaggcaattgaagcgggcgcacggatgcttccaggatggacgcagtccaggccctcccccaccggtaggcgtcaaaaccgttgccctgtctgcaaaggaggcagcagctgctgctgccgccgcagctgcggcagccgccgccgcccagcaacaacagcaacaacagcagcagcagcagcagcaacaacagcagcagcagcagcagcaacaacagcaacagctgaaccacgttgacggatcttctaaaccagccgtcctcgccgctcccagcggcctcgaaagatatggcctctccgccgccgccgcggccgcagccgccgctgctgccgctgtcgagcagcgttcccgcttcgagtacccacccccccctgtatccttgggatcctctagccatactgcgcggctgcccaatggcctgggcgggcccaatgggtttcctaagcctaccccagaggaaggtcctccggaactcaacaggcagagcccaaattcgagctctgcagccgcctctgtggcttccagaaggggaacccatggtggacttgtcacgggccttcccaaccccggggggggtggggggccccagctgactgtacccccaaaccttttgccccagacacttctcaacggacccgccagtgccgcggtcctgcctcccccacccccccacgcgttagggagcagggggcctccgactcctgcacctcccggcgcacccggcgggccggcatgccttggtggcactccaggggtgagcgcgaccagcagcagcgcaagttcctccacgagctcttctgttgctgaggtgggagtcggggcaggaggaaagcgacccggaagtgtcagctccacagatcaagaaagagaactgaaagaaaaacaaagaaatgctgaggccctagccgagctttctgaatccttgcgtaaccgcgcggaagagtgggcttccaagccaaaaatggtcagggatacactgctgaccctggccggctgcaccccgtacgaggtgcgctttaaaaaggaccactcactgctgggcagagtcttcgcctttgatgccgttagtaaacctggcatggattacgagctcaagttatttatcgagtaccccacggggtcgggtaacgtctactctagcgcgagcggagtcgccaagcaaatgtaccaggattgtatgaaggacttcggcagaggactgtcttcaggcttcaagtacctggagtatgaaaagaagcacgggagcggggattggagactcctcggagatttgctgcctgaagctgtcaggtttttcaaagagggcgtgcccggtgctgatatgttgcctcagccttacctcgacgcaagttgtcctatgttaccaactgctctcgtaagcctgtccagggctccgagcgcccctcctggaacaggagcccttccgccagcagccccttcagggagaggcgctgccgcctcgcttaggaaaaggaaagcctcccccgaacctcccgactctgctgagggcgccctcaagctcggggaagaacagcagagacagcagtggatggctaatcagtcagaagccctgaagctcacgatgtcggccggcggatttgctgcgcccgggcacgctgctggaggccctcctccccccccaccgcctctaggtccacactccaatagaacaacacctcccgaaagcgcaccccaaaatggcccaagtccaatggctgctctgatgtctgtcgctgataccctgggcactgcacatagtccaaaagacggttcgagcgtccattccaccactgcctccgctaggagaaactcttccagcccagtgtcacctgctagtgtccctggacagcggcggctagcttcccgcaacggagatctaaaccttcaggtggcccccccaccaccatccgctcacccaggcatggaccaggtgcatccccagaatatacctgactctccgatggcaaactccggtccactttgttgcacaatatgtcacgagaggttagaggatacacacttcgtccaatgcccatcagtgccttcccacaaattctgttttccctgcagtagagagtctattaaggctcaaggagctacgggcgaagtgtactgcccatccggcgaaaaatgccccctagtgggcagcaatgtgccatgggcctttatgcaaggcgaaattgccactatccttgcaggagacgtcaaagtgaagaaggagcgcgatccttag

SEQ ID NO: 12156 - DNA, 1341 bp, Artificial Sequence
  Description of Artificial Sequence: Synthetic coding sequence
atgagtttcccgcacttcggtcatccctatagaggcgcgtcgcagttcctggcctcagcaagttcctctactacctgttgcgagtccactcagcggagcgtttccgatgttgcatccggatctactccagctcctgccctgtgttgtgccccatacgactcccggctgcttgggagtgcgcggcccgagcttggtgctgctctaggtatttatggagctccctacgcagctgctgcagccgctcagagttacccaggatacctgccttatagtcctgaacctccgtcactttatggagccttgaatccccaatatgagttcaaagaggctgctggctccttcacctcatcacttgctcagcccggcgcctattacccatacgagcggacacttggccagtaccagtacgagcgatacggcgccgtcgagctcagtggggcagggagaagaaaaaatgcaacccgcgaaacaacaagtaccctgaaggcatggctgaacgagcatcgaaagaacccttaccctaccaagggcgagaagatcatgctagcaattataacaaagatgactctgacccaggtgtcaacctggttcgcaaatgcccggcgcagactgaaaaaagagaacaaaatgacatgggcccccaaaaataaggggggcgaagaacggaaagccgagggcggggaggaggattcactcggatgcttaactgccgataccaaggaagtgaccgcttctcaggaggcccgcggactgaggctgagcgacctcgaggatctagaagaggaggaagaggaggaggaggaagcagaagacgaagaggtcgtcgcaaccgccggcgatcggctcacggaattcaggaaaggggcccagtccctccctgggccatgtgctgcagcgcgggaggggcgactggaacggcgtgaatgcggcttggccgcgcctagattcagcttcaatgacccttccggcagtgaggaggcggattttctttctgccgaaactgggtctcctaggttaacaatgcattacccttgccttgagaagccccgcatctggagcttggcacataccgctacagcatcggctgttgagggagcgcccccagcccggccacgtcctagatcccctgagtgccgaatgattcccggccaaccacctgcaagtgcaagacgtcttagtgtgcctcgggacagtgcctgcgatgaatcttcttgcatccccaaggctttcgggaatcctaaatttgccttacaaggcctgccactgaactgcgcaccctgtcctaggcgcagtgaacccgtagtacagtgtcagtacccaagcggagccgaggccgggtag

SEQ ID NO: 12157 - DNA, 1080 bp, Artificial Sequence
  Description of Artificial Sequence: Synthetic coding sequence
atggttgacatcattttccactacccgttcctgggtgccatgggggatcacagcaagaagaagccagggacggctatgtgtgtgggctgcggtagccagatccatgatcagtttattctccgcgtatcccccgacctagagtggcacgccgcgtgccttaagtgcgcagagtgtagccagtacctggacgaaacatgtacgtgctttgttcgtgatgggaaaacctactgtaaacgcgattatgtccgcctgttcgggatcaaatgtgccaagtgccaggtgggattctccagctcagacctggtcatgcgggcccgcgattccgtataccatatagagtgtttccgctgttctgtatgcagccgccagctgctgcctggcgacgaattcagcctccgagaacacgagttactatgcagagcagaccacggcctccttcttgaaagagcagccgcagggagccccagatctccaggccccctccctggcgcccgagggttgcacttgccagacgctgggtccggaaggcagcccgctttacgccctcacgtgcacaaacagacggaaaagactactcgcgtgaggacggtcctcaacgaaaaacagttgcacacccttcgaacatgttatgctgcgaaccctcgacccgatgcccttatgaaagaacaactggtcgagatgacaggactgtccccacgggtgatacgggtgtggttccagaataaacggtgtaaagataaaaaaaaatcaattctgatgaaacagctacagcagcagcagcacagtgacaagacgagtctccaaggccttaccggaactcccctggtggctggaagtccaatcaggcacgaaaacgctgttcagggaagtgctgtcgaggtgcagacctaccagccaccatggaaagctctgagcgagtttgcgctgcagtcagacctggatcagcctgcattccagcaactggttagttttagcgaatccggtagcctcgggaactcgagtggatcggatgtgacctcactttcatctcaactcccagataccccaaatagcatggtgccaagccctgttgagacttag

SEQ ID NO: 12158 - DNA, 2460 bp, Artificial Sequence
  Description of Artificial Sequence: Synthetic coding sequence
atggactccgagtattactctggggatcaaagcgacgatggcggggcaacaccggtccaagatgagagagattccggaagcgatggcgaagatgatgtcaatgagcaacatagtggctccgatacgggcagtgtggaacgtcattcagagaatgagacctctgaccgggaagacggactgccaaagggccatcacgtcacagatagtgaaaatgatgaacccttaaatctgaatgcatccgactcagagtcagaggagcttcatcgccagaaggattccgacagcgaaagtgaggagagggccgagccacctgcttccgacagtgagaatgaagatgtcaatcagcacgggtctgactccgagagcgaagaaacgcggaagctgccgggaagcgattcagaaaatgaagaactgctgaatggtcatgccagtgacagcgagaatgaagacgtgggcaaacatcccgccagcgatagcgaaatcgaggaactccagaaaagtcctgcttccgactccgaaactgaagacgcgctgaaacctcagatatccgactctgagtccgaggagccacctagacatcaagcatctgatagcgagaacgaagaacctccgaaaccacggatgtccgacagtgaatccgaggaattacctaaaccccaggtctccgacagtgaaagcgaagagccgcctcgacaccaagctagtgatagcgaaaatgaggaactgcctaaaccgaggatctcagacagcgaaagcgaagaccccccaagacaccaggcaagcgattccgagaatgaggaactgccaaaacctcgcatctcagattcagagtcggaagatccccctcggaatcaggcttccgacagtgaaaatgaagagttgccaaagccacgggtgtctgatagcgaatcagaggggcctcaaaaggggcccgcatctgactccgaaaccgaggacgcttcccgccacaaacagaagcctgagagcgatgacgactctgacagggaaaacaaaggagaagatactgagatgcaaaacgattcttttcactcagactcccatatggaccgtaaaaagtttcacagttctgacagcgaagaagaagaacacaagaaacagaagatggattcggatgaggacgaaaaggagggtgaggaagaaaaggttgcaaaacggaaggccgcagtgcttagcgattctgaggacgaagaaaaggctagcgcaaagaagagcagggtcgtgtccgacgccgacgacagtgacagcgatgctgtctcagacaagagcggcaagcgggaaaaaacgattgcttctgactccgaggaagaggccggaaaggagctaagcgataagaagaacgaagagaaggatctgttcggatcagattcagaaagcggcaacgaagaagagaacctgattgcggatatctttggcgaaagtggagatgaggaagaagaggaatttaccgggtttaaccaggaagacctcgaagaggagaaaggggaaacacaggtgaaggaggccgaggactctgattctgacgataatattaagaggggcaagcatatggacttcctgtccgatttcgagatgatgctccaaagaaaaaaatctatgagcgggaagaggaggcgtaaccgtgacggtgggacttttattagtgacgccgacgatgtggtctctgcaatgatcgtgaaaatgaacgaagccgccgaagaggaccggcagctgaacaatcagaagaaacccgctctgaaaaaactgactctcctgcccgccgtcgtgatgcatctcaagaaacaggacctgaaagagaccttcattgatagtggtgtgatgagcgctatcaaggagtggctcagccccctacccgataggtccctgcctgctctgaagatcagagaggaactgcttaagatcctgcaggagctgccctcggtttcccaagagaccttaaaacatagtggcattggcagggctgttatgtacctgtacaaacaccccaaagaatcccggtctaataaagatatggccggaaagttgatcaacgagtggtcgaggcccatttttggactgaccagcaattataagggaatgacccgtgaagaaagggaacaaagggacctggagcaaatgccgcagcggcggcggatgaattccacgggagggcagactccgcgcagagatctggagaaagtgctgacaggcgaggaaaaggcacttcggccaggagaccccggcttttgcgccagagcaagagtgcctatgccgagcaataaggattacgtggtgagacccaagtggaatgtagaaatggagagctctcggttccaagccacttcaaagaaaggcattagtcggcttgacaagcaaatgagaaagtttacagacataaggaaaaagtcccgctctgcccacgccgtgaagatcagcattgaggggaataaaatgcctttatag

SEQ ID NO: 12159 - DNA, 2319 bp, Artificial Sequence
  Description of Artificial Sequence: Synthetic coding sequence
atggactcggaatactattcaggagaccagtcagatgacggaggagcaacacccgttcaggatgaacgcgacagcggatcggatggtgaagacgacgttaatgaacaacacagcggctctgataccggttcggtcgaacgacattccgagaacgagacatcagatcgagaagatggccttcctaagggccatcacgtcacagacagtgaaaacgactcagagagtgaagaaacaaggaaactcccagggtccgactctgaaaacgaagaactgttgaacggccatgcatccgactcagaaaacgaggatgtcggtaaacatcccgctagcgactcggaaatcgaggagttacagaagtctccagctagcgactccgaaaccgaggacgccctcaaacctcagatttcggactcagagagtgaggagccccccaggcaccaagcctccgattctgaaaatgaggaaccaccaaaacctcggatgtccgacagcgagagcgaggaattacccaaaccccaagtctccgactcagagagcgaggagcctcctcgccatcaggcttctgacagcgagaatgaggagctgccgaagcccaggatttctgatagcgagagcgaggacccacccagacaccaagcttctgatagcgagaacgaagagctacctaagccccgcatcagtgactccgagagcgaagatccacctaggaaccaggcgtccgatagcgagaacgaggaattgcctaaaccacgcgtgtcagacagcgaatcagagggcccccaaaaaggaccagcctctgattctgagacggaggacgcaagccggcataaacagaagccggagtcagatgatgactccgatcgagagaataaaggtgaagacaccgaaatgcagaacgacagctttcacagcgacagtcacatggatagaaaaaaatttcattcatcagactcagaggaggaagaacacaagaaacagaaaatggattctgacgaggacgagaaagaaggagaggaggagaaagttgccaaacgaaaggccgctgttctgtccgatagcgaggacgaagaaaaggctagtgcaaagaagagcagagtagtgtcagatgctgacgacagtgacagcgacgccgtctcggataagtctggcaagagggagaagactatagcgtctgacagtgaggaagaggctggaaaagagctgtcagataagaagaatgaagagaaagacttattcgggagtgacagtgaaagcgggaatgaagaggagaatctcatcgccgatatatttggtgagtcaggagacgaggaggaggaagagttcaccggcttcaatcaagaagacctcgaagaggaaaagggagaaacgcaggttaaggaggccgaagactcagacagtgacgataacatcaagcggggtaagcatatggactttctgtccgactttgaaatgatgctgcagcggaagaaaagcatgagcggaaaaaggcggcggaacagagatgggggcactttcatatccgacgccgatgatgtggtgtccgccatgatcgttaagatgaatgaggccgcagaagaggacagacagctgaataatcaaaaaaagcccgccctgaagaaactcacactcctgcccgctgtggttatgcatttaaagaagcaagatcttaaagagacctttattgattcaggcgtgatgtctgccattaaggagtggctcagccctctccctgatagatctttgccagcactcaagatccgggaagagctgctgaagatactgcaggagctccccagtgtatctcaggaaacactgaagcattccggcatcggtcgcgctgttatgtacctgtataagcatccaaaagaatctagaagcaataaagacatggccggaaagttgattaatgagtggagtagaccaatctttgggcttacatccaactacaagggtatgactcgcgaggagagagagcaacgcgacttagagcagatgccccagcgtcgccggatgaactctaccggcggccagacacctcgcagagatctcgagaaggtgttgacgggagaagagaaagcccttcgccccggtgacccaggcttctgcgcaagggccagggtacccatgcccagcaacaaggactacgtggtgaggccgaagtggaacgtagagatggaatccagtcgatttcaggctacatcgaagaagggtatctcccgcttagataagcaaatgcgaaaatttacagatatacgaaaaaagtctcgcagcgcccacgcagttaaaatctcaatagagggaaacaagatgcccctctag

SEQ ID NO: 12160 - DNA, 1512 bp, Artificial Sequence
  Description of Artificial Sequence: Synthetic coding sequence
atgcctgctagaccacctgcatgtagagttagaccttttcctccggggctgcccgatgatggaggcgccacccctgtgcaggacgaaagagactccggtagtgacggagaagatgacgtgaacgagcaacactccggttccgatacaggttccgttgaacgccacagtgaaaacgagactagcgatcgagaagatggcctccctaaaggccatcacgtgactgactcagaaaatgacgagcctctaaacttaaacgcatctgactctgaatcagaggaactgcatcgccaaaaggacagcgatagcgagagcgaagaaagagccgagcccccagcctccgatagtgagaacgaagatgtgaaccagcatgggtcagattcggagagcgaggaaacccgcaaactacctggcagcgatagcgaaaatgaggaacttctaaatgggcatgcttctgactcggaaaacgaagatgttggcaaacacccggccagcgactccgaaatcgaggagctccagaaaagccccgcgagcgattccgagacagaagacgctctgaaaccgcagatcagcgactcagagagcgaggagccaccccggcaccaggcctccgactcggagaatgaggagccgcccaagccgaggatgtccgactccgaaagcgaagagctgccaaagccacaggtgtccgattctgagtctgaggaacccccacgacatcaggcatccgacagtgagaacgaagaacttcctaagccccggatttctgatagtgagtcagaggacccaccccgtcaccaagcatctgattccgaaaacgaagagctccctaaacctcggatttctgactcggagtcagaggatcctccccggaatcaggcaagtgacagcgaaaatgaagagctccccaaacctagagtaagcgacagcgagtctgagggaccacagaagggtcctgccagtgatagcgaaaccgaagatgcttctcgacataaacaaaaaccggaatctgacgacgattctgatcgggaaaacaagggtgaggatacagaaatgcagaatgacagcttccactccgactcacatatggatcgtaagaaattccactcatccgactcagaagaagaagaacacaaaaagcagaagatggactctgacgaggatgagaaggaaggcgaggaagagaaggttgccaagagaaaagcagccgtgctcagtgatagtgaagacgaagaaaaggcgtctgccaagaagagtcgggtggtgtctgacgcagacgacagcgactccgacgctgtgtctgacaaatccggaaagcgagaaaaaaccattgcctctgacagtgaagaagaggccgggaaggaactttccgacaaaaaaaatgaggagaaagatttatttggatcagactctgaaagcggaaacgaggaggagaatctgattgctgatatcttcggcgaatccggcgacgaggaggaagaagaattcacctacggacttagcgtaagattttag

SEQ ID NO: 12161 - DNA, 2430 bp, Artificial Sequence
  Description of Artificial Sequence: Synthetic coding sequence
atggctggagccgccgctgcagttgccgcaggagcagcagccggagcagctgccgccgctgtgagcgttgccgcccccgggcgcgctagcgccccccctccccctcccccagtgtattgtgtgtgccggcagccatacgacgtgaatagattcatgatcgagtgcgacatctgcaaagattggttccatgggagctgtgtcggggtagaggagcaccacgccgtagatatcgacctgtatcattgtcctaactgcgctgttttacacggctctagtctaatgaagaagcggcggaactggcacaggcatgactacactgagatcgatgacgggagtaaaccagtgcaggcaggtacccgcacttttatcaaagaactcagatccagggtctttccttcggcggatgagattattataaaaatgcacggctcacagctcactcagaggtacctagaaaagcatggtttcgatgtgccaataatggtgcctaagctggatgacctggggttgagacttcccagtcccactttcagcgttatggatgttgaaagatacgttgggggagataaggtgatagatgtgattgacgtggctcggcaggcagactctaaaatgacgctgcataactacgtgaaatactttatgaatccaaatcgccccaaagtacttaacgttatcagtttggagttcagcgacactaagatgtcagaactagtggaggtccccgacattgccaagaaactcagctgggtggagaactactggccggatgacagtgtgtttccaaagccatttgtgcaaaaatattgtctcatgggcgtgcaagactcttataccgacttccatattgacttcggaggaacttcagtctggtaccatgtgctgtggggggagaaaatcttctatctgattaagcctaccgacgaaaatttggcgagatacgagagctggtcatcctcagtgacacagtccgaggttttttttggagacaaggtggacaaatgctataagtgcgtggtcaaacaaggccacaccttgtttgtgccaacaggatggattcacgcagtcctaacgtcccaggattgcatggcgttcggaggtaacttccttcacaacttgaacattggtatgcagctccgctgctacgaaatggaaaagcgcctgaaaacgccagatctcttcaagtttcccttctttgaggcaatttgctggtttgttgccaaaaatttgcttgagactctgaaagagttgcgggaagacggcttccagccgcaaacctacttggtccagggggttaaagcactacatacggcgctaaaactttggatgaaaaaggaactggtttcggagcatgccttcgaaattcccgacaacgtgcggcccggacacttaatcaaagaactgagcaaagtcattagggcgatagaggaggagaatggtaagccagtaaagtcgcaaggaattccaattgtgtgccctgtgtcccgctcttctaacgaggctacttccccataccatagtaggaggaaaatgcggaagttgagggatcataatgttcggacccccagtaacctggacatactggaattgcacactcgggaggtactgaagagactggaaatgtgtccttgggaggaagatatcctaagctcaaaattaaatggaaaatttaataagcatctgcagccctcgtccaccgtgccggagtggagggcaaaggacaatgatctgagactccttttaacaaatggccggatcattaaagatgaacggcagccctttgcagatcaaagcctttacactgcagatagcgagaacgaagaagataagaggaggacgaagaaggcaaaaatgaagatagaagagtctagtggggtggagggtgttgagcacgaggaatcacaaaagcctctcaacgggttctttacaagggtcaaatccgaattacggtcacgcagttccgggtattccgacatctcagaatccgaggattccggccctgagtgtaccgctctgaagagcatttttactactgaagagtccgaaagttccggcgacgagaaaaagcaggagatcaccagcaactttaaggaagagtctaatgtgatgcgtaacttccttcagaaaagccagaagccctcgcgtagcgaaatccctatcaaaagggaatgccccacctccacgtctacagaagaagaggctattcaaggaatgttgtccatggccgggctccactactcaacatgcctccagcggcagatccagtccaccgactgcagcggggagagaaactctcttcaggacccgtcctcttgtcacggcagtaatcacgaggtacgtcagctgtatagatacgacaagccagtcgagtgtgaaacccggtcccacctgtgctgccccgactggtcccccacaccggaattaaagtag

SEQ ID NO: 12162 - DNA, 2826 bp, Artificial Sequence
  Description of Artificial Sequence: Synthetic coding sequence
atggccggagcggccgcagccgtcgcagcaggcgccgccgcgggagcagcagccgccgccgtctcagtggccgcacccggcagggcctccgcccccccaccaccccctcccgtttactgcgtctgtcgccagccttatgatgtgaatagatttatgattgagtgcgatatctgcaaggactggttccacggctcatgtgtaggtgttgaggagcatcacgccgtcgacatcgacctgtaccattgtcctaattgtgccgtgctccatggctctagtctaatgaagaagcgacgcaactggcatcgccacgactataccgagatcgacgacggctctaagccagtgcaggcggggaccaggaccttcatcaaggagctgcgaagtcgtgtgtttccaagcgctgatgagataattatcaagatgcacggctcacagctcacccaaaggtatttggaaaaacacggattcgatgttcccataatggtacccaagcttgacgacttgggactccgtttaccctccccgacattctctgtgatggatgttgaaaggtacgtcggcggcgataaagtcatcgacgtaatcgatgtggctaggcaagcggactcgaagatgaccctccacaactacgtgaaatattttatgaacccgaaccggcccaaagtcctgaatgtgatcagtctggagttcagcgacactaaaatgtccgagctggtggaggtcccagatattgctaagaagctgtcatgggttgagaattattggcccgacgacagtgtatttcccaagcccttcgttcagaagtactgcctgatgggtgtacaggatagctacacagactttcacatcgactttggcggcacttcagtgtggtaccatgtgctatggggagagaagatattttatcttattaaaccaaccgacgaaaacctcgcacgttatgagtcctggtcttcttcggtgactcagagtgaggtcttcttcggtgataaggttgataagtgctacaagtgcgttgtgaaacagggccataccctcttcgtgccaacaggctggatccatgcagtgctaacgagccaagactgcatggccttcggcgggaattttctgcataatctgaacattgggatgcagctcagatgctacgaaatggaaaaaaggctgaagaccccagacctgtttaaattcccttttttcgaagcaatttgttggtttgtggccaaaaatctgctggagacactgaaagaactacgcgaagatgggtttcagccacaaacctaccttgtacagggagtgaaggctttgcacaccgccctgaaactgtggatgaaaaaggaactggtgtcagagcacgcgttcgagatccccgataatgtgcgcccaggccacttaataaaggagttgtcaaaggtaattagagctattgaggaggaaaatggcaaaccagtgaaaagccaaggaatccccatcgtgtgccccgtgagccggtcgtccaacgaggcaacttccccataccattccaggcgaaaaatgagaaagctgagagaccacaatgtgcgcacaccctcaaatcttgatatcttggaattacacactcgggaggtcttaaagagattagaaatgtgcccttgggaagaggatatcttgtcttctaagctgaacggaaagttcaacaaacacttgcagccttcctccaccgtcccggaatggcgagcgaaagacaacgatctgcggttgctgctcacaaatgggagaattattaaggatgaaagacagcccttcgccgatcagagtctgtataccgccgacagcgaaaacgaagaagacaaacggagaactaaaaaagctaagatgaaaattgaggagtcaagcggagtagagggagtggagcacgaggagtctcagaagccactcaatggctttttcaccagagtcaagagtgaactacgttcacggtcttctggctactccgacatcagcgaaagcgaggacagcggacctgaatgtaccgctctcaagagcatttttacgactgaagaatcagagtcttcaggcgacgaaaagaagcaagagatcaccagcaatttcaaggaagagagcaatgtcatgaggaattttctgcagaaatcccagaagccctccagatcagaaatcccgattaaacgcgagtgccccacctccacatctactgaggaggaggcaattcaggggatgctctcaatggcgggactgcactacagtacgtgcctgcagcgccaaatccaatccactgattgtagtggcgaacggaacagcctgcaagatccctccagttgccatggctctaatcacgaggtgcgacagctttatcggtacgataagcccgtggagtgcgggtaccacgtcaagaccgaggaccctgatctccggacatcctcatggataaaacagttcgatacttcccgcttccacccacaggacctgtcaaggtcgcaaaaatgtatccgaaaggaggggtcctccgaaatcagtcaaagagtgcagagcagaaattatgtcgatagttccgggagttcactccaaaatggcaaatatatgcagaacagcaatctgacttcaggggcatgtcagatttccaacgggagcttgagtcctgaaagacctgtgggtgaaacctcattctcagttccactccacccaactaaaaggcctgcaagtaatcctccacccattagtaaccaggctaccaaaggcaaaagacctaaaaaaggaatggctactgccaagcagaggctcgggaagatcctcaagctgaaccgtaatggccacgcaagattttttgtgtag

SEQ ID NO: 12163 - DNA, 4443 bp, Artificial Sequence
  Description of Artificial Sequence: Synthetic coding sequence
atgattgtgatgaatgaccaagtgcttgagccacagaatgtggacccaagcatggtgcagatgacctttctcgatgatgtcgtgcatagcctccttaaaggggaaaacatcggtatcaccagtagacgcaggtctagggcgaaccagaacgtgaatgccgtccattcccactatacccgggcccaggctaattcaccccgcccggcgatgaactctcaggcagccgtgccaaagcagaatacacatcagcagcagcagcagcggagcatccgccccaacaaacgtaaaggcagcgattcatccatccctgacgaggaaaagatgaaggaggaaaaatacgattatatttcacgcggcgaaaatcctaaggggaaaaacaaacatctaatgaacaagcgaagaaagccagaggaagatgagaagaaacttaacatgaaaagactcagaacggacaacgtcagcgacttttcagagagtagtgactctgagaattctaacaaacgcatcatcgataatagttctgagcagaaaccggagaatgagctgaaaaataagaacacaagtaagatcaacggagaagagggtaaaccacacaacaacgagaaggcgggcgaggaaactctgaaaaactcgcagcccccttgggatcaaatccaggaggacaagaaacacgaagaagcagaaaaacggaagagcgttgatacccagctgcaagaggacatgatcattcactcatcggagcagtcaacagtgagcgaccacaattctaacgacctgctcccgcaagagtgcaacatggacaagacccatacgatggagctgctcccaaaggaaaagttcgtctccaggccacctaccccaaagtgtgtgatcgatattaccaatgataccaatctggagaaagtggcccaggaaaacagttccaccttcgggctacagaccctgcagaaaatggatcctaacgtctcagatagcaagcatagcatcgccaacgccaaattcctggaaacagctaaaaaagattctgaccagtcctgggtgtccgacgtcgtgaaagtcgatctgacccagtcttcagtgaccaacgccagcagcgggaacgatcatctcaatatggaaaaggagaagtatgtgagctatatttctcctctgagcgcagtgtcagtgatggaagataagctacacaaaagatcaccaccccccgaaacaataaagagcaagttgaacacaagcgtcgacacccacaaaatcaagtcttccccgtctccggaggtagtgaaacccaaaatcacacacagtcccgattctgtgaaatcaaaggctacttatgtgaactcacaggcgacaggcgagcggcggctagccaacaaaattgagcatgagctctcccgttgttctttccatcccatcccaactcgcagctccacattggagaccactaaatcccccctgataattgataaaaacgaacatttcaccgtataccgagaccccgccctcataggctccgagaccggggccaatcatatctcccctttcctatctcaacatccattccccctccacagcagtagtcatcgcacatgcctgaaccccggaacccatcacccggcgctaacccccgctccgcacctgttggctggaagtagctcgcagacacctctcccaactatcaatactcaccccttaacctcggggccccatcacgcggttcaccacccacaccttttacccaccgtcctgccaggcgtccccaccgccagtctcttgggagggcacccacggctggaatctgcccatgcaagcagtctgtctcacttagctcttgctcaccagcagcagcagcaactgctccagcaccaatccccacatctgctagggcaagcccaccctagcgcatcttacaatcagttaggcctgtaccccattatctggcagtatcctaatggaacccacgcttatagtggacttgggctgccttcttctaagtgggtgcatcctgaaaatgcagtgaacgctgaggcaagtctaaggcggaatagcccctcgccctggcttcaccagcccactcccgtgaccagcgcggatggaattggactgttatcccatatccctgtaagaccaagctctgctgaacctcatcggccccttaagataactgctcattcatcccccccattgacaaagaccctagtggaccaccataaagaggagctggagcgcaaggcttttatggaacctttgaggtccgttgcatctacgagcgccaagaatgacctggatctgaacagaagccagaccggaaaagactgtcatctccaccggcacttcgtggatcctgtactgaatcagctacagaggcctccccaggagacaggcgaacggctaaataaatataaggaagagcatcggagaatccttcaggagtctattgacgtcgctccattcacgacaaaaattaaaggcctggaaggtgaacgcgagaactattcgcgggtcgccagttcctctagcagccccaagtcccatattatcaagcaggatatggacgtggaacggtctgtgtcagacctctacaagatgaagcacagcgtaccccagagtctcccccagtctaactactttacaaccttaagcaattcagtggtgaacgagcccccccgaagctacccgtccaaggaggtttccaatatttacggcgataagcagtccaacgctctagctgccgccgcggccaatccgcagacgctgactagtttcataaccagtcttagtaagccccctcctcttatcaagcatcagcccgaatcagagggactggtcgggaagattccggagcacctgccccaccagatcgctagccactccgtcactacatttcgcaatgactgccgaagccctacccatctgacagtttcctccactaacactctccgatccatgccggctctccatcgcgctccagtcttccatcccccaatccaccacagccttgagaggaaggaaggctcctactcgagcctgtcgccccccaccctgacacctgtcatgcccgtgaacgctggcggaaaggttcaggagtcacagaagccaccgacgctaataccagagccaaaagattcccaggcaaattttaagtcaagttcagagcaatctctgactgagatgtggagaccaaataacaatctctctaaagaaaagaccgaatggcacgttgagaaatcaagcgggaagctgcaagccgcaatggccagcgtcatcgtgaggccctcctcaagtactaagactgatagcatgcccgccatgcaactggcttcgaaggatagggtatcagaacgaagtagtgcaggggcccataagacggactgtctgaagctggcggaagctggcgaaactggaagaatcatattgcccaacgttaacagtgattccgtacacacaaagtccgagaagaactttcaggccgtatctcaagggagtgtgccatccagtgtgatgtccgcagtaaatactatgtgcaacaccaagaccgacgtgatcacttcagcggctgacacaaccagtgtaagctcttggggggggtctgaggtgatttccagcctctccaataccattctggcttcaacttcgtccgaatgcgtttcttctaagagcgttagtcagcctgtggcccagaaacaggagtgtaaagtgagcacaacggctcctgtcaccttggcttcaagcaagaccggaagtgttgtacaacccagctcaggcttttctggaacaacagactttatccacctaaaaaagcataaagcagccctggcagctgcacagtacaagtcctcaaacgcttcagagacagagcccaacgccatcaaaaaccagactctgagcgctagcctgcctcttgatagcacagttatctgttcaactattaacaaagctaactccgtaggcaacggacaggcctcacagacatcccagcctaactaccacacaaaactcaaaaaagcatggctcacccgccactccgaagaggacaaaaacaccaacaagatggaaaactccggtaattcagtctcggagattatcaaaccttgttctgtgaaccttatcgctagcacctcctcggatatccagaattctgtagactccaaaatcattgtggacaaatacgtcaaggacgacaaggtcaatcgtagaaaggcgaaacggacgtatgagtcaggctcggagtccggcgacagcgatgagtccgagtctaaatcagagcagcgcactaaaaggcaaccgaaacccacctataagaaaaagcagaatgacctacagaagcgcaagggcgagatcgaggaagatctcaagccgaacggggtcctgtctcgctccgccaaggaaaggagtaagctcaagttgcagagcaattctaactcttgccacctagtgaagaccgaatag

SEQ ID NO: 12164 - DNA, 7623 bp, Artificial Sequence
  Description of Artificial Sequence: Synthetic coding sequence
atggcggtggagacaagggccgaattggtgggaaaacgcttcctttgcgtcgccgtcggggatgaggcgaggtccgagagatgggaatccgggaggggctggaggagctggagagccggcgtcatcagggccgtgagccacagggatagtcggaatcccgatctggccgtctacgtggagttcgatgacctggagtgggacaagcgggagtgggtgaaagtgtatgaggatttctccacgttcctggtggagtatcacctgatttgggcaaagcgaaatgacccatcccaaacacaggggtctaaaagcaagcaaattcaatggcctgccttgactttcaagccgcttgttgagcgcaacattccgagctctgtaacggcagtggaatttctagtggacaagcagttggacttcctgactgaagattcagcgttccagccttaccaggatgatatcgacagtttgaaccccgtattgcgcgataatccacaactacatgaagaagtgaaagtgtgggtcaaagagcagaaagtccaagaaatcttcatgcaggggccctactccctgaacgggtacagagtcagggtgtatcgccaggacagcgccactcagtggtttaccggcataatcacgcaccacgatctgttcacgcgcaccatgattgtaatgaatgaccaggttctcgaaccacagaatgtggacccaagcatggtgcagatgactttcctggacgatgtagtccacagcttattgaaaggcgaaaatatcggcattacgtcccgtcggcgctcccgggcaaaccagaatgtcaacgcagtgcactcccactatacaagagcccaggccaactcacccaggcctgcaatgaactcccaggcagcagtgcctaagcagaacacgcaccagcaacagcagcagaggagtattcgccccaataaacgcaagggcagtgacagcagcattcctgacgaggagaagatgaaagaggagaagtacgattacatttctcggggtgagaatccaaaaggtaagaacaagcacctaatgaataagaggcggaagccagaagaagacgaaaaaaaactcaacatgaaaaggctgcgcaccgacaacgtgtccgacttttcggagtcttctgattctgaaaactctaataagcggatcattgataattcctcagagcagaagccggaaaatgagttgaaaaacaagaataccagtaaaattaacggtgaagagggtaagccccacaacaacgagaaagcaggcgaagaaactcttaagaattcccagcctccctgggaccaaattcaggaagacaagaagcatgaagaagctgagaaaagaaagagcgtcgacactcaacttcaagaagacatgattatacatagcagtgagcagagtacagtttcagaccacaatagcaacgacctgttaccccaggaatgcaacatggacaaaacccatacaatggagttgctcccaaaggaaaagttcgttagccggcctccgacaccaaaatgcgtgatcgacattactaacgacactaatctcgaaaaggtagcgcaagagaattcttccaccttcggcctccagacacttcagaagatggaccctaatgtttccgattcaaagcacagcattgctaacgctaaattcctggagacagccaagaaggactctgatcagtcctgggtctctgacgtggtcaaggtggatctcactcagtcatctgtcaccaacgcttcatcagggaatgaccatctgaatatggaaaaagaaaaatacgtttcttacatctctccactgtccgccgtgtctgtaatggaggataaactccacaaacggtcccccccacccgagaccattaagagcaagctgaataccagcgtggatactcataaaattaagtctagcccctccccggaggtggttaaaccaaagatcactcactccccagattccgttaaaagcaaagcgacttacgttaacagtcaagccaccggcgagcggcgactagccaacaaaattgagcatgagcttagccgatgtagttttcaccccatccccacccggagttccactctggagactaccaagagtcccttgataattgacaaaaatgagcattttacggtctaccgcgaccctgccctcataggctccgagactggagccaaccacatcagcccttttttaagccaacatccttttccgttgcactcatccagtcatcgcacatgcctgaatccaggtacccaccacccagccctgacacccgctccccatttactggctggcagttcctcacagacacccctacctacaataaatacccatccactgacatctggccctcatcatgccgtgcaccacccccacctgctacctacagtgctccccggggtaccgaccgcttcactccttggcggccatccacgtctagaatccgctcacgcttcgagtctgtctcacctggcattggcccatcagcagcaacaacagcttctgcaacatcaatcacctcatctgctcggacaagctcacccctccgcatcctataaccagctggggctctaccccattatctggcagtaccccaatgggacccacgcttactcggggctgggtcttccttcaagcaaatgggtacatccagagaacgctgttaatgctgaagcatccttgcgccggaactcccctagcccttggttacatcaacccacccctgtgacatcagctgacgggatcggcctactctcccacatccctgtgcgtccctcaagcgccgaaccccacaggcctcttaaaataaccgcccattcctcccccccactgacaaaaaccctagtggaccatcacaaggaagaactggagaggaaggccttcatggaacccctgcgctccgtggccagtacatcagctaagaacgatctcgatctgaataggagccagaccggcaaagattgccatctgcacagacattttgttgaccctgtgttgaatcaattgcaaagaccacctcaggaaactggggagcgactcaataagtataaggaagagcacagacgcattcttcaggagagcattgacgtcgcccctttcactacaaagattaagggcttagaaggggaacgcgagaactacagtagagtagcgtcatcgagttccagcccaaagtcgcacattattaaacaagacatggatgtcgaaaggtccgtaagcgacctgtacaagatgaagcattcagtaccacagagcctccctcagtcgaactatttcactaccttgagcaactccgttgtcaatgaaccccctcgctcatacccatctaaagaagtgagcaatatctatggtgataagcagtcaaatgcacttgccgctgctgccgctaatcctcaaactcttacttcatttatcacgagcctctcaaagccccctccccttattaagcaccagcccgagtcggaaggcttggtagggaagattcctgagcatttgcctcaccagatcgcctcccattccgtcaccacctttcgaaacgattgccggtcgcccacccatcttacagtcagttctacgaatactttgcggagcatgcctgctctgcaccgcgcacctgtatttcaccccccaattcaccattccctcgaaagaaaggaaggcagctattcctctctgagtccacctacgctaacccccgtgatgccggttaatgcggggggaaaggtccaggagagccagaaaccgcccaccctcattcctgagcctaaggactctcaggctaattttaagtcaagttctgagcagtctctgacggaaatgtggcgcccgaataataacctgtcgaaagagaaaaccgagtggcacgtggagaaatccagcggcaaacttcaggctgctatggccagcgtaatcgtgcgcccatcctcctctacaaaaactgacagtatgcctgcaatgcagctcgcctccaaagatcgggtgtctgaacgcagcagcgccggagcccataagactgattgtctgaaactcgctgaggccggagagaccggccggatcatattgcctaatgttaactctgatagtgtacacactaaatccgagaagaattttcaagccgtctctcagggtagcgtcccctcctccgtgatgtctgctgtcaataccatgtgtaataccaaaacagatgttatcacatccgctgctgatacaacctcagtgagtagctggggagggagcgaagtcattagctccctgtccaatacaatcttagcctccacaagcagcgagtgtgtgtcttccaaatccgtctcccaacccgtggctcagaagcaggagtgcaaggtatctaccacagcccctgtgactctagcatcttccaagacgggatcggtagtgcagccatcttcaggctttagtggtaccactgatttcatccatctgaaaaaacataaagcagctttagctgccgcgcagtataagagctcaaatgcatctgagacggagccaaatgcaattaagaaccagactttgagtgcaagcctcccactcgattctacagtgatatgctctacaatcaacaaggctaacagcgtagggaacggccaagctagccaaacgtcccagccaaattatcatacgaagctcaaaaaggcgtggttgacacggcactccgaagaggacaagaacactaacaagatggagaacagtggcaactccgtgagcgaaatcattaagccatgttctgtcaacctaattgcctccacttcctcggacattcagaactccgtagatagtaaaattattgtcgataaatacgtcaaagatgacaaagtgaatcgcagaaaggccaagagaacctacgagtcgggctccgagtccggggactctgatgagtctgagtctaaaagcgagcaacgcacaaagcgccaacccaagcccacctacaaaaaaaagcagaacgatcttcagaaaaggaagggggaaatcgaggaagacctcaagcccaatggagtgctttcacgctcggcgaaggagcggtctaaactgaagcttcaaagcaattccaacacaggaattcctcgttctgtgctgaaggattggaggaaggtgaagaagctgaagcaaaccggtgaaagttttctacaggacgactcatgctgtgaaatcggccctaatctgcagaaatgtagagagtgtagactgatccgcagcaaaaagggcgaggagcccgcacattcgcccgtgttctgcaggttctactatttccgccgattgagtttcagtaagaatggagtggtgcggatcgatggattctctagccccgaccagtacgatgatgaagctatgtcattgtggacacacgagaatttcgaggacgacgaactcgatattgagacatccaaatacatcctcgatattattggagataaattttgccaattagtgacttctgagaagacagccctgtcttgggtgaaaaaagacgctaagatagcctggaagagagcggtacgtggtgttcgtgaaatgtgcgacgcttgcgaggcaaccctttttaacatacactgggtgtgccaaaagtgcggcttcgtggtttgcttggactgctataaggcgaaagaacgtaaatcctccagagataaggaactttacgcctggatgaagtgtgtcaagggccagccacacgaccacaagcatctcatgccaactcagatcattcctggctccgtattgacagacctattggacgccatgcatactttacgcgagaaatatggcattaagagccactgccattgtacaaacaagcagaacctccaggtgggaaattttcccacaatgaacggcgtgtcacaggtgttgcagaatgtcctcaaccattcaaacaagatctccctgtgcatgcctgagagccagcagcagaatacacctcctaagagtgagaaaaacggcggtagctccccggagtccgacgtgggcaccgacaataagctgacgccacctgagagtcaaagtcccctacattggctggccgatctggctgagcagaaagcacgggaggaaaagaaggaaaataaagaacttactttagagaatcagataaaagaagagagggagcaggataacagtgagtctcctaacggccgtactagccccctggtttctcaaaacaacgagcagggctccactctgagggacctattaaccaccaccgccgggaagttgcgggtcgggtcaacggatgcggggattgcattcgcccctgtttattccatgggcgctccatctagcaaatccggaagaaccatgccgaacatcttagatgacataatcgctagcgtagtggaaaacaagattccccctagtaagacttctaagatcaacgtcaagccggagctgaaagaagagccagaagagtccatcatttcagcggtggacgagaacaataaattatactctgatatcccgcattcatggatctgcgaaaaacatatcctttggctgaaagattacaagaactcctctaattggaaactgtttaaagagtgttggaaacaaggacagcccgccgttgtttccggggttcacaagaagatgaacataagcttatggaaggctgagtctataagtctggacttcggggatcaccaggccgatctgttaaattgcaaggatagtattatttctaacgccaacgttaaggagttttgggacgggttcgaggaagtcagtaaacgacagaagaacaagagcggggaaactgtcgtgctcaagttgaaagactggccatctggagaagattttaagacgatgatgcccgcacgctacgaggacctgctcaaaagtctgcccctcccagagtactgtaacccagaagggaagtttaatctggcgtcccacctccccgggtttttcgtgcggccagacctaggtcccagactgtgttctgcctacggggtggttgctgccaaagaccatgacattgggactacgaacctgcatattgaagtgtctgatgttgtcaacattctagtctacgtggggatcgccaaggggaatgggatcctatctaaggccggaatacttaagaagtttgaggaagaggacttggatgatattctccgcaaaagactcaaggattcttcagaaattcccggggcgctgtggcatatttatgccggaaaggatgtggataaaatccgcgagtttttgcagaagatatcgaaagagcagggcctagaggtgctacctgaacatgatcccattagagaccagagctggtacgtaaacaagaagctgcgccagaggttactggaagagtacggggtgcggacctgcaccctaattcagttccttggcgatgccattgtccttcccgcaggggctctccatcaagttcaaaactttcactcttgcatacaggtgacagaagactttgtgagtcctgaacatctggtggagtccttccatttgacacaggagcttcgcctgctgaaggaagagataaactatgacgacaagctccaggttaagaatatcctttaccatgctgtgaaagagatggtcagggctttaaagatccatgaggatgaggtggaggatatggaggagaattag

SEQ ID NO: 12165 - DNA, 6912 bp, Artificial Sequence
  Description of Artificial Sequence: Synthetic coding sequence
atgattgttatgaacgatcaagttctggagccacagaatgtcgatccttccatggtgcagatgacatttctggacgacgttgttcactccctcctcaagggagagaatattggcatcacaagccggagaaggagtcgtgctaaccagaatgtaaacgctgtgcacagccactacacgcgcgctcaagcgaactctcctcgcccggccatgaatagccaggccgctgtgcctaaacagaatacccatcagcaacagcaacagcgctccatccgtccaaataaaagaaaaggcagcgattctagtattcccgacgaggagaaaatgaaggaagagaagtatgattacatctcacgcggggagaatcctaagggcaagaacaaacatctcatgaacaagagaagaaagccggaggaggatgagaagaagctcaatatgaagcggctacggacggacaacgtctcagatttttcggagagctccgattctgaaaacagcaacaagcgcattatcgacaactctagcgaacagaaacctgaaaacgagctgaaaaacaaaaacacttctaagattaacggagaagaggggaagccccacaacaatgaaaaagctggcgaagagactctaaagaatagccaacccccctgggaccaaattcaggaagataaaaagcacgaggaggcagagaaaaggaagagtgtggatactcaactacaggaagatatgatcatccatagctcagaacaaagcaccgtgtcagatcataactctaatgacctgctgccccaggagtgcaacatggacaagacacacactatggaacttctgccaaaggagaagtttgtgtcgcgcccccctacgcctaagtgcgtcatcgacattaccaacgataccaacttggagaaggttgcacaggaaaacagttccactttcggactccaaaccctgcagaagatggatcctaacgtttcagactccaaacatagcatcgctaatgcaaaattcttggagacagccaaaaaagacagcgatcaaagttgggtgagcgatgtcgttaaagtggatcttacacagagctccgttacaaatgcttcaagcgggaatgaccatcttaatatggaaaaagaaaaatatgtgtcttacatctcccccttgtctgcagtctcggtgatggaggataaactgcataaacgatcaccacccccggagacaatcaaatcaaagctgaacaccagtgttgacacccataagattaagtcaagcccctccccggaagtggtcaaaccaaaaattactcatagccctgattccgtgaaatcgaaggcaacatacgttaatagccaggccacaggggagcgaaggcttgcaaataagattgagcacgagttatcacgctgtagcttccatccaatcccgaccagaagctccactctcgaaaccacaaagtcacccctgataatagataagaatgaacactttaccgtttacagagacccggcattgatcgggtcagagaccggtgcaaatcacattagccctttcctctctcaacatccgtttccgcttcatagctcttctcatcgtacatgtctgaaccccggtacccaccaccctgctcttacgccggccccccaccttctggccgggtcttcatcccaaactccgctgccgactatcaatacacacccgctcacctctggcccccaccatgccgtgcatcacccacaccttctgcccacagtgttgcctggcgtgccaactgccagtctccttggcgggcatccgcgacttgaaagcgcccacgctagcagtctatctcacttggccctcgcacatcagcaacaacagcaactgcttcagcaccagtcacctcacctgctgggtcaggcccatccttccgcttcttacaatcagctaggcctatatccaattatatggcagtacccaaacgggactcacgcttatagcggactcggactgccatctagcaagtgggtgcacccggaaaatgcagtgaatgctgaagcatcactccggcggaatagcccttctccatggctgcaccagcctactcccgtgacctctgccgatggcatcggcctgctatcacatattcctgtacgtccttcttcggctgaaccccacagacctctaaaaatcaccgcccattcatctccccctctaacaaagactctagtggaccaccataaggaagagctggaaagaaaggcatttatggagccgttaagaagtgtggccagcacctctgccaagaatgacctcgatctgaatcgatctcagactggaaaagactgtcacctgcacagacattttgtcgaccccgtgcttaaccagctgcagagacctccccaggagaccggagagagactcaacaaatacaaggaagagcataggcgaattctgcaggagagcatcgatgtggccccttttaccaccaagatcaaaggcctagaaggcgagcgagagaactactctcgcgtggcttccagctcatcatcccccaagtcccacattatcaaacaggacatggacgtcgaacgctcggtatcagacttgtacaaaatgaagcactccgtgccccagtctttgccccagtctaactatttcactaccctgtctaatagcgtggttaacgaacctccccggtcatacccatccaaggaggtcagtaatatctatggggacaagcagagcaatgccctcgcagccgcagccgccaacccccagacattaacatcatttataacttcgttgagtaaacctccgcctctgataaagcatcagccagagtctgaaggactcgtgggcaaaatccctgagcacctaccccaccagatcgcaagtcactccgtcaccaccttcagaaatgactgcaggtcccccacgcaccttacagtttcctcgaccaatacactgaggtcgatgccagccctccacagggcccccgtgttccaccctccaatccatcatagcctggaaagaaaggaaggcagctactcctccctctcaccacctacgctgacccccgtaatgccagtaaatgccggcggaaaggtccaagagagccaaaaaccacctacactgatacctgaacccaaggattctcaggcaaactttaagagctcctctgagcaatctttaacagaaatgtggcgacctaataataatctcagcaaagagaaaactgaatggcacgtcgaaaagagctctggaaaattacaggccgcaatggctagcgtgatcgtgcgcccgtcatccagcaccaagacagatagcatgccggctatgcagctggcaagcaaggatcgggttagcgaaaggagcagtgctggcgcacacaaaaccgactgcctcaaacttgcggaagccggagagacaggccgtatcatcctccccaacgttaatagtgattcggtgcacacaaaatctgagaaaaacttccaggcggttagtcagggctctgtgccttcctccgtgatgagcgccgtcaatacaatgtgtaatactaaaacggatgtgattacatccgctgcagacacaacctcagtgtccagttggggcggttccgaggtcatctcaagcctcagtaacaccattctggccagcacaagctccgaatgcgtgtcatcaaaatccgtctcacaacctgtggcccagaaacaggaatgtaaggtgagtactactgcgcccgtgactctcgccagctctaaaacaggcagcgtggtgcaaccttcttccggcttcagtgggactaccgacttcatacatctgaaaaagcacaaagctgccctcgcggcagctcagtataaatcctcaaatgctagtgagacagaacccaatgccattaagaatcaaaccctgtcagccagtttaccacttgatagcaccgtcatttgtagtacaataaacaaagccaacagtgttggcaatgggcaagctagtcagacgtctcagccaaattaccacaccaaactgaagaaggcctggctgacacggcacagtgaagaggataagaacactaacaagatggaaaactcaggaaactctgtttcagaaattattaaaccctgttctgttaacctcatcgcttcaacctcctccgacatccaaaattcagtcgactcaaaaatcattgtagataagtacgttaaggacgataaagtgaaccgaagaaaagccaagagaacctatgaaagcggatccgagtcaggagactctgatgagtctgagtcaaaaagcgaacagaggactaagagacagcccaaaccaacgtacaagaagaagcagaacgatttgcagaagcgtaaaggcgagatcgaggaggacctgaaacccaatggggtgctgagcaggtctgccaaggagagaagcaaacttaagcttcagtccaatagtaatactggcatcccacgcagtgtgctcaaagattggaggaaggttaaaaagctcaagcagacaggtgagtcattcctgcaggatgatagttgttgcgagatcggccccaatttacaaaagtgccgcgagtgccgcctgattcgcagcaagaagggagaggaacccgcacattctcccgtgttctgccggttctactacttccggcgcctcagcttttctaagaacggagtggttaggatagacggcttttcaagtcccgatcaatatgacgatgaggctatgtccctctggacccacgagaacttcgaggatgatgagcttgacatcgagacttcaaagtatatattggacatcatcggcgataaattctgccagctggtgacttctgagaaaacagcgctttcctgggtcaagaaggatgccaagatcgcatggaagcgggctgtgcgcggcgttcgagagatgtgtgacgcctgcgaggccactctcttcaatatccattgggtctgtcagaaatgcggatttgttgtttgtctggactgttacaaagctaaggaacgtaaatctagtagagacaaggaactgtatgcctggatgaaatgtgttaaagggcaacctcacgatcataagcatctaatgcctactcagattatccctggaagtgtgctgacagacctgttggacgcgatgcacaccctgagagagaagtatgggatcaagtcacactgtcattgcacgaacaagcagaatttgcaggtcggcaactttcctacaatgaacggggtgtctcagtcccagcagcagaacacgcctccgaagtctgagaagaatggggggtcatctcccgagagcgatgttggaaccgacaataagctgacacccccagagtctcagtctccgttgcattggctcgccgatctcgcggaacagaaagccagagaggagaagaaagagaataaggaattgaccttagagaatcaaattaaggaggaacgggaacaggataatagtgagtcccccaacgggagaacatcacctctggtgagtcagaacaacgaacaaggaagcacccttagagatctgctgacaacaaccgcgggaaagttgagagtcgggtcaaccgacgctggaatcgctttcgctccagtttacagcatgggcgccccctcgtcaaaatccggaagaacaatgccaaatattctggacgacattatcgccagtgtggtcgagaacaagatcccgcctagcaaaacctctaagatcaatgtgaagcccgagcttaaggaggagccagaagaaagcatcatttctgccgtggacgagaataacaagctctacagcgatattcctcattcctggatttgtgaaaaacatatcctgtggctgaaggactataaaaatagcagcaactggaagctgttcaaggaatgttggaagcaagggcagcctgccgtggtctctggcgtgcacaaaaagatgaacattagcttgtggaaggccgaaagcatatcattggacttcggagaccatcaggcagacctgctcaactgtaaggactcaataatcagcaatgctaacgtgaaagagttctgggacggctttgaagaggtgtctaagagacaaaagaataagtcaggagaaaccgtggttttgaagctgaaagattggcctagcggcgaggattttaagaccatgatgccagctaggtacgaggatcttcttaagtccttacctctgccagagtattgcaatccagaagggaaatttaatctggccagtcatctgcctggcttcttcgtgaggcctgatctgggaccacgcctctgtagtgcatatggtgttgtggctgctaaagaccatgacatcggaacaacaaacttacacatagaagtgtctgacgtggtgaacattctcgtatacgtgggtattgcaaaagggaatgggatcctgagtaaggccgggatactgaagaagttcgaggaagaagatctcgacgacattctaaggaagcgcttaaaggactcatctgagattccaggcgctttgtggcacatctatgccgggaaggatgtagacaagattcgcgaatttctccagaagatttctaaagagcagggtctagaagttcttccggagcatgaccctatcagggaccagagctggtatgtgaataagaaactcagacagcgattactggaagaatatggagtgaggacatgcaccctcattcagttcttaggcgatgccattgtcctgccagccggtgctctccatcaggtgcaaaattttcactcctgcatccaggttaccgaagacttcgttagtcccgagcatctggtcgagtcatttcacctgacccaggagctgcgattattgaaggaagagataaactatgacgacaagcttcaggtaaagaatatcctgtaccatgcagtgaaagagatggtgcgtgctctaaaaatccatgaagatgaagtcgaagatatggaggagaactag

SEQ ID NO: 12166 - DNA, 7077 bp, Artificial Sequence
  Description of Artificial Sequence: Synthetic coding sequence
atgcagggaccgtactcgctgaacggttatagggtgagggtctatcgtcaggattccgctactcaatggtttaccgggatcattacacaccatgacttgttcacacgaacgatgatagtaatgaacgaccaagtgttggaaccgcagaacgtcgaccctagcatggtgcagatgacctttctcgatgatgttgtgcattctttactcaagggagaaaacataggcattaccagtcgcagacgttccagagcaaatcagaatgtgaacgccgtgcatagtcattacacacgggctcaggcgaattcaccacgaccagcaatgaattcacaggctgcagtaccaaaacagaacacacaccagcagcagcagcagagatcaatcagacccaataagcgcaaaggtagtgatagctctataccagacgaagaaaagatgaaggaagagaaatatgactatatctcccggggcgagaacccaaaaggcaaaaataagcacctaatgaataagcggagaaaacccgaagaggacgaaaaaaagctgaatatgaaaagactgcgcaccgataatgtctctgacttcagcgaatcaagtgattccgagaactctaataaacgtatcattgacaactcgtctgagcagaagccagagaacgagcttaagaataagaacacatccaagattaacggcgaagaaggaaagcctcacaataacgaaaaggctggggaagaaaccctgaaaaactcacaacccccttgggaccagatccaggaggacaagaagcacgaggaggccgaaaaacgtaagtccgtggacacacagctccaggaggacatgattatccactcgtctgaacaaagtacagtgtccgatcacaacagcaacgacctcttgccacaggagtgcaacatggacaaaactcatacaatggagttactgcccaaggaaaagtttgtgtctcggcccccaaccccaaagtgtgttatagacataaccaacgacacaaatctggaaaaggtcgcacaagagaattcctccacgtttggacttcagacactccagaaaatggaccccaacgtgagcgacagtaaacactcaattgcaaacgcaaagtttctcgaaactgcaaagaaagatagcgatcaaagctgggtgtctgacgtggtgaaagtggatctcacccaaagcagtgtcactaacgcgagcagcggaaatgaccatctcaacatggaaaaggagaaatatgtgtcttatattagccccctgagcgcagtaagtgttatggaggacaaactgcataaaagatcccctccccccgaaacaataaagagcaagctaaacacatcagtggatacacataaaatcaagtcctccccaagcccagaagtggtcaaacccaagattacccattctccggacagcgtcaagagtaaagccacatatgtgaattcccaggcaaccggagaacgtagactcgccaacaaaattgaacatgagttgtcacgttgcagttttcacccaatccctacgcggagcagcaccctagaaactacaaaatctcctttaataattgataagaatgagcatttcacggtttacagagatccggccctgataggttccgaaaccggtgctaaccatataagtccctttctatcccagcatccgtttcctttgcacagcagctcccatcggacctgtctgaatcctgggacacaccatccggcattaactcctgcacctcacctactcgctggctcctccagtcagacaccattgccaactatcaatacccaccccctcacgagcggtcctcatcatgctgttcaccacccccatcttctccccacagtgctccccggagtccccactgcttcattactgggtgggcaccctagactagaaagcgcacacgccagtagtctctcacacctggccctggctcatcagcagcagcagcagctactccagcaccagagcccccacctgttggggcaggctcacccctccgcgtcttacaaccaactaggtctgtatccgataatctggcagtacccgaatggcactcacgcctacagtggactggggctcccatccagtaagtgggtgcatccagaaaacgccgtgaacgcagaggcaagtctcagacgcaactccccatcgccgtggcttcatcaacctaccccagtaacaagcgcagatgggatcggcctgctgtctcatattcctgtgaggcctagttctgccgaaccccaccgtcctttaaagatcacggctcacagcagcccacccctgacaaaaactctcgttgaccatcacaaagaggaattggagaggaaagcgttcatggaaccacttcggtccgtggccagtacctcagccaagaatgatcttgacctgaaccggtctcagacgggaaaagactgccacttacatcgacatttcgtcgaccccgtcctaaaccagctgcagcgccctcctcaggaaacaggggagcgcctgaacaaatataaagaggagcataggcgaattctgcaggaatctatcgacgttgccccttttaccacgaagataaagggactggaaggggaacgagagaactatagccgggtcgcttcctcatccagtagtcctaaatcccatattattaagcaggatatggatgttgaaaggagtgtgtcagatctctacaaaatgaagcactcagtgccacagtcgctgccacagtctaactactttacaacactgtcaaatagcgtggtgaacgaacccccccgatcatatcccagcaaggaggtgagcaatatctatggcgataaacagtccaacgccctggccgccgcagccgccaatccacaaacattgacatcttttatcactagtctgtctaagccccctcccctgatcaagcatcagccagagtccgagggtttagtgggaaaaattccagaacacctgcctcatcaaatagcctctcacagcgtaacaaccttccggaatgattgtcggtcgcctacacacttaaccgtaagtagcaccaatacactgcgatctatgcctgctttgcacagggcacctgtctttcacccccccatccatcactcactggagaggaaggaaggctcatattcatccctgtcgcccccaactctgactcccgttatgcctgttaatgccgggggtaaggtccaggagtcacagaagccgcccaccctgattccggaacctaaagattcccaggccaactttaaaagcagtagcgaacaatcccttaccgagatgtggagaccaaataacaatctgtctaaagaaaaaactgagtggcatgtcgaaaaaagcagcggaaagctgcaagccgccatggcgagcgtgatagtccgccctagtagtagcaccaagacagattcaatgcccgccatgcagctggcctctaaggatagagtatcggagcggtccagcgctggcgcacataagacagattgtctgaaactcgccgaagctggagaaacagggagaatcatcctgcccaacgtgaattccgatagtgttcacactaagtccgaaaaaaatttccaagccgtgtcccagggcagcgtgccaagctccgtgatgagtgctgtcaacaccatgtgtaataccaaaactgacgtaattacttctgctgcggacacaacaagcgtaagctcatggggtggctccgaagtgatttcatctcttagtaacaccatactggcttccacatcttccgagtgcgtaagctcgaagagcgtgagccagcccgtcgcacaaaagcaggagtgtaaagtatctaccacagctccggtgactctagcctcttctaagaccggaagtgtggtgcagccctcctccggtttttctggcaccaccgattttattcacttaaaaaagcacaaggcggctctagccgctgctcagtataagagttctaacgccagcgaaactgagcccaatgcgataaaaaatcagacactctcggcctccctgcctctggattctactgtgatttgcagcacgataaacaaggcaaattccgttggtaacggtcaggcctcacagacctcccaacctaattatcataccaaactcaagaaggcctggctgaccaggcattctgaggaagacaagaatactaacaaaatggaaaactccggaaactctgtgtctgagataattaaaccctgctctgtgaatctcattgccagtaccagtagtgatatccaaaattccgtggattccaagattatcgtggataaatatgttaaagacgacaaggtgaataggcgtaaggcaaagcggacctacgaaagcgggtccgagtcaggtgactcagacgagtctgaaagcaagagcgagcagcggacaaagcgacaacccaagccgacttataagaagaagcagaacgatctccagaagaggaagggcgagatcgaggaagacctcaaacctaacggggtcctcagccgctcagctaaggagcgctctaaactcaagctgcaaagcaacagtaacaccgggattccacggtccgtgctgaaggactggcgtaaagtaaagaaattgaagcaaaccggggagtcctttttgcaagatgactcttgctgcgaaatagggcccaatctgcaaaagtgcagggaatgcagacttatcaggtctaagaagggagaggagccagctcatagccctgtcttctgcagattctattattttcgacggctctctttttctaaaaatggtgtggtgcgcattgatggcttttccagtcctgaccagtacgatgacgaagccatgtctttatggacacacgagaattttgaagacgatgagctcgacatcgagaccagtaagtatattctggatatcatcggtgacaaattctgtcagttagtcacatctgagaagacagctttgtcatgggtgaaaaaggacgcaaaaatagcatggaagcgggccgtgagaggagtaagggagatgtgcgatgcgtgtgaggccacactatttaacattcactgggtatgccagaagtgtggatttgttgtctgcctcgactgttacaaagcaaaagaacgcaagtcttcacgggataaagaactttacgcgtggatgaaatgtgtgaagggacagccgcacgaccacaagcatttgatgcctactcagatcatccctggatcagtcctgacagacctgcttgacgccatgcatacattaagagagaagtacggaatcaaaagtcactgccactgtacaaacaagcagaatttgcaggtgggcaactttccgaccatgaacggggtttcacaggtgttgcagaacgtcctgaatcactccaataaaatcagtctgtgtatgcctgagtcacagcagcagaacaccccacccaagtccgaaaagaatggtggaagcagtccagaatcggacgttggcacagataacaagctcaccccccccgagagccagtcacctctccactggctggcagacttagccgaacagaaggctcgcgaggaaaagaaggaaaacaaggaactgacactggagaatcaaatcaaagaggaacgggagcaggataactccgagtcgccaaatggccgtacctctcccttggtctcccagaataacgagcaggggtccactctgagggatctactgacaaccaccgccgggaagctgcgggtagggagtacagacgccgggatcgccttcgctcccgtatattcaatgggggccccctctagcaagtccggcaggacaatgcccaacattctggacgacatcattgcgtcagtagttgaaaataaaatcccaccgtcgaaaacatctaaaataaatgtgaaacccgagctcaaggaagaaccagaggagtcaataatctcagcagtggacgagaataataagttgtactccgatatccctcacagttggatttgcgagaaacatatcctgtggttaaaggattataagaattcaagtaattggaaactgtttaaggagtgttggaaacagggacaacctgccgtcgtttcaggcgtccataaaaagatgaatatatcgctctggaaagcagagtctatctcacttgacttcggggatcatcaagctgatttgctaaattgcaaagatagcataattagcaatgccaacgtcaaggagttctgggacgggttcgaagaagtcagtaaaaggcagaaaaacaagtctggcgagaccgtggtcttaaaactgaaggactggccttccggggaggactttaagaccatgatgcccgcccggtatgaggacctgctaaaatctctgcccctgcctgagtactgtaatccagaaggtaagttcaatttggccagccacttgccaggcttcttcgtgcgtcccgatctcggaccccggctgtgcagtgcctatggcgtggtggcagccaaggaccatgatatcggcaccaccaatctgcacatcgaagtttccgatgtagttaatatcctggtttatgtgggtatcgctaaagggaacggcattctatctaaagccgggatcttaaaaaagtttgaggaagaagaccttgacgacattctgagaaaaaggctcaaggactcgagtgaaatccccggcgcgctgtggcatatatacgccgggaaagatgttgataagattagggaatttcttcaaaagatcagcaaagagcaaggcctcgaggtccttccagagcatgatcctatcagagatcagagttggtatgtgaacaaaaaactccggcagaggctcctggaggagtacggtgttcgaacctgcacgctgatacaatttctaggcgacgctatagtcctgcctgcaggggcattacaccaggtgcagaacttccacagctgcatccaggtcacggaggactttgtcagtccagagcatttggtcgaatcattccacctaacacaggagctgcgattattgaaagaggagatcaactacgatgataagcttcaagtaaaaaatattctttaccatgcggtcaaggagatggtgcgcgctctgaaaattcatgaagacgaagtggaggacatggaggaaaattag

SEQ ID NO: 12167 - DNA, 3741 bp, Artificial Sequence
  Description of Artificial Sequence: Synthetic coding sequence
atgtctaaggaaaggccaaagcgcaacatcatacagaaaaagtatgacgactccgatgggattccctggtccgaagagagggtcgtgaggaaggtcctgtatctgagcctcaaagagttcaaaaattcccagaaaaggcagcatgcagagggcatagcgggctccctgaaaaccgttaacgggttgctggggaatgatcaatcaaagggattgggtcctgcctccgagcaaagcgaaaacgagaaggacgacgcttcccaggtatccagcacctccaatgacgtgtcttcatcggactttgaggagggcccatcacgaaaaaggccgcgtctccaggcgcagcgaaagtttgcacagtcacagcccaactcacccagcacaacccccgtgaagattgtggaacccctgttgcctccccctgctactcagatctccgatctgtctaaacgaaaaccaaagactgaagattttttgaccttcttgtgcctgagaggatctcctgccctaccaaatagtatggtttattttggttcttcccaggacgaggaggaggtggaggaggaagacgacgagactgaggacgtcaagacagccaccaataacgcgtccagcagttgccagtccacgccgaggaaaggcaagacacataaacacgtgcataatggtcatgtcttcaacggtagcagccgatcaactagggagaaagagcccgtccagaaacataaatccaaggaggccacaccagccaaggaaaagcactcagatcaccgagccgattcccggcgcgaacaagcgagcgccaatcatccggccgcagcaccctctacaggaagcagcgctaaagggcttgcggcaacccatcatcacccaccgctgcaccgaagcgctcaagatctgagaaagcaggtgtctaaggttaacggcgtaacacggatgagttctctgggtgctggagtgactagcgccaagaagatgcgcgaggttcggcccagtccctccaaaaccgttaagtatactgctactgtaaccaagggtgccgtgacgtacaccaaggctaagagggagctggttaaggacaccaaacctaaccatcataagccgagcagtgctgttaatcacaccatctctggaaaaaccgagtcatctaacgccaagacccggaagcaggtgctgagtctgggtggagcatccaaatcaaccggtcccgctgtgaacggattgaaagtttccggcaggctgaatcccaagtcttgcactaaggaagtgggaggtcgacagcttcgcgaggggctccagctgcgagagggccttagaaactctaaacgtcggctggaggaggcccaccaagccgagaaaccacagagtccaccgaagaagatgaaaggcgcagctgggcctgctgagggccctgggaaaaaggctcccgctgaacgcggactgctaaatgggcacgttaagaaggaggtgcccgaacggtccttggaacgcaatcgtcctaaacgggccacagcaggcaagtctaccccgggtcggcaggcgcacgggaaggcagactccgcctcatgcgaaaatcgctccacctcacagccagagtccgtccataagccgcaggattccggaaaagcagagaaggggggaggaaaggccggatgggctgcaatggacgaaatcccggtcctgcggccgtctgcaaaagagttccacgatcccctgatttatatcgagtctgttcgagcccaggttgagaagttcggcatgtgccgagttattccacctccagattggcgtcccgaatgtaagcttaacgacgagatgcgctttgtaacccaaatccagcatattcacaaattgggtagacgatggggtcctaatgtccagaggctggcctgcataaagaagcacctaaaatcccaggggattaccatggacgaactgccactaattggcggctgcgagttggaccttgcctgctttttccgcctgataaatgaaatgggcgggatgcagcaggtgaccgacctgaagaaatggaacaaacttgccgatatgctccggattccacgtaccgcacaggatcgcctagcaaagttgcaggaggcctattgccagtacctgttgtcatacgattccttgtcacctgaggagcatcggcgacttgagaaagaggtacttatggagaaagagatactagagaagaggaaagggcctttggaaggccacaccgagaacgaccaccacaagtttcaccctctcccacgatttgagcctaagaacggacttatccacggcgttgcccctcgcaatgggtttcggagtaagcttaaagaggttggacaagcccaattaaagaccgggcgaagaagattgttcgcccaggaaaaggaggtggtgaaggaagaggaggaagacaagggggttcttaatgatttccacaaatgtatctacaaaggacgctcagtgtccctcacaaccttttatagaacagcaaggaatatcatgagtatgtgtttcagcaaggagcccgcaccggctgagatcgagcaggaatactggcgcctcgttgaggagaaggattgccacgtcgccgtgcattgcggcaaggtggacaccaacacccatggatctgggtttcccgtcggcaagagcgagccttttagcaggcacgggtggaatctaaccgtgcttcctaacaacactggctccatcctccgacatctcggcgccgtcccaggagtgactatcccctggttgaacatcggcatggtgttttcaactagctgctggagccgagatcagaaccacctcccttacattgactacttgcacaccggcgccgactgcatttggtactgcatcccagctgaagaggagaataagctggaggacgtcgtgcatactttattacaggccaatgggacgccaggactgcagatgctggagagtaacgtcatgatcagccccgaggttctgtgtaaggaagggatcaaagtccacaggaccgtgcagcaaagcggccagtttgtggtatgctttccaggttcgttcgttagcaaagtgtgctgcggatatagcgtaagcgaaaccgttcatttcgctacaacgcagtggacaagcatgggtttcgagacagcaaaagagatgaaacggcggcacatcgccaaaccattttctatggaaaaactgctgtaccagatcgctcaggctgaggcgaagaaagagaatgggcccacactctcaactatttctgctctgctcgacgaacttcgcgacacggagctgcggcaaagacggcagttgttcgaggccggactgcatagttcggcgaggtacgggtcacacgacggtagctccacagtagcagacggcaagaagaaaccacgcaagtggctccagctggagacttccgagcgaaggtgccaaatctgccagcacttgtgctacttgtccatggtggtccaagagaatgaaaacgtcgtgttttgcctagagtgcgcgctacgacatgtggagaagcaaaagtcatgtagagggctgaagctcatgtaccgctacgatgaggagcagatcatatctctggtcaaccagatttgtggtaaggtttccggcaaaaatggaagtatcgaaaactgcctgtccaaacctacaccaaaacggggtcctagaaagagagcgacagtagacgttccaccctctcggttaagcgcatccagctcatctaagtccgcgtctagctctagctag

SEQ ID NO: 12168 - DNA, 3225 bp, Artificial Sequence
  Description of Artificial Sequence: Synthetic coding sequence
atggtttactttggatccagccaggacgaggaagaagtggaagaggaagatgatgaaactgaagatgtaaaaaccgccaccaataacgcttcctcctcttgtcagtccactcctcggaaaggcaagactcacaagcatgtccataatggtcatgtgttcaacggtagcagtagatccacacgagagaaagaaccagtgcaaaagcacaaatcaaaagaggccacccctgcgaaggagaaacactccgatcatagagcagactcaaggagggagcaggcgagcgccaaccatccagctgctgccccatccacagggtccagtgcaaagggacttgccgccacccatcaccacccacccttgcataggtccgcacaagatctgcgcaagcaggtaagcaaggttaatggggtgacacggatgtccagtctaggcgcgggtgtcaccagcgctaaaaagatgcgcgaggtgagaccctcacctagtaagaccgtgaagtacacggctaccgtgaccaagggtgctgttacctataccaaggctaagcgggagctggtaaaagatactaagcccaatcatcacaagcctagctctgccgttaaccacacgatttccgggaagacagagagctccaacgccaagacgcgtaagcaggtgttgtctctgggtggtgccagcaagtcaaccggccctgccgtcaacgggctgaaggtgtccggccgcctgaaccctaagtcatgtaccaaagaagtgggcgggcgccagttaagggagggactgcaacttagggagggcctcaggaatagcaagcggagactggaggaagcacaccaggcagagaaaccgcagtctcccccgaaaaaaatgaaaggtgctgccggcccagccgaaggcccaggcaagaaggcccctgccgagcgcggactgttgaacggacatgttaagaaagaggtccctgaaaggtctctggagcggaatcggccaaaaagagcaactgcagggaagtcgacacccgggagacaagcccatgggaaggccgatagcgcatcctgcgagaatcggtctacctctcagcctgagtccgtgcataaaccccaggacagcggcaaagcagaaaagggcggaggaaaggccgggtgggcagccatggacgaaatccctgtgctccggccttccgccaaggagttccacgaccctcttatctatatcgagagcgtgagggcccaggtcgagaaattcgggatgtgccgggttatccccccgcctgactggcggccagagtgcaaactaaatgatgaaatgaggttcgttacacagattcagcacattcataaactgggtcgacgctgggggccaaacgtgcagcgccttgcctgtattaagaagcacctgaagagtcaaggaattacaatggatgagctgcccttgatcgggggttgtgagttggacctcgcctgcttcttccgcctcattaacgaaatggggggaatgcagcaagtgacggacctcaagaagtggaataaactcgctgatatgctgcgcatcccgagaaccgcgcaggatcgacttgccaagctgcaggaggcttactgtcagtatctattaagctacgattccctctcccccgaggaacataggagactcgagaaggaagtcctgatggaaaaggaaattctggaaaaacggaaagggcccctggaaggacacaccgagaacgatcatcacaaattccatccactgccacggttcgagccaaagaacggcctgattcacggtgttgctccaagaaacggcttccggagcaagttaaaggaggtgggacaggcccagctcaaaactggcaggcgtaggctttttgcccaggagaaggaggtggttaaagaagaagaagaagacaagggtgtcctcaacgacttccataagtgtatctataagggcagatccgtgtcattgactactttttaccgcacagcaagaaatatcatgagcatgtgtttctccaaggaacccgctcccgcggaaattgagcaagagtattggagattggtggaggaaaaggattgccatgtagctgtgcactgcgggaaagtcgacacaaatactcacggctctggattccctgtgggaaagagcgagccgtttagccgacacggttggaacctcactgttctgccaaacaacactggcagcatcctccgtcacttaggagctgtgccaggggtgaccataccctggctcaacatcggcatggtgttctctaccagctgttggtcccgtgatcagaatcatctgccttatattgattatttgcataccggagctgactgcatctggtattgtatccctgccgaggaagagaacaaactggaagacgtagtccacacattgctgcaggccaacggcacacccgggcttcagatgcttgaatcaaatgtgatgataagcccagaggtcctctgcaaagagggaataaaggtacaccgaactgtgcagcagtcaggccagttcgtcgtgtgctttccaggatcattcgtgtcaaaggtatgttgcgggtatagtgtctcagagaccgtccatttcgcaactacacagtggactagcatgggttttgaaacagcaaaagaaatgaagaggcgccatattgcaaaaccattttctatggagaagctgctgtatcaaattgcacaggcagaagctaaaaaagaaaatgggcctaccctgtcaaccatatctgctttgctggacgagctgcgtgataccgagcttcgccagagacgacagctgtttgaagccggactgcactcttcagctcgatacggttcacatgacggctcatctacagtggccgatgggaaaaagaagccacgtaagtggctccagctggaaacaagcgaacggcgctgccagatctgccaacatctgtgttacttgagcatggtggtgcaggagaacgaaaatgtggttttctgtctcgaatgcgctctacggcatgtcgagaaacagaagtcttgtcgtggtctcaaattgatgtacaggtacgacgaagagcaaatcatcagtctggtcaatcagatctgtggaaaggtgagcggcaagaacggctccatcgagaattgtctttcgaagcctacccctaagagaggccctagaaaacgggcgaccgttgacgtccccccttccagattgagtgcctccagctcttcgaagtccgcatcaagttccagttag

SEQ ID NO: 12169 - DNA, 1524 bp, Artificial Sequence
  Description of Artificial Sequence: Synthetic coding sequence
atgaaaagaactatgcaccctaagtgcccacctttggctacaatgctcgtgctgcagattttgaaaaagggaagaagaggaaagggttctcccgcccttcctaacagcatggtttacttcggctccagtcaggacgaggaggaagtggaagaggaagatgatgaaaccgaggatgttaagaccgccactaataatgcaagcagcagttgccagagcacacccaggaaggggaagacacataaacatgtgcacaacggacacgtgtttaatggtagcagcagaagcactagggagaaagagcctgtgcaaaagcacaaatctaaagaagccacacccgccaaagagaaacatagtgaccatagagctgactcccggcgcgagcaggcttcggcaaatcatcctgctgccgcccccagcaccggatcttctgccaagggactggcagcaactcatcatcacccccccttgcatcggagtgcccaagacctgaggaagcaggtgagcaaggttaatggggtcaccaggatgagctcgcttggtgcaggggtcaccagcgccaaaaagatgcgcgaggtcagaccatcacctagtaaaaccgtaaagtacactgctacagtgactaagggtgccgtcacgtacactaaggctaaacgggagctggtaaaggatactaaaccaaatcaccataagccttcatcagctgttaaccataccatatccggaaaaacagaatcttcaaatgcgaagaccaggaagcaagttctcagtcttggtggtgcgtctaagagtactggccccgcggtgaacggacttaaggtcagcggacggctcaacccgaagtcctgcactaaagaggtcggcggtaggcagttgcgggagggactgcagctgcgggaaggattaagaaactcaaagcgccgactagaagaggcccaccaggctgagaaacctcaaagtccccccaagaagatgaaaggtgccgctggacccgcagaggggcccggtaagaaagcccccgctgaacgtgggctgctcaacggccacgtgaagaaggaagtaccggaacgctctctcgaacggaatcgcccaaagagggctacagctgggaaatcaactccaggtaggcaagcgcacggcaaagcagattccgcaagttgtgagaatcgatccactagccaacctgaaagcgtgcacaagccacaggattctgggaaggctgagaagggcggggggaaagcaggatgggccgccatggatgaaattcctgtgctgcgcccgagcgccaaagaatttcatgatcctcttatatacattgaaagcgtccgcgctcaggtagagaagtttggcatgtgcagggtgataccgcctccggactggaggccagaatgcaagcttaacgacgagatgagatttgtgactcagatccaacacattcataagctggggcggcgatggggtcctaatgtccagcgtctagcttgcatcaagaagcatttgaaaagccttggcggctgtgggagctag

SEQ ID NO: 12170 - DNA, 2883 bp, Artificial Sequence
  Description of Artificial Sequence: Synthetic coding sequence
atggcagctcctagggtgtgtcaggtgcagttcctggtagcctacctggaagaacccggcatagagggcctactgggtaatgaccagagtaagggtctcggcccagcatctgagcagtcagagaacgagaaggacgacgcttcccaggtctcgtcaacctcaaatgacgtcagcagctccgactttgaggagggtccctccaggaagcgcccaagactccaggctcaacggaaattcgcccagagccaacccaatagtccctctacaactccagtgaagatcgtcgagccactgctgccccctcccgcaactcagatttctgatctcagtaaacggaagccaaagaccgaggatttcttgacattcctgtgtctgaggggttcccctgcccttcctaatagcatggtatatttcggatcctcccaggatgaagaggaggtcgaagaggaagatgatgagactgaggacgtgaaaactgccaccaataacgcaagctcctcatgtcagtccacgccccgaaaggggaagacccacaaacatgtacacaacggccacgtatttaacggatcaagtaggtccacgagagagaaggagcccgtgcagaagcacaagagcaaagaggccacacctgcgaaagagaaacacagcgaccaccgggccgactcacgcagagaacaagctagtgccaatcatcctgccgctgccccttcaacagggagctctgccaaaggtcttgccgccacccatcaccacccaccactgcaccggtccgctcaggacctgagaaagcaggtcagtaaagtgaacggggtcactcgcatgtcctccctgggcgccggagtgaccagtgcgaaaaagatgcgggaggttcggcccagtccaagcaagactgttaagtacactgcaacagtgactaaaggcgctgtgacatacaccaaggccaagcgggagcttgtcaaagacaccaagcccaatcatcataagccatcaagcgcggttaatcacaccatcagtggtaagactgagagcagcaacgccaagaccaggaagcaagttttgagcctcggaggcgcctcaaaatcaaccggtccagcagtgaatggcctgaaagtctctgggcgacttaatccaaagagctgcactaaggaggtgggtgggcgacagctgcgggaaggattgcagttgagggagggcctgcgaaacagcaagcggagactcgaagaggcccatcaggccgagaaacctcagtcgccgcccaaaaaaatgaagggcgccgcggggccagccgagggaccgggaaagaaggccccggcagaacgtggactgctcaacggccacgtcaaaaaagaagtccctgaacgctctttggagagaaatagacccaagcgagccactgcagggaaaagcactcccggccggcaggctcacggaaaggctgactcagcctcatgtgagaatcgcagtacaagccaacccgagagcgtgcacaaaccacaagacagtgggaaagccgagaagggaggcggaaaggccggatgggctgctatggatgaaattcctgtgctccggcccagcgctaaagagttccacgacccattgatctacattgagagtgtccgggcccaggtcgagaagtttggcatgtgcagggtgattccaccacctgattggcgccctgagtgtaagcttaatgacgaaatgaggttcgtaactcaaatccagcatatccacaaactggggcgccgatggggaccaaacgtgcagcggttggcctgtatcaaaaagcatctgaagtctcagggcattaccatggatgagctgcccttgattggaggctgcgagctcgacctcgcatgcttctttcggcttattaatgagatgggaggtatgcagcaggtgacagatctgaagaaatggaataagctggcagacatgctgagaattccacgaacagcccaagatagactcgccaagttacaggaggcttattgtcagtatcttctcagctatgatagtctctcccctgaagagcaccgtcgcctggagaaagaagttctcatggaaaaagagattttggaaaagaggaaaggccccctcgagggccatactgaaaatgatcaccacaaatttcacccgttaccacggttcgagccaaagaacggtttgatccatggcgtggcccccagaaacggattccgatcaaaattaaaggaagtgggccaggctcagcttaaaacggggcgcagacgcctgttcgcccaggaaaaagaagtggtgaaagaggaggaagaggataaaggtgttctcaacgattttcacaagtgcatctataaaggccggtctgtgtcgttgaccactttttatagaaccgcccgtaacattatgtctatgtgctttagtaaagaacccgcaccagccgaaattgaacaggagtattggcgactggtggaagagaaagactgccacgtcgccgtgcattgcggaaaggtggacactaacactcacgggagcggcttcccagtgggcaaatcagaacctttcagccgacacggatggaacctgaccgtactgcctaacaatacaggctcaatcctcagacacttgggcgccgtgcccggggtaacaattccctggcttaacatcggtatggtgttcagtactagttgttggtcacgcgatcagaatcatctgccttacattgattacctgcacacaggtgccgactgtatctgcctgtcagtcgagccagtgttcccccacctctcagtggccgtcggctccagggtggacctcggtatcagctttcttccctgtggggacaccagagtgatgtacccagtggagtctgtcgcgtggaggggagtgctgggccccagactctag

SEQ ID NO: 12171 - DNA, 525 bp, Artificial Sequence
  Description of Artificial Sequence: Synthetic coding sequence
atggtggccggttggcctgccacaccaccagcaatgatgccagggcagatcccggatccctctgttacgaccggcagtttgccgggtctgggtcctctgacaggcctgccttcttccgcccttactgtggaggaactgaaatatgcagatataagaaacctcggcgccatgatcgctcccttgcactttttagaggttaagctcgggaagcgacctcaaccggtcaagtctgaactcgatgaagaggaagagcgccggaagcgccgtagggaaaaaaacaaagttgcggctgcccggtgtcgcaataaaaagaaagaacgcaccgagttcttacagcgtgaaagcgagagactggagctgatgaacgcggaactcaagacacagatcgaagaactgaaacaggagcgtcagcagcttatcctgatgctaaataggcacaggccgacttgtatcgtgcgaactgattccgttaagacaccggagtccgaggggaatcctcttcttgaacagcttgagaagaagtag

SEQ ID NO: 12172 - DNA, 492 bp, Artificial Sequence
  Description of Artificial Sequence: Synthetic coding sequence
atgatgcccggccagatacccgaccccagcgttacgacaggctccctaccaggtttggggccactgacaggtctcccaagttctgcgctaactgtggaggaactcaaatacgccgacatacggaatctgggcgcaatgatcgcacccctgcactttctagaagtgaagctaggcaaaaggccgcaaccggtgaaatccgaactggacgaagaggaagagcggcgcaaacggagaagggagaaaaataaagtggctgccgcacgatgtagaaacaagaagaaagagcgcacagaattcctgcagagggagtccgaaagactggagctgatgaacgcagaattgaaaacccagatagaggaattgaaacaggaaagacagcagctgatcctcatgttaaaccgtcaccggccgacatgcatcgttcggaccgattcagttaaaacacccgaatcagagggcaaccctctgcttgagcaactggagaagaagtag

SEQ ID NO: 12173 - DNA, 492 bp, Artificial Sequence
  Description of Artificial Sequence: Synthetic coding sequence
atgatgcctggacagattccggaccctagcgttaccaccgggagtctgccagggctcgggccccttacggggctgccgtcttccgccctgacagtggaagaacttaagtacgccgacatccggaacctaggtgccatgattgctccattacattttctggaagtgaagcttggcaaacggccccagcccgtcaagtcggaactagatgaggaggaagagcggaggaaaagaaggcgggagaagaacaaggttgccgcggcccgttgtagaaataagaagaaagaacggacagagttcctccagagggagtccgagcggttagagctcatgaacgccgaactgaagacccaaatagaagagttaaagcaagaaaggcagcagctcatcctcatgttgaacagacaccgacccacctgtattgtgcgaactgactctgtgaaaacgcccgaatccgaagggaatccacttctcgaacagctagagaagaaatag

SEQ ID NO: 12174 - DNA, 492 bp, Artificial Sequence
  Description of Artificial Sequence: Synthetic coding sequence
atgatgccgggacagatcccagacccttctgtaaccactgggagcctccccgggctgggtccgctgacgggcctcccttcttcggccctgacggtggaggaactcaagtacgccgatattagaaatctgggtgcaatgattgccccactgcatttcttagaagtcaaactcggtaaacgcccccagccagtgaaatctgaattggacgaggaagaggagaggcgcaagcgacgacgcgagaagaacaaagttgcagccgcccggtgcaggaacaaaaagaaggagcgaacagagtttctgcagagggaatcagaacgactcgagctgatgaatgctgaactcaaaactcaaatcgaggagctgaaacaggaaaggcagcaactgattttgatgctcaataggcatcgccctacatgcattgtacgcacagactccgtgaaaactcccgagtctgaagggaaccctcttttagagcagctggaaaagaaatag

SEQ ID NO: 12175 - DNA, 405 bp, Artificial Sequence
  Description of Artificial Sequence: Synthetic coding sequence
atgatgcctggccagatacctgaccctagtgtgaccacaggttcactgcctggcctgggcccgttaacgggattaccctcctccgccttgacagtagaagagctgaagtacgcagacataagaaatctgggcgctatgatcgcgcccctgcacttccttgaagttaaattgggaaagagacctcagccagtaaagtcggagctcgatgaagaggaagagcgaaggaaacgccgaagagagaagaacaaagtagcggccgcccggtgtcgaaacaagaaaaaggagagaaccgaattcctgcagagggagtccgagaggctggaacttatgaacgcggagctcaaaactcagatagaggaactgaaacaggagagacaacagcttatcctgatgctgaaccgatag

SEQ ID NO: 12176 - DNA, 6015 bp, Artificial Sequence
  Description of Artificial Sequence: Synthetic coding sequence
atggtgaaattggcgaatccactgtacaccgaatggatccttgaagccatcaagaaggtgaagaagcagaagcagaggccctcagaggagcgtatttgtaacgccgtcagctcctctcacgggctagaccgcaaaacagtgctcgaacagcttgaactgtccgtcaaggacggcaccattcttaaggtcagcaataaggggttaaactcttataaagaccccgataatcccggccgaatcgccttgcctaagccaagaaaccacgggaagctggataacaaacaaaacgtggactggaataaattgatcaagcgcgcggtcgagggtctcgccgagtccggaggtagcactctcaagagtatagaacgctttttgaaaggtcagaaggacgtatctgctctgttcggcggttctgccgcaagtggattccaccagcaattacgcttagccatcaaacgtgctatcggccatggccgattgctgaaggatggccctctgtataggctgaacacaaaggctacgaatgttgatggtaaggagagctgtgagtcactaagctgtctaccccctgtatccttgctgccccacgaaaaggacaaaccagtcgctgagccaatcccaatctgcagcttttgcctcggcacaaaggaacagaatagagagaaaaaaccggaggaacttatcagttgtgcagattgcggcaacagtgggcatcccagctgtctcaaattttcccccgagctgactgttcgggtcaaggccctgcggtggcagtgcatcgaatgcaagacttgtagtagttgcagagaccaagggaaaaacgccgataatatgctgttctgcgattcatgcgatcgcggatttcacatggagtgctgcgaccccccactgactagaatgcccaagggtatgtggatctgtcaaatatgccggccacggaaaaagggccgaaagctgctccaaaagaaagcagctcagattaagcgccgctacacaaatcccatcggccggcctaagaacagactgaagaagcagaatacagtgtctaagggtccattttccaaagtgcgcacggggccgggtaggggacggaaacggaagattaccctttcctctcagtcagccagttcctcatccgaggagggttatctggagagaattgacggcctcgatttttgtcgggactccaacgtttccctgaaattcaataaaaaaaccaagggcttaattgatggactgacaaaattcttcacaccatctcccgatggtagaaaagcgagaggcgaagtagtggactattcagaacaatatcgcattagaaagcgcgggaaccgaaagagctctacttctgattggccgaccgacaatcaagacggctgggatggcaagcaggaaaacgaggaaagactctttgggagtcaggagatcatgaccgaaaaagacatggagctattccgcgacatacaagagcaggcgctgcagaaagttggagtgactgggccacctgatccacaagtaaggtgtccgtcagttattgagttcgggaaatatgagatccatacttggtattcctccccttacccccaagagtactctcgtctccccaagttatatttgtgtgagttctgcctaaagtacatgaaaagcagaacaatactgcagcagcacatgaagaaatgcggatggttccacccccccgctaatgagatttatagaaagaacaatatctctgtctttgaggttgacggaaacgtgtctaccatttattgccagaacctctgtttactcgctaaactgttcctggatcacaagacattatactacgatgtggaaccctttcttttttacgtgctcactcagaatgatgtgaagggctgtcacctggttggatacttctcaaaggaaaaacactgtcagcagaagtacaacgtgagctgtattatgattctaccgcaataccagaggaaagggtatgggcgcttcctcatcgacttcagctatctgctgtctaagcgggagggtcaggcaggaagccctgaaaagccactgtcagacctgggccggttgagctacatggcatactggaagtcagtgatcctcgagtgcctgtaccaccagaatgataaacagatcagcattaaaaaactgagcaagctgacgggaatctgtccccaggacattacatcgactcttcatcacctgaggatgctggatttccggagtgaccagttcgtcattatcaggcgcgaaaaattgatacaagaccatatggccaaactacagttgaacctgagacccgtcgacgttgatcccgaatgtcttaggtggacccccgtgattgtgtcgaactctgtggtatccgaagaggaagaggaagaggctgaagagggcgaaaatgaggagccacagtgccaggagcgcgaactggaaattagcgtcgggaagtccgtcagtcatgagaacaaggaacaggactcttactcggtggagagcgagaaaaaacctgaagttatggctccagtcagcagcacaagactgagcaagcaggtcttacctcatgactccctgcctgccaattcccagccgagtcgtagagggcgctgggggaggaaaaacaggaagacccaggagcgcttcggtgacaaagacagtaaacttctcctggaggaaacgtcttctgctccacaggagcagtacggtgaatgcggggagaagagcgaagctacacaagaacagtacaccgagtctgaggaacagctggtagcaagcgaggaacagccatctcaagacggcaaacctgatctgcctaagcggcggttgagtgaaggagttgaaccgtggagaggacaacttaaaaagagtcccgaggctctcaaatgccgtcttaccgagggcagtgagagacttccgcgcaggtattccgagggtgaccgagctgtgctgagaggcttttcagaaagctcggaggaggaagaagagccagagagtccccgatcgtcatcccctccgattcttactaagcctactctgaaacgaaaaaaaccctttctgcatcgacgtagaagagtacggaaacggaagcaccataatagctcggtggtcactgagaccatctcagaaacaacggaagtcttggacgagccgtttgaggactcagactccgaaaggcctatgccacgtctggagcctacctttgagatcgacgaggaagaagaagaggaggacgagaacgagctattccctagggagtacttccgaaggctcagctcacaggatgtgttaagatgtcagtcctcttccaagaggaagtccaaagatgaggaggaggatgaagaaagcgacgatgcggacgacacccctatcctaaagccagtaagcttgcttcgtaagagagacgtgaagaactccccattggaacctgacacctcaactccactgaaaaaaaagaaaggatggcctaagggaaagtccagaaaacccattcattggaaaaagcgcccaggacgaaagcccgggttcaaactctcacgcgagatcatgcctgtaagcacgcaggcttgcgtcattgaacccatcgtctcaatcccgaaagctggcaggaaacccaagattcaggaatcggaagagacagtcgagcctaaagaggacatgcccttgcccgaagagcgcaaggaagaggaggagatgcaggccgaagctgaagaagcagaggagggtgaggaggaggacgcggcaagttcagaggtccctgccgccagtcccgccgactcctccaatagccctgagaccgaaacaaaggagcccgaggtagaggaggaggaagagaaaccccgagttagcgaagaacaacggcagagcgaggaagaacagcaagagcttgaggaacccgagccagaggaggaggaagacgctgccgccgaaacagcacagaacgatgaccacgatgccgatgatgaggatgatgggcatctggagtcgacgaagaagaaggagctggaggaacagccaactcgcgaggatgttaaggaggagccaggtgtgcaagagtcctttctggatgcgaacatgcagaagtccagagaaaagattaaggacaaagaggagacagaactggatagcgaggaagaacaaccatcccacgatacctcggtcgtctctgagcagatggcagggagcgaagacgatcatgaagaagactcccatactaaggaggagttaatcgagttgaaggaggaagaagagatccctcactctgagttggatctagaaacagtacaggcagtgcaatcactgacacaggaagaatcttctgagcatgaaggggcttaccaagattgcgaggagaccttggccgcttgtcagactttgcagtcctacacacaggctgacgaagacccgcagatgagtatggtggaagactgtcacgcgtcggaacacaactcaccgatctccagcgtgcaaagccacccttctcagagcgtgcggagcgtttcttcgcctaatgtgccggccctggaatcagggtatacgcagatctctcctgagcaagggtcactgtccgcgcctagcatgcagaatatggagacctccccaatgatggatgtgccgtccgtgtcggaccacagccagcaggttgtcgactcggggttttcagacttgggctccattgagtccacgaccgagaactatgagaatcccagcagctatgactctaccatgggtggtagtatatgcggcaattcctcatcacagtcctcttgttcttatggcgggctgtcatccagctcttcactaacccagagttcatgcgtggtcacccagcagatggcaagcatggggtcctcctgttccatgatgcagcagtcatctgtacagcccgctgctaattgtagcatcaaatcgcctcagtcttgtgtcgttgaacggccaccctcgaaccagcagcagcagcctccaccccccccaccgcagcagccgcagccgcccccccctcagcctcaaccggccccccagccaccaccaccacagcagcaacctcagcagcagccacaaccccagccccagcagccccctccgcctccgccccctcaacagcagccaccgctctcacagtgctccatgaacaatagctttactccagcaccaatgataatggaaattccggagagtggctccaccggaaatatatcaatatacgaacggatccctggtgattttggagccggaagttacagccaacccagtgccacgttttcgcttgccaagctgcagcaacttactaacactatcatggatccccatgccatgccgtattcccattcacccgccgttacatcctacgccacttctgtcagtctcagcaacacagggctcgcccagctggctccctcccaccccctggcggggaccccccaggcccaggctactatgaccccgccaccaaatctggccagtacaaccatgaacctcacatcgcctctgctgcaatgcaatatgtctgcgaccaatatcggaatcccccacacgcagcgcttacaggggcagatgccagtgaagggtcacatatccatccgctctaagtcagcacctctgccaagcgccgctgcacaccagcagcagttatacggcagatctccctctgcagttgctatgcaggcaggacctcgggcattagccgtgcagaggggcatgaatatgggagtcaatctcatgcctacccctgcctataacgtcaattcaatgaatatgaatacactaaatgctatgaactcctacaggatgacccagccaatgatgaacagcagctatcattctaatcctgcctatatgaaccagactgcccagtaccccatgcagatgcaaatgggaatgatgggttcacaagcatatacgcagcagccaatgcagccaaaccctcatggaaacatgatgtatactggcccttctcaccacagctatatgaatgctgcaggcgtcccaaagcagagcttaaatggtccgtatatgcgcagatag

SEQ ID NO: 12177 - DNA, 6015 bp, Artificial Sequence
  Description of Artificial Sequence: Synthetic coding sequence
atggtaaagctggccaatcccttgtatactgagtggatcttggaggctatcaagaaagttaagaaacagaagcagcgacctagtgaagagcggatttgcaatgccgtttcaagcagtcacggtctcgatcggaaaacggttctcgagcagctcgaactctccgtcaaagacggcactattctgaaggtgagcaacaaggggctgaactcctataaagatccggataatccagggcgcattgcactgcccaagccacgtaatcacggcaaactggataacaagcagaacgttgactggaataagctgattaaacgggccgtggagggcctggccgagagtggcggttccacactgaagtctatcgaacgattcctaaaaggacagaaggatgtgagcgcccttttcggaggctctgctgcctccggtttccatcaacaactgagactcgccatcaaacgcgccattggtcatgggcgattactcaaggatggcccactctatcgcttaaacacaaaagccactaatgtggacgggaaggagagctgcgagtctttaagctgcctgcctccagtgtcactgttgccccatgagaaagacaaaccagttgccgaacccatcccaatatgttcattttgtctcggcacgaaagagcaaaatcgcgagaaaaaaccagaggaacttatctcctgtgctgactgcggcaattctggacacccatcatgtctgaaatttagccccgagctgaccgtacgcgtgaaagctttacggtggcagtgtatagagtgcaagacctgttcctcttgcagggatcagggcaaaaacgctgataatatgttattctgcgattcctgcgacagaggtttccacatggagtgttgcgatcccccgctgactcgcatgccaaaaggaatgtggatctgtcagatctgccggcccaggaaaaagggacgaaaactgctgcagaagaaggctgcccagattaaacggagatacactaatcctattggtaggcccaagaaccggctgaagaaacagaataccgtaagtaaggggcctttcagcaaagtgcggaccggaccaggcaggggccgcaagaggaaaatcaccctgagcagccagtcggcgagctcttcctcagaagaggggtacttagagaggattgacggactggatttctgtcgcgacagcaatgtatccctgaaatttaacaaaaagactaaaggccttattgatgggctgacaaaattctttacaccttccccagacggacggaaggcacggggtgaagtagttgactattctgagcagtatcgcataaggaaacgtggaaaccggaaatctagcacttcagattggcccacggacaatcaagacgggtgggacggcaagcaggaaaacgaagagaggctgtttggctcccaggagatcatgactgaaaaggatatggagctctttagagacattcaggagcaggccttgcagaaggtaggcgtgaccgggcctccagatccacaagtgcgatgtccttctgttatagagtttggcaagtacgaaattcacacttggtattcaagcccctacccccaggagtacagtagacttcctaagctgtacctctgcgaattttgcctgaagtatatgaaatccagaactattttacagcagcacatgaaaaaatgcggctggtttcatccccccgccaacgagatttaccgcaaaaataatatctccgtgttcgaagtggacggaaacgtgagcacaatttactgccaaaatctatgtctgctcgccaagttattcttagaccataagacactttattatgacgttgagccctttctgttttacgtgttaacacaaaacgacgtcaagggttgccatctggttggatatttttccaaggagaaacactgtcagcagaaatataatgtcagttgtattatgattttaccccaataccagaggaaggggtacggacggtttctcatcgatttcagttatctgctttcaaagagagagggacaggcgggcagcccggaaaagcccttaagcgatttaggcagacttagctatatggcttattggaagagcgtcattcttgaatgtctgtaccaccagaacgacaaacagatttccatcaaaaagttgtccaaacttacggggatctgtccacaggacattacatctacgctgcaccacctgagaatgttggacttccggtcagaccaattcgtaataattcgcagagagaagttaatccaggaccatatggctaaactacagctcaatttaagaccagtggacgtcgacccagaatgcctcagatggacaccagtgattgtctccaactctgttgtgtccgaggaggaggaagaggaggccgaggagggcgaaaacgaggagcctcagtgtcaggaaagggaattggagatatctgtgggcaaaagtgtttctcatgaaaataaagagcaagacagctattccgtggagagcgaaaagaaacctgaagttatggccccagtgtcatccactcgattatccaagcaggtactacctcatgattccctccccgccaactcccagccaagtaggcgcgggagatggggaagaaaaaatcggaaaacgcaggagaggtttggtgacaaggactccaagttactgttagaggagacttcctctgcgccgcaggagcagtacggagagtgtggggagaaatctgaggccacccaggaacagtacacagagagcgaagagcagctggtagctagtgaggaacaacccagtcaggatgggaaacctgacctccccaaaagacgcctgtcagagggtgtggagccttggcgcggtcagctgaagaagtctccagaagcactcaagtgccgcctcacagaaggctcagagaggcttccaagaagatactccgagggggatagagccgtgctgcgcggcttctccgagtcaagtgaagaggaggaggagccagagtcaccaaggtccagcagcccccccatcctcacaaaaccaacacttaaacggaagaagcccttcctgcaccgccgtcggcgcgtgcgcaaacgtaagcatcacaactcatccgtggtgacggaaaccatctccgagaccactgaggtcctggacgagccgtttgaggatagtgattccgagcggccaatgccacggctggagccgaccttcgaaatagatgaggaagaagaggaggaggacgagaacgaattattccctcgggagtacttccggcgtctctcatctcaggacgtgctgcgctgtcagagttcatccaaaaggaagtccaaggacgaagaggaagatgaggagagtgatgatgcggacgacactcctatccttaagcctgtgtccctgctaagaaaacgcgatgttaagaacagccctctggagccggatacctcaactcccctgaaaaagaagaagggctggcctaaaggtaagtcacgcaaacccattcactggaagaagagacccgggcgtaaacccggctttaagctgagcagagagatcatgcccgtcagtacccaggcttgcgtcatcgaacccattgtatccattcccaaagcggggagaaagccgaagattcaggaatctgaggagacagttgaaccaaaagaagacatgccccttcccgaagagcggaaggaagaggaggagatgcaggcagaggccgaagaagctgaggagggggaggaagaggatgctgctagtagcgaggtccccgcagcatctcctgcagatagctccaactcccctgaaactgaaacaaaagagcccgaggtggaggaagaagaggagaagccgcgcgttagcgaggaacagagacaatcagaagaagagcagcaggaacttgaagagcccgaaccagaggaggaagaggacgccgccgctgaaaccgcacaaaacgatgaccacgatgctgatgatgaggacgacgggcatcttgaaagcactaaaaagaaagagctagaggagcagcctacaagagaggacgtaaaggaggagcccggggtgcaggagtcgttccttgatgcaaatatgcagaaaagcagggagaagataaaggacaaagaagagacggaactcgacagcgaggaggagcagccaagccacgacacaagtgtggttagcgagcagatggcaggctcggaagatgaccacgaggaagacagccatactaaagaggagctcatagagctgaaggaggaagaggagattccacactccgagctggatctggagactgtccaggcagtgcaatctctgacccaggaggaatcttcggaacacgaaggggcttaccaggactgcgaggagactctggccgcttgccagacattacagagctatactcaagcagacgaagatccacaaatgtcgatggttgaagactgccatgccagcgagcataacagccctatatctagtgtccagagtcacccatcccagagtgtgcgatctgtgtcttcaccaaacgttcctgctctagaatccggatacacccagatctctccagagcagggttctctctccgcaccttctatgcagaacatggaaacatctcccatgatggatgtaccaagcgtgagcgatcattcacagcaggtcgtggatagtgggtttagtgatttgggatctattgagtctaccactgaaaattacgagaacccaagttcgtacgattcgacgatgggaggctccatttgtggcaacagctccagccagtcctcatgctcgtatgggggtctgtcatcttccagcagtctgacacagagtagctgcgtggtaacccagcagatggcaagcatggggagcagctgcagcatgatgcagcaatcctccgtgcagccggctgccaattgctcaataaaatccccacagtcatgcgtggtggaaagacccccatccaaccagcagcagcagcccccccccccccccccccaacaacctcaaccacctcccccccagccacagcccgcacctcagcccccacctcctcagcaacaaccccagcagcagccccaaccccaaccccagcaaccgccccctcccccaccgcctcaacagcagcccccgctgtctcaatgctccatgaataattctttcacacccgcaccaatgattatggagatccccgagagcggctccacaggaaatatctcaatttatgaaagaataccaggcgactttggcgctggcagttacagtcagcctagtgctactttctccctcgccaagctgcagcagcttaccaacaccattatggacccccatgccatgccctattctcatagccctgccgtcacctcttatgccaccagcgtgtccttgagtaataccggcttggcacagctggccccctcacacccacttgctggcacaccccaagcacaggccaccatgaccccccctcccaatctcgcgtcaacaaccatgaatctgacttcacccctcttgcagtgtaacatgagcgccacaaacatcggtatccctcacactcagcgactgcaaggtcagatgccggtgaaaggacacataagcattcggtctaagtcagctccattaccctctgctgccgctcatcagcagcaactgtatggccggtccccttccgcggtggccatgcaggccggaccgcgggccctggcagtgcagcggggaatgaatatgggtgtcaatctcatgccaaccccggcctataacgtcaactccatgaatatgaataccctgaatgctatgaatagctatagaatgactcagcctatgatgaactcctcctatcatagcaatccggcctacatgaatcagactgcccagtacccaatgcagatgcagatgggaatgatggggtcccaggcgtatacacagcagccgatgcagccaaacccgcacggtaatatgatgtatactggcccgtctcaccatagttacatgaatgctgccggcgtcccgaaacagagcctcaacgggccatacatgagacgctag

SEQ ID NO: 12178 - DNA, 6015 bp, Artificial Sequence
  Description of Artificial Sequence: Synthetic coding sequence
atggtgaaactggccaaccccctctatactgagtggatacttgaggcaataaaaaaggtgaagaagcagaagcagcgcccctccgaggagcgcatctgcaacgcagtgtcatcgagtcatggactcgaccggaagactgttctggagcagctggagctttccgtgaaagatgggactatattaaaggttagcaataagggattgaactcatataaggacccggacaaccctgggcgcatcgctctgccgaagccaaggaatcacggaaaactggataataagcaaaatgtagactggaacaagctgattaagcgagcagttgagggtttggccgaaagcggagggagcaccctcaagtccatcgagagatttttgaaaggtcagaaggacgtgtccgcactgttcggaggatccgccgcctcggggttccatcagcaattgaggctggcaattaagagagccatcggtcatggtcgcctgctgaaagatgggcctctgtatcggttaaacaccaaagctactaatgttgatggtaaggagagttgcgagtcactgtcttgtcttcctccagtctctctgctccctcacgaaaaagataagcctgtggctgagcccatccccatatgctcattctgccttggcaccaaggaacagaaccgcgaaaagaagccggaggaactgatctcctgtgctgattgtggaaactccggtcatccttcatgccttaagttctccccggaactgaccgtgcgggtgaaggccctaaggtggcagtgcatcgaatgtaagacgtgctcgtcttgccgggatcaggggaagaatgccgacaacatgcttttctgtgactcttgcgacagaggatttcacatggaatgttgtgaccccccactcacaaggatgcccaaggggatgtggatttgtcaaatttgccgaccgagaaagaagggacggaaactcctccagaaaaaagcagcccagatcaaacgcagatatacaaacccgatcggccggcccaaaaacagattaaagaaacaaaatacggtgtccaagggccccttcagtaaggtgcgcacagggccaggccggggccgcaaacgaaagataacattgagctcccagtccgccagcagcagctcagaagaaggatacctggagaggatcgatggactagatttttgtagagacagcaacgtctctttgaagtttaataaaaagaccaagggacttattgacggactgactaaattttttaccccttctcccgacggcagaaaggcgaggggggaagttgtggactattctgagcagtatcgcatccggaagagagggaacagaaagagctcaaccagcgactggccaaccgataaccaggacgggtgggatggaaaacaggaaaatgaggagagactatttgggtcgcaggagatcatgaccgagaaagacatggagctgtttagagatattcaagaacaggcactccaaaaggtgggcgtgacaggaccgcctgatcctcaggtgagatgcccgagcgtcattgagtttgggaaatacgagattcacacatggtacagtagcccctatccccaggagtactcccggctgcccaaactgtacctatgtgagttctgcctgaagtatatgaagtcgcgcactattttgcagcagcacatgaagaagtgtggatggtttcatcccccagcaaatgaaatctacaggaagaacaatatttccgttttcgaagtggacgggaatgtgtcgactatctactgtcagaacctgtgtctactggccaagctgttcctcgaccacaaaaccctgtattacgacgtggagccgttcttgttctatgtgcttactcagaacgatgttaaaggctgtcacttggtgggatatttctcaaaggagaagcattgtcagcagaaatacaacgtgtcctgcatcatgatccttccccagtaccagcgaaaagggtacggccgatttctgattgacttttcgtatctgctatcgaagcgtgaggggcaggcaggcagtcctgagaaacctctctctgatctgggacgactttcttacatggcctactggaaatccgtcatcctggagtgcctctatcaccaaaacgataagcagatctctattaaaaagctctctaagctcactggcatatgtccacaggacatcacgagcacgctgcaccacctgcgaatgctcgacttccggtccgaccagttcgtgatcataaggcgggaaaaactgatccaggaccacatggccaagttgcagctgaatctgagacccgtggatgttgatccggagtgcctccggtggactcccgttatcgtgtccaatagtgttgtgagcgaagaagaagaggaggaagctgaagaaggagagaacgaggaaccacaatgtcaggagagggaactggaaataagtgtggggaaaagtgtatctcacgagaacaaggaacaagattcctattccgtagagtccgagaaaaaaccagaagttatggcccccgtaagctccacccgactatccaaacaggtcctgccacatgactcactcccagccaattcccagccaagccggagaggtaggtggggaagaaaaaacagaaaaacccaagagaggtttggtgataaggactctaaactcctcttggaagagactagctccgcacctcaggaacagtatggcgaatgtggagagaagtccgaggccacccaggagcagtacaccgagtcagaagagcaactggtagcctctgaagaacagccctcccaggacggaaaacccgatcttccgaagcgcagattgtctgaaggagttgagccctggcgcggacagctcaagaagtccccagaagccctcaaatgccgcctgactgaaggttcagagaggctcccccggaggtacagcgaaggcgatcgggccgtgcttagaggtttttctgagagctctgaggaggaggaagaaccggagtctccccgttcgtcttctccaccgatactcacaaaacccacactgaaaaggaagaaaccatttctgcatcgacggagaagagtgcgaaaacgcaaacaccacaattcgtccgtagtgacagaaacaatcagtgaaactaccgaggtactggatgagccctttgaggacagcgacagcgagagaccgatgcctcggctggagcctacttttgagattgatgaagaggaggaagaagaggacgaaaacgagctctttccccgcgagtatttcagacgtctgagttcacaggacgttctcagatgtcagtcttcaagcaagcggaagtctaaagacgaagaggaagacgaggagagtgatgacgccgacgacacgccaattctcaaaccagtcagtttattgcgaaagagagatgtcaagaattcaccactcgagccggacaccagtacccccctcaaaaagaaaaaaggatggccgaagggcaagagccgtaagccaatacactggaagaaaagaccaggaagaaagcctggcttcaaactaagccgggagatcatgccagtcagtactcaggcctgcgtaattgaacctatagtttcaatccccaaagcgggaagaaagccgaagatacaagagagtgaggagaccgtcgaaccaaaggaagatatgccactcccagaggaacggaaggaggaggaagaaatgcaagccgaggcagaagaggctgaagagggtgaggaggaggacgccgccagctcagaagttccagcggcaagcccagccgattcgtcgaattctccagagaccgaaacaaaggagcccgaggtggaggaagaggaagaaaaaccacgcgtgagcgaagagcaacgacagagtgaggaggaacagcaggagctcgaggagcctgagcctgaagaggaagaggatgctgccgccgaaaccgctcagaacgatgaccacgacgccgacgatgaagatgatgggcatctggagagcacgaaaaaaaaggagttagaggaacaaccgaccagagaagatgtaaaagaggagcccggcgtgcaggaaagtttcctcgacgctaatatgcagaagagccgcgaaaaaatcaaggataaggaggagactgaattagactccgaagaggagcagccatcccacgacacctccgtggtgtccgagcagatggcaggctctgaagacgaccacgaggaagactctcatactaaggaagaattgatcgaactgaaggaggaagaggagattccccacagcgagctcgacttagaaacagtccaagccgtgcagagtctgacgcaggaagaaagttccgagcacgaaggtgcataccaggactgcgaagaaaccctcgccgcctgccagactcttcaatcttatacacaggcagatgaggatccacagatgtcaatggtcgaagattgccatgcctctgagcataacagtccaatcagtagtgtacagagccatccttcacagagcgttagatccgtaagcagtcccaatgttcctgccctggagtccggttatacccagatttccccagaacagggctcgctgtctgcgccgagtatgcagaatatggagactagccctatgatggatgtcccgtctgtctccgaccattcccagcaagttgtggactccggtttttctgatctgggttcaatcgagagtactaccgagaactatgagaatcctagttcatatgattcgacaatgggcggatcgatctgtggtaacagtagctcgcaatcttcttgctcctacggcgggttgtctagctcttcgtccttgacgcagagctcatgtgtggttacacagcagatggcatcaatgggatcatcttgtagcatgatgcaacagtccagcgtacagcctgcggctaactgtagtatcaagagtccgcagagttgtgtagtggagagaccaccctcaaatcagcagcagcagccgccacctccccccccacaacaaccccagcccccacctccacagccccagccagctccccaacctccccctccccagcaacagccccagcaacagccccaaccgcagcctcagcagccccccccaccacctcctccccagcagcagccgcctctctctcagtgtagtatgaacaactcctttactccagctcccatgataatggagattcccgaaagcgggtccaccggcaacatttccatttatgaacgtattccaggagacttcggtgctggctcatattctcagccatctgccacattttccctagcaaagctgcaacagcttaccaatacaatcatggatccacacgcgatgccctattcccatagtcctgctgtgacatcctatgccacttcagtttcgctttcaaataccggccttgctcagctagctccgagtcaccccctcgccgggactcctcaggcacaggctacaatgaccccaccaccaaatctggccagtactaccatgaacctgacttcccctctgctccagtgtaacatgagcgcgactaacatcggcattccgcatacacagcgtctgcagggccaaatgccggtcaaagggcatattagtatcagaagcaagtctgcaccgctgccttctgctgcagcccaccagcagcaactgtacggtcgatcgcctagcgctgtagctatgcaggccggaccacgagccctggcagtccagcggggcatgaacatgggagttaacttgatgcctacacccgcttataatgtaaactctatgaacatgaacactctcaatgctatgaactcttaccgcatgacccagcctatgatgaactcctcctatcactccaatcccgcgtacatgaaccagactgctcaataccccatgcagatgcagatggggatgatgggaagtcaggcttacacccagcagcccatgcagcccaatccgcacggcaatatgatgtataccggccctagccaccactcctatatgaacgctgccggcgtgccaaagcagagtctgaatggtccctatatgcggcgctag

SEQ ID NO: 12179 - DNA, 42 bp, Artificial Sequence
  Description of Artificial Sequence: Synthetic coding sequence
atggtgaaactcgctaaccccctctacacggagtggatctag

SEQ ID NO: 12180 - DNA, 2448 bp, Artificial Sequence
  Description of Artificial Sequence: Synthetic coding sequence
atggttaaattggccaaccctctgtatacagagtggattctggaggccatcaagaaagtgaagaaacaaaagcagagaccttccgaagaaagaatttgtaacgcagtgagctccagtcacggcctggaccggaagacagtcttagaacagctcgagctgtctgttaaggatggtacgatactgaaggtttcaaacaaagggctgaattcgtataaagaccctgataacccggggaggatagcactccccaaaccccgcaatcatggaaaactcgataataaacagaacgttgattggaataagcttatcaagagggctgtggaagggcttgctgagtctggtggctccactttgaagtctatcgaaagatttctgaaaggccaaaaggacgtgtctgctctgttcggtggatctgccgcttctggatttcaccaacagctcagactggccattaagagggccataggacatgggcggttgctcaaagacggccccctctacaggctgaatactaaggcgaccaatgtggacggaaaagagagctgtgaatccttgtcttgtcttccaccagtgagtctgctccctcatgagaaggataaaccggtggccgagcccattccgatttgctcattctgtcttggaacgaaagagcagaatcgagagaaaaagccagaggagctgatcagttgcgccgactgcggtaatagcggccatccctcttgtctgaagttctcccccgagctcacagtgagagttaaggcccttcgctggcagtgtattgaatgtaaaacctgttcatcgtgcagggatcaggggaagaacgcagacaacatgctcttttgcgacagttgtgatcggggcttccacatggaatgttgtgatccgccactcaccagaatgcccaaggggatgtggatctgtcagatttgcaggccacgcaaaaaagggaggaaactcttgcaaaagaaagccgctcaaatcaagcggcggtacaccaatcctattggaaggcctaagaaccggttaaaaaaacaaaacaccgtctcaaaaggccctttttcgaaggtccggactggccctggccgcggacggaaaaggaaaattactttgtcatcccagtccgcctcctctagttccgaggagggatatctggaacggatagacggtctcgacttctgccgtgattctaacgtgagcctaaaatttaacaagaaaactaaaggcctcatcgatggcctgacgaagttcttcactccttcaccagatggacgcaaggctagaggcgaggtggttgactattccgagcagtacaggatcagaaagagggggaaccggaaatcctccacttccgactggccaactgacaatcaggacggatgggacgggaaacaggaaaatgaggagagactgttcggctcccaggagattatgacagagaaggacatggaactctttagagatattcaggagcaagccctgcaaaaagtgggcgtgaccggcccaccagatccacaggtgaggtgccccagtgttattgaattcggtaagtatgaaatccacacttggtactcctcaccctatccacaggagtattcccgcctgcctaagctgtacttgtgcgaattctgccttaagtatatgaagtccaggactatcttgcagcagcatatgaaaaaatgcggttggtttcatccacctgcaaatgagatttaccggaaaaataatatctcagtgtttgaagtggacggtaacgtctccaccatctattgccagaatttatgtctgttagccaaactgtttcttgatcataaaacgttgtactacgatgtggagcccttcctgttttacgttcttacccagaacgacgtcaaggggtgtcatctagtaggatactttagcaaggagaagcactgtcagcagaagtacaatgtaagttgcatcatgatcctcccccagtatcagagaaaggggtacggccgcttcctgatagatttttcttacctcctgagcaagcgggagggccaggccggttcccctgagaagccgctgagtgacctcggcagactctcctacatggcctactggaaatcagtgattcttgagtgcttgtatcaccagaacgataagcagatctccattaaaaagttatccaagctaacaggtatatgcccacaagacatcaccagcaccctccatcacctgagaatgctggattttcgcagcgatcagtttgtgattatccgacgtgagaaactgatccaggaccatatggcaaaacttcaactgaatctgagaccggtggacgttgaccccgaatgcctccgctggacaccagtgattgtttctaactctgtggtgagtgaagaggaagaagaggaagctgaggaaggagagaacgaagagccccaatgccaagagcgggaactcgaaatcagtgtacgcgcatag

SEQ ID NO: 12181 - DNA, 1836 bp, Artificial Sequence
  Description of Artificial Sequence: Synthetic coding sequence
atgccgcggagaaaacgcaacgctggttcatctagcgacggcacagaagactccgatttttccaccgacctcgaacacaccgactctagtgagagcgacggaacatctcgacgctccgccagagtgaccaggagtagcgcgcgcctgtcccagtcttcccaagactcgtcccctgtgagaaaccttcagagttttggaacagaggaacccgcctatagcacaagaagagtgactcgctcacagcagcagcccacccccgtgaccccaaagaagtaccccctgcggcagacccgatcctccggctctgagacagaacaggttgtcgatttctccgatcgcgaaaccaaaaacaccgcagaccatgacgagtctcctcccagaacgccaacaggcaatgcacctagctccgaaagtgatattgatatcagtagcccaaatgtctctcacgatgagtccatcgccaaggatatgtcactgaaagattctggaagtgatctgtcccaccgccccaagcgaaggcgatttcacgagagttacaactttaatatgaagtgccctacgccaggatgtaattcccttggccatctcactgggaaacatgagcgccacttctctattagcggctgccctctctaccataatctgtcggccgatgagtgcaaggtgcgtgcccaaagtagagacaagcagatcgaggagcgtatgttatctcacaggcaagatgataacaacaggcacgctaccagacatcaggcccccactgagcgccagctgcggtataaggaaaaagttgccgagctcagaaagaagcggaatagtggactctccaaggagcagaaggagaagtacatggagcatcgtcagacgtacggaaataccagggaacccctgctagagaacttgacaagcgagtacgatctggacctttttcgccgcgcacaagcgcgggcatccgaagacttggaaaaattacggctccagggacagattactgagggctcaaacatgattaagacaatagctttcggccgctacgaactcgacacctggtatcactccccgtatccagaggagtacgcccgactaggacggctttatatgtgtgaattttgtcttaaatacatgaagtcccagacaatcctgcggcggcacatggcaaagtgtgtttggaagcatccccccggagacgaaatttatcgaaagggaagcattagtgtcttcgaagtggacgggaagaagaataaaatctattgtcaaaatctgtgcctgttggccaagctgtttctggaccataagactctgtattacgatgtggaaccttttcttttttacgtgatgacagaagcagacaacactggctgccatctgatcggctacttcagtaaggaaaagaactcattcctgaattataatgtttcatgcattttgactatgccccagtacatgcgccagggttatggcaagatgttgatagacttttcttacctgctgtcaaaggtggaagaaaaagtgggaagccctgaacgacctttgagtgacctgggcctcatatcctatcggagctactggaaggaagtcctcctgcggtacttacacaatttccaaggtaaagaaatcagcattaaagagattagtcaggagaccgcagtgaaccctgtggacatcgtctccaccctgcaagccctgcaaatgctcaagtattggaagggtaaacacctggtgctgaagagacaggacctgatcgatgaatggatcgctaaggaagccaagaggagcaactctaataaaaccatggatccttcatgtctgaaatggactcctccaaaaggaacgtag

SEQ ID NO: 12182 - DNA, 1746 bp, Artificial Sequence
  Description of Artificial Sequence: Synthetic coding sequence
atgccccgcaggaaaaggaacgcgggaagcagctccgacggcacggaggactctgattttagcaccgacctcgagcatacagacagcagcgaatcagacgggacaagcaggcggtccgcccgcgttactagatcctcggcgcgccttagtcagtccagtcaagattcaagtcctgtccggaacttacagtctttcggtacagaggagcccgcatactccacaagacgggtgactcggtcgcaacagcagcccacacccgttacgcctaagaagtaccctctgagacagaccagatcaagcggcagcgagacagagcaggttgtcgacttctctgatcgggaaacaaagaataccgcggatcatgacgaatcgccaccccgcactccaactggaaatgctccaagtagtgaatcagacattgacatcagttcacccaacgtttcccacgatgagagtatagcgaaggacatgagcctgaaggactctggctctgatctgtcgcatcgacccaagcgtcgcagattccatgagtcatacaactttaacatgaagtgccccacacctggttgcaattccctggggcatctgactgggaaacatgaacggcacttctctattagcggctgtcccctttaccacaacctctctgcggacgagtgcaaggctcctacagaacgccagctcaggtataaagaaaaggtcgccgaactgcggaaaaagagaaatagcggtctctcgaaagagcagaaggagaaatatatggaacacaggcagacatatggaaacactagagagcccttgctggagaatttaacctctgaatacgatttggatctcttccggcgggctcaggcacgggcctctgaggatttggaaaagctcagattgcagggacagatcaccgaaggctcaaacatgattaaaacaattgcgtttggtcggtatgagcttgacacttggtaccacagtccttatcccgaggagtacgctagactcggacggttatacatgtgcgagttttgtcttaagtacatgaagtcgcagacaatcttgaggaggcacatggccaaatgtgtgtggaagcatccacctggggatgaaatctaccgaaagggaagtattagcgtgttcgaggtggatggaaagaagaataaaatttattgccagaatttgtgccttctcgcaaaactgtttctggatcataaaaccttatattacgatgtggagcctttcttgttttacgtcatgaccgaggctgacaatactgggtgtcatctgatcggctacttctcaaaagaaaaaaatagcttcttaaattataatgtctcatgcatactgaccatgccccagtacatgcgccaggggtatggcaaaatgctgattgatttcagctatctgctatcaaaagtagaggaaaaggtgggttcccctgagaggccactgagcgacctgggtctgataagctacagatcctattggaaggaggtgttactgaggtacctccacaactttcagggcaaagagattagtatcaaagaaatctctcaggaaaccgcggtgaacccagtggacatcgtctctactctgcaagcactgcaaatgctgaagtattggaaagggaaacacctggtgctcaagcgacaagacttaattgatgaatggatcgcaaaagaggcgaagcgttccaatagtaataaaactatggatccttcttgccttaagtggaccccccccaaagggacttag

SEQ ID NO: 12183 - DNA, 1278 bp, Artificial Sequence
  Description of Artificial Sequence: Synthetic coding sequence
atgtccctcaaagactccggcagcgacctgagccatcgcccaaaacgtagacgctttcacgaatcctataacttcaacatgaaatgcccaaccccaggctgtaattccctcggtcacctcactggcaaacatgaacgccacttcagcataagtggatgccctctgtatcacaacctctcagcggatgagtgcaaagccccgaccgagcggcagcttaggtacaaggagaaggttgctgagctccggaagaagcgcaattcaggcttgtccaaagagcagaaagaaaagtatatggaacacagacagacatacggcaatacaagggagcccctgctagaaaacctcactagcgaatacgacttagatttgtttagaagggctcaggctcgtgccagtgaagacctggagaaattgcgactgcaaggacagataaccgaaggcagtaatatgatcaaaacgatagcctttggccgctacgagctcgatacgtggtaccattcaccctatcctgaggagtatgcaaggctaggaaggctttatatgtgcgaattttgtctcaaatacatgaagtctcaaacgatcttaagaaggcacatggcgaaatgcgtttggaagcacccccccggcgatgagatctataggaagggttcgatcagtgtgttcgaggtggacggaaagaagaacaagatctattgccaaaacttgtgcttgctggcgaaactcttcctggatcacaagaccctttattacgatgtggagccattcctcttctacgtcatgaccgaggcggacaataccggttgccatctgatcggctatttttctaaggagaaaaattcgttcctaaattacaacgtgtcgtgcatcctcaccatgccgcaatatatgagacaggggtatggaaaaatgctgatcgattttagttacctgctgtcgaaggtcgaggagaaggtgggctctccagaacgtcctctctccgacctgggccttatctcctacagatcctattggaaagaggtccttctgcgatacttgcataacttccaggggaaggaaataagcattaaagagatctctcaagaaaccgcggtgaaccccgttgacatagtgagtacactgcaggctctccagatgttgaaatattggaaaggaaaacatttggtcctgaaacggcaagatctgattgatgagtggattgcaaaagaggcaaaacgatctaacagcaataagactatggacccctcctgtcttaagtggacgccacccaaagggacttag

SEQ ID NO: 12184 - DNA, 1419 bp, Artificial Sequence
  Description of Artificial Sequence: Synthetic coding sequence
atgccccgcagaaagcgtaacgcggggagctcctcagatggaacagaggattccgatttcagtaccgatctggagcacactgacagctctgagagcgacgggacttcacggcgatccgctcgcgtcacacgaagcagcgccaggctgagccagtcttcccaggggcacctgacaggcaagcatgagcgccatttttcaattagcggttgcccgctgtaccataacctgtctgccgacgaatgtaaggttcgggcccagtcccgggacaagcagattgaggagagaatgctctctcacaggcaagatgataacaatagacacgctaccagacaccaggcccccacagaaaggcagctgaggtataaagaaaaagtggccgaattgagaaagaagaggaacagtggcctctcaaaagagcagaaggaaaagtatatggaacaccggcagacatatgggaacacaagagaacctctacttgagaacctgaccagcgaatacgacctggatctgttcaggcgtgcccaggcccgcgctagcgaggacctcgagaagttaagactccagggccaaatcactgagggctccaatatgataaagaccatcgcattcgggcgctacgaactggatacgtggtaccactccccatacccagaagaatatgcccgacttggtagactctacatgtgtgaattctgcctcaagtacatgaagtctcaaaccatactcagacgtcatatggccaaatgcgtctggaagcatccccccggagatgaaatctatcgcaagggctccatctctgtttttgaggtcgacgggaaaaagaataagatctattgtcagaacctctgcctattagccaaactttttcttgatcacaagacgctctactatgacgtagaaccctttctcttctatgtgatgaccgaggcggacaacactggctgccatctcatcggatatttcagtaaagaaaagaattcctttttgaactacaacgtgagttgcatcctcacaatgccgcagtacatgcgccagggatacggaaagatgctgattgatttctcatatctgctgtctaaggttgaagagaaagtcgggtcaccagaacggcctttatcagacctagggctgatcagttataggtcctattggaaggaggtattgcttcggtatctccacaactttcagggaaaagaaattagtattaaagaaatctcccaggaaactgctgttaatccagtggacatagtatctaccctgcaggcacttcagatgctgaagtactggaagggaaagcacctggttctaaagagacaggatctgatagatgagtggatcgccaaagaagcgaaaaggtccaactccaataagacaatggatccctcctgtctgaagtggacgccacccaaggggacctag

SEQ ID NO: 12185 - DNA, 1368 bp, Artificial Sequence
  Description of Artificial Sequence: Synthetic coding sequence
atgtcactcaaggatagtggctccgatctgagtcacagacctaagcgcaggcggttccatgagagctataattttaatatgaaatgccccacacccggctgcaattccctgggccatctgaccggcaaacatgagaggcatttttcgataagcggttgcccgctgtatcacaatctgagtgctgacgaatgcaaggtacgggcgcagtctagggacaaacaaatcgaggagcgtatgctgtctcatcggcaggatgacaacaatagacacgccacccggcaccaggccccaacggagcggcagttgaggtacaaggaaaaggtagccgagttgcgaaaaaaacgcaacagcggactcagcaaggagcagaaggagaaatatatggagcatcgacagacatacggaaatacgcgcgagcctttgcttgaaaacttgaccagcgagtatgaccttgacctctttcggagagcacaagctcgggccagtgaggatctggagaaactccggctccagggacagataacggaaggctcaaatatgatcaaaacaatcgcgtttggtaggtacgagctcgatacctggtatcactcaccttatcctgaggagtatgctcgtctcggaaggctttacatgtgcgaattctgtctgaaatatatgaaaagccaaacaatcctgcgccggcacatggccaaatgtgtatggaagcatcctccgggcgacgagatctataggaaagggtccatctctgtgtttgaagtggatggcaagaaaaataagatttactgccaaaatctgtgcctgttagccaaactcttcctggaccacaaaaccttgtactatgatgtcgaaccgttcctcttctacgtaatgacagaagcagataatacaggctgtcacctcattggctattttagtaaggagaagaattctttcttaaactacaatgtgagctgtattttaacaatgccacagtacatgcgccaaggatacggaaagatgcttattgacttttcttacctgctcagtaaggtggaagagaaggtgggctctcccgaacgcccgcttagcgatttgggacttatcagttacagatcctattggaaagaggtgctgctgcggtacctccacaacttccagggaaaggaaatctctattaaggaaatcagccaagagactgccgtcaatcccgtcgatattgtctctactctgcaagcgttacagatgcttaaatactggaagggtaagcacttggtcctgaaaaggcaagacctcatcgatgagtggattgctaaagaagcgaaaaggagcaatagcaataaaaccatggatccctcctgcttgaagtggacgcctcctaagggtacatag

SEQ ID NO: 12186 - DNA, 1506 bp, Artificial Sequence
  Description of Artificial Sequence: Synthetic coding sequence
atgcctagacggaaaaggaatgccgggagctcctccgatggcactgaagattctgatttctcaacagatctcgaacacaccgattcttcagagtcggatggtacatctcggcgcagcgcacgcgtgacaagatcctctgctcgactttcacagagttctcaggactcttccccggtgaggaacctgcagtcttttgggacagaggagcctgcatacagcactcgccgtgtgactcggtcgcagcagcaaccgacgccagtgaccccgaagaaataccctttgcgacagaccaggtcatcaggttccgagacagagcaagtggtagacttcagcgatcgggggcacctgactggcaagcatgaaagacacttctccatctcagggtgcccgctttatcacaacctatctgctgacgaatgcaaggcaccaactgagaggcagctgcgctataaggaaaaagttgctgagctgaggaaaaaaagaaatagtggactatctaaggagcagaaggaaaaatacatggaacacaggcagacttatggaaacacgagagaacccctgcttgaaaatctgaccagtgagtatgacttagatctattccgtcgtgcccaggcccgagcatccgaggatttggagaagcttaggctccagggtcaaattactgaaggcagcaacatgatcaaaacaattgcctttggacggtatgaactggacacatggtatcacagcccttaccccgaagagtatgcccgactcggtaggctgtacatgtgtgaattctgcttgaagtatatgaagtcgcaaaccattctgagaagacacatggctaagtgcgtgtggaagcaccctccgggtgatgagatatatcggaagggctcaatttctgtattcgaagtggatggtaagaagaataagatatactgtcagaacttatgtctactggctaagctgttccttgaccataaaaccctgtactatgatgtggaacctttcctgttctatgtgatgaccgaggcagataatacagggtgccatttgattggttactttagtaaggaaaagaattccttccttaactacaacgtatcatgcattctgaccatgccccagtacatgcgacaggggtacggaaagatgctgatagacttctcatatttactttcaaaggtggaggagaaggtcggatcaccggagagacccttgagcgacttggggctgattagttaccggagttattggaaggaggtcctgctacgctacctccataacttccagggcaaggagatcagtatcaaggagatctcccaagaaacagcagtcaatccagtggacatagtgtctaccctccaggctcttcagatgctgaagtattggaaaggcaagcatctagtgttaaagagacaggatctgatcgacgaatggatcgcaaaggaggccaagaggagtaacagcaataagactatggatccttcttgccttaagtggaccccacctaagggaacctag

SEQ ID NO: 12187 - DNA, 1329 bp, Artificial Sequence
  Description of Artificial Sequence: Synthetic coding sequence
atgccccgcagaaaacggaatgctggttcttcttccgacgggacggaggactccgacttctcaaccgatctggagcacactgactcttcagagtctgacggaacttcaagacggtccgctcgggttactcggtcctcagccaggctcagtcaaagtagtcaaggccatctgacgggaaagcacgagaggcatttcagcatctcgggatgccccctatatcataatctctcggccgacgagtgcaaggcacccactgagaggcagctgcgctacaaagagaaagtggccgagttgagaaaaaaacggaactccggcctgtcaaaggagcagaaggaaaaatatatggagcacagacagacctacggcaataccagagaacctctgttagaaaatcttacctccgagtacgacttggacctcttccggcgtgcgcaggctcgagcttctgaagacctggagaagctacgtcttcaggggcagataactgaaggcagcaacatgattaagacaatagcgtttggccgctatgaactcgatacttggtatcatagcccctatcctgaagagtatgcccgtctaggcaggctgtacatgtgcgagttctgtctgaagtacatgaaatcccagaccattttgcggcgccacatggccaaatgtgtctggaagcatcctcccggagacgagatttatcggaagggatccatttctgtctttgaggtggatgggaagaaaaacaagatttattgccaaaatctctgcttgctagccaagctcttccttgaccataagaccctctattacgatgttgaacccttcttattttacgtgatgaccgaggctgacaataccggatgccacctcatagggtatttttcaaaagagaagaactccttcctgaactataacgttagctgtattttgacaatgcctcagtatatgaggcaaggttacggaaaaatgttgatcgatttttcctatctgctcagcaaagtcgaggagaaagttggcagcccagagaggcctctgtcagacctcggcctgatttcatatcgatcctattggaaagaggtcctactccggtatctacataacttccaaggtaaggagatctctatcaaggagattagccaagagacagccgtcaatcccgtggacatcgttagcactttgcaagcattgcagatgctgaagtactggaaaggtaagcatctggtgttaaagcggcaggatctgatagacgaatggatcgccaaggaggctaagcggtctaactcaaacaagacgatggaccccagctgtctcaagtggacccccccaaaagggacttag

SEQ ID NO: 12188 - DNA, 1239 bp, Artificial Sequence
  Description of Artificial Sequence: Synthetic coding sequence
atgattctggccagtgttctgcgcagcggtccaggtggaggccttcccttgcgcccgctgttgggcccggctctagccctcagagctcgaagtacaagcgcgacagacacccaccatgtggagatggctcgagaaaggtctaagactgtgacatctttctataaccagtccgctattgatgcagcagccgaaaagcccagcgtccggctaacccccacgatgatgctgtatgccgggaggtcgcaggatgggtctcacctgctgaagtccgctcgctatttgcagcaagaactgcctgtgcggatcgcccaccggatcaaaggcttccgatgtctcccatttattattggctgcaatccaacgatcttgcacgttcatgagctctacatcagggcttttcagaagcttactgactttcctccgataaaggatcaagccgatgaggcccagtactgccagctggtgagacagctgctcgacgatcacaaggacgtagtgacgcttctggcagagggcctgcgcgagtcaagaaaacatattgaggacgaaaagctggttagatactttttagataagacgttgactagtcgtcttggtatccggatgctggcaacgcaccatctggcgctccatgaagacaaacctgactttgtgggcatcatttgcactcgattgagcccaaagaagataattgagaaatgggtggattttgcccgcagactttgcgaacacaagtatggaaacgccccacgagttcgaataaacggtcacgtggccgctcgattcccctttattccgatgccgcttgactacatcctgcctgagctgcttaaaaacgctatgcgggccacaatggaatcacatctggacacaccatataacgtcccagatgtcgtaattacaattgccaataacgatgtggacttgatcattcgtatctcagaccgcggggggggaattgcccacaaagatctggatagggtcatggattatcattttactaccgcagaagcttcaacacaggacccaaggatcagccctttattcggacatcttgatatgcattccggcgcccagagtggcccaatgcacggattcggtttcggattgcccacctctcgtgcatatgccgaatacttgggtggctccctgcagctccagagtttgcagggaatcgggacagatgtgtacctgaggttaagacacattgacggtcgggaggaatctttccgcatctag

SEQ ID NO: 12189 - DNA, 1404 bp, Artificial Sequence
  Description of Artificial Sequence: Synthetic coding sequence
atggccgcgcaaggggcagccgccgctgtagccgcaggcacctcgggagtagcaggtgaaggcgaacccggcccaggagagaatgctgccgctgaggggacggcaccatcccccggtcgggtgagcccgcctacaccagcccggggtgagccagaggtcactgtggagataggggagacctatctgtgcaggcgcccagacagcacatggcatagtgccgaagtgattcagtcacgtgtgaacgaccaggaaggtcgggaggaattttatgtccattacgtcggctttaatcgcaggcttgacgagtgggtcgacaaaaacagactggctttaacaaagaccgtcaaagacgccgtacagaagaacagtgaaaaatacctctctgagttagcagaacagccagaacggaaaataacacggaatcagaaaagaaagcacgacgaaattaatcacgtccagaaaacctatgccgagatggaccctacaacagccgctcttgaaaaagagcacgaggcaatcacaaaagtcaaatacgtcgacaagattcatatcggtaactacgagatagatgcttggtacttctcaccattcccggaagactacggtaaacagcccaagttatggctgtgcgaatactgcctcaagtatatgaaatatgagaagagttaccgctttcacctgggtcagtgccagtggagacaacctccaggtaaggagatataccggaaatctaacattagtgtatacgaagtcgacggaaaggaccacaaaatctattgtcagaacctgtgtctccttgcaaagctattcctcgaccacaaaaccctgtactttgatgttgagccttttgtgttttatattctcacagaggtggatcgacagggggcccacatcgtggggtattttagcaaggaaaaagaaagcccagacgggaataacgttgcatgtatactgacccttccaccctatcagcgacgtggttacggcaagtttcttatcgccttttcctacgaactttccaagttggagtccacggtagggtcaccagagaagcctttgtctgatcttggtaaattaagttatcgctcctattggtcatgggtgctcctggagatcctgcgcgatttccgaggaactctgtctattaaagatttatctcagatgacttccatcacccagaatgatatcatctcaacgctgcagagtctgaacatggtgaagtattggaagggacaacacgttatctgtgtgacccccaagttagttgaagaacatctgaaatctgcccagtataagaagccgcccattaccgggggatggggagcggctgtttgcagagggagatgggggtcagtatctatttggaccggacggagccagggcctgctaattgctgtgacatag

SEQ ID NO: 12190 - DNA, 1221 bp, Artificial Sequence
  Description of Artificial Sequence: Synthetic coding sequence
atggcagacgggaacgaggacttgagggcggatgacctcccaggacccgccttcgagagctacgagtcaatggagctggcatgtcctgctgagcgctccgggcatgtcgcagtgtcagacggccgccatatgttcgtgtggggcggctataaatcaaaccaggttcgaggtctgtatgatttttacctcccgagggaagagttgtggatctataatatggagacggggcggtggaagaagatcaatactgaaggcgacgtgccaccaagtatgagtggaagttgcgcagtttgtgtggatcgggtcctgtatctttttggggggcatcattcacggggcaatacaaataagttctacatgttagattcccgcagtaccgatcgtgtgctgcaatgggaaagaattgactgtcagggaattcctccatcctctaaagacaaattaggggtttgggtctacaagaacaagctgatcttcttcggcggctacggttacctgccggaggacaaagtcctcggcactttcgagtttgatgaaacatccttctggaacagcagtcatcctcggggttggaacgaccacgtgcacatactggataccgagaccttcacctggtcccagccaataaccaccggcaaggccccatcgccgagagcggcccatgcctgcgccacagttggaaatcggggttttgtgttcggaggtaggtacagggatgctaggatgaatgacctccattatctgaatttggatacatgggagtggaacgaattaataccccagggcatctgtccagtgggacgcagttggcattccttgactccggtctccagcgaccatctattcctcttcgggggatttaccactgacaagcagccgctgtctgacgcgtggacatactgtatttctaagaatgagtggatccaatttaaccacccatacacagagaagccgcgcctctggcacaccgcttgcgctagcgacgaaggtgaggttattgtcttcggcgggtgcgctaacaatctgctagtgcaccatcgggctgctcatagtaatgagatcttgatcttcagcgtacaaccaaaaagccttgtcaggctctctttggaggcagttatctgcttcaaggagatgttggccaacagttggaattgtctgccaaagcatttactgcactccgtaaatcagcgttttggatcaaacaacacgtccgggtcttag

SEQ ID NO: 12191 - DNA, 411 bp, Artificial Sequence
  Description of Artificial Sequence: Synthetic coding sequence
atggtgaatagttgctgcggaagcgtatgcagtgatcagggttgtggtctggaaaattgctgtcgcccctcatgctgccagaccacgtgctgtagaaccacctgctgtcgtccatcatgttgtgtctcctcatgctgtaggccacagtgctgtcagagcgtctgctgccaacctacctgttgttcccccagctgttgtcaaacaacctgctgccgaaccacgtgctgccgcccctcatgctgtgtgtccagctgctttcgccctcagtgctgtcaaagcgtgtactgccagccaacctgctgccgtcccagttgcggccagacaacatgttgtagaactacctgctatagaccctcctgttgcgtcagtacatgctgtcgccctacttgctcgagtggctcatgctgctag

SEQ ID NO: 12192 - DNA, 762 bp, Artificial Sequence
  Description of Artificial Sequence: Synthetic coding sequence
tgctgtcacccttcctgctgccagaccacctgctgtaaaacagcttgctgctgcaggagctttctcaccaccgccccacagacgacttgctgttgcccaagctgcgttgtgtcatcttgctgcaggccttcctgtagtcagacaacgtgttgtcagacaacatgctgcaggcctagttgttgccatcctgtgtgttgccagactacttgccgacctagctgtggtgttagctcctgctgtagacccctgtgttgccagacaacatgtcacccgagctgtggtatgtcatcttgttgtcgtcccttgtgttgccagaccacatgccgccccagctgtggtgttagctcatgctgtcggcccctctgttgccaaaccacatgctgcagggcaacatgctgccgaccaaattgctgccggccaagctgctgccagacgacctgctgcaggacaacctgctgcaggcctagctgttgtgtatctagttgttgtagaccacaatgctgtcagtcagtctgctgccaaccaacgtgttgctcaccatcatgttgtcaaaccacctgctgcaggaccacatgctgtaggcccagctgctgcgtgagtagttgctttaggccacagtgttgtcagtccgtttattgtcagcccacctgctgccggccttcatgtggccaaaccacatgctgtcgaaccacgtgctaccgaccttcttgctgtgtgagcacctgctgccgccctacgtgctcgagtggaagttgttgttag

SEQ ID NO: 12193 - DNA, 1332 bp, Artificial Sequence
  Description of Artificial Sequence: Synthetic coding sequence
atgcagagaagagatgatcccgccgctagaatgagcaggagtagcggacgatccggctccatggatccctccggcgctcacccttcagtacggcaaactccctcccgccagccccccctaccccacagatccagaggaggtggagggggtagtagagggggcgccagagcatctcctgccacccagcccccccccctccttcctccatctgctacgggtccggacgcaacggttggcggaccggcacctactccactactgccaccctcagctactgcaagcgtgaaaatggagcccgagaacaagtacctccctgaactcatggcagaaaaagactcgctcgatcccagctttacgcacgctatgcagctcctgacagcagagattgagaagattcagaaaggagacagcaaaaaagatgatgaagaaaattacctggacctgttttcccataagaacatgaagctgaaggagcgcgtgctaatccctgtgaaacagtaccccaagtttaattttgtgggaaaaattctcgggccccagggcaacactataaagaggttgcaggaagagaccggtgctaagatcagtgtgctgggcaaagggagcatgcgtgataaggctaaagaagaggagctgcggaagggtggagacccaaagtatgcccatctaaatatggacttacatgtgttcattgaggtgttcggtccgccatgtgaagcctacgccttaatggcccacgcaatggaggaagtaaaaaaatttctggtgcccgatatgatggatgacatttgccaggaacagttccttgaactatcctacctgaatggggtgcccgagccctcccgaggccggggggtccccgtgcgggggcgcggagcagccccaccgcccccaccagtcccccggggccggggcgtcggacccccacgcggggctctggtacgcggcaccccagtgcgaggcgccattacccgcggcgccacagtgacgagaggggtacccccccctcctaccgtcagaggtgcacctgcccccagagctaggacagccggcattcagagaatcccccttccccctcccccagcaccagagacctatgaggagtacggatacgacgatacttatgccgagcagagttatgaaggctacgaaggttattattcccagtctcaaggggattccgagtattatgattatggccacggagaagttcaggatagttacgaagcctacggtcaggacgattggaatggcactaggccttccctgaaggcaccgccggctaggcccgtgaagggcgcctacagagaacatccatatgggaggtactag

SEQ ID NO: 12194 - DNA, 1260 bp, Artificial Sequence
  Description of Artificial Sequence: Synthetic coding sequence
atgcagcggcgcgacgatccagctgcaagaatgtctaggagctcgggcagaagcggcagcatggaccccagcggcgcacatccttcagttcgccagactccgtcaaggcaaccgcctcccccattgctccccccctccgctacaggtccagacgccacagttgggggccccgcacccacccctttgttgcctccttccgcaacggccagtgtgaaaatggagcctgagaacaagtatctacccgaactcatggccgagaaagacagtttggatccgagcttcacccacgccatgcagttgctcaccgctgagatcgaaaagattcagaaaggagacagcaagaaagatgatgaggaaaattatcttgacttattcagtcacaagaacatgaagctaaaagaacgggtgctcatccccgtgaaacagtacccaaaattcaactttgtaggcaaaattctcgggccccaaggaaataccatcaaacgccttcaggaggagaccggagccaaaatttctgtgctgggaaaagggtctatgagggataaagccaaggaggaagagctccggaagggcggagacccaaaatatgcacaccttaatatggatctacatgttttcattgaggtgttcgggcctccttgcgaagcttatgccctaatggcccacgccatggaggaggtgaaaaaatttctggtgccggacatgatggatgacatttgccaggaacagttccttgagttgtcctatctgaatggggtccccgagccctccaggggcagaggcgtccctgtgagaggccggggcgctgccccacctcctcctcctgttccccggggtcgtggggtgggtcctccaaggggcgcgctggtgagggggactcctgttcgcggcgccattacccgtggagccactgtgacacgcggcgtccctccccctccaacggtcaggggcgcaccagccccgagggctaggactgccgggatacaacgtatccccctgccgcctcccccagccccggagacatacgaggagtatgggtacgacgacacctacgcagagcagtcctatgagggctacgagggctactactcacagtctcagggagactccgagtattatgactatggccatggtgaagtgcaggattcatacgaggcttatgggcaggacgactggaatggcactagaccctcgctgaaggcccctcccgcaaggcccgtcaaaggggcatatcgcgagcatccttatgggcgatattag

SEQ ID NO: 12195 - DNA, 1215 bp, Artificial Sequence
  Description of Artificial Sequence: Synthetic coding sequence
atgcagcggcgggacgaccctgctgcaagaatgagccggagtagcggtagaagcgggagcatggacccgagcggggcacacccgagcgtccggcaaacgccaagtcgccagcctcccctcccacaccggtccaggggcggcggcggcggaagccggggaggagcgagggccagccctgcaacccaacctccacccctgcttcccccttcagctacaggacccgatgccactgtcggtgggcccgccccaaccccactcctcccaccatctgcgacggccagcgtaaaaatggagcccgagaacaagtatctgcccgaattgatggcagagaaggacagcctggatccttccttcacccacgcgatgcagctgctcacagcagagattgagaagatccagaaaggtgatagcaagaaggacgacgaggaaaattacctggacctgttctcccataagaatatgaagctcaaagaaagagttctaatccccgtgaagcagtaccctaaggaagaggagttacggaaaggcggggatccgaagtatgcccacctgaatatggatttgcacgtgtttattgaagtgttcggccctccctgcgaggcctacgcactcatggcacacgctatggaagaagtcaagaagtttctggtgcctgacatgatggacgacatttgtcaggagcagtttctggagcttagctatttgaatggagtacccgaaccaagccgcggaagaggagtcccagtgcggggccgcggggctgccccgccacctccaccagtgccacgtggtcgaggtgtcgggcctccacgcggagccctggtccggggtacccccgtgagaggtgcaatcacccgcggcgctaccgttacaagaggagtgccgccgccgccaaccgtgcggggggcccccgctcctagagctcgtacagcaggcatccagcgcattccacttccccctcctcccgcacctgagacatatgaggagtatgggtatgatgatacatacgccgagcagtcatacgaaggctatgaggggtattattcccagagccaaggcgactccgaatactacgattatgggcacggagaagtccaagactcttatgaggcttacggacaagacgattggaatggcacacgcccgtccctgaaagcccctcccgcccgccctgtgaagggagcctacagggagcacccctacggtcggtattag

SEQ ID NO: 12196 - DNA, 1050 bp, Artificial Sequence
  Description of Artificial Sequence: Synthetic coding sequence
atggaggaagagaaatacttacctgaactgatggcagaaaaggactctttagatcccagtttcgtacacgccagcaggcttcttgccgaggagattgaaaagtttcagggctccgacggcaagaaagaggatgaggagaagaaatatttggacgtcatcagtaataagaacatcaagttaagtgaaagagttctaatccccgtgaagcaatatcctaagttcaacttcgtaggtaagctcttgggcccccgtggcaattctttaaagcgcttgcaggaggaaacaggcgccaagatgtccatcttgggaaagggttccatgcgggacaaagccaaagaggaggagctccggaagtctggcgaggctaagtacgctcacttaagtgacgaactccatgtactaattgaagtattcgcccctcccggggaggcctattctcggatgtcacatgcattggaggagatcaaaaagttcttggtgccagattacaatgacgagatccggcaagaacagctgcgtgagctttcctacctcaatggaagcgaagatagtgggcgcggccggggcattcggggcaggggtattcgaatcgcacccactgcaccctcaagggggagggggggagctataccccctccaccccccccaggccggggcgtgttgacgcctcggggcagcacagtgacacgcggtgcactgcctgttcctcccgtagcccgaggagtgccaaccccacgggctcgcggggcccctacggttccagggtacagggcccctccgcccccagcacacgaagcgtacgaagaatacggctacgacgatggttacggaggcgagtacgatgaccagacatacgaaacctatgataatagttacgctacccagacccagtctgtaccggagtactatgattacgggcacggcgtgtccgaggatgcctatgacagctacgcaccagaggagtgggccaccactaggtcctcgttgaaagcccctccccaacggtcagcacggggcgggtaccgggagcatccatacgggaggtactag

SEQ ID NO: 12197 - DNA, 951 bp, Artificial Sequence
  Description of Artificial Sequence: Synthetic coding sequence
atggaagaggagaagtatctgcccgagctgatggccgaaaaggacagcctggacccttcatttgtgcacgcaagcagactcctggctgaagagatcgaaaagtttcagggctctgacggaaagaaggaggatgaagagaaaaaatacttggacgtgatttccaataagaatatcaagctctctgagcgtgtgctgatccccgtaaagcaatacccaaagttcaactttgttggaaaacttcttggcccacgggggaacagcctcaaacggctccaggaggaaaccggtgccaagatgagtattctcggaaaaggatcgatgcgggacaaggcaaaggaggaagagctcagaaagagcggagaagctaagtatgcccatctctcagacgaacttcacgttttaattgaagtttttgctcccccaggtgaagcctattctcgcatgtcccatgctctggaggaaatcaagaagtttttggtgccagactacaacgacgaaattcgtcaagagcagctgagagagttgagctacctgaacggaagcgaggactcagggagaggtaggggaataagggggcgtggcattcgtatcgctcctactgctcctagcagaggtaggggcggggccatccctccaccacctcccccagggcggggggtgctgacgcctagggggtctaccgtcacccgtggggcattgccagtaccacctgtcgctcgcggagtccccaccccacgggccagaggtgcccctacagtacctggatatagggctccacccccgcctgctcacgaggcgtatgaggagtacccgtctctcccactgagcttgttcttcgatactgtggcgaagtctcatcagcactgtgataacgaggttcctcagactggaagcacccggctgaatcccggcaggagtttcttccttgcatggcgttgggagtgggactag

SEQ ID NO: 12198 - DNA, 1905 bp, Artificial Sequence
  Description of Artificial Sequence: Synthetic coding sequence
atggccagcgccagaatcggagacgagtatgctgaggatagctccgacgaagaggatattcgcaacactgtgggcaatgtgccgttggagtggtatgacgattttccccacgtggggtacgacctggacggacggcggatctacaaaccattaaggaccagagacgaactggatcagttcttagacaagatggacgaccccgactactggcgcactgtgcaggaccctatgactggccgggacctccgcctgactgatgaacaggtcgctctcgttagacgcttgcagagtggacaattcggggacgtgggttttaatccctacgaacccgcggtggacttcttctccggggacgtgatgatccacccggtgacaaacagacctgctgacaagagatcgtttatcccttcccttgttgaaaaagaaaaggtgagtagaatggttcacgctataaagatgggctggatccaaccacggagacccagggatcctacgcccagcttctatgacctgtgggcgcaggaagaccccaacgccgtactcggtcgtcacaagatgcacgtgccagcccctaagcttgccctaccgggacatgccgagagttataaccccccacctgagtatcttctgtcagaggaggagcggctggcatgggaacagcaggaacccggcgaacgaaagttaagttttctgcccaggaaattcccctctctgcgggccgtacccgcctatggaagattcatccaggaacggtttgagcgttgcttagatttgtacctgtgcccacggcagcggaaaatgagagtgaatgtcgacccggaggatctaattcctaaactgcctaggcccagggatctgcagccttttccaacttgtcaggccttggtgtacagaggacactccgatctggtaaggtgcctgagtgtctcccccggcgggcaatggctagtatctggctcagacgacggatccttgcggctctgggaagtagctacagcccgctgcgtacggacagtccccgttggaggagtggtaaaatctgtggcgtggaacccatcccccgccgtttgcttggtggccgcagccgtggaggacagtgtgttattattgaatcccgcactgggagataggctcgtcgctggcagtaccgaccagctgctgtccgcgttcgtaccaccagaggagccacctctacaacctgcccgctggctggaagcctctgaagaggaacgccaggtgggcttgcggcttagaatttgccatggtaagcctgtgacacaggtcacctggcatggtcgcggagactacctggccgtcgttctggccacccagggccatacgcaagtactcatacaccagctttcccgccgcaggtcccagagtccctttaggcggagccatgggcaggtgcagagggtggcctttcacccggcccgcccttttctgcttgtggcttctcagaggtccgtgcgcctatatcatctgctgaggcaggagctgacaaaaaagttaatgccaaactgcaagtgggtctcgtctttggccgtccacccggctggcgacaacgtgatttgcggcagctacgattctaaattggtctggttcgatttggatctgtccacaaagccatatagaatgcttagacaccacaaaaaggctctgagagctgtcgcatttcatccacgttaccccttgtttgcttctggcagtgatgatggatcagtcattgtttgccatgggatggtctacaacgacctgctgcagaacccgctgttggttcctgtgaaggttctgaaggggcacgtccttactcgagatttaggcgtcctggatgtgatcttccacccaacccagccctgggtgttcagctcaggtgctgatggcacagttagactctttacatag

SEQ ID NO: 12199 - DNA, 1443 bp, Artificial Sequence
  Description of Artificial Sequence: Synthetic coding sequence
atgctgaacttcggtgcatcactgcagcagaccgctgaggagcggatggaaatgatcagcgagaggcctaaagaatcgatgtactcctggaacaagacagccgaaaagtcagactttgaagcagtggaagccctgatgagtatgagctgcagctggaagtctgatttcaaaaaatatgtggaaaataggccggtcacgcccgtgtcagacctgagcgaagaagagaacctcctacccggcacaccagactttcataccatcccggccttctgcctgacccctccatacagcccatcagacttcgagccctcacaggtcagcaatctcatggcccctgctccatctaccgtacattttaaatctctgtccgatacagccaagcctcatatcgccgcaccattcaaagaagaagaaaagagtcccgtgtccgccccaaaattgcccaaggcgcaagcaacttctgtgattcgccacaccgctgatgcacagctctgtaatcaccagacctgcccgatgaaggccgcttccatcttgaactatcagaataattccttccggcgccggactcacctgaatgtcgaggccgcacgcaagaatatcccatgcgccgctgtgtccccaaatcgaagtaagtgtgagaggaatacagtggccgacgtcgatgagaaggcgtccgccgcattatacgacttctccgttccctcctcagagacagtaatttgtcgttcacaaccggcccccgttagccctcagcaaaagagcgtgctggtatcaccccctgctgtgtcggccggtggggtgccacccatgccagtgatttgccagatggtgccattaccggctaataatccagttgtgacaaccgtggttccttccacgcctcccagtcaaccgccagctgtctgcccccccgtcgtgttcatgggaacgcaggtcccgaagggggctgtgatgtttgtagtgcctcagccagtggtgcagtcttccaaacctcccgtagtcagtcccaacggtacgcgccttagccctatagctccagcacccggtttttcaccgtcagccgctaaagtgactccacagatcgatagttccaggatccgaagccatatctgcagtcacccagggtgcggtaaaacatacttcaagtccagccatttgaaagcacatactaggactcacacaggggagaaaccattcagctgctcctggaagggttgcgaaaggcgctttgcgcgaagtgacgagctgtcgcgtcatcggagaacccacactggggagaaaaagttcgcgtgccccatgtgcgaccgccggtttatgagaagtgaccacctgaccaaacatgcgagacgccacctgagtgccaaaaagttgcccaattggcagatggaagtctctaaactaaacgatattgccctgccacccacacccgcccctacacagtag

SEQ ID NO: 12200 - DNA, 1410 bp, Artificial Sequence
  Description of Artificial Sequence: Synthetic coding sequence
atggaagagaggatggagatgatatctgaacggcccaaagagagcatgtactcatggaacaagaccgccgagaagtccgacttcgaggccgtagaggcactcatgtccatgtcttgtagctggaaaagcgacttcaaaaaatatgtggagaaccggccagtgacgcccgtatcagacttgagcgaagaggaaaatctgctccctggcacccctgattttcatactattcccgctttttgccttacacctccttacagtcctagcgattttgaaccaagccaggtgagtaatctgatggcacccgctccgtccaccgtgcactttaagagtctgtccgacaccgccaaaccccacatagcagcgcccttcaaggaggaggagaaaagcccagtgagtgcaccaaagttgccgaaggcccaggctacaagcgtgattcggcacactgccgacgcacaactttgcaaccatcaaacctgtccaatgaaggccgcgtctattctgaattaccagaataatagctttcgccgccgcacgcacctgaacgtggaagcggcccgtaaaaacattccctgtgctgcagtgagtcccaataggtccaaatgcgagcgcaacaccgtggccgatgtagatgaaaaagccagtgccgcattgtatgacttttctgtcccctcatcagagactgtcatttgtagaagccaacctgcgccagttagtccacagcagaaatctgttttggtgtctccaccggcagtcagcgcgggcggagtgccgcccatgcctgtcatctgccagatggtccccctgccagccaacaatccagtggtgacaacagtagtcccttccactcccccttcccagccccccgctgtatgtcctccagtggtgtttatgggcacccaggtgcccaagggagctgtaatgttcgtcgtgccacagcctgtagtgcagtcaagcaaacccccagtggtatcccctaacggtacgcggctcagcccaattgcaccagcgcctgggtttagcccctccgccgccaaggtcacaccccagatcgatagctcccgtattaggtctcatatctgctctcatcctggctgtggcaaaacctacttcaagtcaagtcatcttaaagcacatacaagaactcacacaggagaaaagcccttcagctgctcatggaagggttgtgagcggagattcgcccggtccgacgagttatccaggcacagaagaacacacactggagaaaaaaaatttgcttgtcctatgtgcgataggaggttcatgcggtctgaccatctgacgaaacacgcacgacgccatttgtctgcgaaaaaacttccaaactggcaaatggaggtgagcaagttgaacgacatcgcactgcctcccacgcctgcaccgacccagtag

SEQ ID NO: 12201 - DNA, 972 bp, Artificial Sequence
  Description of Artificial Sequence: Synthetic coding sequence
atgagtgctgctgtagcatgccttgattatttcgccgctgagtgtttagtgtctatgtccgcaggggctgttgtccaccgacgccctcccgatcccgagggggctggcggtgccgcaggttctgaagtgggggccgcgcatccagagtctgccctacccggccccggaccttctgggcccgcatctgtgccccagttgccccaggtcccggccccctcccctggggctggaggggccgccccacacctcctggcagcctccgtgtgggccgatctgcggggcagtagtggtgagggatcttgggagaattctggcgaggccccccgagccagttccggcttctctgatcctatcccttgttcagtacaaacaccttgctccgaactcgctccggcctctggggcagctgccgtgtgcgcgcctgagagctcgagcgacgcaccagctgtgcccagcgctcccgccgcacccggcgctccagcagcaagcggcggcttttccggcggcgcacttggcgcgggacccgctcctgccgcggaccaagcgccacgccgacggtcagttacacctgctgcaaaacgtcaccagtgtccattccccggatgtaccaaggcctattacaagagcagccacttaaagagtcaccagagaacccacacaggcgagaggcccttctcctgtgattggctggattgcgacaaaaagtttacaagaagcgacgagctcgctaggcactatcgcactcacaccggcgagaagagattttcctgtccactttgtcccaagcagttttcccgatcggatcatctgacaaagcatgcacgtaggcatcccacctaccacccggacatgatagagtatagaggccggagaaggaccccgcgcattgatcccccactcacatccgaagtcgagagcagtgcctcaggctccggtccgggccccgcacctagttttacgacttgcctgtag

SEQ ID NO: 12202 - DNA, 759 bp, Artificial Sequence
  Description of Artificial Sequence: Synthetic coding sequence
atgtccgctgcggttgcttgcgtcgattacttcgccgccgacgtgctaatggccatatcatctggagccgtcgtccacagagggaggccaggccctgaaggcgctgggccagccgccggactcgacgtacgcgccgcccggagagaagctgcctcaccaggcacacctggaccaccccccccccctcctgcagcctccgggccgggtcccggtgccgccgccgctccgcacctgctcgccgcctccatactggctgaccttagaggaggcccaggtgccgcccctggcggagccagtcctgcgagctcttctagtgctgcaagctctccatccagcggacgtgcacccggcgccgcgcctagtgccgctgctaagtcccatcgctgcccgttccccgactgtgccaaagcatattataaatcgagtcacctgaaatcccacctccgtacacacactggagagagacctttcgcctgtgactggcagggttgtgataagaaatttgcaaggtcagatgagttggcgagacaccacaggacccacaccggggagaagcggttctcctgtccactatgttccaaacgtttcacacggtcggatcatcttgccaaacatgctaggaggcacccagggttccaccctgacctgctgcggcggcccggagcaagatcaacatctccttcggacagtctcccctgttcgttggcgggttcaccagccccctcgcctgctccttcccctgcacccgctggtctatag

SEQ ID NO: 12203 - DNA, 759 bp, Artificial Sequence
  Description of Artificial Sequence: Synthetic coding sequence
atgtccgccgctgtggcttgcgttgactatttcgcagctgatgttctgatggccatttcaagcggagccgttgttcatcgtggcagacccggcccagagggagctggccccgccgccgggcttgacgtgcgcgctgcaaggcgggaggccgcctccccgggcacccccggccccccgccccctcctcctgcggccagcgggccgggcccaggcgccgctgccgcgccgcacctgctggcggccagcatactggccgacctgcgtggcggtccaggtgcagctcctggaggagcatctccagcgtcctcaagttcagcagcctccagcccaagcagtggtagagcccctggtgcggcaccctccgccgcggccaagtcacacaggtgtccttttcccgactgcgcaaaggcatattataagagcagccatctgaaaagtcacctcaggactcacacaggggagcggcctttcgcctgtgactggcaagggtgcgacaagaagtttgctaggagcgatgaactggcacggcatcaccgcacgcatactggcgagaagagattctcatgtcctctgtgcagtaaacgtttcactaggtctgaccatttggctaagcatgctcggcggcatccaggattccacccagatctgctaaggcgcccaggcgcccgctctacgtcaccctcggactctttgccttgctcactggctgggagccccgccccatcgccggccccaagccctgcccctgccgggctgtag

SEQ ID NO: 12204 - DNA, 1170 bp, Artificial Sequence
  Description of Artificial Sequence: Synthetic coding sequence
atgtatggccggccacaggcagagatggaacaagaggctggcgaattatcccgctggcaggcagcccatcaggcagcacaagataatgagaattcagcacctatcctgaacatgtccagtagttccggatcgtctggggtccacactagctggaaccaaggcctcccgtccattcaacactttccacactctgccgaaatgctgggcagccctttggtgtcagtggaagctcctggtcaaaacgttaatgaaggcgggccacagttcagcatgcctctcccggagcgagggatgtcctattgtccacaggctacactgacacctagcagaatgatttactgtcaacgcatgtcacccccgcagcaagaaatgaccatctttagcgggccccaactgatgcccgtaggagagcccaacatccccagggttgcgagacctttcggggggaaccttcgaatgccacccaatgggttgccagtgtccgcttctaccggtatccccataatgagtcatacaggtaaccctccagtgccgtatcccgggctcagcaccgtgcccagtgacgagacgctgctggggcctacagttcccagcactgaggctcaggcggtgctgccatccatggcacaaatgcttcccccacaagatgcacacgatctgggcatgcctcctgccgagagtcagtctttgttggtccttgggagtcaagacagtctcgtgagtcagcctgactctcaagaagggccgttcctgcccgagcaaccagggcctgccccacagaccgtggaaaaaaattcgcgcccccaggagggtacgggtcgcagagggtcttcggaagcccggccctactgttgtaattacgagaactgcggtaaagcttacaccaagagatcccatctcgtgtcacatcagcgaaaacacacaggagaacggccatactcttgtaactgggagtcttgctcttggtcattttttcggagcgacgagctaagacggcatatgcgcgtgcatacgagatatcggccgtacaaatgtgaccagtgtagtagagaatttatgcgatccgaccacttgaaacagcatcaaaaaacccaccgcccaggaccttccgatccgcaggctaataataacaatggcgaacaggactccccccctgctgccggaccgtag

SEQ ID NO: 12205 - DNA, 1038 bp, Artificial Sequence
  Description of Artificial Sequence: Synthetic coding sequence
atgctgatgtttgaccccgtgcccgtcaagcaggaggctatggatcccgtgagcgtttcttacccttcgaactatatggagtcaatgaaacccaataagtacggagtgatctactcgaccccgctgcctgaaaagttcttccagactccggaaggtctaagtcatgggatccaaatggagccagtggacctgacggtgaacaagcgctcaagccccccgtccgcaggtaacagcccttcttcattgaaattcccctcgtcccaccgcagggccagcccgggcttgtctatgcccagctcaagccctccaattaagaaatactccccccccagtcccggtgttcagcccttcggcgttccactgtctatgccccctgttatggcggccgcactgtccaggcacggaattcggagccccggaattctgcccgtcatccaaccagtcgtggtgcaaccagtcccattcatgtacacatctcaccttcagcaaccacttatggtgagcctatccgaggagatggaaaatagcagttcaagcatgcaagtacctgtgatcgagtcctacgagaaacctattagtcagaagaagatcaagatcgaacccggcatagagccacagcggactgattactatcccgaggagatgagccccccactgatgaattcggtaagccctccacaggccctgctgcaggagaaccatccaagtgtgatcgttcagccaggcaaaagacccctgcctgtggaaagccctgacacgcagaggaagagaaggatccatagatgcgactacgacggctgcaacaaagtctatacaaagagcagtcacctcaaagcccaccgacggactcacactggagagaaaccttacaagtgcacctgggagggctgtacatggaagtttgcacgctctgatgagctgaccagacatttccgcaaacacaccggcatcaaacccttccagtgtccggattgtgacaggagtttcagtcgctctgaccaccttgctttgcatagaaagcgccatatgctcgtctag

SEQ ID NO: 12206 - DNA, 1374 bp, Artificial Sequence
  Description of Artificial Sequence: Synthetic coding sequence
atggccacgcgggtactgagcatgagcgcgagattggggcccgtccctcagcccccagccccccaggatgagcccgtgttcgcccagctgaaacctgtgctaggagccgcaaaccctgcaagagatgctgctctcttccctggagaagaactgaagcacgcccaccatagaccccaggctcagcccgctccagcccaggcacctcagcctgcccagccacccgcaacaggcccgaggctgcctccagaagacctggtccagacccgctgcgaaatggaaaaataccttactccccagctgccaccagtgcctatcatccccgagcacaaaaaataccgccgggacagtgcatccgtggtcgatcaattctttacagacactgaaggtctgccctactcaattaacatgaacgtctttctgcctgacatcactcacctgcgaactgggctgtacaaatcgcagagaccttgcgtgactcatatcaaaactgagcccgtagcaattttcagtcatcagtcagaaactaccgcaccgccaccagcacccacgcaagctctgccagagtttacttctatcttcagctcccaccagactgctgccccagaagtcaacaacatcttcattaaacaggaactccccacaccggatctgcacctttctgtacccacgcagcagggccacttgtaccagctgctcaataccccagatttagatatgccctcgtcgactaaccagacagctgccatggacacgctgaatgtgtcaatgtctgccgcaatggcaggactaaacacgcacactagtgcagtgccacagactgccgtaaaacagtttcagggaatgcctccatgcacttacactatgccaagccagttcctgccacagcaagctacttactttccccctagtcccccctctagcgaaccggggagccccgatcgccaagcagaaatgctgcagaatcttacacctccgcccagttacgcggcaactatcgccagtaagcttgcaatccataatccaaatctgccaaccactctacctgttaatagccagaacatccaaccagtgaggtataatcggagatccaatccagacctcgagaaaaggcgaatccactactgcgactatcctggctgtaccaaggtatataccaaatccagccatctcaaagcccatcttagaacacataccggagagaagccatacaagtgcacgtgggaaggctgtgattggagatttgcaagatccgacgagctcactcgtcattatcgaaaacacacaggagctaagccctttcagtgtggagtttgcaatcgctccttttctcgatctgaccatctagccctccatatgaaaagacaccagaattag

SEQ ID NO: 12207 - DNA, 1101 bp, Artificial Sequence
  Description of Artificial Sequence: Synthetic coding sequence
atggaaaagtaccttacaccccagctcccaccggtcccgattatccctgaacataagaagtaccggagggacagcgctagcgtagtggaccagttttttactgacacagaaggccttccttattctatcaatatgaacgtgttccttcccgatatcacacatctgcggactggactatataagtcgcagcggccttgcgtcactcatattaaaaccgagcctgttgctatcttctctcaccagtcggaaactacagctcccccaccagcccccacacaggctctcccagagttcaccagcatcttttcaagccatcaaactgctgcgcccgaggtgaataatatctttattaaacaagagctacctacaccagacctccatctcagcgtccctacccagcagggccacttgtaccagctgcttaataccccagacctagatatgcctagttctactaatcagaccgcggctatggacacactaaacgtgtctatgtctgcagctatggccgggttgaacactcatacatctgcagtgccacagacggctgtgaagcagttccagggaatgccaccatgtacgtacactatgccatcacagtttctgccccaacaggcaacctattttcctccttctcccccttccagcgaacctggctctcctgatcgtcaggcagagatgttacaaaacctgaccccccccccaagttacgcagctactatcgcttctaaattggcgatccataaccctaatctacctaccactttacccgtgaacagccagaacattcagcccgtgcgttacaataggcggagcaatcctgatctcgagaagcgtcgaatacactactgcgattacccgggatgcactaaagtctacactaaaagttcccacctgaaggcacacttgcggacacataccggagaaaagccatataagtgcacatgggagggctgcgattggcgcttcgcccgctctgatgagctcacgcggcactatcggaaacatacaggggctaagcccttccagtgtggcgtgtgtaatcggtccttcagtaggtctgaccacctggccttgcacatgaagaggcaccagaattag

SEQ ID NO: 12208 - DNA, 1314 bp, Artificial Sequence
  Description of Artificial Sequence: Synthetic coding sequence
atggctacccgcgtcctgtccatgtcagccagactgggcccggtaccacaaccgccagccccacaagatgagcctgtgtttgctcagttgaaacctgtgctcggagcagctaacccagcgagggatgccgcgttgttcccaggcgaggagctcaaacatgcacatcaccggcccaggctgcccccagaggacctcgtgcagactcggtgcgagatggagaaatacctgaccccacagttgccccctgtgccaatcattcccgaacacaagaagtacaggcgcgattctgcttctgtggtagaccaattctttaccgatacagagggactgccttatagtatcaacatgaacgtcttcttgcccgacattacccacttacgcaccgggttgtacaagagccagcggccttgcgtcacacatattaagaccgaacctgtggctattttttcacatcagtcagagacaactgctccaccacctgcacctacccaggccctcccggagtttaccagcattttttcttcacatcagacggctgcaccagaagttaacaatatctttattaaacaggaactgcccacacccgatctgcatctatcggtccccactcagcagggtcacctataccaattgttaaatactcccgatcttgacatgccatcatcgacaaatcagaccgcagcgatggacacactgaatgtctccatgagcgctgcaatggcagggctgaacacacacacatcagccgtaccacagacggctgttaagcaattccagggcatgccaccctgcacttacactatgccgagtcagtttctccctcagcaggcaacatactttcccccttctcctcctagttcagagccgggctcccccgatagacaggccgagatgctgcagaatttaacgcctccgcctagctacgccgcgacaattgcaagcaagctggctatacataatcctaacctgccaactaccttgccagtgaattcccagaatatccagcccgtcagatacaataggcgatctaatccagacctagagaagaggagaattcactactgcgactaccccgggtgcacaaaggtgtataccaagagttcccacctcaaagcacacctgcggactcacacaggagagaagccgtataaatgcacatgggaaggctgtgactggagatttgcgagatccgacgaactgacgagacattacagaaagcacactggagcgaaaccattccagtgtggcgtctgcaatcgatcattctctaggagcgaccacctggccctgcatatgaaaagacaccagaactag

SEQ ID NO: 12209 - DNA, 735 bp, Artificial Sequence
  Description of Artificial Sequence: Synthetic coding sequence
atgagtgcagccgcctatatggattttgtggctgcacagtgcttggtgagcattagcaatcgagccgccgtgcccgagcatggagtcgcacctgatgctgagcggctgcgactaccggagagggaggtaactaaggaacacggcgatcctggcgacacatggaaggattattgtactctcgttaccatcgcaaagtcgctgctcgacctcaataagtaccggcctatccagactccctccgtctgcagcgacagcttagaatcccccgatgaggacatgggttctgacagcgacgttacaacggaatcaggtagctcgccatcacattctcccgaagagaggcaggatcctgggtccgcccccagtccgttatccttgctgcaccccggtgtggccgcaaaaggcaagcacgcctcggaaaagcgccataagtgtccatatagcggctgtgggaaggtgtatggcaagtcctcacacctgaaagcgcactatagggtgcatactggagagcggcccttcccttgtacttggccagactgtcttaagaaattttcacggtcggatgagcttacaaggcactatcgtacccatacgggtgagaaacagtttagatgtccgctttgcgaaaaaagattcatgcggtctgaccacttgaccaagcatgccagacgacataccgagttccatccatctatgatcaagcgttctaaaaaggcactagcaaatgcgctctag

SEQ ID NO: 12210 - DNA, 2343 bp, Artificial Sequence
  Description of Artificial Sequence: Synthetic coding sequence
atgactgagtcagcaagttcaacaagcggccaagaattcgacgtgttctctgttatggactggaaagatggcgtggggaccctgccaggtagtgatctcaagtttagagtaaatgaattcggtgcgctggaggtgatcactgacgaaaatgagatggagaacgtgaagaaggcgactgccaccactacatggatggttcctacagcccaggaagcacctacttcccctcctagcagccgcccggtttttcccccagcctactggacaagtcccccagggtgccctactgtgtttagcgaaaaaactgggatgcctttcagactaaaggatcccgtgaaagtcgaaggcttacaattttgcgagaattgttgccagtacggaaacgtcgatgaatgtctgagcggaggtaattattgctcccagaattgcgctagacatatcaaagataaggatcagaaagaggagcgcgatgtggaggaggacaatgaggaagaagaccccaagtgttcgagaaaaaagaaaccaaagttgagtttgaaagctgataccaaagaagatggcgaggagcgcgacgacgagatggagaataaacaagacgtgcgaatattgagggggagccagcgcgcacgaaggaaacgtagaggcgactctgccgtcctgaaacaggggctcccaccgaagggcaagaaggcctggtgctgggcctcctacctagaggaggagaaggctgtggccgttccagccaagctctttaaagagcatcaatcattcccctacaataagaatggttttaaagtggggatgaagctggagggagttgacccagagcaccagagcgtctactgtgtgttaacggtcgccgaggtgtgcggatataggattaaactgcacttcgatggctactccgattgctacgatttctgggtgaatgcagacgccctcgacatacatccagttggatggtgtgaaaagactggacataaacttcacccacctaagggctacaaagaggaagagtttaactggcagacatatttaaaaacttgcaaggcacaagctgcccccaagtctctctttgaaaatcagaatattacagtcatcccctccggcttccgagtcggcatgaagctggaggccgtggacaagaagaacccatcatttatctgcgtagccaccgtcacggacatggtggacaacagatttctggtccattttgacaattgggatgagtcttacgattattggtgcgaggcctcttcaccccacatccaccctgtggggtggtgcaaggaacatcgaagaacactgatcacgcccccgggctacccaaacgtgaaacatttctcgtgggacaaatacctggaagagaccaattctctgcctgcacctgctcgtgctttcaaggtgaagccgccccacgggttccagaagaaaatgaagttggaagtggtcgacaagcgtaaccctatgttcatccgggttgctaccgttgccgacaccgatgatcaccgcgtgaaagtccatttcgacggctggaacaattgttacgactattggatagacgccgatagtcctgacattcaccctgtgggatggtgtagcaagacagggcatcccctgcaaccaccgctcagtccccttgagctcatggaggcatctgaacacggcggctgcagcactccaggttgtaaaggcataggccactttaaaagggctcggcatctgggtccacactccgccgcaaactgtccctatagcgagattaatctgaataaggacagaatctttcctgaccgactttccggtgagatgccgccagccagccccagcttcccgaggaataagaggaccgacgccaacgaatcatcatcaagcccggaaatcagggaccagcatgcagacgacgttaaggaggacttcgaagaacgaaccgagagcgaaatgaggacctcacatgaggcccggggagctagagaggaaccaacagtacagcaggctcaaagacggagtgctgtctttctatccttcaaaagccctatcccttgccttccgctaaggtgggagcagcagtcgaaactacttcccactgtggccggcatcccagcaagcaaggtgtccaagtggagcacagatgaggtttccgagtttatccagtctcttccaggctgtgaagaacatggaaaggtctttaaagacgaacagatagatggtgaggctttccttcttatgacccagaccgacattgttaaaatcatgtccattaagctgggccccgctctcaaaatctttaactccattctgatgtttaaagcggctgaaaaaaatagccataacgaactatag

SEQ ID NO: 12211 - DNA, 2343 bp, Artificial Sequence
  Description of Artificial Sequence: Synthetic coding sequence
atgacagagtctgcaagttctaccagcggccaggagtttgacgtatttagtgtgatggactggaaggatggtgtgggcacgctgccaggatccgacctgaagttccgagttaatgaatttggagctctggaggtaatcacggacgagaacgagatggagaacgtgaagaaggcaacagcaactacaacttggatggtgcccacggcccaggaagctcctacctcaccaccttcgagccgcccagtgtttccgcctgcctactggacaagccctcccggctgccccactgtgttcagcgaaaaaacaggaatgccgtttcgactaaaggatcctgtgaaggtcgaggggctgcagttctgcgagaactgttgccaatacggaaatgtcgatgagtgcctgtccggtgggaattactgttcccagaactgtgcccggcatatcaaggataaagatcagaaggaggaacgggatgtggaagaggacaacgaagaagaggaccccaaatgttcacggaagaaaaagcccaaactgagtctcaaggcagacacaaaggaagatggagaggaacgtgacgacgagatggaaaataaacaggatgttcggatcctgaggggcagccagagagcacgccgcaagcggcgcggagattcggcagtgcttaaacaggggctcccgccaaaaggaaagaaagcctggtgttgggcttcctacctagaggaggagaaggccgtcgctgtacccgccaagctgtttaaagagcatcagtcgtttccatacaataagaacggcttcaaggtcggcatgaagctcgaaggtgtggaccctgagcatcagtcggtatactgtgtcctgaccgtggctgaagtatgtgggtatcgcatcaagcttcacttcgacggctattccgactgttacgacttttgggtgaacgccgatgcactggatatccaccccgtgggctggtgtgaaaagactggtcataaactccatccccccaagggatataaagaagaagagttcaattggcagacatacctgaagacttgcaaggcacaggctgctcccaaaagtctctttgaaaaccagaacatcacggttattccttcaggatttagggttgggatgaagctggaggcagttgataagaaaaacccatcttttatctgcgttgctactgtgactgatatggtagacaatcgattcttggtgcattttgataactgggacgaaagttatgattattggtgcgaggcttcaagcccacatatccatccggttggttggtgcaaggaacatcggcgtacactaatcacaccgcctgggtacccgaatgttaagcatttctcctgggataagtatctcgaggaaacaaatagcctgccagccccggcgagggcatttaaggtcaagccaccccatggcttccagaaaaaaatgaagcttgaagttgtggataagagaaaccccatgttcatacgggtggcaaccgtcgctgatactgacgaccaccgagttaaggttcactttgatggctggaataattgttacgactactggatcgatgccgactccccagacatccaccctgttgggtggtgcagtaaaaccggtcatcctctgcagccccctctgtctccactggaactgatggaggcttctgagcacgggggatgcagtacccctgggtgcaaagggattggccactttaaacgagcacgccacctaggcccacacagtgccgctaactgtccttatagcgagattaacctgaataaggatcgtatcttcccagaccgactatctggagaaatgccacctgcaagtccgtcattccccaggaacaaacgcacagatgccaatgaaagctcatcatcgcccgaaatccgggatcagcacgccgacgacgttaaagaggacttcgaagagcgaaccgagagcgaaatgagaacctctcacgaagctcgcggagcccgagaagagcccaccgttcagcaagcacagcggaggagcgctgtctttctaagcttcaagagccccatcccttgtctgccgttgaggtgggaacagcagagtaaactgttgcccaccgtggctggaatcccagcttctaaagtgtctaagtggtccacagatgaagtctctgaattcatacagagtctgcccggctgtgaggagcacgggaaagtgtttaaagacgaacagatcgatggagaggctttcttgctgatgactcagaccgatatcgtaaagatcatgtcaattaaactagggccagcgctgaagatcttcaattctatactgatgtttaaggccgcagagaagaattcccataacgagctgtag

SEQ ID NO: 12212 - DNA, 2268 bp, Artificial Sequence
  Description of Artificial Sequence: Synthetic coding sequence
atgaccgagtctgcatcgagcacgtccggccaagaattcgacgtgttttccgtgatggattggaaagacggcgtgggcacattgcccgggtctgatctgaagttccgagtcaacgagtttggcgcgcttgaagtgattactgatgaaaatgagatggaaaatgtgaaaaaagctactgctacaacaacctggatggtgcccacggcacaagaagttttttccgagaaaactggaatgccatttcgtctcaaagatcccgtcaaggtggaagggctgcaattttgcgaaaactgctgtcagtatggtaatgtggatgaatgtctctccggcggcaactactgcagccagaattgtgccaggcacatcaaggataaggaccagaaggaagagcgcgacgtagaagaggacaacgaagaagaagatcctaagtgtagtcgcaaaaaaaagccaaagctgagtctgaaggccgacacaaaggaagatggcgaggaacgtgatgatgaaatggagaataaacaggacgtgagaatcctgcggggtagccagagagcgcggcgcaagaggcggggcgattctgccgtcctgaagcagggcctccccccaaagggcaaaaaggcttggtgctgggcgagttacctggaggaggagaaggcggtagcagtgcctgccaagttattcaaggaacatcagtcttttccatacaacaagaatggctttaaagtgggcatgaaattggaaggggtggatccagagcatcagtctgtgtactgcgtgctgacagtcgccgaggtgtgtggttacaggatcaagcttcatttcgatggctactccgactgctacgatttctgggtaaacgctgacgccttggacatccaccccgtgggatggtgtgagaagaccggtcacaaactgcatcctcctaagggctataaggaggaggagtttaactggcaaacgtatttaaagacttgtaaagcacaggctgcacccaagtccctcttcgaaaaccaaaatattaccgtcattccatcgggattcagggtcgggatgaagttagaagctgttgataaaaaaaaccctagctttatatgcgttgcaacagtcactgacatggtagataatcgattcctcgttcacttcgacaactgggatgagtcttatgattattggtgcgaggcgtcttcgcctcacattcatccagtaggatggtgtaaagagcaccgacgaactttaatcaccccccccggatatcctaatgtgaaacatttcagttgggataagtatctcgaagaaacgaattcactgcccgctcctgcccgagctttcaaagtgaagcccccacacggatttcagaaaaaaatgaagcttgaggtcgtggataaacgaaaccccatgttcatcagagtggccactgtggccgataccgacgaccatagagtcaaagttcattttgacggatggaacaactgctatgattactggatcgatgccgacagccccgatattcaccctgtgggctggtgcagcaaaacaggtcaccccttgcagccaccactgtcccccctggagcttatggaggcctccgagcacggaggctgtagtacccctggctgcaaaggaataggccatttcaaacgcgctcggcacctcgggccacactccgcagctaactgtccatattcggagatcaacttgaacaaggaccggatctttcccgaccgcctgagcggggagatgccccccgcgtcaccctcattcccacggaacaaacgtaccgacgccaacgagtcatcttcgtccccagagatcagggatcaacacgccgacgatgtgaaggaggacttcgaggagcgcaccgaatccgaaatgcggacgtctcatgaggcgcgcggggccagagaggaacctaccgtacagcaggctcagcgacgtagtgccgtttttctcagctttaaatctcccatcccttgcctgccgctgagatgggagcaacaatcaaagctcctaccaaccgttgcaggcatccctgcctcaaaggtcagcaagtggagcaccgatgaggtgagcgaatttatccagtccctccctgggtgcgaagagcacggaaaagtgtttaaggacgaacagattgacggtgaggccttcctcctgatgacccaaacagacatcgtcaagatcatgtcaatcaaactgggcccggcactgaaaatttttaacagcattctcatgtttaaggccgcagagaagaattcccataacgagctttag

SEQ ID NO: 12213 - DNA, 2268 bp, Artificial Sequence
  Description of Artificial Sequence: Synthetic coding sequence
atgactgaatcagcctctagcaccagcgggcaggagttcgacgttttcagcgtaatggactggaaggatggtgttggtaccctgcctggctcagatctcaagttccgcgtgaatgaattcggggccctggaagtgattactgacgaaaatgaaatggagaatgtgaagaaggcaacagcaacaactacttggatggtgccgacggcgcaggaagtatttagtgagaaaaccggcatgccatttaggctaaaggacccagtcaaggtggaaggactgcaattttgcgaaaattgctgtcagtacggtaatgtggatgagtgcttgagcggagggaattactgttctcaaaattgcgccagacacattaaggataaagaccagaaggaggagagggacgttgaggaagataacgaggaggaggatcccaagtgttctaggaagaaaaagcccaagctcagtctcaaggctgacactaaggaggacggggaggagcgggacgatgagatggagaacaaacaggatgtacggatcttacgcggcagccagcgggcacgccggaaaaggagaggagatagtgcagttttaaagcagggcctgccccctaaaggcaaaaaagcatggtgttgggcctcctatctggaggaggaaaaggccgtcgctgtgcccgcgaaacttttcaaggagcatcagagtttcccttataataagaatggtttcaaggttggcatgaaactcgagggggtcgaccctgaacaccagtccgtctactgcgtgttgactgtcgccgaggtgtgcggataccgaatcaaactacattttgacggatacagtgactgctacgacttctgggtgaacgccgatgctctggacattcatccagtgggatggtgtgaaaagactggtcataagctgcacccgcctaagggctacaaagaggaggaattcaactggcagacctaccttaagacctgcaaagcccaggccgcccctaagtcgctttttgaaaatcagaacatcacagtaattccgagcggatttcgggttgggatgaagctggaggcagtcgacaagaagaacccatccttcatttgtgtcgcaacggttacggatatggttgataataggtttcttgtgcactttgacaattgggacgagagttatgactattggtgcgaggctagttcccctcacattcaccctgtgggctggtgcaaggagcaccgtcggacactgatcacaccaccaggctatcccaatgtcaagcatttttcttgggataagtatctcgaagagaccaactctctgccggccccggcccgcgcgtttaaagtcaaaccaccgcatgggtttcagaaaaaaatgaagctggaggtggtcgataagcgaaatccaatgttcatcagggtggcaactgttgcagacaccgatgaccatagagtcaaggttcactttgacgggtggaataactgctacgactattggattgacgcggattcacccgatatccacccagtgggttggtgtagtaaaacaggacacccactgcagcctcccttaagccctctagagctgatggaggcctctgaacacggcggatgttctacacccggatgcaaggggatcggccatttcaagcgggcacgccacctcggaccacattcagcggcgaactgcccttatagcgaaatcaacctcaacaaagacagaattttccccgaccggctgagcggtgaaatgcctcctgcatccccatcatttccgagaaacaaacggacagacgccaatgaaagcagctctagccctgaaattcgagatcagcatgcagacgacgtgaaggaggactttgaggagcggactgaatcggagatgcgcacctcacatgaagctaggggcgcccgggaggaaccgactgtccaacaggcccagcgccgatcagccgtgtttctgtctttcaagtccccaatcccgtgtctaccgctgagatgggagcagcagagcaagttgctacccactgtggccggcatccctgcttcaaaagttagtaaatggtcaacagacgaagttagtgagtttatccagagcctgcccgggtgcgaggagcatgggaaagtgtttaaggatgaacagatagacggagaagctttcctgcttatgacccagaccgatattgttaagattatgtccattaaactcggccctgctctgaagatctttaattccattctcatgttcaaggccgccgaaaagaacagccacaacgaactatag

SEQ ID NO: 12214 - DNA, 573 bp, Artificial Sequence
  Description of Artificial Sequence: Synthetic coding sequence
atgacagagtccgctagttctactagcggccaggagtttgacgtgttttcagtgatggactggaaggatggggtaggtacgttgccaggaagtgatcttaaattccgagtaaatgagtttggagccctagaagtgataacggatgagaacgaaatggaaaatgtgaagaaggctaccgcgacgaccacctggatggtgcctaccgcacaagaggcacctacatcccccccctcttcgcggcctgtgttccctcctgcctattggacgagcccgccaggatgccctacagtgttctccgagaagaccgggatgccctttaggcttaaagaccctgtcaaggtggaaggactccaattctgcgagaattgctgtcagtacgggaacgttgatgaatgcttgagcggcgggaattactgctctcagaattgcgccaggcatatcaaagataaagatcagaaggaagagcgagatgtggaggaagataacgaggaggaagacccgaagtgttcccgcaaaaagaaaccaaagttgtctctgaaagccgacacgaaagaagatggcgaggaacgttag

SEQ ID NO: 12215 - DNA, 2343 bp, Artificial Sequence
  Description of Artificial Sequence: Synthetic coding sequence
atgactgaatctgcatccagcactagtggccaggagtttgatgttttcagtgtgatggattggaaggacggagttgggacactgcccggaagcgacttaaaatttcgggtaaacgagtttggagccttggaggtaataaccgatgaaaatgagatggagaacgtgaaaaaagccactgcaactactacatggatggttccaactgcacaagaggccccgacatcacctcccagctcacgacccgtcttcccccctgcctattggacaagcccaccaggttgccccaccgtatttagtgaaaagacggggatgcccttccgccttaaggaccctgttaaggttgaagggctccagttctgtgaaaattgctgtcagtacgggaatgtggacgaatgtctgtcaggagggaattactgcagccagaactgtgctcggcatattaaagacaaagaccaaaaagaggagagggatgttgaggaggacaacgaggaggaggatcccaaatgttcgagaaagaaaaagcctaagctttccctgaaggccgacactaaggaggacggtgaggaaagagatgacgaaatggaaaacaagcaggatgtgagaatcctgagaggctcccaacgcgcccgtagaaagcgcaggggggacagtgctgtactcaaacagggactcccgcccaagggtaagaaggcttggtgctgggcctcgtatctggaggaggaaaaggctgtcgctgttcccgctaaactgtttaaggagcatcaatcattcccttataacaaaaatggttttaaagtcggaatgaagttggagggggtcgaccccgaacaccagtccgtgtactgtgtgctgacagttgccgaggtgtgcgggtaccgaattaagctgcatttcgatggttattccgattgttacgatttctgggtcaacgccgacgcgctggacattcacccagtcggctggtgtgaaaaaactggccataagctgcaccccccgaaaggatacaaagaggaggagtttaactggcaaacttaccttaagacctgtaaggcacaggctgcgccgaagagtcttttcgagaatcagaacataaccgttattccatcggggttccgtgtgggcatgaagttggaagctgtggataagaagaaccctagcttcatctgcgtcgcaacagttacggacatggtcgacaatcgtttcctggtgcacttcgacaactgggacgagtcgtatgattactggtgcgaggcgagcagccctcacattcaccccgtgggatggtgcaaggaacacaggaggacgctgatcactcctcccgggtaccctaacgttaagcactttagctgggataagtacctggaagaaactaacagcttgccagcccccgctagagcatttaaagtgaaaccccctcatggattccaaaaaaagatgaagctggaggtggtcgacaagcgcaatcctatgtttatccgggtggccaccgtagctgacaccgatgatcatcgagtgaaggtgcatttcgacggatggaataactgctacgactactggatcgacgctgactcccctgatatccatccagtaggttggtgttcgaaaacaggacacccactccaacctcctttgtccccactggagctaatggaggcatccgagcacggaggctgcagtacccctgggtgcaaaggaatcggacatttcaaaagggcccgccatctcggtccgcacagtgccgctaactgtccatactcagagattaatctgaataaggatcgaatcttcccagataggctgtctggcgaaatgccccctgcttctccgtcttttccccgcaacaagcgaactgacgcaaatgaaagctcaagctcacctgaaattagagaccagcacgccgacgatgtgaaggaagacttcgaagagagaaccgaatctgaaatgagaacgagccacgaagcgaggggtgctcgggaagagcccacagttcagcaagcccaaagacgatccgccgtcttcttgagctttaagagccccatcccttgtctgcccttgaggtgggagcagcagagcaagctgttgccgacagtcgccggcattccagcatctaaagtgtcaaaatggtctactgacgaagttagcgagtttatccagtccctgccgggctgcgaagagcacggtaaagtgtttaaggacgaacagatcgatggggaggctttcctgctaatgacacagaccgatatcgtgaagatcatgagcatcaagctgggccctgctctgaagatcttcaattcaattctgatgtttaaagcggctgaaaagaatagccataacgagctgtag

SEQ ID NO: 12216 - DNA, 2268 bp, Artificial Sequence
  Description of Artificial Sequence: Synthetic coding sequence
atgacggagtccgcatcgtccaccagcgggcaggagtttgacgttttttcggtgatggactggaaggatggcgtcggcacgctgcctggtagcgatttgaagtttcgggtgaacgaattcggcgctctggaagttataactgatgaaaacgagatggagaatgtgaaaaaggcaaccgcgaccaccacgtggatggtgccaacggcacaggaggtgtttagtgaaaaaacaggaatgccattccgacttaaagaccccgtcaaggtagagggtttacagttttgtgagaattgctgtcaatacgggaatgtggatgagtgtttatccggcggcaactactgttctcaaaactgcgctaggcacattaaagacaaggaccagaaagaagaaagggatgtggaagaggataatgaagaggaagatcccaagtgttcccggaagaaaaagcccaaactctcgctgaaggcagacactaaggaagatggagaagaaagggatgatgaaatggagaacaagcaagacgtgagaatcctccgcggttcacaacgagccagacggaaacgcaggggggactctgctgtactaaaacaagggcttccacccaagggaaagaaggcctggtgttgggcatcctacctggaagaagagaaggcagtagctgttcctgcgaaattgttcaaagaacaccagtcctttccttataataagaacggtttcaaggtggggatgaagctcgaaggcgtggatcctgagcaccagtccgtctattgtgtgctgaccgtcgccgaggtgtgcggttacaggattaagctccatttcgacggatacagcgactgttacgacttttgggtcaatgccgatgccctggatatccacccggtgggttggtgtgaaaaaacggggcataagcttcatccccccaaggggtataaggaagaggagttcaattggcagacgtacctgaagacttgcaaggctcaggccgcaccgaaaagcctatttgagaaccaaaatattactgtgattccgagcggcttccgggtgggaatgaagttagaggcagtagataagaagaatccctcgttcatttgcgtggcaaccgtgactgacatggttgacaatagatttttagtgcacttcgataattgggacgaaagttacgactactggtgcgaagcctccagccctcacattcaccccgtggggtggtgcaaggaacacagacgcaccttaatcacgccccccggttacccgaatgttaaacatttcagctgggataagtacctcgaggaaaccaacagcctgcccgctccggccagagcctttaaagttaaacccccccacggattccagaaaaaaatgaagctggaggtcgtggacaagcgcaatcccatgttcattcgggttgccactgttgccgatactgacgatcatcgtgtcaaggtgcatttcgatggatggaacaactgttatgattactggatcgatgctgacagccccgacatccaccccgtggggtggtgctccaaaaccggccatcctctgcagccaccccttagccccctggaactgatggaagcatccgagcacggcggatgctctacccccgggtgcaagggcattggtcacttcaagcgggcccgccatctcggcccccactctgctgccaactgcccatacagcgagataaatttgaataaggaccgaatcttccccgacagactgtctggggaaatgccaccagcaagcccgtctttcccccgcaataagcgcacagacgccaacgagtctagcagtagtcctgaaattagagaccagcacgctgacgatgtgaaagaggatttcgaagaaagaacagagtcagagatgagaactagccatgaggctcggggagctagggaggagcctactgtgcagcaagcccaacgacgctcagccgttttcttgtcattcaagtcccctatcccgtgcctgcctctccggtgggagcagcagtctaagctgttaccgacagtagcgggcatacccgcctctaaagtaagtaaatggtcgaccgatgaagtaagcgagttcatccagtcccttcctggttgcgaggaacacggaaaggtgttcaaggacgagcagattgacggagaggccttcctgctgatgacgcaaaccgacatcgtgaagatcatgtctattaagcttggacccgcgcttaagatcttcaactctatcctgatgtttaaggctgcagaaaagaattctcacaatgaactctag

SEQ ID NO: 12217 - DNA, 1872 bp, Artificial Sequence
  Description of Artificial Sequence: Synthetic coding sequence
atgaaacagcccaaccgaaagaggaaactgaatatggatagcaaggagaggctcgaccaagacggcagactggagcaggcagaggaggagaaaaaaccaaaggacagtacaacgccgctgtcacatgttcccagcgcagctgcacagggcgcatggagctgggaatggtatctaaaagaacagaaggcagtcgcagcaccggttgaacttttcagcaaagatcagtccttccccgaacacgaaaatggatttcaaatcggcatgagactggaggggatcgaccccagacacccttcagtattttgcgtcttatctgtagccgaagtgtgtggctaccgcctgcgactccatttcgatgggtatctgtcttgctatgacttttggacaaacgcaggcagcccagacatccacccagtgggctggtgtgaaaagacaaagcacgaattgcacattccaaaaggctaccgcaaggataagttcgtttggatggattatctgaaggcctgcaagctccagaatgcccccaagaaacttttcagaaacaggtctccgaacgggccgatgtctaaagagttccaagtgggcatgaagttggaagccgtggaccgaaaaaatccaagtctagtgtgcgtcgctactatcgcagatattgtagaggatagactactggtccacttcgacaactgggatgattcgtacgactattggtgcgacgtgaactcaccgtacgttcagcctgtcggctggtgccaagaaaatggtagaactctcatcgctccccaaggctatcccaacccagaaaatttctcgtggacagagtacctcgaggctacgcagactaacgctgtgcccgctaaggtgttcaaaatgagactcccgcacgggttcctgcccaacatgaagctagaggtggtggacaaacgcaatccgagacttatccgagtggccacaatagtggatgtcgatgatcaacgcgtaaaagttcacttcgatggctgggaccacaaatacgactattgggtggaggctgacagccccgacatacaccctatcggctggtgtgatgtaacggggcatcccttggaggtgccacagcgcaccaacgatttgaagatcctgcctgggcaggccgtctgtcctactccggggtgtagaggtattggacacatcagaggacctaggtactccggtcaccacagcgccttcgggtgtccatatagcgacatgaatctcaagaaggaggccaccctgcacgataggctgagggagcagacacaggctaacctggagtcagactcatcccatagcaagtcaaagtccttatgctctctgaattttaatggtaaacacgagaaggtaaactctcagcccagactcgtgcagcaggcaaagtgtctgaagattaaaggcaaagaggacatcgacctcgacaacctcttccgtgtcctggtgctacacccccgtggccttgaatatagcgtcgaacaggcgcagcaggtgttacatcaatctgtctccatgtccacagtatctgcgcaccccttcagggatttacctttagggagggaacaacattgtaagctgctgcccggtgtggccgacatccgggcctcccaggtggcccgctggacggttgacgaagtcgcggaatttgtgcagtcacttctggggtgtgaggaacacgccaagtgcttcaagaaggagcagatcgacggcaaggcatttctgctgttgacccaaaccgacattgtgaaggttatgaagatcaaactcggacccgcgctgaagatatataactctatcctgatgttccgccattctcaagaactgccggaggaagacatcgctagtgggcaggaagtccgcggctag

SEQ ID NO: 12218 - DNA, 1872 bp, Artificial Sequence
  Description of Artificial Sequence: Synthetic coding sequence
atgaaacagcccaaccgtaaaagaaaactcaacatggattccaaagagcgcctggaccaggatgggcgcctggaacaggcagaagaagaaaaaaaacccaaagatagcacaactcccctgagtcacgtgccatccgccgctgctcaaggggcctggtcttgggagtggtatctgaaggaacagaaggctgttgccgcccccgtggaacttttttccaaagaccagtcgtttccagaacatgaaaacggctttcagattggtatgaggttggagggtattgacccacgccatccatcagtcttctgtgtgctcagtgtcgccgaggtttgcggttaccgcctacgcctccacttcgacggatacctctcatgttacgacttctggaccaacgcaggctcccccgatatccaccctgtaggctggtgtgagaagaccaaacacgagcttcatatcccgaaagggtatagaaaagataaatttgtgtggatggattaccttaaggcctgcaagctgcagaacgccccgaagaagttgttcaggaatcggagtccaaatggaccgatgtccaaagaatttcaggtgggtatgaaactggaggcagtcgataggaaaaacccatctctggtgtgcgtggcgaccatcgcagacattgtggaggatcggctgctggtgcacttcgacaattgggatgacagctacgactactggtgcgatgtgaattctccctacgtgcaaccggtggggtggtgccaagagaatgggcgtactcttattgccccacagggttatccaaatcctgagaatttctcctggacagagtaccttgaggctactcaaacgaacgcagtgcctgctaaggtcttcaaaatgcgtctgcctcacgggttcctccctaacatgaagctcgaggttgttgataagagaaatccacgtctcatccgcgtggctacaattgttgatgttgacgaccaacgggttaaggtacattttgacggttgggaccataaatatgattactgggtggaagcagactctcccgatatccatcctatcggctggtgtgacgtgacagggcaccctctggaggtcccccagaggacaaacgatctgaaaatcctccctgggcaagcagtgtgccctacacctggctgtagaggcattggccacatcagaggccctaggtactctggccatcattccgctttcgggtgtccttatagcgacatgaatctgaaaaaagaggcgaccctacatgacagacttagagaacagacacaggcaaacttggaatctgattctagtcatagcaaatcaaaatcactgtgctccctcaatttcaacggcaaacatgagaaagtcaatagccagccccggctagtgcagcaagctaaatgcctgaagatcaagggcaaggaagatatcgacctcgacaacctctttagagtgctggtattgcacccaagaggactcgagtactccgtggaacaagcccagcaggtgcttcatcagagcgtgtcaatgtctactgtctcggctcaccccttcagggatctccccctgggcagggagcagcattgtaagttattacctggcgtagcagacatcagagcctcccaagttgctcgctggaccgtagacgaagtggcggagttcgttcagtcccttcttggctgtgaggagcatgccaaatgctttaagaaagaacaaatcgatgggaaggcattcctcctgctgacccaaactgacatcgttaaggttatgaagatcaaacttggtccagccttgaagatctacaactcgatattgatgtttagacatagccaggaactgcctgaagaggacatcgctagcggccaggaggttcggggctag

SEQ ID NO: 12219 - DNA, 1284 bp, Artificial Sequence
  Description of Artificial Sequence: Synthetic coding sequence
atgagcaaggagttccaggttggtatgaaactggaggccgtcgatcgcaagaatcctagcctcgtgtgtgtcgcgaccatagccgacatcgtcgaggacaggttgctggtgcattttgacaactgggatgattcctacgactattggtgtgacgtgaatagcccttacgttcagccagttggatggtgtcaagaaaacggaaggaccttaatagccccacagggctatccaaacccagagaattttagctggactgaatacctggaagcaacgcaaactaatgcggtcccagctaaagtgttcaagatgcgcctgccacacggtttcctcccaaatatgaaactggaggtggtggataagaggaacccccggctcattagggtcgccactatcgtggatgtagacgaccagcgtgtgaaggtgcactttgatggctgggatcataagtacgactactgggtcgaggccgactcaccagatattcacccgatcggatggtgtgacgttactggtcacccccttgaggttccccagcggacaaatgatctgaaaatactgccagggcaagccgtctgccctacacctggttgcagaggcatagggcatattcgtggcccgcggtactctggtcaccatagcgctttcggctgtccttactccgacatgaatctgaagaaggaagcgaccctccatgaccgtctgagagagcagacccaggccaaccttgagtccgatagcagccacagcaaatcaaagtcactatgcagtctgaactttaatggaaagcacgagaaagttaactcccagcccaggctcgtgcaacaggcaaaatgtctgaagatcaaaggaaaagaggacattgatctcgataatctattcagggaatattcggtggagcaagctcagcaggtcctgcaccagtctgtgagtatgtcaactgtgagcgcacaccctttccgagatttaccacttggtagagagcagcactgtaaactactcccaggtgttgccgacatacgggcaagtcaggtcgctaggtggacggtcgatgaggtggcagaattcgttcaaagtcttctgggatgcgaggagcatgccaagtgtttcaagaaggaacagatcgacggaaaggctttcctgctgctaacacagaccgatatagtgaaagtcatgaagatcaaactgggccctgccctgaagatttacaattccattctgatgttccgtcattcccaggaacttcctgaggaggacatcgcatctggccaggaggtacgcggatag

SEQ ID NO: 12220 - DNA, 876 bp, Artificial Sequence
  Description of Artificial Sequence: Synthetic coding sequence
atgagttgggagtcaggggccggacccggcctgggatcgcagggcatggacttggtctggagtgcatggtacgggaagtgcgtcaagggtaaagggtctctgcccttgagcgcacacggcattgtagttgcatggttatctagggcagaatgggaccaggtgactgtgtatctgttttgcgacgatcataaactgcaaaggtacgctttaaaccgaattacagtctggcgctcccggagcggcaatgagctgccgcttgccgtcgcttccactgcggatttgatccggtgcaaactcctcgacgtgacagggggattaggaaccgacgagctgcgattgctttacggcatggccctggtacggtttgtgaatctgatttctgagcgaaaaactaaattcgccaaggtgcccctgaagtgcctagcacaggaggtgaacatacctgattggatagtggatcttcgtcatgaactaacccataagaagatgccacacataaacgactgccgaaggggatgttattttgttcttgattggctacaaaagacctactggtgccgccagcttgagaatagcctgcgagaaacatgggagctggaggagttccgtgaaggaattgaagaggaagatcaggaggaagataagaacattgtggtggatgacatcaccgaacagaagcccgagcctcaagacgatggcaagagcacagagagcgacgtgaaagccgatggtgacagcaagggctccgaagaagttgacagtcactgcaagaaagccctgtcccacaaagaactgtatgagcgcgcacgggagctgcttgtgagttacgaggaggagcagttcacaggcggctgtgccggatgtttctcagggtag

SEQ ID NO: 12221 - DNA, 2028 bp, Artificial Sequence
  Description of Artificial Sequence: Synthetic coding sequence
atgagctgggagagcggcgcagggcctgggctagggagccagggaatggacctggtctggtcggcttggtatggaaaatgcgtgaagggaaagggatcgcttcccctgagcgcacacggtattgtcgtggcctggctgtcgcgcgctgaatgggaccaggtgactgtctatctcttctgcgacgatcacaaactgcagagatacgccctaaataggatcacagtgtggcgctcacgcttcgttaatctcatctcagagcggaagacgaagttcgcaaaggttccactcaagtgcctggcacaagaggtcaacatcccagactggatcgtagatctgcggcatgagttaacccacaagaaaatgccccacattaatgattgtcggagggggtgttacttcgtgttggattggctacaaaaaacttattggtgtcggcaattggagaattctcttagagaaacttgggaattggaggaatttcgagagggaattgaagaggaggatcaggaggaggacaagaatatcgttgtggacgacatcacagagcagaagcccgagccacaagacgatgggaaaagcaccgagtccgacgtgaaagccgacggggatagcaaggggtcagaggaggttgattcacactgcaaaaaggccctgagccacaaggagctgtatgaaagggccagagaactcctagtctcatacgaggaggagcagttcacagtgctggaaaagttccgctatctgcctaaggccattaaggcatggaacaatccgtctccacgggtagagtgcgtgctggcagaactgaaaggcgtgacctgtgaaaatcgggaggcggtgctggatgcctttctcgacgacggattccttgtgccgacttttgagcagttagccgccctccagatcgaatacgaagagaatgtggatctgaatgatgtccttgtaccaaagccattcagtcagttctggcagcccctgctgcgaggcctccactcacagaactttacgcaagccctgttggagcggatgttatccgagctccccgcattgggcatctcagggattaggcctacttacatcttgcgctggacagttgaactaatcgtggcaaacacaaagacagggcgcaacgctagacgcttctctgccggtcagtgggaagctaggcgcggctggcggctgttcaactgcagcgcttccctagactggccacgcatggtcgaatcttgcttaggctcaccctgctgggccagcccacagctgttgaggattatctttaaggcgatggggcaaggtctcccagatgaagagcaggaaaagttgctaagaatctgttcaatttacacacaatcgggtgaaaatagcctggtccaggaaggtagtgaggcatcgcctatcggtaagtctccatatacactggactccctctactggtctgtgaagccagccagctcctctttcggttcagaagctaaagcccagcaacaggaggaacaggggtcagtaaacgacgttaaggaagaggaaaaggaggagaaagaagtactgcctgatcaagtagaggaagaagaagaaaacgacgatcaggaagaagaggaagaagatgaggacgatgaagacgacgaagaagaagatagaatggaagtgggccctttctctacagggcaagagtctccaacagccgagaacgcccgccttctcgcacagaagcgtggggcattacaggggtctgcctggcaggtgtcctctgaagatgtgcgatgggacacttttcctctagggcgcatgcctggccaaacagaggatcctgccgagctcatgctggagaattatgacaccatgtatctgctggatcaaccagtactcgagcaacggctagaaccgtccacttgcaaaaccgatactctgggactttcttgtggagtcggttcaggcaattgctctaattcgagttcctctaacttcgagggacttctatggtctcaggggcagcttcatggtctgaagaccggtctccagctgttttag

SEQ ID NO: 12222 - DNA, 2154 bp, Artificial Sequence
  Description of Artificial Sequence: Synthetic coding sequence
atgagttgggagtcgggcgcagggcccggactcggctcacagggcatggatctcgtctggtccgcatggtatggtaagtgcgttaagggaaagggtagtctgcctcttagcgcacacggcattgtcgtcgcctggcttagccgggccgagtgggatcaggtaaccgtgtatctattttgcgatgaccataagctgcagagatacgctttgaatcgaataacagtgtggcggtctcggtccgggaacgaactgccattggctgtcgctagtacagccgacctgatccgttgcaagcttcttgacgtaacgggcggactcgggacagatgaacttcgtttgttgtacggaatggcactggtgagatttgttaacctgatttccgaaagaaagacaaaatttgccaaagtgccacttaagtgtctggctcaggaagtgaacatcccagattggatagtggatttaagacatgaattgacccacaagaagatgccccacattaacgactgtagaagaggttgttactttgtgctggactggctacagaaaacctattggtgccgccagctggagaacagcctgcgcgaaacatgggaactcgaagagtttagggaggggatcgaggaggaggatcaggaagaggataagaatattgtggttgatgatattactgagcagaaaccagagccacaggacgatggcaaatctaccgaaagcgatgtgaaagctgatggcgacagcaagggaagtgaggaagtagactctcactgcaaaaaggcattgtcacataaggaattgtacgagcgggctagggagctgcttgtcagttatgaagaggagcagtttacagtgctagagaagtttagatacctgcctaaggcaatcaaggcttggaacaaccctagcccacgtgtggaatgcgtgcttgccgagcttaaaggagttacttgcgagaaccgcgaggccgtcttagacgcctttctcgatgacggtttcttggtgccgacttttgagcaactcgccgctctgcagattgagtacgaagagaatgtagacctcaatgacgtattagtaccgaaacccttctcacagttctggcaaccgctcctgagaggtttgcattcccagaattttactcaggccctgttggagcggatgttgtccgagctgccagccctcggaattagtggaattaggcccacatacatcttacgctggacggttgaattgatcgtcgccaacacgaaaactggcagaaatgcacgcagatttagcgccggccagtgggaggctcgaaggggctggcggctctttaattgctcagcttctctcgactggcctcggatggttgagtcatgcctggggtctccctgctgggctagcccccagctgttacgcatcattttcaaggctatggggcagggcctgccagatgaggaacaggagaagcttctgcgcatttgtagtatctatacccagagtggcgagaactcgctggtccaggagggatctgaggcatcgcccatcgggaagagtccctataccttagattccctgtactggtctgtcaagcctgccagttcaagtttcggctctgaggctaaggcccaacagcaggaggaacaaggcagtgtcaacgacgtgaaggaggaggagaaagaagagaaagaagtcctgcccgaccaagttgaggaggaggaggagaacgatgaccaggaagaggaggaggaagacgaggatgatgaagatgacgaggaggaagaccgcatggaagtaggtccgttcagcactgggcaggaatcccctaccgccgaaaatgccagattgctggcccagaagaggggcgcgctccaggggtcagcgtggcaggtttcatctgaagatgtacgctgggacacttttcctctcgggcgcatgccggggcagacggaggatccagccgaactcatgctggagaactacgacacgatgtacctgctggaccagccagtgcttgagcagcgcctagagccctctacttgcaagacagacacgctcggtctgagctgtggagtggggtccggaaactgctcaaactcctcttcctccaatttcgaaggcctactgtggtcacaggggcagctacacggcctgaagacgggattacaactgttctag

SEQ ID NO: 12223 - DNA, 2205 bp, Artificial Sequence
  Description of Artificial Sequence: Synthetic coding sequence
atgtcttgggaatcaggggctggcccagggctgggcagtcagggcatggacctggtctggtccgcatggtacggcaagtgtgttaaaggcaaaggatccctgcccctgtcagcacacggcattgtcgtcgcttggctgagtagggcggagtgggaccaagttaccgtgtacctgttctgtgacgaccataaattacaaaggtacgcgctcaaccgcatcaccgtctggagatcccgctcaggtaatgagctgccgctggctgtggcgagcacagccgacctgattcgctgcaagctcctggatgtcacaggcgggctcggaactgacgaactccggctcctgtatggtatggcattggtgcggtttgtcaacttgatcagtgaaaggaagacaaagttcgctaaagtgccactgaagtgtttggcccaagaagtaaatatcccagactggattgtcgatctgagacatgaactgacccacaagaagatgccacacattaatgactgtcgacggggctgttacttcgtgctcgattggctacagaagacgtactggtgccgccagttagaaaactctctgagagagacatgggagctcgaggagttccgggaggggattgaggaggaagaccaggaagaagataagaacatagttgttgacgatataaccgagcaaaaaccagagccccaggacgatggaaagagcactgagtcagacgtgaaggccgatggtgactcgaagggttccgaggaggtggactcccactgtaagaaggccctgtcccacaaagaattatacgagagggcccgcgagttgctggtgtcgtacgaagaggaacaatttacagtccttgagaaatttcgctacctcccgaaggctatcaaggcatggaataacccctctcctcgcgtcgaatgcgtgcttgccgagctgaagggggtgacctgcgagaacagggaagccgttctggacgcatttcttgatgatggatttctggtgcctactttcgaacagctcgccgccttgcagattgagtacgaagacggacaaaccgaagtccagcgcggggagggcactgaccccaaatcccacaagaacgtggacctgaatgatgttctggtacccaaacctttcagtcagttctggcagcctctgctgagaggactccattcccagaacttcactcaagccctgctggagcgcatgctcagtgagctgccagcgctggggatttccgggattcgccctacctacatattaagatggactgtagaactgatcgtcgctaatacgaagaccgggcgaaatgcacggcggttttctgccggccaatgggaggcccggcgtgggtggcggctgtttaattgcagtgcatccctggactggcctaggatggtcgagtcatgcctcggctccccatgctgggcatcacctcaattgctgcgtattatttttaaggccatgggacaggggctaccagatgaagagcaggaaaagctgctgcggatctgctccatttacactcaatctggtgagaattcccttgtccaggagggcagcgaagccagtcctatcggcaagtccccctataccctggatagcctctattggagcgtgaagcccgcttcatcatccttcggctccgaagcaaaggcccagcaacaggaggaacagggaagcgtgaatgatgtgaaagaggaggagaaggaagagaaggaggtgctgcccgaccaggttgaggaggaagaagagaatgatgaccaggaagaagaagaggaagacgaggacgacgaggacgacgaagaggaggataggatggaagtaggaccatttagcaccggacaggagagtcccaccgcggaaaatgccaggcttctagcacagaagagaggagccttacagggaagtgcctggcaggtttcttctgaggatgtccgctgggacacttttccgttgggcaggatgcctggacaaactgaagatcccgcggagctgatgctggagaattatgacaccatgtatctcctggatcagccagtactggagcagagactggagccaagcacatgcaagaccgataccctgggcctgtcatgcggcgtcgggtctgggaattgttctaatagctcttcatctaacttcgagggcctgctctggagtcagggacaattgcatggcctcaagaccggactgcagctcttttag

SEQ ID NO: 12224 - DNA, 507 bp, Artificial Sequence
  Description of Artificial Sequence: Synthetic coding sequence
atgtctcttactcatcgactgcacctctgtaagtactggggttgtgctgttagcaatgtgtgccggttctgggagggacgcccccttccactgatgatcgtggttccatatacactccctgtgtccctgccggtgggctcgtgtgtaatcataacaggtacgccaattttaacattcgtaaaggatccgcagcttgaggttaacttttacactggcatggatgaggactctgacatcgccttccaattccgtctgcactttggacatccagccattatgaactcatgtgttttcggaatctggagatatgaagaaaagtgttattaccttccttttgaagatgggaaaccttttgaactgtgtatttatgtacgccacaaggaatataaagtaatggtaaatggccagcgtatttacaatttcgctcatcgctttcctcctgctagtgtgaaaatgctgcaggtgttccgcgacattagtctcacccgggtgttaatctccgattag

SEQ ID NO: 12225 - DNA, 420 bp, Artificial Sequence
  Description of Artificial Sequence: Synthetic coding sequence
atgtcctctctgcctgtgccctataccctgcctgttagtcttccggttggtagctgtgtaataattacaggcacgccgattctcacattcgtaaaggacccccagctggaggtgaatttttatacaggaatggatgaagatagtgacattgcgttccagttccgccttcattttgggcaccctgccatcatgaattcctgcgtgtttggaatctggagatatgaggaaaagtgctattatcttcccttcgaagatggcaagccctttgagttgtgcatttatgtgcgccacaaagaatataaagtaatggtgaacggacaacggatttacaactttgctcatagatttcctccagcctccgtgaagatgcttcaagtgttcagggatattagcctaaccagggtgctaatcagtgactag

SEQ ID NO: 12226 - DNA, 1314 bp, Artificial Sequence
  Description of Artificial Sequence: Synthetic coding sequence
atggcccgggtggcttggggtctgctctggcttttactggggtccgccggcgcacagtacgagaagtactcattcaggggttttccaccagaagaccttatgcctctggctgcagcgtatggacatgccctggaacaatatgagggagaatcgtggagagaatcggctaggtacctggaggcagccctgcgattgcataggctattgagggactccgaagcgttttgccatgccaattgctcaggtcccgccccagccgcaaaacctgaccccgatggaggaagagccgatgaatgggcctgcgagctgcgacttttcggcagggtgctggaaagagctgcttgtcttcgacggtgcaagaggaccttgcctgcattccaggtgccttacccaccccggcaactactgcgtgacttccaatccaggttgccataccaatacctacactacgccctgttcaaggctaatagactggagaaagccgtcgccgcagcctatacctttctgcagagaaatcccaaacacgaacttactgccaaatacctgaactactaccaggggatgctggacgtggccgacgagtctcttacagacctggaagcccaaccttatgaagccgtctttcttcgagcggtgaaactgtataacagcggagatttccgatcctctactgaagatatggaaagagccctcagcgagtatctggctgtattcgcacggtgtctggcgggctgcgagggcgcacatgagcaggtagacttcaaggacttttaccctgcaatcgccgatctgttcgccgagtctcttcaatgtaaggtcgattgtgaggccaatctgaccccaaacgtcggaggctattttgtcgataaattcgtggcaacaatgtatcattacctgcagttcgcttactacaagttgaacgacgttagacaggctgcacggagcgctgcctcgtatatgctgttcgaccctaaagacagcgttatgcagcagaatctcgtgtattatagattccaccgtgcccgatggggcttagaagaggaggactttcaacctagagaagaggctatgttgtaccataaccagaccgcagagttgcgggaactgctggagtttacccacatgtacctgcaatctgacgacgaaatggaactggaagaaaccgaaccaccactggagcctgaagacgccctttccgacgcggaattcgagggtgaaggagattatgaagagggcatgtacgctgattggtggcaggaaccagacgcgaagggcgacgaagctgaagcggagccagagccggagttggcgtag

SEQ ID NO: 12227 - DNA, 1314 bp, Artificial Sequence
  Description of Artificial Sequence: Synthetic coding sequence
atggctcgggtagcatggggactcctgtggctgttgctcggtagcgccggcgcccagtacgaaaagtactcatttcgagggttccccccggaggatctcatgccactggccgccgcatatggccacgccctggagcagtatgaaggcgaatcctggcgcgagtctgctcgatacctcgaagccgccctgcgactacatagattgttgcgcgattccgaggccttttgtcatgctaattgctcaggtcccgccccagccgcaaaacctgatcctgatgggggacgagctgacgagtgggcttgcgaactccgtctattcgggagagtactcgagcgcgcagcctgcctgcggaggtgcaaacgcaccctacctgcctttcaagtgccctacccaccacgccaactcctccgggacttccaatcaaggttaccttaccagtacttacattacgcactcttcaaagccaaccggctggaaaaggccgtggcagcagcctacacattcttgcagcggaatcctaaacacgaactgacggccaaatatctgaactattatcaagggatgttggatgtggctgatgaatctctcactgacctcgaggcccagccttacgaggcggtcttcttacgtgctgtaaagttatacaatagcggtgatttcaggtcctcaaccgaagacatggaacgcgcactgtccgagtacctcgccgtgttcgctcggtgtcttgccggctgcgagggcgcccacgaacaagtagattttaaagacttctatcctgctatcgccgatctcttcgccgagagtctccagtgcaaggtagactgtgaagccaatctaacccctaatgtgggcgggtattttgttgataagtttgtagctacaatgtatcattacctgcagtttgcatattacaagctcaacgatgttagacaagccgcccggtcagctgccagctatatgctgttcgaccccaaggattccgtgatgcagcagaacctggtctactacaggttccacagggcgagatgggggttagaagaggaagactttcagcctcgggaggaagctatgctataccataaccagacagccgagctgcgtgaactactggagttcacacacatgtatctccagtcagacgatgaaatggagcttgaggagactgaaccgccgctggaaccagaagatgccctcagcgatgccgagtttgagggcgagggagattatgaagaaggaatgtatgctgattggtggcaagaacctgacgcaaagggagatgaagcagaagcagaaccagagcccgaactagcatag

SEQ ID NO: 12228 - DNA, 1281 bp, Artificial Sequence
  Description of Artificial Sequence: Synthetic coding sequence
atggcccgggtggcatgggggttgttgtggctgctcctgggatccgctggggcccaatacgaaaagtattctttccgggggttccctcccgaggacctcatgcccttggctgccgcctacggtcatgcactagaacagtacgagggagagagttggagagagagtgcccgatatctggaagccgctctacgcctccaccgtcttttgagggatagtgaagcgttttgtcatgccaattgttcagggcccgctcccgccgccaaacccgatcctgatggggggcgggctgacgagtgggcatgcgaacttaggctgtttggtagagtactggagcgcgcggcgttccaggtgccttaccctccgcgccaactgctccgggactttcagagtagactgccgtatcagtaccttcactatgctctcttcaaagccaatcggctggagaaggccgtcgccgccgcttataccttcctgcaacggaatcccaaacacgagttgacagcaaaatatttgaattattaccaaggcatgctggatgtggccgatgagtcccttactgatttggaggcccaaccttacgaagccgtattcctcagagcagtgaagctctacaacagcggagacttccgctccagtacagaggacatggagagggcgctgagtgagtatctggcagtgttcgcaaggtgtctagctggatgcgagggggcacacgagcaagtggattttaaagacttctatcctgccattgccgatctgttcgctgagtcgcttcaatgcaaagtggactgtgaggcaaacctgacccctaatgtgggggggtatttcgttgataaatttgtggcgaccatgtaccattatctacagtttgcatattataagttgaacgacgtgagacaagcagctaggagcgctgcctcctatatgctgttcgatcctaaagattccgttatgcaacagaacctcgtgtattaccggtttcatcgcgctagatgggggctcgaagaggaggacttccagcctcgggaggaagccatgctctatcacaatcaaacagccgagcttcgggagctgctggagttcacccacatgtatcttcagagcgacgacgagatggagctagaagagacggagccgcccctagaacccgaagatgcactgagcgacgcagaattcgagggagagggcgactacgaagagggaatgtacgctgactggtggcaggagccagatgccaaaggagacgaagccgaggcagagcccgagcctgagctcgcgtag

SEQ ID NO: 12229 - DNA, 942 bp, Artificial Sequence
  Description of Artificial Sequence: Synthetic coding sequence
atggcttcgtttcgaaaattgaccttatctgagaaggttccccccaaccacccatctcgcaagaaggtgaacttcctcgatatgtcactggacgacataataatatataaggagctggaaggcaccaatgctgaagaggagaagaacaagaggcaaaaccactctaaaaaagagtcaccaagccgacagcaaagcaaagcccacagacaccgccatcgaaggggctatagccgttgtagaagcaacagcgaggaggggaaccatgacaaaaaaccctcccagaaaccaagcgggttcaaatccggtcagcacccgcttaacggccagcctctaatagaacaggagaaatgtagcgacaattacgaggcccaggctgaaaaaaatcaggggcagtccgaggggaatcagcatcagagtgaagggaacccggataaatccgaggagagccaaggacaaccagaggaaaaccaccacagcgagcggagccggaatcaccttgaacgatctctgtcacagtctgatcgttcccagggccagttaaagcggcaccatccgcagtacgaacgatcccacggacagtacaagcgctcgcacggacagagcgagaggagccacgggcatagcgagagatctcatgggcacagtgagagatctcacggccattccgagagatcccacggtcacagcaagcggagtcgcagccaaggggatctggttgacacacagagcgacctgatcgccacgcagcgggatttgattgccacccagaaggatcttatcgcgacgcagcgagacctcattgcaacccagagagatttaattgtcacccagcgcgatttggtggctacagagcgagacctgattaaccagtctggccggtcacacggtcagtcagaaaggcaccagagatactccacaggtaagaatactatcacgacctag

SEQ ID NO: 12230 - DNA, 237 bp, Artificial Sequence
  Description of Artificial Sequence: Synthetic coding sequence
atggccagtttccggaagttgaccttgtctgagaaagtgcctcccaatcaccccagccgcaaaaaggtgaacttcctggatatgtctctggatgacattatcatatataaagaactggagggcactaatgccgaagaggaaaagaacaagaggcagaatcactctaagaaagaatcaccaagtcgtcagcagagcaaagctcaccgtcaccggcacagacggggcgaggtgcagtag

SEQ ID NO: 12231 - DNA, 696 bp, Artificial Sequence
  Description of Artificial Sequence: Synthetic coding sequence
atgctcaaaaaaaaaagaatcaaggatcgcactatcgtaaagcgcaacagactccaagacagtaatcagaagcttatcgatatcgccataggtgaagaaaaatgttccgataactacgaggcacaggccgagaaaaatcagggtcagagtgagggaaatcagcaccaatccgaaggtaacccagacaaaagcgaggagtcacaggggcagccagaggaaaatcatcactcagagagaagtaggaaccatctagagcggtccctgtctcagagcgaccggtcccagggccagctgaagcgccatcaccctcagtatgagcggtcgcacggacaatacaagcggagtcacggccagtccgaacgatcccacggacacagtgaaagatcccacgggcattccgaacggtctcacggacactccgaaaggtcccatgggcatagtaagaggtcgcgctcgcagggtgatctcgtggacactcaaagcgatctcatagcaacccagcgggacctgatcgctacgcagaaggatctcattgccactcagagagacttaattgccactcagcgtgacttgattgtgacacaaagggacctggtggcaacagagagagacttaataaatcagtccggtcgtagtcacggacaaagcgaaagacaccagcgctactcaacgggtaagaataccatcacgacctag

SEQ ID NO: 12232 - DNA, 1944 bp, Artificial Sequence
  Description of Artificial Sequence: Synthetic coding sequence
atgggacccttatccgcgaggcttctcatgcagcgtggtaggcccaaaagcgataggctaggcaagataagatcactagacttgagtggtctggaactcttgtctgagcacctggatcctaaacttctgtgcaggcttactcagctgcaggagctggatttatcaaacaatcacctggagacactgcctgacaacctaggcctgagccatctgcgggtgttgaggtgcgctaacaaccagctcggcgacgtcacagcactgtgccaatttcctaaacttgaggagctgtcactagagggcaacccttttcttactgttaatgataacctgaaggtgtcctttctgctgcctaccttgagaaaagtgaacggcaaggatgcctctagcacctacagccaggtggagaacctcaaccgcgagctgacaagtcgtgtgacggcccattgggagaagttcatggccactctcggccccgaggaggaggcggagaaggcacaagccgattttgtcaagagcgctgtgagagacgtacggtacggccctgaatcgctctctgaatttacacaatggagagtgcgaatgatctcagaggagttggtggcagcctctcgtacacaagtgcagaaagccaacagccccgagaagccccctgaagcaggggcggctcataaacctcgtgcgcgtttggccgcccttaaaagacccgatgacgttcctctgtctttaagcccttcaaaacgtgcatgtgcttctccctctgcacaagtcgagggcagccctgtagcgggctccgatggaagccagccggcagtgaagctggagcccctgcatttcctccagtgccactccaagaacaatagcccccaggatctggaaactcagctttgggcctgtgccttcgaacccgcctgggaggaaggcgcaacgtcccagacagtggccacatgcggaggcgaggccgtttgtgtgatcgactgtcagacagggatcgttttgcataaatacaaggcgcccggtgaggagttcttttcggtagcatggaccgccctgatggtggtgacacaagccgggcacaagaagcgctggagtgtcctggcagcagctggactgcgcgggttagtccggctcctgcatgtgagggcgggattctgttgcggagtcatcagagcccataaaaaggctattgctacattgtgttttagccctgcacacgagacgcatttgttcactgccagctacgataaaaggataatcctgtgggatattggggtgcccaatcaagactatgaattccaggcctcccagctcctgactctggacactaccagtatacccctcaggctgtgtcccgtggcttcgtgtcccgacgcccggctgttagctggttgcgagggcggctgttgctgctgggatgtgcggctggaccaaccacagaagcgacgggtctgtgaggtcgagttcgtatttagtgaagggtccgaagcctccggtagacgcgtcgacggacttgcctttgtaaatgaggatattgtagcctcaaaagggtctggcctgggaacgatttgcctttggtcatggagacagacatggggtggccgtggtagccagagcactgttgcagtcgttgtcctggcacgtctgcaatggagttccaccgagttggcctacttttccttgtcagcatgtcccgacaaggggatcgtgctgtgcggtgacgaggagggcaacgtctggctgtacgatgtttcaaatatccttaagcagcctcccctactcccagcagccctccaggcgccaacacagatcctcaaatggcctcagccctgggcactcggccaagtcgttactaaaaccatggtcaacacagtcgttgccaacgcttccttcacttatctgaccgccttgaccgacagtaacatcgtcgccatctggggtaggatgtag

SEQ ID NO: 12233 - DNA, 2310 bp, Artificial Sequence
  Description of Artificial Sequence: Synthetic coding sequence
atgagcaataatctgcggcgcgtctttttaaagccagctgaggagaacagcggcaacgcgagtagatgcgtgtcgggatgcatgtaccaggttgtgcagacaattggcagtgacggtaagaatctgctgcaattgctacctatccctaaaagcagtgggaacctgataccactcgttcaatcttcggtcatgtcagacgccctcaaggggaataccggcaagcccgtgcaggtgacattccagacacagatcagttctagcagcacatcagcctctgtgcagctacccatttttcagccagcaagtagtagcaattactttctgactaggactgtggatacctctgagaaagggcgggtgacctcggttgggactggcaacttctcgtccagcgtgtccaaggtgcagtctcacggggtgaagattgatgggctgacgatgcagacctttgctgtgcctccctctacccagaaagattcatcattcatcgtggtgaacacacagagtctgcccgtcaccgttaaaagtccggtcctgccaagcgggcatcacctgcagatccccgcacatgccgaagtcaagtccgtgccggcctcaagcctccccccttccgtacagcagaagattttagccaccgctaccacatctacgtctggaatggtggaagcgtctcagatgcctacggtaatttatgtcagcccagtcaacacggttaagaacgtggttacaaaaaattttcagaatatctaccccaagcctgtcactgaaatcgctaagcctgtaatcctcaatactacgcagatcccgaagaacgtggctaccgagactcaactgaaagggggccagcattcacaggctgccccggttaagtggatatttcaggataaccttcagcctttcacacctagccttgtgcccgtgaaatcctcaaacaatgtcgccagcaagatcctgaaaacatttgtggacaggaagaatctgggcgataacaccatcaacatgcctcctttgtctacgatcgaccctagcggcacccggagtaagaacatgccaatcaaagataacgccttagtgatgtttaatggaaaagtgtatttgctggccaagaaaggcaccgacgtgctgccctcacagattgaccagcagaacagcgtgtcaccagacacccctgtccgtaaggacacgctgcagacagtctcctcatctccagtaacggaaatatctcgcgaagtggtaaacatagtgcttgcaaaatccaaaagctctcagatggagaccaaatctctgtcgaatacccagttggccagtatggccaacctgcgcgctgaaaagaacaaagtggagaaaccaagtccgtccaccactaatccccatatgaaccagtcatcaaactatctcaagcagtccaaaacgctgtttacaaacccaatttttcccgtggggttcagcacaggccacaatgccccaaggaaagtcaccgctgtaatatatgcaaggaaggggagcgtgctccagagcatcgagaagatttcctcgagcgtggacgccacaacagtgacttcgcaacagtgtgttttccgcgatcaagagcccaaaatccataatgaaatggcaagcactagcgacaaaggcgctcagggaaggaacgacaaaaaagactcccaaggcaggtccaacaaggcactccatcttaagagtgatgccgaatttaagaagatatttgggctgaccaaagacttgagggtgtgtctcacgaggatccccgaccacttgacctccggagagggttttgactcattttcatccctcgtaaagagtggaacctataaagagacagagttcatggtgaaagagggggagcgtaagcagcagaatttcgacaagaaaaggaaagctaaaaccaataaaaagatggatcacatcaagaagagaaaaaccgaaaatgcctacaatgcaattatcaatggagaggccaatgtgaccggcagccaactcctatcttcaatcctccctacatcggacgtaagtcaacacaatatcctgacgagccactccaaaacaaggcaggagaagaggacagaaatggagtattacacccacgagaaacaggaaaaaggaaccctgaattctaatgccgcttacgaacaaagccatttttttaacaagaactacaccgaggatatcttccccgtgactccccctgaactggaggaaaccatccgcgatgaaaaaatacgtcggctcaagcaggtgctccgggaaaaggaagctgcccttgaggaaatgaggaagaagatgcaccaaaaatag

SEQ ID NO: 12234 - DNA, 702 bp, Artificial Sequence
  Description of Artificial Sequence: Synthetic coding sequence
atggcatcgacctctgacaagggcgcacaaggcaggaacgacaagaaggatagccagggtcggagcaacaaggccctgcacctgaagtccgatgcggagtttaaaaagattttcgggctcacgaaggatctgcgggtgtgcctaactagaatacccgaccatctcacttccggagaaggctttgatagcttctctagcctagtgaagtcaggaacatataaggagaccgaattcatggttaaggaaggcgagcgtaaacagcagaacttcgacaagaaacggaaagccaaaacaaacaagaagatggatcacataaagaagagaaagaccgagaatgcctataatgctataattaacggggaagcaaatgtgacgggatcccaattgctctcttcaattctacctacaagtgatgtctctcagcataatatactgactagccactccaagacccgacaggagaaaaggacagaaatggaatactacacccatgagaagcaggaaaagggcacacttaatagcaatgcagcttacgaacaaagtcattttttcaacaagaattacactgaggatatctttcccgtgacacctcctgaactggaagagactattagagatgaaaaaataagaagacttaagcaagtactgagagaaaaggaagcagcgttagaggagatgcggaagaaaatgcatcagaagtag

SEQ ID NO: 12235 - DNA, 702 bp, Artificial Sequence
  Description of Artificial Sequence: Synthetic coding sequence
atggccagcacttcggataagggagcccagggcagaaatgacaagaaagactctcagggaaggtcgaataaggctctacacctgaaatccgacgccgagttcaaaaaaatattcggactcaccaaggacttgcgggtctgcctcacgagaatccctgaccatctcacctcaggcgaagggtttgattccttttccagcctggtcaaaagcggcacctataaagagacagagttcatggtaaaggagggcgaaaggaaacagcaaaactttgataagaagcgaaaggcaaagacgaacaagaagatggaccacatcaaaaaacgaaaaacagagaacgcttataacgccatcatcaatggcgaagccaatgtgactggatcccagctgctaagcagcattttacccacgagtgatgtgagtcagcacaatatcctgacctctcactctaagacaaggcaggagaaaaggacggagatggagtattacacacatgagaagcaggaaaaaggcaccctcaactcaaatgcagcttacgagcagagtcatttctttaacaagaattacaccgaggacatcttccccgtaactcctcctgaactcgaggaaactatcagagacgagaagatacgcaggttgaaacaggttctccgcgagaaggaggccgcactggaggaaatgcgtaagaaaatgcaccagaaatag

SEQ ID NO: 12236 - DNA, 1134 bp, Artificial Sequence
  Description of Artificial Sequence: Synthetic coding sequence
atgtactggaagcatgagaacgcagcgcctgcattgccagagggctgtcggcttccagccgagggcggtcccgctaccgaccaggttatggctcagccaggctccgggtgtaaagccacaactagatgcctggaaggaactgcccccccagctatggcacagagcgacgcagaggctcttgccggcgcattagacaaggacgagggccaagccagcccttgcacaccctctacgcctagcgtgtgctcacctcccagcgctgcgtcatccgtaccttccgccggaaagaatatctgctcctcgtgcgggcttgagattttagatagatatctgctgaaggtaaataatctcatctggcatgttcgatgcttggaatgttccgtatgccgaacgtctttgcggcagcagaattcatgctatataaagaataaggagatattttgtaagatggattattttagtcgattcggcactaagtgtgcacgatgcgggcggcagatttacgcctccgactgggtgaggcgagcccgaggcaatgcatatcacctggcctgtttcgcctgtttttcttgcaaaagacaactgtcaaccggcgaggaattcggactggtggaagaaaaagtgctgtgtcgcatccactatgacacaatgatagaaaacctgaaacgagcagcagaaaacgggaatgggcttactctcgaaggagccgtcccatcagagcaggacagccagccgaaacccgcaaaaagagcacgcaccagcttcaccgcagagcagctgcaggtgatgcaagcccaatttgcccaggataataatcctgacgcccagaccctgcagaaacttgccgacatgacaggcttatctcggagggtgatccaggtttggttccagaattgcagggccaggcacaaaaagcatactccccagcatcccgtgcccccttccggggctcctccctccagactgccctccgccttgtctgacgatattcattacacccccttttcaagtcctgaacgcgctcgtatggtcaccctccatggctatattgagtctcacccattcagcgttctcactcttccagcgttgccccatctgcctgtcggcgctccgcagctgcctctctcacggtag

SEQ ID NO: 12237 - DNA, 1092 bp, Artificial Sequence
  Description of Artificial Sequence: Synthetic coding sequence
atggcacagccaggtagtgggtgtaaagccaccacaagatgcctggaaggcacagccccacctgccatggcacagtctgatgcagaagcgctggcgggcgccctcgataaggacgagggacaggcctcaccctgcacaccaagcaccccctccgtatgtagtcctccatcagccgcgtcctcggtgccttctgccgggaagaacatctgctcatcttgcgggctcgaaatcctggatcgctatctcttaaaggttaacaacctgatttggcatgtgaggtgcttagaatgttcagtgtgtcgcacctctttgcggcagcagaatagctgctacattaagaataaggaaatcttctgcaaaatggattacttttcacgcttcggtacaaagtgcgcaaggtgtgggcgccagatctacgccagcgactgggtgagacgagctcgcgggaatgcctaccacctggcctgtttcgcttgtttttcttgtaagcggcagctcagtaccggcgaagaattcggtctcgtggaggagaaggtcctctgccggatccactacgacactatgattgagaatctaaaaagagcggctgaaaatggcaacggactgacgttggagggcgcagtgcccagtgagcaagactctcagcctaagcccgctaagagggctaggaccagcttcacagctgaacaactccaagttatgcaggcacaatttgcccaggacaataacccagatgcacagacactacagaaactggcggacatgactgggctttcaaggagagttatccaagtttggttccagaattgtcgtgcacggcataaaaaacacaccccccagcaccctgttcctcccagtggagctccaccctccaggctgccatcagcactgtctgacgacatccactacacaccattttcttcacccgagcgggccaggatggtaaccctacacggctacatcgagtcccaggtccagtgtggccaggtacactgcagactaccatatacggcaccaccagtgcatctaaaagcagatatggacgggcccctctctaaccgaggggagaaagtcattctgtttcaatattag

SEQ ID NO: 12238 - DNA, 1179 bp, Artificial Sequence
  Description of Artificial Sequence: Synthetic coding sequence
atgtattggaaacatgagaacgcagcaccagctctgccggagggctgtcgcctgcccgccgaaggaggccctgccaccgaccaggtgatggcacagcctgggtctggctgcaaggccaccacccggtgtctggagggaacagctcctcccgctatggcccagagcgatgccgaagctcttgccggcgccttagataaggacgaggggcaagcctcgccctgtaccccctccactccaagtgtttgctcaccccccagtgcagcttcctctgtgcccagtgccggcaaaaacatctgctcttcttgcgggctggaaatcctggaccgctacttgcttaaggtgaacaacttgatatggcacgttcgttgccttgagtgcagtgtttgccgcaccagcctccgccagcaaaacagctgctacataaagaacaaagaaatcttctgtaaaatggattacttttctagatttggaactaagtgcgcccgttgtgggagacaaatctacgcttcagattgggtcaggcgcgctagagggaacgcctatcacctggcatgttttgcctgcttttcctgtaagcgacaattgtcaacaggggaagagtttggactcgtggaggagaaagttctgtgtaggatacattacgacactatgatcgaaaatctgaaacgtgctgctgaaaacggtaatggtcttactttagagggggctgtgcctagcgagcaagactcacagcctaaacccgccaagcgcgctaggaccagcttcacagcagagcagcttcaggtgatgcaggcccagtttgcccaggacaacaatccggacgcgcagactctccagaagctggccgacatgacaggactatcacggcgcgtgattcaggtgtggtttcaaaactgtagagctcgtcacaaaaagcatacacctcaacatcccgtccctcctagtggggccccaccaagtagacttccttctgctctaagcgacgacatacactatacaccctttagctctcctgagagagctcggatggtgaccctccacggctacattgagtcccaggtccaatgtggtcaggtccattgtcggctgccctacaccgctcctcccgttcacctgaaagctgatatggacggccccctgtctaaccgaggagagaaagtcattctgttccagtactag

SEQ ID NO: 12239 - DNA, 1101 bp, Artificial Sequence
  Description of Artificial Sequence: Synthetic coding sequence
atgcggagaggcctgtgtagaagaagcgctgagaatcccgacgctggccctgtgatggcccagcccggatctggctgcaaggccacaacccgttgtctcgagggcacggctccccccgcaatggcacaaagtgacgcagaagccctcgcgggtgcactcgacaaggacgaaggccaggcgagcccctgtacaccaagtactcccagtgtatgcagcccccctagcgccgctagctctgttccctccgcaggtaagaacatctgctcatcttgtggactggagatcctcgatcggtacttactcaaggtgaataacctcatatggcacgttagatgcctggaatgctcggtgtgtcgcactagtctgaggcaacaaaactcatgctacatcaagaacaaggagattttctgcaagatggattacttctccaggtttggaactaaatgtgctagatgtggccggcaaatttacgcgagcgattgggtccggagggcccgggggaacgcctaccacctggcatgctttgcatgtttctcttgcaaacggcaattgtctaccggcgaagagttcggattagttgaagagaaagtcctgtgccgaatccactatgacacaatgatcgagaatttaaaacgggcagccgagaatggcaatggtctgactctggaaggggctgttccatcggagcaagacagccagcctaagccagctaagagggctaggaccagctttaccgccgaacagcttcaagtaatgcaggcccaattcgcgcaggacaacaatcccgacgctcagactctgcagaaattggcagatatgactgggctgagcaggcgggtcattcaggtatggtttcagaattgccgggcacggcacaagaagcatactccacagcatcccgtgcccccctctggcgcccccccttcaaggttgccctctgctttgtcggacgacatccattataccccattttcttcacccgagcgggctcggatggtcacccttcacggctacatcgaaagccacccgttcagcgtcttgactttgccagccctcccgcacttacctgtgggggcaccccagttgcccttaagccgctag

SEQ ID NO: 12240 - DNA, 66 bp, Artificial Sequence
  Description of Artificial Sequence: Synthetic coding sequence
atggcacagcctggatcagggtgcaaggccaccactcgctgcctcgagggaaccgcgcccccctag

SEQ ID NO: 12241 - DNA, 105 bp, Artificial Sequence
  Description of Artificial Sequence: Synthetic coding sequence
atggctcaaccaggaagcggctgcaaggcaacaacaagatgcctagagggtaccgctccccccgccatggctcagtctgatgccgaagctctggccggcgcttag

SEQ ID NO: 12242 - DNA, 531 bp, Artificial Sequence
  Description of Artificial Sequence: Synthetic coding sequence
atgattgagaatttgaagcgggctgctgagaatgggaacggcctgacacttgagggcgcagtgccatcagagcaagactcccagccaaagcccgctaagagagctaggacctcattcaccgcagagcagttgcaggtcatgcaggctcagttcgctcaggataacaaccccgatgctcagacattacagaaactggctgacatgacaggtctgtcaagacgggtcatccaggtgtggtttcagaactgccgtgctcgccacaaaaagcatactccccagcatcccgttccaccttcaggggcaccaccctccagactgcctagtgccctgtctgacgatattcactacactccgttcagctcacctgaacgagctaggatggtgaccctgcacgggtacatcgaaagtcaggtacagtgcggccaggttcattgtcgcttgccctacaccgcaccacctgtgcacttgaaggccgacatggacggcccactcagtaatcggggcgaaaaggtaatactatttcagtactag

SEQ ID NO: 12243 - DNA, 372 bp, Artificial Sequence
  Description of Artificial Sequence: Synthetic coding sequence
atggctgtgtcacactctgtcaaggagaggactattagtgaaaacagcctgattattctgcttcagggcctccaggggcgcgtaaccaccgtagatttgagagatgagtctgttgcacacggacgtattgacaatgttgatgccttcatgaatattagactggctaaggttacatacaccgatcgatggggccatcaagttaaactcgatgacctctttgttactggtcgtaacgttagatatgtgcatattccagacgatgtcaacataacatccactattgagcaacaattgcagattatacaccgcgtacggaacttcggcggtaaagggcagggcaggtgggaatttccccctaagaattgcaagtag

SEQ ID NO: 12244 - DNA, 1083 bp, Artificial Sequence
  Description of Artificial Sequence: Synthetic coding sequence
atggaagaaagagagcgtggagcacggtcagccggagccggctctccagcccggccaccatcgcctcgcttggatgtatcaagcgactcatttgacccgctgctcgccctgtatgctccccgacttccgccgatcccttaccctaatgcaccatgttttaacaatgtggcagagtatgagagttttctgagaacaggggtgaggggaggaggtcggggacgcggaagagcgcggggtgctgccgccgggtctggtgtgccagctgccccaggcccatctgggcggacacgacgcagacccgacgcacccgcaccagatcccgaacgaatccagcgcctccgcaggctcatggtagccaaggaggagggggacggcgcggcaggcgccggaaggagagggcctggaaggagccggaaggctcccagaaatgtgcttactagaatgcctctccatgagggctcgccactaggtgagcttcaccgatgtatcagggagggagtgaaggtaaacgtgcacatcaggacttttaaagggctgcggggcgtctgtaccgggtttttagtcgccttcgacaaattttggaatatggccctcactgacgttgatgagacctacaggaaaccggttctaggaaaagcatatgaaagggacagttcactcaccctgacccgactgttcgataggctgaaacttcaggactcgtccaagaaagaggctgacagtaaaagcgctgttgaggactcaacactgtcaaggtattcacagacctctacttggaaactcgcgtccgtgtggggacgcgctgatacaggacgcggtagccacaaacggtcccggagcgttccatccagtctacaagccagcgcccgggaagagtcccgaagcgaactgagcgggcgaacaactcgcacagacgggtccagcgttggaggaactttctctagggctaccaccttgagcagaggccaatccaggaagaaaaaacgaaagccaaaggttgactatcagcaggtctttacccggcacatcaatcaaatcttcatacgaggcgagaacgtactcctggtgcaccttgcacaatag

SEQ ID NO: 12245 - DNA, 1140 bp, Artificial Sequence
  Description of Artificial Sequence: Synthetic coding sequence
atggtgttcttcacctgcaatgcatgtggggagagtgtgaagaagattcaggtcgagaaacatgtttcagtttgcagaaattgtgagtgtttgtcttgcatcgattgtggcaaggatttctggggcgacgactacaagaaccacgtgaagtgcatatccgaggaccaaaagtatggcggaaaagggtatgaaggcaagacgcacaaaggagacatcaagcagcaagcgtggatacagaagataagtgagctcattaagcgccccaacgtgtcaccaaaggttagagagctccttgagcagatttctgcttttgataacgttccccgtaaaaaggccaaattccaaaactggatgaaaaactcactcaaggtacataatgagagtattttggatcaggtgtggaacattttcagcgaggcaagcaatagcgagcctgtcaacaaggagcaagatcaaaggccactgcaccctgttgcgaaccctcacgccgagattagtactaaagttccagctagcaaagtgaaagatgcagtggaacagcaaggggaggtgaaaaaaaacaagcgggagagaaaggaagaacggcaaaaaaagcgcaaaagggaaaaaaaggaactaaaacttgaaaaccatcaggagaattcgcgcaatcaaaagcctaagaagcgaaaaaagggacaagaggcagacctcgaggccggtggagaagaagtacccgaggccaatggctccgccggaaagaggtcgaagaagaaaaagcagaggaaagatagcgcttccgaagaagaggcacacgtcggtgccgggaaacgcaaaagacgtcacagcgaggttgagaccgattcgaagaaaaagaaaatgaaactgcctgaacatcccgaaggcggtgaacctgaggatgacgaagctccagccaaaggaaaattcaattggaaagggaccatcaaagctatcctgaagcaggcacctgacaacgaaatcactattaaaaagcttcgtaagaaagtgctcgcccaatactacactgttaccgacgagcaccatagaagcgaggaagagctgctggtgattttcaataaaaagatcagcaaaaatccaacgtttaagctcctgaaagataaagttaaactggtcaaatag

SEQ ID NO: 12246 - DNA, 1140 bp, Artificial Sequence
  Description of Artificial Sequence: Synthetic coding sequence
atggtcttctttacatgcaatgcttgcggggaatcggtaaaaaagatccaggtggaaaagcatgtttccgtttgccggaattgcgaatgcttaagttgtattgactgtggaaaagatttttggggcgatgattacaagaatcacgtgaagtgtatctcagaggaccagaagtatggcggcaaggggtatgaaggtaagactcataaaggtgacatcaaacaacaggcatggattcagaagataagcgagctcatcaagagacctaacgtgtcacccaaagtccgggagctgcttgagcaaataagcgcattcgacaatgtcccgcggaaaaaagctaagttccaaaactggatgaaaaattccttaaaggtacataacgaaagtattctggaccaggtctggaacattttttctgaagccagcaatagtgaacctgtgaataaggaacaggatcagcgcccccttcaccctgtcgcaaacccccacgccgaaatttccaccaaggttcctgcctcaaaagtgaaagatgccgtagagcagcaaggcgaagtaaagaagaataagcgcgagcgaaaggaagaacgacagaagaagcgtaagcgggaaaagaaggaactcaaattagaaaatcaccaggagaattccaggaaccagaagcccaaaaaacgaaaaaagggccaggaggcagacctcgaggccggaggcgaggaagtgcccgaggcgaatgggagcgcagggaagcggtctaaaaagaaaaagcaaagaaaggactctgcttccgaggaggaggcccacgttggggctggcaagcgtaaacggcggcactccgaagtggagaccgatagcaaaaaaaagaagatgaagctgcctgaacatcctgaagggggggagccggaagacgatgaagctcccgccaagggtaagtttaactggaaaggcaccattaaagctatcctgaagcaggcaccggacaatgagattaccatcaagaagctccggaaaaaagtactggcccagtattataccgtcacggacgaacatcatcgttctgaggaagagctccttgtaatctttaataagaagatctctaagaaccccaccttcaaattgcttaaggataaagtgaagctggttaaatag

SEQ ID NO: 12247 - DNA, 240 bp, Artificial Sequence
  Description of Artificial Sequence: Synthetic coding sequence
atggtgttcttcacctgtaatgcctgcggtgaatcagtaaagaaaattcaggtggaaaagcacgtctcagtctgccgaaattgcgagtgtctctcctgcatcgattgcggcaaggatttctggggggacgactataaaaaccacgtgaagtgcatctctgaggatcagaaatacggggggaaagggtatgaggggaagacccacaaaggtgacatcaagcagcaggcctggatacagtag

SEQ ID NO: 12248 - DNA, 1863 bp, Artificial Sequence
  Description of Artificial Sequence: Synthetic coding sequence
atgaagccagctcctaggctgacgcccgtgcgacctgcggcagcatcacccatcgtttccggagcccgaaggaggcgggttcggtgcaggaaatgtaaagcgtgcgtccagggcgaatgtggagtatgccattattgtagagacatgaagaagtttggggggcctggcaggatgaagcaaagctgcgttttaaggcagtgtttggctccccgcctcccgcattctgtgacctgctccctgtgtggagaagtagaccaaaatgaagagacccaggatttcgaaaaaaagctgatggagtgttgcatttgcaacgagatcgtgcacccaggttgtctgcaaatggacggtgagggcctgttgaatgaagaactccccaactgctgggagtgtccaaaatgctaccaagaagatagttcggaaaaagcacagaagcgtaagatggaggaatctgacgaggaggcggtccaagccaaggtgttgcgcccactgagatcttgtgatgaaccactcactccacccccacactcccctacctctatgctgcaactgatccatgaccccgtatcccctcgcggcatggtgactcgctcctcgccgggtgctggtccatcggaccaccattccgcttcccgggatgagcggttcaaacgccgccagctcctcagactgcaggccacggagcgaacaatggtgcgggagaaggagaacaacccatcaggaaaaaaggaactcagtgaagtggaaaaagctaagattaggggcagctacctgaccgtgactctccagcggcctacaaaagagctgcatgggacttccatcgtgcctaaacttcaggccataacagcctcctcagcgaatttaaggcattctccgagagtcctggttcagcactgtccagcacgcacgccgcagagaggagacgaggaaggactgggaggcgaagaagaagaagaagaagaggaggaagaggaagacgacagtgcagaagagggaggtgctgcaagattaaacgggcgtggatcatgggcacaggatggggacgaaagctggatgcagcgtgaggtgtggatgtcagtgttccggtacctgtcccgaagagagctgtgcgagtgcatgagagtgtgcaaaacatggtataagtggtgttgtgataagagactgtggacaaaaatcgaccttagcagatgcaaagcaatcgttccacaggccctttccggcattataaagagacagccggtgagccttgaccttagctggacgaacatctccaagaagcagctgacctggctggtgaaccgcctacctgggctcaaggatctcctgctcgccggctgttcctggtctgcggtctccgctctttccacatcctcttgtcccctgctccgcacccttgacctcaggtgggccgtgggtatcaaagaccctcaaatccgcgacctgctgactccccccgctgacaaacccggacaggataatagaagcaaactccgcaatatgacagactttcggctagcaggattggacattacagatgctacactcagactgatcatacggcacatgccactattatctcgtctggacctgagccattgtagccacctgacagatcagtctagcaatctgcttaccgctgtcggctcatccactcgatattctcttaccgaactgaatatggcaggatgcaataaactgaccgaccaaacccttatttatctacgccgcattgcaaacgtgacgctgattgatcttcgaggctgcaagcagatcacgcgtaaggcttgcgaacactttatcagcgatctttcgataaatagcttatattgtctctcggacgaaaagctcattcaaaaaatctcctag

SEQ ID NO: 12249 - DNA, 2349 bp, Artificial Sequence
  Description of Artificial Sequence: Synthetic coding sequence
atggagccggaggaggagcgaatcaggtattcccagcggcttcgggggaccatgcgaaggcggtacgaggacgacggaatttccgatgacgaaatcgaggggaagagaacatttgatctcgaggaaaagctacacaccaacaagtataatgccaatttcgtgacatttatggagggaaaggatttcaacgttgaatacattcaaagaggaggcctacgggatccattaatattcaaaaacagcgacggactagggataaagatgcccgaccctgattttacagtcaatgacgtgaagatgtgcgtcggaagccgccgcatggtcgacgtaatggacgttaacactcagaaagggatcgagatgaccatggctcagtggactcgctattacgagacaccggaagaggagcgagaaaaattatacaacgtcatcagcttggagttctcccacaccaggttggaaaacatggtgcagaggccttccacagtggattttattgattgggtggataacatgtggccacgccacctcaaggagtcccaaacagagagcactaacgcaattctcgagatgcagtatcccaaggttcaaaagtactgcctcatgtccgtacgggggtgttataccgattttcatgtagatttcggtgggacttctgtgtggtatcacatacaccaaggtggcaaagttttctggctgatccctccaaccgcccataatctggaactctatgagaactggctcctctcaggcaaacagggggatatctttctgggagaccgagtgtcggattgtcaacgtattgaactgaagcagggatacacttttgttatcccatccggctggatccacgctgtatatactcctaccgacactctggttttcggcggtaacttcctccactcctttaacatccccatgcagctgaagatttacaacatcgaggatcggacccgtgtccctaataagttcaggtaccctttctactacgaaatgtgctggtatgttttggagcgttatgtctactgtattaccaaccgaagccacctcacaaaagaattccagaaagaatctttatctatggacttagagctgaacggactggaaagtggcaacggtgatgaggaggccgttgacagggaacccagacggctctcatccaggagatctgtgctgacaagtcccgtggcaaatggggtgaatctggattatgacggccttggaaagacgtgccggagtctgccttcacttaaaaaaaccctggctggcgactcatcctccgattgttccagaggctctcacaatgggcaggtttgggatccccagtgcgcccctcgaaaagatcgccaggtccatcttacacactttgaactagagggtctccgatgtctggtggataagctggagagcttacccctccacaaaaaatgtgtgcctactgggatcgaggatgaggatgccttaattgccgatgttaaaattctcctggaagaattggctaactcagatccaaagctggctttaacgggggtgcctattgtacaatggccaaagagggataagttgaaattccctaccaggcccaaagtccgcgtacctaccatccccataactaagccacacactatgaaacctgcgcctcgtctaactccagtgagaccagcagctgcaagcccgatcgtcagcggcgccagacgtaggcgggtgcggtgcaggaagtgcaaagcatgcgtgcagggcgaatgtggggtgtgccactattgtcgagatatgaagaagtttggaggaccggggaggatgaaacagagttgcgttctgaggcaatgcttggcaccacgactaccgcattctgttacctgtagcctttgcggtgaggttgaccagaatgaggaaacccaagacttcgagaaaaaactgatggaatgctgtatctgcaacgagattgtccacccaggttgtctgcagatggacggtgaaggactcctaaacgaggaactccctaactgctgggagtgccccaagtgctaccaggaggacagcagcgaaaaggcccagaagcgaaagatggaagagtccgatgaggaagctgtgcaggccaaggtgttgcgcccccttcgctcttgcgacgagcccctaactcccccacctcacagtcccacaagtatgctgcagcttatccacgaccccgtctctccacggggaatggtgaccagaagtagccccggagcaggccccagcgatcaccactcagcaagcagagacgaacggttcaagagaaggcagcttttacgtttacaggctactgaacgtaccatggttctcagacaggaaactctggataagaactag

SEQ ID NO: 12250 - DNA, 1263 bp, Artificial Sequence
  Description of Artificial Sequence: Synthetic coding sequence
atgtgttctggcagattccagaatatccaggtaaatccagattttcccagaggccggatttctaattccttcaggcgcaccagctcgacagaaaataaaaccaagaccctgggcaagctgcaccaggagcccagacagctgcagagcgacggcaagcgaaagattctgctggaggagctggcgaattctgatccaaagctggccctcaccggagtgccaattgtacagtggccgaagagggacaaacttaaattccctacaaggcctaaggtgcgggtaccaacaatcccaatcaccaaaccgcacactatgaagcctgcgccgagactgactcctgttaggcccgcggcagcctcccccattgtgagcggggcccggcgccggcgggtgaggtgcaggaagtgtaaagcctgcgtgcaaggggaatgcggggtatgccattactgccgcgatatgaagaagttcggcggaccaggcagaatgaaacagtcctgcgtcctgaggcagtgtctggctccaagactgccacacagtgtgacctgcagcttatgcggtgaggtggaccagaacgaagagactcaggacttcgaaaaaaagctgatggagtgctgtatttgcaatgaaatagtccaccccggatgtttgcaaatggacggagaaggattgctgaatgaggagctgcccaattgttgggagtgtccaaagtgctaccaagaggatagctcagaaaaagcccagaaacgtaaaatggaagagtccgacgaggaagccgttcaggctaaggtcctaagaccactccgatcttgcgatgaaccacttactccaccccctcattccccgacatctatgctgcaattgatccatgatcccgtgtcaccccgcgggatggtgacccgcagttccccgggggcaggaccctctgaccaccattcagccagcagagatgaaagattcaagaggcggcagctgctgcggctgcaggctaccgagcgcacaatggtgcgcgagaaggagaataacccgagcggcaaaaaggaattaagtgaagtggaaaaagccaaaatcagaggctcttaccttaccgtgactctacagcgaccgaccaaggagctccacgggacctcaatcgtgcccaaactgcatggacaggtgctcgtggtctccagtgcccgactctcttccataacactgtccagactggcccaagaaggtcctgccgctccaggcgtgcctgatccttgcagatcacactggtgttgttag

SEQ ID NO: 12251 - DNA, 3489 bp, Artificial Sequence
  Description of Artificial Sequence: Synthetic coding sequence
atggaacccgaagaagagcggattcgctacagccagcgattgcgtggtactatgagacgaagatatgaggacgacggaatctcagacgacgaaatcgagggtaaacggaccttcgatcttgaggagaaattgcacactaataaatataacgctaactttgttacttttatggagggcaaagactttaatgtcgaatacatccaaagagggggactgcgcgacccattaatctttaaaaattccgatgggctcggtataaagatgccagacccagatttcactgtgaacgacgtcaagatgtgtgtgggatcaaggcgcatggtggacgtaatggacgtgaatacacaaaaaggaatcgagatgacgatggctcagtggacgcgttattacgagactcctgaagaggaacgcgagaagttgtacaatgtaatcagcctggagttttcccatacccggctcgaaaatatggtgcagagacctagcaccgtggacttcattgactgggtcgacaacatgtggcctcggcaccttaaggaatctcagacagagtcaacaaacgctattttagaaatgcagtatcccaaggtccagaaatactgcttaatgagcgtaaggggatgctacacagactttcatgtggactttgggggtactagcgtttggtaccacattcaccaagggggtaaggttttctggttgatccccccaactgctcataatctcgagctgtacgagaactggctactctccggcaaacagggagatatttttctgggtgaccgcgtttccgactgtcagcgtatcgagttgaagcagggctacacttttgttatcccatctggttggattcatgcggtttacacacccactgacactctggtgttcggaggaaatttcttgcattcatttaatattccaatgcaacttaagatctataatatcgaggaccggacccgcgtgccaaacaagtttcgataccccttctactatgagatgtgctggtatgtgctggagagatacgtgtattgtatcactaatcgatcccacttgactaaggaatttcagaaggagagcctttctatggacctcgaactgaatggactggagagtggcaatggagatgaagaggccgtcgaccgggagccaaggaggctttcttcaagaaggtcggttttgacctctccagtggctaacggcgtgaatctcgactatgatggactgggaaagacatgtaggagcttacccagcctgaaaaagaccctcgccggagacagttcatctgattgcagtcgaggctcccacaacgggcaggtgtgggatccacagtgcgccccccgaaaggataggcaggtgcacctgacacacttcgaactcgagggtctgcggtgcttggtggataaacttgagtcactccctctacacaagaaatgtgtgcctaccggtatcgaggacgaagacgcccttatagctgatgttaagattctcctagaagagttagccaatagtgatccaaaattggcgcttaccggcgttcctatagtgcaatggcccaaacgggacaagttgaagttcccgacacggcctaaagtaagggttccgactattcccattacgaagcctcatacaatgaaacccgcacctaggttgacccctgtcaggccagcagctgcgtcaccaattgtgagcggcgctcgaaggcgcagggttcggtgccgaaagtgcaaggcctgcgttcagggcgagtgtggagtctgccactattgccgcgacatgaaaaagtttgggggtcccggacgcatgaagcagtcttgcgtgctgcgacagtgtttagctccgcgcttgccacatagcgtcacctgctctctatgcggagaagtggaccaaaatgaagaaactcaggatttcgagaagaaactcatggagtgctgtatctgcaatgagatcgtgcaccctggatgtctgcagatggacggggagggcctgttaaacgaagaactgccaaactgctgggagtgccctaaatgctatcaggaagactccagtgagaaggcacagaagcggaagatggaggagtctgatgaggaggcagtgcaggccaaagtgctgcgcccccttaggagctgcgacgagccactgaccccacctccacacagtcctaccagcatgctgcagctgatccacgatcccgtcagcccgcgcggcatggtgactcgcagcagccccggagcaggacctagcgatcatcattccgccagccgggatgaaaggttcaaacggcgtcagttacttaggctgcaggccaccgaacgcaccatggtgagagagaaggagaacaatccttctgggaagaaggaactgagcgaggtcgaaaaagcaaaaataagagggagttatctgaccgtaactctgcagcgacctacaaaagagttgcatggaacatctattgttcccaagctgcaggctataaccgctagctcagccaacctgagacactcgcctcgcgtgttagtgcagcattgtcccgctaggaccccacaaagaggggatgaagaaggccttgggggggaggaggaggaggaagaagaggaggaagaagaagatgactccgccgaggagggcggtgctgcccggcttaacgggaggggctcctgggcccaggacggagacgaatcttggatgcagagggaggtatggatgagcgtgttccgatacctgagccgcagagaactgtgcgagtgcatgagggtctgtaagacatggtataaatggtgttgtgacaagcggctgtggaccaaaatagatcttagcagatgtaaagctatcgtgccacaggccctgagcggtataattaagaggcagcctgtttccctcgatctctcctggactaacataagtaagaaacagctaacctggctcgtgaacagattgccaggtctcaaggacctgctgttggccgggtgcagctggtcagccgtgagcgcattatctacatcatcctgcccgctgctccggacactagatctgaggtgggctgtgggtatcaaggaccctcaaatccgggacctgctaacgccacccgccgataaaccggggcaagacaatcggtcaaagcttcgcaatatgaccgattttcgacttgccggactggacattaccgatgctacacttcggctgatcattcggcacatgccactgctatctaggttagacttgtcccactgctcccatcttaccgaccagagcagcaatctccttacagctgtaggttcctccacacgctactcactgacagagctgaacatggccggatgcaacaagcttacggatcagacgttgatctatctgcggcgcattgctaatgtgacacttatcgatctgcggggttgtaaacaaataaccaggaaagcctgtgagcactttatttccgacctcagcataaattcactgtattgtctcagtgatgaaaagctgattcagaaaatctcctag

SEQ ID NO: 12252 - DNA, 2172 bp, Artificial Sequence
  Description of Artificial Sequence: Synthetic coding sequence
atgtgttctgggcggttccagaatatccaggttaatcctgactttcctaggggcagaatcagtaattcttttagacgtaccagctctacagagaacaagaccaagacacttgggaaactccaccaggagcctagacagttacagagcgatggtaaacgcaaaatcctgctggaggaactggcgaattcagaccctaagttggcactgacaggagtcccaattgtgcagtggcccaaacgcgacaagctgaaatttccaaccaggccaaaggtgagggtgccgacaatcccaattacaaaaccacacacgatgaaacccgcaccgcggcttacaccagtgagaccggctgctgctagcccaatcgtctccggtgcacgtcggcgcagggtacggtgtaggaaatgtaaggcctgtgtccaaggtgagtgcggtgtctgccattactgccgcgacatgaaaaaattcgggggtcctggccgcatgaagcagagctgtgttctccggcagtgtctggcaccaaggttgccccacagcgtgacatgttccttgtgtggtgaagtggaccaaaatgaggagacacaggactttgagaagaagctgatggaatgctgcatctgtaacgaaatcgtacatccgggctgcctgcagatggatggagagggactgttgaatgaggaattacccaactgttgggaatgccccaaatgctaccaggaggatagctcagagaaggcccaaaaacgtaagatggaagagtccgacgaagaggccgtgcaggcaaaagtactgcgtcctctgcgctcctgtgacgaaccactgactccgccccctcattctcctaccagcatgcttcagctgatacacgatccagtctccccccgcgggatggtgacccggagcagccctggcgccgggcccagcgaccatcactctgcaagtagagacgaacggtttaaacggcgacagctgcttaggttgcaggccacggagagaacaatggtacgcgaaaaggaaaacaatccaagcggtaagaaagaactctcggaggttgaaaaagctaagattaggggttcctatctcacagtgacacttcagaggccaacaaaggaattacacggtacctctattgtccctaagctgcaggctatcacagcgtcttccgccaacttacgccatagtcctcgcgtgctggtgcagcactgccctgcccgcactccccagcgcggcgacgaggagggactgggaggcgaggaggaagaagaggaagaagaagaggaggaagacgatagcgcagaagagggtggcgccgcacgactgaacggacggggcagttgggcccaggatggggacgagtcttggatgcaaagggaggtgtggatgagcgtgttcaggtacctgagccgacgagagctctgtgaatgcatgcgagtctgcaagacctggtacaagtggtgctgtgacaaaagactgtggacaaaaatcgacctgagccggtgtaaggccatcgtgcctcaggctctgagcggcattattaagagacagccggtgagccttgacctgagctggacaaatatttcaaaaaagcagcttacctggttggtgaaccggctccccggactgaaggacctgctgttggctggttgttcttggtccgcggtgagcgccctgtcaacttcgagttgcccactcctccggactctggatctcaggtgggctgttgggatcaaagatcctcaaattagagatctgctcacaccccctgcagacaagcccggacaagataataggagtaaactgaggaacatgacagacttccggctggctggactcgacattactgacgcaaccctgagactgattatcaggcatatgccactgctctctcggctggatctcagtcactgttcacaccttacagatcaatcatccaacctgctcacagctgttgggagctcaactcgttatagcctaaccgagctgaacatggcaggctgtaacaagctgaccgaccagacattaatttacctcagaagaattgccaatgttaccctcattgacctgcgcggatgcaagcagattacacgaaaagcttgcgaacactttatttccgacctgagcatcaattccctgtactgcctgtctgatgagaagctgatccagaagatctcatag

SEQ ID NO: 12253 - DNA, 3921 bp, Artificial Sequence
  Description of Artificial Sequence: Synthetic coding sequence
atggcaggacctcagatgggcggatcagccgaggaccaccctccgcggaagcgccatgctgcagaaaagcaaaagaaaaagacagtcatttacacgaaatgtttcgaattcgagtcggccacccagaggccaattgatcgacagaggtacgacgaaaacgaggatctttctgacgtggaagagatcgtgagcgttagaggttttagcctcgaagaaaaacttcggtcccagctctaccagggcgatttcgtgcatgcgatggagggcaaagatttcaactacgagtatgtgcaacgagaagcccttcgtgtacccctcatcttccgcgagaaagatggactggggatcaaaatgcccgatccggatttcacagttcgcgatgtaaagctgctggtgggctccagacggctggtggatgtgatggacgtgaacactcagaagggcaccgaaatgtcaatgtcgcaattcgtccgatattacgagacacctgaagcccagagagacaagctgtacaatgtgatttctctcgagttctcccataccaagctggagcacctggtgaagaggcctacggtggtagatctggttgattgggtggataacatgtggccacagcacctgaaagaaaagcaaaccgaagccacaaatgccatcgcagagatgaaatatcccaaggtgaagaaatactgcctgatgtcagtaaaaggctgctttacggattttcatattgattttggcgggaccagtgtctggtatcacgtttttagaggaggtaagattttctggctgatcccaccaacactgcataatctggccttgtatgaagagtgggtcctgtcgggcaagcagagcgatattttcctgggggacagagtagagcgctgtcaaaggatcgaactcaagcagggctacacgttcttcatcccttcaggatggatacatgctgtgtatacccccgtggattccttggtctttggtggtaacattttacacagttttaatgtacctatgcagctgcgtatatacgagattgaggataggactcgagtccagcccaagttcaggtatcccttctactacgaaatgtgctggtacgtcctggagaggtacgtgtactgcgttacccagcggagtcatctgacacaagagtatcagcgggaaagcatgctgatcgacgcgcctaggaagccttctatcgacgggttttctagcgatagttggctcgagatggaggaggaagcttgcgatcagcaaccccaggaggaagaagaaaaagacgaagagggcgagggccgggatagggcaccaaagcccccaacggacggttccacgagccctactagcacaccgtctgaggatcaggaagccctgggtaagaagcccaaagctcctgctctgagattcctgaagcggaccttgtctaatgaaagtgaggaaagcgtgaaaagcacaacacttgctgttgattacccaaaaacccctaccggctcccctgctacagaggtatccgctaaatggacccacctcacagagtttgagctgaagggacttaaggctttggtcgaaaagcttgaatctctgccagagaataagaagtgcgttccggagggtatcgaggatcctcaagccctgctggagggcgtgaagaatgtcctgaaagaacatgctgacgacgatccttctctggctataacaggagtccctgtggtgacctggccaaagaagacacccaaaaatagggcagttgggagaccaaaaggtaagttgggtccagcgtctgcggtcaagctggctgccaatagaaccacggccggagcacggagaagaagaactcggtgtagaaagtgcgaagcgtgcctgaggactgaatgcggcgaatgccacttttgtaaggatatgaagaaattcggaggtccgggcagaatgaagcagtcatgtataatgaggcagtgtatcgcacccgtgttgccacatacagctgtgtgcttggtgtgtggggaggcgggaaaagaagatactgtggaggaggaggagggaaagtttaacctgatgctgatggagtgcagcatctgtaacgagatcatccaccctgggtgccttaagatcaaagaatccgaaggcgtggttaatgacgagctgccaaattgctgggaatgtcctaagtgtaatcatgctggaaaaaccggaaaggcatacaaacagaagcgcggcccaggattcaagtatgccagtaacctacctggctcactgctcaaggagcaaaaaatgaaccgggataacaaagaaggccaggaaccagccaagcggagatcagagtgcgaggaagctcctagaaggcgatccgacgagcattcgaagaaagttcccccagacggcctgcttcgaaggaaaagtgatgacgtccacctgaggaagaaacgcaagtatgaaaaacctcaggagctctcagggcgtaaaagagcctcctccctgcagacatcccccggatcttcttcccatctgagcccgcgaccacctctgggctccagccttagcccttggtggcgctcctctctaacgtatttccaacagcaactaaagcccgggaaggaagataagctgtttagaaagaagagaagatcctggaagaatgctgaggaccggatggccctggccaataaacccttgcggcgcttcaaacaggaacccgaagatgagctgcccgaagctcctccaaagacacgagaatccgaccatagtaggtcatcatcacctaccgccgggccctcaaccgagggtgcagagggccccgaggagaagaagaaggtgaagatgcgacgaaagcggagactccctaacaaagaactcagcagggagctctctaaagagctcaatcatgagattcaacggactgagaactctctcgctaatgagaaccagcagcctataaagagtgagccagaaagtgaaggcgaagaacccaagaggcctccaggaatctgcgagagaccacaccgcttttcaaagggccttaatggaaccccccgggaactcagacaccagctcggcccgagcctgcggtccccaccgcgggtgatttctagaccccctcccagtgtatcccccccaaaatgtattcagatggaacggcacgtaattagacccccacctatttcgccgccgcccgattctctccctcttgacgacggggccgcacacgtcatgcacagggaagtgtggatggccgtgttcagttatctgtcacaccaagatctgtgtgtttgcatgcgggtctgccgcacatggaatagatggtgttgcgataagagactgtggacccgaattgacctgaaccactgcaagtccattactccgctgatgttgtccggcatcatcaggcgccaacccgttagtttagatctcagttggaccaatatttccaaaaagcagctgtcctggcttatcaaccggctgcccggcctccgtgatttggtccttagtggctgttcatggattgcggtgagcgctctgtgtagctcctcatgtccactgctccgtaccctggacgtgcagtgggtggaagggctgaaggacgcgcagatgcgagacctgctctcccctccaaccgacaatcgtcctggacagatggataacagaagcaagctgagaaacatcgtggagctcagactggctggtctggatataacggatgcatcacttaggctgataatcagacatatgccactcctctccaagcttcacctctcatactgtaatcatgtgaccgaccagtcgatcaacctgcttaccgctgttggcaccacgacacgcgactccctgaccgagattaatctcagcggcttttttgttggtagggttttcggactacagttttggggaatttgtgagccccaggctcgcaagaacgcaggctgggcttag

SEQ ID NO: 12254 - DNA, 3798 bp, Artificial Sequence
  Description of Artificial Sequence: Synthetic coding sequence
atggaagccgagaaagactcgggcaggcggctcagaccaatagacagacagcgatatgatgagaatgaggatcttagcgacgtggaagagatcgtcagtgtgcgcggctttagtctggaggaaaagctgcgctcccagctctatcagggcgactttgttcatgccatggagggaaaagacttcaactacgagtacgtccagcgagaggctctgcgagtgcctctcatcttccgagagaaagatgggttgggcattaaaatgccagatcccgattttactgttagggacgttaagctgctggtgggttccagacgcttggtggatgttatggatgtgaatactcagaagggaaccgaaatgagcatgtcacagtttgtccggtattacgaaacaccggaagcccagcgagataaattgtacaatgtgatcagtctggaattcagtcatactaaactagagcacctagtcaagagaccaacggtggttgacttggttgactgggtcgacaatatgtggccccaacacctcaaggagaaacagaccgaggcaacaaacgccatcgctgaaatgaagtaccccaaggtgaaaaaatattgcctgatgagcgttaagggatgcttcacagactttcacatagatttcgggggcacctcagtgtggtatcacgtatttcgcggggggaagattttctggctgatcccacccaccctgcataacttagcactatacgaagagtgggtactctctggcaaacagagtgacatctttctcggtgacagggtcgaacggtgccagcggatagagcttaagcaggggtacacatttttcatccccagtggctggatacacgctgtctatacccccgtggactctctggtctttggtggaaacattctgcatagtttcaacgtcccaatgcagctccggatttatgaaatagaggacaggacacgggtgcagccaaaattccggtatcccttctactacgaaatgtgctggtacgtccttgaacgttacgtatattgcgtgacgcagaggtcacacctcacccaagaataccagcgggaatcaatgctgatcgacgcaccccgtaaaccttctattgacggtttttccagcgactcttggcttgaaatggaagaagaggcctgtgaccagcagccccaggaagaagaggaaaaggatgaggaaggagagggacgtgaccgtgcacctaaaccgcccacggacggcagtacgagcccaacctcaacaccgtcggaggaccaggaagccttgggtaagaagcccaaagctccagcgctgcgattcctcaagcgaaccttgtccaatgagagcgaggaatccgtcaagtccacaactctggctgtggattatcccaagacccctactggcagcccggctacggaggtgtccgctaaatggacccaccttacggaattcgaacttaagggattgaaagctctggtcgaaaagctggagagtctgcctgagaataaaaaatgcgtacccgaggggattgaggacccgcaggctctcttggaaggcgtcaaaaatgtgcttaaagaacatgccgacgatgatccttcactggcgataacgggggtgcctgtcgtcacgtggcctaagaagacaccgaagaacagggccgttggccggcctaaggggaaactcggccccgcgtctgcagtaaagctcgcagcgaatcgaaccaccgctggagcccggagacgaaggacccgctgtagaaaatgcgaagcctgccttcgcaccgaatgcggcgaatgccatttctgtaaggacatgaagaaattcggcgggcccggcaggatgaaacaaagttgtattatgcgccaatgcatagccccagtgttgccacatactgcagtgtgcctggtttgcggcgaggccggaaaggaggacactgtggaggaagaggagggcaaatttaacctgatgctgatggagtgttctatttgtaacgaaatcatacaccccggctgtctgaagattaaggagtcagagggagtggtcaatgacgaattgccaaactgctgggagtgtcctaaatgtaaccacgctggcaagactggcaagcagaagcgcggacccggcttcaagtacgcgagcaacctcccggggagcctactcaaggaacagaaaatgaaccgcgataacaaggaaggccaggaaccagccaaacggcgctctgagtgcgaagaggctccgaggaggcggagcgacgagcattcaaaaaaggtgccaccagatggccttctgcgccgtaaatccgacgacgtacacctgcgaaaaaagcggaaatatgaaaagccacaagagctctctggccggaagaggctgaagccaggcaaggaagacaagctgtttcgaaagaaacgccggtcctggaaaaacgcggaagataggatggctctcgcaaacaagcctctgagacggtttaaacaggaaccagaagacgaactcccagaggcacctcccaaaaccagagagagtgatcattcgaggtcttcaagtcctaccgccgggccatccacagaaggggccgaaggccctgaggagaagaaaaaggttaagatgcgacgcaaacgccgactaccaaataaggaattaagtcgtgagctctccaaagagcttaatcacgagatccagcgaacagaaaatagtcttgccaacgagaaccagcagccgattaaaagtgagcctgagtcagagggtgaagaaccaaaacgacctccaggaatctgtgaaagaccacatcgcttttccaagggtttgaatggtacgccccgggaacttagacatcagttgggaccgtccctgcgatccccaccacgtgtgattagcagaccccccccctctgtctctccaccaaaatgcatccagatggaaaggcatgtgattagacccccaccaatttcccctccccctgactccctgcctttggacgacggcgcagctcacgtcatgcaccgggaagtttggatggcggtattcagttacctgtctcaccaggacttgtgcgtatgcatgagggtgtgtagaacctggaacaggtggtgttgtgataaaagactatggacacggatcgacctgaaccattgtaagtctattacaccactgatgctgagcggaataattcgtaggcaacccgttagtctcgacctcagttggactaatatatctaaaaaacagctcagttggctgattaatcggctgcctggactccgcgatctggtgctgtcgggctgctcgtggattgcggtatcagcgctgtgcagctcatcctgcccattgctcaggactctggacgtgcagtgggttgagggactcaaagacgcacagatgcgcgacctgctgtcccctcctacagataatcggcctggacaaatggataataggtctaagctgcgaaatattgtggaactgcggcttgccgggctagacatcactgatgcttctctccgcctgataattcggcacatgcctctactatccaagctacacctcagttactgtaatcacgtgaccgaccagtcgataaacctcctcacagccgtcgggacgactacccgggacagcctcacagagattaatctgagcgattgtaataaggtgactgatcaatgtctgagtttcttcaagcgctgcgggaatatctgtcacatagacctgagatactgcaaacaggtcacaaaagagggctgcgagcagtttatagcggaaatgtcctccttccaagggcgaagctgcagcaccactcgattgggcgacgaatag

SEQ ID NO: 12255 - DNA, 4011 bp, Artificial Sequence
  Description of Artificial Sequence: Synthetic coding sequence
atggcaggcccccagatggggggaagcgctgaagatcaccctcccagaaagcgacacgctgcggaaaaacaaaagaagaaaactgttatatacacaaagtgctttgagtttgaatctgctactcagcggcctattgaccggcagcggtacgacgaaaacgaagatttgtctgacgttgaggaaatcgtgtcagtgcgaggcttttcccttgaagaaaagctgcggagccaactgtatcagggggatttcgtgcatgccatggaagggaaagatttcaattacgagtacgtacagcgtgaggctctgcgcgtgccccttatttttcgagagaaagacgggcttgggattaaaatgccggatcccgatttcaccgttcgtgacgtcaaacttctcgtgggctccagacgactggttgatgtgatggacgtcaatacgcagaagggaacagagatgagcatgtctcagttcgtacgatactacgaaactcctgaggcacagcgagacaaactgtacaatgttattagtctggagttttcccatactaaactagagcacttggtaaagaggcccacagtcgtggacctggttgattgggtggataatatgtggcctcagcatctcaaggaaaaacagacagaagctactaacgcaatagcggagatgaagtatcctaaagtgaaaaaatattgtctgatgtcagtaaagggttgctttacagatttccacattgactttggcgggacgtccgtgtggtaccatgtgttcagagggggaaagatcttctggctcatcccacccactcttcacaacctggctttgtatgaggaatgggtactgagtggcaaacagtccgatatattcttgggggacagggttgagcgctgtcagagaattgaactgaaacagggctacactttcttcatcccgtctggatggatacacgcagtctacacacccgtggactctctcgtgtttggtggaaacatcttgcattctttcaatgtcccgatgcaactgcgaatctacgaaatagaggatagaacacgcgtgcagccaaagtttaggtatcccttctactacgaaatgtgctggtacgtgctggagagatatgtgtattgcgtgacgcagagatctcacctgactcaggaataccagcgtgaatcgatgctcatcgatgccccgcgaaagccatccatcgacggtttctcctcggattcttggctcgagatggaggaggaagcctgcgaccagcagcctcaggaggaggaggagaaggatgaggaaggagagggcagagatagggcccctaagccaccaacagacggatccacgtcacccacaagcacccctagcgaggatcaggaagcgctgggtaagaagccaaaggctcccgctctcaggtttctcaaacgcaccttgtccaacgagtcagaagaatctgtgaaatccacaactctcgcagtcgattacccaaaaacacccactggcagccccgccaccgaggtatccgccaaatggacccacctcaccgagtttgaactaaaaggattgaaagcattggtcgaaaagctcgagtctttacctgaaaataaaaagtgcgtgccagaaggcatagaagacccgcaggctctccttgagggcgtcaaaaatgtgctgaaggagcatgccgacgacgatccgtcgctggccatcaccggcgttcctgttgtgacttggcccaagaagactcctaagaatagggccgtcggccggccaaaaggtaagctcgggcccgccagtgccgttaaactggccgccaacaggacgacagcaggcgcgagacggagaaggactcgatgccggaagtgtgaggcttgcctgcgcactgaatgtggggagtgtcacttctgtaaagatatgaaaaagttcggcggacctggcaggatgaagcagagttgtattatgaggcaatgtattgcaccagtgctaccacatacagcagtatgcctggtttgcggagaggccggaaaagaagatacagtcgaagaagaggagggtaagtttaaccttatgctgatggaatgttcaatttgtaatgagatcatccatcctgggtgtctgaagattaaagaatctgagggggtggtcaacgatgaacttccgaactgctgggaatgtcctaagtgtaaccacgccggtaagaccggtaaacaaaaacgagggccaggatttaagtacgcttcaaatctgccagggagtctgctcaaggagcaaaagatgaaccgggataacaaagaaggccaggaaccagcaaagcggcggtccgagtgcgaggaagcccccagacgtagatcagacgaacactcaaaaaaggttccgcctgatggattgctccgtcgcaagtccgacgatgtccatctccggaagaagagaaaatatgagaagcctcaggaactctcaggcagaaagagggcctcaagtctccaaacctccccaggatcaagcagtcatctatctcccaggccccctcttggcagttctctgtcaccgtggtggcgtagctctctgacttactttcaacagcagttgaaacccggcaaggaagacaaactgtttaggaagaaaagaaggagctggaaaaacgcagaggaccgaatggcactcgctaataagccactgaggaggttcaagcaggagcccgaggacgaactcccagaagcccctcctaaaacgcgggaaagcgaccactctaggagtagttctcccactgctggcccttctactgagggcgctgaaggcccggaagagaaaaagaaggtgaagatgcgaaggaaacgacggttgcccaacaaggagctgtctcgcgagttgtcaaaggagttgaaccacgaaatccagcgtaccgaaaactcacttgcaaatgaaaaccaacagccaatcaaatctgagcctgagtccgaaggtgaggagccgaagagacctccaggcatttgcgagcgaccacaccgttttagcaaggggctaaacggtacgcctcgcgagctgcgccatcaactgggcccttcattaaggtcaccaccacgcgtgatctcccgtccccccccctccgtttcaccacctaaatgtatccagatggaacgacacgtgatcaggccccctcccattagccccccccccgacagcctccctctggacgacggggcggcccacgtgatgcatcgcgaggtttggatggcagtgttcagttacctgtcccatcaagacctgtgcgtttgcatgcgagtgtgtaggacctggaatcggtggtgttgtgacaaacgtctgtggaccagaatcgacctgaatcactgtaaaagtattactccactcatgctgtccggcatcatcagacggcagcctgtgtcattagacctgtcttggacgaacatcagcaagaaacagctgagttggctgatcaatagactgccaggtctcagagatctggtcttgtctggctgtagttggatcgccgtcagcgcgctgtgttcttcctcatgccccctcctcagaacactcgatgtccagtgggtggaggggctgaaagacgcccagatgcgcgatctgttgagccctcccactgataataggcctggccagatggataacagatccaagctgcgtaacatcgtggagttgcgattggccgggcttgacatcactgacgcttccctgcgtctcattatacggcacatgcccctattatcgaaactgcatttaagctactgcaatcatgtgactgaccagtcaattaacctcctgacagccgtaggcacaacaacccgcgatagtctgaccgagatcaacctgagcgactgcaataaagtcacggaccagtgtctgtcgttctttaaaagatgcggcaatatttgtcacatagacctgcgatactgcaagcaggttactaaggaggggtgtgaacagttcattgcagaaatgtccgtgtcggttcaattcgggcaggtcgaagaaaaattgctgcagaagctgtcatag

SEQ ID NO: 12256 - DNA, 2121 bp, Artificial Sequence
  Description of Artificial Sequence: Synthetic coding sequence
atggcggggccccagatgggaggatctgccgaggaccacccacctcgcaagaggcatgctgctgaaaaacagaagaagaaaaccgtgatctacactaaatgctttgagttcgaatctgctactcagaggcctatcgaccgccaacgctatgacgagaacgaagatctgtccgacgtagaagaaattgtgtcggtgcgaggtttctcactcgaggagaagctgagatcacaactgtatcagggggatttcgtgcacgccatggagggcaaagactttaactacgagtatgttcagagggaggcactgcgcgtgccgctgatctttcgagagaaggatggtttgggaattaagatgccagaccccgacttcacagtccgagatgtgaagcttctggtcggtagcaggaggctggtggacgtaatggatgtaaatacccagaaaggtaccgagatgtctatgagtcagtttgtgcggtattacgagacgcccgaagctcagagagataaactatataatgttatctctctcgagttctcacataccaaactcgagcacctcgttaagcggcctaccgtggtggacctggtagactgggttgacaatatgtggcctcagcacctgaaggagaagcagaccgaagcgacaaatgccatcgctgagatgaagtatccgaaggtgaagaagtactgcctgatgtccgtcaaaggttgctttacggattttcacattgactttggggggacctcagtatggtaccacgtgttccgcgggggtaagatattttggctgattccccccacccttcataatctggcgctgtatgaggaatgggtgctcagtggaaagcaatctgacatcttcctgggagaccgagtggaacgatgtcagagaatcgaactgaaacaggggtacactttctttatcccttcaggctggatacacgctgtgtatacccctgtcgatagcctcgtgtttggtggcaatatactgcacagtttcaacgtgccaatgcagctgagaatctacgagatagaggacaggacaagagtgcagcctaaattcagatatcccttctactacgaaatgtgttggtacgttctggagcgatatgtatactgcgtgactcagcggtcacacctgacacaggagtatcagcgtgagagcatgctgattgatgctcccaggaaaccatctatcgacgggtttagctctgactcctggctagaaatggaggaggaagcttgcgaccagcaaccacaggaagaggaggagaaagatgaggagggggagggccgtgacagggcccccaagccccctaccgatggctcaacctctccaacgtcaacacctagcgaggaccaggaggcattgggaaaaaaaccaaaagcacccgccctgaggttccttaaacgtaccctttctaacgagagcgaggaatccgtgaaatctaccacattagccgtcgattacccaaaaacccctaccggatcaccagccaccgaagtttcagctaagtggacccacctgactgagttcgaactgaaaggcttgaaggctctggtcgaaaagctcgagagcctcccagaaaacaagaaatgtgttcccgagggtatcgaggacccacaagcgctattggaaggagtgaaaaatgtcctgaaggagcatgctgacgatgacccgtctctggctatcaccggcgttccagtggtcacttggccaaaaaaaacccccaagaaccgggcagtgggaagacccaaaggcaagctcggccctgcatcagccgtgaagctggctgccaatcgcacaactgcgggtgccagaagacggaggacccggtgccgcaagtgtgaggcctgcctgcgaactgagtgtggagagtgccatttttgtaaggacatgaagaagtttggaggaccaggccggatgaagcagtcttgcatcatgagacagtgtattgcaccagtccttccccatacagccgtctgcttggtatgcggcgaggcaggcaaggaggatacggtggaggaggaagaaggtaaatttaatttaatgctgatggaatgctccatatgcaacgagattattcatccaggctgtctcaagagagatcagcccgtttag

SEQ ID NO: 12257 - DNA, 3981 bp, Artificial Sequence
  Description of Artificial Sequence: Synthetic coding sequence
atggcggggccacagatgggcggcagcgcggaagaccatcccccccgcaagaggcatgctgccgaaaaacaaaaaaagaaaaccgtgatttacacaaagtgctttgagttcgagtccgcaacacagaggcctatagataggcagcgatatgacgaaaacgaggatctgagcgatgtcgaggagattgtaagcgtgagagggttctcccttgaggaaaaactccggtcacagctgtatcagggggatttcgttcatgcaatggaaggaaaagattttaattatgagtacgtgcagcgtgaagccttgcgtgtccccctgattttccgtgagaaagacgggctcgggatcaaaatgccggatcccgatttcacagtgcgcgacgttaaactcctggtaggatcaaggcggcttgttgatgtcatggatgtgaatacccagaaggggaccgagatgtccatgagccaattcgtacgttactatgaaacccccgaggcccagcgagataagttgtacaatgttatctccctcgaatttagtcacactaaactcgagcatctggtgaagcgtcccacggttgtggatcttgttgattgggtggacaacatgtggccacagcacctgaaggagaagcagactgaagctaccaacgctattgcagaaatgaaatatcctaaagtgaaaaagtattgcctgatgagcgtgaagggttgtttcacagattttcacattgactttggcggcacatcagtatggtaccatgtctttagaggcggaaagatcttctggctgattcccccgacactccacaatcttgcactgtacgaggaatgggtcctttctgggaagcagtctgacatttttctgggggaccgcgtggaaaggtgtcagcgcattgaactcaagcaagggtatacattcttcattcccagcggatggatccacgccgtctatacccctgtggacagtctagttttcggtggaaacatcctccattcatttaatgttcctatgcagctccggatttatgagatcgaggatcgaacccgagttcaaccaaagttcaggtacccattttactacgagatgtgctggtacgtcttagaacgctatgtctactgcgtgactcagagaagtcacctgacccaggaataccagcgggaatcaatgctcatcgatgcacccagaaagccatccatcgatgggttctcatctgattcatggctggagatggaagaagaggcatgtgaccagcagccacaagaagaagaggagaaagacgaagagggtgagggccgcgatcgggctcccaaacctcctactgatggatccacctcccctacctcgactccatctgaggatcaagaggcccttggaaaaaaacctaaggccccagctctcagatttcttaaacggacattaagcaatgaaagcgaggaatccgtaaaaagcactacacttgccgttgattacccaaagacacctactggctcccctgctacggaggtctccgctaaatggacacacctcaccgagttcgaactgaagggcctaaaggccctggtggaaaagctagagagtttaccggagaacaagaaatgcgtgcctgagggaatcgaggatccccaggccctgctggagggtgtgaaaaatgtgttaaaagagcatgctgacgatgatccctcgctggctatcaccggcgtgcccgtggtgacgtggcccaagaagacacctaagaaccgagcggtgggtagacccaaggggaaactaggccccgctagcgccgtgaaactagcagctaataggacaacagcaggcgctagacgtcgacgcaccaggtgtcgcaagtgtgaagcgtgccttcgaactgaatgcggagagtgccacttctgtaaagacatgaagaagtttggcggccccggtagaatgaaacaatcttgcattatgcggcaatgcatcgctccagtgctgcctcacacagccgtatgcttggtttgcggcgaagccggcaaggaggataccgtggaggaggaagaggggaaattcaacctgatgcttatggagtgcagcatctgcaatgagattatccaccccgggtgcctgaagattaaggaatccgaaggcgtcgtgaacgacgaactccccaattgctgggagtgtccaaagtgtaaccacgcgggaaagacaggtaaacagaagagaggtccagggtttaaatatgcctcaaatttgccgggatccctcctcaaggagcaaaagatgaatagagacaataaagagggacaggagcccgccaaaagaaggtccgagtgcgaagaggcaccccgccgacgctcagacgagcacagcaaaaaggtgccacccgatggcctgctccgtcggaaatctgacgatgtgcacctgaggaagaagagaaaatatgaaaagccacaagaactgagcggaagaaagcgtgcttctagtcttcagaccagcccgggttccagctcgcaccttagcccccgcccgccactcgggagttctctgagcccttggtggcgatcttccctgacctatttccagcagcaacaacggcggagctggaagaacgccgaggatcgaatggccctggctaataaacccctacggagatttaaacaggagccagaggatgaactgccagaagcgccccctaagactagggagtccgatcactcccggtcatcgtccccgaccgcaggtccgtcaacagagggagcagaaggtccagaagagaaaaaaaaggtgaaaatgcggcgaaaacgccgcctacccaataaagaattaagtagagagttgtccaaggagcttaaccatgagattcagcgaacagaaaacagcttggctaatgagaatcagcagcctattaagagtgagcccgaaagcgaaggagaggagcctaaacggccgcccggaatatgcgaacgccctcacagattctctaaaggccttaacgggacacccagggagctgcggcatcagctgggtcccagcttaaggtctccccctagagtgattagtaggccccccccctctgtaagcccacctaaatgtatccagatggagcgtcacgtaatcaggcctcccccgataagtccccccccagatagtttgccccttgatgacggagctgcgcacgttatgcatcgtgaggtctggatggctgtgttttcctatctgtcgcatcaggatttatgtgtatgcatgcgggtatgtagaacctggaacaggtggtgttgtgacaaacgactctggaccagaattgaccttaaccactgtaaaagtatcactccacttatgctgagtggaataataaggaggcaacctgtgtcacttgacctgagctggactaatatatccaaaaagcaactgagctggctgatcaacagactccccggactccgagacctcgtcttaagcggttgctcttggatcgccgtgtctgccctttgttcgagcagctgtcctctgctgagaacgcttgatgtccagtgggttgagggtttgaaagatgcgcaaatgcgggatttgctcagtccaccgaccgataacaggcctgcgccaggccagatggataatcggtcgaagttgagaaacatcgttgaactaaggctcgccggcctggatattacagacgctagcttaaggctcataatacgtcacatgcctcttctgtctaaattacacttgtcctactgcaaccacgttaccgatcagagtatcaatctgctgaccgccgtgggtactaccaccagggatagtctaaccgaaatcaacctctcagattgcaacaaggtaaccgatcagtgtttgtcatttttcaagcgatgcggaaacatctgtcatatagacctgcggtactgtaaacaggtaacaaaggagggatgtgagcagttcattgccgaaatgtcggtttcagtccagtttggccaagtcgaggaaaagctgctacagaaactgagttag

SEQ ID NO: 12258 - DNA, 1680 bp, Artificial Sequence
  Description of Artificial Sequence: Synthetic coding sequence
atgcccgatcccgatttcacagtgcgggacgtgaaactccttgtgggtagtcggagattggtagacgtaatggacgtgaacacacagaaaggcactgagatgtccatgagccaatttgtgagatactatgagactccggaggctcagagagacaagctgtataacgtgatttcactggaatttagccataccaaactggagcacctggtgaaacgacccaccgtggttgacctggtggactgggtcgataatatgtggcctcagcatttaaaggaaaaacagactgaggcgaccaatgccatcgccgaaatgaaataccctaaagtaaaaaagtactgcctgatgagcgtgaaaggctgtttcacggatttccatatagacttcggcgggactagtgtttggtatcacgtgtttagaggcgggaagattttctggttgattccccctactctgcacaaccttgcactgtacgaagagtgggttctgtctggaaagcaatccgacatctttttgggggatcgcgtggaacgttgccagcgcattgaactcaagcagggatacaccttttttattccaagtggctggattcatgcagtctatacccctgtcgactcactggtatttggcggcaacatcctccatagtttcaacgttcctatgcaacttcggatctatgaaattgaagacaggactcgagtgcagcccaaatttcgctatcccttctactacgagatgtgctggtatgtcttagaacgatatgtgtactgcgtgacccagagaagccacctcacccaggaatatcagagagagagtatgctcattgacgccccaagaaaaccatccatcgatggctttagcagtgactcttggttggagatggaagaggaggcttgcgaccaacagcctcaggaggaggaggagaaagacgaagagggcgaaggacgggatagagcccctaagcccccaaccgatggaagcaccagtcctacctctacaccttccgaggatcaggaagcactcggcaagaagccaaaagcacctgccctgaggtttctgaaacgaaccctgtctaatgagtccgaggaatccgtgaagagtacaaccctggccgtggactaccccaaaactcccacggggtctcccgctactgaggtcagtgcaaagtggacacaccttactgagtttgagctgaagggcctcaaagctctggtggagaagctggagtccttgccggaaaataaaaaatgtgtgcctgaaggaatagaggaccctcaggcacttctggaaggggtgaagaatgttctcaaagagcacgccgacgatgatccgagcctggccattactggagtccccgtggttacgtggcctaaaaagactcctaaaaatcgggcagtcgggcggccaaagggcaaacttggccccgcgagcgcagtcaaactggcggcaaaccgtactacagctggtgcccgcagacgacgaacccggtgtaggaaatgcgaggcctgcttgcgtacagaatgtggggagtgtcacttctgcaaagacatgaaaaagttcgggggtccgggccgtatgaagcagagctgtattatgagacagtgtatcgcgacagcgataaggagcttgatcagcgcttgcccctcttccaacgccgtggagacctctgtcatccttacctag

SEQ ID NO: 12259 - DNA, 2340 bp, Artificial Sequence
  Description of Artificial Sequence: Synthetic coding sequence
atggctatgtccgtaagcgccgaggacgacgactatgaaagtgaaccggatcaaaaccgagcagtcggcaggcccaaaggaaaactagggcctgcctccgcggtgaaactggctgcaaataggaccactgcaggggcacgacgtaggaggacccgctgcaggaaatgcgaagcttgtcttcgtaccgagtgcggcgaatgccatttctgcaaagatatgaagaaattcggggggccgggacgcatgaaacaaagctgtataatgaggcagtgcattgccccagttctgcctcacacagcagtttgcctagtgtgtggagaagccgggaaggaggataccgtggaagaggaggagggtaagtttaatctgatgctcatggagtgttccatttgcaacgagattattcacccaggatgcctaaagataaaggagtccgagggcgttgttaatgacgaattgccaaactgttgggagtgccctaaatgtaatcacgctgggaagaccgggaaagcctataaacagaagcgcgggccgggctttaaatatgcatccaatcttccaggcagtctgcttaaggaacagaaaatgaatcgggacaataaagagggtcaggagcccgccaagcgcaggtctgagtgcgaagaagcgccgcgaagacggagtgacgaacactccaaaaaagtgcctcccgacgggctgcttcggaggaagagcgatgacgtgcatctgagaaagaaaagaaaatacgagaaacctcaggagctgagcgggcgcaaacgagcctccagcctgcagacatcaccaggctctagcagccatctgtctccccggccccctctgggatcaagtctgagtccctggtggcgcagcagcctgacctacttccaacagcagctcaaacccgggaaggaagacaagttatttcgcaagaagaggcggtcctggaagaatgctgaggacagaatggccctagccaataaacccctcagacgctttaagcaggagcccgaagacgagttgcctgaagccccgccaaagacaagagagtctgatcactcccgcagcagcagtccaaccgccggtccatcgacggagggcgccgaggggccagaggagaagaagaaggtgaaaatgagacgcaagagaagactgccaaacaaagagctgtcaagagagctgagcaaggaacttaatcacgagatccagcggacagagaacagcctcgcgaatgaaaatcagcagcccatcaagagcgaacctgagagcgagggggaggaacccaagagacctcccggcatctgtgaaagaccccatagattctctaagggtctcaatggcacgccgagggaactgaggcatcaactcggtccgtcccttcgctcccccccacgtgtgatcagtaggccaccgccatccgttagtccccctaagtgcattcaaatggaaaggcatgtgattagacccccgcccattagccctccccctgattctctgcccctggatgatggagctgcccatgttatgcaccgcgaagtttggatggcggtcttctcgtatctgagccaccaggatttgtgcgtctgcatgcgggtctgtcgaacctggaaccgctggtgctgcgacaaacggctctggacgcgaattgatttgaatcattgtaagagcattacccccttaatgctcagcggtattattcgtcggcagccagtgagtctggacttatcatggactaatatctccaaaaaacagctcagttggctaatcaatcggctgccagggttgagggatctcgtcttatctgggtgctcctggatcgctgtctctgctctgtgctcatcatcatgccccctgctccgtactctggacgtccagtgggtcgaagggttgaaggatgcccaaatgagggacttattgtcccctccaactgataaccgacccggtcagatggacaaccgctccaagctgcgaaatatcgtggagttgaggcttgcgggtcttgatatcaccgatgcctctctgaggctgatcattcgccatatgccgttacttagcaagctgcacttgtcctactgcaaccacgtcaccgaccaaagtataaatctgttgacagctgttggaaccaccactagagactctctcaccgaaattaatttgtcagattgcaataaggtcaccgatcaatgcctgtctttcttcaaacgctgcggcaacatttgccacatagacctgagatattgtaagcaggtgacaaaagagggatgcgagcagtttattgccgagatgtccgtatcagtccagtttggccaggtggaagagaagctgctccagaaactgtcttag

SEQ ID NO: 12260 - DNA, 3291 bp, Artificial Sequence
  Description of Artificial Sequence: Synthetic coding sequence
atgggcagcgaggaccatggggcccaaaacccttcctgcaagattatgactttccgccccactatggaggagttcaaagatttcaataaatacgtggcttatatcgagtcgcagggggcccaccgagccggtctcgctaagattatacccccaaaagaatggaaacccaggcagacctacgacgatatcgatgacgtagtgatccctgccccaatccagcaggtggtgacagggcagtccggactgttcacccagtataatatccaaaaaaaggctatgactgtgggagaatacagaagactggcaaactccgagaagtattgcacccctcggcatcaggatttcgatgacctagaacggaaatactggaaaaacctgacttttgtttcccccatctatggggctgacatctcaggttccctctacgacgatgacgtcgcccagtggaacatagggtctttgcgcaccatcctggatatggtggaacgagaatgcggcaccattatcgaaggtgtgaacaccccctacctctattttgggatgtggaagaccacattcgcgtggcatacggaagatatggatctctactctatcaactatctccatttcggcgaacccaagagttggtatgccatccctccagaacacggcaaacgccttgaacgactcgccatcggattctttcctggctcaagccagggctgtgatgcgtttcttcgtcacaagatgacgctcataagccccattattctcaagaaatacgggattcccttttctaggatcacccaagaagctggggaatttatgataactttcccctacggttaccacgcagggtttaaccatggcttcaactgtgccgaatccactaactttgcgaccctccgctggatagactatggcaaggtggctacccagtgcacctgtcgaaaagacatggtgaagatatcaatggatgtgttcgtgagaatactccaaccagagcgctacgagctgtggaaacagggaaaggacctcaccgtcctggaccataccagaccaaccgccctgacgagccctgagttgtccagctggagcgcctcccgggcctccctgaaggcaaagcttcttaggcggtcgcatagaaagcgttcccaaccaaaaaagcctaaacccgaagatcccaagtttcccggggaagggaccgccggtgctgctctgctggaagaggccggtggcagcgtcaaagaggaagcgggaccagaagtggaccccgaggaggaggaggaagaacctcaaccgctgccacatggcagagaagccgagggcgccgaggaagatggtagagggaaacttaggcccacaaaggcgaagtcagaaagaaagaaaaaatccttcggccttctcccacctcaacttccaccgccacctgctcatttcccctcggaagaggcattatggctaccttcacccctggaacccccagtcctggggcccggacctgcggccatggaggaatcccctctcccggcaccactgaatgtcgttccacctgaggtgcctagtgaggaactggaggctaagcctcgacccatcatccccatgctatacgtcgttccacgccccgggaaagcagcattcaatcaggagcatgttagttgccaacaggccttcgaacactttgcacaaaaaggacctacttggaaggagccggtctctccaatggaacttacaggcccagaggatggagccgctagctcaggggccggacggatggagacaaaggcaagagccggcgaaggacaggccccctcaacgttctccaaactgaaaatggaaataaaaaaatccagacgccatccactgggacgtccgcccacacggagcccactctccgtggtgaagcaggaagcatcctctgacgaggaagcgagtccattcagcggcgaggaggacgtgtcagacccagacgctctgaggcccctgttgtccctgcagtggaaaaaccgagccgcctccttccaggccgagcggaaattcaatgccgcagccgcacggacggagccttactgtgccatctgtaccctgttttatccgtattgccaggctctgcaaacggaaaaagaggcgccaatagcgtctttgggaaaaggatgcccagccactctaccctccaaatcaaggcaaaagacacggccactaatccccgaaatgtgttttactagcggtggagagaatacggagccgctgcctgcaaacagctatattggcgacgacgggacttccccacttattgcttgcgggaaatgctgccttcaggtacacgcctcctgctacgggatcagacctgagctagtgaatgaaggatggacttgcagtcgctgtgctgcgcacgcctggacggctgaatgctgtctgtgcaacctgcgagggggagcgttgcaaatgaccaccgaccggagatggattcatgtaatatgcgcgatcgctgtgcctgaggcgcgcttcttgaatgtgatcgagcgacaccccgtcgatatctctgcaatccctgagcagaggtggaagcttaaatgcgtctactgcagaaaaaggatgaagaaggtgagcggggcctgtattcaatgctcgtatgaacattgcagtaccagctttcacgtgacatgtgcccacgcagcaggggtgttgatggaacctgatgattggccctatgttgtatctattacctgcctgaagcacaaaagtggtgggcatgccgtgcaactgctcagggcagtcagccttgggcaagtcgtgattacaaagaatcgcaacggtctttactacaggtgccgggtgattggcgccgcctctcaaacatgctacgaggtgaactttgatgacggtagttactctgataatctgtatcctgagtcaatcactagtcgcgactgcgttcagttaggaccgccgagtgagggggagctggtggagcttagatggaccgatggaaacctgtataaagcaaagttcatctcctcagtgactagccacatctatcaggtggagttcgaggacgggagccagttaaccgtgaagaggggagatatcttcactttggaggaggagctccctaagcgggtgcggagccgcctgtccctttccaccggcgcaccacaggagcctgcgttctccggcgaggaagcgaaggccgccaagcgcccacgggtcggcacacctttggcaacggaggatagcggtaggagtcaggactacgtggcgtttgtcgagtccctgctccaagtgcagggaagacccggggcaccattttag

SEQ ID NO: 12261 - DNA, 1347 bp, Artificial Sequence
  Description of Artificial Sequence: Synthetic coding sequence
atggggtcagaagatcacggagcccagaacccttcatgcaagattatgacatttaggccgacaatggaagaattcaaagacttcaataaatatgtggcctatatcgagtcccagggagcgcacagagcgggactggccaaaatcatccccccaaaagagtggaaacctcggcagacatacgacgatattgacgacgtagttattcccgcacccatccagcaagtcgtcactgggcaaagtggcctgttcacccagtataatatccagaagaaagcaatgacggtaggggagtatagaagactggcaaattcagagaagtattgtacacccagacaccaggactttgacgaccttgaaagaaagtactggaagaatctgaccttcgtgagtcctatctatggcgccgatatttccgggtcgctatatgatgatgatgtggcccagtggaatattgggagtcttagaacaattctcgacatggtggaacgggagtgcggaactataattgaaggcgttaacactccttacttgtactttggcatgtggaagacaaccttcgcatggcacacagaggatatggacctctactccatcaactatctgcatttcggtgaaccaaagagctggtatgccatcccaccagaacacggcaaaagattggagcgcttagcgattggattcttccccggatccagccagggctgcgacgcttttcttaggcacaaaatgactcttatatcaccaattatcctgaaaaagtatggaattcctttttctagaattacacaggaggcaggagagttcatgatcaccttcccctacggatatcatgccggtttcaaccacggctttaactgtgcggaaagcactaacttcgctacactccgctggattgattacgggaaagtggcgacccagtgtacctgtagaaaggacatggttaagatcagtatggacgtgttcgtgaggatcttgcagccagaaagatacgagctatggaagcaaggaaaagacctgacggtcctggaccacacccggccaacagcactgacctccccggagctctccagctggtcggcttcacgcgcttcactgaaagccaaactcctaaggcggacaccaccatgtgtctccccgcatcggccttcgcaaccaggaatttggtgcccgcctgggggagaagctaaagcgtccgctgcaagttggttgcttaccactcggggacatggcgacacggaagctggacccggcttggggggagatcccctgcatgcacagagcgaagggcaggcttcctgcgttagcaccagtcggctgaggatggcgacccaggacccttgcaggtag

SEQ ID NO: 12262 - DNA, 3393 bp, Artificial Sequence
  Description of Artificial Sequence: Synthetic coding sequence
atgggaagtgaagatcatggggcgcagaatccctcatgtaaaattatgacatttcgcccaacaatggaggaatttaaagatttcaacaagtacgtcgcatatattgaatcccagggagcccaccgcgctgggttggccaagatcattcctcctaaggagtggaaaccaaggcagacatacgatgacatcgacgacgtggtgattcccgccccaatccagcaagtggtcaccgggcagtccggattattcacgcagtataatattcagaaaaaggctatgactgtaggagagtatagaagactggccaactccgagaaatactgcaccccgcgacatcaggatttcgacgacctagagcgtaagtactggaaaaatctgacattcgtgtctcccatttatggggctgacatttcgggctccctctacgacgacgacgtcgcacaatggaacatcggaagtcttagaacaatccttgacatggttgagcgggagtgtggtaccattattgaaggcgtcaatacaccctatctgtacttcggcatgtggaagacaacatttgcttggcacactgaggacatggacctgtattctattaactacctgcacttcggtgaaccaaagtcatggtacgcaatcccacctgaacacggaaaaagactagagcgtctcgcaatcgggttcttccccggctcttcacagggctgcgatgcattcctcaggcacaaaatgaccctgatctctcctataatattaaaaaaatatggtatccctttctctcgcatcacccaggaagctggcgagttcatgattacatttccatatgggtaccatgccgggtttaatcatgggttcaactgcgctgaaagtacaaacttcgcaaccctgaggtggatagattatggcaaggtggcaacacagtgcacttgtcgaaaagatatggtgaagatatctatggacgtgtttgtgcgtatcttgcagccagagagatatgaactgtggaaacagggaaaggacctgacagtccttgatcacacacggcccacagccctcacctcgccagagctgagtagctggagcgcttcccgggcctctctcaaggcaaaattgctcagaagacagatctctttgaaggagaacaggcattggcgaaagactgaagaagagaggaaacctagcctggaaagaaagaaggagcaaaccaagcggcctggcctgagttcgcacagaaaaagatctcaaccgaaaaagccgaaaccagaagaccccaaatttcctggggagggcactgcaggagctgccctgctggaggaagcaggtggcagtgtcaaggaagaggccggcccggaagttgatcccgaagaagaggaggaggagccccagccactgccacacggacgggaggcggagggcgctgaagaggacggcaggggaaagctaagaccaaccaaggcaaaatcggagcgaaagaaaaagtccttcggattgctgccaccccagctaccccccccaccagctcacttcccctctgaggaagctctctggctgccctcgcccctggaaccgccagttctggggcccgggcccgctgccatggaggaatctcccctgccagctcctttaaatgtcgtgccacctgaggtgccttcagaagaattggaagccaagcctaggccgatcatccccatgctgtacgtggtcccccggccagggaaagctgccttcaaccaggagcatgtcagctgtcagcaagccttcgagcactttgctcagaaagggccaacttggaaagaacctgtgtcaccgatggagttgacaggacccgaggacggcgcggcctcctcaggagctgggaggatggaaacaaaagccagggccggggagggtcaggcaccctctaccttctcaaagctgaagatggagatcaagaagtcccgtcgtcaccccttgggtaggccccccaccaggtctcctctgagcgtcgtgaagcaagaagcttcatcagacgaagaggcctccccattttcaggcgaagaggatgtcagcgatccggacgccctgaggcctctgctgagcctccaatggaaaaaccgcgctgcctcttttcaggcggagaggaagttcaatgctgcagcggctaggaccgaaccctattgcgctatatgcacattattttatccatattgccaggccctgcagactgagaaggaagccccaattgcctcacttggcaaagggtgccccgccaccctgccgtcaaagtcaaggcagaaaacccgccctctgatccctgagatgtgttttaccagtggcggggagaataccgagcctttgcccgcgaacagctacataggggacgacggcacatccccactcatcgcctgtgggaaatgttgcctccaggtacacgcaagctgctatggcatccggccagaactggttaacgaaggatggacctgctctcgatgtgcggcacacgcctggaccgccgaatgttgcctatgcaatctcagaggcggggcactgcagatgacaactgacagaagatggatccacgtgatatgtgcgatcgcggtgccagaagcaagattcttgaatgttatagagagacatccagtggacattagtgccattcctgaacagcgatggaagttgaaatgcgtttattgtagaaagcgtatgaaaaaggtgagcggcgcctgcatccagtgcagttatgagcactgcagcacctccttccacgtcacttgtgctcacgcagcgggagttctgatggaaccggacgactggccatacgtggtgtctattacttgcttgaagcataagtctggcggacatgcagtgcagctcctgagggccgtgtccctgggccaggtggtcataaccaaaaatcggaacggactgtactatcgttgtcgggttatcggggcggctagccagacatgttatgaggttaattttgatgacggcagctacagcgacaatctttaccctgagtccattacaagtagggactgtgtacagctaggaccgccctccgagggagaattagtggagctgagatggactgatggaaatctctacaaagcaaagttcataagcagtgtcacatcccatatctatcaggtggagtttgaggacggcagccagcttacagtcaagcgcggagatatattcacacttgaagaggagctgcctaaacgagtgcggtctcgtctctcgcttagcacaggcgcaccccaagagccagctttctcaggcgaagaggcaaaagcagcaaaaaggcctcgggtgggcaccccactggcaactgaagatagtggccgctctcaggactacgtggccttcgtggaaagtctactgcaagtgcagggacggccaggcgcgcccttctag

SEQ ID NO: 12263 - DNA, 3144 bp, Artificial Sequence
  Description of Artificial Sequence: Synthetic coding sequence
atggaagtggccgaagtggagtcccccctcaacccatcgtgcaaaatcatgacttttcgacccagcatggaggaattccgcgagtttaacaagtatctagcttacatggagtcaaagggggcccacagggccgggctggctaaagtaatccctccgaaagaatggaagccacgacagtgttacgatgatatcgataaccttctgatccccgcccctattcaacaaatggtcaccgggcagagtggtttgttcacacagtataacatccagaagaaagctatgacagtcaaggaattcaggcagctggcaaatagcggcaagtattgtactcccaggtacctcgactacgaggatttggagcgcaagtactggaagaatctaacttttgtggcgccgatctacggggccgacattaacggatcgatctacgacgaaggcgtggacgagtggaacattgcaaggctgaataccgtgcttgatgtcgtcgaggaggaatgcgggatttcaattgagggggtcaatacgccctatctgtattttggaatgtggaaaacaacattcgcctggcataccgaggatatggacctgtactctatcaactatctgcacttcggagaacctaaatcatggtatgcaatcccacctgagcatggcaaaagactggagcggttagcgcagggcttttttccctcgagctcccagggctgcgacgcattcctgcgccacaaaatgactctgatctctcctagcgttctcaagaaatacggtattccgttcgacaagataactcaggaagctggggagttcatgatcactttcccatacgggtatcacgccggattcaatcacggcttcaattgcgctgagtccaccaacttcgccactgtacgctggatagattatggtaaggtggctaagctttgcacctgccgcaaggatatggtcaagatttcaatggatatcttcgttcgcaagtttcagccagacagataccagctctggaaacagggaaaagacatctacaccatagaccacaccaagccgactcctgccagcacccctgaggtgaaggcatggcttcagcgtcgtcgcaaggtgcggaaagccagcaggtcatttcagtgcgctagatctacttccaagcggcctaaggcagacgaggaggaagaagtgtctgacgaggtggacggagctgaagttcctaatcctgactccgttacagacgatttaaaggtgtctgaaaaatctgaggctgccgtgaagctgcgaaacacagaggcctcaagtgaggaagagagctcggcctcccgcatgcaggtcgagcagaatttgtcagaccacattaagctgagcggaaactcctgtttgtcaacttccgtcacagaggacataaaaactgaggacgataaggcctatgcttaccgtagtgtcccatcaattagcagcgaagccgatgactccattccactgtcctcgggttacgagaaacccgagaaatcagacccctctgagctgagctggcctaagtcacctgaatcttgctcgagcgttgcagagtcaaatggagtgctgactgaaggtgaagaatccgacgtggagtcccacggaaacgggctcgaacctggagagatccccgccgttccctcgggagagaggaatagctttaaggtcccctctattgctgagggagagaacaagacatcaaaatcatggcgacatccgctctcccgaccccctgctcgctccccaatgacccttgtaaagcagcaagctccgagcgacgaggagctgccagaagtactttccattgaggaggaggtggaggagactgagtcatgggccaaacccctgatccatctttggcagaccaaaagccccaactttgccgctgagcaagagtataacgcaaccgtggcccgcatgaagccacattgcgccatatgtacgctgttgatgccttatcataagcccgacagctcaaacgaggagaatgacgcgcggtgggagacaaaattagacgaggtggtaacctctgagggtaaaactaagccgctcatcccagaaatgtgttttatttactccgaggagaacatcgaatattccccacccaatgcttttctggaggaagatggtacctctctgctcatctcttgcgcaaaatgctgcgtccgggtacacgctagttgttacggcatcccttcccatgagatctgcgacggatggttatgtgccaggtgcaaacgcaacgcctggaccgcagagtgctgtttgtgtaatttaagaggcggcgccctgaaacagaccaaaaataataaatgggcacatgtcatgtgcgcagtggccgttcccgaagtgcgctttacaaatgtccctgaacgaacgcagattgacgttgggcgaatcccgctgcaacgcttgaagctgaaatgcatattctgtcggcatagagtcaagagagttagcggagcctgcatccagtgctcatacgggagatgtccagcatcgttccacgtgacgtgcgcccatgctgccggggtgctgatggaaccggacgactggccctacgtggtaaatatcacttgttttcgccataaagtcaacccgaacgtaaaaagcaaggcatgtgagaaggtgatttcagtggggcagaccgtcattaccaaacaccgaaatacccggtattatagttgccgagttatggcagttactagtcaaaccttctacgaagtcatgtttgacgacggatctttcagcagggacactttcccggaagatatagtttcacgggattgcctcaagctgggacctccagcagaaggcgaggtggtgcaagttaagtggccagatggcaaactgtacggcgccaagtactttggatctaatattgcacacatgtatcaagtggagttcgaggatggctcccagattgccatgaaacgagaagatatttatacgctggatgaggaactacctaaacgcgtgaaagcaagattcgtgtccgctgggcgctgtcatctgggcacctgtcaagtcaattctctgagttccccgcacgtctcccaggctcagcaggagacatacttaggtttctggatcaatagcaaaaagtcccagtgtaacatttttctttctggaacgtactag

SEQ ID NO: 12264 - DNA, 3171 bp, Artificial Sequence
  Description of Artificial Sequence: Synthetic coding sequence
atggaggttgccgaggtggaaagcccactgaaccctagctgtaagatcatgacttttcgcccaagcatggaggaatttagagagttcaacaagtatctcgcgtacatggaatcgaagggggcccatagagccggactggccaaagtgataccccccaaagaatggaaaccccgtcagtgttatgacgatatcgacaacttactgattcccgcccccatacagcagatggtgaccgggcagagcggactctttactcagtacaatatccaaaagaaggctatgacagtgaaggaattccgccagctggccaactctggcaaatactgtacacctcggtacttggattacgaggatctagagcgaaaatactggaagaatctgaccttcgtcgcgccgatatatggggctgatatcaacggctctatatacgacgaaggagttgatgagtggaatattgctaggttgaacaccgtactggacgttgtggaagaagaatgtggaatctccattgagggcgttaatactccttacctgtatttcggaatgtggaaaaccacatttgcctggcacaccgaagacatggacctctactccattaattatctccatttcggggagcctaagagttggtatgccattcccccggaacacggaaaacgcctggaacggctcgcacaaggattttttccttcttcaagccagggttgcgacgccttcttaagacataagatgactctaatctctccaagtgtactaaaaaaatatggcatacccttcgataaaatcacacaggaagccggagagttcatgatcaccttcccctatggctatcatgccggatttaaccacggattcaattgtgctgagagcaccaattttgcaactgtgagatggatcgactatggcaaagtcgcaaagctttgtacatgtaggaaggacatggttaagatttccatggacatattcgtacgcaaatttcagccagaccggtaccaattgtggaagcaagggaaggacatatataccatcgatcatactaaacctacccccgcaagtacccccgaggtcaaagcttggctgcagagaagacggaaggttcgcaaggcctcacgcagctttcaatgtgctcgctccacatccaagcgcccaaaggcggacgaggaggaggaggtgtccgacgaggtggacggcgctgaagtgccaaaccccgatagtgttacagacgacctaaaggtgtcggagaaatccgaggccgcagttaagttaaggaatacagaggcatcgagcgaagaagaaagcagtgcttcccgcatgcaggtcgagcaaaatttgtctgaccatatcaaattatcgggaaatagctgtctgagtacatctgtgacagaagacattaaaacggaagatgacaaagcctacgcttaccgctccgtcccttcgatttcaagtgaagccgatgactccataccgctatccagtggctacgaaaaaccagagaagagcgacccaagtgagctgagctggccaaagagtcccgagtcttgcagtagtgtagctgaatcaaatggtgtcctaaccgaaggcgaagaatcggatgttgaatctcatggaaacggcctcgaacccggggaaatccccgcagtgcccagtggcgagagaaacagttttaaggtaccttcaattgctgaaggagagaacaaaacatcaaaaagctggcggcaccctctatctaggcctcccgccaggagccccatgactttagtgaagcaacaggcaccgtctgatgaggaacttcctgaagttctttctatcgaagaggaggtcgaggaaaccgaaagttgggccaaacctctgatccatctgtggcagacaaagtcgccgaacttcgctgcggagcaggagtataatgcaacagtggcccggatgaaacctcattgtgcaatctgtactctcctcatgccctaccataagccagatagctccaacgaagaaaacgacgccagatgggaaacaaagcttgacgaggtcgtaacttccgaggggaaaaccaaaccacttattccagagatgtgttttatttactcggaagaaaacatcgagtactcccctcccaacgcttttctcgaagaagacgggacctctcttctcatctcatgcgcaaaatgctgtgttagggtgcacgcctcctgctacggaatccctagtcacgaaatttgtgacgggtggctctgtgccagatgcaaacgaaatgcctggactgctgaatgctgtctgtgtaatttgagagggggtgccctgaagcagaccaagaacaacaagtgggcacacgtgatgtgcgccgttgccgtcccagaggtgaggttcaccaatgtaccagagagaacccagatcgacgttgggcggatccccttacaacgcctaaagctaaaatgtattttttgcagacaccgggtcaaaagagtctccggtgcttgtatacaatgctcctacggccgttgtcctgccagttttcacgtgacgtgcgcgcacgccgccggggtattgatggaacctgatgactggccatatgtagttaacatcacgtgtttcaggcacaaggtcaacccaaatgtaaagtctaaagcatgcgagaaagtgatatcagttgggcagactgtcatcaccaagcaccgaaatacccgctactatagttgcagggtaatggctgtgacgagccagactttttacgaggttatgtttgacgatggatcattcagccgagatacattccctgaagacatcgtgagccgcgattgtctgaaacttggccctccagctgagggggaggtggttcaggtcaaatggccggacggaaaactgtacggagcaaaatatttcgggtctaatatcgcccacatgtaccaggtggagttcgaagacgggtcccaaattgctatgaagcgcgaagacatatacacgctggacgaggagttacctaaaagagtaaaagcccgcttttctacagctagtgacatgcggtttgaggataccttctacggggcagatatcatccaaggggagaggaagaggcaacgggttctgtcatctcgattcaaaaatgagtacgtcgccgaccccgtctacaggacatttctgaaatcaagtttccagaaaaagtgccaaaagcgccagtag

SEQ ID NO: 12265 - DNA, 1065 bp, Artificial Sequence
  Description of Artificial Sequence: Synthetic coding sequence
ccagactcatccaatgaagagaacgacgcgcggtgggagacaaagctggatgaggttgtcacaagtgaaggcaaaacaaagccattgattcctgagatgtgtttcatttacagtgaggagaacatcgaatacagcccaccaaatgcgtttcttgaagaggatgggacatccttactcatctcatgtgctaagtgttgcgttcgggtgcatgcctcctgctatggcatacccagccacgaaatatgcgatggatggctctgtgcaagatgtaaacgaaacgcttggaccgcagagtgttgcttgtgcaacctacgcggtggggcccttaaacagacaaagaataacaaatgggcccatgtcatgtgtgcagtcgcagtgcccgaagtccgcttcactaacgtcccagagcgcactcaaattgacgtgggccgcatcccactccagcgattgaagttgaagtgtatattttgtcggcaccgggtgaaacgagtctcaggagcctgtatccagtgttcttacgggcgatgtcccgcctcctttcatgtgacttgtgcacatgccgccggagttctcatggagcccgacgattggccttacgtagtgaatatcacgtgtttccggcataaggtgaatccaaacgtgtttacagcccagtcgaagcactctaaaaatgaaagctgcattgccactaccactagcgcagccgcagctggcgcaactattctctgtgaattgggacacaagtctaaggcatgtgaaaaagtgatcagcgtgggacagacggtcatcaccaagcacaggaatacaaggtactattcatgtcgtgttatggccgtgacctcccagaccttttacgaagtgatgttcgatgatggcagcttctcccgcgacacattccccgaggatattgtatcccgagattgcttgaagttgggacctcctgcagaaggcgaggtggtccaggttaaatggcccgatggcaaactctatggcgccaagtacttcggaagtaatattgcccatatgtaccaggtagaatttgaagacggatctcagattgcgtag

SEQ ID NO: 12266 - DNA, 2232 bp, Artificial Sequence
  Description of Artificial Sequence: Synthetic coding sequence
atggtgaaaatctctatggacattttcgtgagaaagttccagccggaccgataccaattatggaagcagggcaaagacatttataccattgaccataccaagcctacccccgccagcacgcccgaggtaaaggcatggcttcagaggcgccggaaggtaaggaaagccagcagaagtttccagtgtgcccgttcaaccagcaaaagaccaaaggccgatgaggaggaggaggtatctgatgaggttgatggcgccgaggtgccaaacccagacagtgtaaccgatgacctaaaggtaagcgagaagagcgaagcggccgtgaagcttaggaataccgaggccagcagcgaagaggagagtagcgcatctcggatgcaggtggaacagaacctgtctgaccacataaagctgtccgggaacagctgtctgagcacatccgtcaccgaggacattaagacggaggacgacaaggcttacgcttaccgttccgtccccagcatctcatctgaggctgacgatagcatccccctctctagcggatacgaaaagcccgagaaatcggatccttccgaactgtcatggcctaagtctcctgaatcctgcagtagcgtggccgaaagcaacggcgtcttaactgaaggcgaagaaagtgacgtggaatcacatggtaacggattggagccaggcgaaattccagcagtcccatcaggtgagcgcaactctttcaaagtgccctcaattgctgagggggaaaataaaacaagcaaatcctggcggcacccattgtctcgacctcccgcgcgctcaccaatgaccctggtgaagcagcaggcaccatctgatgaggagttgcctgaggtgctgagcatcgaagaagaagtggaagagacagaaagctgggccaagccactcatacacttatggcagacaaagtctcctaattttgccgctgagcaagagtataatgccacagtggctcggatgaagcctcactgcgcgatctgtaccttgcttatgccatatcataaacccgatagtagcaatgaggaaaatgatgcccgctgggagacgaagctggatgaggtggtaactagcgaaggtaagaccaagccgttaatacccgagatgtgctttatttattcagaggagaacatcgagtattcccccccaaacgcattcctcgaggaggatgggacctcacttctcatttcctgcgctaagtgttgcgtgcgtgtgcatgcgtcttgctacgggatccctagccacgagatttgcgatggctggttatgcgcgagatgtaagcgaaacgcctggaccgcagagtgttgtctctgcaacctccgggggggggccctgaagcagaccaaaaataacaagtgggctcacgtgatgtgcgctgtggccgtcccagaagttcgattcactaacgtgcccgagcgaacccagatagatgttgggagaattccattgcagcggctgaagcttaagtgtatattctgccggcatcgtgtgaaacgggtgtcgggcgcttgtatccagtgtagctatggccggtgtccagccagcttccatgtcacttgcgcacacgccgcgggtgtgctgatggagcctgacgattggccctatgtggtaaatatcacttgttttcgacataaggtgaacccaaatgtcaagtctaaggcttgcgagaaggtgatcagcgtcggccaaacagtgataacgaagcaccggaacactagatattattcctgtagggtgatggccgtgaccagtcagactttctacgaggtgatgtttgacgatggttctttctcccgggatactttcccggaagatatcgtgtctcgggattgcctaaagttgggcccccctgcagagggcgaggttgtccaagtcaagtggcctgatggaaagctgtacggcgctaagtacttcggcagtaatatagcacatatgtatcaagttgagtttgaggacgggagtcagatcgccatgaagagagaggacatctatacgctcgatgaggaactccctaagcgagtcaaagcccggtttagcaccgccagcgatatgcgcttcgaggatacattctatggcgcagacatcatacaaggtgagcggaagaggcaaagagtcctgtcttcccgatttaagaatgagtatgtagcagaccccgtctatcgcactttcctgaagtcatcttttcaaaagaagtgccagaaaaggcagtag

SEQ ID NO: 12267 - DNA, 2406 bp, Artificial Sequence
  Description of Artificial Sequence: Synthetic coding sequence
atgtggaaaaccacattcgcctggcataccgaggacatggacctgtatagtataaattaccttcactttggagaaccgaagtcctggtatgcaattccaccagaacacgggaagagactggaacggctggcccaggggttcttcccgtcatcatcacagggatgtgatgcttttcttagacataaaatgacacttatttcgccttcagtcctgaagaagtatggcatcccgtttgacaaaatcacccaggaagcaggggagtttatgataacctttccatacggttaccatgcgggcttcaatcatggcttcaattgcgctgaatccacaaatttcgccactgttcgctggattgactacggaaaggtggccaagctgtgcacgtgtcgtaaagacatggtgaaaataagcatggatatattcgtccgcaagttccaacctgataggtaccagctgtggaagcagggcaaggatatctacacgattgaccatactaagccaacccccgcctccacacctgaagtgaaggcctggttgcagagacgccgtaaagtgaggaaggcttctaggtccttccagtgcgctcggagtacgtccaagcggccgaaagccgatgaggaggaagaagtgagcgatgaagttgatggcgccgaagtgccgaatccagattctgtcacagatgatctgaaggtaagcgaaaagtctgaagctgctgtgaagttgcgaaacacagaggccagttccgaagaggagagcagtgccagtcgcatgcaagttgagcaaaacctttcagaccacatcaagctctccgggaattcatgcttgtccacatcagtgacggaagacattaagacagaagatgacaaagcctatgcttacagatcggtcccaagcattagctcagaggccgatgacagcatcccattgagctccgggtatgagaagcctgaaaaaagcgatcctagcgaactgtcctggccaaaaagccctgagtcttgctcctcagtcgccgaatcaaatgagctcccagaggttctcagtattgaggaagaggtagaagagactgagtcctgggcaaagcccctcatccatttgtggcaaaccaagagcccgaacttcgccgctgagcaagaatacaatgcaaccgtggcgagaatgaaaccccactgtgccatttgcacactgctgatgccataccataaaccagattcgagcaacgaggagaatgacgcacggtgggagacaaaactggacgaggtcgtgacgtcagaaggaaagactaagccactaattccagagatgtgcttcatctactccgaggaaaacatcgaatactcgccccctaatgccttcctggaggaagacggtacatctcttcttatcagctgtgcgaaatgctgcgttcgcgttcacgcatcatgctacggtattcctagtcacgagatttgcgatgggtggctttgcgcgcggtgcaaacggaacgcttggacggcagaatgttgtttgtgtaatctgagagggggtgctctcaagcaaacaaagaacaacaagtgggcacatgtgatgtgtgcggtcgccgttccagaagtcagatttacaaatgtgcctgagcggacacagattgatgtgggtcgaatcccactgcagaggctcaagctgaagtgcatcttttgcaggcaccgcgtgaaaagggtaagtggtgcctgtattcaatgctcctacggtcgctgccctgccagtttccacgtgacatgcgctcatgccgccggcgtcctcatggagcccgatgattggccctacgtggtcaatatcacatgctttaggcataaggttaacccgaatgtcaaatcgaaggcgtgtgagaaggtgatcagtgtcggtcaaacagtgataacaaaacacaggaataccagatactattcctgcagagtgatggctgttaccagtcagacattctacgaagttatgtttgacgacggctcattcagcagggatactttcccagaagatatcgtgtctagagactgtctgaagttgggaccgcccgctgaaggcgaagtcgtgcaggtaaaatggccggatggcaagctgtatggggcgaagtactttgggagcaacattgcgcacatgtatcaagtcgaatttgaagacggctcacagatcgcaatgaagagagaggatatttatactttggacgaggagctccctaagagggtcaaagcccgcttctctaccgcatctgatatgcgcttcgaagataccttctacggagcagacatcatccagggtgagcgcaaaaggcaacgcgttttgtcgagtcgttttaaaaacgagtacgtagcagacccggtctacaggacctttcttaagtccagttttcagaagaaatgtcagaaaagacagtag

SEQ ID NO: 12268 - DNA, 2508 bp, Artificial Sequence
  Description of Artificial Sequence: Synthetic coding sequence
atgaagcactacggacttccctggaaacggacagaggaggccgctgccgataccgctctcaccattatggaggtggcggaagtggaatcgccccttaacccatcctgcaagatcatgacattccgcccttcgatggaggaattccgggagtttaataagtatctcgcttatatggaatcaaaaggcgcccatcgggccggcctagcaaaggtgataccccctaaggagtggaagccgcggcagtgttatgatgatatagataacttgctaatacccgcacccattcagcagatggtaacaggacagtccgggctgttcacacagtataacatacagaagaaagcgatgactgtgaaagaatttaggcagctggcaaactccggcaagtactgtactcccagatatctggactacgaggatctggaaagaaaatactggaagaatctaacattcgtcgcccccatctacggcgcagacataaatggcagcatttatgatgaaggggtggatgagtggaacatcgcgaggttaaatacagtactcgatgtggtggaagaagaatgtggcatcagtattgagggagttaatacaccttacctctactttggtatgtggaagacaacctttgcatggcacaccgaagacatggatctttattcaatcaattatctacactttggtgaacctaaatcctggtacgcgataccccctgagcacggcaagcgccttgagagactggcccaggggttcttcccctcgtccagccagggttgtgacgccttcttaagacataagatgactttgatttcaccatctgtgcttaaaaaatacggcatccccttcgacaagatcactcaggaagccggagaatttatgattactttcccctacggctatcacgccgggttcaaccacgggttcaactgtgcagagtcaaccaatttcgctacagtgcgttggatcgattatggaaaggtagccaagctttgcacatgccggaaggacatggtgaagatttccatggacattttcgtgagaaagtttcagccagacagatatcaactctggaagcagggtaaggatatatataccatagaccatacaaaacctacacctgcatctacacctgaggtcaaggcctggctgcagagacgcaggaaagtaaggaaggcgtcccgcagcttccaatgtgctaggagcacttccaagcgccccaaggccgatgaggaagaggaagttagcgatgaggtggacggggcagaggtgccaaatccagattccgtgactgatgacctgaaagtctctgaaaagtcagaggccgcagtcaaactccggaatacggaggcgtcgtcagaggaggagtcatccgcttccaggatgcaggtggaacagaacctgtctgaccacataaagctgagtgggaacagttgtttatccacgtctgtcacagaagatattaagactgaggacgacaaggcttacgcttatcgatctgtgccgtccattagctccgaggctgatgatagtatccccctctctagcggctatgagaagcccgaaaaatcagacccaagcgagctgtcctggcccaaatccccagaatcatgcagttcagttgctgaaagcaacggcgttttgaccgaaggggaagaaagcgatgtggagtctcatggtaatggattagaacccggcgagatccccgcagtgccctctggagagcgcaatagctttaaggtgccgtcaattgcggaaggagagaacaaaacttccaaaagctggaggcacccattgagccgtcccccagcccgcagcccaatgaccctggtgaagcagcaagctcccagtgatgaggagttgcctgaggtgctttctattgaggaagaggttgaagaaacagagagttgggccaaacctctcatccacctgtggcaaactaagtcgccgaacttcgcagccgagcaggagtacaacgccacggtggcacgcatgaaaccacattgtgccatctgcacactcctcatgccctatcataaaccagattcctccaatgaggagaatgatgcaaggtgggagacgaagcttgatgaggtggtgactagcgagggcaaaacaaagcccctgatcccagaaatgtgctttatctacagcgaagaaaatattgagtattcacccccgaacgcatttttagaggaggacggtaccagccttttaattagttgtgccaagtgctgtgtgagagttcatgcttcatgttatggcatcccatctcacgaaatctgtgacgggtggctatgcgcccgctgcaagcgcaatgcatggaccgcagaatgctgtctctgtaacttgaggggtggcgcgctgaaacagactaaaaacaacaaatgggcccatgtgatgtgtgccgtggcggtgcctgaagtgcgatttactaacgttcccgaaaggacccaaattgatgtagggaggattcctctgcagaggttaaagcttggaagactgggaatttag

SEQ ID NO: 12269 - DNA, 1890 bp, Artificial Sequence
  Description of Artificial Sequence: Synthetic coding sequence
atgtggaaaaccacattcgcctggcacaccgaggatatggatctctattctataaattacctccattttggcgagcctaaatcttggtacgccattccaccagagcacggaaagcggctcgagcgactagctcaagggttctttcccagttcatcacaggggtgtgacgcttttctccggcacaagatgaccctgatctcgcctagcgtgctgaaaaagtacggaattccctttgataagattacccaggaggccggcgagtttatgattacttttccctacggataccacgctgggtttaaccacggtttcaactgtgccgagagtacaaactttgctacagtgcgctggatcgactatgggaaagtcgctaaattatgcacatgtagaaaagacatggtcaagatctctatggatattttcgtcaggaagtttcagcccgatcgctatcagctgtggaaacagggaaaagatatctacaccatagaccacacaaagcctacgccagccagtactccagaggtcaaagcatggctgcagagacggagaaaagtgagaaaggcatcgcgatcattccagtgcgcaagatctacgtcaaagcggccaaaagctgacgaagaagaggaggtttcggacgaagtggatggggccgaggttcccaacccagatagcgtgacagatgatctgaaagttagtgagaaaagcgaggcagctgtgaagctgagaaataccgaggcatcaagtgaggaagaatccagcgcttcccgcatgcaggtcgaacagaacctctccgatcacataaagttgtcaggcaattcttgtctgtcgaccagtgtcacggaagatatcaaaacggaggatgataaagcctacgcataccgatctgtccccagcattagctctgaagctgacgattccatacccctgtcttccggctacgaaaagcccgaaaaaagtgacccaagcgagttatcatggcctaaatcccctgaaagctgtagcagcgtggctgaatcaaatggggtgctaaccgaaggcgaggagagcgacgtggagtcccacggcaacgggcttgaacccggggagatcccagcagtaccctccggagaacgtaactccttcaaggtgccaagcatcgccgagggggaaaacaaaacttcaaagtcgtggaggcacccgctgagccggcctcctgcccggagtccaatgaccctcgtgaaacaacaggccccttcagacgaggagctgcccgaagttctgagtattgaagaggaggtggaagaaaccgagagctgggctaaacccttgattcacctgtggcaaaccaaatctcccaacttcgctgcggagcaagagtataatgccaccgttgcgcggatgaaaccacattgcgcgatctgcaccctccttatgccctatcataagcctgatagtagcaacgaggagaatgacgcccgttgggagactaaattggacgaggtcgtgacctcagaagggaagacgaaaccactgataccggaaatgtgttttatttacagcgaagagaacattgagtattctcctcccaacgcttttctagaggaggatggcaccagcctgctgatatcctgcgcaaagtgctgcgtacgcgtgcacgccagctgctatggtatccctagccatgagatctgtgatggatggctctgcgcccgttgcaagcggaacgcctggacagcagaatgctgcctgtgtaaccttaggggaggagcgctgaagcaaaccaagaataacaagaacgcttcaagcgctgacactggactgcgcggctccttagagcctgccagttcagtgcccaccgtcgctgcgcggcctccaagcatgagcctcgtgccgatgctgttgggctactag

SEQ ID NO: 12270 - DNA, 2442 bp, Artificial Sequence
  Description of Artificial Sequence: Synthetic coding sequence
atggaggttgcagaagtcgaaagccccctcaaccccagctgcaaaatcatgacctttcgcccaagtatggaagagtttcgggagttcaataagtatctggcctatatggaaagcaaaggggctcatcgggcagggctcgccaaagtcattcccccaaaagaatggaagccccgacagtgctacgacgacatcgacaacttgctgatcccagcgcctatacaacagatggtcaccggtcagtcagggttatttacacaatacaatatccaaaagaaagcaatgaccgtcaaagaattcagacagttggcaaattccggtaaatactgcactccacggtacttggattatgaggatttagaaagaaagtactggaaaaatttgacgtttgtcgctcccatctatggcgctgatattaatggaagtatttacgacgagggtgtagatgagtggaacatcgcacgactgaacacggtgttggatgtagtcgaagaggagtgcggtatttcaatcgagggcgtgaacacaccgtatctgtacttcggaatgtggaaaaccacttttgcctggcacactgaggacatggacctctactcaattaactacctgcactttggggaacctaaaagctggtacgctattccccccgagcacggaaaaagactcgaaaggctggcacagggtttcttcccctcaagctcacagggttgtgacgccttcctccgtcacaaaatgactctcatctcccctagcgtgctcaaaaagtacgggatacctttcgataaaatcacacaggaggcaggggagtttatgatcaccttcccctatggctatcacgcgggctttaatcatggcttcaactgcgcagagtctaccaattttgctacagtccggtggatcgattacggaaaggtcgccaagctttgtacttgtagaaaggatatggtgaagatatcaatggatatctttgtgagaaaattccaacctgatcgatatcagctttggaaacaaggcaaggatatttacacaatcgatcatactaagcccacacctgcatcaacgcctgaagtgaaggcctggctgcagcgacgtcgcaaagtccggaaggcatctaggagttttcaatgtgcacgctcgacctccaaacgccctaaggctgacgaagaggaagaggtgagcgacgaggttgatggggcagaggttccaaatccggactctgtgaccgatgatttaaaggtctccgagaaatcagaggcagctgttaaactgaggaacacggaggccagttcagaggaggagagtagtgccagccggatgcaagtggagcaaaatctgtctgaccacatcaagctgtcaggcaacagttgcctgtccacatccgtcaccgaggatattaagactgaggacgacaaagcttacgcttacagatccgtgccttccatttcgagtgaggcagacgactccatcccactaagttctggctatgagaagccagagaagtcagatccttccgaactgtcctggcctaagagccccgagtcgtgttccagcgtcgccgaatcaaacggggtgctgacagagggggaggaatcggacgttgagagtcatggaaacgggctcgagccaggcgaaatcccagcggtgccatctggtgagcggaatagcttcaaggtgccatctatcgccgaaggagagaacaagactagcaaaagctggaggcacccactgtcccggcccccagccagatccccaatgacacttgtgaagcagcaggcaccctccgatgaagagctccccgaggtgctgagtattgaggaagaggtggaggagaccgaaagttgggcgaaaccccttattcatctctggcaaacaaaatcacctaatttcgccgccgagcaggagtataacgctaccgtggccaggatgaagcctcattgcgcgatttgcactctgctgatgccttatcataagccagattcttccaacgaagaaaatgacgcccggtgggaaacgaagctggacgaagtcgttaccagcgagggcaaaacaaagcccctgattccagagatgtgttttatttactctgaggagaacatcgaatactcaccccccaacgccttcctggaagaagatggaaccagtctgctgatctcttgcgccaagtgctgtgtccgcgtgcatgccagctgttacgggatcccttcccacgaaatttgtgacggatggctatgtgctcgctgtaagagaaatgcgtggacggcagaatgttgtctgtgcaatttgcgcgggggtgctttgaaacaaactaagaataataaatgggcccatgtgatgtgtgccgtcgcggtacccgaggtgaggttcaccaatgtcccggaacgaacgcagatcgacgtcggccgcattcctttgcagcgtcttaaactcgggcggctgggtatttag

SEQ ID NO: 12271 - DNA, 1572 bp, Artificial Sequence
  Description of Artificial Sequence: Synthetic coding sequence
atggagaccatgaagtcaaaagcgaactgtgctcagaacccgaactgcaatattatgatcttccatccaactaaggaagaattcaacgacttcgataagtacattgcatacatggagtcccagggggcccaccgggcagggctggctaagattatcccaccaaaggagtggaaggcccgtgaaacatacgataatatatctgaaatccttatcgccacccccctgcagcaagtagcatcgggtcgagccggggtgtttacacagtaccacaaaaagaagaaagccatgaccgtgggcgaataccggcacttggccaatagtaagaaataccagacaccacctcaccagaatttcgaagatctcgagaggaaatactggaaaaatagaatatacaatagccccatttacggagctgatatctctggttctctgttcgatgagaatactaagcagtggaacctggggcaccttggtaccatccaggacttattggagaaggagtgcggggtggttatagaaggcgtcaacacaccctatctatactttgggatgtggaagacaacattcgcctggcatactgaggatatggacctgtactcgattaactacctgcatcttggcgagccaaaaacgtggtacgttgtgcccccagaacatggtcagaggttggaacgcctggccagggagctgtttcccggcagcagcagaggctgtggcgcttttctgcgtcacaaggttgccctgatctctcctacagtgcttaaagagaatggtataccttttaacagaataacacaggaagccggtgaatttatggtgactttcccttacggctatcacgcaggattcaatcacggcttcaactgcgccgaggcaattaacttcgctacgccaagatggatagattacggtaaaatggcaagtcagtgttcttgcggtgaagcacgcgtaaccttctccatggacgcctttgtccgcatcctgcaaccagaaaggtacgatctgtggaaacgcggccaggacagggccgtcgtggatcacatggaacccagggtacccgcttcgcaggaattaagtactcaaaaagaggtccagctgcctcgacgagcagcccttgggctgcgccaattaccatcccactgggcacgacacagcccttggcccatggccgcgagatcaggaaccagatgtcatacacttgtttgtagcagccttccccgaagaagtgctgtgagtggtaccgctacccagccacgagcggctgctgtgcattcaagcaagaagcccagctcaacgcccagctcgacccctggaccctccgctcagattattcatccctctaatggacggaggggacggggaagacctccgcagaaacttagagctcaggagttgactctgcagacccccgccaagagaccgctccttgcagggacaacgtgtactgctagtggccccgaacccgaacccctgcccgaggacggcgccttgatggacaaaccagtgcctctcagccccggtctgcagcaccctgtaaaggcctccgggtgttcatgggccccagtgccatag

SEQ ID NO: 12272 - DNA, 1521 bp, Artificial Sequence
  Description of Artificial Sequence: Synthetic coding sequence
atgaaaagcgtgcactcttccccgcagaacacatcccacaccataatgaccttctacccgaccatggaagaattcgcagatttcaatacgtacgtcgcctatatggagagtcagggcgctcatcaagccggactcgccaaggttattcccccaaaggagtggaaggctagacagatgtacgacgatatcgaggatatccttatcgcaaccccactgcagcaagtgacctccgggcagggcggggtatttactcaataccacaaaaagaagaaagccatgagggtcggccagtacagacgcctcgccaacagcaagaaataccagacaccaccgcatcagaatttcgctgatctcgagcagagatattggaaatctcatcccggaaacccccccatctatggcgctgacatatcaggcagtctgttcgaggagagcacaaagcaatggaacttggggcatctgggaactatcctggacctactggaacaggagtgcggcgtggttatcgaaggtgtcaacacgccctatctgtacttcggtatgtggaagaccacgtttgcttggcacaccgaggatatggatctgtattccattaattacctccatttcggggagcctaagacatggtatgtagttccacctgagcatggccagcatctggaaagacttgcccgcgaactctttcctgacatctcaagaggatgtgaagcctttttacgacataaagtcgccctgatcagccccaccgtcctgaaagaaaacggaatccccttcaattgcatgacccaagaagccggtgaatttatggtaaccttcccctacgggtaccatgccgggttcaatcacggattcaattgcgccgaggccatcaatttcgccaccccgcgctggatcgattatggcaaaatggcatcacagtgtagttgcggtgaatccaccgttaccttcagtatggatccttttgtgagaattgtccaacccgagtcctatgagctgtggaaacaccgtcaggacttagctatagtagagcataccgagcctagggtggctgaatcacaagaactaagcaattggcgtgacgacattgtattgcggcgggccgcactgggcctgagactgctccctaatctgaccgcacagtgtcctactcaacccgtatctagcggccattgttataaccctaaaggatgcgggacagacgctgtccctgggagtgcgtttcagagtagcgcttaccatactcagactcaatcccttacattggggatgtccgcccgcgtcctgttgcccagcaccggcagctggggaagtgggcgggggaggggtcggggtcaggggcagggaaggggatgtagccgaggtcggggtcatggatgttgtacgagggaactggggacagaggagcctacagtgcagcccgcctctaagcgtcggttgttgatgggcacccgcagccgcgcacagggtcatagaccacaacttcctctagctaacgacctcatgaccaacttaagcttatag

SEQ ID NO: 12273 - DNA, 1080 bp, Artificial Sequence
  Description of Artificial Sequence: Synthetic coding sequence
atgatcgccgcccaggccaagctggtgtatcagcttaataaatactacactgagcgttgtcaggcccggaaagccgcgatcgcaaagaccatcagagaggtctgtaaagtggtgagcgacgtgctgaaggaggtcgaggttcaggaaccacgcttcatctcaagcttaagcgaaattgacgcacgttatgaagggctagaggtcatttcacctacagagtttgaggtggtcctgtacctgaatcagatgggagtgtttaacttcgtggatgatggttctctgcccggctgtgcagtgctgaaactgtccgacggacggaaaagaagcatgagtttgtgggtggagtttatcaccgcttctggctacctatcagcacgcaagattcgcagtcgattccagacactagtggcccaagctgtggataaatgtagctacagggatgtggtgaagatgatcgctgatacctccgaggtcaaactccgaatcagggaacggtatgtggtgcagatcaccccagctttcaaatgcaccggcatttggccacggtctgccgcacaatggcccatgcctcacattccttggcctgggcccaatcgtgttgcggaagttaaagccgaaggctttaacctcctaagcaaagaatgctatagtctcaccggtaagcagagcagcgctgaaagcgatgcatgggttctgcaatttggagaggcggagaatagattgctgatgggcgggtgtaggaacaagtgtctgagcgtattgaaaacattgagggataggcacctcgagctgcctgggcagcctctcaataattatcatatgaaaaccctcctgttatacgagtgtgagaagcacccgcgggaaaccgactgggatgagtcgtgcctaggcgaccgacttaacgggattctgcttcaattaatcagctgtctgcagtgccgacgttgccctcactattttctgcccaatcttgatctgttccagggcaagccacattctgctctcgagagcgcggccaaacaaacctggcgactggccagagagatcctgaccaatcccaagagtcttgataaattgtag

SEQ ID NO: 12274 - DNA, 447 bp, Artificial Sequence
  Description of Artificial Sequence: Synthetic coding sequence
atggcagtggccagcgacttctatttaaggtactatgtgggtcacaagggcaagtttggccatgaatttctggagttcgaatttaggcctgatgggaagctgcgatatgctaacaattctaattacaagaatgacgtaatgattaggaaggaggcgtatgtacacaagtctgtgatggaagagctgaaacgaattatcgatgatagcgaaattaccaaggaggatgatgctctctggcctcctccagatcgcgtcggcaggcaagaacttgaaatcgtcattggggacgagcacatctcatttacgacgagcaagatcggttccctgatcgatgtgaaccagtcgaaagaccccgagggtctgcgcgtcttctattatttggtacaggatttgaaatgtctggttttcagccttatcgggctccacttcaagattaaaccaatttag

SEQ ID NO: 12275 - DNA, 336 bp, Artificial Sequence
  Description of Artificial Sequence: Synthetic coding sequence
atggccgtcgcctcagatttctatttgagatactacgtcggacacaagggtaagttcgggcatgagttcctcgagttcgaattccggcccgacggcaaactgcgatacgcaaataattctaactacaagaacgacgttatgattcggaaggaggagctcgagatcgtgatcggggatgaacacatcagctttacgacctctaaaataggatccctgatcgacgtaaaccagtctaaagacccagaaggactgcgggtattttactacctggtacaagatctgaaatgtctagtcttctccctcatcggcctgcattttaagattaaacccatctag

SEQ ID NO: 12276 - DNA, 1041 bp, Artificial Sequence
  Description of Artificial Sequence: Synthetic coding sequence
atggcccctcgatccctgttgttactattgagcggcgccctcgcattaaccgatacatgggcaggtagtcactcacttcgatattttagcacagctgtgtccagaccgggacgaggagaacctcgttacattgcggtggaatacgtcgacgacacccaatttttgaggtttgacagcgacgccgccattccacgcatggaacctcgagagccttgggtggagcaggagggtccacaatactgggaatggactacagggtatgcaaaagccaatgcacaaactgacagagtcgccctccgcaacctcctcaggaggtataaccagtcggaagctggttcccataccctgcaaggaatgaacgggtgcgatatggggcccgatggccggctgctgagaggctaccaccagcatgcttacgacggtaaagattacatatctctgaacgaggacctgcgctcatggaccgcagccgacaccgtggcacagatcacccaacggttctacgaggcagaagagtatgccgaggagttcaggacatatctggagggagagtgcctggaactcctacggagatatttggagaatggcaaggaaacattacaacgcgcagacccacctaaggctcatgtggcccatcacccaatttcagaccatgaggccaccctgaggtgctgggcccttgggttttatcccgctgaaattacactcacatggcagcgggatggtgaagagcagactcaagacaccgaacttgtggaaacacgccccgcaggagatggcactttccagaagtgggccgctgtggtggtgcccagtggagaagagcagaggtatacctgccacgtgcagcatgaaggactgccacagcccctgatcctccgatgggagcaatcacctcagccaacaatacctatcgttggcatagtggccggtttggtggtgctgggggcagtagtgactggggccgttgtggctgccgtcatgtggagaaagaaaagttcagaccggaatcggggctcatatagccaagccgctgtgtag

SEQ ID NO: 12277 - DNA, 903 bp, Artificial Sequence
  Description of Artificial Sequence: Synthetic coding sequence
atgcagagtgatgacgtgatatgggatacgctcggcaacaaacagttttgctccttcaagataaggacaaagacacagtccttctgccggaacgagtactcccttaccgggctctgcaatcgaagctcttgcccgcttgctaacagccagtacgctacaattaaagaggagaaggggcagtgttatctctatatgaaagtcattgaacgagcagcatttccaaggcgactctgggagcgggttagactatccaaaaactacgaaaaggccctggaacagatcgacgaaaacttgatttactggccacgcttcatccggcacaaatgtaaacagagatttacgaaaataacacagtacctcattcgaatccggaaacttaccctgaaacggcagagaaagctagtccctctgtccaaaaaagtcgagcgccgcgaaaagagacgggaagagaaggcgctgatcgcggcccagctcgacaatgctatagagaaggagttgttggagcgattgaaacaggacacttatggcgatatttacaatttccccatccacgcattcgataaagcccttgagcagcaagaagctgagagtgacagttccgacaccgaagaaaaagacgacgatgatgatgatgaggaggacgttggtaaaagagagtttgtggaagatggcgaggtggatgagtcagatatttctgatttcgaagatatggataaacttgatgcttcttcagacgaagatcaagacggcaagtcaagttccgaggaggaggaagagaaggccctgagcgccaaacacaaggggaagatgccattgcgcggtcccctacaacgcaaacgggcctacgttgaaatcgagtatgaacaggagacagagccagtggcaaaagcaaagacgacctag

SEQ ID NO: 12278 - DNA, 1056 bp, Artificial Sequence
  Description of Artificial Sequence: Synthetic coding sequence
atggagaggagaatgcaactcgtcaagaaggataatgaaaaagaaagacacaagctgtttcaaggatatgaaactgaggaacgcgaggagacagaactgagcgagaagataaaattggagtgccagcctgagcttagcgagaccagtcaaaccctgccaccaaagcctttctcttgcggtagatctggcaaaggccacaaaagaaagagccccttcggatccactgaacgcaaaacccccgtcaagaagctcgcaccagaattttccaaggtaaaaacaaaaactccaaaacattcccccattaaagaagagccctgtggcagcctctcggaaaccgtgtgtaagagggaactgagatctcaggagactcccgagaaaccacggagctccgttgacacacccccacgtctctccactccccagaaggggccttcaactcatccaaaagaaaaggcattttcttccgagatcgaggacctgccatacctgtccaccacagaaatgtatctctgtcggtggcatcagcccccccctagcccacttcccttgcgagaaagtagccctaagaaagaggagacagtggcaaggtgtcttatgcccagcagcgtggcaggcgagacgtctgtcctggcagtaccctcttggagagatcactcggttgaaccactccgcgaccctaatccatcagatctcctggagaacctggatgattcggttttttcaaaaaggcatgccaagctggaactcgacgagaagcgcaggaagagatgggatattcaaagaatcagagaacagcggatcctgcagagacttcagttgaggatgtacaaaaagaaaggtattcaggaatcagaacccgaagtcacctcattttttcctgagcctgatgacgtggagtcactaatgatcactccattcctcccagtggtagcattcggacgccctctgcctaaactgacaccacagaattttgaactgccatggctggatgagagaagccgctgcagactcgagattcagaagaaacaaactccacatcggacatgcaggaagtag

SEQ ID NO: 12279 - DNA, 1845 bp, Artificial Sequence
  Description of Artificial Sequence: Synthetic coding sequence
atgacaatgcggagcgcagtcttcaaggcagcagcagcccccgcgggtggaaaccccgaacagagactggattacgaaagagccgctgcactgggtggacctgaggatgaaccaggcgctgcagaggctcactttcttccacgccaccgaaagttgaaggagccagggcctcccttggccagcagtcagggaggctctccagcgccttcccctgccggttgcggtggaaaaggccggggcttactgctccccgcaggtgcagctcccggccagcaggaagagagctggggcgggagcgtcccactcccttgtccgcctcctgctactaagcaggcggggataggcggggagcctgcagcggccggggccgggtgctctccacggccaaagtatcaggctgtgcttccgattcagacgggaagcctggtggccgccgccaaggagcccaccccatgggccggggataagggtggagccgctagtccagcagccacagcctcagatccagctgggcccccaccgctgcccttgccaggcccacctccgcttgccccaaccgctacagccggcaccttagccgcctctgaaggaaggtggaagtccatgagaaaatcccccctaggaggaggcgggggctctggtgcgtcctcccaggccgcatgcctcaaacaaatactcctgttacaactcgacctgatagaacagcagcagcagcaattacaggccaaggagaaggagatagaggagctgaaaagtgaacgagacaccttactggcccgcatcgagagaatggaacgaagaatgcagcttgttaagaaggacaacgaaaaagagcggcacaagttgtttcagggctatgaaacggaagagcgagaggagacagagctatcagagaagataaagcttgaatgccagcctgaactgagcgagacttcccagacgctccctcccaaacctttctcctgcggtcggagtggaaaagggcacaagaggaaatctcccttcggctccaccgagcgaaaaacaccagtgaagaagctggcccctgagtttagcaaggttaaaaccaagacacccaagcactctcctattaaggaagaaccctgcggctccctttcagaaacagtatgtaaacgggaactcagatcccaggagacacccgaaaagccacgaagttccgtagacaccccaccccgcctttcaactccacaaaagggcccctctactcatcctaaagagaaggccttctcttcagaaatagaggatctgccctatctgtctacaacggagatgtatctgtgtaggtggcaccagccccccccctccccgttgcccctgcgcgagagctcaccgaagaaagaggagaccgtggctcggtgccttatgccctcttccgtcgccggcgagacctccgtgctcgctgtacctagctggcgggatcattccgtggagcctctacgggatccgaacccatctgaccttcttgaaaatttggacgattctgttttcagcaaacgccatgcaaagctagaacttgatgagaaaagacgaaagcgctgggacatccagaggatcagggaacagaggatcttacagcgcctccagttgcgtatgtataagaagaagggtattcaagaatctgagccagaggtgacctcatttttccccgagccagacgatgtggagagcctgatgattactccattcctgccggtggtggcattcgggcgacccctcccaaaacttacgcctcaaaattttgagctcccctggttggacgagcgcagccggtgcagactcgaaattcagaagaaacaaactcctcatcgaacatgcagaaaatag

SEQ ID NO: 12280 - DNA, 1056 bp, Artificial Sequence
  Description of Artificial Sequence: Synthetic coding sequence
atggagagacgcatgcaactagttaagaaggacaacgaaaaggaacgtcataaactgtttcagggctatgaaacagaggagagagaagaaaccgaactgtcggaaaagatcaagttggagtgccaacctgaactgagtgagaccagtcagaccctgccgccaaagcctttcagttgcggacgtagcggaaaaggccataagcggaagtcaccttttggttcaaccgaaaggaagacgcctgtcaaaaaactggcccctgagttctccaaagtgaaaactaaaacgccaaaacactctcctatcaaggaagagccgtgcggctcattgagcgaaacagtctgcaagcgagagctgcggagccaagaaacgccagagaagccccgatctagtgtggacacgcctccccgcctcagcacccctcaaaaagggccctctacacatcccaaagagaaagctttttcctccgaaatagaagatcttccctacctgtccactacagaaatgtacctgtgtaggtggcatcagccgccccctagcccccttcccttgagggaaagcagtccaaagaaagaggaaacggtcgcaagatgccttatgcccagtagtgtggcgggagagacatctgtcttagcagtgccctcatggcgggatcattccgtagaaccgctgagggatcccaaccccagcgatcttttggagaacctggacgattccgtattttccaagcggcacgcaaagctcgaactggacgagaaacgtcggaagcggtgggacattcaacggattagggagcaacgcatattgcaacgcttacagctgcgcatgtacaagaagaaggggatccaggagtcagagccggaagtgacatcattttttcccgagccagatgatgttgaatctcttatgatcacgccgttcctgcctgtggtggcctttggcaggcctctgccaaagctcacaccccagaattttgaactgccctggctcgatgaacggtctcggtgtcggctggaaatccagaagaaacagaccccacataggacttgcagaaagtag

SEQ ID NO: 12281 - DNA, 1734 bp, Artificial Sequence
  Description of Artificial Sequence: Synthetic coding sequence
atgaacccagtgaacgctaccgccctctacatttcggctagcagactggttctgaactatgatcctggggacccaaaagcctttactgagatcaatcgtcttctcccctactttcgacagtcactgagctgctgcgtgtgcggccacctgctgcaagacccaattgctcctactaattctacgtgccagcactacgtgtgtaagacttgtaagggaaagaaaatgatgatgaaaccctcatgctcttggtgtaaggattatgagcagttcgaggaaaacaaacagctatcaatcctggttaactgttataaaaagctttgtgagtacataacgcagactaccctggccagagacatcatcgaggcggtggactgcagctccgacatcttggcacttctgaatgatggctcactgttttgtgaagagacagagaaaccgtcagatagctcgttcacgttatgtctcactcatagccctctgccttctactagtgaacctacaacagaccctcaagcctctttgtcccctatgtctgagtctaccctgtcaatcgccatcggttcgtccgtaatcaatgggctgcccacctataatggcctgagcatcgaccgattcggaatcaacatcccaagccctgaacatagcaacactatcgacgtatgtaatactgtggacatcaaaactgaagacctgagcgattcactccccccagtgtgcgataccgtcgccaccgatctttgtagtaccggcattgatatctgttcattttccgaagacattaagcctggtgacagtcttttgctttctgtggaggaggtgcttagatctcttgagactgtctctaataccgaggtctgttgtccaaatctgcagcccaatctggaggctaccgtgtccaacggtccatttcttcagctttcaagtcagtcactcagtcacaatgtttttatgtcaacgtctcccgcactgcacgggctgagctgtactgcggcaacacctaaaatcgcgaaactgaatagaaagaggagcagatcggagagcgacagcgagaaggtccagcccctgccgatctcgaccatcatacgcggccctacgctgggcgcttctgcccctgtgactgtaaagcgcgaaagcaaaatctcccttcaaccaatcgccacagttcctaatggaggtacgacgcctaagatctccaagactgtcctcctttctacaaagtcgatgaagaaatctcacgaacatggttcaaagaaatctcacagtaaaacgaagcctggtatcctaaagaaagacaaggccgttaaagagaaaatcccttcccaccatttcatgcctggctctcccactaagactgtgtacaaaaagccgcaggagaagaagggctgcaagtgtgggcgcgcaactcagaacccttctgtactcacttgtcgaggccaaagatgtccgtgttactctaacagaaaggcctgtctggactgtatctgtagaggttgtcagaattcctatatggccaatggagaaaaaaagttagaggcttttgccgtgcccgagaaggcccttgagcaaactaggttaactctcgggattaatgtcactagcatcgccgtgcggaacgcgtcaacatccacgtctgtgattaacgtaaccggaagccccgtgactacatttctcgccgcctctactcatgacgacaaatctctggatgaggccatcgacatgcggttcgattgttag

SEQ ID NO: 12282 - DNA, 1512 bp, Artificial Sequence
  Description of Artificial Sequence: Synthetic coding sequence
atgatgatgaagccctcgtgttcttggtgcaaggactacgagcaatttgaggagaacaaacagctttctatcctcgtgaattgctataagaaactgtgcgaatacatcactcagacgacgctcgccagagatattatcgaagccgtggactgcagcagtgacattctcgcccttcttaatgatggctccttattctgcgaagaaactgagaagcccagtgatagtagcttcacactctgtctgactcacagcccattgccctccacatctgaaccaacaactgatcctcaggcaagcttgtctcccatgagcgagtccaccctgtctattgctattgggagctccgttatcaatggcctgcctacctacaatgggttgtcaatcgacagatttgggatcaacatcccttcccctgagcattccaacactatagacgtttgcaatactgtagacatcaagactgaggatttgtcggacagcctcccaccagtgtgcgatacagtggctacagacttatgtagcacgggcatagatatctgcagctttagtgaggacatcaagcctggggattccctgctgctaagcgtagaagaggtgttgcgctctcttgaaaccgtcagcaacacagaggtctgctgtcccaacctgcagccaaacctggaggccacggtgtcaaatggcccattcctccagctatcttctcagtctctttcccataacgtctttatgagtacaagcccggcgctgcacggcctgtcctgcacagccgcaacacccaaaatcgcaaagttaaacagaaagagatcccggagcgaatcggattcagaaaaagttcagccactcccaatttctaccatcatcaggggccccaccctcggagcatcagcccctgttaccgtgaagagggagtccaaaatctccctgcagccgatagcgacagttcctaatggtggaacgacacccaagattagcaaaacagtgctgctttccaccaaaagcatgaagaaatcacacgaacacgggtctaagaagtcccactcaaagacaaaaccgggtatcctcaagaaagacaaagctgtcaaagaaaagataccttcacatcattttatgcccggctcaccaactaagacggtgtataaaaaaccacaggagaagaaaggatgcaaatgtggccgagccacacaaaacccctctgtactgacatgtagagggcagcgatgtccttgttacagcaaccgcaaggcatgccttgattgtatttgtaggggctgccagaatagctatatggccaacggtgaaaagaaactcgaggcgttcgctgtgcccgaaaaggccttggagcagaccagactgacactggggatcaatgtcacttcaattgcagtgcgtaatgcttctacatcgacctctgtcattaatgttaccggatcacccgtgactacgtttctggccgcaagtactcatgacgacaagtccttagacgaggctatcgacatgcggtttgattgttag

SEQ ID NO: 12283 - DNA, 1566 bp, Artificial Sequence
  Description of Artificial Sequence: Synthetic coding sequence
atgtcagcctcggaaggcatgaaatttaagttccatagcggagaaaaagtgttatgcttcgaacccgacccaaccaaggctagggtactttacgacgcgaagattgtggatgtgatcgttggtaaggacgagaaaggccggaaaattcctgaatacctgatacacttcaacgggtggaataggagctgggaccgatgggccgccgaggaccatgtgttacgggataccgacgagaatagacggctccagcggaagctcgctaggaaagccgtcgcccgtctacgttcgactgggagaaagaagaaaaggtgtcggttaccaggagttgattcggttctcaaaggcctgcccaccgaggaaaaggacgaaaatgatgaaaacagcctgtcctcttccagtgattgttcagagaataaagatgaagagatcagcgaggaaagcgacatcgaagagaagaccgaggtcaaagaggaacctgagcttcagacccggcgagagatggaggagagaacaattacaatcgagataccagaggtgttgaagaaacagctggaagatgactgttactatattaatcgcaggaagcgactcgtgaaacttccttgccagaccaacatcatcacaatcctcgagtcttacgtgaaacacttcgccatcaacgcggcatttagcgcgaacgagcgaccacggcaccaccatgtgatgccccacgcgaacatgaacgtccattatatccccgctgagaagaatgtggatttatgtaaggaaatggttgacgggctgagaattacattcgactatacactgcctctggtgctgctgtacccctacgagcaagcccagtacaagaaagttacatcatctaaattctttttgcccattaaggaaagtgccaccagcactaataggagccaagaggaactctcaccaagtcccccactgctaaacccttccacacctcagtccacggaatctcaacctaccacaggagagcccgctactccaaagcgacgaaaagccgagcctgaggcacttcaaagcctgaggcggtcaacacgccactcagcaaattgcgaccgcttaagcgaatcttctgcatctccccagcccaagaggagacagcaagacactagcgcctcaatgcccaagctgtttctgcatctggaaaaaaaaactcctgttcactctcgaagctctagccctatccccctaacaccctcgaaggagggctctgctgttttcgctggattcgaaggtaggcggacaaacgagatcaatgaagtactgtcctggaaactggtgccagacaactatccccctggtgatcagccaccccctccaagctacatatatggcgcccaacatttgctgaggctgtttgtgaagctgcccgagattttgggaaagatgagtttcagcgagaaaaatctcaaggctctcctcaaacatttcgatttattcttgcgctttctggctgagtaccacgatgatttttttcccgaatctgcatacgtggccgcgtgcgaagcccattactccacaaaaaacccaagggcgatttactag

SEQ ID NO: 12284 - DNA, 1251 bp, Artificial Sequence
  Description of Artificial Sequence: Synthetic coding sequence
atgtccgctagcgaggggatgaagtttaaatttcattcaggtgaaaaagtgttatgcttcgagccagatccaaccaaagcacgcgtcctgtacgatgccaaaatcgtggatgtgatcgtcggtaaagacgaaaagggaaggaaaatccccgaatatctgatccactttaacgggtggaatcggtcttgggatcgctgggctgccgaggatcacgttctgcgagatacagatgaaaaccgtcgcctacagaggaaactcgccagaaaggctgttgcccggctgagatcaaccggtaggaaaaagaaaaggtgtcgactgcctggtgtggacagtgtgttgaagggcctgccgaccgaggagaaagacgagaacgacgaaaactctctgagctccagctcggattgttctgaaaacaaggacgaggagatctctgaagagtccgacatagaagagaagactgaagttaaggaagagcccgagttgcagacacgcagagagatggaggaacgcacaattacaatcgaaatcccggaggtattaaaaaaacagctggaggacgattgctattatattaaccggcgtaagcgactggtcaagttaccatgccagacaaacataattacaatcctggagtcgtacgtgaagcactttgcaatcaacgccgcttttagcgctaacgagaggcccagacaccaccacgttatgcctcatgccaacatgaacgttcactacatccccgccgaaaaaaacgtcgatttgtgtaaagagatggtggacggactgcgaataacgttcgactataccttgcccctcgttcttctttacccctacgaacaagctcagtacaagaaggtgactagctccaagttcttccttcccattaaagaatcagcaacctctacaaacagatcgcaagaggaactgtccccctcccctccactattgaatccctcaaccccacagtccaccgagtcccagcccacgaccggagagccagctacgcctaagcggcggaaggctgaacctgaggcactgcagtcactaagacgatccacacgccactcagccaactgcgaccggctctcagagtccagcgcaagcccacagcccaaacgacggcaacaggacacctctgcatccatgcccaagttgttcctgcatcttgagaaaagccgctttatactcggctgcccaagaccaggccgagcctcagtctactttgttttcagccagtgtcaggcctggtgttag

SEQ ID NO: 12285 - DNA, 1119 bp, Artificial Sequence
  Description of Artificial Sequence: Synthetic coding sequence
atgaagatgatgaagacgaaggaagagcctgaacttcagactcgccgggagatggaggagaggaccatcaccattgaaatccccgaagtgctcaaaaaacagctggaggacgattgctactatataaataggcggaagaggctggtcaagttgccttgccagacgaacattattacgatcctggagtcttatgtgaaacatttcgctattaacgcagcctttagtgctaatgaacggccccgccaccatcacgtgatgccccacgcaaacatgaatgtgcactatattcctgccgagaaaaatgtcgacctctgcaaggagatggtggacggtctgcgtattacctttgattataccctcccactggtcttgttgtatccgtacgagcaggctcagtacaagaaagtgacaagtagcaaattctttctcccaatcaaggaaagcgcaacctccacaaacagaagtcaggaagagttgtctccgtcaccacccctcctcaaccccagcacaccccagagtactgaaagccaaccaactacaggggagcccgctaccccaaagagaaggaaagccgagcctgaggcccttcagagccttagacgctctactaggcatagtgctaattgtgaccgcttaagtgagtcaagtgcttctccacagccaaaaaggcggcagcaagatacttctgccagcatgcccaagctgtttctgcacctggaaaagaaaacccccgtccacagcagaagctcttctcctattcctttgacaccctctaaagaaggctctgctgttttcgccggcttcgaaggccgaaggactaacgagatcaacgaggttctgtcatggaagttagtgcctgataattaccctccaggcgaccagcccccccccccctcctatatttatggggcacagcacctgctgcgattgtttgtgaaattgcccgaaattctggggaaaatgtctttttccgaaaaaaacttaaaggcccttctgaagcatttcgacctctttctgagattcctcgccgaatatcacgacgactttttcccagagtcagcctatgtggcagcctgtgaagcccattactctaccaagaaccctagggccatatactag

SEQ ID NO: 12286 - DNA, 591 bp, Artificial Sequence
  Description of Artificial Sequence: Synthetic coding sequence
atggaagagcgcacgattaccatcgagatacctgaagtgttaaaaaagcaactggaagatgattgctattacatcaacaggcggaaacgattagtaaaactgccctgccagactaatattatcaccatcctggagagctacgtcaagcatttcgctattaacgcagccttttctgcaaacgagaggcccagacaccatcacgtgatgccccatgccaacatgaacgtccattacattcccgctgaaaaaaacgtcgatctttgcaaggagatggtggacgggctgcgtataacatttgactatacactcccactagtccttttgtacccctatgaacaggcccagtataaaaaggtgacaagctccaagttcttcctgccaatcaaggagtctgcaacgtctacaaacaggagccaggaggagttaagtccaagcccacctctactcaaccccagcaccccccagagtaccgagagccaaccaaccaccggagagccggctacccccaaacggagaaaggcggagcccgaggctctccagtcgctgagacggtctacgcgacactccgccaactgtgatagactctcttag

SEQ ID NO: 12287 - DNA, 1068 bp, Artificial Sequence
  Description of Artificial Sequence: Synthetic coding sequence
atggaagaacgaaccatcactatcgaaatccctgaggtgctgaaaaaacaattggaggacgactgctattatattaatcggaggaagcgattagtgaagctgccatgccagaccaatattatcactatacttgagtcgtacgttaagcactttgcaatcaacgctgctttctcagccaatgaacggcctcgccaccatcatgtgatgcctcatgcgaatatgaacgttcattacatacccgccgagaagaatgtcgacctttgcaaggagatggtggacggactccggattaccttcgactacaccctgcccctggttcttttatatccctacgaacaggcccaatacaagaaggtgacatcctcgaagtttttcctgcccataaaggagagtgccacttctacaaaccgaagccaagaagaattaagcccttcgccgccactccttaacccctcaaccccgcagtccactgagagtcaaccgacaaccggagagcccgccacaccaaagcgccggaaggctgagcccgaggcactgcagagcctgagaaggtccacccgacacagtgccaattgcgacaggttatcggagtcctctgcgtccccacaacctaaacggagacagcaggacacttccgcctccatgcccaaacttttcctgcacttagagaaaaaaacaccggtccactctagaagctcctcaccaatccctttaacaccatcaaaggagggctctgccgtttttgcaggatttgaggggcggcgcacgaatgagattaacgaggtgctctcttggaagctggtgccagacaattacccccctggcgatcagccccctcccccctcctacatttacggcgcccagcacttgctgaggttatttgtgaaacttccagagatcttgggcaagatgagtttctctgaaaagaacctaaaggcccttttaaagcacttcgacctcttccttcgtttcttggcagaataccacgatgacttcttcccagagtccgcctatgtggcggcatgcgaggcccactactcaaccaaaaatcccagagctatctattag

SEQ ID NO: 12288 - DNA, 1530 bp, Artificial Sequence
  Description of Artificial Sequence: Synthetic coding sequence
atgtccccctccgtcagacctggcgcagggtgggccccagtcggaagacccgggcgtccgatacaaatcgtcgacgttatcgtggggaaggacgaaaaaggaaggaagataccagaatatctcattcactttaacggatggaatagatcctgggatcgctgggccgccgaagaccatgtcttacgagatactgatgaaaatcggcggttgcaaaggaagctggcccgcaaagcggtggcgcgactccgcagcactggaagaaaaaaaaagaggtgtcggctgcccggcgtggatagtgtacttaaagggttgccgacggaagaaaaggacgaaaacgacgagaactcgctgagcagcagctccgattgttcagagaataaagatgaagagatctctgaggaatctgacatcgaggagaaaactgaggtcaaagaagaaccagaacttcaaacaagaagagagatggaggagagaaccattactattgagatccctgaagtgctgaagaagcagctcgaggacgactgctattatattaaccgccgcaaacgcctcgtgaagctgccgtgtcagacaaacatcattaccattctcgagagctacgtgaagcattttgctatcaacgccgcttttagtgccaatgagcgccctcgccaccatcatgttatgcctcacgccaatatgaacgtgcactacattcctgccgaaaaaaacgtcgatttgtgcaaagagatggtagacggtcttaggattaccttcgattataccttgcccttagttctgctctatccctacgaacaggctcagtataagaaggtcacctccagcaagttttttctacctattaaagagagtgccacgagtactaataggtcccaggaggagttaagtccctcaccaccgctcttaaacccgagcacacctcaatccactgagtctcaacctacaactggtgagcctgctactccgaaaaggcgtaaagccgagccagaagctctgcagtcattgcgtcgatccactaggcattcagctaattgcgacagactgagtgaaagttccgcctcaccgcagccaaagcgacgccagcaggacactagcgctagcatgccaaaattatttctgcacttggagaagaagacacctgtgcacagtaggagctcctcccccattccgctgacaccaagcaaggaaggatctgcagtgttcgccggctttgaaggaagaagaacaaatgagataaatgaggtactgagctggaaattagtgcctgataactatcctcccggcgatcagcccccccccccctcctatatctatggagcacaacatctgttgcgcttatttgtgaagctcccagagatactggggaagatgtcattctccgaaaagaacctcaaagcgcttctgaagcacttcgacttgttccttaggttcctggctgagtatcacgatgactttttcccagagtcagcttacgtcgccgcatgcgaagctcactatagtacaaagaaccctcgggcaatctattag

SEQ ID NO: 12289 - DNA, 60 bp, Artificial Sequence
  Description of Artificial Sequence: Synthetic coding sequence
atggaggagcgcacgatcactatcgagatacctgaggtcttgaaaaagcaactggagtag

SEQ ID NO: 12290 - DNA, 1842 bp, Artificial Sequence
  Description of Artificial Sequence: Synthetic coding sequence
atggctgctcaggctgccgctgccgctcaggctgccgccgcacaggcagcccaggccgaggccgctgatagttggtacctggctctgcttggattcgcggagcacttccgcacctccagtcccccaaagatccggctctgtgtgcattgcctgcaagccgtatttccgtttaagccgcctcagcgcatagaggcaaggactcacctgcagctgggttccgtgctataccaccacacaaaaaacagcgaacaggccaggtcacatcttgaaaaagccgggtcattgtcacaacaaattccccagttcgaggacgtgaaatttgaagcagcatctctgctgtcagagctctattgtcaggaaaactccgtggacgcagctaaaccactcctgcggaaagctattcagattagccagcagaccccatactggcattgccgcctccttttccagcttgctcaactgcacaccttggagaaggacttggtgtctgcctgtgacctcctcggggtgggagctgaatacgctagggtggttggttcggagtataccagagccttgttcctgctgagtaaaggaatgttattgctcatggagcgcaaattgcaagaggtccacccattactcactctgtgtggacagatcgtggagaactggcagggcaatcctatacaaaaggagtctcttagggttttttttctcgtcctccaggtcacccactacctggatgccggccaggtgaagtcagtgaaaccatgcctgaagcaactccagcaatgcatccagaccatctccaccctgcatgatgacgaaatcctaccctccaatccagccgatctcttccactggctccctaaagagcacatgtgtgtgctggtctacctggttactgtcatgcactccatgcaggccggttatcttgaaaaagcacagaagtacactgataaagcactgatgcagcttgagaagcttaaaatgctcgattgttcccccatcctgagcagctttcaggtgattttgcttgagcacataatcatgtgtaggctcgttaccggccacaaagcgaccgctctgcaggaaatcagtcaggtctgtcagctgtgccaacaaagccctagactgttctcgaaccacgcggcacagctgcacactctactggggttgtattgtgtgtctgtgaactgtatggataacgctgaggcccagtttacaactgcgctacggttgactaaccaccaggagctgtgggcgttcatcgtcacgaacctcgcatcagtttacattcgagagggaaatcgacatcaggaggtgctttattctctgttggaacgtataaatcctgatcactcgttcccagtgtcgagccattgcctcagagctgccgccttttacgtgcggggcctattctcattcttccagggccggtataatgaagctaagagattcctcagggaaacacttaagatgagcaatgctgaggacctcaaccgccttaccgcttgctcattagtgctgctcggccacatattttacgtgctcggcaaccaccgcgaatctaacaatatggtagtgcctgccatgcagctggcttccaagatccccgatatgtccgtgcaactgtggtcttccgcacttctgagggatttgaacaaggcctgcggcaatgccatggacgcccacgaggctgcacagatgcaccagaacttcagccaacagctcttgcaggaccatatcgaggcatgttccctgccagaacataacctgatcacatggacggatggaccaccaccagtccagttccaggcacagaatggacccaatacctccctggccagcctgctgtag

SEQ ID NO: 12291 - DNA, 504 bp, Artificial Sequence
  Description of Artificial Sequence: Synthetic coding sequence
atgccaatgaaacccccacggtgcacaaggacctcccgaagctcatgtagcagaaccactctgaggcccgctgcgtctccaaatacgaccagtagtcggggtcagactgttcaccctccttgctctagcaaactcaggatggacccaacccccgcctggcccgccagctgcgaggcgctgatggggccctcttcttcagcaggtccagcacggttgcgcctcccccccaggcggcactctagtctgccccctagaagggcaagtttcctcattgtgagcagagctagcaagtcttgggaatgcgcaggccctgtacctgccctgcctggtggcgtggtagccgtgcccacatctcagcaggacccacagtgcaggggatctcaggtggcacacagaagatgtttgagccgagcaatcctgcagtccggaccacagtgtcagtcttgtctctcgatctgggtcacaagcgcgcgaagtagggtccaggcgtcgtcccgcagttag

SEQ ID NO: 12292 - DNA, 1842 bp, Artificial Sequence
  Description of Artificial Sequence: Synthetic coding sequence
atggctgctcaagccgccgcggcggcccaggcagctgctgcacaggccgcacaggccgaagcagccgacagttggtatctggccctgctcggatttgccgagcatttcaggacatcgagcccccctaagatccgactctgcgtccattgcctccaagcagtcttcccctttaaaccaccccagcgtattgaggcaagaacgcaccttcagctgggcagtgtgctctatcaccacacaaagaactccgagcaggcccgatcacatcttgagaaggcttggctgatttcacagcaaatcccccagtttgaagatgtaaaatttgaggccgcgtccctcctgagtgaattgtactgccaggagaattcggtcgacgcagctaaaccattgttgaggaaagctattcaaataagccagcagaccccttactggcattgcaggcttctgttccagctggcacagctccataccctagagaaggacctcgtctccgcgtgtgatctgttgggcgtgggcgcagagtacgccagagtggtggggtctgagtatacacgcgcgctgttcctgctttctaagggaatgctcttactcatggaacgcaaactccaagaagtgcatccgctgctgaccctgtgtggccagattgtggaaaactggcaaggcaaccccattcagaaagaatcattgagggttttttttttggtcttacaggtgacacactacctcgatgcgggacaggtaaagtcagtgaagccttgccttaagcagttgcagcaatgcatccagaccatttcaaccctgcacgatgacgagatcttgcccagtaacccggccgatctgttccactggcttccaaaagaacatatgtgcgttctcgtgtatcttgtcaccgtgatgcattctatgcaggcggggtatctggagaaagctcagaaatataccgacaaagccctcatgcagctcgagaaactgaaaatgcttgactgttcacctattctgagtagttttcaagtgatcttacttgaacatataataatgtgtcgtctggtcactgggcacaaagccaccgccttgcaggaaatctcacaggtgtgtcagctctgccagcagagtcctagattgtttagtaatcatgcagcccagctgcatacccttcttggcctgtactgtgtatccgttaactgtatggacaatgctgaggctcagttcacaactgcgttgcggttgacaaatcaccaggagctatgggccttcattgtcacgaacctcgcaagcgtctacatacgcgagggcaatcggcatcaagaagtgctgtattcattactggaaagaattaacccggaccacagtttccctgtctccagccactgcttacgcgcggccgccttttacgtgcgtggactgttttcgttcttccaaggaagatacaatgaagctaaaaggtttctcagagagactctgaaaatgagcaatgcggaagacctgaatcggctgactgcctgctccctggttctccttggtcatattttctacgttctgggcaaccaccgtgaaagtaacaatatggttgtgccagcgatgcaactcgccagcaagatccccgacatgtctgtgcagctctggtctagtgcccttcttagggatttgaataaggcttgcggtaatgccatggatgcccacgaggcggctcagatgcaccagaactttagtcagcaactgctgcaggaccatatagaggcgtgcagtcttcctgagcacaatctgatcacctggacagacgggccacccccggtgcaattccaggcccagaatggaccaaacacctccctggccagtctgctttag

SEQ ID NO: 12293 - DNA, 504 bp, Artificial Sequence
  Description of Artificial Sequence: Synthetic coding sequence
atgccaatgaaaccgcctcggtgcacccggacctcccgctccagttgttcccggacaacgttacggccagcggcctcccccaatacgacgtcttcccgggggcagaccgttcatcctccatgttcttcgaagttacgaatggaccccactccggcatggcccgcgtcttgtgaggcactcatgggacccagcagtagtgcaggccctgctaggttgagactgccgcccaggagacactctagcctaccacccagacgggcaagtttcctgatcgttagccgtgctagcaaaagctgggagtgcgccgggcccgtacctgcactgccaggcggtgtggtcgccgtccctacgagtcagcaggatccgcagtgtaggggatctcaggtggcccacaggcggtgcttatcacgcgccattctgcaatcaggccctcagtgtcaaagctgcttgagcatttgggtaacctccgcccgatccagagtccaagcttcctcccgttcgtag

SEQ ID NO: 12294 - DNA, 426 bp, Artificial Sequence
  Description of Artificial Sequence: Synthetic coding sequence
atgtcatcacccccacactctggccagacagttcatcctccctgcagctcaaagttacgaatggaccccactcctgcatggccagcatcctgtgaagctctgatgggaccatcctcttccgcaggacctgctagactccgcttgccaccacggcggcacagtagcctgcctccacggcgcgctagtttcctgatcgtctcgcgagcatcaaagtcctgggaatgtgcaggtccagtgccagcgctaccgggcggcgtagtagcagtccctacctctcaacaggatccccagtgtaggggatcccaggttgcacatcgacgttgcttgtcccgagccatactgcaatctggcccgcagtgtcagtcgtgcctcagtatatgggttacatccgctaggagccgggtacaggcctcaagtcgttcctag

SEQ ID NO: 12295 - DNA, 666 bp, Artificial Sequence
  Description of Artificial Sequence: Synthetic coding sequence
atggctgccgcagtgaggatgaatatccagatgttgctggaagctgctgactatctggaacgcagggagagggaagctgaacacgggtacgcctctatgctgccatataataataaagaccgggatgctctgaaaagaaggaacaagagcaaaaagaacaactcatcatctcggtccactcataatgaaatggaaaagaacagacgagcacacttgaggctgtgtttggagaagctcaagggtcttgtgccattgggacctgagagcagtcggcacacaactctttccctactcaccaaggctaagctccacattaaaaagctcgaggattgcgaccgcaaggcagtacatcagatcgatcagctgcagcgggaacagcgacatttaaaaaggcagctggagaaactcggaattgagcggatcagaatggacagtatcggatccactgtgagttctgaacgcagcgattctgaccgggaagaaattgacgtggacgtggaaagcaccgattacctgacaggcgacctggactggtcttcttcttcggtgtcagattcggatgagcgcgggtctatgcagtccttgggctctgatgaggggtactccagcacctctataaagcgcataaagctgcaggatagccacaaggcatgcctgggtctgtag

SEQ ID NO: 12296 - DNA, 636 bp, Artificial Sequence
  Description of Artificial Sequence: Synthetic coding sequence
atggccgccgcagtgaggatgaatatacagatgctccttgaggccgcggattacctggagaggcgggagcgggaagcagagcacggatatgcgagtatgttgccctacaataataaggacagagacgcactcaagcgtcgtaacaaaagtaaaaaaaataacagctcaagtcggcgggcgcacctgaggctctgtctggaaaaactaaaaggcctggtccctctgggccccgagtcttccagacacaccacgttgtccctgctgacaaaagctaaacttcacatcaagaaactggaagactgtgacagaaaggcagtacaccaaatcgaccagctccagcgtgagcagcgacatctgaagcgacagcttgagaagttaggaattgagaggattagaatggacagcatcggcagcaccgtgagcagtgagcggtcagattctgatagggaagagatcgacgtggatgtggagagcacagactatctgactggtgacctggactggagcagttcatctgtgagtgatagtgacgagagaggtagcatgcagagcttggggtccgatgaagggtattccagtacctctatcaagcgaatcaagctgcaggactctcataaggcatgtctgggcctgtag

SEQ ID NO: 12297 - DNA, 630 bp, Artificial Sequence
  Description of Artificial Sequence: Synthetic coding sequence
atggagcttaactcgttactcatcttactggaggccgctgagtacctcgagaggcgtgatcgcgaagctgagcacgggtatgccagtgtcctgccctttgacggcgattttgcccgcgagaaaacaaaagcggcgggactggtcagaaaggccccaaacaataggtcatctcacaatgagctggagaaacatcgccgtgccaagcttaggctgtacttagagcagctgaagcagctggttcctctggggcccgattccactcgccacacaaccctaagcctgctcaagcgggcgaaggtccatatcaaaaagctggaagagcaggataggcgggctctgtccattaaggagcagctgcaacaggaacaccgctttctgaagcgcagactggagcagctgagtgttcagtctgtggaacgagtgagaaccgatagtactgggtccgccgtgtcaaccgacgacagcgagcaggaagtcgatattgaagggatggagttcggccccggtgagctagacagtgtcggcagttccagcgatgccgatgaccattacagcctgcagagcggtactgggggggattccggctttgggccccattgccgccggctgggtcggccagctctcagctag

SEQ ID NO: 12298 - DNA, 177 bp, Artificial Sequence
  Description of Artificial Sequence: Synthetic coding sequence
atggagcttaacagcttgctgatccttctggaggccgcagagtacctggagagaagagaccgggaggccgagcatggatatgcctccgttctgccatttgacggggattttgcccgggaaaagaccaaagccgctggcttggtgcgtaaggccccaaacaaccggccgcctcagtag

SEQ ID NO: 12299 - DNA, 1293 bp, Artificial Sequence
  Description of Artificial Sequence: Synthetic coding sequence
atgtttgatggctatgactcttgttcggaagatacatctagttcttcttcctctgaagagtctgaagaagaagttgccccattgcctagtaacttgccaataattaaaaataatggtcaggtctatacgtatcccgacggaaagagtggcatggctacatgcgagatgtgcggtatggtgggcgtacgcgacgctttctactcaaagaccaagcgtttctgcagcgtcagctgttccagatcttatagttccaacagcaagaaggccagtatcttggcacggttgcagggtaagccccctacaaagaaggccaaggtgcttcaaaagcagcctctagtagccaagctcgccgcatacgcccagtatcaagcaacccttcagaatcaagccaagaccaaagctgctgtcagcatggagggctttagctgggggaattacatcaattccaatagcttcattgcggcacctgtgacttgttttaagcatgcaccaatgggcacctgttggggagatatctctgagaacgtgcgagtggaggtacccaatactgattgtagtctcccaacaaaggtcttctggatagcgggtatagtcaaactggctggatataatgcattgttgcgctacgaggggttcgaaaatgacagcggtctcgatttctggtgcaatatctgcggctctgatattcatcccgtgggttggtgcgccgcaagtgggaagcccctggtgccccctaggaccattcaacacaaatacactaattggaaagcgttcctggtcaaaagactgaccggcgccaaaaccctaccccctgatttcagccagaaagtgtcagaaagcatgcagtatccctttaagccttgcatgcgggttgaagttgtggacaaaaggcacctgtgccggacacgtgtagctgtagtggagagtgtgatcggcggccgcctgaggctcgtctacgaggaatcggaagatcggaccgacgatttttggtgtcacatgcatagccccttgattcaccacatcggctggagtaggtcaattggccatcggttcaaaagaagcgatattacaaaaaaacaagacgggcactttgacacaccaccacatctgtttgccaaagtcaaggaggtggaccagtccggcgagtggttcaaggagggcatgaagctagaggccatcgatcctcttaacctgtcaactatatgtgtcgcaactatccgaaaggtcacccagaacttcttgctgaacgggctgactactagtggtaaattggcacctctgcagcaccagtag

SEQ ID NO: 12300 - DNA, 1887 bp, Artificial Sequence
  Description of Artificial Sequence: Synthetic coding sequence
atgttcgacggctatgactcatgcagtgaggatacaagttcgtccagttccagcgaggagagtgaggaggaagttgcaccactcccctcaaatctgcccattataaaaaacaacggccaagtgtacacatatcctgatggaaagtcggggatggctacctgtgagatgtgcggcatggtgggagtgcgcgacgccttttactcgaaaaccaagaggttttgctctgttagttgctctagatcttattccagcaattccaaaaaagcaagcattctggccagattacaggggaagcctccaactaagaaagctaaagtcctccagaagcaacctttagtcgctaaactggccgcatacgcccagtaccaagccaccctccagaatcaggccaagacaaaagctgcagtgtctatggaaggattctcctggggaaactatattaacagcaattccttcatcgccgcacccgtcacgtgctttaagcacgccccgatggggacgtgttggggcgacatctctgaaaatgtgcgagtagaggtgcccaatactgactgcagcctgcccacaaaggtgttctggattgctggtattgtgaagctggccggctacaacgctctgctgcgctatgaaggctttgaaaatgactccgggctcgatttctggtgcaacatatgtggctccgatatacaccctgtgggctggtgcgctgcttctggaaaacctctcgtcccaccccggacaatccaacataagtataccaactggaaggctttccttgtgaaacgactgaccggcgctaaaacattgcccccagatttttcccagaaggtgagtgaatctatgcagtatccattcaagccatgtatgagggttgaggtcgtagataaaagacatctgtgccgaaccagggtcgctgtcgtggagtctgtgatcggcggtaggctgaggctcgtgtatgaggaatctgaggaccggacagatgatttctggtgccacatgcactcacctctgattcatcacattgggtggagccgatccatcggccatcgcttcaaacggtccgatatcacaaagaagcaagatggccacttcgataccccaccgcatcttttcgccaaggtgaaagaggtagaccagagcggcgagtggtttaaagaggggatgaagctggaggccatcgatcccctgaacctgagtacaatttgtgttgccactatcaggaaagtgctggctgacggatttctaatgattggaatcgacggaagtgaggccgccgatggctccgattggttctgttatcacgcaacttcaccctccatttttccagttggcttctgtgagattaatatgattgagctcacaccccctcgtggctatacgaagctcccctttaaatggttcgactacctaagagaaacaggatctatcgctgcaccggtgaagctcttcaacaaggatgtgccgaatcacggatttagagtggggatgaagctcgaggccgtggatctcatggaaccacgactcatctgcgtggccactgtcaccagaattattcatcggctcctccgtatccattttgacggttgggaggaggagtatgaccagtgggtagattgtgagagccctgacctataccccgttggctggtgccagctcacaggttaccagcttcagcctcctgcatcacagagcagtagggagaaccagagcgcttcctcaaagcagaagaaaaaagcaaagtcacagcaatataaaggtcacaagaaaatgacaacactgcagctgaaagaagaacttctggatggggaagattacaatttccttcagggcgcctccgatcaggaaagtaatggctccgccaacttctacataaagcaggaaccctag

SEQ ID NO: 12301 - DNA, 1887 bp, Artificial Sequence
  Description of Artificial Sequence: Synthetic coding sequence
atgtttgacggctacgatagctgcagtgaagatactagttcctcaagctccagcgaggagagcgaggaggaagtggctcctttacccagcaacctgccaatcattaaaaataacggccaggtttacacttatccagatgggaaatccgggatggccacctgcgaaatgtgtggcatggtcggcgtaagagacgccttctatagcaaaactaaacggttttgtagcgtttcgtgttccagatcttatagttccaattctaagaaagcctcaattctcgcccgactccagggaaagcctcccactaagaaggcaaaggtgcttcagaagcagcccctcgtcgctaagctagccgcttatgctcaatatcaggcaactttacaaaaccaggccaagaccaaggccgccgtctctatggaaggcttttcctggggcaactatataaatagcaatagctttatagccgcccccgtgacctgctttaagcatgcaccaatgggaacgtgctggggcgacatctcagagaatgtacgggttgaggtccccaacacagattgtagcttgccaactaaggtcttctggattgccggtattgtgaagcttgcagggtacaatgccctgctgagatacgaagggtttgaaaacgattcaggtctcgatttctggtgcaacatttgtgggtctgacatccaccctgtgggctggtgtgccgccagtggaaagccactggtgcccccacgcactatacagcacaagtatactaattggaaggcgtttcttgtgaaaagactgacaggtgccaagacccttcctcccgacttctcacagaaagtaagcgaaagtatgcagtatcccttcaaaccctgcatgcgggtggaggtagtggataagcggcatctgtgcagaacccgcgtcgccgtcgtagagtctgtgattggcggacggctgcgccttgtgtacgaggagagcgaggatcgcacagatgatttttggtgtcacatgcattccccccttatacaccacattggctggagcaggtcgattgggcatcgcttcaaacgctctgacattactaaaaaacaggacggacacttcgatacccccccacacctattcgcaaaagtcaaggaggttgaccagtcaggcgaatggtttaaggaggggatgaaactcgaagccattgacccacttaatctgtcaaccatttgcgtggcaaccattaggaaagtgctcgccgatggcttcctgatgatcggtatcgatgggagcgaagcagccgacggatccgactggttctgttaccacgccactagccctagtattttcccagtgggcttctgtgagattaacatgatcgagctgacccccccgcgaggatacacaaaacttcctttcaagtggtttgactacctgagagaaacaggaagtatcgcggcacccgtaaaactttttaataaagacgttccaaaccacggctttagagtggggatgaagctggaggcagtggacctgatggaaccacgactgatctgcgtggcgacagtcactaggatcatccatagactgcttcgaatacattttgatggctgggaagaagaatacgaccaatgggttgactgcgaaagccccgatttgtatccggttggatggtgtcagctcacaggatatcagttgcagccaccagcatcccagagtagcagagagaaccagtctgctagctccaaacaaaagaagaaggctaagagtcagcagtacaaggggcacaagaagatgactacattgcagctgaaagaagagctgcttgacggagaagattacaatttcctgcagggcgcttctgaccaagagtctaacggctccgcgaatttctatataaaacaggagccctag

SEQ ID NO: 12302 - DNA, 1887 bp, Artificial Sequence
  Description of Artificial Sequence: Synthetic coding sequence
atgttcgacggctacgattcttgttcagaggatacatcctcttccagcagctcggaggagagtgaagaagaggtcgcccccctaccgagcaatctcccaattatcaaaaataatggacaggtgtatacctatcctgacggcaaatcaggcatggcaacctgcgagatgtgcggaatggtgggggtgcgggatgcgttttacagtaaaaccaaacggttttgttcggttagttgctcgcggtcatactccagcaacagtaagaaggcctccatcctggctcggctccagggaaaaccccctactaagaaagctaaggtgctgcagaaacagcctttggtggccaagttagcggcctacgcgcagtatcaggcaacactacagaatcaggcaaaaacaaaggcagccgtttctatggaaggattctcctggggaaactatatcaactcgaacagtttcatcgctgcccccgtcacctgcttcaagcatgctcccatgggcacttgctggggtgacattagcgagaacgtccgcgtagaagtccccaataccgactgctcattgcctaccaaggttttctggattgcaggaatcgtcaagctggctgggtacaacgcactcttaagatatgagggctttgagaatgactcaggcctggacttctggtgcaatatatgcggttcagacattcatcccgtgggctggtgcgccgcgtctggtaaacctcttgtacctccccgaactattcagcataagtacacgaattggaaagcctttcttgtgaaaaggctgacgggcgccaaaacactgccgccagactttagccagaaggtttctgaatctatgcagtatccttttaagccctgtatgcgcgtagaggtggtggacaagagacatctctgccggacccgggtagctgttgtggagtccgttatcggcggtaggttgaggctcgtatatgaggaaagcgaggatagaaccgatgacttctggtgtcacatgcactctcccctcatccaccatataggctggtcgaggtccatagggcataggttcaaaaggtctgatatcacgaaaaagcaggatgggcattttgacactccccctcatctgttcgctaaggtgaaggaggtagatcagtccggcgagtggttcaaagagggaatgaagctcgaggccatcgaccctctgaacctcagtacaatctgtgttgccactatcaggaaagtactcgctgatggctttctcatgatagggattgacgggagcgaggctgctgatggaagcgattggttttgctatcatgccactagcccatccatcttccctgtggggttttgtgagataaatatgatcgaactgacccccccacgaggctatacaaaacttccttttaaatggttcgactatctgcgggagaccggaagcattgcggctcccgtcaaacttttcaacaaggacgtcccaaaccacgggtttcgagtagggatgaaactggaagccgtggacctcatggagccgcggctgatctgcgttgccactgtcaccaggatcatacacagactgctcagaatacactttgacggttgggaagaagaatatgaccagtgggtcgattgcgaaagccctgatctgtacccagttggctggtgccagctgaccggctatcagctccagccacccgcaagccaaagttcaagagaaaatcagtctgctagctccaaacagaagaaaaaagccaaaagccaacaatacaaaggccacaaaaagatgacaactctgcaactaaaggaagagctgctggacggggaagattataacttcctgcagggagcatcagaccaggagtctaatgggagtgcaaacttctatataaaacaagagccctag

SEQ ID NO: 12303 - DNA, 16791 bp, Artificial Sequence
  Description of Artificial Sequence: Synthetic coding sequence
atggaacactttttgctggaagtcgctgccgcacctctgaggctgatagctgcaaagaacgagaagtcacggtccgagcttgggagattcctagcaaagcaagtatggacccctcaggatcgccagtgtgtgctgagcactttggcccaactgctgcttgacaaggattgcaccgtcttggttggacgccagctgcggcccctgctgctggacctgctggagaggaacgcagaagccattaaagctgggggccagatcaaccacgatctgcatgagcgcctctgcgtttcaatgagcaaattaatcgggaaccaccctgatgtgcttccgttcgcgctgcggtacttcaaggatacatcacctgtattccagaggctcttcttagagtcttcagacgctaacccagtccggtacgggcggaggcggatgaaactcagagacctgatggaggccgcattcaaatttcttcagcaggagcagtcagtcttcagagagctctgggactggtccgtgtgtgtgcccctgctgcgctctcatgatactcttgtgaggtggtacacagccaactgtctggctcttgtcacctgtatgaacgaagagcataagctgtctttccttaaaaagattttcaattcagacgaactcattcatttccggctccgtcttttggaggaggctcaattgcaggacctggaaaaagctttggtcttggcaaaccctgaagtcagtctgtggagaaagcagaaagaacttcaatacttacagggccaccttgtttcatctgacttgtcccctagagtgactgctgtctgtggcgtcgtgctgcctggtcaactgcccgcaccaggtgagctcggaggcaaccgctcctcctccagagagcaggaactggccttgaggtcctacgtgctcgtagaatctgtgtgcaaatctctgcagacgctggccatggcagtggcttctcagaacgccgtactgcttgaaggcccaatcggctgcggcaagacctcgctggttgagtacctcgctgccgtcacaggaagaaccaagccgccccaactgctaaaagtgcaactgggagatcagaccgattcaaagatgctgcttggaatgtaccggtgcaccgacgttccaggtgaatttgtgtggcagcccggcaccctaacccaggctgcaactatggggcactggatcttactcgaggacatagactatgctcctctagacgtagtgtctgtcctgataccgcttttagaaaacggtgagctcctgatcccgggacggggggactgcctgaaagtcgcacccgggttccagtttttcgcaacccgccggttactgagttgtggtggtaattggtataggccattaaatagtcacgcgactctgcttgacaaatactggactaagatccatctggataatctagacaaacgcgagttgaacgaggtgctgcaatcccggtacccttcactgttggccgttgtcgaccacctgttggatatttatatacagctcactggggagaagcatcatagctggtcggattctagcgtcgggtgcgagcaagcccccgaggaagtgagtgaggcacggagggaaaataaaagacccaccctcgaaggcagagaactgagcctgagagacctcctgaattggtgcaatcgcatcgcccactcgttcgattctagctccctatccgcaagcctaaacatctttcaggaagccctggactgcttcaccgccatgctcagcgagcacacatccaagctgaaaatggcagaggtcatcgggtccaaattgaatataagccgtaaaaaggcagaatttttctgtcagctctacaaaccagagatagtgattaacgagctggatctacaggttggacgggtgcgcctgttaagaaagcaatccgaggcggtgcacctgcagagggagaaattcaccttcgctgcaactagaccctcgagcgtgttgatcgagcagcttgcagtatgcgttagcaaaggagaaccggtgctgttagtgggtgagactggcactggaaagacatctactattcagtacctggcgcacatcaccggtcatagattgagggtcgtgaatatgaaccagcagagcgacacagctgatttactcggcgggtataagcctgtagatcacaagctgatctggctgcctcttcgcgaagcttttgaagagctttttgctcagactttcagtaagaagcagaatttcacttttctagggcacattcaaacatgctatagacagaagcgatggcacgatctgttacggctgatgcaacacgtgcacaaaagcgccgttaataaagacggcaaagattccgaaactggtctgctaataaaggaaaagtgggaagcttttggcctccgactgaatcacgcgcagcagcagatgaaaatgacagagaataccctgctgttcgcattcgtcgaagggactctggcccaggcagttaaaaaaggcgagtggattctgcttgatgagataaacctagcagctcccgaaatcttggagtgcctgagcggtctcctcgaagggtccagtgggtcccttgtgctcctggaccgaggcgacacagagccgctcgtgcggcaccccgatttccgactttttgcctgtatgaatccagctaccgacgtcggaaaacgcaatctgcctccgggcattcgaaaccgctttaccgagctgtatgtggaggaactcgaatccaaagaagacctccaggtgctcatagtggattacctgaaggggctgagtgttaacaagaataccgttcagggaatcatcaatttttataccgctctgagaaaagagtcagggactaaacttgtggatggtacggggcaccgtcctcactacagcttgcggaccctctgtagggcgttaagatttgctgcctccaatccttgtggcaacatacagaggtcgctttacgaaggattctgcctggggtttctcacccagctggaccgggcctcccaccccatcgtgcagaagttgatttgccagcatattgtgcccggtaacgtgaagtccctgctgaaacagcctatcccagagccaaagggcggcaggctgattcaggttgagggatactggattgctgtgggagataaggagcctactatagacgaaacatatattctcacgagctcggtaaagctcaaccttagagacattgttcgcgtggtatctgccggcacctacccggtgttgatccagggagaaacaagcgttgggaagacgagtctaatccagtggcttgcagcagccaccggtaaccactgcgtacgtattaataaccacgaacacaccgacattcaagagtatattggatgctatacttccgactccagcgggaagctggtttttaaagaaggggtgctgattgatgccatgagaaagggttactggattatcctggacgagctgaacctagcccccacggatgtgctggaggcacttaacagacttctcgatgataatagagaacttctggtgaccgagacccaggaagtagtaaaagctcatcccaggttcatgctgttcgctacacagaatccgcccggactgtacggtggccggaaggtgctcagtagagcctttcgcaatcgctttgttgagctccacttcgacgaactgcctagctctgagcttgaaactatcctgcacaagagatgctccctgccaccatcttattgcagtaaactggtgaaagtcatgctcgacctacaaagctaccggaggtcatcttctgtctttgcaggtaagcaaggatttatcactttacgcgatctattcagatgggccgagagataccgcctggccgaaccaaccgaaaaggaatatgattggctgcagcacttagcaaacgacgggtatatgctcctagccggcagagtacgcaagcaagaggaaattgatgtcatacaggaggtgctcgaaaagcatttcaagaaaaaactgtgcccgcagtcccttttcagcaaggaaaacgttctcaagctgttaggcaagttgtcgacacagatcagtactcttgagtgcaatttcggacatattgtgtggacagagggcatgcgccgcttggcgatgctcgtggggcgcgcattagaattcggcgagcctgtcctgctcgtcggagataccggctgtgggaagacaaccatatgtcaagtgtttgcggccctggccaatcagaaactctattcagtctcctgtcatctgcacatggagactagtgatttcctcggaggcctgagacccgtacgccaaaagcccaacgacaaggaggaaatcgacaccagcaggctgttcgaatggcacgatggtcctctcgtgcaggcaatgaaggaggatggcttctttctgctcgatgagatcagtcttgcagatgacagcgtgcttgaaagattgaattccgtactggaagtagaaaaatctttggtactggccgagaagggttcccccgaagacaaagacagtgaaatcgagctgctgaccgctggcaaaaaatttcgcatactcgctacgatgaatcccggcggggactttggcaagaaagagttatctccagcattaaggaataggtttacagaaatttggtgtccacaatccacatcacgagaagacttaatccagatcatctcccacaatttacgccccggtctctgcctgggccggatcgaccctaagggcagtgatatcccagaagtgatgctggactttatcgattggctgacccatcaggagttcggaagaaagtgcgttgtgtctattcgagatatactgtcatgggttaacttcatgaacaagatgggcgaagaggcggctttgaaaagacccgaaatcatctcaacagttacaagtttcgtgcacgctgcttgcctggtgtatatagatgggatcggctcaggagtgacatctagcggcttcgggacagcactcttggcccgcaaggagtgtttgaagttccttataaaacgtctcgccaagatcgtccggctcacggaatatcagaaaaatgaactgaagatatacgataggatgaaggcaaaagaattcacgggcatcgataatctttggggaattcatccgttcttcatacccagagggccagtgctgcataggaataatatagccgactatgccctgtcagcgggcacaacagcgatgaacgcacagcggcttctacgtgctaccaagttgaagaaacccatattactagagggatcacccggcgttggcaaaacctccctcgtgggcgctctggccaaggctagcggcaacacgctggtcaggatcaacctgagtgagcagacagatatcaccgacctgttcggggccgatctccccgttgaaggggggaagggaggcgagttcgcctggcgagacggaccgctgctggccgctctgaaggccgggcactgggtggtcttggacgaactgaacctagctagtcaaagtgtgctggaaggcctcaacgcttgttttgaccaccgcggcgagatctacgtgcccgagttaggcatgagcttccaagtacagcacgagaaaaccaagatctttggttgtcaaaaccccttcagacagggaggcggccggaagggcctgccaaggagcttcttgaaccgctttacccaagtattcgtcgatcctctgacagtgatcgacatggagtttatcgcgagcaccctctttccagccatcgaaaagaatattgtcaaaaagatggtcgcattcaacaatcagatcgatcacgaggtgaccgtcgagaagaaatggggacagaagggcggaccatgggaattcaatctgagggacctgtttagatggtgtcaactcatgctggtcgatcagtcccctggttgttacgacccaggacagcacgtattccttgtttatggggagaggatgaggaccgaagaagataagaaaaaggtgattgctgtgtttaaagacgtctttggaagtaattccaacccatacatgggtacacgtctgttccgcatcacaccctatgatgtgcagctgggctatagtgtgttaagccgcggatcctgcgtaccccatccaagccgtcacccactgctgctgctccaccaaagcttccagccactggagtcaataatgaaatgcgtgcagatgtcttggatggtgatcctggttggccctgctagtgtagggaaaacgtccctcgtgcaactgttggctcatctgacaggtcacacgcttaagatcatggcaatgaattccgctatggacacaaccgagctgctcggtgggtttgaacaagtcgatttaattaggccctggcggagactgctggagaaggtggagggcacagtcagagccctgctgagggactcacttttgatctctgcagatgacgctgaagtcgtgctccgggcttggagccattttctgctgacgtacaagcctaaatgtcttggcgaggggggcaaagccattaccatggaaatcgttaataaattagaggcagtgctcctcctgatgcagcgcctcaacaataagatcaatagctattgtaaggcagaatttgccaaacttgtagaggaattccggtcctttggggtcaagctgacacagttggcatcaggccacagccacggcactttcgagtgggtcgactctatgcttgtgcaggctctgaagagtggagattggttgctcatggacaacgttaacttctgtaacccctccgtcttggaccggcttaacgccctgctggagcccggcggagtactgaccatctccgagagggggatgattgatgggtcaacccccaccatcaccccaaatcccaatttccgcctgttcctatctatggaccctgtccacggagatattagccgcgccatgcggaatcgaggactcgagatctacatcagcggcgagggagacgcaagcacccccgataacctggatctcaaggtgctgttacatagcctaggactggtgggcaactcagtgtgtgacatactcttggccttacataccgaaactaggagtactgttgtcggatctcccacatcaagtgtgagcaccttgattcagaccgccattctcatcgttcaatacctccaaagagggctgagcctggatcgggcctttagtgaggcctgctgggaagtctacgtgtgttctcagcattcacccgcaaacagaaaactcgtgcaggcactcttggagaaacatgtttcttccctaagggctcacgagacgtggggcgactctatcttggggatgggcctctggcctgattccgtgcccagtgccctgttcgcaaccgaagattctcacctttcaacagtccgccgagacggccagattctcgtgtactgcttgaatcggatgtccatgaaaacgtcctcctggacccgctcccaaccattcacgttgcaggatctcgagaaaattatgcagtccccttcacccgagaacctgaagttcaacgccgtcgaggtgaacacctactggatagatgaacctgatgtgctggtgatggcagtgaagcttttaatcgagcgagcaaccaaccaggattggatgttgagggtgaagtggctttatcatttagccaaaaacatcccccaggggctggagtcaatacagatccatttggaggccagcgctgcgtcactacgcaatttctattctcactcactctctggtgctgtgagcaatgtgttcaagatcctccaaccaaacacaaccgacgaattcgtgataccactggatcccagatggaacatgcaggctttagatatgatcaggaacctgatggactttgaccctcagactgatcagcccgatcaactgtttgccctactggaatcagctgctaacaagacaattatttatttggacagggagaaaagggtgttcaccgaggcaaatctggtctctgtggggtctaagaaactgagagaaagtgtcctgagaatgtcctttgagttccaccaggaccccgaatcataccacaccttaccgcatgaaatcgtcgtgaatctcgctgcgtttttcgagttatgcgacgccctggtgctgttgtgggtccagagtagtcaaggcatggtgtccgacgcctctgccaatgagattctggggtcactgcgctggcgcgatagattttggacagtggccgacaccgtgaaggtcgacgcaccggggctcgcactgctggccctgcattggcactgggtgctgaaacatctggtgcaccagatccccagactgctgatgaactacgaggacaaatactataaggaagtgcagactgtttctgagcacatccagaattgcctgggaagccagacaggcggattcgccggaattaagaagctgcagaagtttctcgggcgaccctttccattcaaagacaagctggtcgtcgaatgcttctcccaactcaaggtgctcaataaagtcctcgcaattcgagaacagatgagcgcgcttggcgaaagcggctggcaggaggacatcaatagactgcaggtcgtggcgtctcagtggaccctcaaaaaatcacttctccaagcctggggtctaattctcagagccaatatcctggaagatgtgagcctcgacgagctcaagaactttgtccacgcccagtgtctggagctcaaagccaaaggtctgtccctgggttttctggagaaaaaacatgacgaggcatcctctctgtcacatcctgatttaacctccgtgattcacctcactagatctgtccagctgtggcctgccatggagtatctcgccatgctctggaggtacaaggtaaccgcggatttcatggcacaggcatgcctgcgtagatgttcaaaaaatcaacagccccagattaatgaggagatttctcacctgatctccttctgcctttaccacacacccgtgactcctcaggaattacgcgatctctggagcctcctccaccaccagaaagtctcgccggaggagatcacttccctgtggagcgaactgttcaactccatgtttatgtctttttggagctctaccgtgacgaccaatcccgagtattggctcatgtggaacccattgcccggcatgcaacagcgagaagcacctaaaagcgtgttggatagtactcttaaagggcctggaaacctcaacagacccattttttctaaatgttgcttcgaggtgcttacgagcagctggagggccagcccctgggacgtctctggcttacctattctgtcctcatcccatgttactctgggagagtgggtggaaagaacacagcagctgcaggacatttcttcaatgttgtggactaacatggctatttctagtgtcgcagagtttcgtaggacagattcgcaactccaaggccaggtgctgttccggcacctggctggcctggctgaactcttacccgaaagcaggcgccaagaatatatgcagaattgcgagcagctccttcttggttcaagccaggcatttcagcatgtgggacaaaccttaggagatatggctggccaggaagtcctgccaaaggagctgttgtgccagctcttgacctctctgcaccacttcgttggcgagggtgaaagcaaaagaagcctacccgaacctgcccaaaggggctccctgtgggtgtccctgggcctcttgcagatccagacctggcttccccaagcccgcttcgaccccgcagtcaagagagaatacaagctgaactatgtaaaagaggagcttcaccagttgcagtgcgagtggaagacccgcaacctcagctcccagttgcagactggccgggacctggaggatgaagtggtggtgagctactctcatccgcatgtgagattactgagacaacgaatggatcgacttgacaacctcacatgtcacctccttaagaaacaagcctttagacctcagctccccgcctacgaatcacttgtgcaagagatccatcattatgtgactagtattgccaaggcacccgcagttcaggacctccttacaagactcctccaggcgcttcacatcgacggcccgcgctcagctcaagtcgcccagtctctgctgaaagaagaagctagttggcagcagtcacatcatcagttccgcaaacgattatctgaagaatacaccttctaccccgacgccgtgtcccctctccaggcaagcatcctgcagctgcagcacggtatgaggctggtagcgagcgagctccatacgtctctgcactcgtccatggtgggagcagaccggttgggcaccctagctacagcactgcttgcctttccaagtgtgggacccacatttcccacgtactacgcacacgctgacactctttgcagtgttaagtccgaggaggttctgcgtggtcttggcaaactaatactgaaaagaagcgggggaaaggaactggaaggtaagggccagaaggcctgtccgacgagggagcagctgctgatgaacgcccttctgtaccttaggagtcatgtactgtgcaaaggggagttagatcagagggcacttcagctgttccggcatgtttgccaggagatcataagtgaatgggatgagcaggagagaattgctcaggagaaagctgaacaagagtcgggactgtatcggtatcgctctaggaatagccgcaccgcattgagcgaagaagaagaagaggaacgggaattccgaaagcagtttccgctgcatgagaaggatttcgccgacattttggtccagccaaccctggaggagaacaaaggaacttctgatgggcaggaagaggaagctggcacgaacccggcactcctttctcagaactcaatgcaggcagtgatgctgattcaccaacaactgtgtctgaacttcgcccgttccctgtggtaccagcagacgctgcctcctcacgaggcgaagcattatctcagcttattcctgtcctgttaccaaaccggggcctcgttggtcacccacttctatcctctcatgggcgtggaattaaatgatcgtctcctcgggtctcagttgttggcatgcaccctgtctcataacacactgttcggagaggccccatccgacctgatggtgaagccagacggcccatacgatttctaccaacatcccaacgtccctgaagccagacagtgtcagccggtacttcaggggttctctgaggccgtgtcgcacctcttgcaagactggcccgaacacccagcccttgagcagttgttagtggttatggacaggatacgcagcttcccgctatctagccccatttcgaaatttcttaatggattggaaatcctgctggctaaggcacaggactgggaggaaaatgcatcccgtgctctttcgctgcgcaagcatcttgatctcatcagccagatgatcatacgttggcggaagctcgaattgaactgctggtcgatgagtctcgacaatactatgaaacggcacactgagaaatcgaccaaacattggttcagcatatatcagatgctggagaagcacatgcaggagcagaccgaggaacaagaagatgacaaacagatgaccctcatgcttttggtgagcacgcttcaagcctttatcgaggggtcctccctgggcgagttccatgtgcgtctgcagatgctcttagtgtttcattgccacgtattattgatgccccaagtcgaaggcaaggattctctgtgttcggtgctgtggaatctgtaccactactataagcagttttttgaccgagttcaggcaaaaatagttgagttgagaagccccctggaaaaggagctcaaggaattcgtcaaaatttctaagtggaatgatgtttcgttttggtccattaagcagtcagtggaaaagactcatcgaactctctttaagtttatgaaaaagttcgaggcggtcctgagcgaaccatgtagatccagtctcgtggaatcggataaggaagaacagcctgactttctgcctcgccctactgacggggcagcgtccgaactgtctagcattcaaaacctcaatcgtgcattgagggaaactctgctggcccagcctgctgccggccaggcaacaatcccggaatggtgtcagggagccgccccgtcaggcctggaaggcgaactcctgcgacgcttgccgaaactgcggaaaaggatgcgtaaaatgtgtctaacgttcatgaaggagtcacctctgcccagacttgtagaaggcctggatcagtttacaggtgaggtgatttcttccgtctctgaactccagtccttgaaggtggagcctagtgctgaaaaagaaaagcaacggagcgaagccaaacatatcttgatgcagaagcagcgcgctctctctgacctctttaaacatttggctaagattggtttaagctaccgcaaggggctggcatgggccagaagtaaaaacccacaggagatgctgcacctacacccactcgatcttcagtctgctctcagtattgtgtcaagtacccaggaggcagattctagactgttgaccgaaatatcatcctcatgggacggctgccagaaatatttctaccgttcactggccaggcacgcaaggttaaatgccgccttggctacaccagccaaggagatgggtatgggaaacgtcgagcgctgcagaggtttctcagctcacctcatgaagatgttagtgaggcagcgtcgctccctcaccactctatcagaacagtggattatcctcaggaatcttctctcatgcgttcaggagatccacagccgattgatgggaccacaggcatatccagttgccttcccccctcaggacggcgtacagcagtggactgagcgccttcaacacctggctatgcagtgccagatattgctagaacagctaagttggctgcttcaatgttgcccctccgtgggcccagcccctggccatggcaatgtgcaagtgctgggacagcccccagggccatgtctggaagggcccgagctgagcaaaggccagctgtgcggcgtggtgctggatttaatcccctccaacctgtcctatccgagccctatccccggaagccagctgccatcaggttgtaggatgcgtaaacaagatcacctgtggcaacagagcacaactagactgactgagatgcttaagacaatcaagacggttaaggctgacgttgataaaattcgacagcagagttgcgagacgctgtttcatagctggaaggactttgaagtctgctcctccgcactcagctgtctgagccaagtgtcggtgcatcttcagggcctcgagtctctgttcatcctgccaggcatggaagttgagcagcgcgacagccaaatggccctagtggagagcctggagtacgtgagaggcgagatcagcaaagccatggccgatttcaccacctggaaaacgcacctcttaacatccgactcccaaggcggtaaccagatgttggacgaagggttcgtggaggacttctctgagcagatggaaatcgcgattagggctattctgtgcgctatccagaacctcgaggagagaaagaatgaaaaagcagaggaaaatactgatcaggcctcgccccaagaggattatgccggattcgagaggctgcagtccgggcatttgaccaagctcttagaggatgacttttgggcggacgtgagcaccctccacgtccagaagatcataagtgcaatcagcgaattgttagagcggctcaagtcctacggggaggacggtacggccgcgaagcatctttttttttctcagagctgtagccttctcgtgaggcttgtccccgttctctccagttactccgacctggtgctctttttcctcaccatgtccctagccacccaccgaagtacagccaaactgctgagcgtcttggctcaagtattcaccgaattagcccagaagggtttttgcttgccgaaagaattcatggaggatagtgcgggggagggcgcgacagaattccatgattatgaaggcggaggaattggtgaaggggaaggcatgaaagatgtgtccgaccagatcggcaacgaagaacaggttgaagacactttccagaagggacaggagaaagacaaagaagacccagacagtaagtcagacatcaaaggcgaagacaatgctattgaaatgtccgaagatttcgacggaaagatgcatgacggtgaactcgaagagcaggaggaggatgacgagaaatccgattccgagggtggtgatctcgataagcacatgggtgatcttaatggtgaggaggccgataagctggatgaacgactctggggtgacgacgatgaagaggaggatgaggaagaggaggataacaaaactgaagagaccggccccgggatggatgaagaggattccgagctggtggccaaagacgacaacctcgatagtggcaatagtaacaaagataagtcacagcaagacaaaaaggaagaaaaggaggaggccgaggccgatgacggaggacagggggaggataaaatcaacgagcagattgacgagcgggattatgacgagaacgaggtcgatccgtaccatggtaaccaggagaaggtcccagagcccgaagcgcttgatctgcctgacgatttgaacctggactctgaagacaaaaatggtggggaagacaccgacaacgaagaaggggaggaggagaacccactggagatcaaggagaagcccgaggaggcaggtcatgaagcagaggaaagaggcgagaccgagacagaccagaacgagtcacagagcccacaggagcccgaagaaggtcctagcgaggacgacaaagcagaaggggaggaggagatggataccggggccgatgatcaggacggggacgcagctcaacatccagaggagcactctgaggagcagcagcaatccgtagaagagaaggataaggaggcagacgaggaaggcggagagaatggtccggcagaccaggggtttcagcctcaagaggaggaggaacgggaggactccgacaccgaggagcaggtgccagaagccctcgaaaggaaagaacacgccagctgcggacaaacgggggtggaaaacatgcagaatactcaggccatggaactggcaggcgctgcaccagaaaaagagcagggtaaggaagagcacgggagcggcgccgcagacgcaaatcaagcagaaggccatgagtctaattttatcgcacagctggccagccagaaacacacgaggaaaaacacgcagagctttaaacggaagcccggccaggccgacaatgagcgcagcatgggcgaccataatgaacgtgtgcacaaacgcttaagaacagtggatacggatagccacgctgaacagggccctgcccaacagcctcaggcccaggtggaggacgcagatgcattcgaacatataaagcaggggagcgacgcatatgacgcccagacgtacgacgtggcgtccaaggagcaacagcagtccgccaaagacagtggtaaagaccaggaggaggaggagatcgaggataccctcatggacacagaggagcaggaggaattcaaagctgcagacgtcgagcagctgaaacccgaggagatcaaatccggcaccaccgctccactgggctttgatgagatggaagttgaaatccagactgtgaaaacggaggaggatcaggatccacgaaccgacaaagcccacaaagaaaccgagaatgagaagccagaacgatccagggagagcacgatccatacagcacatcagtttctcatggacacaattttccagcccttcttaaaagacgtaaatgagctgcgccaagagttagaacggcagctcgagatgtggcagccccgagagtctggcaaccccgaagaggagaaagtggcagctgaaatgtggcaaagctacctcattctcaccgccccactatcacagcggctgtgcgaggagttacgcttgatacttgagcctacccaggcagctaaacttaaaggtgactaccggactgggaaaaggctgaacattcgtaaggtgatcccatacatagcatctcagttccggaaggataaaatttggctccggagaacaaagcctagcaaacggcagtaccagatctgtctggctattgacgacagctcgtctatggtagataaccacacgaaacaactggccttcgagagtctggctgtgattgggaacgctctgacattactggaggtggggcagatcgctgtgtgtagctttggggagtcagtgaagcttctccatcccttccatgaacagttttccgattatagcggttcccagatcttaagactttgtaaatttcagcagaaaaagacaaagatcgcccagtttctcgagagtgtggcaaacatgtttgccgctgcccagcagttgtcacagaacatcagctccgaaacagcacagctgctcttggttgtatccgacggtagaggcctgttcctggagggcaaggagagagtcctcgctgcagtccaagccgccaggaatgccaatatctttgtgattttcgtagtgcttgataacccatcctcgagagactctatcctcgatattaaggtgcctatttttaaagggcccggtgaaatgccagaaatcaggagttacatggaggagttcccgtttccatactacattattttgcgtgacgtgaatgcgctccccgagaccctgtccgacgccctgcggcaatggtttgagctggtcactgcgtccgaccacccttag

SEQ ID NO: 12304 - DNA, 16791 bp, Artificial Sequence
  Description of Artificial Sequence: Synthetic coding sequence
atggaacacttcttactagaagtggcagccgccccattgagactgatcgccgccaagaatgaaaagagtcgcagcgagctgggccgattcctcgcgaagcaagtgtggacgcctcaggaccgtcagtgcgtgctatccactctcgcccagcttctcctggacaaagactgtacagtgctcgtgggacgacaattacgccccttattgctggacctgttggagcgtaacgccgaagccattaaagccgggggccagattaaccacgaccttcatgagaggctgtgtgtgagcatgagtaagctgattggtaatcacccggacgtccttccttttgcactcagatatttcaaggacacaagcccagtgttccagaggctctttctggagtcaagcgatgccaaccccgttcgctatggccgccgaaggatgaaattgcgagatttaatggaggccgcatttaaattcttgcagcaagaacaatcagtgttcagggagctctgggattggtccgtttgcgtgcctctattgcgctcccacgacacattggtgaggtggtataccgccaattgcctcgcccttgtgacctgcatgaatgaagagcataagttgagcttcctcaagaaaatattcaatagcgacgaactgatacactttcgtctcagactgctcgaggaggcacaactccaggacttggagaaggcccttgtgcttgcaaacccagaggtgagcttatggaggaagcagaaagagttacaataccttcagggacatcttgtctccagtgacttaagtcctcgcgtgacagccgtgtgtggggtggtgctccctggtcagctgccagcacctggagagttagggggcaatcggtcctcttcacgcgaacaggagctcgcactgcggtcatacgtgctcgtcgaatcagtctgcaagagcctccagacattagcgatggcggtcgcctcccagaacgccgttctgctggagggacctattggttgtggaaagaccagtctggttgaataccttgccgccgtgaccgggcgaaccaaaccaccacagcttttaaaggtccagctgggggatcaaactgactccaaaatgctgctcggcatgtacagatgcacggacgtgccaggagagtttgtgtggcagcctgggacccttacccaggcggcaactatgggccactggatactgctggaagacatcgattacgcaccgctcgacgtcgttagcgtcctcattcccctgcttgagaacggagaactgttaatcccaggacgaggcgactgtttaaaggtcgctccaggcttccaatttttcgctacccggcggctgctctcctgtggcggcaattggtataggcccctcaactcccatgcaactctgctagataagtactggaccaaaatacatcttgataaccttgacaagagagagctgaatgaagtgttacagtccaggtatccctccttgcttgctgtagtcgatcacctcctggacatctacatccaactgaccggcgaaaagcatcattcctggagtgattcgtcagtaggatgtgagcaggctcccgaggaggtgtcggaggcccgcagggagaacaagcgtccaaccctcgagggtagagagctgagtctccgggacctcctaaactggtgcaacaggatcgctcactcttttgacagttccagcttgtcggcctccctgaatatctttcaggaagccctggattgctttaccgctatgttgtccgaacacacatcaaagcttaaaatggccgaggtaattgggtctaagttaaacatctctaggaagaaagcagagtttttctgccagctgtacaagccagagatagtgataaacgagctggaccttcaggtagggagagtgagactgctgcgaaaacaatcagaagccgttcatcttcagcgagagaagttcacttttgccgctacccggccttcttccgttcttattgaacagcttgccgtgtgtgtgagcaaaggcgagcccgtccttcttgtgggagagaccggtacaggcaagacctcaactatccaatatctggctcatatcacaggacatcgactgcgcgtggtcaacatgaaccaacagagcgatactgccgatctcctgggagggtacaagccggtggatcacaagctcatttggctcccccttcgcgaggcgttcgaagagctgttcgctcagacattctcaaagaaacagaattttacgttcttggggcacatccagacttgctacaggcagaagagatggcatgatttgctaaggttgatgcaacacgttcacaagtctgccgtcaacaaggatggtaaagatagcgagaccggactgctgatcaaggaaaagtgggaagcttttgggctccgcttaaatcatgcgcaacagcagatgaaaatgactgagaataccctgctgttcgcctttgttgagggaacgctggcgcaggccgtgaagaaaggtgaatggattcttcttgacgagatcaatcttgccgctccagagattcttgagtgcctgagcgggctcttggaaggaagctctgggtcactggttttattggaccggggtgacaccgagcctttggtgcgtcatccggatttccgcctattcgcttgtatgaaccctgctactgacgtcggtaaacgcaacctccctccggggatccggaatcggtttacagaactgtacgtcgaagaactagagtcgaaggaagatctgcaggtgctgattgtcgattatttgaagggcttgagtgtgaataaaaatactgtccagggcatcatcaacttctacactgcactgagaaaagaaagtgggacgaagctggtggatggcaccggtcaccggccccactatagtcttcgcactctttgtagagcgctccgctttgctgctagcaatccttgcggcaacatccagcgctccctttatgaggggttctgcctaggatttctcactcagctcgatcgagcctcccaccctatcgtgcaaaagctcatctgtcaacatattgtccccggcaacgtcaaatccctgcttaaacagcccatccctgaacctaaaggaggcaggttgatacaggtggaaggatactggattgccgttggcgataaggagcctacaatcgacgagacatacatacttaccagctccgtcaagctgaatctgcgggatatcgtgcgtgtggtgtctgccggtacttatcccgtcttaatacagggcgagactagcgtagggaaaacctccctgatccagtggctggctgcggctacggggaatcactgtgtccggataaataatcacgagcacactgatattcaggaatacataggctgttatacttccgactcgagcggcaagcttgtgttcaaagaaggggttctgatcgacgccatgaggaaaggctactggatcatcttggacgaactgaatttggcccccactgatgtattggaagctctcaatagactactggatgacaaccgggagctgcttgtgacagaaacacaggaagttgtgaaagcccatccgaggttcatgctgtttgccacacagaatccccccggactgtacggcgggagaaaggttctgtcccgagccttcaggaacaggtttgttgaactccatttcgacgagctgcccagtagcgagctcgagacaatcctgcacaaaaggtgctccctgccaccatcttattgcagtaagctcgtcaaggtgatgctcgatctccagtcctaccgacggtcttcaagcgtgttcgctggcaaacaagggttcatcaccctgcgagacctgttccgctgggccgaaaggtaccgattggccgagccgacagagaaagagtacgactggctgcagcatctggctaatgatggctatatgctcttggccgggcgtgtgaggaagcaggaggaaatcgacgtcattcaggaggtgctggagaagcattttaagaaaaagctatgtcctcagtccttattttccaaagagaacgttctgaaactgctcggcaaactgagcacgcagatctcgaccctggaatgtaatttcggtcacatcgtgtggacggaaggaatgcgtagattggcgatgctggtcggcagagccctggaatttggggagccggtactgctagtaggtgataccggctgtgggaagacaacaatctgtcaggtcttcgccgccttagcgaaccagaaactctatagtgtttcctgtcatctccatatggagacctccgatttcttaggagggctgcggcctgtgcgccagaagccaaatgacaaagaagagattgacacatccaggctgtttgagtggcacgatggccccctcgtacaggccatgaaggaggacgggtttttcctgctggacgagatttcactggccgatgactctgtgttggaaagactcaattccgtcttagaggtggagaaatcccttgttttggcagaaaaaggcagccctgaagataaagattccgagatagaactgttgaccgcagggaagaaattccgaatcctggctaccatgaatcctgggggggatttcgggaaaaaggaactgtctcccgccctccggaatagatttaccgaaatctggtgcccacagtccaccagtagagaggatctaatccagatcatctctcacaacctgcgccctggactgtgtctgggacgaatcgaccccaagggctcggatatcccagaggttatgcttgactttatcgactggctgacccaccaagagtttgggcgtaagtgcgtggtgtcaattcgagacattctgtcatgggtgaatttcatgaacaagatgggtgaggaggcggccctgaaaaggcctgaaatcattagtactgtgacaagcttcgttcacgccgcttgtctggtgtacatcgatggtattggatctggagttacttcttccgggttcggaactgctttgcttgctcgcaaagagtgcttaaagtttcttatcaaaagactcgccaaaatcgtgaggttgaccgaatatcaaaagaacgagctcaagatttatgataggatgaaggccaaggagttcaccggcattgataacctgtggggtatacacccgttcttcatcccaaggggcccggtactgcatagaaataacattgccgactacgccctgtcagctggaaccacagctatgaatgcacaacgcctacttagggcaaccaagctgaaaaaaccaattctccttgagggctcacctggtgtagggaagacctcactggtgggagcccttgctaaggcaagtggaaataccttggtccgtatcaatctgtcagaacagactgacataaccgacctgtttggggccgacctgccggtggaaggagggaaagggggcgagttcgcatggcgagacgggcccttgcttgccgcgctcaaagccggccactgggtggtgctggacgaacttaaccttgcgtcacagtctgtgctggaggggttaaacgcatgcttcgatcatagaggcgagatctacgtgccagaactaggaatgtcatttcaggtgcagcacgagaaaaccaaaatcttcgggtgccagaatccatttaggcaaggcggaggtagaaaaggtctaccacgcagcttcctaaacaggtttacccaggtgttcgtggatcctctaacagtgatcgacatggagttcatagctagtacccttttccccgccattgagaaaaatatcgtgaaaaaaatggtggcatttaataaccaaatcgaccacgaagtgacagtcgaaaagaaatggggccagaagggaggcccatgggaattcaacctgagagaccttttccgatggtgccagctgatgctggtggaccaatctccgggctgctatgaccctggtcagcacgtctttctggtttacggggagagaatgcgcactgaggaagacaagaaaaaagtgatcgcagtatttaaagacgtgttcgggagcaacagcaatccttacatggggacgcggctgttccgtatcaccccctatgacgtccagctggggtattctgtcctgtcccggggctcctgcgtcccccatcctagccgccacccattacttctgctccatcagtctttccaaccgttggaatcaattatgaagtgtgtacaaatgagctggatggtgattctagttggtcctgctagcgttggcaaaacttcactggtgcagctgcttgcgcatctgactgggcatacactaaagattatggctatgaactcagccatggatacgactgagttgctgggcggattcgaacaggtggatttgatccgtccctggcggaggcttctcgaaaaagttgagggtaccgtgcgtgccctgctgcgtgattcactccttatctcagcagatgacgcagaagtagttttgagggcctggagccatttcctcctcacctacaagcctaaatgcttgggagaaggcggcaaggccattacgatggagattgtcaataagctcgaggctgtactcctgctgatgcagcgccttaataacaagatcaacagctactgcaaggccgaattcgctaagctagtggaggaattccggagtttcggggtgaaactgacccagctggcttccggtcattctcacggaacatttgaatgggtcgactccatgctggtgcaagctctaaaaagcggagattggctgctcatggacaacgtaaatttttgcaacccatctgtgttggatcgccttaatgccttgctagaaccaggaggggtcctcacaatttccgaaagggggatgattgacggatcaacacctaccataacaccaaacccaaacttccgcctattcctgagcatggatccagtgcatggagatatctcaagagctatgcgcaatagaggtctcgaaatttacatttctggtgagggggacgctagcacccccgataacttggatctcaaggtgctcctacattcactggggctggtgggcaattcagtatgtgatattctgctggccctgcacacagagactcgatctactgttgttggaagtcctacaagctcagtgagtactcttatacagactgccatcctgatcgttcaatatctgcagcggggactgtctctggatagggctttcagcgaagcatgctgggaagtgtatgtgtgctctcagcattctcctgcaaacagaaaactggtgcaggcccttttagaaaaacacgtgtcatccttaagggcacacgaaacatggggcgacagtattctgggcatgggcctgtggcccgactccgtaccgagcgccctgtttgccacagaagactcccatctctcaacagtgcggagggatgggcagattctggtgtactgtttgaacaggatgtctatgaaaacgagttcctggactcgtagtcagccattcactctgcaggacttggaaaaaattatgcaatccccttcccccgaaaacttgaagttcaatgcagtggaagtgaatacctattggatagacgagccagacgtcctcgtgatggctgtaaaactgctcatcgagcgggcgacaaatcaagattggatgctgagggtgaagtggctgtatcaccttgccaagaacatcccccaaggccttgagagcattcaaattcatttggaggcttcagctgcgagcctgcgcaacttctatagccatagcttaagtggagcggtatccaacgttttcaagatcttgcagcccaacacaacagacgagttcgtcatcccacttgacccccgttggaatatgcaggcactcgatatgattaggaatttaatggacttcgatcctcagactgaccagcccgaccaactttttgctctactggaaagcgccgccaacaagactatcatctatctggatcgggaaaagagagtgttcacagaggccaatctagtgagtgttggcagtaagaagctcagggagtccgtactcaggatgtccttcgagtttcaccaggaccccgagagctatcatactttaccacatgagatcgtcgtgaatctagctgccttttttgaactgtgtgatgctctggtcctgctctgggttcagtcttcgcagggcatggtgtctgacgcatcggcaaatgagattctcgggtcactcaggtggagagaccgcttctggaccgttgcagatacggtgaaggtggacgcacctggcctggctctcctcgcactccactggcactgggtgctgaagcacctcgtgcaccaaatcccacggctcctcatgaattacgaggataagtactacaaggaggtgcaaacggtgagtgaacacattcaaaattgcctcggttctcagactgggggattcgctgggattaaaaagctccaaaaattcctggggcggccattcccttttaaggacaagctggtcgttgaatgcttctctcagctaaaggtcctgaataaagtcttggctatccgggaacagatgagcgctctgggcgagtccggctggcaggaagacattaacaggctgcaggtggtggcttctcagtggactcttaagaaatccctgctgcaggcctggggtctgatcttaagagccaatattcttgaggacgttagtctcgacgaactcaaaaactttgtccacgcccaatgcctcgaactgaaagctaaaggcctttccctgggctttctggagaaaaaacacgatgaggcctccagcctgtcacaccccgacctgacatcggtgattcatctcaccagatcagtgcaactttggcctgcaatggaatacctcgccatgctttggagatataaagtcacagcagatttcatggcacaggcctgcctgagacgatgttctaagaaccagcagcctcagatcaatgaagaaatttcacacctgatttctttttgtctgtatcacaccccagtaacaccacaggagttgcgcgacttgtggagtctgcttcatcatcagaaggtgagcccggaagagattacctcactgtggagtgaactcttcaattctatgttcatgtcattctggagtagtacggtgacgacgaatccagagtactggctcatgtggaacccgctgccaggcatgcagcagagagaagcccctaagtccgttctcgatagcaccctgaagggacctggcaacttgaataggcctatattcagtaagtgttgcttcgaagtgttaacatcgtcatggcgcgcctccccctgggatgtgtctgggctgccaatactgagctccagccatgtgactctgggagagtgggtggagcggacccagcagttacaagatatctcatcaatgttgtggactaacatggcgatttcatctgtcgccgaatttaggcgcactgattcccagttgcagggacaggtcttgtttagacatctcgcgggcctggcggaacttcttccagaaagtcggcgccaggaatacatgcagaattgcgagcagctgttactgggtagttcgcaggcatttcagcacgtgggtcagactcttggcgatatggccgggcaggaagtgctgcccaaagagctgctctgtcagttactcaccagccttcaccattttgttggagagggagagtccaagagatcattgcccgagcctgctcagcggggatccctgtgggtgtcactgggattactacagatacagacatggctgcctcaagcccgattcgatccagcagtgaagcgggagtacaagctcaactatgtcaaggaagaactacatcaactacagtgcgagtggaaaacacgcaatctgtcttcacagctccagacagggcgagacctggaggacgaggtggtggtgagttactcccatccccatgtaaggcttctgagacagcggatggatcgcctcgacaacttaacctgccatctcctaaagaaacaggcgtttcgcccacagctgcctgcctacgagtcactcgtgcaagagatccaccactacgtgactagcatagctaaagctccagctgtacaggacctgctgacacgcctgcttcaggccctgcacattgatggcccaagatctgcacaggtggcacagtctctactcaaagaggaagctagctggcagcagtcccatcaccagttcaggaaacgcctgagtgaggaatacacattttatcccgatgccgtgtcaccacttcaagcttctattcttcagctgcagcacggcatgagactcgtggcctctgagctgcataccagtctgcatagctctatggtgggagcagatcgacttggaactctcgcgaccgctctgttggcattcccatccgtgggccccactttccccacctattacgcccacgccgataccttgtgcagcgtgaaatcagaggaggtgcttaggggtctgggaaagctgatccttaaaaggagcggaggcaaggagctagaaggcaagggccagaaggcatgtccgacacgggagcaattactaatgaatgccttgctgtacctcaggtcacacgtcctttgcaaaggggagcttgaccagcgtgcactccaactctttcggcatgtttgccaggaaataatttcagagtgggacgagcaggagcgcatagctcaagagaaagccgagcaggagagcggcctgtaccgataccgtagccggaactcacgtacagctctctcagaagaagaagaggaggaaagggaatttcggaagcagtttcccctgcatgagaaagacttcgccgatatactcgttcagcctacgctcgaggagaacaaaggtacctcggacggccaggaagaagaggcaggaacaaacccagctctgctgagccagaattcaatgcaagcagtcatgctgattcaccagcagctttgcctgaattttgcccgttccctctggtaccagcagaccctcccacctcacgaagctaagcattatctttccttgttcttgtcatgttatcagacaggcgcgagcctcgtgactcatttctacccgttgatgggggttgaactcaacgatcgtcttctgggaagtcagttgctcgcgtgcactctttctcacaacaccctcttcggggaggccccaagcgacctgatggttaaaccagatgggccatacgacttctatcagcaccccaacgtgccagaggcccgccaatgccagcctgtgttgcagggtttttccgaggcggtttcccacctgctccaggactggccagagcatcccgcattggagcagctgctggttgtgatggaccgtattcgttcattccccctaagcagtcctattagcaagttcctgaacggcttagaaatcctgctcgctaaagctcaagactgggaagagaacgctagccgggccctatccctccgaaagcacttggaccttatatcccaaatgataatcaggtggaggaagctggaactcaactgctggagtatgtcactcgacaatactatgaaaaggcacactgaaaagagcactaaacattggttttcgatctatcagatgctggaaaagcatatgcaggaacaaacagaagagcaggaagatgacaaacagatgaccttaatgctgttggtaagtaccctccaagcttttattgagggcagctcgctgggggaatttcatgtccgactccagatgctgctagtctttcactgccatgtgctgctaatgcctcaggttgaggggaaggactctctgtgctccgtcttgtggaatctataccactactacaaacagtttttcgacagagtgcaggccaaaatcgttgagttaagatctcctctggagaaagagctaaaggaattcgtcaaaattagcaaatggaacgacgtgtccttctggtctatcaaacagagcgtagagaaaacgcatcggacgttgttcaagttcatgaaaaagttcgaagctgtgttgagcgagccctgtagatcttccttagttgaatctgacaaagaagagcagcccgacttcttacccagaccaacagatggcgccgcttccgagctgtcttcaatacagaatttaaacagagcactgcgcgaaacgctgcttgcccagccagccgccggacaggctactatcccagagtggtgccagggagccgcaccgagtgggctcgagggggaactgttacgtaggcttcctaagctgaggaaaaggatgcggaagatgtgcctgacctttatgaaggagagtcctctgccacgactggtggagggtctcgatcaatttaccggggaagtaatcagtagcgtgtccgaactccagtctctgaaagtcgagcctagcgctgaaaaagagaaacaacggagcgaagccaaacacattctgatgcagaagcagcgggccctgtctgatctgttcaagcatttggccaagatcggcctgagttaccgtaagggactcgcctgggccagatccaaaaatccccaggaaatgctgcacctgcaccctcttgatttgcagtctgccctttcaatcgtgagtagtactcaggaggccgattctagattgttgactgaaattagtagcagctgggatgggtgccaaaagtatttttaccggtcgttagcaagacatgctcggctgaacgccgccttagccacacctgccaaggagatgggcatgggtaacgtggagcgctgtcgagggttttcggcgcatttgatgaaaatgttagttagacaacgcagatctctgaccactctctcggagcagtggatcatattacgaaatctgctgtcttgtgtccaagagatccacagccgactaatggggccccaagcgtacccagtcgcgttccctccccaagacggtgtgcaacagtggaccgaacgcttacagcatctggccatgcagtgccagattttgctcgagcagctcagttggctactccaatgctgcccttcagttggaccagccccaggccacggtaacgttcaagtcctgggccagccacctgggccctgcctggaaggaccagagttgtcgaaagggcaactttgtggtgtagtgctggatctgattcccagtaacctatcttacccttcaccgatccctgggtctcagctgccaagcgggtgtagaatgcgaaagcaggatcatttgtggcaacagagcaccacgcggctaactgaaatgctgaaaactataaaaactgtaaaggccgacgtggacaagatccggcaacagagctgtgagaccctcttccactcatggaaggattttgaggtttgtagtagtgccctcagttgtctaagtcaagtgagcgtgcacctgcagggccttgaatcactttttatattgcctggaatggaggtagaacagagagactctcagatggcgctggttgaaagcctcgagtacgtacggggcgaaatctccaaggctatggccgactttacaacttggaagacccaccttcttacatcggatagtcagggaggcaaccaaatgcttgacgaaggatttgtggaggacttttcagagcagatggaaatcgccattcgagcgatcctctgtgccatccaaaacctggaagagaggaagaacgagaaagccgaagaaaacaccgaccaggccagtcctcaggaggattacgcagggttcgagcgtcttcagtccgggcacctcaccaagttgctggaagatgacttttgggccgatgtctctactcttcacgtgcagaaaattataagcgccatctcagaactgctggaacgtctaaaatcttacggtgaagacggcacggcggccaaacacctattcttttcccagagttgctccctgttggtgcgcttggtgccggtcctctcttcttatagcgaccttgtactgttttttctgaccatgtcccttgcgacgcacaggagtaccgccaaattattgtccgtccttgcgcaggtgtttactgaactggcacaaaaggggttctgtcttccgaaagaattcatggaagatagtgccggagaaggagccacagagttccacgactatgaaggcggtgggattggagaaggcgagggcatgaaggacgtttctgatcagatcggcaacgaggagcaggtggaagacaccttccaaaaaggccaagagaaggacaaggaggatcccgactctaagagtgacattaagggagaagacaacgcaatagagatgtctgaagattttgatggcaagatgcacgacggcgagctggaggagcaggaggaagacgatgaaaagagtgattctgaaggaggagacctagataagcacatgggcgacctcaatggcgaggaagccgataaactagatgaacgactgtggggcgacgacgatgaagaagaggacgaagaggaggaagacaacaaaacagaggagacaggcccaggcatggacgaggaggatagtgaactggtggcaaaggatgataacctggacagtggaaattcaaataaggataaatcccaacaggacaagaaagaggagaaggaagaggcagaagccgacgacgggggacaaggggaggataaaataaatgagcagatcgacgagagagactatgacgaaaacgaagttgacccataccatggtaaccaggagaaagtgcctgaacctgaagcactcgatctgcctgacgatctcaacctggattctgaagacaagaacggcggtgaggataccgacaacgaggagggcgaagaagaaaatccactcgagatcaaggaaaaaccagaagaagcaggacatgaggccgaagagagaggagagaccgaaactgaccagaatgagagtcaatccccgcaggagccagaggaaggaccatctgaggacgataaggctgagggagaggaagagatggataccggtgcagatgaccaggatggtgacgcagcccaacatcccgaagaacactctgaagagcagcagcagagcgttgaagaaaaagataaggaggccgacgaagaggggggagaaaatgggccggcagatcaggggttccagccgcaggaagaggaagagcgtgaggactcagataccgaagaacaggtgccggaggcgttggaacgaaaggagcatgcctcatgtggccagactggtgttgaaaatatgcagaatacccaggcgatggaattagctggtgctgcaccggaaaaggagcagggtaaggaagagcatgggtcgggcgctgcagacgcaaaccaggccgaagggcatgagtcaaactttattgcccaactggcaagccagaaacatactcgcaagaacacccagagttttaagcggaaaccaggccaggccgataacgaacggtccatgggggaccataacgaacgggttcacaaacggcttagaacggtggacaccgattctcacgcagaacagggccccgctcagcagccacaggctcaagtagaggatgccgatgccttcgagcatatcaaacagggatccgacgcctacgatgcccagacatatgatgtggccagcaaggagcagcaacagtccgccaaggatagcggtaaagaccaggaggaagaagagatagaggacacacttatggatactgaagagcaggaagagtttaaagcagctgacgtcgaacagctgaaacccgaggagataaaatcgggcaccacggcgcccctgggctttgatgagatggaggtagagatccaaaccgtgaagacagaagaagaccaggatccacgcacggacaaggcccacaaagagactgaaaacgagaaaccagagcgctctcgcgagtccacaattcatacagcccatcagttcctaatggataccatttttcagccttttctcaaggacgtcaatgagctgcgacaggaactggagagacagttggagatgtggcaaccaagagaatcaggtaacccggaagaagagaaagtggccgcggagatgtggcaaagctacttaatcctgaccgcccccctttcacagcggctgtgcgaagaacttcgactgatcctggaacccacccaggccgcaaagcttaaaggagactataggacaggtaaacgcctcaacatccggaaagtcatcccttacattgccagccagtttagaaaagataaaatctggctgaggaggacaaagcccagtaaacgtcagtaccaaatctgcttggccatcgatgactcttcatccatggtggacaatcataccaagcagctggcgttcgagagcctagcagtcatcggcaacgctcttaccctactggaagttggtcagatcgccgtctgttcttttggagaaagcgtgaagctgctccatcctttccacgaacagttctccgattacagcggctcgcagatcctgagactgtgtaagttccagcagaaaaaaacaaagattgcccagttccttgagtctgtcgccaacatgtttgcggccgctcagcagctctcacaaaatattagttctgagacagcgcaacttctgctcgtggtttccgatgggcgaggactgttcttggagggcaaagaaagggtcctcgccgccgttcaggcggcccggaatgctaacatattcgtgattttcgtcgtcttggataacccaagtagcagggattctattctcgatatcaaagtgccaatttttaaggggcccggtgagatgccagaaattcgctcttacatggaggagttccccttcccttactacattattctgcgcgacgtgaatgcactcccagaaactctctccgacgctctccgtcaatggttcgagctggtgacggccagcgaccacccctag

SEQ ID NO: 12305 - DNA, 3546 bp, Artificial Sequence
  Description of Artificial Sequence: Synthetic coding sequence
atggaacacttcctgctggaggtggcagccgcgcctctcaggctgatcgctgcaaagaatgaaaagtctagatctgagctgggacggtttctggcgaagcaagtgtggaccccccaggaccgccagtgcgtgctgtcaaccctggcccagctcctgctggacaaggattgtactgtgctggtgggcagacagctcaggcccctcttactggatctgcttgagagaaacgcagaagcaatcaaagctggcggtcagattaatcacgatctacatgagcggttgtgcgtgagcatgtcaaaacttattgggaatcaccctgacgtgttgccattcgcattgcgatatttcaaagacacaagtcccgttttccagagactgttccttgagtcatccgacgcaaatcctgtgcgctatggacggaggaggatgaaacttcgcgatctaatggaagccgcattcaagttcctccagcaagaacagtcggtgtttcgcgaactttgggattggagtgtctgcgtcccccttttgcgctctcacgacacgctcgtccgatggtacaccgccaattgtctagccctggtaacatgtatgaatgaagagcacaagctgagcttcctgaagaagatcttcaattccgatgaactgattcatttcaggttacgcctgctggaggaggcccaactccaggatctagaaaaggccttagtcctggctaaccccgaggtgtcgttgtggcgaaagcaaaaggagctccagtatttgcagggtcacctggtcagttctgatctatccccacgagtgaccgctgtatgcggggtcgtgctgcccgggcaactgcccgcccctggagagctgggcgggaaccggtcatctagtcgggaacaggaactcgccctgcgctcttacgtccttgtagaaagcgtgtgcaaatccctgcagactttggccatggcagtcgcctcccaaaatgccgtattgctcgaaggtccgataggatgtggcaaaacctcactggttgagtacttggcagcagtaactggccgtaccaagcccccacagcttttgaaagttcagctgggagaccagacagactcgaaaatgctcctaggtatgtaccggtgtactgatgtccctggcgagtttgtctggcaacccggcacattgacccaggcagctaccatggggcactggatcctgctggaagacattgattacgctcctctggacgtcgtgttgcaaagtaggtatcctagcttgctggccgtggtggaccatctgctggatatatatattcagctcactggggagaagcaccattcttggtccgattcttccgtggggtgtgagcaggcccccgaagaggtctccgaagccagacgcgaaaataagcggcctaccctagagggaagagagctttccctgagggacctgctcaattggtgcaaccgcatagcacacagttttgacagcagctctctgagcgccagcctgaacatattccaggaagccctcgactgcttcacggcaatgctgagcgaacacacctccaaactgaagatggcggaggttatcggcagcaaactcaacatctcccggaaaaaggccgaatttttctgccagctctataagcctgagatcgtgatcaatgagctggacctgcaggtaggtcgggttaggttgctgagaaaacaaagcgaagcagttcacctgcaaagagaaaagttcacatttgctgctactcgcccgtctagtgtgctgattgaacaactggctgtgtgtgtgtcaaagggggagccagtgctccttgtgggggagaccgggaccgggaagacttcgacaatccagtatctggctcacattacaggccacagattaagagtagtcaatatgaatcagcagagcgacaccgccgatcttttgggcggttacaagccagtcgatcacaagctcatctggttaccccttagggaggccttcgaagaactctttgcccaaacattcagcaaaaagcagaattttacttttcttgggcacatccagacatgttaccgccagaagcgctggcacgatctgctccgcctcatgcagcacgtgcacaaatcggcagtgaataaagacggaaaggatagcgaaaccgggcttctaatcaaggaaaaatgggaggccttcggcctccggctgaaccatgcccagcagcagatgaaaatgaccgaaaatactctcctgtttgcattcgtggagggcactcttgcacaggcagtgaaaaagggcgagtggatcctcctggacgagatcaatctcgccgcccctgagattttggagtgcctatccggactgctggaagggtcttctggaagtctggtgctgttggatcggggggataccgagcctttagtgaggcatccagatttccgacttttcgcgtgtatgaaccctgccaccgatgtgggcaagaggaacttaccccctggaattcggaatcgttttactgagctgtatgtcgaagagcttgaatccaaggaggacttacaggtgcttattgtggattacctgaaaggtctcagcgttaacaagaatacggtccaggggatcatcaacttctatactgccttacgcaaagaatcgggtaccaagctggtggacgggacaggacataggcctcattactcactgcggacactgtgtagagcactgagatttgccgcatcaaacccatgtgggaacatccagcgctctctgtacgagggtttctgcctcggcttcttaacccaacttgatagagctagccaccccatcgttcaaaaactgatttgccagcacatcgtgcccggaaatgttaaatcactgcttaagcagcctattcccgaacctaaaggcggcagacttattcaggtagagggatactggattgctgttggcgacaaggagcccaccatcgacgagacctatatactcacatcatctgttaagctcaacttgcgagatattgtcagggtggtgagcgccgggacctatcctgttcttatacagggtgaaacctctgtcggtaaaacaagcctgatccagtggctggcagccgccacaggcaatcactgcgtccggattaacaatcatgaacacaccgatatccaggaatacatcggatgctataccagcgatagctctggcaagttggtttttaaagagggagttttaatcgatgccatgcgcaaagggtactggattattctggatgagcttaatctcgcacccaccgatgtgcttgaggcactgaacagactgttggacgacaacagggaactcctcgtgacagaaacccaggaagtagtcaaggcgcatccccggttcatgcttttcgcgacgcagaacccgccaggactgtacggcggcaggaaggtcctgtccagagccttcagaaatagattcgtggagttacatttcgacgaactcccaagctcagagcttgagactatcctgcacaagagatgctccctgcctccgagttactgcagtaagctggtgaaggtgatgctcgacttacagtag

SEQ ID NO: 12306 - DNA, 3351 bp, Artificial Sequence
  Description of Artificial Sequence: Synthetic coding sequence
atgattttagacgagttttacaacgtgaagttttgtatcgacgcctctcagcctgatgtgggatcttggctgaaatacattcggttcgcagggtgctacgatcagcacaacctggtggcctgtcagatcaacgatcagattttttatagggtagtggcagacatcgctcctggagaagagctgctgctatttatgaagtctgaggattacccacacgagactatggccccagatatccacgaggagcgtcagtataggtgtgaagattgcgatcagctgtttgaatctaaggctgagttagccgaccatcagaaatttccttgcagtactcctcattccgcttttagcatggtagaggaggactttcaacagaagctggaaagcgagaatgacttacaggagatacatacaattcaggaatgcaaagagtgcgatcaggtatttcctgatctccaaagcttagagaagcacatgctgagccacaccgaggagcgagagtataagtgtgatcagtgcccaaaggcatttaactggaagtcaaatcttatccggcatcagatgtcccacgacagtggtaaacattacgagtgtgagaattgcgcgaagcaagtatttacagacccttctaatctccagcgccacattagatcgcagcacgtgggggccagggcccatgcatgtcccgagtgtggcaagacattcgcgactagcagtgggttgaagcagcacaagcatattcactctagcgttaaacctttcatctgtgaggtttgccataagtcatatacccagttttccaatctttgtagacataaacggatgcacgccgactgccggactcaaattaagtgcaaggattgcggccaaatgttctcaactacatcatcgctgaataaacatcgccgcttttgcgaagggaaaaaccatttcgccgctggcggcttctttgggcaggggatatcactgccagggacccccgctatggacaagacatccatggtgaacatgagccacgccaaccctggactcgccgactactttggagcaaatcggcatcccgctggactgactttccccaccgcccctggattcagcttttccttccctggactattcccctcgggactgtatcatagacccccattgattccagcatcctctccggtgaagggcctctcttcgactgagcagacaaacaagagccagtccccactgatgacccacccccaaatactcccagctacacaggatatcctcaaggcgctgtccaaacatccttccgtcggcgataacaaacctgtcgagctgcagcccgaaaggagctccgaagaaagaccgtttgagaaaatttcggaccaatccgagtcgtcagaccttgacgatgttagcactccatcaggcagtgatctcgagaccacatcaggatccgacctggagtcagacatcgagagcgacaaagagaagttcaaggaaaacggcaaaatgtttaaggataaggtgagccccctgcagaacttggcctcaattaataacaaaaaagaatattctaatcactccatcttttcaccatccctagaagaacagaccgcagtctctggggcagtgaacgactctatcaaggcaatcgcttcaatcgcagaaaagtatttcggaagcacaggactcgtcggcctccaggacaaaaaagtgggagctctaccatacccttccatgtttccactcccattcttcccggcttttagtcagtccatgtatccttttccggaccgagacttgcgtagcctgcccctgaagatggagccccagagccccggagaggtgaagaaactgcagaagggttcttctgaatctcctttcgacctcacgactaagagaaaagatgagaaaccacttaccccagtgccaagcaagcctcccgtgacccctgcaacaagccaggatcagccactggatctgtctatgggttcccgctctcgcgcatctggaaccaaactcactgagccacggaagaatcatgtgtttggaggtaagaagggaagcaatgtcgagagccggcccgcatccgacggtagtctgcagcacgcccgcccaacgccgttctttatggatccgatttacagagtggaaaaaaggaagttgacagatccgctggaagccttgaaagagaaatatttgcgcccttcgccgggattcctcttccacccccagttccagctgcccgaccagcgaacatggatgtctgcaattgaaaacatggctgaaaagttggaatcattttcagcattgaagcccgaagcctcggaattgttacagtcggtcccaagcatgttcaacttccgtgccccccctaatgccctgccggagaacctgctgagaaaaggtaaggaacggtacacatgcagatattgtggcaaaatcttcccacgtagcgccaacctgactcgccacttgcgcacccatactggcgaacagccgtatcgttgcaaatattgcgatagaagtttttccataagctcaaaccttcagaggcacgtgcggaacatacataacaaagaaaagcctttcaaatgccatctgtgtgacaggtgcttcgggcagcagaccaatctggataggcacctgaaaaaacacgagaacggaaacatgagtgggaccgccacttcttccccacacagcgaactggaatctactggcgctatattggatgataaggaggacgcttacttcacagagattaggaacttcattggcaattccaatcatggcagccaatcaccacgaaacgtggaggagaggatgaatggctcccactttaaagacgaaaaagctctggttacctcccagaactctgaccttttggacgacgaggaagtagaagacgaggtactccttgacgaggaggacgaagataatgacattacaggcaaaactgggaaagagcctgtgacgagcaacctgcatgagggtaatcctgaggacgattatgaggagacctctgccctagaaatgtcctgcaaaacatctcctgtgagatataaggaggaagaatataagtcaggcctaagtgccttagatcatatcaggcactttacggattctttgaagatgcgaaagatggaggacaaccaatatagtgaggccgagctttcctccttcagcacaagccacgtccccgaggagttgaagcagccactgcacagaaaaagcaaatcccaggcatacgcaatgatgctgagcctgagcgacaaggaatctcttcatagtacgtcacattccagttccaacgtgtggcactccatggctagggcggcagccgaaagcagcgccatccagtccatttcacacgtatag

SEQ ID NO: 12307 - DNA, 3156 bp, Artificial Sequence
  Description of Artificial Sequence: Synthetic coding sequence
atgaagtcagaagactatccccacgagaccatggcccccgacatccacgaggaacgtcaatacaggtgcgaggactgcgaccaactctttgaaagcaaagccgagcttgctgaccatcaaaagtttccctgctcaacaccccattctgcctttagcatggtggaggaggattttcagcagaaactggaaagcgagaacgacctccaagagattcacactattcaagaatgtaaagaatgcgaccaggtgtttccagatctgcagagcctcgagaagcacatgctctctcatactgaagagcgggagtacaagtgtgaccagtgcccaaaagcattcaattggaaatccaacctcatacggcatcagatgtctcacgacagcggtaaacactatgagtgcgagaattgtgccaaggtgtttaccgatccaagcaacctgcaaaggcacataaggtctcagcacgtcggagcccgggcccacgcgtgtcccgagtgcggaaaaacgttcgcaaccagcagcggcctcaagcagcacaaacacatacacagctcagtgaagccctttatttgcgaagtctgccacaaaagctatacccagttctccaacctttgtcgacataaacgcatgcatgcagattgtaggacccagattaaatgtaaagattgcggccagatgttctcaacaacctcgtcattgaataagcatcgtagattctgcgagggaaaaaatcatttcgccgccggcggtttctttggccagggcatttccttgcccggtacccccgcaatggacaagacgagcatggtcaacatgagccacgccaatcccgggcttgctgactactttggcgcaaacagacacccagcaggccttacttttccgactgcccccggattctctttcagcttccccgggctctttccatcaggcctgtaccacagaccacccctgatccctgctagctctccggtgaaaggcctttcttctaccgagcagactaacaagtcgcagtcccccctcatgacacacccccagatcctgcctgcgacacaggatatcttaaaagcattgagcaagcatccttcggtcggcgacaacaagcccgtggaacttcagcccgaacggagctcagaggagcgtccctttgaaaaaatatctgaccagtccgaaagcagcgacctggatgacgtttccacgccaagtgggagtgatctggagactacctcaggctccgatctcgaaagcgacatcgagagtgacaaggaaaagtttaaggagaacggtaaaatgttcaaggacaaggtgtcccccctccagaatctggccagtatcaataacaagaaagaatatagcaaccactctattttttcaccatccctagaggagcaaacagccgtaagcggggccgtgaatgacagcatcaaagccatcgccagtattgccgagaagtattttggctctactggactcgtgggcctgcaggataaaaaggtgggggcattgccttaccctagcatgtttccattgccctttttcccagccttctcccaaagcatgtacccttttcctgaccgagatcttagaagcctgccactcaagatggagccccagtcacccggcgaggtgaagaagttgcagaaaggctcctccgaatcacccttcgatctgacaacgaagcgtaaggacgaaaaaccactcactcccgtaccgtcaaagccacccgttaccccagccacaagccaggatcagcccctcgacttatccatgggatctcgtagtcgggcaagcggaactaaacttacagaaccacgtaagaatcacgtcttcggcggcaagaagggctccaatgttgaatctagacctgcttctgatggaagcctgcagcacgcgagacccaccccttttttcatggaccccatttatagggtggagaagcgtaaattgaccgatccactcgaggctctaaaagagaagtacctgcgacctagccctggcttcctgttccatccacaatttcagctgcccgaccagaggacctggatgtctgccatcgaaaatatggccgaaaaattggaatcattctccgcgctcaagcccgaggcatcggaactcctgcagagtgtccctagtatgtttaatttcagagccccacctaacgccctgccggaaaatctcctgaggaaggggaaagagcgttacacctgcaggtactgtggaaagatattccctaggagcgccaatttaaccaggcacttacggactcacactggtgagcagccttaccgatgtaaatactgcgatagatcattcagtattagctccaacctgcagagacacgttagaaacattcataacaaagagaaacccttcaaatgtcatctgtgtgataggtgttttggacaacagaccaacttggaccgccatctaaagaagcatgaaaacggcaacatgtcgggaacggctacctcctccccacatagtgagttggaatccacgggggccatcttagatgataaggaggatgcttatttcactgagatcagaaacttcatcggcaacagcaaccacggttctcaaagcccaagaaacgtcgaggaaagaatgaacgggagccactttaaagatgaaaaggctttggtgacgtctcagaatagtgaccttttggacgacgaggaggtggaggacgaggtgctccttgatgaagaggatgaggacaatgacatcactggtaagacagggaaagaacccgtaacttcgaatctgcatgagggtaatcctgaagatgattatgaagaaacctcggcactagagatgagttgtaagacttcacctgtgcgatataaggaggaggaatacaaatccggactgagcgcgttagatcatattagacatttcacagattctttgaagatgcggaagatggaggataaccagtatagcgaagcggagctgagttctttttcaacaagccacgttccagaagagctcaaacagcccctgcaccggaaatcaaagtcccaagcctacgctatgatgctgagcctctctgacaaggagtccctccattccactagccacagcagtagtaacgtgtggcatagcatggcacgcgctgccgctgaatcgagcgccattcagtcaatcagtcacgtctag

SEQ ID NO: 12308 - DNA, 3159 bp, Artificial Sequence
  Description of Artificial Sequence: Synthetic coding sequence
atgaagtctgaggactatccacatgaaacgatggccccggatatccacgaagagagacagtatcggtgcgaggattgtgatcagctgtttgaatctaaagctgagttggccgaccaccagaagttcccatgctccacaccgcattccgcatttagcatggtcgaagaggattttcagcagaagttggaatctgaaaacgatctccaggagatccatacgatccaggaatgcaaggaatgtgaccaggtgtttccagatttgcagtctctggaaaagcacatgctgtcccacaccgaagaacgtgagtacaagtgcgaccaatgccccaaagccttcaattggaaaagcaacctcatccggcaccagatgtctcacgatagcggtaagcattacgagtgcgagaactgcgctaagcaggtgttcaccgatcccagtaatttgcagaggcacatccgttcccagcatgttggtgcaagggctcatgcatgcccagaatgcgggaaaacattcgcgacgagtagcggtctaaagcagcataagcacatccatagctccgtaaagcctttcatttgcgaggtctgtcacaagtcctatactcagttctctaacctgtgcagacataagagaatgcatgcagattgccgcacccagatcaaatgtaaagattgtggccagatgttcagcactactagctctcttaataaacataggaggttttgtgaagggaaaaatcactttgccgccggaggattttttgggcagggcatttctctacctggaactcccgcgatggacaaaacatccatggtgaacatgagccacgccaatccaggcctggccgattacttcggagctaatcgtcatcccgcagggctcacgtttccaaccgcccctggtttctccttttcttttcccggcttgttcccctccggcctgtatcacaggccacccttgattccggcctccagtcccgtgaagggactctcctccacagaacagactaacaaatcccagtccccccttatgacacacccccaaatattgcccgcaacgcaagatatcctaaaggcactgagcaaacacccttccgtgggtgataacaaacccgttgagctgcaaccagaaagatcttccgaagagcggcccttcgaaaaaattagtgaccagtcagagtcttccgacctggacgatgtcagcactccctcaggctctgatctggagactacatcaggaagcgaccttgagtctgacatcgagagtgacaaagagaaattcaaagagaacggcaagatgttcaaagataaagtgtctcccctacagaaccttgcatcaatcaacaataagaaggaatattccaatcactcgattttcagcccctctctggaagagcagactgcagtgagcggggccgtcaacgactcaatcaaggccatcgccagcattgccgagaaatattttggaagcacgggtctggtcggtctgcaagataagaaggtcggcgcactcccctaccctagtatgtttccattacccttcttcccagccttctctcaatcaatgtatcctttcccagatcgagatttgaggagccttccactgaagatggaaccccagtcacctggagaggttaagaaactccagaagggatctagcgagtctccgtttgacttaactactaagcggaaggacgagaaacctctaaccccggtcccatcgaaacccccagtcacacctgctacctcccaggatcaaccactagacctgtctatgggaagtagatcgcgcgcctccgggacaaaactgaccgagccacgaaaaaatcatgttttcggcggcaagaaaggcagcaatgtggaatctaggcccgcgagtgatgggtccttgcagcacgcaagacctactcccttcttcatggaccccatctaccgggtggaaaaaagaaaactgaccgaccctctggaggccttaaaagaaaaatatctgagacccagtcctggattcttgtttcacccgcaattccagttacctgatcagaggacctggatgagcgccattgagaacatggctgaaaaactggaaagtttctccgccctgaagcccgaggcctcagagctgctgcagtcagtgccctctatgttcaactttagagctccacctaacgctctgcctgagaatctcttacgaaagggcaaggagcggtacacctgcaggtactgtggtaagatcttccctaggtctgccaacctgacacgccacctgcgcactcatacaggcgagcagccgtatagatgcaaatactgtgacaggagcttctccatttcctccaacctgcagcgtcatgtgcgcaacattcataataaggaaaagccattcaaatgtcatctttgcgaccggtgcttcggacagcagactaaccttgatagacatttgaaaaaacacgaaaatggcaacatgagtggaacagctacatcaagcccacattccgagctggagagcacaggcgctatcctcgacgataaagaggacgcctacttcaccgagattaggaatttcatcgggaacagcaaccatgggtctcagtctccacgaaacgtcgaagaaagaatgaatggctctcacttcaaagacgagaaggccttggtgacctcccagaacagcgatctgctcgacgatgaagaggttgaagatgaggttttactcgacgaggaggacgaggacaacgacattacaggaaaaactgggaaagaacccgtaacttcgaatctgcacgagggcaatcccgaagatgactatgaagagacaagtgctttggagatgtcatgtaaaacgagtcccgtaaggtacaaagaagaagagtataagtctggcttgtctgcactggaccacatccggcatttcacagatagtctgaagatgcgaaaaatggaggataaccagtatagtgaggctgagctaagcagctttagcacaagccatgtacctgaggagctgaagcaaccgctccacaggaagtctaagagtcaggcctatgctatgatgttatccctctccgacaaagagagtttgcactctacatcacatagctcttccaacgtgtggcactccatggctagggctgctgctgagagttccgccatccagagtatctctcacgtttag

SEQ ID NO: 12309 - DNA, 3012 bp, Artificial Sequence
  Description of Artificial Sequence: Synthetic coding sequence
atgaaatccgaggattacccgcacgagaccatggcccccgatattcacgaagagagacaatatcggtgcgaggactgcgaccagctttttgaatcaaaagccgaactcgctgatcaccaaaagttcccttgctctactccacactcggccttctccatggttgaagaggacttccaacagaagctcgaatccgaaaatgacttacaggagatccatactatccaggagtgtaaagagtgcgaccaggtgtttcctgatctgcaatctcttgaaaaacatatgctctcgcacacagaggagagagaatacaagtgcgatcagtgtccaaaagctttcaactggaaaagtaatctgatacgccaccagatgtctcatgatagcggaaaacactacgaatgtgagaattgtgcaaaagtctttacggatccgtccaatctgcagcgccatatcagaagccagcatgtcggcgcccgggcccacgcctgtcctgaatgtggaaagaccttcgccacatcatcaggactgaaacagcacaagcacatccactcctccgtgaaacccttcatctgtgaggtttgtcacaagtcctacacacagttttctaatctgtgcagacacaagcgcatgcacgcagattgtcgtacacagattaagtgtaaggactgtggccaaatgttttccaccacttcgtcattgaacaaacacagaagattctgtgagggcaagaatcacttcgctgctggcgggttttttgggcaggggattagtcttcctggaaccccagccatggataagacatcaatggtcaacatgagccacgctaatccaggcctggcagactacttcggcgctaacaggcatccggcaggcctgacatttccaaccgcccccggattctccttcagctttcctggcttattcccatcaggtctgtaccataggccacctctgatccccgctagcagccccgtaaagggactgtccagcacagagcagactaacaaatcccagtcccccctgatgacccatccgcagatactgccagcaacacaggacattctgaaggctttgtcaaagcatccatcagtgggcgacaacaagccggtggagctgcaaccggagcgctccagcgaagaacggcccttcgagaaaatctcagaccagtcagaatccagcgatctggatgacgtgtctaccccatcaggctctgatcttgaaacaacctccggtagcgatttggaaagtgatatcgaaagcgataaggagaaattcaaggaaaatggcaagatgtttaaggacaaggtgtctccgttgcagaacttggcttccataaacaacaaaaaggagtacagcaaccactccatcttttctcccagtctggaagaacagactgcagttagtggagcagtgaacgactccatcaaagctatcgcaagcatcgcggaaaagtactttggatccaccggcctggtgggtttgcaagataaaaaggtgggcgccctgccctaccccagtatgtttccgctgccgttttttcctgcattcagccagtctatgtaccccttccccgaccgggacctccgaagtctgcctttaaaaatggagccccaaagccccggcgaggtgaaaaagctgcaaaagggctccagcgaatctccttttgaccttaccacaaaacgcaaagacgaaaagcctttaaccccagtgccctccaaaccacccgtcactcctgcaacatcgcaggatcagccattagacttaagcatggggagcagaagcagggccagtggaaccaagctgaccgagcctcgaaagaatcatgtgtttggagggaaaaaagggagcaatgtggaaagtcggcccgcaagtgacggaagtctccagcatgccaggccaaccccattttttatggatcccatctatagagtggaaaagcgcaaacttacagaccctcttgaagcccttaaggaaaagtacctgcgaccctctcccggttttcttttccatccccagatgagcgctattgaaaacatggccgagaagctagaatccttcagcgctctgaaacccgaagcctctgagttgcttcagtccgtgccttccatgtttaattttagggctccaccaaacgccttaccggagaatctgcttaggaaaggcaaagagcggtacacctgccgatactgcggtaagatctttcccagatcggccaatctgacgaggcatttgaggactcacacaggggagcagccgtatagatgtaaatactgtgataggagctttagcatatcctcaaatctgcagcgccatgtccgcaacatccataataaagagaagccttttaagtgccacctgtgtgataggtgttttggtcagcagaccaacctggaccggcacttaaagaagcacgaaaatggcaatatgtcaggcacagccacctcatccccacacagcgagcttgagtccaccggagctattttagatgataaggaggatgcttacttcacagagattcgaaactttatcggtaatagcaatcacggttcccagtcacctcgaaatgttgaggagagaatgaatggatctcactttaaggatgagaaggcccttgtcacatcccagaatagcgatttgctggacgacgaggaggtagaggatgaagtgctgctggatgaggaggacgaagataatgatatcaccgggaaaacagggaaagaacctgtgactagtaatctgcatgagggcaatcctgaggacgactacgaagagacgtctgcactggaaatgagttgtaaaaccagccctgtgagatataaggaagaggaatataagtcaggcctttctgctctggaccatatacgacactttaccgatagcttgaaaatgcgcaagatggaagacaatcagtactctgaagctgaattgtcttctttctctacatcccatgtccctgaggagctgaagcagcccctgcacaggaaatccaaatctcaagaagagtctaaggcgtag

SEQ ID NO: 12310 - DNA, 312 bp, Artificial Sequence
  Description of Artificial Sequence: Synthetic coding sequence
atgaagagcgaggattatcctcatgagacgatggcccccgacattcatgaggagcgacagtacaggtgtgaggactgtgatcaactctttgagtctaaggccgagcttgccgaccatcagaagtttccatgttctacgcctcattccgccttctcgatggtggaagaagatttccagcagaagctcgaatcagagaacgacctccaagaaatacacactattcaagagtgcaaggagtgcgaccaggttttcccagatctccaatccctggagaagcatatgctgtcacacactgaagagcgtgagtattag

SEQ ID NO: 12311 - DNA, 3129 bp, Artificial Sequence
  Description of Artificial Sequence: Synthetic coding sequence
atgaagagcgaggattaccctcatgaaactatggccccggacatccacgaggaaaggcagtatcgctgcgaggattgtgaccaactgtttgagagcaaggctgagttggctgatcaccagaagtttccatgctccaccccccacagcgcattctccatggtggaggaggacttccaacagaagctcgagtccgaaaatgatctgcaggagattcacactattcaagagtgcaaggaatgtgaccaagtcttccccgaccttcagagccttgaaaaacacatgctttcacacaccgaggagagggagtataaatgtgaccagtgccctaaggcctttaactggaagtccaacttgattcgccaccaaatgtcacatgacagcgggaagcactacgagtgcgagaactgtgccaaagtatttactgacccgtccaacttgcagaggcatatccgaagccagcacgtcggtgcgcgggcccatgcatgcccggaatgcgggaaaaccttcgccactagtagtggcctgaagcagcacaaacatatacacagcagcgtgaaaccattcatctgcgaagtgtgtcataagtcatacacccagttctctaacctgtgccgccataaacgcatgcacgccgattgccgtacccagattaagtgtaaagattgcgggcagatgttcagtactactagctctctgaacaaacaccgacgattctgcgaaggaaaaaatcacttcgctgcaggcggcttctttgggcaaggtatcagcttgccaggaacacccgcaatggacaaaacctccatggtgaatatgtcccatgcaaacccaggcctggccgattatttcggagcaaatcggcacccagcagggctgacatttcccactgcccccggtttctccttctctttccccggcctgtttccctctgggctgtaccacaggccacccctgatcccagcttcctcaccagttaaaggcctgtcttcaacggaacagacaaacaagagtcagtcccctctcatgacgcatccccaaattctgcccgccacccaggatatcctgaaagctctatccaaacatccatcggtgggagataacaaaccagtggagcttcaacccgaaagatcctccgaagagaggccattcgaaaagatcagtgaccagtctgaaagttcagacctggatgacgtgagcaccccatcaggctccgacctggaaaccacttcgggctcagatctcgagagcgatatcgaatccgacaaggagaaatttaaggagaacggaaagatgttcaaagataaagtttccccactacagaatcttgcatctatcaataataaaaaggagtattcaaaccatagcattttcagcccttcccttgaggagcagacagctgttagtggcgcggtgaatgattctataaaggccatcgcatctatagccgaaaaatattttggcagcactggactcgttggcttgcaggacaaaaaggtaggagctctgccttacccgagcatgttcccccttccttttttccctgcattttcacagtccatgtaccccttcccagaccgcgacttgcgtagcttgcccctcaaaatggaaccgcagtctcctggagaagtgaagaagctgcagaagggctcctctgagtccccctttgatctcactacaaagcgcaaggacgagaagccattgaccccagtcccaagcaagcctcccgtgacccccgcaacgagtcaggatcagcctctggatctctccatgggctcccgctcccgcgcctcaggcacgaaactcacagagcctagaaagaaccatgtgttcggcggaaaaaaagggtctaacgtcgagtcaaggcccgcgagtgacggcagtcttcagcacgccaggccgacccccttctttatggatcccatctaccgagtggagaaacgtaaactgacagaccctcttgaggcccttaaggagaagtacttgagacctagtcccgggtttctctttcacccccagatgagtgccattgagaacatggccgaaaaactcgaatcattcagtgccctgaaacccgaggcatcagagctgctgcagtccgttcctagtatgttcaacttccgggctcctcccaacgccctccctgagaacctgcttagaaaaggtaaagaacgctacacctgcagatattgcggcaaaatctttcctcggtctgccaatctcacacgacatctccggacccatacgggtgagcagccatatcgctgtaaatattgcgataggagtttctctatctccagcaatttgcagagacacgttcggaatatccataacaaggaaaaacccttcaaatgccatctctgcgatagatgctttgggcagcagaccaatctcgacagacatcttaagaagcacgaaaatggaaacatgtccggaacagctacgagcagtccacattctgaactcgagagcactggggcgattttagacgataaagaggacgcctactttactgaaatcagaaattttattggcaattccaaccatgggtcccagagtcccagaaacgtggaagagcgcatgaatggttcacattttaaagatgagaaggccctagtgacaagccagaatagtgacttgctagacgacgaggaggtggaggatgaagtgttgctggacgaagaggacgaggacaatgatataacagggaaaacaggaaaggaaccggtgaccagcaatctccatgagggtaatcccgaagacgattatgaagagaccagcgccctggagatgtcctgcaagacaagccccgtccgctacaaagaagaggagtataaatccggattgtccgccttggaccatatccggcacttcaccgattctttaaaaatgagaaaaatggaagataatcagtattcagaagccgagctgagcagcttttccacttcgcatgtcccggaagaactgaagcagccgttgcatagaaagagtaagtctcaggcatatgcaatgatgctcagcctgagtgataaagagagcttacatagcacgtcccactccagtagcaacgtctggcactcaatggcacgcgccgcggccgagtcctctgccatccagtctatctcccacgtgtag

SEQ ID NO: 12312 - DNA, 69 bp, Artificial Sequence
  Description of Artificial Sequence: Synthetic coding sequence
atgaagagtgaagattaccctcatgaaacaatggctccagatattcacgaggagcggcagtatcggtag

SEQ ID NO: 12313 - DNA, 3156 bp, Artificial Sequence
  Description of Artificial Sequence: Synthetic coding sequence
atgaagtcggaggattacccacacgagacaatggcccctgatatccatgaggagaggcaatacagatgtgaagattgtgaccagttatttgagagcaaggccgaattggcagaccatcagaagtttccttgtagcactccccacagcgcttttagcatggtcgaagaagacttccagcaaaaactggaatccgagaacgatcttcaagagattcataccatccaggagtgcaaagagtgcgaccaggtttttcctgacctgcagtcacttgagaaacacatgctgtcccacacagaggaacgcgaatacaagtgtgatcaatgccctaaggcttttaattggaagtccaacctcatcaggcaccagatgagccacgactctggcaagcactatgagtgtgagaactgtgcgaaggtatttactgacccctccaacctgcagcggcacattagatcacagcatgtaggcgcaagggcccatgcctgtcctgaatgcgggaaaacttttgcaactagcagcggtcttaagcaacacaagcatatccactccagtgtgaaaccattcatctgtgaagtgtgccataagtcctatactcagttctctaacctgtgccgccacaaacggatgcatgctgactgccgcacccaaatcaaatgcaaagattgtggacagatgttctccactaccagttctctgaataagcatagaagattttgcgagggtaagaatcactttgccgccggcgggtttttcgggcagggcatctccctgcctggaactccagcaatggacaagacatccatggtgaacatgtctcatgccaatccaggcttggctgactacttcggcgcaaacaggcacccagcaggactgacattccctaccgctcccggattttctttttctttccccgggctgttccccagcgggctctaccatcgtcccccactcatccccgcgtctagcccagtgaaagggctgtcttcaacggaacagaccaacaagagtcagtcacctttaatgacccacccacagatcctcccggcaacccaggatattctgaaggctctgtcaaagcacccaagcgttggggataataagcccgtggagttgcaacctgagcgaagctcagaggaacgccctttcgagaaaatctcagaccagagcgaaagtagcgacctcgatgatgtctcaaccccaagtgggtccgatctggaaactacctccggcagtgacttggagtccgatattgagtctgataaagagaaatttaaggagaacgggaaaatgttcaaagacaaggtgagtcctctccaaaatctagcttctatcaataataaaaaagagtattccaaccactctattttcagtcctagcctcgaggaacagactgccgtctccggcgccgtcaatgattcgatcaaagcaatcgcgagcatcgcagagaaatatttcggaagcaccgggcttgtggggctgcaagataaaaaagtcggcgctctgccttatccctcaatgttcccgctgccattcttcccagccttcagccagagcatgtacccctttcccgatagagacctgaggtctctgcccctgaaaatggagccccagtcacccggggaggtaaagaagttacaaaaggggtcctcagaaagcccgttcgacctgacgaccaaacgcaaggatgaaaaacctctgacacccgtgcccagtaagccacctgtcactcccgccaccagtcaagatcagccccttgatctgagtatgggcagtaggtctagagcctctggtaccaagctcacagagccgagaaaaaatcacgtgtttggaggtaagaagggttctaatgtggaatctcgccccgcaagcgacgggagcctgcagcatgcacggcccacgcccttctttatggaccctatttaccgtgtcgaaaaacggaagctaacggacccacttgaggccctcaaagagaagtatctgcgaccgtcccctggatttctattccatccccagttccaattacctgaccagagaacctggatgtcagctattgaaaatatggctgaaaagctggagtccttcagtgctcttaagcctgaagcaagcgaactgctgcagtcagtgccgagcatgttcaacttccgggcaccaccgaatgcattaccagagaatctgctgcggaagggtaaggagcggtatacatgtagatactgtggcaaaatctttcccaggtctgccaacctcactagacacttgagaacgcataccggcgaacagccctaccggtgtaagtattgcgatcgtagtttttcaatctcatcaaatctccagcgacatgtaagaaatatccacaacaaggaaaaacctttcaagtgtcatctatgtgacagatgtttcggacagcagactaatctggacagacatctcaagaaacacgaaaacggaaatatgtccggcaccgccacctcaagccctcattccgaactagagtcaacgggagccatcctggacgataaggaggacgcctatttcaccgagatccggaattttattggcaattctaaccatggatcccagtctcccagaaacgtagaggaaaggatgaatgggagccacttcaaggacgaaaaggctttagttacatcgcagaattctgatcttctggatgatgaagaagtggaagacgaggtgctccttgatgaggaagatgaggacaatgatataaccggaaaaacggggaaggaaccagtcacctctaacctgcacgaagggaaccctgaggacgactacgaagaaacttccgcactggaaatgtcctgtaaaacatcccccgttagatataaggaggaagagtacaagagcggactatccgctctcgatcacatccggcacttcaccgacagcttgaagatgcgcaaaatggaggataaccagtatagcgaagccgaactgagttccttctctacgtcccacgtccctgaggaacttaaacagccactgcatagaaaatctaagagccaagcctacgctatgatgcttagcctgagcgataaggaatcactgcacagcacgagtcactcttctagtaacgtctggcattcaatggctagagccgcagcagaaagcagtgccatccagtctataagccacgtctag

SEQ ID NO: 12314 - DNA, 3159 bp, Artificial Sequence
  Description of Artificial Sequence: Synthetic coding sequence
atgaagtcagaggattatccccatgagaccatggctccagatattcacgaagagaggcagtaccgctgtgaggactgcgaccagctatttgagagcaaagctgaactggccgatcaccaaaagtttccttgctccaccccacattccgcattttccatggtggaagaggactttcagcagaaattggagagtgaaaacgacctacaggagatccacacaatccaggagtgtaaggaatgcgaccaagtgtttcctgaccttcagagcctggagaagcacatgctgtcacatactgaagagcgggagtacaagtgcgaccaatgcccaaaagcatttaactggaaaagcaacctaattcgccaccagatgagtcatgactcaggaaaacactacgaatgcgagaattgcgccaaacaggtgtttactgatcctagtaatttgcagaggcacatcagaagccagcacgttggagccagagcccacgcctgcccagaatgcggaaagactttcgcaacctccagtggcctgaagcaacataagcatatccactcctcggttaagcctttcatttgcgaagtgtgtcacaagtcctacacccaattctcaaatttgtgcaggcacaagaggatgcatgccgattgtagaacgcagatcaagtgtaaggactgcggtcagatgttttcaacaaccagcagtttaaacaagcatagacggttctgcgaagggaagaaccacttcgccgcaggcgggttcttcggacaaggaattagccttccagggacccccgccatggacaaaacatccatggtaaatatgagccacgcaaaccctgggttggctgactattttggcgccaatagacaccccgccgggctgaccttcccaacagctccagggttttcctttagttttccagggctattcccgtcgggcctctaccaccgccccccattgatccccgctagttcccccgtgaagggactgtcctctacagaacagacgaataagtcacagagtccgctaatgacacatccccagatactgcctgctacgcaggacatcttgaaagccctgtctaaacacccaagtgttggtgacaacaagccagtcgagcttcagcctgagcgctcctcagaggagcgccccttcgaaaaaataagcgaccaaagtgagtcctctgacctcgatgacgtaagcacacccagcgggtctgacctggaaactacctctggttctgatttagagtctgacatcgaaagcgataaagagaagttcaaggagaacggaaagatgtttaaggacaaggtttcgcccctccaaaatctggcatcaattaacaacaagaaggagtatagcaatcacagtatatttagcccctccctcgaggagcaaacggcggtgtccggcgcagtgaacgacagcataaaagccatcgctagtatcgctgagaagtacttcggatccaccggcctggtgggcctgcaggacaagaaggtcggagcactgccttacccctccatgttcccccttcctttctttccagctttttctcaaagtatgtacccatttccagaccgagatcttagaagtttgcccctgaagatggaaccccagtctcctggagaggttaagaagctacagaagggctcttcagaatctcctttcgatctcacaacaaagcgcaaggacgagaagcctcttactcccgtgccctctaagccgcctgtcaccccagccaccagtcaggatcagcccctggacctgagcatgggctcgaggagtagggcctcaggcactaaattaacagagcctcgtaagaaccacgttttcggtgggaaaaagggtagcaacgtagagagccgccccgcatcagacgggtcactccagcacgcccggccaaccccatttttcatggatcccatatatcgcgtggagaagcgaaaactgaccgatcccctcgaggcccttaaggagaaatacttaagaccgtcccctggttttctgttccaccctcagttccagctacccgaccagcgtacatggatgagtgctattgagaacatggccgaaaaactagagtctttttccgctttgaagcccgaagcctctgagctgctgcagtctgtcccatccatgttcaacttcagggccccgcctaatgcccttcctgagaacttgctgaggaaggggaaggagcgctatacctgtcgctactgtggcaaaatttttccaaggagcgctaatcttacacggcacctaagaacccacaccggcgaacagccttatcgctgtaaatactgtgaccgcagcttcagtattagctccaacctgcagcgccatgtacgtaacatccataacaaagagaagccattcaagtgccatctttgtgacagatgcttcgggcaacaaaccaacctggaccgtcaccttaagaaacatgagaacggaaatatgtcagggactgccactagctcacctcactcagaactggagtcaacaggcgccatcctcgacgacaaggaggatgcttacttcacggaaatcaggaacttcatcggaaactcgaaccacgggagccagtcccctcggaacgtggaggaaaggatgaacgggagccacttcaaagatgaaaaggcactggtcacttctcagaactcagacctgctggatgatgaagaagtagaagacgaggtccttctggatgaagaagatgaagacaacgatataacgggaaagaccgggaaagagcccgttacctccaatcttcatgagggcaaccccgaggacgattacgaagagacaagcgcactggaaatgtcctgcaaaacatcacctgtgcggtacaaggaggaagagtacaagtcaggcctgtccgctctggaccacatcaggcacttcacagactctctcaaaatgaggaaaatggaagataatcaatacagcgaggctgagctgagtagtttcagtaccagccatgtcccagaggagcttaagcagccactgcacagaaagagcaaaagtcaagcttacgctatgatgcttagcctgagcgacaaggagagtttacacagcacaagccactcctctagcaacgtatggcactctatggctcgcgcagccgctgagtccagtgcgattcagtcaatctctcatgtctag

SEQ ID NO: 12315 - DNA, 207 bp, Artificial Sequence
  Description of Artificial Sequence: Synthetic coding sequence
atgaagagtgaagattatccacacgagacaatggcacctgacatccatgaagaacgccagtataggtgcgaggactgcgaccaactctttgagtcaaaggctgagttggctgaccatcagaaattcccctgttccactcctcactcggctttcagtatggtggaggaggacttccagcagaaactcgagtccgagaatgatctctag

SEQ ID NO: 12316 - DNA, 90 bp, Artificial Sequence
  Description of Artificial Sequence: Synthetic coding sequence
atgaaatccgaggattaccctcacgagaccatggctcctgacattcacgaagaacgccagtatcgctgtgaggattgtgatcaactgtag

SEQ ID NO: 12317 - DNA, 378 bp, Artificial Sequence
  Description of Artificial Sequence: Synthetic coding sequence
atgaagagcgaagattaccctcacgagacaatggcaccagatattcacgaggagcgccagtatcgttgcgaggactgcgatcagctcttcgaatccaaggctgaattggctgatcaccaaaagtttccctgcagtactccccacagcgcctttagcatggtggaagaggactttcagcaaaagctggaatcggaaaacgatctccaggaaatccataccattcaggagtgtaaggaatgtgatcaagtattccccgatctgcagagtctagagaagcatatgttgtctcacacggaagagcgtgagtacaaatgtgaccagtgcccaaaagcctttaactggaaatccaaccttattcggcatcagatgagccattag

SEQ ID NO: 12318 - DNA, 312 bp, Artificial Sequence
  Description of Artificial Sequence: Synthetic coding sequence
atgaaatcagaggattatccccacgaaacaatggcccctgatatccacgaggagcggcagtacagatgtgaggattgcgatcaattattcgagtccaaagccgagctcgccgatcaccagaagtttccttgctccacaccccatagcgccttttccatggtcgaagaagacttccaacagaagttggagagtgagaacgatctccaggaaatccacacaattcaggaatgcaaagagtgtgaccaggtctttcccgatctgcaatctctggagaagcacatgctgagtcatactgaagagagggaatattag

SEQ ID NO: 12319 - DNA, 3693 bp, Artificial Sequence
  Description of Artificial Sequence: Synthetic coding sequence
atgcgatcaaaggggcgcgctaggaagctggctacgaataacgagtgtgtgtatggaaactaccccgagatcccattggaggagatgcctgacgcagacggggtagcctcaaccccttctcttaatattcaagaaccttgctcgcccgcaaccagctctgaggccttcacaccaaaggaggggtcaccctacaaggcccctatatacattcctgacgacatcccaatccctgcagaatttgaactgcgagaaagcaatatgcccggcgcaggtctagggatctggactaagcggaagatagaggtaggagaaaagtttggaccgtacgttggcgaacaacgctccaacctcaaggaccccagctatgggtgggaaattcttgacgaattttataatgtgaagttttgcattgacgcctcccagcccgacgtgggatcttggcttaaatatatcagattcgctggttgctatgaccagcataacctcgtggcctgccaaatcaatgaccaaatcttctatcgagtcgtggcagatattgcccccggagaggagcttctgttgttcatgaaaagtgaagactacccgcatgaaaccatggccccagacatacatgaagaacgccagtaccggtgcgaagactgcgaccagctatttgaaagcaaagcagaactggcagatcatcaaaagttcccatgttcaacaccccacagtgcattctctatggtagaagaggactttcaacaaaaactggaatcagagaatgacctacaggagattcatacaatacaggaatgcaaggagtgcgatcaagttttcccagacctgcagtcccttgaaaaacatatgcttagtcatactgaggaaagggagtataagtgcgaccaatgccccaaagcttttaattggaaaagcaacctgattcgccaccaaatgagtcatgacagtggaaagcattacgagtgcgagaactgcgctaaagtcttcacagacccctcaaacctacagagacacattcgatctcagcatgttggcgccagagcgcatgcatgccctgagtgcggtaaaaccttcgctacttctagtggcctgaaacagcacaagcacatacatagtagcgttaaaccttttatttgcgaagtatgccataaatcttacacccagttttctaatctgtgccggcataagcgtatgcatgccgactgtcgaactcaaatcaaatgcaaagactgcgggcagatgttctccactacttcatctctgaacaagcaccggcgcttttgcgagggcaaaaaccatttcgctgctgggggcttttttggacagggaatctcccttcccggcacacccgccatggataaaacaagcatggtgaatatgagtcacgccaacccggggctagcggactactttggagctaacaggcacccagctggattgacctttccaaccgctcccgggttttccttttccttccctggactttttccatctggcctgtatcaccgccctccccttattccagccagctcaccagtcaaaggtctatcatcaacagaacagactaataaaagccagtcccccctgatgactcatccccagattctgcccgccacccaggacatcctcaaagctttatctaagcacccaagcgtgggagacaacaagcccgtcgagctccagccagagaggagctctgaagagcgaccatttgaaaagatctccgaccagtctgaatcttctgatctggatgatgtgagcaccccgagcggatctgatctcgaaactacgagtggctccgatttagaatctgatatagaatccgataaggagaagtttaaggagaacggtaaaatgtttaaagacaaggtcagcccactacagaacttagcgtcgatcaacaacaagaaagagtactccaatcactctattttctctcccagtctcgaggaacaaacggccgtgagtggcgccgtgaacgacagtataaaagcaattgccagtatcgccgaaaagtatttcggctccacaggtctggttggactgcaagacaagaaggtgggggccctcccttatccttccatgtttcctctccctttttttcctgcgttctcacagtctatgtacccctttccagatcgggacttaagatcattgcctctaaaaatggagccacaatcccccggcgaagtgaaaaaactgcagaaaggttcttcggagagcccctttgacctgaccaccaaaagaaaggacgaaaagccccttacacccgtgccttctaaacccccggtcactcctgccacgtcccaggatcaacctctcgacctcagtatggggagccggagtcgcgccagcggcaccaagctaaccgaaccacggaagaatcacgtttttggtggcaagaagggatcaaacgtggaatcaaggcctgctagcgatgggtctctgcagcatgcgagacctaccccattctttatggatcccatctaccgggtggagaaacgcaagctcacggatccgttggaagccttgaaggagaagtacttgcgccctagcccaggtttcctgtttcatccccagatgtccgcgatcgaaaacatggccgagaaacttgaaagtttttccgccttaaaaccagaggcctccgagctgctacagagcgtcccatcgatgttcaattttcgcgctcctcctaatgccctcccagagaacttgctcaggaagggtaaagagagatacacctgtcgatactgcggtaagatcttccccaggtctgcaaaccttactagacacttgcggacccacactggtgagcagccttaccgctgcaagtactgcgacagatcctttagcatatccagtaatctccagcggcacgtcaggaatatccacaataaggagaaaccatttaaatgtcatctgtgtgatcgctgctttggtcagcaaactaatcttgaccgacatttaaagaagcatgaaaacggcaatatgtctggcacagctacgtcctccccccatagcgaactggaatctactggcgcaatcctcgatgacaaggaagatgcctatttcacagagattcggaactttataggcaattcaaaccatgggagtcagtccccacgcaacgtggaggagcgtatgaatggctcacactttaaagatgaaaaagcccttgtgactagtcagaactcggacctgctggacgacgaggaggtagaggacgaggttctgctggacgaggaagatgaggacaatgacattaccggcaaaaccggcaaagagccggtgacaagtaacctgcatgaggggaaccccgaggatgactatgaggagacaagcgcgttggagatgagttgcaagacaagcccggtccgttataaggaagaagaatacaaaagcggtctctctgcactggaccatattaggcacttcactgactctctgaaaatgcgtaaaatggaggataaccagtactcagaagcagaactgagcagcttctctacaagtcatgtccccgaggagttaaagcagccgctccaccggaaatcaaagagccaggcttatgctatgatgctatccctgtcagacaaagagagcttgcattcaacaagccattcctctagcaacgtgtggcatagcatggcccgagccgcagctgagtcaagcgctatccagtcaattagccacgtgtag

SEQ ID NO: 12320 - DNA, 312 bp, Artificial Sequence
  Description of Artificial Sequence: Synthetic coding sequence
atgaagtccgaagattatccgcacgaaacaatggcccccgacattcacgaggagaggcaatatcggtgtgaggactgcgatcagcttttcgagtccaaggcagaacttgccgaccaccagaaattcccctgcagcaccccacattcagccttctcaatggtggaagaggactttcagcagaagctggagagcgagaacgatctccaggagatccatacaatccaagagtgtaaagaatgtgatcaagtcttccccgacctacaaagtctcgagaaacatatgctttcacatacagaggagcgcgagtattag

SEQ ID NO: 12321 - DNA, 2256 bp, Artificial Sequence
  Description of Artificial Sequence: Synthetic coding sequence
atgtgcgacctgagaaggcccgccgcaggcggaatgatggacctggcctacgtttgcgaatgggaaaaatggagcaagtcaacccactgcccaagtgttcccctggcttgtgcttggtcttgccgtaacctcatcgccttcactatggacctgagatcagacgatcaagacctcacccgtatgattcacatcttggacactgaacacccatgggatttacactctattccctcagagcatcatgaggccattacatgtctggaatgggaccagtcggggtcacgtttgctatccgccgatgcagacggccagatcaaatgttggagtatggctgatcaccttgcgaattcttgggagtcctctgtaggttctcttgtagaaggggacccaatcgtggccttgtcctggctccacaacggggttaagctggccctgcatgtggaaaagtcaggggctagctcctttggagagaaattctcccgtgtgaagttctcaccctcacttaccctattcgggggtaaacccatggagggttggattgcagtgaccgtctctggcttggtgaccgtctctcttctgaagccctccggccaggtactaactagtactgagtccctgtgtcgactgagaggccgagtggctcttgccgacattgcttttacaggaggcgggaatattgtggtcgcaaccgcagatggaagctctgcctcaccagtacaattctacaaggtgtgcgtgagtgtggtgtcggaaaagtgcagaatcgatacagagatcttaccgtctctttttatgagatgtactacagacctgaataggaaagataaattccctgcaattacccacctgaagtttctggctcgagatatgtccgagcaagtgctcttgtgtgctagctcacaaacctcatcgattgttgaatgctggtcgttgcgcaaagagggcttacccgtcaataacatctttcagcaaatttcacctgtggtcggcgacaagcagcctactatcttgaaatggaggatcctctccgccacaaacgatctggaccgcgtctcagccgtcgctctgcccaaactgcccatctctctgacaaatacagatctgaaagtagcatccgacacacagttctaccccggactcggcctcgccctggcgtttcacgatggttctgttcacatcgtgcacaggttgagccttcagactatggctgtgttttattccagtgccgctcctagacccgtggatgagcctgcaatgaaaagaccccggactgcaggcccggccgtgcatctgaaagccatgcaattatcctggacaagtctcgccctggtggggatagacagccacggaaagttgagcgtgttgcgactgagccctagtatgggccaccctctggaagtcgggttggccctgcgccacctcttgtttctgttggaatactgcatggtgaccggctacgactggtgggacattctgttgcatgttcaaccgagtatggtccagagcctggtagaaaagctccacgaagagtacactaggcagacagccgctttgcagcaagtgctgtctaccagaattctagcaatgaaggcgagcctgtgtaagttgagcccctgcacagtaactcgcgtctgtgactaccatacaaagctctttctgattgccatatcctcaactcttaagtcattgcttcggccacactttctcaatactcctgacaaaagtcctggggaccggctgaccgagatatgcactaaaatcaccgatgtggatattgataaagttatgatcaacctcaagactgaagagtttgtcctcgacatgaacacactgcaggctttgcagcaattgctgcagtgggttggcgacttcgttctgtacctccttgcgtctttaccgaaccaggtcgctatgcgagcccagcgagcaagtagaacccgacgctggtggatgaacgctgcttgctgccctgcttcctgtctgagtccagcctggaccgggtgtcagcctgccacggcctggttggccgcttgttctcccagtagccctttcgtctgttcacttgctggtcgccctagatgcctggccgttttgccgccgtgcagttctacagcgtctcccgggcctcaggcctctcccagatctacaacctgcggaggatgcacgctggctctcgccccaagaagaaacgctaggccagctcccggcgccgccgtcagcccttgcagctcccgccctaccgagcctagacgttag

SEQ ID NO: 12322 - DNA, 2583 bp, Artificial Sequence
  Description of Artificial Sequence: Synthetic coding sequence
atgtgtgacctgcgccggccggctgcaggaggtatgatggacttggcctacgtgtgcgagtgggagaaatggtccaagagcacccactgcccttctgtcccactggcctgcgcctggagttgtcgaaacctgatagcattcactatggaccttcgatctgacgaccaagatctgacaagaatgatccacattctggacacagaacacccctgggatctccacagtatcccctcagaacaccacgaggctatcacttgtctcgaatgggatcagtccggatctcgcctgctctcagccgatgctgatggacaaataaaatgctggagcatggccgatcacctggcaaactcatgggaaagtagcgtgggatcattagtagaaggcgaccccatcgtcgctctgtcttggctccacaatggagtgaaactggcactccatgtcgagaaatcaggtgcttcatccttcggagaaaagttctcccgcgttaagttctcgccatcccttacactgtttgggggtaagcctatggaaggatggatagctgtcacagtttctgggctggtgacggtgtccctccttaagcccagcgggcaagtgctgacgagcacagagagtctgtgcagactgcggggtcgcgtggccctcgcggatatcgcatttacgggaggcgggaatatagtcgtcgctaccgccgatggaagctctgcctctcccgtgcaattctacaaggtgtgtgtgagcgtagtgtctgaaaaatgccggatcgacactgagatcttacccagtttgttcatgcggtgcaccactgacctcaatagaaaagataaatttcctgctataacgcacctgaaattcctggcaagagacatgtccgagcaagtccttctctgtgctagctcccagacatcctcaatcgtggaatgctggagtttacggaaagagggcctccccgtgaataatatctttcagcagatcagcccggtcgtcggagataagcaacctaccatacttaaatggcgaatcctgtccgcgacgaacgatctggacagggtaagtgcggtggccctacctaagctaccaatctctctgacaaacacagatctgaaggtggcatctgatactcagttttatccgggcctgggccttgccctggcatttcacgacgggtcagtgcacatcgttcaccgcctgagtctccaaactatggccgtattttactcctctgccgcgccccgtccagtggatgagccagccatgaaacgtcctcggactgcaggcccggctgtgcatttgaaggcaatgcagctgtcatggacaagcctggccctggttggaattgattctcatggcaaattgagtgttttgcggctgtccccgagcatgggccatccattggaggtgggactggcgcttcgccacctgctttttctactggagtactgcatggtaaccggctacgattggtgggatattctgctccatgtccagcctagtatggttcagtcactggtggaaaagttgcacgaagaatacacaaggcaaacggctgctctgcagcaggttttaagtacacggatcctcgcaatgaaagctagtttgtgtaagctctcaccctgcacggtgactagggtgtgcgattatcacaccaagctctttcttattgccatctccagcacactgaagagtctgcttcgcccacactttcttaatacacctgataagagccctggcgacaggctgactgagatctgcaccaaaattactgacgttgatatcgataaagtaatgattaacctcaagacggaggagtttgtgttggatatgaacactctacaggccttgcagcagttgctgcagtgggtgggggattttgtgctgtacctgttggcttcactccctaatcagggttctctgctccgacccggacatagttttctgcgggatggcacgtctctgggaatgctgagagaactgatggtggtgataagaatttggggcctccttaagccaagttgtttacccgtgtataccgctacctccgacacacaggatagtatgtctctcctgtttagactgctgacgaaactgtggatctgtttcccctccaccggcccttgttccgtgtgggtcctcctgggttggcagccattgccagggagggacgaggggccggctagcgagccggatgaggcactggttgatgaatgctgcctcctgcctagccagctccttattccctcattagattggcttcctgcctccgatgggctggtctctagactccagcctaaacagcctctgagattgcagttcgggcgagccccaacactgcccggcagcgcagctaccctgcagttggatgggctggcgcgcgctccagggcagcccaagatcgaccacctgaggcgtctgcacctgggggcctgtcccacggaagaatgcaaagcctgtacacgttgtgggtgtgtgacgatgcttaaaagtcctaatcgcacaaccgccgtgaagcaatgggagcagagatggattaagaactgtctctgcggaggactctggtggcgggtgccattgtcgtatccgtag

SEQ ID NO: 12323 - DNA, 2634 bp, Artificial Sequence
  Description of Artificial Sequence: Synthetic coding sequence
atgtgcgaccttcgccgtcccgctgctggtggcatgatggatctggcatacgtgtgtgagtgggagaaatggagtaaaagcactcattgcccatcagtgccgttagcttgcgcctggtcctgcaggaacctcatcgcctttacgatggatctgagaagtgatgatcaggatctcacacgaatgatccacatcttagacaccgaacacccatgggacctgcactcaattccaagcgagcaccatgaagctattacctgcctggagtgggaccagtcgggcagtcggctactgtccgccgatgctgacgggcagataaagtgttggtccatggcagaccacctggctaactcctgggaatccagcgtgggatcactggtcgaaggagatcctatcgtcgccctttcgtggctgcacaatggcgtgaagttggccctgcatgtggaaaagtccggcgcatccagcttcggagagaagttctcccgagtgaaattctctccatccctgaccttgtttgggggcaaacctatggagggctggatcgcagtgacagtgtcagggctggtgactgtttccctcttgaaaccatccggacaggtgcttacaagtaccgagtcgctctgcagactgcgcggcagagtggccttagccgacatagcattcaccggaggaggtaacatcgtggtcgctaccgcagacggcagctcggcgagccccgtacaattttacaaggtatgtgtgtctgtcgtgagtgagaaatgccggattgatacagaaatcttgccctccctctttatgcgatgcactacagatttgaaccgcaaagacaagttccccgctattacccatttgaagtttctcgctagagacatgtctgagcaagtgctgttatgcgcgtcttctcagacaagctccatcgtcgagtgctggtcacttaggaaggaggggttgccagtgaacaacatcttccagcagatctcaccggttgtcggtgataaacagcccactatcctgaagtggaggatcctgtctgcaacaaatgacctggatagagtgagtgccgttgcccttcccaaactgccgatctctctcactaatacggacctcaaggtcgcgtcagacacacaattctaccccgggctgggcctcgcactcgctttccacgacggctcagtgcatattgttcatcggttatctctacagactatggctgtgttttactctagtgccgccccccgtccagtcgatgagcctgccatgaaacgcccgcggacggcagggccagccgtgcatctgaaagctatgcaactgtcctggaccagcctggccctcgtagggatcgacagtcatgggaaactgtcggtgctgcggttgtcgccaagcatgggccacccacttgaagtcggactggccctgaggcatctactctttctgcttgagtattgtatggtgaccggctatgactggtgggacatcttgctccatgttcaaccctcaatggtccagtctttggtggagaaactgcacgaggaatatacccggcaaaccgccgctttacagcaggtgctttctacccggattctcgccatgaaggcaagcctgtgcaagcttagcccatgtactgtgacccgagtttgcgattatcacaccaaactgttcctgatagccatttcaagtaccctgaagtcactactcagaccacactttcttaacactcccgataaaagtccgggcgaccgcttgactgagatctgcacaaaaattacggacgtagatattgataaggtcatgatcaacctgaaaacagaagaattcgtcttggacatgaacacgttgcaggcattgcaacaactcctccaatgggtaggtgacttcgtgctttatcttctggcgagtctgcccaatcaaggctcgctcctgaggcctggtcactcattcctgcgtgacgggacaagcctgggcatgctgagggaactgatggttgtcattagaatctggggtctcctcaagccctcctgtttgcccgtatacactgctaccagtgacacacaggattccatgagccttctgtttcggctgctaaccaaactctggatctgttgtcgagatgaaggtcctgccagcgagcccgacgaagcactggtggacgagtgctgtctgctccctagccagctcctgatacctagcctggactggctgccggcctccgacggtctggtctcgagacttcagcctaagcagcctttgcgcctgcaatttggacgtgcaccgactctgcccgggtctgctgcgacgctccagttggatgggctggcaagggcccctggccagcctaaaatcgatcaccttaggagactgcatctgggggcttgcccgactgaggaatgtaaggcatgcacccggtgtgggtgcgtcacaatgctaaaatctccaaatcggaccaccgccgtgaagcagtgggagcagcggtggattaaaaattgtttggctgtggaaggcaggggacccgatgcctgcgtaacatcacgagcttctgaggaagcaccggcattcgttcagctcggccctcagtctacacaccatagccccaggaccccccgctccctggaccacctacatccagaggacaggccctag

SEQ ID NO: 12324 - DNA, 2526 bp, Artificial Sequence
  Description of Artificial Sequence: Synthetic coding sequence
atgtgcgacttaaggcgacccgctgccggcggcatgatggacctggcctatgtgtgcgaatgggaaaagtggagtaaaagtacgcattgtccctctgttccacttgcatgcgcgtggtcctgcaggaatctgatagccttcaccatggatctgcgcagcgacgatcaagacctaacgcggatgatccatattcttgacacggagcacccctgggatcttcatagtatcccatcggagcaccacgaggccattacgtgtcttgaatgggatcagagtgggtcccgattgcttagcgcggatgcggatggccagattaaatgttggtctatggccgaccacctcgccaattcctgggagagctccgtggggagcctggtggagggcgaccctattgtcgcattgagctggctgcataacggagttaagctggccttgcacgtggagaagtctggggcttctagcttcggggaaaagtttagccgggtgaagttttcaccatccttgacgctgttcggggggaaacccatggaggggtggattgccgtcacagtgagcgggctcgtaactgtgtctctcttaaagcctagcgggcaggtgctgacgagcaccgagtctctgtgcaggctccgcggtcgggtggctctggccgacattgcatttactggaggaggcaatatcgtcgtggcaacagccgatggctctagtgcttcccctgttcagttttacaaggtgtgtgtcagtgtggtcagcgaaaagtgtcgaattgacacagagatacttcctagtctcttcatgagatgcacaactgatctgaacagaaaggacaagttcccagctatcactcatctcaaatttctggctcgggatatgtcagagcaggttttgctatgcgccagcagccaaacttctagtattgttgagtgttggtccctccgcaaagagggcttacccgtcaacaacatttttcagcaaatctcccccgtcgtgggggacaagcaacctaccatccttaaatggcgaatactgtctgccaccaacgacctggatagggtgagtgcagtagctttgccaaagttaccaatatctctgaccaatactgaccttaaggttgccagtgacactcagttctaccccgggttgggtctcgccctcgccttccacgatggctccgtgcatatcgtgcatagactgtctctgcagacaatggccgtattctacagcagcgcggcccctagacctgtcgatgaacctgcaatgaagcggcctagaaccgccgggccagctgtgcacttaaaggccatgcagttgtcctggacttcactcgccctggttgggattgattcgcacggaaaactttccgttctgcgactttctccctctatgggtcaccccttggaggttggcctagccttgcgacatctcctctttttattagaatactgtatggtgacaggctatgactggtgggacatcttattgcatgttcagcctagcatggtacaatcactagtggagaagttgcacgaggaatatacccgacagaccgccgctctccagcaagtgctgtctacaaggattctcgcaatgaaagccagcctatgtaaattgtctccctgtaccgtcactcgagtttgtgactaccacactaagttatttcttatagcgatatcatccaccctcaagtccctcttgcggccacacttcttgaacacccccgataaatcacctggggatcgtttgactgaaatatgtacaaaaataactgatgtcgacattgacaaagtgatgatcaacctaaaaaccgaagagtttgttttagacatgaacaccctgcaagctttgcaacaactactgcagtgggttggggatttcgttctctatctcctcgcgtccctgccaaatcagggcagtctgctcagaccaggtcactccttcctcagggatggcactagtcttggcatgctgcgggagttgatggtggtcatacgaatctggggccttttaaaaccatcctgcctgcctgtgtatactgcaaccagtgacacgcaggatagcatgagtctgctgtttaggctgctcacaaaactgtggatatgttgtcgtgatgaaggccccgcttccgagccggatgaagcactggtggatgagtgctgcctgctcccttctcaactccttataccttctctggactggttacctgcaagtgacgggctggtgtcaagactgcaacctaaacagccgcttcggcttcaatttgggagggcccccacactgcctggatccgcagctaccctccagttagatggacttgcaagggcccctggccagccaaagattgatcatttacggcgcctccacctgggcgcatgtcctactgaagagtgcaaagcctgcactaggtgcggatgcgtgacgatgctgaaaagtcctaacagaacaactgctgtgaagcagtgggaacaacggtggattaagaattgtttgtgtggaggcctgtggtggcgcgtaccccttagttacccgtag

SEQ ID NO: 12325 - DNA, 1992 bp, Artificial Sequence
  Description of Artificial Sequence: Synthetic coding sequence
atgtgtgatctacggcgtcccgccgcaggtggaatgatggacctggcatatgtttgtgaatgggagaagtggtctaagtccacacactgtccctccgtgcccctcgcatgcgcctggtcctgcaggaatctgattgcctttaccatggatctgaggagtgacgaccaggacctgacaaggatgatacatatcctcgacacagaacatccttgggatctgcactctatccctagtgaacaccatgaagccattacatgccttgaatgggaccagtccggatctcgtcttctgagcgccgacgctgacggccagattaagtgttggagcatggctgaccacttggctaacagctgggagtcatcagttggatctcttgtcgaaggcgaccctattgtggctctgtcatggctccacaacggagtgaagctggcattgcacgtcgagaaatcgggcgctagtagcttcggtgagaaattcagcagagttaaattctccccctccctcacattgtttgggggaaaaccaatggaggggtggattgccgtcactgtttcaggattagtgaccgtgtcactcctcaagccaagtggacaggttcttacttcaaccgaatcattgtgcagactccggggccgggttgccttggctgatatcgccttcaccggcgggggcaacatagtcgtcgctacagcagatggatcttccgcctctccagtgcagttttataaagtgtgtgtgtccgtagtcagtgagaaatgcaggattgataccgagatccttccttcattatttatgaggtgcacgacagatcttaataggaaagataagttcccagcgattacacacctcaagtttctcgctcgggatatgagcgaacaggtcctcctgtgtgcatcctcgcagactagcagtatagtggaatgttggtccctgcggaaggagggactccccgtgaacaacatattccagcaaatatctccagtagtgggcgataaacaacccacaatcttgaagtggaggatcctctcagctaccaacgatctggatcgagtgagcgctgtggccctccctaagctcccaatttccctaactaacactgatctgaaagttgcgtctgatactcaattctaccctggccttggtctggctctcgcatttcatgacggatcggttcacatcgtgcaccgcctctctctacagacaatggcggtgttctacagtagcgcagcccctaggcccgtggatgaacctgctatgaagcgccccaggacagctggacccgccgtgcacctgaaagccatgcaactctcatggacatcgctcgctctcgtgggcatcgattcacacggcaaattgtccgtcttgaggctgtccccaagcatggggcacccgctggaggtaggactggctttacggcacttgttgttcctcctggagtactgtatggtgacaggctatgactggtgggacatcctcctgcatgtgcaaccatcaatggtgcagagtctggtggaaaaactacatgaggagtataccaggcaaaccgccgcactccagcaggtgctatccacgcggatccttgccatgaaagcgtccctctgcaagctctctccgtgtaccgttactagagtctgtgattaccacacaaaactgttcctgattgcaatttcgtcaacactcaaaagcctgctccggccacattttctgaacactcctgataagtccccaggggaccgcctgactgaaatttgtactaaaataactgatgtcgacattgataaagttatgattaacctgaaaaccgaagaatttgtgctcgatatgaacaccctgcaggccctgcaacagcttttgcagtgggttggcgacttcgtgctgtatctgctagctagtttaccaaaccaaccatgtcccacctcagaaccctgcccaacaagtgaaccctgccctacttcggaaccttcgcctacttccgaacccagccccacctag

SEQ ID NO: 12326 - DNA, 1614 bp, Artificial Sequence
  Description of Artificial Sequence: Synthetic coding sequence
atgtgcgacctgagacgacctgcagccggaggcatgatggatttagcctacgtgtgtgagtgggagaagtggtcaaaatccacccattgtccttcagttcccctcgcctgcgcgtggtcctgtagaaacttgatcgctttcaccatggacctgcgaagcgacgatcaagacctcacccggatgatccatattcttgatactgagcacccttgggacctgcactcgatcccttcagaacatcacgaagcaataacctgtttagaatgggaccagtctggttcgcgcctcctttctgcagatgccgatgggcagataaaatgttggtccatggctgaccaccttgcaaactcttgggaaagctcagtcggaagcctcgtggagggcgatcctatagtagccttaagttggttacacaacggggttaagcttgctctccatgtcgagaagtctggcgcatcctcctttggggaaaaattctccagagtaaaattctcccccagtttgaccctcttcggagggaagcctatggaaggctggatagcagtgactgtgtcaggcctggtgaccgtttcgctgctgaagcctagcgggcaggtgctcacaagtacagagtccctgtgcagactccgaggcagagtggcactcgccgacattgcgttcactggcggagggaatattgtcgtcgccacagccgacggaagctccgcctctccggtacagttctataaggtgtgtgtatcagtagtatcagagaagtgcaggatcgacacagaaattctccccagcttgttcatgaggtgcacaactgacctgaacagaaaagacaagtttccagctatcactcacctgaagtttttggcacgcgatatgtctgagcaggtgcttctgtgtgctagctctcagacatcatcaatcgtcgagtgttggagcctgcgaaaagaaggtctacccgtgaacaacatttttcagcagatttcacccgtcgtgggggacaagcagcccacaatcctcaagtggagaatcctgtctgcgaccaacgacctggacagagtatcagccgtcgctcttccaaagctgccgattagtttaacaaatacagatttaaaagtggcgtctgacacacagttctatccggggcttggactggcattggcatttcatgatgggtctgtccacattgtccatagactgagcttgcagactatggccgtgttctacagctccgctgctccccgacctgtcgatgaacctgccatgaagcggccacggacagcgggccctgctgtccacctgaaggctatgcagctgtcttggacaagccttgccctcgttggaatcgattctcacggtaaggtcttgagcacacggatccttgccatgaaagcatcactgtgtaagctctccccatgtactgtgacccgggtgtgcgactaccatacaaagctgttcttgatagccattagttcaactctcaaatctctactgcgccctcacttcctgaacacgcctgacaaaagcccaggtgaccgtctcacggagatttgcaccaagatcaccgacgtggatatagataaagtgatgatcaacctgaaaacagaagagttcgtactgtag

SEQ ID NO: 12327 - DNA, 1389 bp, Artificial Sequence
  Description of Artificial Sequence: Synthetic coding sequence
atgtgtgatctacgtcgacctgctgcgggcggcatgatggatcttgcctacgtctgtgagtgggagaaatggtcgaagtccacacactgtcctagtgtacctctggcttgtgcctggtcttgtaggaatctgatcgccttcaccatggatctgcgatcggacgaccaagacctgacccggatgatccatattttggacaccgagcacccctgggacctgcactctatcccttctgaacatcacgaggcaattacctgccttgagtgggaccaaagcggatcccgcctcctgagcgctgacgccgatggccagattaaatgttggtctatggccgaccatctcgcaaacagctgggaatcctctgtgggctccctcgtggagggtgatcctatagtcgctctctcttggctccataatggtgtcaagctggccctgcacgtggaaaaagtgttgctgtgtgctagcagtcagaccagctcaatcgttgagtgttggtcccttcgcaaagagggcctgccggtaaacaacattttccagcaaatctcgccggtcgtgggcgacaaacagcctactattctgaaatggagaatcttgtcggccactaatgatctagaccgtgtctctgctgtagcgttacccaagctccctattagtttaactaatacggacctaaaagtggcatctgatacccagttctacccaggcctcggcctcgccctggccttccatgatggcagcgtccatattgtgcatcgtctcagcctgcaaactatggcggtgttctactcttctgcggctccacgacctgtagacgagcccgccatgaagcgcccccgcaccgcgggacctgctgtgcatctgaaggccatgcagttaagctggacttccctcgccctggtggggatcgactcccacggcaagctgagtgtcctgaggctgtcaccatctatgggccacccccttgaggttggcttggcactcaggcacctgctgttcctcctggagtactgcatggtcacagggtacgactggtgggatattttgcttcacgtgcagccctctatggttcagtcactcgtggaaaaactccatgaggagtacactcgtcagacagccgccctccagcaggtactctctacgcgcatcctggccatgaaagcttccctgtgcaagctttcgccgtgcacagtgactcgggtgtgcgactaccacacaaagctgtttctgatcgcaatctcctccaccctcaagtccctgcttagacctcattttctgaacacacccgacaagagcccgggtgacagacttaccgagatttgtaccaaaatcacggacgtggacattgacaaggtgatgatcaacctaaaaactgaagaatttgtactctag

SEQ ID NO: 12328 - DNA, 1098 bp, Artificial Sequence
  Description of Artificial Sequence: Synthetic coding sequence
atgtgcgaccttcgtcgtcctgccgcagggggcatgatggatctggcatatgtttgcgaatgggaaaaatggtcaaagtcaactcactgtccgagtgtccccctcgcatgcgcatggtcctgcagaaatttaatagcctttacgatggatctgagatccgatgaccaggacctgacccgcatgatccacattctggatacagagcatccatgggatctccatagtatccctagcgagcaccatgaggcgattacgtgcctggagtgggatcagagcggaagtaggttgttatccgctgacgctgacggccaaattaagtgttggtcaatggctgatcacctggcaaacagctgggagagctctgtgggctccttggtggagggggatcctatcgtggcactgagctggctgcataacgggctcgccctggcatttcatgatggatccgtccatatagttcaccgcttaagcctgcaaactatggccgtattctacagctccgcagccccaagaccagtggatgagcctgccatgaaaaggccccgcacagccggaccagcagtgcacctcaaggccatgcagctgtcatggacatccttggctctggttgggattgactcccacggaaaactgagcgtcctccgtttaagcccatctatgggacacccactggaagtcggactcgccctgcgacatcttctgttcttacttgagtattgcatggtgactggctacgactggtgggacatccttctgcatgtacagccaagcatggtccagagcctcgttgaaaagctgcacgaggagtacacccggcagactgcggcccttcagcaggtgttatctactaggatcttggccatgaaggccagtttgtgtaagttgtcaccttgcaccgtgaccagggtctgtgattaccacactaagttgtttctcatcgcaatctcgtcaactctgaaaagcttgctgcgaccacacttcttgaacacgcctgataaatcacctggggaccggctaactgagatctgtacaaaaataaccgacgtggacattgataaagtgatgatcaatctcaaaacagaagagtttgtgttatag

SEQ ID NO: 12329 - DNA, 1104 bp, Artificial Sequence
  Description of Artificial Sequence: Synthetic coding sequence
atgtgtgacttgagacgtcccgccgccggaggtatgatggacctggcctacgtatgtgagtgggaaaaatggagtaaatcgacccactgtccatccgttcccttggcgtgtgcttggagctgccgcaacctgatcgcctttaccatggacctgcgaagtgacgatcaggatttgacgcgaatgatacatattttggacacagagcatccctgggacctgcacagtatcccttccgaacaccacgaagctattacatgcctggagtgggaccaaagcggaagcaggctgctgagcgccgacgcggacggacagataaagtgttggtcgatggctgatcacctggccaactcatgggagagctcagtcggatctctagtagagggagatcccatcgtggctctttcctggctgcacaatggcgttcggctggccctggctttccacgacggatccgtccacatagtacatcgcctaagcttgcagacaatggccgtcttctactccagtgcggcaccccgacctgtagatgagccggctatgaagcggccacgtaccgccggtcctgccgtgcaccttaaagcgatgcagctcagctggacctcactcgctctcgttggcattgattctcatgggaaactctctgtgctgcggctttctcccagcatgggccatcctctcgaggtaggcctggctctgaggcacctgttgttcctactcgaatattgcatggtgactggctacgattggtgggatatccttttgcacgtgcagccatctatggtacaatcacttgtcgaaaaactacacgaagagtacacccgacagactgctgctctgcagcaggtgctttctacaagaattcttgctatgaaagccagtctgtgtaagctatccccctgtaccgtgacacgagtttgcgattatcatacaaaactcttcctcattgcaataagcagcacgctgaagtcccttctgcgcccacacttcctcaataccccagataagagtccaggcgacaggctcacagaaatctgcacaaaaatcactgatgttgatattgataaggtgatgattaacttaaaaacagaagagtttgttctgtag

SEQ ID NO: 12330 - DNA, 975 bp, Artificial Sequence
  Description of Artificial Sequence: Synthetic coding sequence
atgtgtgacctgcgccgtcctgctgcaggagggatgatggatctcgcctacgtgtgcgaatgggaaaagtggtcaaaatcaactcactgccctagtgtgcctctggcctgcgcttggtcatgcagaaacctgattgcttttacaatggatctgcggtcagatgaccaggaccttaccagaatgatccatattctggacacagaacacccctgggacctccattctattccttccgaacatcacgaagcaataacatgtctcgagtgggaccagagcgggtcacgcttactcagcgctgatgccgacggccagattaaatgctggtcaatggccgatcatctggctaactcttgggagtcttctgtgggatccctggtggagggggatcctatcgtagccctgagctggctgcataacggggtgaagctggccctgcacgtcgaaaagagtggagcctcaagctttggagaaaagttttcaagggtcaagtttagcccatctctgacgttgttcggaggaaagcccatggagggttggatcgcagttacagtgagcgggttggtgactgtgtctctgttatttctcctggagtactgtatggtgaccggctatgactggtgggatatacttttgcatgtgcagcctagcatggtccaaagcttggtagagaagctgcacgaggagtataccagacagacagcagccttacagcaggtgctatccacgcggatactggcgatgaaggcctccttgtgtaaattgtctccctgcacggtcactcgcgtctgcgactaccataccaagctctttttgattgccatttcctctactctaaaatcactgctgcggccccattttctgaatacccccgacaaatcaccaggcgacagactcactgagatctgcaccaagatcacggacgtcgacatagataaagtgatgattaatctgaaaacagaggagtttgtgttgtag

SEQ ID NO: 12331 - DNA, 603 bp, Artificial Sequence
  Description of Artificial Sequence: Synthetic coding sequence
atggcgcagcaacgggcattgcctcaaagcaaagaaactttgctccagtcctataataaaagattaaaggatgacatcaaatccatcatggataactttaccgagatcattaagacagcgaaaatcgaggacgagacacaggtgagccgggccacacagggggaacaggacaattacgagatgcatgtaagggctgccaatatcgtccgggctggagaatccctcatgaaattggttagtgacttaaaacaattcttaatccttaacgacttcccttccgtaaacgaggcgattgaccagaggaaccagcagctacgaaccctgcaagaggaatgcgatcgcaaacttataaccctgagggatgagatttcgattgatctgtacgagcttgaggaggagtattactcatcgagttcatccttgtgtgaggcaaacgatttgccactgtgcgaggcctatggaagattagacctggacacagactccgccgatggtctgagcgccccacttctcgctagtcctgaaccatcagctgggcctctgcaggtggccgcccccgcacatagccacgccggaggacctggtcccaccgaacatgcgtag

SEQ ID NO: 12332 - DNA, 423 bp, Artificial Sequence
  Description of Artificial Sequence: Synthetic coding sequence
atggcccagcagcgggccctgccccagtcaaaagagacattgttgcagtcttacaataagcggctgaaagatgatattaagtccataatggataacttcacggaaataatcaaaactgctaagatagaagacgagacgcaggtgagtcgtgccacccagggtgaacaggacaactacgaaatgcacgttagggctgcaaacatcgtccgcgcaggcgaaagcctgatgaagctcgtgtctgatcttaagcagttcctgatcctcaatgatttcccctcggtgaacgaggccattgatcaaaggaaccagcagcttcggacattgcaggaagaatgcgacagaaagctaatcacactacgtgacgagatcagcatcgacctgtatgagttagaggaagagtactattcgtctcggtacaagtag

SEQ ID NO: 12333 - DNA, 405 bp, Artificial Sequence
  Description of Artificial Sequence: Synthetic coding sequence
atggcgcagcagagagctctgcctcagtcaaaagaaactctgcttcagagttacaacaagcgcttaaaggacgacattaaatctattatggataacttcaccgagataattaagacagctaagattgaggatgaaacacaagtgtcccgggccacgcagggcgaacaggacaactacgagatgcatgtgcgagccggcgagtcactgatgaagctcgtgtctgacctcaagcagttcctgattttgaatgattttccaagtgttaatgaggcgattgatcagagaaaccagcaactgcgaaccctgcaggaggagtgcgaccgtaagttgattaccctgcgtgacgagataagcatcgacctgtacgaactcgaggaggagtactatagttcacgttacaagtag

SEQ ID NO: 12334 - DNA, 414 bp, Artificial Sequence
  Description of Artificial Sequence: Synthetic coding sequence
atggcccagcaacgagccctgccacaatcaaaagagacacttctgcagagctacaacaagagacttaaggacgacattaaaagtattatggataacttcaccgagattatcaaaacagccaaaatcgaggatgagacccaggtgtctcgggctactcagggggaacaggacaactacgagatgcacgtgcgagcagcaaatattgtccgagcaggcgagagtctgatgaaactggtgagtgacttgaaacagtttctgatcctcaacgacttcccttctgtgaatgaggcaattgaccaacgtaatcagcaactccgtacccttcaggaggaatgtgatagaaaacttatcacactgagagatgagatctctatcgacctttatgagcttgaagaggaatattacagcagctag

SEQ ID NO: 12335 - DNA, 336 bp, Artificial Sequence
  Description of Artificial Sequence: Synthetic coding sequence
atggctcagcagagggctcttccccaaagcaaggagaccctgctgcaaagttataataaacgcctcaaggatgacataaagagcattatggataacttcacagaaatcattaaaaccgcgaaaatcgaggatgaaacccaagtgtccagagccactcaaggggagcaggataattatgagatgcacgtgagagctgcaaatatagtcagagccggcgagtccttgatgaagttggtctctgatctaaagcagtttctaatcttgaacgacttcccatcagtaaacgaggccatcgatcagcgcaatcaacagttgcggactctgcaagaggagtag

SEQ ID NO: 12336 - DNA, 423 bp, Artificial Sequence
  Description of Artificial Sequence: Synthetic coding sequence
atggcccaacagagggccctgccacagagcaaggaaaccctcctccagtcttacaacaaacgcctgaaggacgacattaaatccatcatggataactttaccgagatcatcaagaccgccaaaatcgaggatgagacccaggtctcacgagcaacccaaggcgaacaagacaattacgagatgcatgtgcgtgctgccaatatagtaagagcaggggaaagtctgatgaaactggttagcgatctcaagcagtttttaatcttaaacgactttccatctgtcaacgaggccatagatcagaggaaccagcagctgagaaccttgcaggaagaatgtgatcgaaagttaatcaccctgagagacgaaatctccatagacctatacgagttggaagaggaatattacagcagcagatacaagtag

SEQ ID NO: 12337 - DNA, 423 bp, Artificial Sequence
  Description of Artificial Sequence: Synthetic coding sequence
atggcacagcagagggccctcccccaatctaaggagacgcttctccaaagctataacaagcgtctaaaggacgatatcaagtctatcatggacaactttacagaaattataaagacagctaaaatcgaagacgagacgcaggtaagccgagccacccaaggggagcaggacaactatgagatgcacgtccgggccgctaatatagttagggcgggcgagtctctcatgaagctcgtgtccgacctcaagcaatttctgatcttgaacgacttcccctctgttaatgaagccattgaccagcgcaaccaacaactacgcacgctccaagaggagtgcgatcggaaacttattactttaagagacgaaatatctatagacctatacgagctggaagaggaatattattcatcccgatacaagtag

SEQ ID NO: 12338 - DNA, 603 bp, Artificial Sequence
  Description of Artificial Sequence: Synthetic coding sequence
atggctcagcaacgcgcgctccctcagagcaaagagacgctgctgcagagttataacaaaagactcaaggacgacatcaagtctattatggataacttcactgagatcatcaaaaccgctaagatcgaggacgaaactcaagtgagtcgcgctacccaaggtgaacaggacaactatgagatgcatgtgcgggccgccaacattgtccgggccggagagtctctgatgaaactggtgtccgacctgaagcaattcctcatcctaaacgactttcctagcgtgaacgaagccatcgatcagaggaaccagcaactccgcacactgcaggaagaatgcgacagaaagttgatcacgctgcgcgatgagataagcatcgacctgtacgaactagaggaggagtattactcctcgtcgagttctctttgtgaggccaatgacctacccttgtgtgaggcttatggaaggttggacttagatactgacagcgcagacggcctcagtgcccccctcctggctagccccgagccaagcgcaggcccgttgcaggtcgcagccccagcgcactcacatgctggtggccctggaccaaccgagcatgcgtag

SEQ ID NO: 12339 - DNA, 408 bp, Artificial Sequence
  Description of Artificial Sequence: Synthetic coding sequence
atggcacagcaacgcgctttaccacagtctaaggaaactttactgcagtcttacaacaaacgactcaaagacgatatcaaatccattatggataactttactgagatcattaaaacagccaagatcgaggatgaaacacaagtctcaagggccacccaaggtgaacaggataactacgaaatgcacgtgcgggccgccaacatcgtaagagcgggggaaagcctgatgaagttagttagcgatctcaaacagttcctgatattaaacgatttcccgtctgtgaatgaggctatcgaccagagaaaccaacagctcaggacccttcaagaagagtgtgatcggaagctgatcaccctgcgcgacgagatttctatcgatttgtatgagcttgaggaggaatactattag

SEQ ID NO: 12340 - DNA, 1452 bp, Artificial Sequence
  Description of Artificial Sequence: Synthetic coding sequence
atgaaagccttccacactttttgtgtggtgctgctggtgtttggttcagttagcgaggccaagttcgacgacttcgaggatgaggaggatatcgtagagtatgacgacaacgactttgccgaatttgaggatgtcatggaggactccgtgacggagagcccccagcgggttatcattacagaggatgacgaagacgagaccaccgttgagttggaaggacaggatgaaaaccaggaaggggatttcgaagacgcagacacccaggagggggacactgaatcagaaccctacgatgatgaggaatttgaggggtacgaagacaaaccggacactagttccagtaaaaataaagatcctataacgatcgtggatgttccggcacacctgcagaattcttgggagtcttattacctggagatcttgatggtcacaggtttgttggcctatataatgaactacatcatcgggaaaaacaaaaactccaggttggcacaggcctggttcaacacccaccgtgagttgctagaatccaattttacactggtcggagacgatggaaccaataaggaagctaccagcaccggcaagctcaaccaagagaatgagcatatctataacctctggtgttccggacgggtgtgctgcgaggggatgctgattcaactgcggttcttgaagagacaggatttgcttaacgttttagcgagaatgatgagacctgtgagcgaccaggtacagatcaaagtcacgatgaatgacgaagatatggacacctacgtatttgcagtcgggaccagaaaagccctcgtgcgtctgcaaaaggaaatgcaagatctgtccgaattttgtagcgataaaccaaagagtggagccaagtatgggttgcctgactctctggccattctatccgaaatgggggaggtaaccgatggcatgatggataccaaaatggtgcatttcctgactcactatgctgataagattgagtctgtccactttagcgatcaattctccggcccgaagatcatgcaggaagaaggtcagccgctaaaactgccagacactaaacggactctgttattcacatttaacgtcccaggcagcggcaatacatatcctaaagacatggaagcccttctccctctcatgaacatggtgatctacagtattgacaaggcaaagaagttcaggttaaatcgagagggtaaacagaaagccgacaaaaaccgggcacgcgtggaggagaactttctcaagcttactcacgtgcagaggcaggaggcggctcagtctaggagagaagagaaaaaacgagcagaaaaggagcgaattatgaacgaagaagatcccgaaaaacaaaggcgattagaagaggctgcactgcgccgtgaacagaagaagttggaaaaaaaacaaatgaaaatgaagcagattaaggtgaaggcaatgtag

SEQ ID NO: 12341 - DNA, 741 bp, Artificial Sequence
  Description of Artificial Sequence: Synthetic coding sequence
atggccgcagtggacattcgcgacaacttactggggatttcgtgggtcgactcttcctggatccctatcctgaactctggctccgtgctcgattatttttccgaaaggtcaaatcctttttatgatcgcacctgcaacaatgaagtcgttaaaatgcagcgccttacattagagcacctgaatcagatggttggaatagagtacatccttctgcacgctcaggagcctattttgtttatcattcgcaagcagcagcggcagtctcctgcacaagtcatccctctcgctgactactacatcatcgcaggcgtgatttaccaggcgcccgacttgggctccgtgattaactcgcgagtgctgacggccgtgcacgggatccaaagtgctttcgacgaggctatgagttactgccgatatcacccctcgaaagggtactggtggcactttaaggaccacgaggaacaagacaaagtacgccccaaggctaagcgaaaggaagaaccttcttctatctttcaacgccagagggtagatgcacttctgctggacctgagacagaagttccctcctaagttcgtacaattaaaacccggagagaagcccgtccctgtggatcagactaagaaagaggctgagcccatacccgagacagtgaagcccgaagagaaagaaacaacaaaaaatgtgcaacagaccgtctccgccaaaggtcctcccgagaaacgcatgaggttgcagtag

SEQ ID NO: 12342 - DNA, 762 bp, Artificial Sequence
  Description of Artificial Sequence: Synthetic coding sequence
atggccgcagtggacatccgagacaacctgttggggatcagctgggttgattcctcttggatacctatactgaatagtggttcagtgctggactacttttcagagcgcagcaacccattttacgatcgcacttgcaacaacgaagtggtgaagatgcagcgactgaccctcgagcacctgaaccagatggtgggcatcgaatacatcctccttcatgcgcaggagccgatcctgtttatcattcggaaacagcagcggcagagcccagctcaggttattcctctggccgattattacattatcgccggcgtaatctaccaggcaccagacctcggcagcgttatcaatagcagagtgtctctgttctccttctataaacttaccgccgtgcatggaattcaaagtgcctttgatgaggccatgtcttactgtaggtatcacccatcaaaaggctattggtggcattttaaggatcatgaggagcaagacaaagtcaggccgaaggcgaaacgcaaagaagagccatccagcatcttccagcgccagcgtgtagacgccctgctgctggacctgcgtcagaaatttccaccgaaatttgtccagctgaagccaggcgagaagccggttcctgttgaccaaacaaaaaaagaggccgagcccatccctgagaccgtgaaaccagaggaaaaagagactaccaagaatgtgcaacagactgtgagcgcaaaaggccctcctgagaaacggatgcgcttgcagtag

SEQ ID NO: 12343 - DNA, 546 bp, Artificial Sequence
  Description of Artificial Sequence: Synthetic coding sequence
atggctgcagtggacatccgcgacaacttgctgggaattagctgggtcgactcatcctggatcccaatcctcaattctggaagcgtgctcgactacttctctgagcgctctaacccattctacgataggacctgtaataacgaggtcgtgaagatgcaacgccttactttagagcacctgaaccagatggtcggcattgagtatattcttctgcacgcacaggaaccgattctctttatcattcggaagcaacagcgacagtcccccgctcaggtcattccattggctgattattacattattgctggggtgatctaccaggcccctgatcttggctcggttataaattcccgggtactcacggcagtgcatggcatccaaagtgccttcgatgaggcaatgtcttattgccggtaccatccgtcgaagggctattggtggcactttaaggaccatgaggagcaggctaaggcctggaggaaggcttgttccagtggcagcaataaagagaggggcagaacgtacacaagaaactgtaagacttag

SEQ ID NO: 12344 - DNA, 750 bp, Artificial Sequence
  Description of Artificial Sequence: Synthetic coding sequence
atggctgccgtggatattcgcgataatctcttgggaattagctgggttgactcctcctggattcccatccttaatagcggctctgtcttggactattttagcgagcgcagtaatccattctatgatcggacttgtaacaatgaggtagtaaagatgcaaaggctgacgctagagcacctgaaccagatggtgggtatcgagtacatacttctgcacgcacaggagcctatcctttttatcataaggaaacagcaacgtcaaagccccgcacaagtgataccgctcgcagactattatatcatagctggcgtcatttaccaggcccccgacttaggaagcgtgattaattcacgggtgttgacagccgtgcacggcattcagagcgcattcgacgaggctatgtcttattgccgctaccacccctctaagggctactggtggcacttcaaagatcatgaggaacaagacaaagtgcggcctaaggcgaaaaggaaagaagagccatcttccattttccagcggcagagagtggatgcgcttcttctagatctgaggcagaaattccctccaaagtttgtacaacttaaacctggtgaaaagccagtgcccgttgatcagactaaaaaagaagctgaacccatccccgagaccgtcaaaccagaggagaaagaaaccaccaaaaatgttcaacagaccgtcagcgccaagggcccccccgagaagaggatgaggctgcaaaaggctgtttag

SEQ ID NO: 12345 - DNA, 906 bp, Artificial Sequence
  Description of Artificial Sequence: Synthetic coding sequence
atgcaacgcgaggaaaaacagctggaggcctctcttgatgccttgctgagtcaagtggcggacctgaagaatagtttaggatcttttatatgtaagctcgaaaacgagtacgggaggctgacgtggcctagcgtcttagatagctttgccctcttgtctggccagctgaacactttgaacaaggttctgaagcacgagaagacgcccctgtttcggaaccaggtgatcattccactggtgctatccccagaccgcgatgaggacctgatgaggcagacagaagggcgtgtgccagtattttctcatgaagtcgtgcctgaccatcttcggaccaagcccgatcccgaagtggaagagcaggagaaacagcttacgaccgacgccgcgcggatcggagcagacgcggctcagaagcagatacagagcctgaacaaaatgtgctcgaaccttttagaaaagatttccaaggaagagagagaaagcgagtccggaggattaaggcccaataaacagacctttaacccaacagacaccaatgcattagttgctgccgtggccttcggcaagggtttatcaaattggaggccaagcgggtcatctggcccgggccaggctgggcagcccggtgcgggtacaattctggcggggacaagtggcttacagcaggtccagatggccggagctccctctcagcaacagcctatgctcagcggagtgcagatggcccaagctggacagcctggcaagatgccctcaggtataaagaccaatatcaaaagcgcttcaatgcacccttaccaaaggccctcttgcctcggatttatcctggccattcctctgcgcagaaaggttaaaaagttacttggtcaggagggtaaaaagaacgcgcacctacagctatggtag

SEQ ID NO: 12346 - DNA, 807 bp, Artificial Sequence
  Description of Artificial Sequence: Synthetic coding sequence
atgcagagggaggagaaacagctggaggctagcctggatgcacttctgagtcaggtcgcggatttaaagaatagcctgggctcgtttatctgcaaactggagaacgaatatggccgtcttacttggcccagtgtgctggactcttttgccctgttaagtgggcagcttaacaccctgaacaaagtgctcaagcacgagaagacccctctgttccgcaatcaggtgattatcccacttgtcctttcgccagatagagatgaagatctcatgagacaaacagaaggaagggtccctgtcttctcacacgaagtcgttcctgaccatctgagaacaaagccagaccctgaggtagaagaacaggagaagcagttaactaccgacgcagcccggatcggtgctgacgccgcccaaaaacagatccagagcttaaataaaatgtgcagtaacctgctggagaagatttccaaagaggaaagagaaagcgagtccgggggtctgcgacccaacaagcagacatttaaccccaccgatactaatgcgttagtggcggccgtggccttcggtaaaggattgtccaactggaggccctcaggctcaagcggacctggacaggccggacagccaggcgcaggaactatactcgcgggcaccagcggcctacagcaagttcagatggcaggcgctccttcacagcagcagcccatgctgagcggcgttcaaatggcacaggcaggccagcctgggaaaatgccttccgggatcaagaccaacatcaagtccgcctctatgcacccataccagcgttag

SEQ ID NO: 12347 - DNA, 1248 bp, Artificial Sequence
  Description of Artificial Sequence: Synthetic coding sequence
atgacccttgccgcaagctcccagcgctctcagatcatacggtccaagtttagaagtgtactgcagctgcgcatccacaggcgcaatcaagaacagatctctgaccccgatccctggatctctgcgagcgacccacccctggctccggctcttccaagcggcaccgccccatttttgtttagcccgggtgtcctgctgcctgagcccgagtactgtcctccttggcggtcccccaaaaaagagtcaccgaagatatctcagaggtggcgagaaagcaagccacgcggcaatctgacctatcaccagtacatgccccccgaaccgcgtcaggggtccagggcagaccctcaagcagagggttccgccctgggtccacccggaccctctttatgggaaggcacagattcacagcaacctcatcccagaatgaaacctagtcctctcacaccctgccctccaggcgtcccaagtccctctccgcctccgcacaagttggagttacagacacttaaactggaggaactgacagtctccgagctgcggcagcaattgcggctcagagggctccccgtgtccgggaccaagagcatgctgctggagaggatgagggggggagctccacctagagagcgaccaaaaccacggcgggaagactctccagctggcgcaccctggccgcgcctgaaaccgaaagcccttgccgcagcccggcgtcagggctccgtgaagccgagcgccgcttctcatagacctcctctccccagggccgccgatacgcctggcaccgcacccgcccccactcccacaccagcccccgcagctgcccctgctctaacgccctcttcggggcccgggtccgctgccctaacacttgaggaggagctgcaggaagccataaggcgcgctcagcttttacccaaccgcggcatcgatgatatcctggaagaccaggtggagccagacgaccctctgcccccaattcctctagacttccctggctcttttgatgtgttgtccccatcccccgacagcgagggtctatcatcagtgttctcaagcagcctgccttcgcccacgaatagtagcagtccctctccaagggacccaacggacagcttagactggttagaggcactgtccggaggaccccctctggggagcggaccacccccgccctctatttttagcgccgatctcagcgattcatcaagctctcggctctgggacctgttggaggatccgtggtag

SEQ ID NO: 12348 - DNA, 939 bp, Artificial Sequence
  Description of Artificial Sequence: Synthetic coding sequence
atgccccctgagccccgacagggaagccgagctgacccgcaagccgagggatcggctttaggcccacccggtccctctctgtgggaaggcactgacagtcaacagccacacccccgcatgaaaccttcgccgcttacaccttgtcctcctggtgtgccttccccgagccccccgccccacaaactagaacttcagaccctcaaactggaggagctaacagtaagtgaactgcggcagcaactgcgcctgagaggactgccagtgagtggaaccaaatccatgctactcgaacgtatgcgcggcggcgcacctcctcgcgagaggcccaaaccgcgccgtgaggattccccggcaggtgctccatggcctcgactaaagcccaaagccctcgctgctgcccgcaggcagggctctgtgaagccttccgccgcgtcacacaggcctccactgccccgcgccgctgatactcctgggaccgcccccgccccaaccccgacacctgcccctgctgcggcccccgccttgacccctagttctgggcccggttccgccgctctgacactcgaggaggagttgcaggaggccatcagacgggcacaattgctgcctaaccgcgggattgatgatatattggaggaccaggttgagcccgacgaccctttaccacccatccccctcgactttcccggcagtttcgatgttctcagccccagtcccgacagcgagggcctaagctccgtcttctcgagctcacttccatccccaaccaattcctcttcccctagcccccgcgatcccaccgatagcttagactggttagaagccctttccggagggcctcctttggggtctggacctcccccaccttccatttttagtgctgacctctcagacagttcatctagtcgattgtgggatctcctggaagatccatggtag

SEQ ID NO: 12349 - DNA, 744 bp, Artificial Sequence
  Description of Artificial Sequence: Synthetic coding sequence
atgccacccgagccacgccaaggaagtcgagccgatccccaggccgagggctcagctttgggacccccaggcccatcattatgggaggggactgacagtcagcagccccatccccgaatgaagccaagcccccttactccctgtcccccaggggtaccctctcccagcccccctcctcacaagctggaacttcagacactgaaacttgaggagctcactgttaaaccttccgccgctagtcatcgccccccacttcctcgggccgcggataccccaggcaccgcgcccgcgcccacgcccactcccgcacctgctgccgccccagcgctgaccccatccagcgggcccggatctgctgcactgaccctcgaagaagaactccaggaggccattaggcgtgcccagcttctcccaaatagaggcatcgatgatattctggaagatcaggtagagcccgacgatccactgccccccatcccactggattttcccgggagcttcgatgtcctgtctccaagtccggactccgagggattaagtagcgtgttttcctcctccctgccttcaccgacaaacagctcttcgccatcccctcgcgatcctaccgatagtctggattggctggaagccttgagcggtggaccacctttaggaagcggacctccaccgccaagcattttctccgccgatctgtctgactctagctctagtaggctgtgggatctgctggaggacccctggtag

SEQ ID NO: 12350 - DNA, 939 bp, Artificial Sequence
  Description of Artificial Sequence: Synthetic coding sequence
atgcctccagagccacggcagggctctcgcgccgacccacaagctgagggaagcgcgttgggcccaccagggccttctctatgggaaggcacagactcacaacagccccatccccggatgaaaccaagcccactgactccctgtccccctggcgttcccagcccatcaccaccccctcacaagctggagctgcagacactgaagctcgaagagcttaccgttagtgagttgcgacaacaactgcgcctacgaggcctgcccgtatcaggcacaaagagtatgttactggagaggatgcggggcggcgcacctccaagggaaaggcccaagcctcgacgcgaggacagtccagccggagctccctggccccggttaaagcctaaagcacttgcagcggcaaggagacaggggtcagtgaagccctctgcggccagtcatcgacctccactccccagagccgctgacacaccaggtaccgcccccgcaccaacaccaactcccgcccccgccgccgcacccgcattaaccccatcatcgggcccaggctctgccgctctgacgttggaggaagaattgcaggaggcaatacgacgcgcccaattgttgcctaacagggggatcgacgatatcttggaagaccaggttgagcccgatgacccccttccccctattcctctagacttccctggatcattcgacgttttatctcccagtccagattctgagggcttgtcaagtgttttttcctcctccctccccagccccacaaactcaagttctcctagccctagagaccctactgactccttggactggctggaagcactctccgggggtcccccgctgggctccggcccccccccacctagtattttcagcgctgatctctctgacagcagtagtagtcgcctctgggacctcttagaggacccttggtag

SEQ ID NO: 12351 - DNA, 618 bp, Artificial Sequence
  Description of Artificial Sequence: Synthetic coding sequence
atgtcaaagaaaaagggcctgtcagcagaagagaagcgaacgaggatgatggagatcttctctgaaacgaaggacgtgttccagctaaaggacctggagaagattgcgcccaaggagaaaggtattaccgccatgagtgtgaaagaggtactacagagtctagtagacgacggcatggtggactgcgagcgcattggtactagcaactattattgggcatttccctccaaagccctgcatgcccgcaagcacaagctcgaagtgctcgaatcccagctgtccgaggggagtcagaagcacgcttcactacagaaatcaatcgaaaaggccaaaattggcaggtgcgaaactgaagagagaacgcggctggccaaggagctgtcctctctgagggaccaacgagagcagttgaaggctgaagtggagaaatacaaggattgtgatccccaggtggtggaagagatacgacaggccaacaaggtagccaaggaggcagccaatagatggacagacaacatctttgccatcaaaagttgggcaaaaagaaagttcgggttcgaggaaaacaagatcgacagaactttcgggatcccggaggacttcgactacatcgactag

SEQ ID NO: 12352 - DNA, 159 bp, Artificial Sequence
  Description of Artificial Sequence: Synthetic coding sequence
atgattgatcaatctaatcgcacaggccaaggagctgcattttcccccgagggtcagccaatcggggggtacaccgagacacagccccacgttgcagtaagaccccctgggtccgtgggtatgtcgctcaacctggagggggagtggcattatctttag

SEQ ID NO: 12353 - DNA, 1077 bp, Artificial Sequence
  Description of Artificial Sequence: Synthetic coding sequence
atggctcgcaggtacgatgaactcccacactacccaggaattgtcgatggccctgctgcactggccagctttccagagactgttcccgccgttcccggaccctacggcccacatcgtccacctcagcccctaccacctggtctcgactcggacggattgaagcgtgagaaagatgagatttacggtcatcctctcttccctcttctggccctagtgttcgagaagtgcgaactagccacatgttctcctcgcgatggagctggggccggcttgggaaccccgcccgggggggacgtctgcagtagtgatagtttcaacgaggatattgcggctttcgctaaacaggtcaggagtgagaggcctcttttttctagcaatccagagcttgacaatctgatgatacaggcaattcaggttcttaggttccatttgcttgagctcgaaaagggaaagatgcctattgatcttgtgatcgaggatcgggacggcggctgcagagaagacttcgaagattaccctgcctcatgtccaagcctgccagatcagaacaatatgtggatccgggatcacgaagacagcgggtctgtgcatctgggaacacccgggcccagctccggcgggctggcctcacagtcgggagataatagctccgatcaaggggacgggctcgatacttctgtcgcctctccgagtagcggaggggaggacgaagatctggaccaagaaaggcggcgcaataagaagcgtgggatctttcccaaagtcgctactaacatcatgcgggcttggctcttccagcacttaagtcacccataccccagcgaggaacaaaagaaacagctcgcacaggacaccgggttgaccatactgcaggtgaataattggttcattaacgctcggcgtcgcatagtgcagcccatgatcgatcagtctaacagaactggacagggcgccgcctttagcccggagggacagccaatcggtgggtataccgaaacgcagccgcacgtcgctgttaggcctccaggttccgtggggatgtccttgaatctcgaaggggaatggcactacttgtag

SEQ ID NO: 12354 - DNA, 1128 bp, Artificial Sequence
  Description of Artificial Sequence: Synthetic coding sequence
atggcgcgacgttatgatgagctcccacactaccccgggattgtggacggcccagctgcattagcttctttccctgagaccgtgccagcagtgccaggcccttacggacctcatcgccccccccaaccactgccgcccgggctggacagcgatgggctaaagcgggagaaggatgagatctatgggcatcctctatttccactgctggcattggtcttcgagaaatgcgaactcgcaacctgtagcccccgggatggtgctggggcaggtctggggacacctcccgggggggatgtttgttcatccgactccttcaatgaagacattgcagcctttgccaagcaggttaggagtgagcgtccacttttttcatctaatccagagctggataacttgatgattcaggcaattcaggtgttgcggttccacctgctggaactggaaaaagtgcacgatctgtgcgataacttttgccatcgctacataacatgcctgaaggggaaaatgcctatcgacttagtgatcgaagacagggatgggggctgcagggaagacttcgaggactatcccgctagctgtccttccctgccagatcaaaacaacatgtggattcgcgaccatgaagacagcggctccgtgcacctcggaacacccggacccagtagcggcggtctggcctctcagagtggtgacaactcaagcgatcagggggacggactggatacctctgtggcatctccttccagtggaggcgaagacgaggatctagaccaggaaaggcgccgcaacaagaagcggggcatttttcctaaagttgcaaccaacatcatgagggcttggcttttccagcatctgagccatccctacccttcagaggagcagaagaaacagctcgctcaggatacaggcctgaccatacttcaagtgaataactggttcattaacgctcgccggcgaattgtgcagcccatgatcgaccagagtaacagaacgggccagggcgctgctttctcaccagaggggcagccaataggcggatacaccgagacacagccacacgtagccgtgaggcctcccggcagcgtgggcatgtctctgaacctcgaaggagaatggcactatctctag

SEQ ID NO: 12355 - DNA, 1266 bp, Artificial Sequence
  Description of Artificial Sequence: Synthetic coding sequence
atggcacggcgatacgatgagctaccacattatcctggcattgtggacggcccagctgcactggcatcttttcccgaaacagtccccgccgtacctggcccgtacggaccccaccggccccctcagccactgcctcctgggctcgattctgacggactgaaacgcgagaaggatgagatctatggccatccgctgttccctctgctggcgctagtgttcgaaaagtgtgagctcgcgacttgctccccgcgcgacggtgccggtgcagggctggggacccctcctgggggtgacgtttgttcctcagattccttcaatgaggacatcgccgcctttgccaagcaggttcggtccgaacgaccgctcttttcaagcaatcccgagcttgacaacttaatgatacaagcgatacaagtccttcgctttcatcttctggaattggaaaaggtccacgacttgtgtgacaacttttgtcacaggtacattacttgcctgaaaggaaagatgcctatcgatcttgtgatcgaggacagggacggcggatgccgtgaggatttcgaagactacccggcatcctgtccctcccttccagaccagaataatatgtggatacgggaccacgaagactctgggtctgttcaccttggtacaccagggcctagcagtggtgggctggcttctcagtcaggtgacaactctagcgaccagggagatggcttggacacgagcgtagcctcccccagtagcgggggcgaagatgaggacctggatcaggagcgtagacgcaacaagaagcggggtatctttcctaaagttgcaactaacattatgcgtgcatggctttttcagcatctgtctcggcggagcgaagctcccgttttgcccgacgtgtgtctgggcctgggcagtccaagtccaggtccccgttgggccagaccatggggttccgactgcggacggcctggaagacagtctgattcttgctggtggctgcagcatccgtaccccagtgaagaacagaaaaagcagctcgcacaggacacaggcttgacgattttgcaggtgaataattggtttattaacgcacgcaggcgcattgtgcagccgatgatcgaccagtctaatagaacaggacaaggggctgccttttctccggagggccagccaatcggcgggtacaccgagacacaaccacatgtggccgtacgtccaccagggtctgttggaatgagcttaaaccttgaaggcgaatggcactacctttag

SEQ ID NO: 12356 - DNA, 1266 bp, Artificial Sequence
  Description of Artificial Sequence: Synthetic coding sequence
atggcccgcaggtacgacgaattgccccactaccccggcattgtggacggccccgccgctttggcatctttcccagagacagtacccgcggtcccaggaccctacgggccccacagacctcctcagcccctcccgcctgggctcgatagcgacggactgaaacgcgaaaaggacgagatctacggccaccctcttttccccttgctggccctagttttcgagaagtgcgagctcgcaacgtgctccccccgcgatggtgccggcgctggactcggaactccaccagggggcgacgtttgtagcagcgatagctttaacgaggatatcgccgcctttgctaagcaagtgagaagcgagcgccctctgttcagctctaacccagagttggacaaccttatgatacaggcaattcaggtcctgaggttccacctcttggaacttgagaaggtccatgatctttgcgacaatttctgtcaccgctatatcacatgcctgaaaggtaaaatgccaattgacctggtcattgaagatcgggatggcggatgccgcgaggattttgaggactaccccgcttcttgtccttctctaccagaccaaaacaacatgtggatcagagatcacgaggactccggttctgtgcacctcggcacaccaggccccagctccggcgggctggcatcccaatccggggacaacagtagtgaccaaggcgatggtctagatacctctgtagcctccccctcaagcggaggagaggatgaagatctggaccaagaaagacggcgaaacaaaaaacggggaattttccccaaggtcgccactaacatcatgagggcctggctgttccagcatctttcccgacggtcagaggcgccagttctacctgatgtctgtctcggactcggaagcccgagccccggtcctagatgggccagaccatggggttcagactgtggccgtcccgggaggcagtcagacagttgttggtggctccagcatccctacccctctgaagagcagaagaaacagctcgcgcaggacacggggctaactattctccaggtgaataattggtttattaatgcaagacgacggatcgtgcagcctatgatagaccaaagcaataggactggacagggggcagctttctcccccgagggccagcctataggtgggtacaccgagactcaaccacacgtcgcagtgaggccaccgggttctgtgggcatgtctctaaacctggaaggcgagtggcattacttatag

SEQ ID NO: 12357 - DNA, 1266 bp, Artificial Sequence
  Description of Artificial Sequence: Synthetic coding sequence
atggcccgacgctacgatgaattgcctcactatccagggattgttgatggcccagccgccctggcatccttccccgagacagtgccagcagtaccaggaccttatggcccgcaccgtccacctcaacccctgccacctggattggattccgatggcctgaaacgagagaaagatgagatctatgggcacccactgttcccactgctggcactggtcttcgagaaatgtgagctggccacctgctcaccacgtgacggagcaggggccggcttggggaccccacctggaggagacgtgtgcagctccgattctttcaacgaggacatcgccgcgttcgctaaacaggtccggtctgaacgaccgttattcagctcaaaccccgagctggataaccttatgatccaagcgatccaggtgcttcgcttccatctactcgagttggaaaaagtccatgatctatgtgacaacttctgtcaccggtacatcacctgtctcaagggcaagatgccgattgatctcgtgatagaagaccgcgacgggggctgtcgcgaggatttcgaggactatcccgcctcatgcccctcactccctgaccagaataacatgtggatcagagatcacgaagacagcgggagcgtccacctgggaacaccaggcccgagtagcggtgggcttgcctcccagtcgggggacaactcgtctgatcaaggagatggtctcgacacatccgtggcgtcaccttccagcgggggggaggacgaggatctcgatcaggaacgcaggcggaataaaaagcgtggtatcttccccaaagtggcaacaaacatcatgagggcctggcttttccagcacctgagtcgcaggtcagaagcaccagtcctgcccgacgtgtgcctcggactgggttcaccctctcctggtcctaggtgggctcgaccgtggggctccgattgcggtcgtccaggacgccagtcggacagctgctggtggctgcagcatccatatccctcagaggagcagaagaaacagctggctcaggacaccggacttaccatattacaggtgaacaactggttcattaacgccaggagacgaatcgtccagcccatgattgatcagtccaatagaactggtcagggtgccgccttcagtcccgagggccagcccatcggaggctatactgaaacccagccacacgtagctgtgcgccccccaggatccgtgggcatgtcccttaacctagagggggaatggcattacttgtag

SEQ ID NO: 12358 - DNA, 1929 bp, Artificial Sequence
  Description of Artificial Sequence: Synthetic coding sequence
atggtcagtgcatcgcagaacgaggtacctgctgctcctttggaagaactcgcataccgaaggagcctgcgagtcgcacttgacgtgttgtctgagggttccatttggtcacaggaatcctccgccggcactggccgagctgaccggagcctaagaggcaagccaatggagcacgtgtcttcaccatgtgattcaaattcctcctccctcccccggggcgatgtcctggggagctctcggccacatagaaggcgcccatgtgtgcagcagtcactgagctcgagttttacatgcgagaaggatcctgagtgtaaggtcgaccacaagaaggggctgcggaagtctgagaatccgcgcggacctctggtcctccccgctgggggaggcgcccaagatgagtccggctccagaattcaccacaagaattggactctcgccagtaagaggggagggaactccgcccagaaagcttccctgtgtctcaacggaagtagtctgagtgaggacgacactgagcgcgatatgggctcaaaggggggatcatgggccgcccctagcctgccctctggcgtgagagaggatgacccctgtgctaatgccgaaggccatgatcccggcctacctttaggaagtctgacagcccccccagccccagagccatctgcatgtagtgagcccggcgagtgccctgcgaagaagagaccccggctggatggctcccagcgaccgcctgccgtacagctagagccaatggccgccggcgctgccccaagcccgggtcccggccctggcccccgtgagtcagtgactccccgcagtactgcccggttgggacccccgcccagtcacgcgtccgcggacgcgactagatgcctgccctgccctgactctcagaaactggaaaaggagtgccaatcatccgaggaaagcatgggatctaattctatgaggtctattcttgaggaagacgaggaggatgaggaacctccacgcgttctgctttatcatgagccccgatctttcgaggttggcatgctggtctggcacaagcataagaagtatcctttctggcctgcagtcgtgaaaagtgtccgccagcgggacaaaaaagcaagcgtgctgtatatcgaaggacatatgaatccgaagatgaaaggcttcactgtgtcgctgaaaagcctcaagcacttcgactgcaaagagaagcagaccctccttaatcaggcccgagaggattttaatcaggatattggttggtgcgttagtctgataaccgactacagagtgagactcggctgtgggtcatttgcaggatcctttctggaatactacgccgcagatattagttaccccgtgcgaaaatctatacagcaggacgtcctggggacaaaacttccacaactctctaaaggcagccctgaggagcctgtggtgggctgcccactggggcaaaggcaaccttgtaggaagatgctcccagaccggagccgcgccgccagggatcgcgccaaccagaagctggtggagtacatagtcaaggctaagggggccgagtctcatttgagggcgatcctaaaatcacgcaagccaagtcgatggttgcagacgtttttgagtagctcacagtatgtaacttgtgttgagacgtacttggaggatgaaggccaactggacctggtagtgaaatatctgcagggagtataccaggaagtgggagctaaagtgctccaacgcactaacggcgaccgaatccgtttcatcctcgatgtgttgctgcccgaagccatcatttgcgccatctcagccgtagatgaggtggattacaaaaccgccgaagagaaatacatcaagggcccttctctatcctaccgggagaaggagatctttgataaccagctgttggaggaacgaaaccgccggaggagatag

SEQ ID NO: 12359 - DNA, 2136 bp, Artificial Sequence
  Description of Artificial Sequence: Synthetic coding sequence
atgatggcggacgctaagtacgtgctgtgccgctgggagaagcgtctatggccagctaaggtgctcgccagaacagctacttcgaccaaaaacaaacgtcgcaaagaatattttcttgctgtgcagatactttcattagaagagaaaatcaaagtgaagagtacagaagttgaaattctggagaagtctcagattgaggccattgcaagcagcttagcctctcagaacgaggtcccagcggctcccctggaggaactggcgtaccgcaggtccctgcgcgtggctcttgacgttctgagcgagggatccatctggagtcaggagagctccgcagggaccggcagggcagaccgttccctcaggggaaaacccatggaacacgtgtcgagtccatgtgattccaatagttcatctctcccgcgcggggatgtcctgggcagtagtcgtcctcacaggcgccggccctgtgtgcaacaatcgctttctagctctttcacatgcgaaaaggaccccgagtgcaaggtcgatcacaaaaagggattaaggaagagtgagaatccgcgcggacccctcgttctgcccgcaggaggtggagcacaggatgagtccggctctagaatccatcacaaaaattggactctggccagtaagcggggaggcaatagcgcccagaaagctagtctgtgcctgaacggaagcagtctcagtgaggacgacacagagcgggacatgggatcaaagggcgggtcttgggcagccccaagcctaccgtctggtgttcgtgaagacgatccatgtgccaatgcagagggccacgatcccggcctcccactcggtagcctgactgccccacctgcccctgaacctagcgcctgctctgaacctggcgaatgccccgcgaagaagaggcctaggctggatggcagtcagagacctccggcagtccaattggagcccatggctgccggcgctgccccaagtcctggacctggtcctgggcctcgcgagtctgttaccccccgcagtaccgccagacttgggccacctcctagtcacgcctcagccgatgcaacaaggtgcctgccctgccccgattctcagaaactggagaaagagtgtcagtcctcggaggagtccatgggctctaattccatgcgatcaatactggaggaggacgaggaggacgaagagcctcctagggtgctgctctatcacgagcctaggagttttgaggtaggaatgctggtatggcacaaacataagaaatatccattttggcccgctgtagtgaaatccgtacgccagcgtgataaaaaggcctcagtattatatatagagggacatatgaatcccaagatgaaaggcttcactgtcagtctgaagtcactgaaacacttcgactgcaaagagaagcagaccctgctcaatcaggcccgggaggacttcaaccaggacatcggatggtgtgtgtcccttattaccgattacagagtgcgcctggggtgcggctcgtttgcgggtagcttcctagagtattacgcggctgatatttcttatcccgtgcgcaaatctatccaacaagatgtattggggacgaaattgcctcagctgtcaaagggcagccccgaggaacccgttgtgggctgccctctcggtcaaaggcaaccatgtaggaaaatgctgccagatcgtagccgggccgccagagatcgcgctaatcagaagctggtagaatatattgtgaaagcaaagggggccgaatcccaccttcgcgcgatcctcaaaagccgcaagcctagtcggtggctgcagaccttcctgtcatcatcgcagtacgtgacttgcgttgagacatatttagaagatgaaggccagctggacctcgtggtaaaatacctgcagggagtgtaccaggaggttggcgccaaagtgctgcagaggactaatggggatcgaatccgatttatcctggatgtgcttctaccggaagccatcatctgcgccatctctgccgtagacgaggtcgattacaaaacagctgaggagaaatacattaaaggcccatcactgtcctaccgagaaaaagagatttttgataaccagctgcttgaggaaaggaacaggagaaggcgctag

SEQ ID NO: 12360 - DNA, 225 bp, Artificial Sequence
  Description of Artificial Sequence: Synthetic coding sequence
ggcggcggagggggtggccatatcggcgttcggcccggctcaacattatgccaaataattgcaacttgccacatgtcggttaacgatggcggatgctacgtgctgtgtaggtgggagaaaagattatggcccgcgaaagtgctagcgcggaccgccacaagtacaaagaacaagagacggaaagaatacttcctcgccgtgcagatactgagtctcgaggaatag

SEQ ID NO: 12361 - DNA, 2199 bp, Artificial Sequence
  Description of Artificial Sequence: Synthetic coding sequence
atgatggctgatgccaagtacgtcttgtgcaggtgggagaagcgtttgtggccagctaaggtactggcgcgaaccgccaccagcactaagaacaaacgccgcaaagagtactttctggccgtgcagattttaagtctggaggagaagatcaaggttaagtccaccgaagttgagatcctggagaagtctcagatcgaggctatcgccagttcactcgcttctcagaatgaagtccctgcggcccctttggaggagctggcatataggcgttccctgcgagtggcccttgacgtgctatctgaggggtctatctggagccaggaatcctcggccggaacggggcgcgccgaccgtagccttagggggaaaccaatggaacatgtttcctctccttgcgacagcaactcaagcagcctaccaaggggggacgtgctggggagttcccgtcctcacagacggcggccatgtgtccagcagtcactgtctagctccttcacatgtgagaaggacccagagtgtaaagttgatcacaagaaaggccttagaaagtcagagaatccaaggggccctcttgtcctgcctgctgggggtggcgctcaggatgaatctggttcacggatacatcataaaaactggactctcgcttcaaagcgcggcggtaactcagcgcagaaggcctccctctgcttaaatggttccagtctgtccgaggacgacaccgaaagagacatgggcagtaaggggggttcctgggctgccccgtcccttccctctggagttcgcgaagacgacccgtgcgctaacgccgaggggcacgatcctggactccccctcggttctctcactgcccctcccgcccccgagccgagtgcttgcagcgagccaggggagtgcccggccaaaaagaggccccggctggacggtagccagcggccaccagctgtccaattagagcccatggcagccggcgctgctcccagcccgggtcccggtcctgggccccgggaatcagtgaccccacggagcaccgcccgcctgggcccacctccaagtcacgccagtgctgacgctacacgatgtctgccttgccctgacagtcagaaactggagaaggagtgccagagttctgaggagtccatgggctctaacagcatgcgaagcatactggaagaagatgaagaggatgaagagcctccacgggtcctgctttaccatgagcctagaagttttgaggtaggcatgcttgtgtggcataaacacaaaaaataccctttctggcctgcagttgtgaaatctgtccgccaacgtgacaagaaggcaagcgtgttgtatattgaggggcacatgaaccccaaaatgaaaggattcacagttagcctgaaatcactaaaacactttgattgtaaagagaagcaaacgctgcttaaccaagcgcgggaggacttcaaccaggacataggttggtgcgtttcactgattaccgattacagggtgcgcttgggttgtgggtctttcgccgggtcatttctggagtattacgctgccgatatttcatacccagtccgcaaatccattcagcaggacgtcctgggaacgaaacttcctcagctgtctaaagggtctcctgaggagcctgttgtgggatgccctctgggacagcgacagccctgtaggaagatgctgccggataggagcagagcagctcgagaccgcgccaaccagaaactggtggaatacattgtaaaagcaaagggggcagaaagtcatcttagggctattttgaagtcacgcaagccttctagatggctacagacatttctctcgtcaagccagtacgtcacgtgcgtggaaacatacctggaggacgagggccagctcgacctggttgtcaagtacttgcagggtgtataccaggaagttggagccaaggtgttgcagcgaaccaatggcgacaggattagattcatcctggacgtcttgctgcccgagtgttgggagatgagagtccgagcactcgaccccgtacgccggcgcagcagactcctggatccctgcgcagagatggaattacttcggagctgtcagcaccaaggagtcagaacccccagtctgctcagggcacatcggtgttttccagcatctgtgggacatcacctctgcgacttatgcggcggtagggggggactccaggatggatag

SEQ ID NO: 12362 - DNA, 501 bp, Artificial Sequence
  Description of Artificial Sequence: Synthetic coding sequence
gttttagccgctagccagaatgaggtgcctgcacacccgtggaaaaactggcccacagacggcagagttgccttagatgtgttatccgaaggctccatttggtcccaggagtcttccgccgggaccggtagagcagaccggtctctccgcgggaaacccatggagcatgtctcgtccccttgtgactcaaacagctcctccctgccgaggggagatgtgctgggcagcagcagacctcatagacgcaggccctgtgtacagcagtcactcagcagttccttcacctgtgaaaaggaccccgaatgcaaagtcgatcacaaaaagggcctccggaaaagtgaaaaccccaggggtcctctggtcctgccagcgggcgggggcgcccaggatgaatcagggagccgcatccatcataagaattggacgcttgccagtaagagaggaggtaactcagctcagaaggcctcactctgcttaaatggctcatctctgtccgagtag

SEQ ID NO: 12363 - DNA, 1539 bp, Artificial Sequence
  Description of Artificial Sequence: Synthetic coding sequence
atggcagaaccctccgttgagagctcgtcgcccggcgggtctgccacttctgatgaccatgagtttgatccctcagctgatatgctggtgcatgatttcgatgacgaaagaaccttagaagaagaagagatgatggagggtgaaacaaactttagttctgagatcgaagatctcgccagagaaggagatatgcctatccacgaactcctgtccctatatggttacggctcaaccgtacgactgccggaagaggatgaagaagaagaagaggaggaggaggagggggaagatgatgaagacgccgacaatgacgataactcaggctgttccggggagaataaagaggagaacattaaggacagctccggtcaggaagatgaaacgcagtcttccaatgatgatccatcccagtcagttgcaagtcaggatgcccaggaaattattaggcccagacggtgtaagtatttcgatacgaattcagaggtggaggaggagtccgaggaggacgaggactatatccctagcgaggattggaaaaaagaaatcatggtgggatctatgttccaagcggagatacccgtcggcatctgtcgttataaagagaatgagaaagtttacgagaacgatgatcagctgctttgggaccccgaatatctccccgaagacaaggttatcatttttctcaaggacgcatcacgaaggaccggcgacgaaaagggcgtcgaagcaattcccgaaggctcgcatattaaggacaatgagcaagccctgtacgagctggtgaagtgcaattttgacaccgaagaggctctacgccgcctgagattcaacgttaaagcagcccgcgaagagctttcagtgtggaccgaggaggagtgccgtaattttgagcagggtcttaaggcatacggcaaagatttccatttgatacaggcaaataaggtgcgcacacggagtgtcggcgaatgtgttgcattttactatatgtggaagaagagtgagagatatgattttttcgcacagcagacaaggttcgggaagaagaagtacaatctgcatcccggcgttaccgattatatggacaggctcctcgacgagtcggagagcgccgcatcctcccgggctcccagtccacctccgactgcttctaattctagtaacagccagtcagagaaggaggacgggacggtcagcacagctaatcagaacggagtgtcgagtaatgggccaggcgagatcttgaataaagaagaagtcaaggtggaaggcctccacatcaacggacctaccggaggcaacaagaagccattacacgctgacatggacacaaacggctacgagaccgataacctcaccactgaccccaagctagcccacatgacagccaggaatgagaatgacttcgatgaaaagtctgagcgtccggccaagagacggagagttaattcgaacggcaaagagagccctggctctagtgaatttttccaggaggctgtcagtcacggtaaatttgaagagctggagaatacagacgattag

SEQ ID NO: 12364 - DNA, 1113 bp, Artificial Sequence
  Description of Artificial Sequence: Synthetic coding sequence
atgccgattcacgaacttctttctctttacggctatgggtcaaccgtcaggctgccagaagaggatgaggaagaagaagaggaggaagaggaaggggaagacgatgaagacgcagacaatgatgacaacagcgggtgttctggcgaaaacaaggaggagaacatcaaggacagctccgggcaggaagatgaaacccagtcatccaatgacgatccatcgcagagcgtggcctcacaggacgcacaggaaatcatcaggccacggcggtgtaaatactttgatactaactccgaggtggaagaagagagtgaggaggacgaagattacattccttctgaagattggaaaaaagagatcatggtggggtccatgttccaggctgagatccctgtcggtatctgccggtataaggaaaacgaaaaggtgtatgagaacgatgaccagctgctgtgggatccagaatacctcccggaggataaggtgattattttcttaaaggacgcctcaagacgcaccggcgatgagaagggagttgaggcaattccagaaggaagtcatattaaggataacgagcaggcattgtatgaacttgtgaaatgtaactttgacacagaggaggctttgaggcggctgcggtttaacgttaaagctgctcgggaggagttatccgtatggacggaagaggagtgtaggaattttgaacagggtttgaaagcctacggtaaagattttcacctgattcaggcaaacaaagtgagaacgcggtccgtgggtgaatgtgtggccttttattacatgtggaagaaaagtgagaggtacgacttctttgcgcaacagacacggttcgggaaaaagaaatataacctgcatcccggcgtcaccgactatatggaccgtctgctcgatgagagtgaaagcgccgcttcaagccgggcccctagcccacctcccaccgcatccaactcttcaaatagccagagcgaaaaggaggacggcactgtgagtactgcgaaccagaacggggtatccagcaatgggcctggaatactgcagatgctgcttcccgtccatttctctgccatctccagtcgtgccaatgcgtttctcaaatag

SEQ ID NO: 12365 - DNA, 1590 bp, Artificial Sequence
  Description of Artificial Sequence: Synthetic coding sequence
atgttcatgtttaattggttcactgattgtttatggaccctgtttttatcaaattatcagccaagcgtggagagttcgtccccaggcggatcagccactagtgacgatcacgagttcgacccttctgctgacatgctggtgcacgacttcgacgatgaacgaacgctggaagaagaagaaatgatggaaggggagaccaacttctcgagtgagattgaagacctagctcgcgaaggggatatgcccattcatgagttgttatctctctacgggtatgggagcacagtacgcctccctgaggaagatgaggaggaggaggaagaagaggaagaaggtgaagacgacgaggacgccgacaatgacgacaactccgggtgctcgggcgaaaacaaggaagaaaatattaaagactccagcggccaagaagacgaaacccaaagttcgaacgatgatcctagccaatcagttgccagtcaggacgcacaggagatcattagaccccgacggtgcaaatatttcgacaccaactctgaagtagaggaagaatcagaggaagatgaggattacataccgagcgaggattggaagaaggagattatggtcggctcgatgttccaagccgaaattcctgttggaatatgtagatataaggaaaacgagaaggtttatgagaatgatgaccagctgctgtgggatccagaatatctgccagaagataaagtgattatctttctgaaagacgcgagccgtcgtacaggcgatgaaaaaggcgtcgaggctatccctgaaggttctcatatcaaagataacgaacaagccctttacgagctagttaaatgtaattttgacacagaagaggccctccggagacttcgttttaatgtcaaagcggctcgggaagaattgtcagtctggaccgaggaggagtgcagaaatttcgaacagggtctgaaagcatacggcaaggacttccacttaatccaggcgaataaggtgagaacgcggagtgtgggcgagtgtgtcgctttctattatatgtggaagaagtccgagcgctatgatttctttgcacagcaaacccgcttcgggaagaagaaatataatcttcacccaggggtgaccgactacatggaccgcctcctggacgagagtgagtcagccgcctcttctcgtgccccctccccacctcctaccgctagcaattcttcaaacagtcagtctgagaaggaggacggcacagtgtccactgccaaccaaaatggcgtgtcctctaatggtcccggagagatattaaacaaggaagaagttaaggtggagggcttgcacatcaacggacctaccggagggaacaagaagcccctacacgccgatatggacactaacgggtacgaaaccgataaccttacaacagatcctaagttggctcacatgacagcccgtaatgaaaacgattttgatgagaagtcagaaaggccggccaaaaggaggcgcgttaacagtaatgggaaagagtcaccgggctcaagcgagtttttccaagaagctgtgagccatggcaagtttgaggaactcgaaaacaccgatgactag

SEQ ID NO: 12366 - DNA, 1461 bp, Artificial Sequence
  Description of Artificial Sequence: Synthetic coding sequence
atggacggcgcctccagcggcggcgggggctcctccgagggaggtggcgggtcaagcggatcagggtacggcgtggtcgctagatttagtcagtgtttggccgaattcaggacttggctgagaaccaattggttgagatttaacgctgataaaactgacgtgatgctcccatcggtcgagtccagtagtcctggagggagtgccacatcggacgaccacgagttcgatccttccgccgacatgttggtacatgacttcgacgatgagcgaactcttgaggaagaggagatgatggagggagaaactaatttcagttctgaaatcgaggatctggctagggaaggagacatgcccattcacgaactgttatctctgtacgggtacgggtccacggtgcgtctccccgaagaagacgaagaggaagaggaagaggaggaggaaggtgaagatgacgaagacgccgacaacgacgataatagcggatgcagtggggaaaacaaggaagagaatataaaggacagttccgggcaggaggacgaaacacagtctagcaacgacgacccaagccagtctgtagcctcccaggacgcacaagagattatcaggccgcgacgctgcaaatattttgataccaactcagaggtcgaagaggagagtgaggaagatgaagattatattccttctgaagactggaaaaaggagatcatggtcggaagtatgttccaagctgaaatccctgtgggaatttgccgctataaagagaacgaaaaagtgtatgagaacgatgaccagctgctgtgggatcctgaataccttcctgaagacaaggtgattatatttctgaaagatgcgtcccggaggaccggggacgagaaaggagtggaggccatacctgaggggagccacatcaaggacaatgagcaggctctctacgagctggtaaaatgcaactttgacacagaagaggccctcagaaggctgcgcttcaacgtgaaagcggcgagggaagagctaagcgtatggaccgaagaggaatgcaggaacttcgagcaggggctgaaggcctacggaaaggatttccacctgatccaggccaataaggtgcgaacgcgctcggttggagagtgcgtggccttctactacatgtggaagaaatccgagaggtatgatttcttcgcccagcaaacccgttttgggaagaaaaagtacaatcttcaccccggcgttacagactatatggatcgcttactggacgaaagtgaaagtgctgccagctctagagcgccaagtcctccccccactgcctcgaatagttcgaactcgcagtcagagaaggaggacggcaccgtgtctaccgcgaaccagaatggtgtttcatccaacgggcctggtatcctgcagatgctgctgcccgtgcactttagtgcaatcagtagccgcgccaacgcttttttgaagtag

SEQ ID NO: 12367 - DNA, 1353 bp, Artificial Sequence
  Description of Artificial Sequence: Synthetic coding sequence
atgtttatgttcaattggtttaccgactgcttatggactctgttcttaagtaactaccagccctccgtcgaatcatctagtcctggcgggagtgctactagtgatgatcacgagtttgacccctccgcagatatgttggtgcatgacttcgatgacgagcgaaccctggaagaagaggagatgatggaaggtgagaccaacttttcaagcgaaatcgaagatctggcaagagaaggagacatgcccattcacgaactcctcagtctgtacggctacggcagcacggtaaggctccctgaagaggatgaggaggaggaagaggaggaggaagagggtgaggacgacgaggatgcagacaatgacgacaatagtggatgttctggggagaataaggaggagaacatcaaggactcatcaggacaggaggatgagacacaaagttcaaatgacgatccttcccagtccgtggcctcccaagacgctcaggaaatcatccgacctcgcaggtgcaaatattttgacacgaattctgaagtggaagaggaatcagaagaggatgaagattacataccctcagaggactggaagaaggagatcatggtaggctcgatgttccaggcggaaattcctgtcggtatttgccggtacaaggaaaatgaaaaggtgtacgagaacgatgaccagttactttgggatcccgaatatctgcccgaggacaaggtaatcattttccttaaggatgctagtcgtcggaccggcgatgagaaaggcgtggaggctattcctgaaggctcacatattaaagataatgaacaggctttgtatgagttggtgaaatgtaatttcgacactgaagaagccctcagaagattgcggttcaacgttaaggccgcccgagaggaactctcagtatggacggaagaggagtgccgtaattttgaacagggtttaaaagcctatggcaaggactttcacctgattcaagcgaataaggttcgaaccagatctgtgggagaatgcgtggctttttactacatgtggaagaagtccgagagatatgactttttcgcacaacagactaggtttggcaagaagaaatataacctacaccccggggtgacagattatatggacaggctcctcgacgaatcagaatccgccgcctcctcgcgcgcacctagccccccccctaccgcttccaattcttcgaactcacagtccgagaaggaggatggaaccgtcagcactgctaatcagaatggcgtgagctctaatggccccggcattctgcagatgctgctccccgttcatttctctgctatctcctcacgcgccaacgctttcctcaagtag

SEQ ID NO: 12368 - DNA, 1602 bp, Artificial Sequence
  Description of Artificial Sequence: Synthetic coding sequence
atgtgtataagatgtttatgtctgatcggactgcagactgtttgcggtttgttttcttgccagatcacccgaccatccgtggaatctagttcaccaggaggatctgcgacctcagacgaccatgaatttgatcctagtgcagatatgcttgtccacgacttcgacgacgagagaacacttgaagaggaggagatgatggaaggggaaactaacttctcaagcgagatcgaggatctcgcaagggaaggtgacatgccgattcacgagcttctgtccctctacggttatggctctacggtcaggttgcctgaggaggacgaggaggaagaggaggaagaggaggagggcgaagatgatgaggatgcagacaatgacgataatagtgggtgttccggagagaacaaagaagaaaacataaaagatagcagtggccaggaggacgaaacacagagcagcaacgatgacccttcccagtcagtagcgagccaagacgcccaggagatcatcaggcctcgccggtgtaagtatttcgacaccaacagtgaggtcgaagaggagtctgaggaagacgaggactatatcccttccgaagattggaagaaggagatcatggtgggttcaatgttccaggcggaaatccccgtggggatatgccggtacaaggagaatgagaaggtgtacgaaaacgacgaccagttactgtgggaccctgaatatctcccagaagataaggttattattttcctaaaagatgcttctcggcgcacaggggatgagaagggggttgaggccattcctgaaggcagccacattaaagacaacgagcaggccctgtatgaacttgtcaaatgtaatttcgataccgaagaagccctaagaaggttgcgatttaacgtgaaagccgcgagagaggagttaagcgtgtggactgaggaggagtgtcgtaactttgagcaggggttgaaagcctatggcaaggactttcacctcattcaggcgaataaggtaaggacccgctcagtcggtgaatgtgttgcattttattatatgtggaagaagtcagagagatacgatttctttgcccaacagaccaggtttggcaagaagaagtacaatctgcatcccggcgtcactgactatatggatagattactggatgagtctgagtctgccgcatctagccgtgccccatcacctccccctacggcaagcaattcttccaactctcaatcggaaaaagaggacggtacagtttcaacagcgaatcaaaacggcgtcagtagcaacggcccaggggagatacttaataaggaagaggtgaaggttgaggggttacatatcaatggtcccaccggtggaaataagaaacccctccacgccgatatggacactaacggttatgagaccgataacctcactactgatcctaaactggcacatatgacggccaggaatgaaaacgactttgatgagaaaagtgaaagacccgccaaaaggagacgtgtgaattctaatggcaaagaaagtcccggctcttcagagttctttcaagaagccgtctcacatggaaagttcgaggagttggagaataccgacgattag

SEQ ID NO: 12369 - DNA, 1413 bp, Artificial Sequence
  Description of Artificial Sequence: Synthetic coding sequence
atgttcatgttcaattggttcacggactgtctctggaccctttttctgagcaattatcaaccctctgtagaatcttcatccccaggcggctcagctacgtcagatgaccacgagtttgatccatctgctgacatgctggtgcatgactttgatgatgagaggaccttagaagaggaggagatgatggaaggagaaacaaactttagcagtgagatcgaagatttagcccgcgagggggatatgcctatccacgagttattgtcattgtacggttatggcagcacagttaggctgcccgaggaggacgaggaggaggaagaggaggaggaagaaggagaagacgatgaagacgcggataacgatgacaacagcggttgtagcggagagaacaaggaagagaacatcaaggattcaagcgggcaggaggatgaaacacagtcatccaacgacgatccatcccaatcagtggcgagtcaagatgcccaagagataattcgcccacgcagatgcaaatattttgacaccaacagcgaggtagaagaagaaagtgaagaggacgaagactacatccccagtgaagattggaaaaaggagataatggtggggtccatgttccaagccgagatacccgttggcatttgtagatacaaagagaacgagaaggtctatgagaatgacgatcaattactctgggatcctgagtatttgccggaagataaggttatcatctttctgaaagatgccagccgcaggactggcgacgagaagggcgtcgaagccatccccgaggggtcccacatcaaagacaatgaacaagcgttatatgaactggtgaagtgcaattttgatacggaggaggccctgagaaggctgaggtttaatgtgaaagcagccagggaagagctcagtgtgtggactgaggaagagtgtcggaattttgagcagggcctgaaagcttacgggaaagattttcatctgattcaggccaataaggttaggaccagatctgtgggagaatgcgtggccttctactacatgtggaaaaagtccgagcgctatgatttcttcgcccagcaaacacgattcgggaagaagaaatataacctgcaccccggggtcacagactatatggatcggcttctcgatgagtctgagtccgcggccagttcccgcgctccaagtcctcctcccaccgcttccaattcaagcaactctcaatctgagaaagaggacggaactgtgtctacagccaaccagaacggtgtgtcttctaatgggccaggagaaatcctgaataaggaagaagtcaaggtagagggcctccacattaatggacctactgggatactccagatgttgttgccagttcacttttcagccatttcatcccgggccaacgcatttctaaaatag

SEQ ID NO: 12370 - DNA, 1698 bp, Artificial Sequence
  Description of Artificial Sequence: Synthetic coding sequence
atggacggcgcatccagcggcggtggcggctctagtgagggaggcggcggatcaagtgggagcggctacggcgttgtggcgcgattctcccaatgcctggctgaatttcgaacatggctgcgaacgaattggctccgattcaatgccgacaagacagatgtgatgttgcccagcgttgagagcagtagccctggtggaagcgcgacctccgatgaccacgagttcgacccaagtgccgacatgctggtgcacgacttcgatgatgagcgcaccttggaagaggaggaaatgatggaaggggagacaaacttctcctccgagattgaagacctcgcccgtgagggcgacatgccaattcacgagcttctgtcactgtatggatatggctccaccgtgcggctgcctgaagaagacgaagaggaagaggaggaggaggaggaaggtgaagacgacgaggacgcagacaatgacgacaattctggttgttcaggagaaaataaggaggaaaacatcaaggactcctcgggccaggaggacgagacccagagctctaacgatgatccttctcagtccgtggcttcacaagatgcgcaggagattattcgccccagacggtgcaaatatttcgatacaaactcagaagttgaagaagagtccgaagaggatgaggattatataccatcagaggattggaagaaggaaattatggttgggagcatgtttcaagccgagattccggttggaatttgtcggtacaaagagaatgagaaagtgtatgaaaatgacgatcaactattatgggatcccgagtacttgccagaggacaaggttatcattttcctgaaggacgcttcccggcgcaccggcgatgagaaaggtgtggaggcaattccagagggaagccacatcaaggataacgagcaggcactctatgaactggtaaagtgcaatttcgacacagaagaggcactccgaaggcttaggtttaatgttaaagctgcccgggaggagctaagcgtctggaccgaagaggagtgcaggaactttgaacagggactgaaggcatatggaaaggattttcatctgattcaagccaacaaggtaagaactagaagcgtgggcgaatgtgtagcgttttactatatgtggaagaaatcagagagatatgacttcttcgcccaacagaccagatttgggaaaaagaaatacaacctccatccgggtgtgacagattacatggacagactgctggacgagtctgagagcgcagcctcatcacgggcaccttctccccctcccacagccagcaactcttcaaattctcagtctgagaaggaggatggaacagttagtaccgccaatcagaacggggtcagttctaacggaccaggcgagatcctgaataaggaagaggtgaaggtggaggggctgcacatcaatggccctacaggcggaaataagaagccgctgcacgctgatatggacactaatggctatgaaactgataatctgactaccgatcctaaactagcgcacatgactgcccggaatgaaaacgactttgatgagaagtctgagcggccagctaagaggcggagagtgaactccaacggcaaggagtctccagggtccagcgaatttttccaggaggctgtgtctcacggcaagtttgaagaattggaaaataccgatgattag

SEQ ID NO: 12371 - DNA, 1302 bp, Artificial Sequence
  Description of Artificial Sequence: Synthetic coding sequence
atggctgagccaagtgtggaatcttcatcccccgggggatctgccactagtgacgatcacgagttcgatccgtctgccgacatgctcgtgcacgactttgatgacgagagaaccctagaagaggaggaaatgatggaaggtgagaccaacttttcctcagaaatcgaggacctcgcaagggaaggcgacatgcctatacatgagctactaagcctgtatggatatggcagtactgtgaggctcccggaagaggacgaagaggaagaggaggaagaggaggagggggaagatgatgaagacgctgacaatgatgataattctggctgcagcggcgaaaacaaggaagagaacattaaggacagttcgggtcaggaggacgagacacagtcatccaatgatgacccctcccagtcagtagcatcacaggatgcccaggagattattaggccaaggcgttgtaaatattttgataccaatagtgaggtcgaggaagaaagcgaggaagacgaggactacattccctcagaggactggaagaaggaaattatggttgggtctatgtttcaagcagagattcccgtgggcatctgtcggtataaagaaaacgagaaggtctacgagaacgacgatcagctgttatgggatcctgagtacttgcctgaagataaagttattatttttcttaaagatgcatccagacgtacaggagatgagaaaggagttgaggcaataccagaaggaagtcacattaaggataatgagcaagctctatacgagctcgttaagtgcaatttcgacactgaggaggcgctgcggaggctaagattcaacgttaaggctgcacgggaggagctgtccgtgtggaccgaagaggaatgcagaaacttcgagcagggcctgaaagcttatgggaaagattttcaccttattcaggccaacaaagtaaggacgcggagcgtaggagagtgtgtggctttctactacatgtggaaaaagtcagagcggtacgacttcttcgcacagcagactcgctttgggaaaaaaaagtacaatttacatccaggcgtaaccgactatatggaccggctgctggacgaaagcgagagtgccgcgtcatcaagagctcccagcccccctccaacagcctcaaactcttcaaacagtcaaagcgaaaaagaagacgggacggtatcaaccgccaatcagaatggggtttccagcaacggtcccgggatactccagatgctgctgcccgtgcacttttccgcaatttctagcagggcaaatgccttcttgaaatag

SEQ ID NO: 12372 - DNA, 1638 bp, Artificial Sequence
  Description of Artificial Sequence: Synthetic coding sequence
atggcagaggcttcttccctgggccgacagagcccgcgcgtcgtgtcctgcctggaacattcgctgtgtcctggggagccaggtttgcagaccaccgctgtcgtgtcaatgggaagcggggaccatcaatttaatctcgctgaaatcctgtcgcagaattattcagtgcgtggcgaatgcgaggaggctagtcgctgcccggacaagcccaaagaagagctagagaaggacttcatttcacagtccaatgatatgcccttcgatgagttgctggctctctacggctacgaggcaagcgacccaattagtgatcgcgaatccgagggaggtgatgtggcacctaaccttcccgacatgacgctggacaaggaacagatagcgaaggaccttctctccggggaggaagaggaagagacacagtcttccgccgacgatctcactccatccgtcacaagccacgaagctagtgatttattccctaatagatctggaagtaggttcctcgcagacgaagatcgggagcccggctcttcagcttcatctgacactgaagaggattcccttcctgccaataaatgcaaaaaagagatcatggtgggtcctcagttccaagccgatttgtccaatctgcacttgaatcggcattgtgagaaaatctatgagaacgaagatcagctgctgtgggacccttcggtcctgccagagcgagaggtggaagagtttctctatcgtgcagtgaaacggcgatggcacgaaatggccgggcctcagcttccagaaggcgaggccgtgaaggacagcgagcaagccctctatgagctggttaagtgtaatttcaatgtggaagaggctctgagacgactgcggtttaacgtaaaagtaatccgagatgggctgtgcgcatggagtgaagaagagtgccggaactttgagcacggcttccgagtgcacggaaaaaacttccaccttatccaagcaaacaaagtgaggacacgctctgtcggagaatgcgtggagtactattatctctggaaaaaaagcgagcggtatgattactttgcgcagcagacaagattgggaagaagaaaatatgtgccgtctggtaccactgatgctgatcaagacctggatggatccgacccagacggccccggtcgtccccgcccagaacaggacacactgaccggcatgcgcacggacccattaagcgtggacggcacagcaggaggtttagacgaaccaggcgtagccagtgatggactcccatccagcgaacccggcccttgtagctttcaacagctagatgagagtccagccgtccccctcagtcatagaccccccgcattagctgaccctgcgagttatcagccagcagtaactgcccccgaacccgacgcctcccctcggctcgctgtggacttcgccctgcctaaagagctgcccctgattagcagccatgtagatctcagtggcgaccccgaggagactgtcgctccagcacaggttgcgctgtctgttacagagttcgggcttatcgggataggcgacgtgaaccccttcttggccgcgcatcctacctgccccgctccagggctgcactctgagccactgagtcactgcaatgtgatgacctgttag

SEQ ID NO: 12373 - DNA, 1653 bp, Artificial Sequence
  Description of Artificial Sequence: Synthetic coding sequence
atggctgaagcctcctttggaagctcctctcccgttggcagcctctcgagcgaggatcacgatttcgatcccacagctgagatgctcgtgcatgattacgacgatgaacggacactcgaagaggaagaaatgatggatgaaggcaagaatttctcgtccgagatcgaagatctggagaaggaagggactatgccccttgaagatctgttggccttctacggatacgagcctaccattcccgcagttgcaaactcatcagcaaatagctctccatcagaactagcagacgagctgcctgacatgacgctggacaaagaagaaatcgccaaagacttgctatctggcgacgacgaagagacacagtcctctgctgatgacctcacaccatcggtgacgagccatgagaccagtgatttcttcccgcgcccactgaggagtaatactgcctgcgatggggataaagaatcagaagtcgaggatgtggagactgattctggcaatagcccagaggacctgcgcaaagaaataatgatagggctgcagtatcaagcagaaatacccccctacctgggcgaatatgatggcaacgaaaaggtgtacgagaacgaggaccagctgctttggtgccccgatgtagtcttagaaagcaaagtcaaagagtacctggtggaaaccagtctgagaacaggttctgagaaaattatggaccgcatctccgcgggcactcatacccgagacaacgagcaggccctgtatgagttgctcaagtgtaatcataatattaaagaggctatagagcggtactgttgtaatgggaaagcctctcaggaaggcatgaccgcatggaccgaagaggaatgtcgctcatttgaacatgcattgatgttgttcggaaaggactttcacctgatacagaagaataaggttagaacacggaccgtcgctgagtgcgttgccttctattatatgtggaaaaaatcggagcggtatgactattttgctcagcagacacgctttggaaagaagagatataatcaccacccaggcgttactgattatatggatcgattggttgatgaaacagaggcactcggcggaaccgtcaatgcttcagccctgacctcgaaccgcccagagcctattcccgaccaacagctgaacattttgaattccttcacggcaagcgacctcacagctctcactaactccgtggcaacagtctgcgaccccacagacgtgaactgcttggacgactcattcccgcccctaggcaatactccacgtgggcaggtgaatcatgtgcccgtggtcaccgaagaattgctgacgctgccaagtaacggcgagtcagattgctttaacctgtttgaaaccggcttctaccatagtgagttaaacccaatgaatatgtgcagcgaagaatcagagcgacccgcaaagagattaaagatgggtatcgctgttccagagagctttatgaacgaggtctctgttaacaacctcggagtggacttcgagaatcatacacatcatattacttccgccaagatggccgtctctgtagctgacttcggctcactgagtgctaacgaaacaaatgggtttatcagcgctcacgcacttcaccaacacgcagccctgcatagtgaatag

SEQ ID NO: 12374 - DNA, 1650 bp, Artificial Sequence
  Description of Artificial Sequence: Synthetic coding sequence
atggccgaagcgagttttggcagctcctcccccgtgggttccttgagctcagaagaccacgatttcgatcctaccgctgaaatgttagtgcacgactatgatgatgaaaggacgcttgaagaggaggagatgatggacgagggaaagaatttctcttccgaaattgaggacctggagaaagagggcaccatgcccctggaggacttactggccttctatgggtacgaacctactataccggcggtggctaatagcagtgcaaatagctcaccatctgagctcgctgacgagctgccagacatgacactagataaggaagagatcgccaaggacctcctgtctggagatgatgaggagacccagtcttccgccgatgatctcacgcctagtgttacatcccacgaaacctctgacttctttcctcggcctctccgatccaatacggcgtgtgacggggacaaagaatcagaggtggaggatgtcgagaccgactctgggaactctcctgaagatctgcgcaaagagatcatgattggactgcagtatcaagccgagattcctccttacttaggagagtacgacgggaatgaaaaagtgtatgaaaacgaggatcagctattgtggtgccccgatgtcgtgctggaatctaaagtgaaggaatatttggtcgagactagtctccgcaccggctccgagaaaattatggacaggatcagcgcaggcacccacacaagggataacgagcaggcactgtacgagttgcttaaatgcaaccataatattaaagaagccattgaaagatactgctgtaacggaaaggcatctcaaggaatgacagcgtggaccgaggaagagtgccgttctttcgaacacgctcttatgctttttggaaaggattttcatttgatccaaaaaaacaaagtgaggaccaggactgtcgccgagtgtgtcgctttctattacatgtggaagaaatctgagcgctacgactactttgcacaacagactcgctttggcaagaagcgttacaatcatcacccaggcgtcaccgattacatggatcggctcgtggacgaaacggaggctttaggtgggacggtgaatgcctctgcgctcacttcgaaccggcccgagccaatccccgaccaacagctgaacatacttaactcattcacagcatctgatctgacagctctcacaaatagtgtagctacagtgtgtgaccccacggatgtgaactgcttggatgactcgtttcctccactcggtaataccccgcgaggccaggtgaaccacgtgccagtggttaccgaggaactgctcacactgcccagcaatggggaatccgactgctttaatttattcgaaaccggtttctatcactctgagctcaatcctatgaatatgtgctccgaggagagtgaacgaccagccaagcggctgaagatggggatcgccgtgcccgagtccttcatgaatgaggtctccgtcaacaacctcggtgtggattttgaaaatcatacccaccacatcacgtcagccaagatggccgttagcgtagcagattttggcagtctttccgccaatgaaaccaacggattcatttctgcccacgctctccatcagcatgccgccttacattccgagtag

SEQ ID NO: 12375 - DNA, 807 bp, Artificial Sequence
  Description of Artificial Sequence: Synthetic coding sequence
atggctcagccactttgcccccctctcagcgagagctggatgctgagcgctgcctgggggcctacccggcggcctcccccaagtgacaaggattgtggccgatccctcgtcagcagccctgacagttggggatcaacgcctgctgattcacctgtagcttccccagctaggcccggcaccctgagggaccctcgggcccctagcgtagggcgcagaggagcaagatcctcacgcttggggtcagggcagagacagtccgcctctgagcgtgagaaactgaggatgcggaccctggcccgtgctcttcatgagctccgaagattccttcctccctcagtggcccccgccggccagtctctcacgaagatagaaaccttgcgacttgcgatcaggtacataggacacctgagtgctgtgctgggcttaagtgaggagtctctccaacggagatgccggcagagaggcgacgccggctccccacgcgggtgccctctgtgccctgatgattgtccagctcagatgcagactcgaacccaagctgagggtcagggccagggcagaggtctaggccttgtctcggcagtaagggccggggcttcttggggatcccccccagcatgccccggcgctcgcgcagctcctgaaccgagagacccaccagcgctgttcgccgaggcagcttgtccagaaggccaggccatggaaccgagcccaccaagcccgttactcccaggcgacgtcctggcccttttggaaacatggatgcctctgtcgccccttgaatggctccccgaggaaccaaaatag

SEQ ID NO: 12376 - DNA, 2007 bp, Artificial Sequence
  Description of Artificial Sequence: Synthetic coding sequence
atggctgctaacatgtaccgcgttggggactacgtatacttcgagaacagctcctctaatccatatctagtaagacgcatagaagaattgaataagactgccaacgggaacgtggaagcaaaggtcgtttgtctattccggcgcagggatatcagttcctcgttgaatagtttagccgattctaatgcaagggaattcgaagaggagagcaagcagcctggtgtaagcgaacagcagcggcaccagctgaagcaccgcgagctgtttctctctcggcagtttgaatcccttcccgctactcatatcaggggaaaatgcagcgtaacattgctgaatgaaactgacatcctatcccagtatctggagaaggaggactgttttttctactccctggtcttcgacccagtgcagaagacactgctagctgaccagggagaaatcagggtcggctgcaaataccaggccgagattccggatcgattggtggaaggggagtctgacaatcgcaaccagcagaagatggagatgaaggtgtgggacccagacaaccctttaaccgacagacagatagaccagtttctcgttgtagccagggcggtgggaacttttgcacgtgcgcttgactgttcttcctccatccggcagccctcccttcacatgagcgctgccgcggcatctagggacattacactgtttcacgcgatggacacactgcagaggaatggatacgaccttgctaaagccatgtctactctggtaccgcaggggggccccgtactgtgccgcgatgagatggaagagtggtccgccagcgaggccatgctgttcgaggaggccctcgagaaatacggaaaagactttaacgacattaggcaagacttcttaccctggaagtcactggcgagcatcgtgcagttctattacatgtggaagaccactgacagatatattcaacaaaaacggttaaaggctgccgaggccgattcaaagctgaaacaggtgtatatccccacctacacaaagcctaatccaaaccagattatttctgtggggtctaagcccgggatgaatggtgccgggttccaaaaagggctcacatgcgaatcctgccataccactcaatcagcccaatggtacgcttgggggcctcctaacatgcaatgtagactatgtgcaagttgttggatttattggaagaagtacggggggctcaagacaccaactcaactggagggcgctacccggggcaccactgaaccccatagtaggggacacctctcaaggcccgaggctcaaagcctctccccgtacaccacctccgctaatcgagccaagctcctcgcgaagaatagacagacctttcttctccaaacgacaaaattaactagattggcccgccgcatgtgtcgcgacctacttcagccgaggagagcggcacggagaccatacgcccctattaatgcaaacgcgataaaggccgagtgctcgatacgcctgccgaaagcggctaaaacaccacttaagattcacccactcgtccgcctgccgctggctaccattgtgaaagatctcgttgctcaggctcctctgaagccgaaaacaccaaggggaacaaaaacaccaataaaccggaaccagcttagccaaaacagggggttaggcggcatcatggtgaagagggcatatgaaaccatggcgggtgctggcgtcccttttagcgccaatggccgtcccctcgccagcggtatcagatcaagcagccaaccagcagccaagaggcagaaactaaatccagccgatgcaccaaaccccgttgtgtttgtcgctaccaaagacacaagggctctacggaaggccctcacccatttggagatgcgaagggcagcaagacggcccaatttgccactgaaggttaaacccacactgattgctgttcgccctcctgtgccgcttccagccccctcccaccctgcttcaacgaacgaacccatcgtcctcgaggactag

SEQ ID NO: 12377 - DNA, 1488 bp, Artificial Sequence
  Description of Artificial Sequence: Synthetic coding sequence
atggagatgaaagtgtgggacccagataacccccttaccgatcgacaaatcgatcagtttcttgtggtggccagggctgttggtacattcgcgcgggccctggactgctcttcgtccatcaggcagccttcactccacatgtcggcggcagccgcctcgcgggatatcaccctgtttcatgcaatggacaccttacaacgcaacgggtatgacttggctaaggcaatgtccacattggtgcctcagggggggcccgtgctgtgccgcgatgagatggaagagtggagtgcaagtgaggcgatgctgttcgaagaagccctggagaagtacggcaaggattttaatgatataaggcaggacttcctgccttggaaatcacttgccagcattgtgcagttttattatatgtggaaaaccacagacaggtatatccaacagaagagactgaaggcagctgaagctgattccaagttaaaacaagtttatattccaacctacacaaagccgaatccaaatcagatcataagcgtaggatccaagccagggatgaacggagcaggcttccagaaagggttgacgtgcgaaagctgtcataccacacaaagtgcccagtggtacgcttggggaccccccaatatgcaatgcaggctgtgcgctagttgttggatctactggaaaaagtatggaggactaaagacccctacccagctcgagggagcaactcgcggcactactgagccacactcacgggggcatctctctaggcctgaagcacagtcactgtccccttatacaacgagcgcgaaccgcgccaagttgttggcaaaaaatcgacagacgttcctgctgcagaccacaaagctgacgcggctagcccgcaggatgtgtcgcgacctactccaaccaagaagagcggcaaggcggccttatgcacctataaatgcgaacgctataaaagcagaatgctctattagattgccaaaggccgcaaagactcctctcaagatacatcctctggtgagattgccgttggcaaccattgttaaggatctcgtcgcccaggctccactaaaaccaaagactcctcggggcaccaaaacgcccatcaacagaaaccagttgtcgcagaatcgtgggctgggagggattatggtgaaacgcgcctacgaaacaatggccggggctggcgtaccatttagtgctaacgggcggcccttggcctctggtattagaagctcatcccagcccgccgctaaaaggcagaagctgaaccccgcggatgcccctaatcccgtagtatttgttgctaccaaggatactagagcccttcgtaaagccctgacacatttagagatgcggcgggctgctaggaggccgaatctccctctgaaagtgaagcccacactgatcgctgtaaggccccccgttcctcttcctgcacctagtcacccagcttccaccaacgagcccatagttctcgaggattag

SEQ ID NO: 12378 - DNA, 1488 bp, Artificial Sequence
  Description of Artificial Sequence: Synthetic coding sequence
atggagatgaaagtatgggacccagacaatcccctgaccgacagacagatcgatcaatttctcgtggttgccagggcggtgggaacatttgcccgcgccctggactgcagttcttcaatccgccaacccagtcttcatatgtctgcagccgccgcctcgcgagacattacgctattccacgctatggacacactgcagcggaacggatacgacctcgcaaaagccatgtcaacactagttccccagggaggtccagttttgtgccgcgatgaaatggaagaatggagtgcaagtgaggcgatgctgttcgaggaagccctcgagaaatatggaaaggactttaacgacatccgacaggacttcctgccctggaaatccctcgcctccattgtgcagttctactatatgtggaagaccaccgatcgctacatccagcagaagaggctcaaggccgcagaagccgattccaaactgaagcaggtttacattccaacctacactaaacctaatcctaaccagattatctcagtaggatctaaaccaggaatgaatggcgccggcttccagaagggcctcacctgcgaatcctgtcataccacacaaagtgcccaatggtatgcttgggggcctcccaacatgcaatgtcggttgtgtgcgtcttgttggatttactggaaaaaatatggcggactgaaaacacctacacaactagagggggccacacggggaactacagagccccatagccgcgggcatctttcacgccccgaggcccagagcttatcaccctacacaaccagcgccaaccgagccaaactgctagccaaaaacaggcagacgttcctactgcagacaactaagctgacgcggctcgccagacgaatgtgtagggacctactgcagcccagaagagccgctcgaagaccttatgcacctatcaacgcgaatgctatcaaagctgagtgcagtatcagattgcccaaggccgctaaaactcctttaaaaattcatcctctagtccgccttcctcttgctaccattgtgaaggacctggttgcacaggcccctttaaaaccgaaaactcccaggggcaccaagactcctatcaataggaaccagctcagtcaaaataggggactgggcggcatcatggttaaaagggcttacgagacaatggcaggggcgggcgtcccattcagcgcaaacggtagacccctggccagtggtattcggagctcaagccagccagcagcaaaaaggcagaaactgaatccagctgatgccccaaaccctgtcgtctttgttgctacaaaagatacccgggccctcagaaaggcattgactcacttggagatgagacgagcagctaggaggcccaatttgccacttaaggtcaagccgacccttatcgcggtgaggccccccgtgccactccccgccccaagccacccagcctcaactaacgagcctatcgtcctggaagactag

SEQ ID NO: 12379 - DNA, 1761 bp, Artificial Sequence
  Description of Artificial Sequence: Synthetic coding sequence
atggcggctaacatgtatagggtgggagattacgtgtactttgaaaactcatcctccaatccctacctcatacggaggatcgaagagcttaataagaccgcatccggcaacgtcgaggccaaagtggtgtgcttttacagaagacgagacataagtaacacactcattatgctcgccgataaacacgccaaggaaatcgaagaggaaagcgaaaccactgtggaggccgaccttacggataaacagaagcatcagctcaagcacagagagttattcctgtctcgacagtatgagtctttgccagcgacccacattcggggtaaatgttccgttgctctgctgaatgagactgagtctgtactatcctacttggacaaagaagatacttttttttacagcctggtttacgatccgtcgttgaagaccctgctggccgataagggggagatacgggtcgggccacgctaccaggcagacattcccgagatgctgcttgagggcgagtctgatgagagggaacaatccaaactggaagtgaaggtttgggatcccaactccccattgactgatcggcagatagaccagttcttggtcgtggcccgagccgtgggaacttttgcccgagctctagactgctctagcagtgtgagacagccctctctccacatgtcggccgccgcagccagccgcgacataacactgttccacgctatggataccctgtacaggcattcctacgatctgtcatctgcgatatccgtgttagtcccactgggcggacctgtcttgtgccgggatgaaatggaggaatggtcagcctctgaggcctcattgtttgaagaagctctcgaaaagtacggaaaggattttaacgacattaggcaggatttcctaccatggaagagtctgacctcgataatcgaatactattatatgtggaaaacaactgatcgatacgtacagcaaaaacggctcaaggccgctgaagctgaatctaagctgaaacaggtttatatcccaacatattccaaacccaacccaaatcaaatatctacctcaaatggcaaacccggcgctgtaaacggagctgtaggtacgacattccagccccagaatcccttgttgggccgcgcctgtgaatcatgttacgcaactcagagtcatcagtggtatagctggggtcctcccaacatgcagtgccgactgtgcgcaatttgttggctgtattggaagaagtacgggggcctcaaaatgccaactcagtcagaggaagaaaaactctcaccctctccaactacagaagatcctcgcgtgagatcacatgtcagccggcaggcaatgcaagggatgccagtgcggaatacgggcagtccaaagtccgccgttaagactcgtcaagcgttcttcctccacacgacctatttcaccaagttcgcccgccaggtctgtaagaatactctcaggctccgacaagctgcccggagaccattcgtcgctattaattatgccgccataagggccgagtacgcagaccgtcatgcagagctaagcggaagtcccctgaaatccaagtcaactcgcaaacctctggcctgcattattgggtatttggaaatccaccccgctaaaaagcctaatgtcataagatctaccccctcacttcaaacccctaccacaaaacggatgcttaccactcccaaccacacaagcttgtctatcctggggaagaggaattatagtcatcataacggcctggattag

SEQ ID NO: 12380 - DNA, 1785 bp, Artificial Sequence
  Description of Artificial Sequence: Synthetic coding sequence
atggccgctaatatgtatagagtcggcgactatgtctattttgagaactctagcagcaatccctacctcattcggcgcatcgaagaactgaacaaaacggcctctggaaatgttgaagcaaaggtggtctgtttctatagacggagggacatcagcaacaccctcatcatgctggctgataagcatgcaaaggagatcgaggaggagagtgagacaacggttgaggccgaccttacagacaaacaaaaacaccaattaaagcaccgcgaattgttcttgagtcgccagtatgaatctttacctgcaacccatattagaggaaagtgcagcgttgcactgctgaacgaaaccgaatccgtccttagttacctcgacaaggaagatacctttttctactccttagtctacgatccatctctgaaaacgctacttgccgacaagggggagatccgagtggggccaagataccaggcagacataccggaaatgctgcttgagggggaatccgacgagagagaacagtccaagctggaggtgaaggtctgggatcccaactctcccctgacagacaggcagatcgaccagtttttagtcgtggcacgagctgttggtaccttcgctagggccctagactgtagtagctccgtgcgccagccaagtctgcacatgagcgccgctgccgcgtcgagggacatcacactgttccatgccatggacacactgtatcggcactcctatgacctttcatccgctatcagcgtgcttgtaccacttggtggccccgtgctgtgcagggacgagatggaggagtggtcggccagtgaggcctcattgtttgaggaggcactcgagaaatacggcaaagactttaatgacattcgacaggacttcctgccatggaaatctctgacgagcatcattgagtattactacatgtggaagaccacggacaggtatgtgcagcaaaagcgcctcaaagctgccgaagcggagtctaaactcaaacaggtgtacatccctacatattcgaagccaaaccccaatcagatttctaccagcaatggtaaaccaggagccgtgaacggcgctgtagggactactttccagccccagaatccattgttgggccgagcttgtgagtcctgttacgccacacaaagtcaccagtggtacagctgggggccacctaatatgcagtgccgcttgtgcgccatttgttggttgtattggaagaaatacggaggattgaaaatgcccactcaatcagaggaggagaagttatcgccaagcccaaccaccgaagatccacgcgttaggtcccatgtaagcagacaggcaatgcagggcatgccggtgcgcaacaccggaagccctaagagcgccgtcaagacccgccaggctttcttcctgcacacaacatattttaccaaatttgcgaggcaggtttgtaagaataccctaagattgcgacaagccgcccggaggcccttcgttgccatcaactatgcagcaataagggccgagtacgctgacagacacgctgaactttcaggatccccgctaaagtccaaaagtacaaggaagcctctggcttgcattattggatacttggaaatacatcccgctaagaagccaaacgtaatcaggagtaccccttcccttcagaccccaacgactaagcgtatgctgactacccctaaccatacctccttgagcatattgggtaagaggaattactcccaccacaacggcctggatgaactcacttgttgcgtgagcgactag

SEQ ID NO: 12381 - DNA, 1548 bp, Artificial Sequence
  Description of Artificial Sequence: Synthetic coding sequence
atggccgccaacatgtaccgggtaggcgattacgtgtactttgaaaatagcagtagtaatccttaccttattagacggatcgaagaactgaataaaaccgccagtggcaatgttgaggctaaggtggtgtgcttctaccgccgccgggatatttccaataccctcattatgctggccgacaagcacgcaaaagagattgaggaggagagcgagactactgttgaagccgaccttaccgataagcaaaaacaccagctcaaacacagagaactgtttttgtcgagacaatatgagagtctgccagcaacccatatccgaggtaagtgctctgtggccctcctgaacgagaccgagtctgtgctctcatatctggataaggaagacactttcttctactcactggtctacgatccatccttaaaaaccctcctggccgataagggagagattagggtggggcccagataccaggccgacatcccagaaatgctacttgagggggaatctgacgaacgcgaacagagcaagctggaggtgaaggtgtgggacccgaattctcccttaacagaccgacagatagatcaatttctcgtggtggcccgggctgtcggtacattcgctcgggcactggactgttcatcaagcgtgcgccaaccgtccctccacatgtcagcagccgcagcaagtcgggacattaccctgtttcatgctatggatacactctatcgccattcctacgatttgagcagcgccatcagtgtcctggtgccccttggcggaccagtcctctgccgcgacgagatggaggaatggtctgcaagcgaagctagcctgttcgaggaggctttggagaagtacggcaaagacttcaatgacatacggcaggattttctcccttggaagtctttgacctcgatcatcgaatattattacatgtggaagacaacggacaggtatgttcagcagaagcgactgaaggctgctgaggctgaatctaagctaaagcaggtatacatccctacatattcaaagccaaaccccaatcagatttccacctcaaacgggaagccaggcgcggtcaatggtgccgtggggacgaccttccaaccgcagaatccattactgggacgggcctgcgagagttgttacgctactcagtctcaccagtggtattcttggggccctccaaacatgcagtgcagactgtgtgcaatctgctggctctactggaaaaaatatggcggtctgaaaatgcccacgcaatctgaggaagagaaactttcgcctagtcctacaaccgaggaccctcgcgtgcgcagccacgtgagccgacaagctatgcaaggcatgcccgtgaggaacaccggcagcccaaaaagtgccgttaagaccaggcaggccttttttctgcacactacatacttcacaaaattcgcaagacaagtctgcaagaacactcttcgccttaggcaagccgcccgcaggccattcgtcgccattaattacgctgcaatcagggcggagtgtaagatgctgctgaattcatag

SEQ ID NO: 12382 - DNA, 585 bp, Artificial Sequence
  Description of Artificial Sequence: Synthetic coding sequence
atggcaaaatcatcacaacggaagcagagagactgcgtcaatcagtgtaagtccaaacccggtctgtcgactagtatcccgctgcgcatgagcagctatacctttaaaaggccagtcacaaggatcaccccccatcctggaaatgaagtgcgctatcaccagtgggaagagagtctggaaaagccacagcaggtgtgttggcagcgtcgtctgcaggggctgcaggcatatagcagtgccggagaattgagttccacactagatctggctaatacattgcagaaactggttccaagctatacaggcggatccctgctcgaggaccttgcgtcaggtcttgaacatagttgcccaatgccccacctggcttgtagtagcgacgctgtggagatcattccagcggagggtgttggcatttcccagctgctgtgcaaacagtttttagtcaccgaagaagacatcagaaagcaagaaggtaaagtcaagaccgtacgggaacgcctggcgattgctctgatagcagatgggttagcgaatgaagctgagaaggtgagagaccaagaaggcagacccgagaaacggtag

SEQ ID NO: 12383 - DNA, 1245 bp, Artificial Sequence
  Description of Artificial Sequence: Synthetic coding sequence
atgctcggcgctctgcctctcccactgtctctaggacagcctccgcccagcccattactgaatcattcattatttggggttcttacaggcggaggcggacagcctcctcctgagcccctcctgccaccccctggtggtccagggcctcctttagccccaggcgagcccgaaggcccgtcactgctggtcgcttctttgctaccacccccaccttccgacctgctcccacctccgtcagcaccaccttctaacctgctcgcttcttttttacccctgctggcgcttgggccaaccgctggggatggtgaaggcagcgccgaaggagctgggggacccagtggggaaccgtttagcgggctcggcgatttaagtccccttcttttccctcccctgtctgccccacctacactgattgccttgaactccgcgttgctcgccgctactcttgatccaccttctgggactcctcctcagccatgcgtgctgtctgccccccaacccgggccccccaccagcagcgtcactaccgctactaccgatcctggggctagctctctcggcaaagccccgtccaactctggaaggcctcctcagcttttgagccccctgctgggcgcaagccttctgggggatctgtcctcactaacatcctcccccggcgccctgcccagtctcctgcaacctcctggccccttgctttctggtcaactcggcctgcaactgcttccgggcggcggagcccctccgccgctcagcgaggcttctagccccttggcctgccttctgcagtccctgcagatcccacccgagcagccagaggccccatgcctgccccctgaatcacctgcttcggccttagagccagagcccgctagacccccactaagcgccctggcgccaccccacggatctcccgacccaccagtcccggaactcctcactggacggggctccggaaagcgaggccgtcgtggcggagggggccttcggggcataaacggcgaggcccggcccgcccgggggagaaagcccggatctaggagagagccagggcgactagccttgaaatggggcaccaggggaggttttaatggccagatggagcgacaggaagagcccactatcgggtcaattatgggcagctggctgaaaggcgtccttagccctagaatacaccccctgcctggaccgattctgcgcactctccgctgcccttccagccaaaaggtgtcatcctggccttag

SEQ ID NO: 12384 - DNA, 3012 bp, Artificial Sequence
  Description of Artificial Sequence: Synthetic coding sequence
atgaacggaggcaacgagtccagtggtgccgatcgggccggcggccctgtggccacgagtgtaccgattgggtggcagcgctgcgttagagagggagccgttttgtatatatccccatctggcacggagctatcaagtctggaacagactaggagttacctcctcagcgacgggacgtgcaagtgcgggttagagtgtccactcaacgtaccgaaggtgttcaacttcgaccctctggccccagttacccctgggggggccggcgtggggcccgcgtccgaggaagacatgaccaagctctgcaaccatcgaagaaaggcagtggctatggccacgttgtataggtccatggaaaccacttgttcacattcctctccaggggagggcgcatctccgcaaatgtttcacactgtcagccccgggcctcccagcgcaaggcccccatgcagggtcccccccacaacccccctcaacggtgggcctggatctcttccaccagagcctcccagtgtaagccaggccttcccgacactcgccggtcctggcggacttttcccacctagactggccgatccagtacccagcggaggatcttcctctccacggtttctgccacgcgggaacgcaccctcaccagccccgccacccccacctgcaatctctctcaacgccccatcatacaactggggcgccgctctgcgctcgtcattggtcccgtcagatcttgggtcacctcctgcccctcacgcgtcctctagccccccctccgaccccccattgttccactgtagcgacgcattgacaccaccacctttaccaccaagtaataacctgcctgcccaccctgggcctgcttctcaacctccagtgtcctcggccactatgcacctaccattggttctcggccccctgggtggagcgccaacagtagaaggacccggggcgcctccctttctagcatcctcgctgttaagtgctgccgcaaaagcgcagcatcctcctctccccccgccctccactctccaaggccgaagacctagagcccaggccccctccgctagtcactcttcttccctgcgaccctctcagcggcggcctaggcggcctccaaccgtgtttcgtctcttagaggggcgggggccacagacacctagacgaagcaggcctagagcccctgctcctgtgcctcaacctttttccctgcccgagccctctcagccaatactacctagtgttttgagcctcctgggactgcccacccctggcccatctcacagtgatggctcattcaacctgctgggctcggatgctcaccttcctccgccgcctaccctgtcctctggctcgcctccccagcctcgccatcccattcaacctagcctgcccggaactacgagtggaagtttaagctccgttcctggcgcacccgcgccacccgccgcatctaaagcacctgttgtgccatccccagtgctccagtcacctagcgagggcctcggcatgggggctggcccagcatgcccactgccacccctcgcaggaggggaggctttccctttccccagtcctgaacagggactggccctgagcggggccggcttcccaggaatgctgggagccttgcctctcccattgagtctcggccagcctccaccgagcccgttgctgaaccattcactgttcggtgtgctgaccgggggcggcggccagccaccccccgagccactactgcccccgcctggcggtcccggacctcctctagcacccggagagcccgagggccccagcttgctcgtggcatctctgttgcccccgcctcctagtgatctgctgccacctccaagcgcccccccgagcaatctgttagcatcgtttctgcccttgctggccctgggccctacggccggcgatggtgaaggttccgctgagggcgccggcggacccagcggtgaaccattctccgggctgggggacttatcccccctcctgttcccgcccctttccgccccacccaccttgatcgcattaaattcggcgctcttggctgcaactctcgaccctccttctggtacgccgcctcagccctgtgttctgtccgccccgcaacccggcccaccaacatcctcagtcacaacagccactacagacccaggggccagttccctggggaaggctccaagcaattctggccgccctccccagctccttagccccctgttgggcgcctcattgttaggcgacctgtctagtttgacctccagtccgggtgccctgccatcgctgcttcagccccctggccctttactcagtggtcagctgggattgcaactcctccccggcgggggagcaccccccccattatcagaggcgagcagccctctggcatgcctgctgcagagtctgcaaataccacctgaacagcccgaggcaccctgcctgcctccggagagcccagcttctgcactggagcccgagcccgccagaccccctctctctgctttggcaccgccacatggatccccggacccacccgtccccgagcttttaacaggccgcggatccggcaagcggggtcgccgaggcggggggggtctgcggggaatcaacggcgaggcccgacccgcgcgagggcgtaagcccgggagtaggcgagaaccaggtcggcttgctctcaaatggggaaccagggggggctttaacggtcagatggaacgttccccacgacgcacccaccactggcaacacaacggcgagctggccgaaggcggtgctgagcccaaggatccgcccccccccggacctcattctgaagatttgaaggtgcctccaggtgtggttagaaagtcgaggcgtgggaggcggagaaagtacaatcctacacggaactccaatagttcacgtcaagacataaccctagagccaagccccactgctagagctgcagtgcctctgcccccgcgggcacgtccaggcaggccagccaagaataagagacgcaaacttgcaccatag

SEQ ID NO: 12385 - DNA, 3012 bp, Artificial Sequence
  Description of Artificial Sequence: Synthetic coding sequence
atgaacggcgggaacgaatcctccggtgcagacagggccggaggtcctgtcgcaacttctgttcccatcgggtggcagagatgtgtgcgagagggagccgtgctctacatctcaccctccggcactgagctctcctcgttagagcagactcgctcatatctactgtcggacggcacctgcaagtgtggcctggagtgcccgctgaacgttccaaaagtgttcaattttgatcccctggcacctgttactcccggtggcgctggcgtgggcccagcttccgaggaggatatgaccaagctttgcaaccacagacgtaaagccgtcgccatggctacgttgtaccgaagtatggagactacatgttctcactccagtccaggcgaaggcgcgtcacctcagatgttccacacagtatctcccgggccacccagtgccagacccccatgtcgcgtgccacccactactccccttaatggaggccccggctccttgcccccagagcctccgagcgtaagtcaagcatttccaacactggcaggtccaggaggcctatttcccccacgcctcgccgacccagttccgagcgggggcagcagttcacctcgtttcctcccaaggggtaacgctcccagtccagcaccacccccaccccccgccatctcactcaacgcgccttcttataactggggggctgctctgaggagcagcctcgttcccagcgatcttggtagcccccccgctccacacgcatcctccagtccacccagcgatccaccactttttcattgcagtgatgcattgacaccaccaccgttacccccatccaataacttacccgcccaccctggacccgcgagccagccccccgtgtcaagtgctactatgcatctgccactggttctgggtcccttgggaggggcccccacggtggagggccccggagctcctccttttctggctagttcccttctgagtgcagcagccaaggcccaacatccacccctgcccccgccctccactctacagggacggcgtcctagagcccaagcgccctccgcgtcacactcgtccagcctccggccttcccagagaaggccaagacggcctcccacagtctttaggctgctagaaggccgaggaccacagacaccacgccgcagtcgtcctagggcccccgcccctgtacctcaacccttttcgctgcctgagccttctcaacccatactaccttctgtgcttagccttctgggcctgcctacaccgggtccaagtcattccgacgggtctttcaatctcctgggaagcgatgcccatttgcctccgccgcctactctctcgagtgggtctccccctcagccaagacatcctatacagccctctttgcctggcacgacttccggaagtttgtccagcgtgcctggtgccccggcacccccagcggcaagtaaagctcctgtcgtgccttccccagtgctacagagcccatccgaggggctgggtatgggtgcaggacctgcttgtccactcccgccactcgccggcggtgaagctttccctttcccctcccccgaacaggggctggctttaagtggcgcaggcttccctggaatgcttggggcacttcccctccccctgagcctgggtcaaccccctccctctcccctgctgaatcactcattgttcggcgtgttgacaggagggggcggccagccaccacctgagcccctgctgccccctcctggtggcccagggcccccgcttgctccaggagaacctgaggggccttcactgctcgttgcctccttactcccccctccgccctctgatctcctgcccccgccgtctgcccctccctcaaacttactagccagtttcctgcccctgctggccttaggcccaacggctggtgatggcgagggaagcgctgagggcgcaggcggaccgtctggcgaacctttcagcgggctaggcgacctgtcgccgctgcttttcccccctctgagcgcgcctccaacgctcattgcactcaactcagcactgctggccgccactctggaccctccttcaggcacgccacctcaaccgtgcgtcttgtcagcaccccaacctggcccaccgacatcaagtgtgacgactgcaactacggacccgggagcctcgagtctgggcaaggcaccttctaattctggacggccacctcagctactaagtccactactcggcgccagcttattaggtgatctgtcttcgctcactagctcccccggagctcttccctctcttttgcagccccccggacctttgctctcagggcagttgggtctgcaattattgccaggggggggggcccccccacctctttctgaagcttcatcacctctggcctgtttactccagtctctccaaatcccacccgagcagcccgaggccccctgtctccccccagaatcaccagcctctgcgctggagcccgagcccgcccgcccccctctcagtgccctggcgccgcctcatgggtcccccgaccctcctgttcctgaactgctcaccggaaggggctcaggaaaacgcggtcggaggggaggcggcggcctgcgcggcatcaacggtgaggctagaccagcacgcggtaggaagccaggatccagaagggagccaggccggctcgccttaaagtggggaactcgaggaggcttcaacgggcagatggaacgttctccaaggaggacccaccattggcaacataacggtgagcttgctgaggggggcgccgagccaaaggacccccctcctcctggaccacacagcgaagacctgaaggtaccccccggggtggttcggaaatctagacgaggccgccgccggaaatacaaccctacaaggaacagtaattcgtcccggcaagatataaccctggagccctccccaactgcgcgcgcagccgtccccttaccaccccgcgctagacccggtcgacctgccaagaataaaagacgcaaactcgctccttag

SEQ ID NO: 12386 - DNA, 162 bp, Artificial Sequence
  Description of Artificial Sequence: Synthetic coding sequence
atgaatggggggaacgaaagctccggtgctgaccgggccgggggacctgtagccacttcagtcccgatagggtggcagcgttgcgtgcgcgaaggtgcggtgctgtatatttctccatcagggaccgagctctcatctcttgagcagacccgctcttattag

SEQ ID NO: 12387 - DNA, 222 bp, Artificial Sequence
  Description of Artificial Sequence: Synthetic coding sequence
atgaacggtggcaatgagagcagcggagccgaccgcgcaggaggtccggtggccacctcggtgccaatcggctggcagaggtgtgtgcgcgagggggcggtgctctacatctccccaagtggaactgagctgagctccctggagcagacacggtcatatctactcagcgacggtacttgcaagtgtggacttgagtgcccacttaacgttcctaaagtatag

SEQ ID NO: 12388 - DNA, 447 bp, Artificial Sequence
  Description of Artificial Sequence: Synthetic coding sequence
atgaacggtggcaatgagtcaagtggcgcagatagggcaggaggccccgttgccacatcagtgcctatagggtggcagcgatgcgtgagggagggcgctgtactgtacatctctccctccggaacagagttgagttccctggagcagacaaggtcctacctactgtcggatgggacatgcaagtgtggtctagagtgtcccctgaacgttcccaaggtgttcaactttgatcctctggcacccgtgacaccaggtggtgctggcgtgggcccagcttctgaagaggatatgaccaaactctgtaatcaccggaggaaagctgtcgccatggcaacgctgtatcgttccatggaaactacctgttcacactccagcccgggagagggggcttccccccaaatgtttcacaccgtgtccccaggtcccccgtcggcacgtcctccctag

SEQ ID NO: 12389 - DNA, 162 bp, Artificial Sequence
  Description of Artificial Sequence: Synthetic coding sequence
atgaacgggggcaatgagagctctggcgcagatagagcaggaggcccagtagccacatctgtacccattgggtggcaacgttgcgttagagagggcgccgtgctgtatatttctccatccggaacagagctgtcctcactcgaacagaccaggtcctattag

SEQ ID NO: 12390 - DNA, 138 bp, Artificial Sequence
  Description of Artificial Sequence: Synthetic coding sequence
atgaatggaggtaatgagtcctcgggggctgacagggctggcggtcctgtggccacctcagtgccaatcgggtggcagcgatgtgtaagggagggcgccgttctctacatatctccatcgggaacagaacttagttag

SEQ ID NO: 12391 - DNA, 672 bp, Artificial Sequence
  Description of Artificial Sequence: Synthetic coding sequence
atgacatccgaagtaattgaagatgagaagcagttttacagcaaagcgaagacgtactggaagcagatcccacctacagtcgacggtatgctcgggggatatgggcacatctcatcaatagacattaactccagtcggaagttcctgcagcggttcctgagagaggggccaaacaagaccggaactagttgcgctctggattgcggcgctggcatcggtcggattaccaagaggctacttttgcctcttttccgagaggttgatatggtggacattacagaggactttctcgtgcaagctaagacatacctcggcgaggagggcaaacgggtcaggaactacttctgctgcggactgcaagacttcacacccgagccggattcttacgatgtgatctggatacaatgggtgattggacatcttactgatcagcacctggcagaatttctgaggaggtgcaagggatcgttaaggcctaacgggattatcgttataaaagacaatatggcccaggagggtgtcattttggatgatgttgactcctctgtatgccgagaccttgatgtggtgagacgaattatctgtagcgccggactgtcattgcttgcagaagagcgacaggagaatctcccagacgaaatataccacgtctactcctttgccctccggtag

SEQ ID NO: 12392 - DNA, 438 bp, Artificial Sequence
  Description of Artificial Sequence: Synthetic coding sequence
atgacaagcgaagtgattgaagacgaaaagcagttttacagcaaggcaaagacctactggaaacagataccaccaaccgtagacggcatgttaggtggctatgggcacatttcctctatagacatcaattcctctagaaagtttctgcagcgcttcctgagggaaggaccaaacaagacaggcactagttgtgcactggactgcggtgccggaatcgggcgcatcaccaagcgcttgctccttccactgtttcgcgaggttgatatggtggatataactgaggatttcctcgtccaggcaaaaacttacctgggcgaggagggtaagcgagcaaccagtccgatctccacctggccttcctcatgcggtgcggccagggctgctagcgcaccaacagcgtcctctagctccaaaaccacctggccccgtagagcctag

SEQ ID NO: 12393 - DNA, 672 bp, Artificial Sequence
  Description of Artificial Sequence: Synthetic coding sequence
atgacctctgaggtgattgaagacgagaaacaattctacagcaaagctaagacttattggaaacagatccctccaaccgtggacggaatgctaggcggttacggacatatttcgtctattgatatcaattctagccgaaagtttctgcagcgcttcttaagggagggtccaaataagaccggaacttcctgcgctctcgactgcggcgctggcatcggccgcatcacaaaaagacttctcctgccactgttccgcgaggtggacatggtggacattactgaagattttttggtccaagcaaagacttatctgggggaggagggtaagcgtgttcgcaattacttttgttgcggccttcaagacttcactcccgaaccagacagttatgacgtcatttggattcaatgggtcattggccacctcaccgaccaacacttggctgagttcctgcgcagatgcaaaggttctttgcgcccgaacggaataattgtgatcaaagataacatggctcaagaaggcgtcattttagatgatgtggatagctcggtgtgtcgggatctagatgtggtccggaggattatatgctctgccggacttagcctgcttgctgaggagaggcaggaaaatctgcccgacgagatctatcacgtatatagtttcgctcttaggtag

SEQ ID NO: 12394 - DNA, 672 bp, Artificial Sequence
  Description of Artificial Sequence: Synthetic coding sequence
atgacctccgaggtaattgaggatgagaagcagttttatagtaaagcaaagacatattggaagcagatcccccctactgtcgacggaatgctgggaggatatggacacatctcaagtatagacattaactcctcacgaaaatttcttcaacgctttcttcgagagggccctaacaagaccggaacgtcctgtgcactggactgtggagctggaatcggcagaattactaagcgcctgcttcttccactcttcagagaggtcgacatggttgatatcaccgaggatttcctcgtccaggcaaaaacttaccttggggaagaggggaagagagtgcgcaactatttctgttgtggtctgcaggatttcacacctgagccagattcttatgacgtgatctggattcagtgggtcatcggccatcttacagaccagcacttggccgaattcctcagaagatgtaagggcagtcttagacccaacggaattattgtaataaaggacaacatggcacaggagggagttattcttgacgatgtcgattcatctgtgtgtcgggacctggacgtcgtgcgccgtatcatctgtagcgctggactatcactcctcgcggaggagcgccaggagaatcttcccgacgaaatttaccacgtgtattcatttgccctaaggtag

SEQ ID NO: 12395 - DNA, 1371 bp, Artificial Sequence
  Description of Artificial Sequence: Synthetic coding sequence
atggacagccgactgcaggaaattcgtgaacgtcagaaactgaggcggcagctgctggcccagcaacttggggccgagagtgccgattcaatcggcgcagttctgaattccaaagacgagcaacgagaaatagctgaaaccagagaaacttgccgcgccagctacgacacttctgctccaaacgccaagcggaaatacctagatgagggcgaaaccgacgaggataaaatggaagaatataaagatgagttagaaatgcagcaagacgaggaaaatctcccctacgaggaagagatctataaagactcttcgacattcctgaagggaactcagtctctgaacccacacaatgactattgtcagcactttgtcgatactggccacaggccacagaacttcatccgggacgtcggccttgccgaccgatttgaagaataccctaaacttagggagctgattagattaaaggatgagctgatcgccaaatccaacacccccccaatgtatctacaggctgacattgaagcatttgacatccgggaactgaccccaaagttcgacgttattctgttagaacctccccttgaggagtactatcgcgagacagggataacggcaaatgagaagtgctggacatgggacgatataatgaaactcgagattgatgagattgccgcccctcgatcttttatcttcctctggtgcggaagtggcgaggggttagatctcgggagggtgtgcctgaggaagtggggctaccggcgctgcgaggatatctgttggattaaaacaaacaagaacaacccaggcaaaactaagacattagaccccaaagcagtcttccagcggacaaaggagcattgcctgatgggcataaagggcaccgtgaaaagaagtacagacggtgacttcatccacgccaatgtggacatcgaccttatcatcactgaagaaccggaaattgggaacatcgaaaagccagtggaaatctttcacatcatagagcacttttgcctgggcagaagaagattgcacctgttcggccgcgacagtacaatcagaccgggatggctgactgtcgggcccaccttaacaaattcaaattacaatgctgaaacctatgcctcctacttctccgccccaaattcatatctgaccggatgcactgaagaaatagagcgcctgaggccaaaatccccgccaccgaagagtaagtccgacaggggcgggggtgccccgaggggtggcggacgaggtggcacgtcagccggccgcgggagggagcgaaatagatcgaatttccgcggggagagaggcggcttccgggggggtcgtggaggtgctcaccgtggcgggtttccacctcggtag

SEQ ID NO: 12396 - DNA, 3399 bp, Artificial Sequence
  Description of Artificial Sequence: Synthetic coding sequence
atgattgctacaccactcaagcattcgaggatttacctgccgccagaggctagttcgcagcggaggaatctccctatggacgctattttttttgactctattccaagtgggacattgacccccgtgaaggatctggttaaatatcagaacagtagccttaagctcaatgatcacaaaaaaaaccaatttttgaaaatgacaacctttaataacaagaatatatttcaatccaccatgctgacggaggccactacctctaactcctcactggatatttctgccataaaacccaataaggacgggctgaagaacaaggccaactacgagagtcctgggaagatcttcctcagaatgaaggagaaggttcttcgagacaaacaagaacagcccagtcggaatagctccctgctcgaacctcaaaagtcagggaataacgaaacgttcactcccaacagagttgaaaagaaaaaactccaacatacctacctgtgtgaagagaaggagaacaataagagtttccagagtgatgattcgtctttgcgggcatccgtgcagggagtgccccttgaatcttctaacaatgatatctttctgcccgtcaagcagaaaatacagtgtcagcaggaaaaaaaggctcctctccacaatctaacctacgaattacccactctcaatcaggagcaagaaaactttctggctgtcgaggccaggaacaagactcttacgcgtgcacagctcgcaaagcagatctttcacagcaaggagtctatcgtggctaccaccaagtcaaagaaagacacctttgtgctcgagtccgtcgactccgcagacgagcaattccaaaacacaaacgccgaaaccctttctacgaattgcattcctattaaaaacggctctttacttatggtgtcagatagcgagcgcactaccgagggaaccagccaacagaaggtaaaggagggaaacggaaagacggtaccgggcgagaccgggctgccagggagcatgaaggatacttgcaaaattgtgctggctactccccggctgcacattaccattccacggcggtccaaacggaacatttctaagctgtccccccccaggatcttccaaactgtgaccaacggtcttaagaaaaatcaggtggtgcagctgcaagagtggatgatcaagagtattaataacaatactgccatctgtgtcgaaggaaaactgatcgatgtgactaatatctattggcatagtaatgtgatcattgaaagaatcgaacacaataaactccgaaccatctctggtaatgtatacatccttaaagggatgatcgatcagatttccatgaaagaggcggggtacccgaattacctgattcggaagtttatgttcggcttccccgaaaattggaaggagcatatcgataactttttggagcagctaagagccggcgagaagaatagggagaagaccaagcagaagcaaaagacaggccggtcagtgagggatatcaggaagagcatgaaaaacgatgccagagaaaatcaaaccgacaccgctcagcgtgccacaacgacttatgactttgattgcgataatctcgagcttaagtcaaacaaacactctgagtcccccggagccaccgagctcaacatgtgccatagtaattgtcagaataaacctacattacgatttcccgacgaccaagtgaacaatacaatccagaacggaggtggcgacgacctcagtaatcaggaattgataggcaaaaaagaatacaagatgagcagtaagaagcttaaaataggcgagcggacaaatgagcggatcatcaagagtcagaaacaagagacaaccgaggaactggatgtcagcattgacatcttgacctcccgggaacaattcttcagcgacgaagagcggaaatatatggccataaatcagaagaaggcatacatcctggtgacaccacttaaaagccgaaaggttattgaacagcgctgcatgagatacaacctctccgcggggaccattaaagccgtcaccgacttcgtgatccccgagtgtcagaagaagagccctatttctaagtctatgggcactttggagaatacctttgagggccacaagtcaaaaaataaagaggattgtgacgagcgagatctgttgacagtcaaccggaagatcaagatcagcaacctggagaaagagcagatgctcacatctgatttcaagaagaacacaagacttctcccaaagctgaagaaaattgagaatcaggtggccatgtctttttataaacatcagtcaagtcccgacctgtcctcagaggaatcagagaccgagaaggagatcaagcgaaaggcagaggtgaagaagacaaaggcaggcaacacaaaagaagctgttgtccacctccgcaagtccacaagaaatacctccaatatacccgtgattcttgagcctgagacagaggaatcggaaaatgagttctatatcaagcagaaaaaagccaggcctagcgtcaaagagactctccaaaaatcaggcgtgagaaaagaatttcccatcacagaagctgttggatccgataagaccaaccggcacccattggagtgcctcccaggccttatccaggataaggagtggaacgaaaaagagctgcagaagctgcattgtgccttcgcttccttgcccaaacacaaacctggtttctggagtgaggtcgccgccgcggtgggctctcggagtcccgaggaatgccaacgtaaatatatggagaaccctcgtggaaaaggctcccaaaaacacgttacaaaaaaaaaaccagcaaattccaaaggacagaacggcaagcgtggggacgccgatcagaagcaaactatcaaaattaccgcaaaggtgggcactctgaagcgaaagcagcaaatgcgtgagtttttagaacagctgcccaaggacgaccatgacgattttttcagtactaccccccttcaacatcagaggatcctgctcccatcctttcaggactctgaggacgatgatgatattctgcctaacatggacaaaaatccaaccacaccaagctctgtgatatttcccctggtgaaaactccccaatgccagcacgtgtctccaggaatgttgggttctatcaatcggaacgactgtgacaaatatgtcttccgaatgcagaagtaccacaaaagtaacggtgggatcgtctggggcaacattaaaaagaaactagtggaaaccgacttttccacccccacccctagaaggaaaacccccttcaacaccgacttgggggagaatagcggcatcgggaaacttttcacgaatgccgtcgagtcactagacgaggaggaaaaagattactacttctcaaattctgattcagcctag

SEQ ID NO: 12397 - DNA, 468 bp, Artificial Sequence
  Description of Artificial Sequence: Synthetic coding sequence
atgatcgcaactcccttgaaacacagtcggatctatctgccaccagaggccagcagccagcggcgaaacctacctatggatgccatctttttcgactccattccctctggaactctgacccctgttaaggacctggtgaaataccagaacagttcgctcaaactgaatgatcataagaagaaccagtttttgaagatgactacgtttaataacaagaatattttccagtcaacaatgctgacagaggcgactacgtccaacagcagtcttgatatctctgctattaagcccaacaaagacgggctcaaaaataaggctaactacgagtctcctgggaagatctttctgcggatgaaggaaaaagtcctgagagataagcaagaacagccgtctcggaacagtagtttgctggagcctcaaaaaagcggtaacaatgagacatttacccctaaccgagtggagaagtag

SEQ ID NO: 12398 - DNA, 702 bp, Artificial Sequence
  Description of Artificial Sequence: Synthetic coding sequence
atggctggagtgcgcagtttgagatgctcacgggggtgcgctgggggttgcgagtgcggagacaaaggcaagtgttctgatagcagtttgctgggaaaaagattatctgaggactcctcgcgtcatcagctcttgcagaagtgggccagcatgtggtcctctatgtcagaggacgcaagcgttgctgacatggagcgcgcccagttggaggaagaggcggcggctgcagaagagcgcccgctcgtttttctgtgttcgggatgtagacggccgctgggtgatagcctcagctgggtggcctcccaggaggataccaactgcatcctcttaaggtgtgtaagttgtaacgtgagtgttgacaaagagcagaaactgtcgaaaagggaaaaagaaaacggctgcgtgttagaaaccctgtgttgtgccggctgttccctgaatctggggtatgtatacagatgcacaccaaagaacctcgactataagcgggaccttttttgtttatccgtggaagccattgagtcgtacgtcctaggctcctcagagaagcagattgtgtccgaggacaaagaattattcaatttggagtcacgggtggagatcgagaaatctctcacacagatggaggacgtcctgaaagctctccagatgaagctttgggaagccgagtccaagttgagttttgccacatgcaagtcttag

SEQ ID NO: 12399 - DNA, 3150 bp, Artificial Sequence
  Description of Artificial Sequence: Synthetic coding sequence
atggaccacaccggagctatcgacactgaagatgaagtcggccccctcgcccacttggccccaagcccccagagtgaggcagtggcccacgaattccaggagttatctttgcagtccagccaaaaccttcctcccctgaatgagaggaaaaatgttctgcagctgagactgcagcagaggagaacgcgagaacagctggtggatcaggggattatgccacccctgaagtctcccgctgctttccatgaacaaatcaagagcttggaacgggcacggacagagaacttcttaaaacacaagatcaggtcccgccctgacagatctgaacttgtgcgcatgcatatcctggaggagacattcgcggaaccgtctcttcaggccacgcaaatgaaactgaagcgggctcggttagcagatgacctgaatgagaaaatcgcacagagaccaggcccaatggaactcgttgaaaaaaacattctgcccgtggatagctcagtgaaagaagccatcatcggagttgggaaggaagattacccccatacacaaggagacttctcttttgatgaagattcttcagacgccctgagcccagaccagcctgcttcacaggaaagtcagggcagtgcagcttcaccctccgagccaaaggtctctgagtccccttcgccggtgacaactaacacaccagcccaattcgcctctgtgtcccctactgtgccggaattcctgaagactccccccacagctgaccaacccccgcccagacccgccgcccccgttctgcctaccaatactgtcagcagcgcaaagcctgggccggctctggtgaaacagagccaccctaaaaatccaaatgataagcaccggtctaaaaagtgtaaagatccaaagccaagggttaagaagctgaagtaccaccagtatataccccccgaccagaaaggagaaaaaaatgaaccccagatggacagcaactatgcacgcctcctacagcagcaacagctattcctgcaattgcagatcttgtctcagcagaagcaacattacaattaccaaacaattctgcccgccccttttaagccactgaacgacaagaacagcaacagcggaaacagcgccctgaataacgcaacccccaatactccacggcagaatacatctactcccgtccgaaaaccgggacccctcccatcttctctggatgacctaaaagtgtcggagttaaagaccgaacttaagctccggggcctgccggtcagcggtaccaaaccagatctaattgagcggctcaagccctaccaggaggtcaactcctctggcttggctgccggtgggatagtggcggtctcatcttccgctattgttacgtctaaccctgaagtaaccgtcgcgcttccagtgacaaccttgcataacactgtaaccagtagcgtctccacccttaaggcggagctgcccccaaccggtacctccaacgctactcgagtggaaaatgtgcactctccccttcctatctccccttctccaagtgagcagtcttccctgtcgaccgatgacaccaacatggccgacacatttacagagatcatgaccatgatgtccccctcgcagtttctatccagtagcccactccgcatgaccaacaacgaggacagtctatcccctacaagcagtaccctgagtaacttagaactggacgccgccgaaaaggataggaaactacaggagaaggaaaagcagattgaggagctcaaaaggaaactggagcaggagcagaaactggtggaagtgctcaaaatgcagctggaagtcgagaaacgtggtcagcaacagagacccctggaggcccaaccttctgcaccgggtcatagtgtaaaatccgaccagaaacacgggtcccttggcagttcgattaaggacgaagcctctttgcctgactgttcaagttccaggcagcctatccctgtggcttcccatgcagttggccagcctgtctctactggcggacagaccctagtagctaagaaagccgtggttatcaagcaagaggtgcccgtgggccaggcggaacaacagtcagtggtgagtcagttctacacttccccacaggccggcatgcagacacagccacaaatagccacagcagcgcagatccccacagctgccctcgcatcgggacttgcccccacggtgccccagacgcaggacacttttcctcagcacgtcctgtcccagccacaacaggtgagaaaagtgttcacaaattctgcttccagtaatacggttcttccctatcagaggcacccggctcccgccgtgcaacagccatttatcaacaaggcctctaatagcgtgctccaatcacgtaacgcaccattgccgtccctgcagaatgggccgaacactccaaacaagccaagctcacccccccctccacagcaattcgttgtgcagcacagtcttttcgggtcgcccgtagcaaagactaaggatcctcctcgatacgaagaggctatcaaacagaccaggagcacgcaagctcccctgcctgaaataagtaacgcccactcgcagcaaatggacgacctgttcgatattcttattaagagtggggagatttccctgccaatcaaagaagagccatcaccaatctctaagatgcgacctgtaacagcaagcatcacgaccatgccagttaacactgttgtgtctaggcctccgcctcaggtgcagatggctcccccagtgagcctagagccaatgggatcactctctgcgagcctggagaatcagttagaggccttcctcgacggcacactgccttcagcaaacgagatccccccattgcagtcatctagcgaagaccgcgaacctttttccttgatagaagatctgcagaacgatctgctctcccatagcgggatgctggaccattcccactccccaatggaaactagcgagacgcagttcgccgctgggacgccttgcctgagtctcgatctctctgactcgaatcttgacaacatggagtggctggatatcacgatgcctaacagcagtagcggtctgacgccgctttctactacggcaccaagcatgtttagcgccgattttctcgacccacaggatctgcctctgccgtgggattag

SEQ ID NO: 12400 - DNA, 3267 bp, Artificial Sequence
  Description of Artificial Sequence: Synthetic coding sequence
atgatcgatagctccaagaaacagcagcagggcttcccagaaatcctgacggccggggatttcgaacccctaaaggagaaagaatgcctggaaggctcaaatcagaagtctctgaaggaggtgttgcagctccgcctgcaacagagacgtaccagggagcagcttgtagatcaaggcattatgcccccactgaaatctccggcggcctttcatgagcagatcaagtctctggaacgtgcacggaccgagaacttcctgaagcataagattcgatctcgccccgatcggagcgaactagtccgtatgcatattctcgaggaaaccttcgcagagcccagcttgcaagcaacccagatgaaactgaaacgggcccggctggccgatgacctcaacgagaaaattgcacaacgtccaggaccgatggagttagtggagaagaacattttgcccgtcgatagctcagtgaaggaggccatcatcggagtcggaaaagaagattatccccacactcagggagatttctcgtttgatgaggactcttcagatgccctatcacccgaccaaccggccagtcaggaatctcagggttcagcagccagcccatctgagcccaaggtaagtgaaagtcccagccctgtgaccactaacactccagctcaattcgcatcagtgtccccaaccgtgcccgaatttctgaagacgcctccgacagcagatcagccaccaccacgtcccgccgcccccgtgctgccaactaacactgtaagctcagctaagccggggccggctttagttaagcaaagccatcctaaaaacccaaatgacaaacatcggtctaagaagtgcaaagacccaaaaccccgggtgaagaaattgaagtatcaccagtacattccaccggatcaaaaaggcgagaagaacgagccccagatggattctaattatgcaagactgctgcaacagcaacaacttttcctgcagctgcagatcctttctcagcagaagcagcattacaactaccagaccatcctccccgcaccattcaaacccctgaacgacaagaattctaactctggaaactcagccctgaacaacgctaccccaaacactcctcgccagaacacaagtaccccagtgaggaaacctgggccgcttccaagttctttggacgatctgaaagtttctgaactcaagaccgagctaaagctgcgggggctgcctgtatcaggaaccaaacctgatctaatcgagaggttgaaaccatatcaggaagtgaattcaagcgggctggccgcaggggggattgtcgcagtgtcttcctccgccatagttacatccaatccagaggtaaccgtggcactgccagtcaccaccttgcataataccgttacttcgtctgtgtccacactgaaagctgagttgcccccaacaggcacctcgaatgctactcgagtagagaatgtgcattccccactgcctatatcccctagtccgagtgagcaatcatcgctgtccaccgacgataccaacatggcggacactttcacagaaatcatgacgatgatgagcccaagccagtttctctcatcaagtccgttacggatgactaataacgaggatagtctaagcccgacatccagcacactgagcaatctggagttagatgctgccgaaaaggatagaaaactccaggagaaagagaagcagatcgaggaattgaagcggaagcttgaacaggagcagaagctggtagaagtgttgaaaatgcagctggaagtggagaagcgcggccagcagcaaagaccactggaagcccagccctctgcccctgggcactccgtaaagtccgatcagaagcatggctctctgggcagttccatcaaagatgaggcctccttgccagactgctcatcatcccggcagcccatacccgtcgcctctcatgccgtcggccagcccgttagtactgggggccaaacactggttgccaaaaaagctgttgtcatcaaacaggaagtccctgtgggacaagcagaacaacaatctgtggtctctcagttttatgtttccagtcagggtcagcccccacccgctgtggttgcccagccccaggcactgctcaccacccagactgcgcagctgctcctgcctgttagtatacagggcagcagcgtgactagtgtccagctcccggtcggatctctcaaactgcagactagcccacaggccgggatgcagacacagccccagatcgcgacagctgcccaaatccctacagctgccttagcttcaggactagcaccaaccgtccctcagacacaggacactttcccgcagcatgtgttgtcgcagccgcagcaggtcaggaaggtgttcacgaactcggcctcaagtaacaccgtactgccttatcagaggcatccggcgcccgccgttcagcagccatttatcaacaaagcctccaattctgtgctgcaatcccgtaatgcccctcttccatctttgcagaacggccccaacacccccaacaagccaagctccccaccacctcctcaacagttcgtagtgcagcatagccttttcggctctccggttgcaaaaacaaaagaccctcccagatatgaggaagcaatcaagcaaacgaggtccacccaggccccgttgcccgaaatctcaaatgcccattctcagcagatggatgatctgtttgacatccttattaagagtggggagatttccctgcctatcaaggaggagccttctcctatcagcaagatgcgaccagtcaccgcgagcatcactaccatgccagtgaacactgttgtctcccggccacctccacaggtgcagatggctcctcctgtttctttggaaccaatgggctctctttcagcttcactggagaaccaactcgaggcttttctcgacggaaccctgccaagcgccaacgagattcctccactgcagtcgtcgtccgaggatcgcgagccgttctctctgatagaggacttgcagaatgacctgttgtcgcattctggaatgctggatcactctcattctccgatggaaacttccgagacccagttcgcagctggtacaccttgcctttcgctggacttatctgactccaatctagacaacatggaatggttagatattacaatgccgaattcttcatcaggtttaaccccgctgtctaccactgctcctagcatgttttctgctgatttcctggacccccaagacctcccactgccctgggactag

SEQ ID NO: 12401 - DNA, 1383 bp, Artificial Sequence
  Description of Artificial Sequence: Synthetic coding sequence
atgatcgattcctcaaagaagcagcagcagggcttccccgaaattctgaccgccggagattttgaacccctcaaggagaaggagtgtctagaaggctctaatcaaaagtccctgaaggaggttctccaactgagactgcagcagagacggacaagagagcagctggtcgatcagggcataatgccccccctgaaatctccagccgcgttccatgagcagatcaaatcgttagaaagagcaaggaccgagaactttctgaagcacaaaatcaggtcgcggccagatcggagcgagcttgtgcgtatgcacatcttggaagaaacttttgcagaaccatcactgcaggctacccagatgaagctgaagagggcccgcttggccgacgacctcaatgaaaagatcgctcagcgccccggtccaatggaactggttgagaaaaacattctacctgtggactctagcgttaaagaggcgataattggagtcggtaaagaggattatccacacacgcagggggacttttcatttgacgaggactcaagtgacgccctctcccctgatcagcccgctagccaggagtcccagggatccgcggcaagccctagcgaaccaaaggtctccgaaagccccagcccagttacaaccaatacgccggctcaattcgcaagtgtctcacctactgtgccagagttccttaagacaccccccacggccgaccagcccccgcctaggccggcagctccggtattgcctaccaacaccgtttccagcgccaagccaggaccagccctagtgaagcagtctcatcctaaaaacccaaacgacaaacacaggtccaagaaatgcaaggaccccaagccacgcgtgaagaaactcaaatatcatcagtatatcccgcctgaccagaagggggaaaaaaacgaaccacaaatggactctaactacgctagactcctccagcagcagcaactctttctccaactgcaaatcctctcacagcagaagcagcattataactatcagacaattcttccagcgccatttaagtatgggggagcgcacgccatcctaaatgcaggctttagtgtttttatgaggaactacaagctgccaaaggtggaatgctgccaccttttcgtgctgtcgaatgactttcatttctttgtgatacgcgcctaccatactgtttcagaggtacatatggtccgtgtggcctgcataccctttcagtttctcagcagcaagatcggatccgagtttcttcaggtgaggaacgctttctcccagctgttcattcagatttgtctgctcctagaacaccagaactcaacacgatgcagcgagaaatcagtgtcttccatcatccctgggattaactcatag

SEQ ID NO: 12402 - DNA, 3732 bp, Artificial Sequence
  Description of Artificial Sequence: Synthetic coding sequence
atggagaactgcagcgccgctagcacttttctgacggactccttggagctagaattgggcactgagtggtgtaaacctccgtattttagttgcgcggtggataatcggggaggaggcaagcatttctccggagagtcctacttgtgctctggcgccttgaagcgccttatcctaaacctggatccattgccaaccaattttgaagaggatacactggagatattcggcatacaatgggtgactgaaactgctttagtgaattctagcagggagctgttccacctgtttcgtcaacaattgtacaacctggaaacgctactgcaaagcagttgcgatttcggcaaggtaagtacactgcactgtaaagccgacaacattagacaacagtgtgtgctgtttttgcactacgtgaaggtgttcatctttcgatacctgaaggtgcagaacgccgagagtcacgtcccagtgcacccatacgaagccttggaggctcaactcccaagcgtgctaattgatgaacttcacgggctgctgttgtacattggtcatctgtccgagctgccctctgtaaatattggggccttcgtgaatcagaatcagattaaactcttccccccgtcatggcaccttctgcatttacacctggatattcactggcttgtgcttgagatcctatacatgctgggagagaagctgaagcaagtggtctacggccatcagtttatgaacctggcctcagataatctaactaatatcagcttgtttgaggagcattgtgagaccctgctatgtgacctgatttcccttagcctcaatagatacgacaaggtgcggtctagtgagagcctgatgagtgaccaatgtccttgcctctgtattaaggaactgtgggtactcctgattcacttgctcgaccataggagcaagtggtttgtctccgaatcattttggaactggttgaacaaattgttgaaaacgctcctcgagaagtcctctgaccggaggcgctcaagcatgcccgtgattcagtctagggaccccctcggcttcagttggtggatcataacccacgtcgcatcattctataagtttgaccgccatggcgtgcccgacgaaatgaggaaagttgaatcaaactggaactttgttgaagaactcctgaagaaaagcatatcagtgcaaggggtgattcttgaagagcagctgagaatgtatttgcactgctgcctcactctctgtgacttttgggaacctaatatcgccattgtgactatcctgtgggaatactactctaagaacttgaattcgtccttctctatttcatggctgccatttaaaggattggcaaacaccatgaaatcccccctgtccatgcttgagatggttaagacatgttgttgtgacaaacaggaccaggaactctacaagtcctcaagcagctatactatcttcctttgcatactggcgaaagtagtgaaaaaggccatgaagagtaacgggcctcatccttggaagcaggtcaaagggagaatttactccaaatttcatcagaaacgtatggaagaactgacagaggtgggcctgcagaactttttctcattatttctgcttttggccgccgttgccgaggtcgaagatgtcgcaagccacgtgttggatctgcttaactttctgaagccagcctttgtgacatcgcagcgcgctctaatctggaaaggccatatggcgttccttcttatgtacgcccagaagaatctggatatcggggttttggccgaaaagttttcttgtgcgttccgagagaaggccaaagagtttctagtgtccaaaaatgaagaaatggttcagcgtcagactatttggacattactgagcatctacattgacggcgtccaggaggtcttcgaaacctcctattgtctctacccctcccatgagaaactgcttaatgacggattttcaatgctgctccgcgcttgcagggaatctgaacttcgaaccgtcctgagctttttgcaggctgtgctggcgagaataaggtcaatgcaccagcaactgtgtcaagagctgcagagagacaatgtcgacttatttgtgcagtcatctctgagtgccaaggaacgtcatttggcggccgtggcatctgccctctggcggcatttcttcagctttctaaaatcacagaggatgtcgcaagtggtgcctttttctcagttggccgatgcggctgccgatttcactttactggccatggacatgccctccactgcgccctccgacttccagcctcagcccgtgatttcaatcattcagctgttcggttgggacgacattatatgtcctcaggtggtggccagatacctgagccatgtgctgcaaaacagtactctatgcgaggccctctctcattccggctatgttagcttccaagccctgaccgtacgaagctggatacgctgtgtgctgcaaatgtatattaaaaatttgtccggtcccgacgatctgctgattgacaagaacttagaggaagccgtcgagaaagagtacatgaagcagttggtgaagttgacccggctcctttttaatctgtccgaagtcaagagcattttcagcaaggcacaggtcgagtacctgtccatatccgaagaccccaaaaaggctctggtcagattttttgaagcagtcggggtgacatacggtaatgtgcagacactctcagataagtcagcaatggtcacaaagtccctcgagtatctgggagaggttctgaagtatatcaaaccctatttgggaaagaaagtctttagcgcaggactccagctcacatacgggatgatgggcattttggtgaagagctgggcccagatcttcgcgacttccaaggcccagaaactcctctttcggatcattgattgcctgctgctaccgcacgcagtactgcagcaagagaaggagttgcccgcacccatgctgagtgcgatccagaagtctctgccgctgtatcttcaagggatgtgtatagtgtgctgtcaatctcaaaatcccaacgcctatctcaaccaactgttggggaatgtcatcgaacagtatatcggtcgattccttcccgcctcgccgtacgtttccgacctcggacagcatcctgtgctacttgcccttagaaataccgcgactattcctcctatatcgagcctaaagaagtgcattgttcaggtcataaggaagagttacctcgaatacaaagggtccagccccccaccacgactcgcttcgatcttggcattcatcctacagctcttcaaagaaaccaacactgacatctatgaggtggagctacttttgccagggatactcaagtgccttgtgctggtctccgagcctcaggtgaaacgtctagccacggagaacctgcagtatatggtcaaggcctgccaggtgggttctgaggaggaaccatcttcccaacttaccagtgtgttcaggcagtttatccaggattatggcatgcgttactactaccaagtgtactccattcttgagacagtggctactctggatcagcaggtcgtgattcatctcatcagtacactaacacaatctctgaaggatagtgagcagaaatggggacttggacggaacattgcccagcgtgaagcctacagcaagctgcttagtcacctgggacagatggggcaggatgagatgcagagactggagaacgacaatacgtag

SEQ ID NO: 12403 - DNA, 867 bp, Artificial Sequence
  Description of Artificial Sequence: Synthetic coding sequence
atgtcatctcgaaaacagggctcgcagccgcggggacagcaaagcgccgaagaggaaaatttcaagaaaccaaccagatcaaatatgcagcgcagtaaaatgaggggcgcaagcagcggaaagaaaaccgccgggccacaacagaagaatttggaaccagctttgcccgggcgatggggcggccggagtgccgaaaatcctccaagcgggtctgtcaggaaaaccaggaaaaataagcaaaagactccggggaatggcgacggtgggtccaccagcgaggccccccagccaccaaggaaaaagcgagcgcgagccgacccaactgtggagtctgaggaagcattcaagaatcgcatggaggtaaaggtgaaaatcccagaagagctcaagccttggctggtagaggattgggatttggttaccaggcagaagcagttgttccagctccccgctaagaaaaacgtcgatgctattctagaggaatatgcgaactgcaaaaagtcacaagggaatgtggacaataaagaatatgccgtgaacgaggtagtcgcgggcatcaaggagtactttaatgtgatgttggggacccagctcctgtataagtttgagaggccccaatacgcagaaattttgctagcgcatcctgatgcccctatgagtcaagtctacggggcgcctcacctactgaggctgtttgtacgcattggagctatgctggcatacaccccacttgacgagaagtctctggcactgttactcggttacctccacgattttctgaagtacttggctaagaactctgcttcactcttcacagccagtgactataaagttgcttcagcagagtatcaccgtaaggcattgtag

SEQ ID NO: 12404 - DNA, 813 bp, Artificial Sequence
  Description of Artificial Sequence: Synthetic coding sequence
atgagcagtcgaaagcaaggatctcagccccgcgggcaacagtccgcagaagaagagaatttcaagaagcccactaggtccaatatgcagaaaaacctggaacctgcactccccgggaggtggggaggacggagtgctgaaaaccctccgtccggatcagtgagaaaaaccaggaaaaataagcagaaaactcctggaaatggggacggcgggagtacaagcgaagcacctcagccacctcgaaaaaagagagcaagagccgaccctacagtggaaagtgaagaggccttcaagaatagaatggaagtcaaagtcaagataccagaagagctgaagccctggctggtggaggactgggatttggtgacacggcagaagcaattgtttcagttacccgcaaaaaagaatgtggatgccatcctcgaagagtatgccaactgcaaaaaatcccagggcaatgtcgataataaggaatatgcagtgaatgaagttgtcgcgggcatcaaggagtactttaacgtgatgctggggacccaactgttgtataaatttgaacggccccagtacgctgagattctgttggctcaccccgacgccccaatgagtcaggtatacggagccccacacctgctgcggctgttcgttcgaatcggagcaatgttagcctacacacctttggatgagaagtcactcgcgctcctgctgggctatcttcatgatttcttgaaatatctcgccaaaaattccgcctcactttttacagcttcagactacaaggtggcatctgctgaataccataggaaagccctgtag

SEQ ID NO: 12405 - DNA, 513 bp, Artificial Sequence
  Description of Artificial Sequence: Synthetic coding sequence
atggaggtgaaggtgaagattccagaggagctgaagccctggcttgtggaggactgggaccttgtaactagacaaaagcaacttttccagctgcccgcaaagaaaaacgtggacgcaatccttgaggagtatgctaactgtaagaagagtcagggaaacgtggataacaaggaatacgccgtgaatgaagttgtggctgggattaaggaatacttcaacgtgatgctgggtacccagttgctatacaagtttgagaggccccaatatgccgaaatcttgttggcccatcctgacgcacccatgagccaggtgtatggcgccccccacttgctccggctctttgtccggatcggcgccatgctggcatacactcctctggacgaaaagagtttggcactcctgctgggttatctgcatgactttttgaaatacctggccaaaaatagcgcaagtctcttcactgcttctgactacaaggtcgctagcgctgaataccatagaaaagcactgtag

SEQ ID NO: 12406 - DNA, 534 bp, Artificial Sequence
  Description of Artificial Sequence: Synthetic coding sequence
atgtctagtcgtaagcagggaagccagcccagagggcaacaatcggctgaagaggagaactttaaaaaacctacccgatcgaatatgcaaaggtccaaaatgagaggggcctctagtgggaagaaaaccgcaggtccacagcagaagaacttagaacctgcacttcccggtagatggggcggaaggtcagctgagaatcccccttcggggtcagtgcgaaagacgcggaaaaacaaacagaaaacgccagggaacggagatggaggttctaccagcgaggcaccacagccgccacgtaagaagcgcgccagggccgaccctaccgtggagagcgaagaggccttcaaaaatagaatggaagtcaaggtgaaaattcccgaagaactgaagccgtggctggttgaggactgggacctggttacccgtcagaaacagttattccagctaccagcaaagaaaaacgttgacgctatcctagaggagtatgcaaattgcaagaagtcccaaggcaatgtcgacaacaaggaatattag

SEQ ID NO: 12407 - DNA, 867 bp, Artificial Sequence
  Description of Artificial Sequence: Synthetic coding sequence
atgtcatcccgtaagcagggctcacagcctcgcggccaacaatcagccgaggaagaaaactttaaaaagccgacacggagtaacatgcagagatctaagatgcgaggtgcaagttctggtaagaaaactgccgggcctcagcagaaaaacctggaacccgcactcccaggccggtggggggggagatccgcggagaatccgccgtcgggcagcgtacgaaagacacggaaaaataaacagaaaacacctggcaacggagatggtgggtcgacctctgaggcaccccagccccctcgaaaaaagagggctagagccgaccccaccgtcgaaagtgaagaggcgtttaagaaccgaatggaggtaaaagtgaagatccccgaggaactcaagccctggctggtagaagattgggatttagtcaccagacagaaacaattatttcaattaccagccaaaaaaaacgtcgatgcaatactggaggaatacgctaattgtaaaaaaagccaggggaacgtggacaataaggaatatgccgtgaacgaagttgttgcaggaatcaaagagtactttaatgtcatgcttggcacccaacttctgtataaattcgagaggccccagtatgccgaaatcttactcgctcatcctgacgcaccgatgtcacaggtctacggggcaccccatttgctacggctgttcgtgcgaattggagccatgttagcttatacaccccttgacgaaaagtcactggctttattgctcggttatttgcacgacttcctgaagtacctggccaaaaactcagcttccttgttcacagcctctgactacaaagtggctagcgcagaatatcatcgtaaggccctatag

SEQ ID NO: 12408 - DNA, 204 bp, Artificial Sequence
  Description of Artificial Sequence: Synthetic coding sequence
atgtccagtagaaagcaggggtcccagccacgtggccagcagagtgctgaggaggaaaactttaaaaagccaacacgctccaatatgcaacgcagtaagatgagaggcgcaagcagcggcaagaagacagcgggcccacaacaaaagaacctcgaaccagcactgccagggcgatggggcggcaggtcagccgagaacccatag

SEQ ID NO: 12409 - DNA, 867 bp, Artificial Sequence
  Description of Artificial Sequence: Synthetic coding sequence
atgagttctaggaagcagggttcccagcccagaggacagcaaagcgcagaggaggagaattttaagaagcccacaaggagcaatatgcagcggagcaagatgcgcggcgcatccagtggtaaaaaaaccgccggcccccaacagaaaaacctggaacctgctctgcccgggcgctggggtggtaggagtgccgagaatccgccttccggcagcgtgcgaaagactagaaaaaataagcagaagacccctggcaacggtgatgggggttccacctctgaagcaccccagccaccacgtaaaaaacgcgcccgcgcagatccaactgtggaatctgaagaggcattcaagaacagaatggaggtcaaagtgaaaattccagaagaattgaagccatggttggtggaggactgggacctggtcactcgccaaaagcagctgttccagctacccgcaaagaaaaatgtggacgccatacttgaggagtacgccaactgtaaaaaaagccagggcaacgtggataataaggagtatgccgtgaatgaagttgtcgcaggcattaaagaatattttaacgtgatgctgggcacccagctcctctacaagttcgagcgaccacagtatgccgaaatcctgctagcacaccctgacgctccaatgtcgcaggtatacggagcgccacacctgctcagactttttgttaggatcggcgccatgctggcttatactcccctagatgaaaaatcactggcgttactcctgggatacctgcatgatttcttgaagtatctcgccaagaattccgcatctttatttacagcttcagactacaaggtggcgagtgccgaatatcataggaaggccctgtag

SEQ ID NO: 12410 - DNA, 867 bp, Artificial Sequence
  Description of Artificial Sequence: Synthetic coding sequence
atgtcgagccggaaacagggatcgcagccccgaggtcagcagtcagcggaggaagaaaatttcaaaaagcctacaagatcaaacatgcaacgaagtaaaatgcgcggtgcttccagcgggaagaaaactgcgggacctcagcagaaaaacctggaacctgcactgccaggtcgatgggggggcaggtcagcagaaaaccctccctcagggagcgtgaggaagacaagaaaaaacaagcagaaaacacctggcaacggcgacggtgggtcaacgagcgaagcccctcaacccccgcgaaaaaagcgtgcgcgtgccgaccccacagttgagtctgaggaggcctttaaaaatcgaatggaggttaaagtgaagatccctgaagagttgaaaccgtggcttgtggaggactgggatctggtgaccagacagaaacagctctttcagctgccggcaaagaaaaacgtggacgctattttagaagagtatgctaattgtaaaaaatcccaaggaaatgtcgataacaaggagtacgccgttaatgaggtggtggctggcattaaagagtatttcaatgttatgctcggaacccagctcctatataagttcgaacgacctcagtacgcggaaatcctgctagcacaccctgacgcaccaatgtctcaggtgtacggcgcccctcacctcttaaggctctttgtacgcattggggcaatgttggcatatacacctctggacgagaaatctctggcgcttctgctagggtaccttcacgacttcttaaagtatctggcaaaaaactcagctagtctctttactgcatccgactataaagtcgcctccgccgagtaccacaggaaagcactatag

SEQ ID NO: 12411 - DNA, 537 bp, Artificial Sequence
  Description of Artificial Sequence: Synthetic coding sequence
atgtcttcccgtaagcagggcagtcaaccacgaggccagcagtctgctgaggaagaaaattttaagaaaccgacgcgttccaatatgcagcggtccaagatgagaggagcaagttctggtaagaaaaccgccggtccacagcagaagaacctcgaaccggccctgccaggacgctgggggggcaggtcggccgagaaccctcccagtggttcagtgcgtaaaactcgaaagaataagcaaaagacccccggcaatggcgatggcgggagcacatcggaggcccctcagcccccccggaaaaagcgtgccagggccgaccctacggtggagtccgaggaagccttcaagaaccggatggaggtgaaggtgaagatcccggaagagctgaagccctggctggttgaggattgggatctagtaactcgccaaaagcagctgttccaactccccgcaaaaaagaacgtggacgccatcctggaggagtacgctaattgtaaaaagtcacagggcaatgttgacaacaaagaatacgcttag

SEQ ID NO: 12412 - DNA, 867 bp, Artificial Sequence
  Description of Artificial Sequence: Synthetic coding sequence
atgtcatcaagaaagcagggttcccagcccagaggccagcagtctgccgaagaggaaaacttcaagaagcctacccggtcaaatatgcagcgttctaagatgaggggcgcctcaagcgggaaaaagactgcgggcccgcagcagaagaatctggagcctgccttgcccggcaggtgggggggcaggtctgcagaaaaccccccttctggctcagttcgcaagaccagaaaaaataagcaaaagactccaggaaatggtgacgggggatctacctcggaagcaccccagcctcccagaaaaaagagggcccgagccgatcctaccgtcgaatcggaagaagctttcaaaaaccggatggaggttaaggtgaaaattcctgaagaactaaagccgtggctggttgaagactgggacctggtaactcgccagaaacagctcttccaacttccggctaaaaagaatgtggacgctatcttagaggagtatgccaattgcaagaagtctcaagggaacgttgataacaaagagtacgccgtaaacgaagtggtggctggaattaaggaatacttcaacgtcatgttggggacacagctcttgtataaatttgaaaggccccaatatgcagagattctgttagcccatcccgatgctccaatgtctcaggtctacggagccccacatcttctccggttgtttgtccgaattggcgctatgctggcatacaccccacttgacgagaagtctctcgccttgcttttgggctacctgcatgatttcctcaaatatctggcaaaaaacagtgcttctctatttactgccagcgattacaaagtcgcttcagctgaataccaccggaaggctctttag

SEQ ID NO: 12413 - DNA, 477 bp, Artificial Sequence
  Description of Artificial Sequence: Synthetic coding sequence
atgtcaagtcgcaagcagggcagtcagccgcggggccagcagtctgcagaggaggagaactttaagaaacccacccgctccaatatgcaaagatccaagatgcggggcgcgagctctgggaaaaagacggctgggccacagcagaaaaacctggaacctgccttgcccggccgctgggggggtcgcagcgccgaaaatcctccatctggtagtgtccgtaagacccgtaagaataaacagaagacccccggcaatggggacggagggagcacatcagaggctccgcagccccctagaaagaagcgcgctcgcgccgatcctaccgtggagtccgaggaggcttttaaaaaccgaatggaggtaaaggtcaaaattccagaggagctgaaaccctggctagtagaggactgggatttggtgacaaggcaaaagcagctgttccagctgccagcaaaaaaaaacgttgacgccatttag

SEQ ID NO: 12414 - DNA, 867 bp, Artificial Sequence
  Description of Artificial Sequence: Synthetic coding sequence
atgagttcacggaagcaagggtcccagcctcgcgggcagcaatccgctgaggaggagaattttaagaagccaacccggtcaaatatgcagcgcagcaaaatgagaggggcttccagcggcaaaaaaacagcagggccgcagcaaaaaaacctcgagcctgccttgccagggagatggggaggacggtccgctgagaacccccccagcggatctgtccggaagactcgaaagaacaagcaaaagactcccggcaatggcgatggcggatctacatccgaagcaccacaaccgcccaggaagaaaagagcccgagcagatcccaccgttgagagcgaagaggccttcaagaacaggatggaagtcaaggtcaaaatcccggaggaactgaagccttggctcgtagaggactgggatctcgttacaagacagaagcagctattccagctccctgctaaaaagaacgtggatgctatcctggaggagtacgccaattgcaagaagagccagggcaacgtggacaacaaagaatatgcagtcaacgaagttgtggctgggataaaggagtatttcaatgtgatgctaggcacgcagctcctctacaaatttgagagacctcagtacgccgagatcttgctcgcccatcctgatgcaccaatgtctcaggtctatggggctccacatctgctgcggctgttcgttcggattggagccatgctcgcctataccccgctggacgagaagtcactggccctgctccttgggtacctccacgattttctcaaatatctggctaagaactccgcttccctttttaccgcgtcagactacaaggtggcttctgccgaatatcacaggaaggcgttgtag

SEQ ID NO: 12415 - DNA, 2046 bp, Artificial Sequence
  Description of Artificial Sequence: Synthetic coding sequence
atggcaccgcaagtatggaggcgtaggacattggagagatgtctgacggaagtcggtaaagctacaggacgaccagagtgtttcctcactatccaagaggggttggcgtcaaaattcaccagccttacaaaggtgctgtacgattttaataagatccttgagaacggcagaatacatggttcacccctccaaaaactggtaatagagaattttgacgacgagcaaatttggcagcagctcgagctgcaaaacgaaccgattctgcagtattttcagaacgccgtttcggagactatcaatgatgaggatatatctcttctccccgagagcgaggaacaggaacgcgaggaagacgggtccgagattgaagcggatgacaaggaagacctggaggatcttgaggaggaggaggttagtgacatgggcaatgacgatcccgaaatgggcgaacgtgcggagaactctagtaagtccgatttgaggaaatctcccgtctttagtgacgaagattctgaccttgatttcgacatctcgaagttagagcagcagagcaaggtgcaaaacaagggccagggcaaaccccgagaaaagtctatcgtcgatgacaaatttttcaaattgtccgagatggaagcttaccttgagaacatcgaaaaagaagaagaacgcaaagacgacaacgatgaggaggaagaagacatcgatttcttcgaggatattgatagcgatgaggatgagggtggcctgttcggatccaagaagcttaaaagcgggaagagttctcgtaatctgaaatacaaggacttttttgaccccgttgaatccgatgaggatatcacgaatgtccatgacgatgaactcgattccaacaaggaggatgatgaaattgccgaggaggaggcagaggagctgtctatttccgagactgacgaggatgatgacctccaggaaaatgaagataataagcagcacaaggaatccttaaaaagggtcacgtttgcactgcccgacgacgcagaaacagaggacaccggagtcctcaacgtgaagaaaaatagcgacgaagtgaagagcagttttgagaaaagacaggagaaaatgaatgagaagatagctagtctcgagaaagagttgctggaaaagaaaccctggcagctccagggcgaggtgactgcccagaaacggcccgagaatagcctgctcgaggagaccttgcacttcgatcacgccgtgcgcatggcgcctgtgattactgaggagaccactctccagctggaggatatcatcaagcagcggatacgtgaccaggcgtgggatgacgtggtgaggaaggaaaaacccaaggaggacgcctatgagtataaaaaaagacttaccttagatcacgaaaagtctaaattaagtctggccgagatctatgaacaggagtacatcaagctgaaccagcagaagacagctgaagaggagaacccagagcatgtcgaaattcagaagatgatggacagtctgtttctaaagttggacgccctgagcaattttcacttcattcccaagcctcctgttcctgaaattaaggtggtgtctaacctgcctgcaattaccatggaggaagtggctcctgtgtcagtgtcagacgctgccttattagcccccgaagagattaaggagaagaataaagctggcgatatcaaaactgccgccgagaaaaccgccacggataaaaagagggaacgtaggaagaagaagtaccagaaaaggatgaagatcaaagagaaagaaaagcgacggaagctgctggaaaaaagctcggtcgatcaggccgggaaatattccaagaccgtggcctccgagaaattgaagcaactgaccaagactggaaaggcttcctttatcaaagacgaaggcaaggataaagccctaaagtcttcacaggcatttttttccaagctgcaagaccaggtcaagatgcaaatcaatgatgccaagaagactgaaaaaaagaagaaaaagcgccaagatatttcagtgcataaactgaaactgtag

SEQ ID NO: 12416 - DNA, 720 bp, Artificial Sequence
  Description of Artificial Sequence: Synthetic coding sequence
atgccaaaaagtaagagggacaagaaagtgtcattgaccaagaccgctaagaaaggcctggagctcaaacagaacctgattgaagagttacgtaagtgtgttgacacctacaagtatctgtttatcttttctgtggctaacatgagaaacagtaaattgaaagacatcagaaatgcatggaaacattcccgcatgttctttggaaaaaataaagttatgatggtcgcccttgggaggtctccaagtgatgagtacaaggataacttgcaccaggtttcgaagcgcctccgtggggaggtgggcctcctgtttaccaatcggactaaggaggaggtgaatgaatggtttactaagtacactgaaatggactacgcccgggccggtaataaagcagcctttacagtgtcccttgatcctggtccactggaacagttcccacacagtatggagccccagctgaggcaattggggctcccaacggcccttaaaagaggagttgtgacactcctgagcgactacgaggtatgtaaggagggtgacgtgttgaccccagagcaggcaagagtcctgaagttgtttgggtacgaaatggcagaatttaaagttactattaaatacatgtgggactcccagagcggccgtttccagcagatgggtgacgacctgccggaaagcgcgtccgaatcaaccgaggaaagtgacagcgaagatgatgattag

SEQ ID NO: 12417 - DNA, 621 bp, Artificial Sequence
  Description of Artificial Sequence: Synthetic coding sequence
atgtccaccggttccgtgtccgaccccgaagagatggagctgcggggcctgcagcgggagtaccctgtgccagcatctaaacgtcctccactccgaggggtggagagaagctatgcgtcaccttctgataattcatcagccgaagaagaggatcctgacggagaggaggagaggtgtgcacttggaacagctggatctgccgagggctgcaaacgaaagaggcccagagtggccggaggcggcggtgccgggggatcagccggcggaggcggcaaaaagcccttgcccgctaagggaagcgcggccgaatgcaagcaatcccagaggaacgcggctaacgcccgtgaacgagcccggatgagagtgctcagcaaagccttctcacgcctgaagacctccctaccctgggttcctcctgacacaaagctatctaaacttgacaccctgcgtctcgctagctcgtatattgctcatctcaggcagctcctgcaagaagatagatatgaaaacggctatgtacatccagtcaatctgacatggccgttcgtcgtttctgggagaccagacagcgatacaaaagaggtttcagctgccaatcgcctctgtgggactaccgcatag

SEQ ID NO: 12418 - DNA, 249 bp, Artificial Sequence
  Description of Artificial Sequence: Synthetic coding sequence
atgagccaggcaggagcccaggaggctcctattaaaaagaagagaccacctgtaaaagacgaggatctcaaaggggctagaggtaacctgaccaaaaatcaggaaattaaatctaaaacttatcaagtgatgcgagagtgtgaacaagctggttcagccgcaccaagcgtgtttagccgcacccggactggcaccgaaaccgtattcgagaaaccaaaagctggccccaccaaatcggtttttggctag

SEQ ID NO: 12419 - DNA, 2508 bp, Artificial Sequence
  Description of Artificial Sequence: Synthetic coding sequence
atggcctcactcggtgccaaccctaggcggaccccccaaggccccagacctggcgccgcctcctcagggtttccaagcccagcccccgtgcccggcccacgagaagctgaagaagaagaagtagaagaagaagaggagttggccgagatacacctctgtgtcctctggaatagcgggtatctaggaatcgcttattatgatacctctgactctacaatccactttatgccggatgcccctgatcacgagagtcttaaactactccagcgcgtccttgacgaaatcaaccctcagagcgtcgtaactagcgctaagcaagacgaaaatatgactagattcctagggaagttagccagccaggagcaccgcgagccaaagcgacctgaaattatctttctgcccagcgttgattttggacttgaaatcagtaagcagcgactgctgtctggcaattactcattcataccggatgccatgacagccacagagaagatcctgttcctatcctcaatcatacccttcgactgtctgctgaccgtgcgcgccctgggtggactcctaaaatttttggggcggagacggatcggggtcgaacttgaggactacaacgtgtccgtccctattctcggcttcaaaaaattcatgctcacccacttagtcaatattgaccaagatacctactccgtgctgcagatcttcaagtctgagtcccacccgagcgtgtacaaagtggcttctggtcttaaggagggactgtctttgttcgggatccttaacaggtgccactgcaaatggggtgaaaagcttttgagactgtggtttacacggcctacacacgacctgggagagttgtcatcccggctggacgtaatccagttttttctgctgccccagaacctggacatggcccagatgctgcataggctgctgggccacattaagaatgttcccttgattctgaaacgcatgaaactgagtcacacgaaagtctccgactggcaggtgctgtataagacggtgtattcagcactaggcctgcgagacgcttgtcgatcccttcctcaatccatacagctgttccgcgatatcgctcaggagttttcagatgacctgcatcatattgccagcctgatcggcaaagtcgtggatttcgaaggttctcttgccgaaaaccgtttcaccgtcctgcctaacattgaccctgagatcgatgagaagaaacggaggctcatgggactgcctagctttctgacagaagttgccaggaaggagcttgagaatctggactcacggattcccagttgttcagtgatatacatcccactaataggcttcctcttgtccatcccacgactgccttcgatggtcgaagcttctgattttgaaattaacgggctggatttcatgttcctgagcgaggagaaactgcactacagatcggcacggactaaagaactcgatgccctcttaggggatcttcactgcgaaatccgcgatcaggaaaccctgctgatgtaccagctccagtgtcaagtgctggcgagagcagcggtgctcacaagagtgctggatctggccagtcgcctggatgtgctgttagccctggcgagcgctgcccgagactacgggtattcgagaccaagatattcaccgcaggtgctcggcgtccggatccagaacggtaggcatccgttgatggagctttgtgcccggacatttgtaccaaactccaccgaatgtggaggcgataaagggagagtgaaggtgattactgggcccaattccagcggcaagagtatttacctcaaacaggtcggactgattactttcatggcactcgtggggagctttgttcctgcggaggaggcagagatcggagccgtggatgccatttttaccagaattcattcttgtgaaagtatctccctcggattgagtacatttatgattgaccttaaccagcaagttgctaaggctgtgaataacgctacagcccagtccctggttcttatcgatgagtttggcaaaggcaccaatactgtggatggccttgccctgctggctgccgtgctgaggcactggttagctagagggcccacctgcccacacatatttgttgcgaccaacttcctctccctggtgcaactgcagctgctcccccaggggcctctggtgcaatacctgactatggaaacgtgcgaggatggcaacgatctggttttcttctaccaggtctgcgagggagtggcaaaagcctcccatgcctctcacaccgccgcacaggctggcctaccggacaagttggtggccaggggtaaggaggtgtcggacttgatccgctccgggaagcctatcaagccggtgaaggacctgctaaaaaaaaatcagatggaaaactgccagaccctggtggacaagttcatgaagctggacctggaagaccctaacttagatcttaacgttttcatgtctcaggaggtgctccccgcagcgacttccattctgtag

SEQ ID NO: 12420 - DNA, 2469 bp, Artificial Sequence
  Description of Artificial Sequence: Synthetic coding sequence
atggcttctctaggggctaacccacgccgtacccctcagggaccgaggcccggcgccgcttcaagcgggttcccaagccccgctcctgtgccaggccctcgcgaagctgaagaagaagaggtagaggaggaagaggagcttgccgagattcacctctgcgtactatggaacagcggttatctggggatagcctactacgatacctccgatagtactatccactttatgcctgacgcacccgaccacgagagcctgaagctgttgcagagagtgttggacgaaatcaatcctcagagcgtagtgacttcagcaaagcaggacgagaatatgactcgattcctcggcaaacttgcgagccaggaacatcgcgagccaaagcgtccagagatcatctttctgccaagtgtggactttggcctggagatttccaagcagagactgctgtcaggtaactattcatttatccccgatgccatgaccgctacagagaagatcctcttcctgtctagcatcataccatttgattgtctgttgacgcctcctggcgatctgcgtttcacgccaattcccctgcttattcccagccaggttagagcgctggggggcctgctcaaattcctgggcagaaggcgaatcggagtggaactcgaagattacaacgtgagcgtgccaatcctcgggttcaaaaagttcatgctaacgcaccttgtgaatatagaccaggatacctatagcgtgctgcagatctttaagtccgagtcacatcctagcgtgtataaggtcgcctctgggttgaaggagggcctcagtcttttcggaatcctgaaccgctgccattgcaaatggggcgaaaagcttctgcggttatggttcacgcgccccactcacgatttgggagagctgtcatcacgactcgacgttattcagtttttcctgctgccgcaaaatctggacatggcacagatgctccaccgactgctcggacatatcaaaaatgtgccactgatcctgaaaaggatgaaactctcccacacgaaggtgtctgattggcaggtattgtacaagactgtgtatagcgctctgggcctgcgtgatgcctgcaggtctctgccccagagcattcaattgtttagggatatcgcccaagaattttcggatgacttgcaccacatcgcaagcctcatcggaaaagtggtggatttcgaaggcagcctggccgagaacaggtttacagtacttccgaatatagatccagaaattgacgaaaaaaagaggagactcatgggtctccccagctttcttaccgaggtggctcgaaaggagctggagaatcttgattctagaatcccctcttgttcggttatctatattcctctgataggatttctgctgtccatccccagactgccctctatggtagaggcatcagatttcgagatcaatggccttgacttcatgttcctatccgaagaaaaacttcactataggagcgcccggaccaaagagctggatgcactgctgggggacctgcactgcgagattagggaccaagagacgttgttgatgtatcagttacagtgtcaggttcttgctcgcgctgccgtgctcacacgcgtccttgatctcgccagcagattggacgtgttgttagctttggcctccgcggcccgggattacggctatagtcggcccagatactcaccccaggtccttggcgttaggatccagaacggcagacatcctctgatggagctgtgtgcgaggacattcgtccccaattcaacagagtgcggaggcgacaagggccgcgtgaaagtcataaccggccccaactccagcggaaaatctatctacctaaagcaggtcggcctgataaccttcatggctttggtaggatctttcgtgcctgctgaagaggccgagatcggggcagttgacgcaatcttcacaagaatccacagctgtgagagcatctccctcggcttatccacgttcatgatcgatctaaatcagcaggttgcaaaagcggtcaacaatgccacagcacagtctctcgtcttaatagacgagttcgggaaaggaaccaatacagtagacggtctagccctgctagccgcagtgctcaggcattggctggcccgggggcccacatgtccacatattttcgtggccacaaactttttaagtctcgttcagctgcagctgctcccccagggtccactcgttcagtatctgactatggagacgtgtgaagacggaaatgacctggtttttttctaccaggtcagtgaccttatccggtccggtaaaccaatcaagcccgtaaaagacttactcaagaagaatcagatggagaattgtcagacccttgtcgacaagttcatgaaactggacctcgaagaccccaacctggacctcaatgtatttatgagtcaggaggttctccctgctgccaccagcatattgtag

SEQ ID NO: 12421 - DNA, 2556 bp, Artificial Sequence
  Description of Artificial Sequence: Synthetic coding sequence
atggcctctctgggagctaacccaaggaggactccccagggcccaagacccggtgctgcatcatcaggtttcccttctcccgcccccgttcctggtcctagagaggccgaggaagaagaggtggaggaggaggaagaacttgccgaaattcacctctgcgtgttatggaactcaggttatctgggcattgcatactatgacacctccgacagtaccattcactttatgcccgacgccccggatcatgaatctcttaagctgctccaaagagtgctagatgagatcaacccacagagcgtggtgaccagtgccaagcaggacgagaatatgacaagattcctgggcaaactagcctcacaggagcatcgcgagccaaagagacctgagatcatcttccttccttccgttgattttggactcgaaatatctaagcagcgtctgcttagtggcaattatagttttataccggatgcaatgaccgctaccgagaaaatactgttcttgtctagtattattccattcgattgcttgctgacacccccaggtgatctgagatttactccaatcccactcctcataccaagtcaagtccgcgccctgggaggactgctaaagttcctgggccgacggaggattggagtggagctggaagactacaatgtctccgtgccaattctgggattcaagaagtttatgctcacacacctggtaaatatcgaccaggacacctactccgttctgcaaatcttcaagtcagagtctcacccaagcgtctacaaggtagcctctggactgaaagaaggtctgagcctgttcggaattctcaatcgatgccattgcaagtggggcgagaaattactgaggctgtggttcactcggcctacccatgatctgggcgagcttagtagtcggctggatgtgatccagtttttcctcctgccccagaacctggatatggcacaaatgctgcaccgacttttaggacacataaagaacgtaccactcatcctgaagcgaatgaaactttcccacacgaaagtttcggactggcaggtcctgtataagactgtttattccgcgttgggcttgcgcgacgcatgtaggtccttgcctcagtcaatccagctgtttcgggatatcgcccaagagttttctgacgatctgcaccatattgcctcactcattggcaaagttgtggacttcgagggctcccttgcggaaaacagattcacagttcttcctaatatcgaccctgaaatcgatgagaaaaagcgccgcctcatgggcctgccgtccttcctgaccgaggtcgctcggaaggaacttgaaaacctggactctcggattccctcttgttcagtgatttacatcccactcatcggatttttactcagcatcccgaggttgccttccatggtggaggccagcgattttgagatcaacggccttgatttcatgtttctgtcggaagagaagctgcattatcgtagcgctcgaacaaaagagctggatgcactgctgggtgatctacactgcgaaatccgtgaccaggagaccctgctaatgtaccagctccagtgccaggtattggcaagagccgcagtgttgactcgggttctggacctggcctcgcgcctcgatgtgttgctggctctagctagtgcagcccgcgactacggatatagccgaccccgctactccccgcaggttttgggtgtcagaatacagaacggcagacatcctctaatggaactttgtgcccgcaccttcgttcctaattctacagaatgcggaggggacaaagggcgcgttaaggtcattacgggaccaaattccagcggcaagtccatatacctgaagcaggtggggctgatcacattcatggctttagttggatctttcgtgcctgcggaggaggccgagattggggcagtcgacgccatctttactagaattcattcatgcgagtcaataagtttgggtctgagtactttcatgatcgatcttaaccaggtggcaaaggccgtgaacaacgccactgcccagtccctggtactgatcgatgaatttggcaaagggacaaacaccgtggatgggctggccctccttgcagcagtgctacgccattggctcgctcggggccccacctgccctcacatattcgtcgcaactaactttctcagcctggtgcagctccagttactgcctcagggcccactggtgcagtacctgaccatggaaacttgcgaggacggtaacgacttggtttttttttaccaggtttgcgaaggcgttgccaaggcatctcacgcaagtcacaccgctgctcaagccggtctgcccgataaattggtcgcccgcgggaaggaggttagcgacttgatccggagcggcaagccaatcaaacccgtgaaagatctgctgaaaaaaaatcagatggagaattgtcagacgctcgtcgataaattcatgaagttggacctggaggatccgaacttggacctgaatgtttttatgtcgcaggaggtgctcccggcggcaacctccatcttatag

SEQ ID NO: 12422 - DNA, 2505 bp, Artificial Sequence
  Description of Artificial Sequence: Synthetic coding sequence
atggcctctctgggagctaaccctagaaggactccgcagggaccgaggcctggggccgctagctctggtttccccagccctgcccccgtgccaggtcctcgggaggcagaggaggaggaagtcgaggaggaagaagagctcgccgaaatccacctttgcgtactttggaactctggttacctcgggatagcttactatgacacaagcgactctaccatacacttcatgccggacgctccagaccacgaaagtttaaagctgctgcagagggtcctagacgagatcaatccccagtccgttgttacctcggctaagcaggatgagaacatgacccgctttcttgggaagctggcctcccaagaacacagagagccaaagagaccagagattatcttcctgcctagcgtggattttggactggagatctcaaagcagcgtttactgagtgggaactactccttcattcccgacgccatgacagcaacagaaaaaattctctttctgagttccattatcccgtttgactgtctgctcaccgtgagagccttaggggggctgcttaagttcctggggcgccgtcgcatcggcgtcgaactagaagattacaatgtgtccgttccgatcctgggcttcaagaaattcatgctgactcacttggtcaacatagaccaggacacctactctgtgcttcagatcttcaagagtgagtcccacccatctgtctataaggtggctagcgggctcaaagaaggcctctcactcttcgggatcttaaacagatgtcattgtaagtggggggaaaagttgcttagactgtggtttaccagacccacccacgacctcggcgaactgtctagccgcttggatgtgatacagttttttttattgcctcaaaacctcgatatggcccagatgctgcaccggctgcttggacacataaaaaatgtcccgctcatcctaaagagaatgaagctcagccatacaaaggtgtccgactggcaggttctgtacaaaaccgtgtatagcgccctcgggctcagagacgcctgcaggagcttacctcagagcatccagttgttcagggatatcgcccaggagtttagtgacgatctgcaccacattgcatccttaataggcaaggtcgtggactttgagggatcacttgccgagaatagattcacagttcttcccaatatcgatccagagatagatgagaaaaagaggagactaatgggtttgcccagtttcctgaccgaggtggcaaggaaggagttagaaaaccttgattcccgcataccttcatgcagcgtaatctatatccccttgatcggttttctgctctcaatccctcggcttcctagcatggtagaggcaagcgatttcgaaataaacggattggactttatgttcctcagcgaggagaaattgcattacaggtctgcacggaccaaggagttggacgcgctcctcggagatctccactgtgagatccgtgatcaagagaccttactgatgtatcaacttcagtgtcaagtgcttgcccgggccgcggtgctgacaagggttctcgacctagcaagtaggctggatgttctgctggcgctggcaagcgcagcacgggattatggttatagtcgccctagatactccccccaggttctcggtgtgcgcattcagaacggacggcaccctcttatggaactgtgcgcccgcacctttgtgccgaactccacagaatgtggaggggataagggccgcgtgaaggtcatcaccggcccgaattcatcaggaaagagcatctacctgaagcaagtcgggctgatcaccttcatggctttggtcggatcattcgtgccagccgaggaggccgaaatcggcgcagtcgatgccatcttcactcggatccacagctgcgagagtatttcactggggctgagtacttttatgatcgatctgaaccaagttgctaaggcagtcaacaatgccacagctcaaagcctcgtgctaattgatgagttcggcaaagggactaatacagtggacggtcttgccctgctggcagcagtgctgcggcactggctggccagaggcccaacttgtcctcatattttcgtggctactaattttctgtccttagtgcagctgcagctgcttccccagggacccttagtgcagtatctgaccatggagacatgcgaggacggaaacgatttggtttttttttatcaggtgtgcgaaggagttgccaaggcgtcgcatgcctctcacactgcagcccaagctggtctgcctgataaactcgtcgctcgcggcaaagaagtaagcgacctgattcgctcgggcaaacccattaaacctgtgaaagatctactgaagaagaaccagatggagaactgccagacccttgtggacaagttcatgaagcttgacttggaagatccaaacctggacctcaacgtgtttatgagccaagaagtgctgccagccgccactagtatcctctag

SEQ ID NO: 12423 - DNA, 2505 bp, Artificial Sequence
  Description of Artificial Sequence: Synthetic coding sequence
atggctagccttggagcaaatccccggcgtactccacagggtccccgacctggtgccgcctcttctggatttcctagccccgcccctgtgccaggcccccgggaggctgaagaggaagaagttgaagaggaagaagaactggcagagatccacttgtgcgtgctgtggaatagtggctatctgggcatcgcttattacgacacctccgactccactatccactttatgcctgatgcaccagaccatgagagcctgaagctcctgcagagagtccttgacgagatcaatccccagagtgtggtgaccagtgccaaacaggacgagaacatgacgcgcttcctgggtaaactggctagccaggaacatagagaaccaaagaggcctgaaatcatttttctgcctagcgtggacttcgggctggagatttccaagcaacgactgctctctggcaactatagtttcatacccgacgccatgacagccaccgaaaaaatactcttcttaagcagcatcattcctttcgattgtctgctgaccgtccgggccctcggtggattgttaaagttcttgggtcgaaggaggatcggagtggagttggaagattataacgtttcagtcccaatcctaggctttaagaagtttatgctaacacacctagtcaatattgaccaggacacttactctgtactccagatctttaagagcgaaagccatccatcagtatacaaagtcgcgagtggcctcaaggagggactatctctgtttgggatcctgaacagatgtcactgcaaatggggggagaagctgctccgcctctggtttactcggcccacccacgacctcggagagctgagcagtcggctggatgtcattcaattcttcctccttccacagaacctggacatggcccagatgctgcacagacttctgggacatattaagaacgtgcctttaattctgaagcggatgaagctctcacatacaaaggtgtcagactggcaagtgttgtataagacagtgtatagtgctctggggctgcgcgacgcttgccgttccctgccccagagtatccaactcttcagagacatagctcaggagttcagcgacgacctccaccacatcgccagcctcatcggaaaagtggtggattttgagggttcgctggctgagaaccgcttcacagttctgccaaacattgaccctgagatagacgaaaaaaaacggcgtctaatgggcttaccctcctttctgacagaggtggcacgcaaggagcttgaaaacctggactccaggatcccgagctgtagcgtgatatatattccgctcataggattcctcctttccattccaaggcttccctcaatggtcgaagctagtgacttcgagataaacggcctggatttcatgtttctgtcagaagagaaactgcactacaggagcgctagaactaaggagctggatgctcttctcggagatcttcattgtgagatcagagatcaggaaaccttgctgatgtaccaattgcaatgtcaggtcctagctcgggctgccgtactgacccgcgtactggacctggcatccaggttggatgttctattggcgctcgcctccgcagcccgcgattacgggtactcgcgccctcggtactccccacaggtgctcggcgtccgcatccagaatggtcgtcaccctcttatggagctctgcgctcggacatttgtgccaaactcaaccgaatgcggtggtgacaaagggcgtgtgaaggttattaccggtcccaactccagtggcaaaagtatctacctgaaacaggttggtctcattacattcatggctctcgtgggatcattcgtgccagctgaggaggcagagattggtgcggtggatgccatcttcacacgcatccacagctgtgagtccatttcactcgggttatcgactttcatgatcgaccttaatcaagtggcgaaagcagtaaataatgctactgcccagtccctcgtgttgatagatgagtttggaaagggaactaatacagtggatggcctggccctcctagccgcagtccttcggcactggttggcgcgcggtcctacatgcccgcacatcttcgtggccaccaatttcctgagcctcgtgcaacttcagctcttgccacagggccccctggttcagtacttaactatggagacatgcgaggatgggaatgatctcgtgttcttctaccaggtatgtgaaggtgtggctaaggcttcccatgcttctcacacagctgctcaggctggcttgcctgacaagcttgtggctcggggaaaggaagtctctgaccttataagatctggaaagccaattaaacccgtgaaggatctcttgaagaaaaaccagatggaaaattgtcagactctggtagacaagttcatgaaactcgacttggaagaccccaacctggatctgaacgtgtttatgagccaggaagtgcttcctgcagccacttcaattctgtag

SEQ ID NO: 12424 - DNA, 816 bp, Artificial Sequence
  Description of Artificial Sequence: Synthetic coding sequence
atgttcttgtctgaggaaaaacttcattacagatctgcacgcacaaaagagctggacgcccttcttggagatctgcactgcgagatcagagaccaggagaccctgcttatgtatcaacttcaatgccaggtgctggctagggccgccgttctgactcgcgtcctggatctggcctcccgacttgatgtgctgctggccctggcttcagccgctcgcgattacggctactcacgccctcgctatagcccccaggtgctcggggtcaggatccaaaatggacgtcatccactgatggaactgtgcgcgcggactttcgtgccaaatagcaccgagtgcggaggggataagggaagagtgaaggtgatcacggggcccaattccagtgggaagtccatctatctaaaacaagtagggttgatcactttcatggcactagtaggttctttcgtccccgcagaagaggctgagatcggagcggtggacgctatttttacccgtatccactcatgtgagtcaatcagtctcgggcttagcactttcatgattgatttaaaccaggtcgcgaaggccgtgaacaatgctacagcccagtctctcgttctgattgatgaattcgggaagggtacaaacaccgtcgacggactggccctgctagccgccgttctaaggcattggttggccagggggcccacatgtccacatatctttgtggctacaaacttcctgtctctggtccaactccagctccttccccagggacccttggtgcagtacctggattggccccgcgtttctggccaggagggaggtgactag

SEQ ID NO: 12425 - DNA, 1002 bp, Artificial Sequence
  Description of Artificial Sequence: Synthetic coding sequence
aagattcttttcctatccagtatcatccctttcgactgtctgctaaccgtgcgagctttaggcggactgttaaagttccttggaaggcgtcggattggagtggagctcgaggattataatgtatctgttcccatccttggtttcaaaaaatttatgctgacccacctggtaaacatcgatcaggatacgtattctgtcctgcagatcttcaagtccgaaagccatcccagtgtctacaaagtggcttccggtctcaaggaaggcctgagtctcttcgggattctgaatagatgccattgcaagtggggggagaaattgctacgactctggtttactaggcccacacatgacctcggagaacttagctcccgcctagatgtcattcagttctttctcctgccacagaatctggacatggctcagatgctgcatagattactaggccacatcaaaaacgtgcccctaattctgaaacgcatgaagctatcacatactaaggttagcgactggcaggtgttatataaaaccgtatatagcgcattaggcctacgtgacgcttgcaggtcgttacctcaatcgatccaactgtttagggatatagcccaggagttcagcgatgatctccatcacatagcgtccctgatcgggaaggtgtatttatctccacaggtcgactttgagggcagtttagccgagaacaggtttacggtgctgcccaacatcgatccagagattgatgagaaaaaaaggagactcatgggcctgccaagcttcctgaccgaggtggcccgtaaagagcttgagaatcttgacagccgcatcccaagttgctctgtgatatacattcccctaattggtttcctactgtccatacctagactcccaagtatggttgaggcatctgatttcgaaataaacggattagattttatgttcctctccgaagaaaaactgcattacaggagtgcccgcactaaggagctcgatgctcttctcggatag

SEQ ID NO: 12426 - DNA, 1527 bp, Artificial Sequence
  Description of Artificial Sequence: Synthetic coding sequence
atgtggcctgtcctcctcttcgtctttctttctcagaccgtttactcagcactgggattgcgcgatgcttgcaggtccctcccacagagcattcaactgtttagggatatcgctcaggaattcagcgacgacttgcatcatattgcgagccttattggcaaggtggtggattttgagggctctctggccgaaaataggttcaccgttctgccaaacattgatccggagatcgacgaaaagaagaggagactgatgggcctgcctagtttcctgactgaagtggcccgaaaagagctggagaatttagattctcggatacccagttgtagcgtgatttatatacctcttattgggtttttgctctctattccaaggctgccatcaatggttgaggcgtctgattttgagatcaatggcctagactttatgtttttgtctgaagagaagctccattatcggagcgcgcgcaccaaagagctggacgctcttctgggagacctgcattgtgagattcgggaccaggaaaccttgttgatgtatcagctgcagtgtcaggttctggcccgggcagcagtgctgaccagagtgctagatctggcctcaagattggatgtccttctggccttggcctctgcagccagggattatggctattcccgcccaagatattccccccaggtcctcggagtcaggattcagaacggtcggcaccctttgatggaactgtgcgcaagaacctttgtgcctaatagcaccgagtgtggcggagataagggacgggtgaaagtaataacggggccgaactctagtggaaaatccatctacctaaagcaggtggggttgattactttcatggccttagtggggtctttcgtccctgccgaagaggctgaaatcggcgctgtggatgcaatctttactcgaatccactcttgcgagagtatttctctcgggctgagcacattcatgatcgatctgaatcaggtggcgaaggcagtgaacaatgcgactgcccagagccttgtcctgattgatgaatttggcaagggaaccaacaccgttgacggactggcactcctagctgctgtcttgcgtcactggctggcacgcggccccacgtgcccacacatatttgtcgcgaccaatttcctgtcactggtccaattacagctgctccctcaaggccctctggtgcagtatctgactatggaaacgtgcgaggatggcaatgatctagtattcttttaccaggtgtgtgaaggagtcgcgaaagccagtcatgctagccacactgctgcccaagccggactgccagataagctggtcgctaggggtaaagaggtatcagatctgatccgcagcggaaagcccatcaaaccagttaaggaccttttgaagaaaaatcaaatggagaactgtcagactctggtggacaagttcatgaagctcgatttggaggacccaaacctggatctcaacgtgttcatgagccaggaagtgctcccagcggccacaagtatcttatag

SEQ ID NO: 12427 - DNA, 2505 bp, Artificial Sequence
  Description of Artificial Sequence: Synthetic coding sequence
atggcctctctcggcgccaacccgcggcgcacaccacagggaccccggcccggtgccgcctcgagtggctttccttccccggccccagtccccggccctcgagaggccgaagaggaggaggtcgaagaggaagaagaactggccgagatacatctctgtgtgctgtggaattccggctatctgggcatcgcatactatgataccagtgatagcaccatccactttatgccagacgcacccgatcatgagtcgctgaaattactgcagagggtgctggacgaaattaatcctcagagcgtagtgacaagtgccaagcaagacgaaaatatgacaaggtttctgggtaaattggcgtcccaggaacatcgagagccaaagaggcctgaaatcatctttctgcctagtgttgactttgggctggaaataagtaagcagcgactgctgtccgggaattacagcttcattccagacgctatgaccgctacagagaagatcctttttttatcgtcaattatccccttcgactgcttattaacagtgagagccctgggtggcttgctgaagttccttggccggcgcagaatcggtgttgaattggaggattataacgtgagtgttccaattcttggctttaagaagttcatgctcacccacttggtaaacatcgatcaggacacatatagtgtccttcagatcttcaagtcagaatcacacccctctgtatacaaggtggcatctgggttgaaagagggcttgtctctgttcggaatattgaatcgttgtcactgtaaatggggggagaaactcttgcgtctgtggtttacacgacctacccatgaccttggggaattgagcagccggctggacgtcatccagtttttcttgctcccacagaacctagatatggcccagatgcttcacagactgttgggccatataaagaacgttcccctgattctcaagcgcatgaagcttagccatacaaaagtgagcgattggcaggtgctgtacaaaactgtgtactccgcactgggcctgagagacgcctgcaggtcattgcctcaatccatccagctgttcagagacatcgcccaggaattcagtgatgacttacatcacattgccagccttattggtaaggtggtagacttcgaaggatcattggcagaaaacagatttactgtgctcccgaacattgatcccgagatcgacgagaaaaagcggagactgatggggttaccctcatttctaacagaagtcgccagaaaggaactagaaaatctcgactctcggattccctcttgttctgtgatctatattccgcttattggctttctgctctctatccctagactgcctagcatggtcgaggctagcgattttgaaattaatggcctggatttcatgtttttatcagaggaaaagttgcactataggtctgcacgcacaaaagagttagacgccctgcttggtgacttgcactgcgagatccgcgaccaggagaccctgctaatgtaccagctgcagtgccaggtactggctagggcagccgtactaacccgggtgctagacttggcgagtcgcctcgatgttttgctcgctcttgcgtccgccgccagggactatggctactcaagacccagatattctccgcaggtcttgggcgtaaggatccagaatgggaggcaccccctcatggagttgtgcgcgcggaccttcgtgcccaacagcaccgaatgcggaggggacaagggtcgtgtgaaggtgattaccggacctaacagctccggcaaatccatttacctgaagcaggtgggattgatcacctttatggctctggtgggatccttcgtgccggctgaggaggcagaaatcggcgctgtcgacgccattttcacccggatccactcctgcgagtctattagtctcggactgagcacatttatgatcgacctgaaccaggtggccaaggctgtgaacaacgcaacggctcagtcgttagttctcatcgacgagtttggcaaagggaccaacaccgtggatggattggcccttttagcggccgtgctgcgccattggttggcccgaggtccgacctgcccacatatattcgtagctaccaactttctcagcctggtgcagctgcagttgttacctcagggccccctggtccagtacctgaccatggaaacctgcgaggatggaaacgacctggtattcttttatcaggtttgtgaaggagtcgcgaaagccagccacgccagccacactgctgcccaggcaggacttcccgacaagttggtagcgcgaggcaaagaagttagtgacctgatcaggagtggaaagccgattaagcccgtcaaagacctccttaagaaaaatcagatggagaactgccaaaccttggtcgacaagttcatgaagctggatctggaagacccgaacttagacttgaatgtctttatgagccaggaggtgcttcccgcggctacgtccatactttag

SEQ ID NO: 12428 - DNA, 2508 bp, Artificial Sequence
  Description of Artificial Sequence: Synthetic coding sequence
atggcatctctcggggctaatccgcggagaacccctcagggcccccggcccggtgcagcatcttcaggctttccctcccccgcccccgtaccaggaccaagagaagccgaagaggaggaagtggaggaggaggaggaactagcggaaatccacctgtgtgttctgtggaacagcggatacctgggaatcgcttactacgatacatcagattcaaccatccacttcatgccagacgccccagaccatgagagcctgaaacttctgcagagggtgttggacgaaatcaatccccagtctgtggttacttctgcaaagcaggacgagaatatgaccagatttctagggaagctggcctctcaggagcatagagaaccaaaacgccccgagataattttcctgcctagcgtcgactttggtctggaaatctcaaagcaaagacttctctctggcaattacagttttatcccagatgctatgacagctactgagaagatactctttctcagtagtattattccctttgactgcctgttgacagtacgcgcgctgggggggctgctaaagttcctgggcagacgtcgtatcggggtcgagcttgaggactacaatgtgtccgtccccatcctggggtttaagaaattcatgttgacccacctagtcaacatcgatcaggatacgtacagtgttttacaaatcttcaaatctgagagtcatccctctgtgtataaggtggccagcgggctgaaggaagggctgtcactgtttggcattcttaacagatgtcactgtaaatggggagaaaaactcctcagactctggttcactaggcctacccacgacctgggggaattgtcatccaggctcgatgtgattcaattctttctgctcccccagaacttggacatggctcaaatgctccaccggcttctgggccatatcaaaaatgtgcccctgatcttaaaacgtatgaagttatcgcacacaaaagtaagcgactggcaagtgttatataagaccgtatacagcgctctcggactaagagacgcctgccgcagtctgccacaaagtatacaactcttcagagatattgcccaggagtttagtgacgatctgcaccatattgcttctttgataggtaaggtggtggatttcgaggggtctttggccgagaatcgatttacagtcttaccgaacattgatcccgagatcgacgaaaagaaaagacggctgatggggctgccttcttttctcaccgaagtggcgagaaaagagctcgagaatctcgattctcggatcccatcttgttctgtcatttacatccctttaattgggtttcttttgtcaattcctagactgccatccatggtggaagctagcgactttgagatcaacgggctggactttatgtttctttcagaggagaaattacattatcggagcgcacgtacgaaggaactcgatgctcttctgggcgacttgcattgtgagataagggaccaggaaacactactaatgtatcagcttcaatgtcaggtgctggcgcgggctgccgtactgacaagggtgctggatttggcaagccgcctcgatgtgctccttgcacttgccagtgccgcacgcgactatggatactctaggcctagatatagtcctcaagtgcttggagtgcgcattcagaatggtcgccaccccttgatggaactttgtgcccggacgtttgtgcccaattcaacggagtgcggcggagacaaaggaagagtcaaggttattacgggcccgaatagcagtggaaagtctatttatttgaaacaggtgggactgataacctttatggccctggtgggatcgtttgtgccggccgaagaggcagagataggagccgtcgatgcaatctttacacgcattcatagctgcgaaagtatctccctgggactcagtacattcatgattgatcttaaccagcaagtcgctaaagctgtaaataacgccacagcacagtccttggtactgattgatgaattcgggaagggcactaacactgtggacgggctagctctcctggctgcagtccttcggcactggctcgccagggggccaacttgtccgcacattttcgtggccacgaacttcctgtctctggtgcaattgcagctgttacctcagggacccctagttcagtacctcacaatggaaacctgcgaagacggtaacgacctggtttttttctatcaggtctgtgagggagttgccaaagcgagtcacgccagccacacagccgcccaagcgggcctcccggataagttagtcgccagaggaaaggaggtgagcgatctgattagatccgggaaacctatcaaaccagtgaaagacttgctgaagaaaaaccagatggagaattgccagaccctcgttgacaagtttatgaaactggatttagaggacccaaatttagatttgaatgtcttcatgtcccaggaagtactgcccgctgccacaagcattctgtag

SEQ ID NO: 12429 - DNA, 585 bp, Artificial Sequence
  Description of Artificial Sequence: Synthetic coding sequence
atggcctccctgggagccaaccctcggcggacaccccagggccctcgccctggagcagcctcatccgggtttccaagcccagctcccgtccccggcccaagggaggccgaggaagaggaggtagaggaggaggaggaactggctgaaattcacctttgcgttctgtggaactctggttacctggggattgcctattatgatacatctgattcaaccatccattttatgcctgacgccccagaccacgagagcctgaagctgttacagagagtgctagatgagattaatccacagtccgtcgtaacaagtgccaaacaggatgagaacatgacgagattcctgggcaagctagcctctcaggagcatcgagaacctaagagaccggagataatttttttgccatctgtggactttgggttggagatttccaagcagcggctgctctccggaaattattctttcatccctgatgcaatgaccgcgaccgaaaaaattttatttttgtcctctatcatccccttcgactgccttctgaccgtcagagctctgggcggcttattgaagtttctgggccggcgacggtag

SEQ ID NO: 12430 - DNA, 585 bp, Artificial Sequence
  Description of Artificial Sequence: Synthetic coding sequence
atggcgagccttggggcgaaccctagaaggacaccacaaggccctcgccctggtgccgcgtcatctggatttcccagccccgcccccgtacccggaccccgggaagccgaggaagaagaggttgaggaagaggaggagctggccgagatacatctctgcgtgttgtggaattcaggatacctggggatcgcctactacgacacttcggatagcaccatccattttatgcccgacgccccggatcacgaaagcctgaagctcttgcagagagtgctggacgaaataaacccacagtccgtcgtgacaagtgccaaacaagatgaaaatatgacaaggtttctgggcaagctggctagccaggaacatcgggagccgaagcggccggagatcatttttctgccttctgtggactttggactggaaatttctaagcaaagactgctgtcaggaaactactcattcattcctgatgccatgacagctaccgagaagattctgtttttgtcttcaattattccattcgattgtctgttgactgtgcgagcacttggcggtctgctcaaattcctgggccgaagacggtag

SEQ ID NO: 12431 - DNA, 2505 bp, Artificial Sequence
  Description of Artificial Sequence: Synthetic coding sequence
atggcctccttaggagccaaccccagacgcacccctcagggccccagaccaggagcggcttcaagcgggtttccttctcctgcccccgttccgggcccccgggaggccgaagaggaagaggtggaggaggaggaagagctggcagagattcatctgtgcgttctttggaatagtggttatcttggcattgcctactacgacactagtgatagcacaatacattttatgcccgatgcccccgatcacgaatctcttaagcttttacaacgcgtgctggatgagattaacccacagagtgtggtgacttctgccaagcaggacgaaaacatgacccggttcctcggcaagctggcctcccaggaacaccgggagccaaaaagacccgagattatctttttgcctagcgtagattttggtctcgagatcagtaaacagcgtcttctctccggtaattacagcttcatcccagatgccatgactgctacagagaaaattctatttctgtcctccattatcccctttgactgcctgctcacagtacgagccctgggcggactcctcaagtttttggggcggagaagaattggagtggaactggaagattacaatgtctctgttcccattttagggtttaagaagttcatgctcacacacttggtcaacattgaccaggacacctattccgtgctccagatatttaaaagtgagtcacacccaagcgtctataaagtggcctcaggactcaaggaggggctctcacttttcgggatcttgaatcgctgccattgcaaatggggtgagaagctgttgagactgtggtttaccaggccaacccacgaccttggggagctatccagtcgcctggatgtgatccagttcttcctactgccacaaaacctagacatggctcagatgctgcaccgcctcctgggacatataaagaacgtaccgctgatcctgaaacgtatgaagctttcacacactaaagtttctgactggcaggtcttgtacaagacggtctattccgccctaggtcttcgagatgcttgcagaagtctgcctcagagcatccaactctttcgggatattgcccaggagttttccgacgacctccaccacattgcaagtttaattggaaaggtggttgacttcgaggggagtttggcagaaaatagatttactgtgctcccaaatatagacccggagattgacgagaagaaaaggcggctgatgggtctgccgtcattcttgactgaagtagcccggaaggagcttgaaaatctagactctcgcatcccttcatgctcagtgatttatattcctctcatagggtttctcttgtccatccctaggctgccttccatggtcgaggcatcagacttcgaaattaatggcctggacttcatgttcctctccgaagagaagctccactatagatccgcccgcacaaaagagctcgatgctctactgggagatctgcattgcgagatcagggaccaggagacgctcctcatgtaccaacttcaatgccaggtcctagcgagggccgcggtgttgacccgggtgttagacttggcctctagactggatgtgctgctcgccctggcctcagcagcgagagactacggatattctaggcccaggtactcaccacaggtgctcggggtgcggattcagaatggacgccatcctctaatggaactgtgcgcccggacgttcgtccccaattccacagaatgtggaggtgataaggggagggtgaaagtgattaccggcccaaattcatctggtaagtctatctatctgaaacaggtgggcctgatcaccttcatggctctcgtgggatcgttcgtgccggctgaagaagctgaaataggagcagtggatgctatttttacgagaatacactcctgcgagagcatctccttgggcctgtcgacctttatgatagatctgaaccaggtggcaaaagcggtgaataacgccactgctcagtctttggtcctgatcgacgagttcggcaaaggcacgaacacggtggatggattagccttgcttgctgccgtcctgagacactggttggccagaggtcctacatgtccacacatcttcgtggcaactaacttcctgtctctggttcagttgcagctgttaccccagggcccactggtgcaatatctcactatggagacatgtgaggatggtaacgatctagtcttcttctaccaggtttgcgaaggggtcgcaaaggcctcacatgcatctcacacagctgcacaagccgggctgccagacaagctagtggcgcgggggaaggaagtttctgaccttatacgttccggtaagccaattaagccagtgaaggacctgctgaaaaagaaccaaatggaaaattgtcagacactggtcgataagttcatgaagcttgaccttgaagatcctaacttagacctcaatgtttttatgtctcaggaggttctcccagcagccacctcaatcctctag

SEQ ID NO: 12432 - DNA, 585 bp, Artificial Sequence
  Description of Artificial Sequence: Synthetic coding sequence
atggctagcctgggcgccaatccgcggaggaccccccagggaccacggccaggagccgctagttctggattcccttcgccagcgccagtccctgggccccgggaggccgaggaagaagaggtggaagaggaagaggaactggccgaaattcatctttgtgtgctgtggaattccggttacctcggaatagcatactacgacacctccgattcaaccattcacttcatgcctgatgcacctgaccatgaatcgcttaaactgctccagcgggtgctcgatgagatcaacccccagtctgtcgtgacaagcgctaagcaggacgaaaatatgacccgattcctcgggaagttggcgagtcaggagcatcgggaacctaagaggcctgagattatcttcctgcccagcgtggactttggccttgagatcagcaaacaacgactcctctctgggaattactcctttattccagatgccatgactgccacagaaaagatcttgttcctgtcatccatcatcccatttgactgtcttctgacggtgagggccctaggagggttattaaaatttttgggtcggcggagatag

SEQ ID NO: 12433 - DNA, 1602 bp, Artificial Sequence
  Description of Artificial Sequence: Synthetic coding sequence
atggcccagatgctgcatcgcctactaggccacattaagaacgttcctttgattctgaagagaatgaagctgagtcacacaaaagtgtcagactggcaggttttgtacaagacagtgtacagtgctcttgggctgcgggatgcttgccgttctctccctcagtcaatccagttgttccgagacattgctcaggaattcagtgacgacctgcatcacattgcctcattaatcggcaaagtggtggacttcgaggggtcccttgccgagaaccggtttaccgtgctcccaaatatagaccccgagatcgatgagaaaaagcgcagactgatgggcctgcctagcttcctcacagaagtggcgagaaaggagttggagaacctggattcgaggattcccagttgctctgtgatctacatcccattgattggtttcttgctgtcgatcccgaggttgccgagcatggtggaggcaagcgatttcgagatcaacggccttgactttatgttcctgagcgaagaaaagttgcactaccgatctgcccgaacaaaggaactcgatgcccttttgggtgatctgcactgcgagatccgcgaccaagagactctcttaatgtatcagcttcagtgccaggtcctggccagggccgccgttctgaccagagttttagatctggcatcccgccttgatgttctgctcgctcttgccagtgccgcgcgggattacgggtattctaggccccgctacagcccccaagtactgggtgtacgtatccagaacggtcgccacccccttatggagctctgtgcacggaccttcgttccaaactcaaccgaatgcggaggggataagggacgagtcaaggtgattacaggtccgaactcttccggaaagtcaatttacctgaagcaagtgggcctcattaccttcatggctctcgtgggttccttcgtacctgctgaggaagcggaaatcggtgcagtcgacgccattttcacaagaattcatagctgcgaaagcattagtctgggcctgtctacctttatgatagatctaaatcaggtggccaaggccgttaacaacgcgactgcacagtctctagtcctgatcgacgagttcggcaaaggtactaatacagttgacgggctcgccctactggctgcagtgctccgccactggcttgcaagagggccaacctgccctcacatcttcgtcgctaccaacttcttgagcctggtccagctgcagctccttccccaaggcccactcgttcagtacttaacaatggaaacctgcgaggacggcaatgacctcgtgttcttttatcaggtgtgcgagggggtggccaaagctagccatgcatcacacaccgccgctcaggccgggctgccagacaagctggtggctagaggtaaggaggtgtctgatctgattcgatcaggaaagcccatcaagccagtgaaggaccttctgaaaaagaatcagatggaaaactgccaaaccctcgtggataaatttatgaaacttgatctggaagaccccaatctggatctgaacgtgtttatgagccaggaggtgcttcctgccgctacctctatcctttag

SEQ ID NO: 12434 - DNA, 2508 bp, Artificial Sequence
  Description of Artificial Sequence: Synthetic coding sequence
atggcatctctaggcgccaaccctcggaggactccacaggggccacggcccggcgccgcttcaagcgggttcccctcccccgcccctgtgcccgggcctagagaagcagaagaggaggaggtcgaggaagaagaagagctggccgagatccatctgtgtgtcctgtggaattctgggtatcttgggattgcctattatgatacttctgatagtactattcattttatgccagacgctcccgatcatgagtctctgaagctacttcagagagttctggacgagatcaatcctcagtctgtggtcacatccgctaaacaagacgaaaacatgacccgatttttgggaaagctggcttcgcaggaacaccgtgaacccaaaagacctgagatcatctttctgccctccgtagactttggtctggagatctcgaaacagagactgctgagcggcaattacagctttattcccgacgcaatgacagctactgaaaaaattctctttttgtctagcatcattcctttcgactgcctgcttactgtgcgcgccctcgggggattgcttaagtttctgggacgcagacgtattggcgtggagcttgaggactacaatgttagtgtccccatattagggttcaaaaaattcatgcttactcacctcgtcaacattgatcaggatacatactccgtcctccagattttcaagagtgaaagtcacccctctgtgtataaggtggcctccggcctcaaggaagggctaagtctgttcgggattttgaacagatgccattgcaaatggggtgaaaaactgttgcgtctatggtttactaggcctacccatgatctcggcgaattgtccagcaggctggacgttatccaattcttcctgctcccacagaacctcgacatggcacagatgttacatagattgctgggccatattaagaatgtcccccttatcttgaagcgcatgaaactgtctcacactaaggtgagcgattggcaagtcctgtataaaacagtctattccgctctgggactccgggacgcctgtaggtctctgcctcagtccatccaactcttccgggatatcgcccaagaattctctgacgatctccaccacatcgccagcttaattggtaaagtagtggactttgagggctccctcgcagaaaatcgctttacggtgctccccaatattgatcctgagatagacgaaaaaaagaggagactcatgggtctccctagctttctgaccgaagtggcccgtaaagaactagagaaccttgatagccgaatcccttcatgcagcgtgatctacatcccactcatagggtttcttctctccatccctcgtctaccgagcatggttgaggcctccgacttcgagattaacggcttagactttatgttcctgtctgaagagaagttgcactaccggagcgcgcggacaaaagagctggacgctctgctgggtgatttgcattgcgaaatccgggaccaagagaccctgctaatgtatcaacttcagtgccaggtcctggcacgggctgctgtgcttaccagagtcctggacctggcatcgcgcctggatgtcttgcttgccctagcctccgctgcaagagactatggatattcaagacctagatatagtccccaggtcctgggagtcaggatccagaatgggcgccacccacttatggagctgtgcgcgaggaccttcgtaccaaacagcaccgagtgcggcggagacaagggcagggtgaaagttattactgggcctaactcgagtggaaagtctatctatctcaagcaggtcggattgataacctttatggccttagtaggtagctttgtccccgcggaggaagctgagataggtgcagtggatgccatctttactcgcatacattcgtgcgagagtatctccctagggctctcaaccttcatgattgacctcaatcagcaagtcgctaaagctgttaacaacgcaacagcccagagcctggtgctgattgatgaattcgggaaaggtaccaatactgtggatggactagctctgctggccgctgtgctgagacattggctggcccgaggccccacttgtccgcacatcttcgtggctacaaacttcctgagtttagttcaactccagctcttaccacagggaccactcgtgcagtatctcactatggagacgtgcgaggacggaaacgaccttgtctttttttaccaggtttgtgaaggggttgccaaggccagccacgcctcccacactgctgctcaagccggcctgcccgacaaactcgtagccaggggcaaagaagtgtctgacctcatacgaagtggaaagccaatcaagcctgtcaaggacctgctgaagaaaaaccagatggaaaactgccaaacactagtggacaagtttatgaaactggacctagaggatcccaatttggacctgaacgtgttcatgtcacaagaggtgttaccagccgcaacctccattctgtag

SEQ ID NO: 12435 - DNA, 1002 bp, Artificial Sequence
  Description of Artificial Sequence: Synthetic coding sequence
aagattttattcctgagctcaattataccctttgattgtctcctgaccgttagagcactgggagggcttctcaaatttctcggccgtcgaaggataggggtggaactcgaagactataacgtatcagtgcccatcctcggtttcaagaaatttatgcttactcatttggtgaacatcgatcaggatacatattctgtgctgcagattttcaaaagcgagtcacatccctctgtgtacaaagtggcctctggtctaaaagaggggttaagtctttttggtatcctcaacaggtgtcactgtaaatggggcgaaaagctcctgagactgtggttcaccaggccaacccacgatttgggtgagcttagcagccgactggacgtcatccagttcttcctgctccctcagaacctggacatggcccagatgctccatagattgttggggcatattaaaaatgtacctctgattctgaaaagaatgaaactgtctcacactaaagtgagcgactggcaggtcctctataaaactgtgtattccgccctgggactgcgggatgcttgcagaagtctgcctcagagtatccaattattcagagacattgcacaagagttcagcgacgatctgcatcatatcgcatccctcattgggaaggtgtacttatctccccaggtcgattttgaaggttcactagccgagaaccgctttactgtgctgccaaatatcgaccccgagattgatgagaagaagagaaggctcatggggctgccgtctttcctgaccgaggtggcgagaaaagagttagagaacttggattccagaatcccaagttgctccgttatctatattccactgatcggcttcctgttgtcaataccgagattgcctagtatggttgaagcgagtgatttcgagattaatggtctcgattttatgttcctgtcagaagagaagctccactatagatctgccagaaccaaagagctggatgctctgttgggctag

SEQ ID NO: 12436 - DNA, 2508 bp, Artificial Sequence
  Description of Artificial Sequence: Synthetic coding sequence
atggccagcctgggcgcaaatccacgccgcacaccacagggacctagacccggtgcagcatcctctggcttcccctctcctgcccccgtgccaggccccagggaggctgaggaagaggaggttgaggaagaggaggaattggccgaaatccacctgtgcgttctctggaatagtggctacctcggcattgcctattacgacacttccgacagtaccatccattttatgcctgacgccccggaccacgagagcttgaaattgctgcaaagagtgctcgatgagatcaacccccagtcagtcgtcacttctgcgaaacaggacgagaatatgacgagatttctgggtaagctggcaagccaagagcatagggaacccaaacgcccagaaataatattcctgccctcagttgatttcggactggaaatctcaaagcagcgtttactgagcggtaattatagcttcattccagacgccatgacggccaccgaaaagattctgtttctcagcagtatcattccctttgactgtctgttaacggtgcgcgccctgggtgggttgctcaagtttctaggccgacgcagaattggagtggaattggaggactataatgtcagcgtgcctattctgggctttaagaagttcatgctgacccacctggtgaacatcgaccaggacacctacagtgtgcttcagatttttaagtcagagtcacatccttcagtctataaagtagcgtctggattaaaagagggcctgtccctgttcggcatcctgaaccgatgtcactgcaagtggggcgagaagctgttgaggctgtggttcacacgaccaacccatgatctgggcgagctgtcgagcaggctcgatgtcatccaatttttcctgttgccccagaatctcgacatggcacaaatgctgcacaggctgctcggccacattaagaacgttccactgatcctgaagcggatgaaactgtcccacacgaaggtgtcagattggcaagtgctgtacaaaacagtttattcggctctcggactgagagacgcgtgtaggtccctccctcagtcaattcaactgtttcgcgacattgcccaggaattcagcgatgacctgcaccatattgcctcactgattggtaaggtcgtggacttcgagggatcactagcagaaaaccgctttaccgtgcttcccaatatagacccggagatagatgaaaaaaagagacgattgatgggtctgccgagcttccttactgaagtcgcccgaaaagagctcgagaatttagattccaggatcccaagttgcagcgtgatttacatccccctcatcggtttcctgctcagcattcctaggttgccttctatggtggaggcctcagattttgaaattaacggtctggactttatgttcctttcagaagaaaagcttcactatcgctcagcacgaacaaaggagctggacgccctgctaggagaccttcattgcgaaatcagagaccaggagactctcttaatgtaccagttgcagtgtcaggtccttgctcgggccgccgtgctgactcgcgtgctcgatctagccagcagattagatgttctgcttgctctcgccagcgccgccagagactatgggtactcgcggccaaggtattcaccacaggtacttggagtccgcattcagaacggccggcatcccttgatggagctctgtgcccgcacctttgtacctaattctaccgagtgtggaggagataaagggagggtaaaggtcatcacaggtccaaatagctccggcaaatctatttacctcaaacaggtggggttgattaccttcatggctttggttggatcatttgtgcccgcagaagaagccgaaatcggcgccgtggatgctatatttacgcgcatacattcatgtgagagcattagtctgggactcagtacatttatgatcgatctgaatcaacaggtggctaaggctgtcaacaacgccactgcccaaagtcttgttctgatcgatgagtttggtaaggggacaaacaccgttgatgggctcgcgctccttgccgccgtattaagacactggctggcacggggacccacatgtcctcatattttcgtggccaccaactttctcagcttggtgcagctgcaactccttccccagggacctctagttcaatatctcacaatggaaacctgcgaggacggtaatgatctcgttttcttttaccaggtctgcgagggggtggcaaaggcctctcatgctagccacacagctgcccaagctgggctgcctgataagctcgtggcaagaggcaaggaagtgtccgacttgattaggagcggcaaaccaataaaaccagtgaaggatctgctgaagaagaatcagatggaaaattgccagaccctggtggataaatttatgaagctagatttggaagatccaaacctggatctgaatgtgtttatgtctcaagaggttctaccagcggccactagtattctttag

SEQ ID NO: 12437 - DNA, 2466 bp, Artificial Sequence
  Description of Artificial Sequence: Synthetic coding sequence
atggctagcctgggcgccaacccccgacgtactccccagggcccccgtccaggcgcggcctcttcggggttcccgagccctgcgcctgtccccggcccacgggaggctgaagaggaagaagtagaagaggaggaggaactggccgaaatccacctgtgtgtgctgtggaactctggctacctagggatcgcatactacgatacgtctgattcaacaatacacttcatgcccgatgcccctgaccatgaatctcttaaactgctgcaaagggtgttggacgagatcaatccccagtccgttgtcacgagcgcgaaacaggacgagaacatgacccggtttttggggaagttggcctctcaggagcatcgagaacccaagcgtccggagattatatttctcccttcagttgatttcggactggaaatctcgaagcagcgactcctgtccgggaattatagttttatccccgacgctatgaccgccaccgagaagattcttttcctcagctctatcatccccttcgactgtcttctcactccgcccggtgatctacggttcacccccatccccctgttgattccctctcaggttcgtgcactggggggactactgaagtttctgggaaggcggcggataggcgttgagctggaagactataacgtatcagtgccgattctggggtttaaaaagttcatgctgacccacctcgtgaacattgaccaggacacttactcggtgttacaaatcttcaaatccgagtcccaccctagtgtgtataaggtggcttcaggtttaaaggagggcctgtcactgttcggtattcttaaccgatgtcattgcaagtggggggaaaaattgcttcgactgtggtttacccggcccacacacgacctgggagagctatcctccagattggacgtaatacagtttttcctgctgccacaaaatctcgacatggcccagatgctgcacaggcttcttggccacattaaaaatgttcctctgatattaaagcgaatgaagttatcacatacaaaagtgagcgattggcaagtgttatacaagacagtctacagcgctttggggctaagggacgcctgtagatccttaccgcaaagcatacagctgttcagggatattgctcaggagtttagtgatgacttacaccatatcgctagcctgatcggtaaggtggtggattttgagggcagcctcgccgaaaatcgtttcacagtgcttcctaacattgaccccgagatcgacgagaaaaaacgccgactcatgggtctgcccagctttctcactgaggtggcacgcaaggagctggaaaacctggattctcgtatcccctcctgttctgtgatctatataccgctgatcggcttccttctttctatccctagactcccttctatggtggaggcttccgattttgaaattaacggactcgacttcatgtttttaagtgaggagaagctgcattaccggtccgcacggaccaaagaactcgatgcgctcctgggggaccttcattgcgaaattcgagatcaggagacactgctgatgtatcagcttcagtgtcaggttttagctagagccgctgtgcttacaagggttctagaccttgctagtcgtttggatgtgttgctagcactggcgtcagctgctcgggattatggatattcgcgtccacggtatagtcctcaagtgctgggagtgaggatacagaacggccggcatcctctcatggaactctgcgcccgcaccttcgtgccgaactctaccgaatgcgggggtgacaagggccgagttaaagttatcacaggccccaattcatcaggtaaatccatttatctgaaacaggtaggacttattactttcatggccttagttgggtcattcgtgccggccgaagaagccgagatcggcgccgttgatgcaatcttcacccggattcacagctgtgagagcattagtttgggcctaagcacctttatgatcgatctgaatcaagtggctaaagctgtgaacaatgctacagctcagtccctcgtgctgattgatgagtttgggaaggggactaataccgtggacggcctcgctctgcttgccgcagtattgagacattggctagcaaggggccctacatgcccccatatctttgtggcaaccaactttctgagccttgtccagctccagctactgccccaggggccgctggtgcagtacctgacaatggagacatgcgaagatgggaatgatttagtgtttttttaccaagttagcgatctgatccggtctggaaaacctattaagccggtgaaggatctgctgaaaaagaatcaaatggagaattgccaaactctggtggacaagttcatgaagctggacctggaggatccaaacttggatttaaatgtttttatgtcacaagaggtgttgccagccgcgacctcgattctgtag

SEQ ID NO: 12438 - DNA, 1527 bp, Artificial Sequence
  Description of Artificial Sequence: Synthetic coding sequence
atgtggccagtcttgctttttgtatttcttagtcagaccgtttatagcgctctgggccttcgcgatgcgtgtcggtcactcccccaaagcattcaactgtttagggatattgcccaggagtttagcgacgatcttcatcatatagcaagcctcatcggaaaggttgtggactttgagggcagcttagcggagaaccgctttacagttctgcctaacatcgatcccgagatcgacgagaagaaaaggcgtctcatgggccttcccagcttccttactgaagtcgctcggaaagagctcgagaacctggatagcagaatcccttcctgttccgtgatatatattcctcttattggcttcctcctgagcattcctcgtctgccgagtatggttgaggcgtccgatttcgagattaacggactggattttatgttcttaagtgaggagaaactacattacaggagcgctcggaccaaggaactggacgcactgctcggagacctgcattgtgaaatcagggatcaggagacactgcttatgtaccaactgcagtgccaggtactggcccgtgcagctgtgctaacaagggtcctggacctcgcaagcagactggacgtcctcctggccctggcctccgctgccagggattacggctatagtcgaccacgctactccccccaagtcctgggcgttcgcatacagaatggcaggcatccgctgatggagctctgcgcccggacattcgtccccaactctacagaatgcgggggggacaagggtagggttaaagtgataactgggccgaattcttccggaaagagcatctaccttaagcaggttgggctaatcacattcatggccttggtgggtagttttgtaccagccgaggaggcagagataggtgccgtggatgccatatttactagaatccactcatgtgagagcatctctctcgggttgagcacattcatgattgatttgaaccaagtggccaaagccgtgaataatgctacagcccagagcctcgttctcatcgacgagttcgggaagggaacaaatactgttgatggattggccttgctcgcagctgtgctccggcactggctcgcacgcggccccacctgtcctcatatctttgttgcaaccaactttctgtcattggtccagcttcagctcctgcctcagggccctctcgtgcagtacttgacaatggagacatgcgaagacggcaacgacctcgtgtttttctatcaggtttgtgagggagtcgctaaagcctctcacgcaagccacactgctgcccaggcaggtctccctgataaactggtggccagaggtaaagaggtgtccgatcttatccgcagcggcaagcccatcaagcctgtgaaagatctcctcaaaaagaaccagatggaaaactgccagactctggtcgataaattcatgaagctggatctcgaggatccaaatctggatcttaatgttttcatgagtcaagaggtcctcccagccgccacctccatcctgtag

SEQ ID NO: 12439 - DNA, 2505 bp, Artificial Sequence
  Description of Artificial Sequence: Synthetic coding sequence
atggccagcttgggggccaatcccagacggaccccacagggtcccagacccggcgctgcttcgagtggttttccctcacctgcaccagtgcctggaccccgggaagcagaggaagaggaggtggaggaggaagaggagctggctgaaattcatctctgtgttctgtggaactcaggctacctggggatagcctactatgacacaagtgatagcaccatacacttcatgccagacgctccagaccatgagtccctgaagttgctacagagggtcttggacgaaataaatccacagagcgttgtcacaagcgctaagcaagacgagaatatgacgaggtttttgggaaaattagcttcccaagagcaccgagaacccaaacggcctgagatcattttcctgccaagcgtggacttcgggctcgagatctcgaaacagcgattgttgagcggtaattacagtttcatccctgacgccatgaccgccacagaaaaaatcctgttcttaagcagtataattccattcgattgcctgctgaccgtgcgcgccctgggcggattgctgaagttcctgggcaggcgccgaattggggtcgaattagaggattataatgtgagcgtcccgatcctggggtttaaaaaatttatgcttactcatcttgtcaatatagatcaagacacgtactctgtgcttcagatatttaaatcagagtctcacccatcggtgtacaaggtggcctcaggcctcaaagaagggctctcgctcttcggtatcctgaaccgctgccattgcaaatggggcgagaagctgctacgcctttggtttacccggccaacgcacgaccttggtgagttatcaagtaggctcgatgttatacagttcttcctgctaccacagaacttggacatggctcagatgctccacaggctgctgggtcatatcaagaacgtgcctctcattctgaaaaggatgaagctgagccatactaaagtcagcgattggcaggtgctatataaaaccgtgtattctgcactgggactgcgggacgcctgccggtctctgccgcagagcatacagctcttcagagacatcgcacaagagttctccgacgatttgcaccacattgcttctctgataggaaaggtggtggatttcgagggaagcctcgctgaaaaccgcttcaccgtgctccccaacattgatcctgagattgacgagaaaaagcgtagactaatgggccttccaagttttctaaccgaggtagccaggaaagagctggaaaatctcgattctaggataccgtcctgctcagtgatttatattcccttgatagggttcctcctgtctattccacggttgccatcaatggtggaagctagcgactttgaaatcaatgggttagatttcatgttccttagcgaagagaagctgcattacagatccgccagaaccaaggaattagacgccttgctgggtgacttacactgtgagattcgagatcaggagacactgctgatgtaccagctccagtgccaggtgctcgcacgcgcggccgtgctaaccagagtgttagacctggcctcccgcctggacgtgctgcttgcactcgccagtgcagcccgtgattacgggtattccaggccccggtattctccgcaggtgctgggcgtaagaattcagaacggcaggcaccctctgatggagctttgcgcccgcacattcgtgccaaattccactgagtgcggtggggacaagggtcgggttaaagtcatcaccggccctaactcctcaggaaagagtatatacctgaagcaggtcggcctgatcacgtttatggccctcgtgggctccttcgttccagctgaggaagccgaaatcggggccgtcgacgccatctttactcgcatccactcttgtgaatccattagcttagggctctccacctttatgatcgatctgaaccaggtagccaaagccgtgaacaatgctaccgcccagtcactggtgctcatcgacgaatttggaaagggcaccaataccgtagatggactggctctcctggcagcagtcctgcggcactggctcgcaagggggccgacgtgcccacacatcttcgttgctacaaacttcctgagtctggtacagctccagttacttccacagggacccctggtccagtatctaacaatggagacttgcgaagatgggaacgatttggtctttttctaccaggtttgtgagggagtggccaaagcaagtcacgcctctcacacagcagcacaggccggcctccctgataaactggtggctcgggggaaagaggtgagcgatctgatccgttctgggaaacccatcaagcccgtcaaggatctactgaagaagaaccagatggaaaattgccaaactctggtggataagttcatgaagctggatctggaagatccaaacctggatttgaacgttttcatgagtcaggaggtactgcctgcggctacttccatcctgtag

SEQ ID NO: 12440 - DNA, 2505 bp, Artificial Sequence
  Description of Artificial Sequence: Synthetic coding sequence
atggcctctctcggggccaaccctcggagaacacctcagggccccaggccaggtgccgcatcttccggattcccgtcaccggcccccgtgccaggccccagagaggcagaagaagaagaggtcgaggaagaagaggaactcgcagaaatacacctctgcgtgctgtggaattccggctacctgggcatagcttattatgacacttctgacagcaccatccatttcatgccggatgctcctgaccatgagagtctgaagttgctccagagagtgcttgacgagattaacccacaaagtgtagtgacatctgctaaacaggatgaaaatatgacacgctttctcggaaaattagccagccaggagcatcgcgagccgaagaggcccgaaattattttcttaccaagtgtcgactttggcctcgagatatccaagcagaggctgctgagcgggaattactcctttataccggacgcaatgaccgcgactgagaaaatactgttcctgagctccataattccattcgactgcctgttgaccgtacgcgccctcggaggcttgctgaagtttctggggagaagacggattggggttgaacttgaggactataatgtgagtgttccgatcttgggatttaagaaattcatgctcacccacctggtgaatatcgatcaagatacctattctgttcttcaaatcttcaagagcgaaagccacccttccgtttataaagtggcctcgggcctgaaagaggggctgagcctttttggcatccttaatcgatgtcactgtaaatggggcgaaaagctgctcagactgtggttcacaaggcctacacatgacctgggcgaactcagcagtaggctggatgtcatccagttcttcttgcttccacagaacctcgacatggcccagatgctgcatcgactgctggggcacataaaaaatgtgccactgatactgaagcgcatgaagctatcccacacgaaagtttccgattggcaggttctgtacaagactgtgtactctgccctggggctgcgtgatgcctgtcggtcactgccccagagcatacagctttttcgcgatatcgctcaggaattttctgatgatttgcatcacatcgccagcctgattggtaaagtggtggacttcgaagggagcctcgccgaaaacaggtttacagtgctccctaatatcgatccagaaatcgatgaaaaaaaacgtcgtcttatgggcctgccatctttcctcactgaggttgccagaaaagaactggagaatctagactctaggatcccatcttgtagtgtgatatatatccctctcattgggttcctcctgagtataccaaggctgccgagcatggtagaagcgagcgactttgagattaatggattagacttcatgttccttagtgaggaaaaactgcactatcgatccgctaggaccaaagagctagacgcccttctcggtgatctccattgcgaaattcgggatcaggaaactctcctcatgtaccaattgcagtgtcaggtgctggcccgagcagctgtgctgactcgggttttggacttagcttctagactcgatgtgttgttggctcttgcctccgcggcccgggattacggttattcaagaccacgctactcacctcaggtactaggagtacggatacagaacggccggcatcccctgatggagctgtgcgccaggacatttgtaccaaacagcaccgagtgtggaggcgataaggggcgggtcaaagtgattaccggtcctaactcatcagggaaatcaatctatctcaaacaggtgggactgataaccttcatggctctagtcgggtccttcgtacccgccgaagaagcggaaattggagcggttgatgccatcttcaccagaattcatagttgtgaatcgatctcacttgggttaagtacattcatgatagatttaaatcaggtggcgaaggccgtgaataatgcaaccgctcagtccctggtcttaattgatgagtttggtaaagggaccaatacagtcgacggactggctctgctcgctgctgttttacggcattggctggccaggggcccaacatgcccgcacattttcgttgctactaactttttgagcttggtccagttgcagctgttgccccagggacccctggttcagtatttaacaatggagacatgtgaagatggcaatgatctcgtgttcttctaccaggtgtgcgagggtgtcgctaaggcttctcacgctagtcacacggcggctcaggcaggcctgcccgacaagctggtggcaaggggaaaagaggtgagtgatctcattagatctggaaaacccatcaagcctgtgaaggacctgctgaagaagaaccagatggaaaactgccagaccctggttgacaagtttatgaagctggatctcgaggaccccaatctggacctcaatgtttttatgagtcaagaggtgttaccagccgcaacatccattctgtag

SEQ ID NO: 12441 - DNA, 585 bp, Artificial Sequence
  Description of Artificial Sequence: Synthetic coding sequence
atggccagtttaggcgcaaatcccagacgcactccccagggtcctaggcccggggctgcgagctcaggatttccatcaccggcccccgtgccagggccccgcgaagcggaggaggaagaggtggaggaggaggaggagttggctgaaattcatctgtgcgtcctgtggaactccggctaccttggcatcgcctattatgatacatcagactcgacgatacacttcatgccagatgctcccgatcacgaaagtctgaagttgctacagagagtcttagacgaaataaacccacagtctgttgtgacatccgctaagcaggatgaaaatatgacgagattcctcggtaaacttgccagccaggaacaccgggagcccaaacgtcctgaaatcatatttctgccctccgtagatttcgggctggaaatctccaaacaacgcttgctgtcaggcaattattcttttatcccagatgctatgacagcaactgagaagattctgtttctgtcctcaattataccctttgactgtctgctgactgtgcgcgctctggggggcctcctcaagtttcttggccgtcgccggtag

SEQ ID NO: 12442 - DNA, 2469 bp, Artificial Sequence
  Description of Artificial Sequence: Synthetic coding sequence
atggcctctctaggcgcgaacccgcggcgcacccctcagggcccaaggcctggcgccgcctcatccggttttccgtcccctgcccctgtacccggcccgcgggaagccgaggaggaggaggttgaggaagaagaggagctggccgagatccacctctgtgtgctttggaactccgggtatctagggattgcctattacgatacttccgattctaccatccacttcatgccagatgcccccgatcatgagagccttaaactgctccagagagtcttggatgagatcaatccccagtccgtggtgactagcgccaaacaggacgagaatatgacaagattcttgggcaaattagcttcccaggaacatcgggaacccaaacgccccgaaatcatcttcttaccctccgtggatttcggcctagagattagtaaacagaggctcctgagcggtaactacagttttattccagatgctatgactgccaccgaaaagattctgttccttagctcaattatccctttcgactgtcttttgactcccccaggtgacttgcggtttacgcccattccgttgttaatcccatcccaagtgcgcgccttaggggggctgctgaagtttctgggtcgcagaagaatcggagtcgagctcgaggattataatgttagcgtccccattctcggctttaagaaattcatgttgacacatcttgtgaacatagatcaggacacatacagtgtgctccaaatctttaagagtgagagccatcccagcgtgtataaagtcgcttctgggctgaaagaagggctgtcactctttggaatactcaatcgatgccactgtaaatggggagaaaagcttctgaggctatggttcacacgtcctacccatgacctgggcgaactctcttcccgcttagatgtgatccagttcttcctgctaccccagaatttagatatggcgcagatgcttcataggctgttaggccacatcaagaatgtccctttaatactcaagagaatgaaattgagtcacaccaaagttagcgactggcaggtgctgtacaaaactgtgtatagcgctctaggtctgcgagacgcatgtaggagtctgccacagagtattcagttatttcgcgatatagcccaggagttcagcgacgacttacaccacattgccagcttgatcgggaaagttgtcgactttgaaggatcattagccgaaaacagattcaccgtcctgcctaatatcgatcctgaaatcgatgagaagaagaggcgactgatggggttgcccagcttcctaaccgaggtggcccgcaaggaactggagaacctggattccagaatcccgagctgtagcgtcatctatatccccctgattggctttctgctatcgatcccgcggcttcctagcatggtggaggcttccgacttcgagatcaacgggctggacttcatgttcctgtccgaggaaaaacttcactaccgcagtgcgcgaaccaaagaacttgacgccctgcttggcgacctccactgtgagattagggaccaagaaacattgttgatgtaccagctgcagtgccaagttctggctagagcagcagtactgactcgtgtcctggacctagccagtcgcctggatgttttattggccctcgcctctgccgcaagagattacggttattcacggccccgctacagtcctcaggtgctaggggtcaggatccagaacggcagacacccacttatggaactgtgcgccagaacatttgtacctaacagcacagagtgtggaggcgataagggacgggttaaagtgatcacgggaccaaacagttctggaaaatcgatatatctgaaacaggtcggactgatcacttttatggcccttgttggctccttcgttcccgccgaggaagccgagatcggggcagtcgacgcaatttttactcggattcatagttgtgagtccatcagtctgggcttgtcgaccttcatgatcgatctcaaccaacaagtagctaaagctgtcaataatgcaaccgctcagtcccttgtgctcatagatgaattcgggaagggaacaaacacagtcgacggcctggccttgctcgcagctgtgttgcggcactggctcgcacgagggccgacttgccctcacatcttcgttgctacaaatttcctctctctggttcaactccagctgctgcctcagggacccctcgtccagtatctgaccatggagacatgtgaagatggtaacgatctggtgttcttctatcaggtgtctgatctaataagaagcggtaaacccatcaagcccgtcaaggacctacttaagaagaaccagatggagaactgccagactttggtggacaagtttatgaagttagatttagaggatcccaatctggatcttaatgtcttcatgtctcaggaggtactgccagcggccacttcaatcctgtag

SEQ ID NO: 12443 - DNA, 471 bp, Artificial Sequence
  Description of Artificial Sequence: Synthetic coding sequence
acagcccaatccttagtacttatagacgagtttgggaaaggcacaaatacagtggatgggctggcactattagcagctgttctgagacattggctggctaggggtcctacttgtccacacattttcgtggccaccaactttctgtccttagtacagctgcaactgctgccacagggtccgctggtgcaatatttggtgtgcgagggagtggccaaggcgtctcatgcttcccacactgctgcacaggccggactgccggataagttagtggctaggggcaaagaggtatctgacctgattcgcagcgggaagcctatcaaaccagtgaaagacctccttaaaaagaatcagatggaaaattgccagaccctagttgacaagtttatgaaacttgacttggaggacccaaacctggacttgaatgtatttatgtcacaggaggttctgcccgccgcaacctcgatcctttag

SEQ ID NO: 12444 - DNA, 2505 bp, Artificial Sequence
  Description of Artificial Sequence: Synthetic coding sequence
atggccagcctgggggctaatcccaggaggacaccacaaggaccgcgccctggtgctgccagctctggctttccttctccagctcccgtgccaggcccccgcgaggctgaggaagaggaggtggaagaggaagaagaactggcggagatccatctttgtgtcctttggaacagcggctacctcggaatcgcgtattatgatacatcagattcgacgattcattttatgcctgatgctcccgatcatgagagccttaaactgctccagcgggttctggacgagatcaacccacagagtgtggttacttccgctaagcaggatgaaaacatgacccgcttcctaggcaagctggcatctcaggaacacagagaacctaagcgccccgaaattatctttcttccatctgtggattttgggctggagatttcaaagcagcgcctgctcagtggtaattacagttttatccccgacgcaatgacagcaaccgaaaagatcctatttctctcgtctattataccatttgattgtcttttaactgtgcgggcccttggggggctcctgaagttcctgggaaggcggcggatcggcgtcgaactcgaagactataatgtgtccgtacccattctgggatttaagaaattcatgctgacccacttggtgaatatagaccaggatacttactcagtactgcagatatttaagagcgagtcacatccaagcgtctataaggtcgccagcgggcttaaggagggattgtccttgttcggtatactgaaccggtgccattgcaagtggggtgaaaaactgctaaggctgtggttcacacgcccgacacacgatctcggcgaactcagtagtcgtctggatgtaatccagttttttttgctcccccaaaaccttgacatggctcaaatgctccaccgtttgctagggcacatcaaaaatgtacccctcattctcaagagaatgaagttgtctcatactaaagttagtgactggcaggtcttatacaaaaccgtttacagcgcactgggattgcgtgacgcgtgcaggagcctcccccaatctatccagctttttagggacatagcccaggagtttagtgacgatctccaccatattgcctcccttattggtaaggtggtcgatttcgaggggagccttgctgaaaaccggtttaccgtgctgccaaatattgacccagagatcgacgagaaaaagcgccgcttgatgggactaccaagctttcttacagaggtagccagaaaagagctggagaacttagatagcagaattcccagttgttctgtaatatacattcccctgattgggtttttgctctcaatccctaggctgccttctatggtagaagcgtccgacttcgagatcaatgggctggactttatgttcctctccgaggaaaagctccactacagatcagccaggacaaaagagcttgacgccttacttggtgatctgcattgtgagatccgtgaccaagagacgctgctaatgtatcagttgcagtgtcaagtgctggcacgggcagctgtacttactagagtgctggacctggcaagcaggctggatgtgctcctcgcactagcaagtgctgctagagattacggttactctcggcccaggtattccccacaggtcctgggggtaaggattcaaaatggccggcaccctctgatggagctgtgcgcgaggaccttcgttccaaacagcaccgagtgcggcggcgacaagggtagggttaaggtcattaccggtcccaactccagcggtaaaagcatctacctgaagcaggtggggctaataacatttatggcactcgtgggttctttcgtccccgcagaggaagctgagattggcgctgtggatgccatcttcacacggatacacagctgcgagtctatctccctgggcctttccactttcatgatcgacctcaatcaagtggccaaagctgtgaataacgccaccgcgcaatcgttggttctgatcgacgagttcggaaaaggtaccaacaccgtcgatgggctggcattactggctgccgtgctccgccactggttagcaagggggcccacatgtccccacatatttgtggccactaacttcctttccctggtccagctgcagctattgccgcaaggcccactggtgcaataccttaccatggagacctgcgaggatggcaacgacttggttttcttctaccaagtttgcgagggagtcgccaaagccagccacgcttctcatactgcagcccaagcaggcctgccggataaactggttgctcggggcaaggaagtatctgaccttatcagatccggaaaaccaattaagccagtgaaagacctgctgaagaaaaatcaaatggagaattgccagacacttgttgacaagtttatgaagctggacctagaggaccccaacctggatctgaacgtttttatgtcacaagaggtgctgcccgctgccacctcaatcctgtag

SEQ ID NO: 12445 - DNA, 2505 bp, Artificial Sequence
  Description of Artificial Sequence: Synthetic coding sequence
atggcgagtctgggtgctaatcctagaagaacaccccagggtcctcgccccggtgctgctagtagtggcttcccttcacccgccccagttcctggccctagggaagccgaagaggaggaggtggaggaagaggaagaattggcagagattcatctctgcgtcttgtggaacagtgggtaccttggcatagcctactacgatacttcagattccacaatacacttcatgcccgatgcgcctgaccacgagagtctgaagctcttgcagagagtgttagacgagattaaccctcaaagtgtagtcacctccgccaaacaggatgagaatatgacccgatttctggggaagctcgcttcgcaagagcacagggaaccgaagaggcccgagattatttttctgccctctgtggattttggcctggaaatctcaaaacagaggcttctgtccgggaactacagttttatacctgatgcaatgacagcaaccgagaagatactgtttctctccagcattatcccatttgattgccttctgactgtgcgggcactcggtggtcttctaaagttcctcggtcgaaggagaattggcgtcgaacttgaagactacaatgtatcggttccaatactcggatttaagaagtttatgttgacacatttagtgaacattgaccaggacacatacagcgtgctgcaaatttttaagagtgaatctcatcctagcgtgtacaaagtagcctctggcctgaaggagggactatcactcttcggtatcttgaatcgttgccactgcaaatggggagagaagctccttcgcctctggtttaccaggcctacccatgacctgggggagctttcttctaggttggatgtgattcagtttttcctcctgccccagaacctggatatggctcaaatgctacacagactgctagggcacattaagaatgttcctcttattctgaagcgcatgaagttgagccatactaaagtctccgactggcaggttttgtataagactgtctactccgctctgggcctgagggatgcttgccggagtttgccccaaagcatccagctgtttcgtgatattgcacaggaatttagcgatgacctgcaccatatcgcaagtctcatcgggaaggtcgtcgactttgagggatccctggctgagaatcgattcaccgtcctgcccaacatcgatccagaaatagatgaaaagaagcgcagactcatgggtcttccttccttcttgacggaggtggctagaaaagagctggagaacctcgactcccgcattccatcttgtagcgtcatatatatcccactgatcggcttcctgctatctattcctcgcctcccttcaatggtggaggccagcgacttcgaaatcaacggcctggatttcatgtttttgtccgaggagaagctccactataggtccgcgcgcactaaagaactggacgctctgctgggcgatctacactgcgaaatcagggaccaggaaaccttgctgatgtaccagctccaatgccaggtgcttgctcgagctgcggtgcttaccagggttctcgatttggcttcacggctagatgtgctcctggcactcgccagtgccgctagagactacgggtattccaggccccggtattctccacaggtgctgggagtgcggattcagaacggcaggcaccctctcatggagctatgtgctaggacgtttgttcctaatagcactgaatgcggaggagataaaggcagggtcaaggtgatcactggtcctaatagtagcggaaagagcatttatttgaagcaggtgggcctgatcacctttatggccctggtgggctctttcgtccccgccgaggaagcagaaataggagccgtggacgctatctttactaggatccatagttgtgagagtatttccctaggattatccacttttatgattgatttgaaccaggttgcgaaggccgtcaacaacgccaccgcacagagcttggtcctcattgatgaattcggcaaaggcaccaataccgtcgacggcctggctctcttagcggccgtgctgcgtcattggctggcccgaggccctacttgcccgcatatattcgtggccacaaattttctttcacttgtgcaactgcagctgctcccccagggtcccctggtgcagtatttaactatggagacttgtgaagacgggaacgatctcgtgttcttctaccaggtctgcgaaggcgtggctaaagcctcacacgcgtcacacacagctgcccaggcgggcttgcctgataaactcgtcgcgcgaggcaaagaagtaagcgacctgattcgcagcgggaagcccattaaaccagtgaaagatctgctcaaaaagaatcagatggagaactgccagacgttagtggataagttcatgaaattagatctcgaagacccaaacctggacctcaacgtgtttatgtcacaggaagtgctcccagcagccacttcaattttgtag

SEQ ID NO: 12446 - DNA, 471 bp, Artificial Sequence
  Description of Artificial Sequence: Synthetic coding sequence
accgcacagtcactggtcttgatcgatgaatttggaaaaggcacgaacacagtcgacggcctggctctcctggctgcggtcctgaggcactggctcgcaagagggcccacctgtccacatatttttgtggctaccaactttcttagccttgtacagctgcaactgctccctcaagggcctctcgtacagtacttagtttgcgaaggggtggctaaggcaagccatgccagccacactgcggcccaagctggccttccggacaaactggtcgccaggggcaaagaggtgagcgatctgattaggtccggcaaacccatcaagcctgtgaaggatttgctcaagaaaaatcagatggagaattgtcagaccctggtggacaagttcatgaagctcgacctcgaggatcccaacctggacctgaacgtcttcatgtcacaagaggtcctccccgccgctacatccattctgtag

SEQ ID NO: 12447 - DNA, 2466 bp, Artificial Sequence
  Description of Artificial Sequence: Synthetic coding sequence
atggcctcgctgggtgccaatccaaggcgcacaccacagggaccccgacctggagcagccagcagcggctttccaagccccgctcccgtgcccggcccacgcgaagcggaggaggaggaagtcgaagaggaagaagaactcgcagagatccacctttgcgtgctttggaattcgggttatctgggaatagcgtattatgatacatctgattccacaatacacttcatgccggacgcacctgatcacgagtccctcaaactcctccagcgagttctagacgaaatcaacccacagagtgtggtgaccagtgcaaaacaggacgaaaacatgacaaggttcctaggcaaattggcctcacaagagcacagagagcccaagcggccggaaatcatttttctaccttctgttgacttcggattagaaatttccaaacagcgcctgctcagcggaaattatagcttcatccccgacgcgatgaccgcgaccgagaagatactctttctgtcttccatcattccattcgattgcctgctaacacctcccggcgatctccgcttcaccccgatacctctcctgattccctcacaagttagagccctgggcggccttctaaagtttctgggcaggagaagaataggcgtcgagttggaggattataatgtgtccgtccccattcttggattcaaaaagtttatgctgacccatttggttaacatcgatcaggacacatattccgtcctgcagatcttcaagagcgagtcgcacccttccgtctataaggtggcttctggcctgaaggaggggcttagcttgttcggtatcctaaacagatgccattgtaagtggggggagaagctgctccgactgtggtttacaagaccaacgcacgaccttggcgagctgtctagccgattggatgttatccagttcttcctgctcccccagaacctggacatggcacaaatgctccacaggttgttggggcacataaaaaacgtgccgttgatcctaaaacgcatgaaacttagtcacacaaaagtgtcagactggcaggtgctgtataaaaccgtgtatagcgccctgggactccgcgatgcgtgtcgtagtttacctcaaagcatccagctgtttcgggatatcgcccaggaattctcagatgatttacaccatatcgcaagcttgataggcaaagttgtcgatttcgaaggctcgctagcagagaatcggttcaccgtgctgccaaatatagaccctgaaatcgatgaaaagaaacgacggctgatgggtttgcccagctttctaactgaggtcgctcggaaggagctggagaacctggattcacgcattccctcctgcagcgtgatctatattcctctcattgggttccttctgtcaattcccaggcttccttccatggttgaggcctctgacttcgaaattaacgggttggacttcatgtttctgtcagaggagaaacttcattatcggagcgcacgcacgaaagagctggacgccctcctcggagacttacattgcgagattcgcgaccaggagacactgctgatgtatcaactgcagtgccaagtgctggcccgagcagctgtgctcacgagagtcctggatctggcaagccggctggatgtgctgctggccctcgcatctgctgcaagagactacgggtatagtcgtccccgctattcccctcaggtactaggggtccgtattcagaacggaagacatccgctgatggaactatgtgccagaacatttgtccccaatagcaccgagtgcggtggggacaaggggcgggtgaaggtcataacgggccccaatagcagcggtaagtcaatctacctgaaacaggtgggcctgattactttcatggccctcgtcggttcattcgttccagctgaggaagctgaaataggggctgtcgacgcaatcttcacgcgcatccacagctgtgagtctatctccctcggtttgagcacctttatgatagacttgaatcaggtggccaaagcagtaaacaatgctacagcccagagtctggttctcatcgacgagttcggaaagggtaccaacaccgttgacggcctggcccttttggccgctgtcctgcggcactggttggctaggggccctacatgtcctcatatctttgtcgccactaattttctctcactcgtacagctacagctgctgccgcaagggccgttagtgcagtatctcacaatggagacctgcgaagatggaaatgacttagtgttcttttatcaagtgtcagacctaatacgtagtgggaaacctataaagcccgtaaaggacctcctaaaaaagaaccaaatggagaattgccagaccctggtggataaattcatgaagttggacttggaagaccccaatctagacctgaatgtgttcatgagtcaagaagtactcccggcggcaacttccatcctgtag

SEQ ID NO: 12448 - DNA, 2556 bp, Artificial Sequence
  Description of Artificial Sequence: Synthetic coding sequence
atggcgagcctgggcgcgaacccgcgaagaacaccacaaggtcccaggcccggcgccgccagtagcggattcccttccccggctcctgtaccagggccaagggaggctgaggaagaagaagtggaggaggaagaggagttggccgagattcatctgtgtgtgctttggaacagtggatatctcggcattgcatactacgatacctccgattctacgattcacttcatgcctgatgccccagatcacgaaagcctgaaactcctgcagcgagtgttggatgagatcaatcctcagagtgtagtgaccagcgcaaaacaggatgaaaatatgaccagattcctggggaagcttgcttcacaggagcaccgcgagcccaaaagacccgaaataatttttctgccatccgtggacttcgggctggagatttcaaaacaacgcctgctgagtggaaactatagtttcatccctgacgcgatgaccgccacagagaagatattatttctaagctcgattatcccttttgactgcctcctgacaccgccaggtgacctgcgattcacacctattcctttactgatcccatcacaggtgcgagccctgggtggattgctgaagttcctcggacgcagaaggatcggcgtcgagctcgaagattataacgtgtcagttccaatcctgggattcaagaaattcatgttaacccacctcgtcaacattgaccaagatacatactctgtactccagattttcaagtcggaatctcacccctccgtgtacaaggtagcgtcgggcttgaaggaagggctatcactgtttggcatattgaacaggtgccattgtaaatggggtgaaaaactgttgagactttggttcacacggccgacccatgacttgggcgaactgagttctaggttggacgtgatacagtttttcctgctaccacagaacctagacatggcccagatgctccacaggctgcttggacacatcaagaatgtgcctctcattctaaagcgaatgaaactgtcccacacgaaagtgtccgattggcaagtgctctacaagactgtctacagtgcacttggattgcgagacgcatgtcgctccctgccacagtccatccagttgtttagggacatcgctcaggagttttccgacgaccttcaccacatcgccagcctcattggaaaggtggttgactttgaagggtccctcgccgagaatcgcttcaccgtcttgcccaacatcgatccagagattgatgaaaagaaaagaagactcatgggactgccatcatttcttacagaggtggcccgcaaggaactggaaaatctggatagcaggatcccctcttgtagcgtcatctacattcccttaattggttttctgctgagcatccctaggttgccgagcatggtcgaggcttcagatttcgagattaatggtctcgacttcatgtttctttctgaagaaaagctgcactaccgatcagcacggactaaggaactggatgcattgttaggagatctccactgcgagatccgagatcaagaaactttactgatgtatcagctacagtgtcaggttctggcccgtgctgccgtgctcacccgtgtactggacttagcctctcgacttgacgtgcttctcgctctggcgtccgctgcacgggattacgggtactcacggcctcggtatagcccacaggtcctgggggtgcgaatacagaacggcagacaccccctcatggaactttgtgctcgcactttcgtgccaaactcaacagagtgtggtggtgacaaaggacgggttaaggttataacagggccgaattccagtggcaagtcgatctacctgaaacaggtaggcctgattacgttcatggctctggtcggaagcttcgtgcccgcagaagaggcggagatcggagctgtggacgctatttttactaggatccacagctgtgagtctatttcattagggctctctaccttcatgattgacctgaaccaggtggccaaggccgtgaacaacgccacagcccagagtctggttcttatcgatgaattcggaaagggcacaaatactgttgacgggctcgcactcctcgctgctgtcctccgccattggctggcaaggggacccacctgtccccacatctttgtagccacaaacttcctgagtctagtacagctacagctgctgccccagggtcccctggtccaataccttactatggaaacctgtgaggatggcaacgacttagtgttcttttatcaggtgtgtgaaggtgtggcaaaggcttcccacgcatcacataccgccgcccaggcaggcctgcctgacaaactagttgctcgcgggaaagaagtatctgacttgatacggtctgggaaaccgattaagccagtgaaggatctgctgaaaaagaaccagatggaaaattgtcagacactggtggacaagttcatgaaattggacctcgaggatccaaatctagacctgaatgtgttcatgtcccaagaagtgttacctgccgctacctccatcctatag

SEQ ID NO: 12449 - DNA, 1602 bp, Artificial Sequence
  Description of Artificial Sequence: Synthetic coding sequence
atggcccagatgctgcacaggctactgggccatattaaaaatgtacctctcatcttgaaacgcatgaaactgtctcacacaaaagtcagcgattggcaggtgctctacaaaactgtgtatagtgccttaggcttgcgtgatgcttgtcgtagtctgccacagtccatacaattgttcagggacattgctcaggaattcagcgatgacctgcaccacattgcatctctgatcggaaaagtggtagactttgaaggctctctcgccgaaaacaggtttacagttctcccaaacatagacccagagatcgatgaaaagaaaagacggctcatgggacttccgagctttttgactgaagttgctaggaaggaattggaaaacctggattctcgaatacctagctgctccgtcatttatatcccactgattggttttttactgtctatcccgagactccccagcatggtagaagcgagtgacttcgagattaacggcctcgactttatgtttctgtccgaagaaaagcttcactataggtccgcacgcaccaaggaactcgatgccctgctcggggatctgcattgtgagattagggatcaagaaactctgctgatgtatcaacttcagtgccaggtgttggcccgagctgcagtgctaacgcgtgtactcgacttggcatctcgactcgacgttctactggccctggcctctgcagctcgtgattacggctactcacgcccgcgctactcgccccaggtgcttggtgtgagaattcagaacggccgccatccattgatggagttatgcgcaaggacctttgtgcctaacagtacagaatgcgggggcgataaagggcgggttaaggtgatcacagggcccaactccagcggaaagagcatttatctaaagcaggtcggcctgatcacgttcatggccttagtgggttctttcgttcctgccgaggaggccgagattggggccgtggacgctatttttaccagaatccattcctgtgaatctatcagcctggggctgtcaactttcatgattgacctaaatcaggttgccaaggcagtcaataacgctacagcacaaagtttggttctgatagacgagtttgggaagggtactaacactgttgatggtttagccctcctcgccgccgtgttgagacactggctggcccgcggtcctacttgcccgcacatttttgtggctactaatttcctaagtctggtgcagctgcagctcttaccgcaagggcctttagttcagtacttgaccatggagacatgcgaggacggaaacgatctagtgtttttctatcaggtctgcgagggggttgcaaaggcctcgcatgccagccatacggctgctcaggccggtctgcccgataagctagtagcccgcggcaaggaagtgagcgatctgatacggtccggcaaaccaatcaagcctgttaaggacctgctgaaaaaaaaccagatggaaaattgccagacactagtagacaagttcatgaaattggatctcgaggatcctaacctggacctcaatgtctttatgagccaggaagtattgcccgctgcgacgagcatattgtag

SEQ ID NO: 12450 - DNA, 765 bp, Artificial Sequence
  Description of Artificial Sequence: Synthetic coding sequence
atggcctctctaggagctaaccctagacggactccccagggaccaaggcctggagccgcatcttcagggtttcctagtcctgcccccgtgcccggtcccagagaagcagaagaggaggaggttgaagaggaggaggagttggccgaaattcacttgtgcgtcctttggaactccggctacctaggtattgcatattacgacacttcagactccacgatccacttcatgccggacgctcccgaccacgagtccctgaagctgcttcaacgggttctggacgagatcaacccccaatcagtcgtgacatctgctaaacaagatgaaaatatgacaagatttctcggcaaactggcatcacaggaacaccgggagcctaaacgccccgagattatcttccttccatcagtggattttggtctggagataagcaagcagagactcctgagcggtaactactcgtttatcccagatgcaatgaccgctacggaaaaaatcttgttcctgtcttcaatcatcccctttgactgtctgctgaccgtgcgagccctcggtggcctgctgaagttcctgggtaggcgtaggataggcgtggaactcgaggattacaacgtatcggtccccatccttggctttaagaagtttatgctgactcatctcgtgaatattgaccaggacacctaccgattagaatgtaatggagcgatcagcgcccagtgcaacctgtgtctgctagggtcttcagatagcccagcttctgcttcctag

SEQ ID NO: 12451 - DNA, 816 bp, Artificial Sequence
  Description of Artificial Sequence: Synthetic coding sequence
atgttcttatcagaggagaagctccactatcgttctgcccggacaaaggaactggacgctctccttggcgatctgcactgtgaaatacgtgaccaggaaaccctgttaatgtatcagcttcagtgccaggtactcgccagggcagccgtcctgacgagagtgttggacctggcctcgcgcctagacgtgcttttagcactggcctctgccgcccgcgattacggctattctcggccaaggtatagccctcaagttctgggagtgcgcattcagaacggccgccacccacttatggaactgtgtgcccggacattcgtccctaattctacagagtgtggcggcgacaagggacgtgttaaggtgatcacagggccaaatagctctggtaaatctatatacctgaaacaggtaggcttgatcacattcatggccctcgtggggtctttcgtccctgccgaggaagcagagatcggcgctgtcgatgcaatcttcacccgcatccatagctgtgagagtatctccctgggtcttagcaccttcatgattgatctgaaccaagtggctaaagccgttaacaatgcaactgcccagtctcttgtcctgatcgatgagttcggcaagggcacgaacaccgtggatggcttagctttgcttgccgccgtcctgcgacactggctcgccaggggccccacctgcccacatattttcgtcgccacaaattttttatccctggtccaactgcagttactcccacagggacccctggtgcagtatctcgactggcctagggtctctggtcaggaggggggagattag

SEQ ID NO: 12452 - DNA, 1602 bp, Artificial Sequence
  Description of Artificial Sequence: Synthetic coding sequence
atggctcagatgctgcaccggctcctcggccatataaaaaacgtgcctctgattcttaagcgcatgaagcttagccatacaaaagtgagtgattggcaagtgctctataaaaccgtctattctgcactgggtttgagagatgcttgccgaagcctccctcagtccatccagctgttccgagatatagcccaagagttcagcgatgatctgcaccatatagcctcattaataggtaaggtcgttgactttgagggaagtcttgccgagaataggtttacagtcctacccaatatcgaccccgagatcgatgagaagaaacggcgactgatgggactgccctcatttttgaccgaggtcgcaaggaaagaactggagaacttggacagccgaatacctagttgtagcgtgatttacatacctttgatcggcttcttattgagcattcctcgacttcctagtatggtcgaggcctccgatttcgaaatcaatggcctggattttatgtttctctctgaggagaaattacactaccggagcgcaaggaccaaagaactggatgcattgttaggcgacttgcattgcgaaattagggatcaggagacgttattgatgtaccagttacagtgccaggtgctggccagggcagccgtgctcaccagggtgttggatcttgcctcccgtctggatgtgcttttggccctggccagcgcggctagggattacgggtattccagaccgagatatagccctcaggtgctgggggtacggatccagaacggcagacaccctttgatggaattatgcgcccggacctttgttcccaacagtacagaatgcggaggcgacaagggccgcgtaaaggttatcacagggcctaattcttcaggcaagtccatctacctgaagcaggtcggactaatcaccttcatggctctggtgggaagctttgtcccagcagaagaggccgaaatcggggctgtggacgctattttcacccggatccatagctgtgagtctatcagcttgggcttatcaacctttatgatcgatctgaaccaggttgccaaagccgtgaataatgccactgcacaaagtttggtgcttatcgacgagtttggtaaaggaaccaacacagtagatgggctggcgctgctcgccgcagtcctgcggcattggctggcccgtggacccacatgcccccacatctttgtagcaaccaatttcttgagcttggttcagctgcaattgctgccacaggggccactggtgcaatacttgaccatggaaacctgcgaagatgggaacgacttggttttcttttaccaggtgtgtgaaggggttgcaaaagcatcacacgctagtcacactgccgcacaggcaggactgcctgataaacttgttgcgcggggaaaagaggtgagcgacctcatacggagcgggaagccaataaaaccagtgaaggacctcctgaaaaagaatcagatggagaactgtcagaccttagtagacaaatttatgaagctggatctcgaggatcccaacttggatttgaatgtatttatgtcacaggaggttcttcccgctgcaactagtattctgtag

SEQ ID NO: 12453 - DNA, 816 bp, Artificial Sequence
  Description of Artificial Sequence: Synthetic coding sequence
atgttcctttcagaggagaagctgcactataggagtgcccgcacgaaagagttagacgcactgttaggagatttgcactgcgagattcgtgatcaagaaactctgctgatgtaccagctccagtgccaggtgctggcccgagccgccgttctcacaagagtgcttgatttggcctcccgactggacgtgctgctcgccctagcctcagctgcccgggactacggatactccaggccacggtactctccacaagtcttgggggttaggatacagaatggacgccatcccctaatggaactgtgtgctcgcacctttgtgcccaattcgaccgaatgcggcggcgataagggccgcgttaaggtgatcacaggccctaactcctctggaaaatctatttacctgaagcaggtgggcttgattacttttatggctttagtcggttccttcgtgcccgccgaagaggcagaaatcggtgcagtagatgccattttcacgaggattcactcatgtgagtccatcagtctagggctgtctacttttatgattgacctgaaccaggtggcaaaggccgtgaacaatgccactgcccagagcctggtgcttatcgatgaatttggcaaaggaacaaacaccgtcgacggtcttgccctccttgcagcagtgctgcggcactggcttgcccggggacctacttgcccccatatcttcgtagccaccaactttctgagtctcgtccagctgcagcttctgcctcagggacctctggtgcagtacctggactggccacgcgtgagcggccaggaaggaggcgattag

SEQ ID NO: 12454 - DNA, 765 bp, Artificial Sequence
  Description of Artificial Sequence: Synthetic coding sequence
atggcatcactaggggcaaatcccaggcgcaccccacagggtcctcggcctggtgctgcgagtagcggttttccgtcacctgcacctgtgccaggacctcgagaagcagaagaagaagaagtcgaggaagaggaagagttggctgagattcatctgtgtgtgctgtggaactccggctacctcggcatcgcctactacgacacttccgatagtactatccactttatgccagacgcacccgatcatgaaagcctgaagctgctgcagagggtgctggatgagatcaatccccagagtgttgtcacatctgccaaacaggatgaaaacatgacgagatttcttggaaagctcgcgtcgcaagagcaccgcgagccaaagcgccccgaaattatttttctccccagcgttgattttgggcttgaaatctcaaaacagagactactgtcagggaactactctttcatacctgatgcgatgacagccactgaaaagattctattcctgtccagcataataccattcgattgtctgctaactgtgagggctctggggggcctgttgaagtttttgggaaggcgcaggatcggtgtcgagctagaggactataatgttagtgttccaatcctgggattcaaaaaattcatgttgactcatttagtgaacatcgatcaggatacttaccggttggaatgtaacggcgccatctctgctcagtgcaacctttgccttctgggctccagcgacagcccggctagcgcctcttag

SEQ ID NO: 12455 - DNA, 765 bp, Artificial Sequence
  Description of Artificial Sequence: Synthetic coding sequence
atggcttctctaggtgcaaatcctcgtagaacaccacagggtccccgcccaggggcagcctcctctgggtttccgtccccggcccctgtgcccggcccacgggaagcggaggaggaggaggtggaagaagaggaagagttagccgaaattcatttgtgcgtgctctggaattccggctacctaggcatcgcctattacgatacgtccgattcaacaattcatttcatgccggacgcccccgaccacgagagccttaaactcctgcaaagagtactggacgagatcaacccacaatccgtggtgacaagcgccaagcaggacgaaaatatgacgcggtttcttggaaaactcgctagccaggagcacagagagccgaaacgaccagagattatattcctgcccagcgtggatttcggtctggaaatatcaaagcagaggctgctgagtggaaattattcctttattccagacgcgatgacggctacagagaagatcctgtttctgagctcaatcattccctttgactgcctcctcactgtgcgagcattggggggcttgctcaaatttcttgggagaaggcgcatcggagtggaactcgaggattataacgtcagcgtaccaattctggggtttaagaaattcatgttgacacacctggtaaatatcgaccaggatacatacaggctggaatgcaacggagctatatccgcccaatgtaatctgtgcctcctgggctctagtgattctccagcctcagccagttag

SEQ ID NO: 12456 - DNA, 1602 bp, Artificial Sequence
  Description of Artificial Sequence: Synthetic coding sequence
atggcgcagatgctgcacaggttactcgggcacataaagaatgttcccctcattctaaagagaatgaagctttcccatacaaaggtgtcagactggcaggtactatataaaaccgtgtactctgccttgggattacgggacgcgtgtcgctctcttccccaaagtattcagcttttccgggacatcgctcaggagtttagtgacgatctacatcatatcgcctcactgattggaaaggtggtcgacttcgaggggagcctggcagagaacagattcaccgtgctccccaatatcgatcccgagattgacgagaagaaacgaagactaatggggctgccgtccttccttaccgaggtggcccgcaaggagctggagaatttggatagcagaatccccagctgctccgtaatctacatccctctcataggctttttactctctataccacggctgccttcaatggtggaggcctctgattttgaaatcaatggacttgacttcatgtttctatccgaagagaagctgcactatcgttcagctaggaccaaagaactggacgctttgttgggagaccttcattgtgagatacgagaccaggaaacgttgctcatgtatcagctccagtgtcaagtgttagcaagagctgcagttctcactagggtgctcgaccttgcctccaggcttgatgtgctcctggcacttgcttctgcagccagagattacgggtactcacgtccgagatactccccccaagttctcggagtcagaatacagaacggacgacatcctttaatggagttatgtgcgcgtacattcgtgcccaatagcacagaatgcgggggcgataagggccgggtaaaagtgattaccggccccaattctagcggaaagagtatctatctaaaacaggtcggcctgattacttttatggcgcttgtgggctcttttgtcccggccgaagaggcagaaattggcgccgtcgatgccatttttacacggatccactcatgcgagtccatcagcctgggactcagcaccttcatgattgaccttaatcaggttgcaaaggcggtgaataatgcaaccgcacagtctctcgtgctgattgatgagtttggaaaagggaccaataccgtcgacggtctcgccttgctggccgccgtgctaaggcactggctcgcgagagggcccacctgtccccatattttcgtggccacaaatttcctcagcctggtccagctccagctcctcccacaggggccactagtccagtatctcacaatggaaacctgcgaggacgggaatgacctcgttttcttttaccaggtatgcgagggcgtggcgaaagctagccacgctagtcatactgcagcacaagctggtcttcctgacaaactcgtggcccgaggtaaggaggtctctgatcttatcagatcgggtaagccaattaagcctgtcaaggacctccttaagaagaaccagatggaaaattgtcagacattagtggataagttcatgaaacttgacctagaggatccaaacttagatctgaacgttttcatgtctcaagaggtgctgcccgcggcaactagcattctgtag

SEQ ID NO: 12457 - DNA, 2556 bp, Artificial Sequence
  Description of Artificial Sequence: Synthetic coding sequence
atggctagccttggcgccaaccccagacgcacccctcaggggcctcgccccggcgctgcaagtagcgggtttccaagccctgcgcccgtgcctgggcctcgtgaggcagaggaagaggaggtcgaggaggaggaggagttagcagagattcacctctgcgtgctctggaatagcggctacttaggtattgcttattatgatacttctgattccactatccacttcatgcctgacgcgccggaccacgaaagtctgaagctacttcagagagttttagatgaaattaacccacaatccgtcgtgacatctgccaagcaggacgagaacatgacccggtttctaggtaagctggctagccaggaacaccgggaacctaagaggcctgagataatttttctgccctcggtggacttcggtctcgaaatcagtaagcaaaggctactctcaggcaactacagctttatacctgacgccatgactgccacagagaagatcctctttcttagttcaattattccgttcgattgcttactgactccccccggcgatctacggtttactccaattcctctgctcattccctctcaggttcgcgctctaggcgggctactcaagttcctggggcgacgacgcataggggtagaacttgaagattacaatgtaagcgtgcccatactgggattcaagaaattcatgctgactcatctagtgaacatagatcaggatacgtattccgttctccagatctttaaatctgaatcccacccctcggtgtataaggtggcaagtggcctgaaggagggtttgtctttgttcggaatcttgaaccggtgtcattgcaagtggggggagaagctgctgagactgtggttcacgcgacctacccacgacctgggcgagctgagcagcagattggacgtgattcagtttttcttgctaccccaaaatttagatatggctcaaatgctccacaggcttctcgggcacattaaaaacgtcccattgatcctaaaacgcatgaaactgtcccatacgaaggtgtccgattggcaggtgctgtataaaacagtttattccgctttggggctgagggatgcttgcagatctctaccccagtcgatccaactgtttcgagatatcgcacaggagttcagtgatgacctgcatcatattgcatccttgatcgggaaagttgtggattttgaagggtctctggccgaaaatcgcttcactgtactgcctaatatcgacccggaaattgacgaaaaaaaacgtcggttaatgggcctccctagctttctgacagaagtggccagaaaggaactggagaacctggactctcgaatcccatcttgctcagtaatttatataccacttatcggttttctcctgtctataccaaggttaccctcgatggtggaagcttccgactttgagattaacggactagattttatgtttctgtccgaagagaagctccattatcgatccgcaagaaccaaggagctggatgcactcttaggcgatctgcactgtgagattcgcgatcaagaaacccttttgatgtatcagctgcagtgccaagttctggccagggccgccgtgctcactcgcgtgctggatttggcatcaaggctggacgtgctgctggccctggcttctgccgcaagggactacggatactcccgcccaagatatagtccacaggtgttgggcgtaaggatccagaacgggcgccatccactgatggaactttgtgcacgaacctttgttcctaattctacagagtgtggaggagacaaagggcgggtgaaggtcattaccgggcctaatagcagtggaaaatctatttacctgaagcaggtgggtctgataactttcatggcactagttggatccttcgtgccagccgaagaggctgaaataggagctgtcgatgcaatcttcacaaggatccattcctgtgagtcaattagcctgggtctcagcaccttcatgatcgatttaaaccaggttgctaaagccgtcaataacgcaacagcacagagtcttgtgctgatcgatgagttcgggaagggcacaaacacagtggatggcttggcgctcctggctgcggtacttaggcactggctagcaagagggcccacttgcccccatatatttgtggcaaccaacttcctgagcctggtgcaactgcagctgcttccacagggcccactcgtgcaatacctcaccatggagacttgtgaggatggcaatgaccttgtgttcttttatcaagtgtgtgaaggcgttgccaaagcatcacacgcctcacacaccgcggcccaggcgggcctgcctgacaagctggtggccagaggaaaagaggtgagtgacctgatcaggagcggaaagccaataaagccagtgaaagatctgctgaaaaagaaccagatggagaactgtcagacattggtagacaaattcatgaaattagatctggaagacccgaacctcgacctgaatgtgtttatgtctcaggaggtgctccccgcggccaccagtattctctag

SEQ ID NO: 12458 - DNA, 1200 bp, Artificial Sequence
  Description of Artificial Sequence: Synthetic coding sequence
atggctagcgccgctgcaggggaggcagaagaaacaacgcggctccgtaagcctagattttccttcgaggagaatcaaatcttaatccgagaggtgcgcgcgcactatccacaactgtacggcgcacagtctcggcgggtgtctgtggccgaacgccggagagtgtgggatgggatcgccgcaaaaatcaatgggattacctcgtggaagcgcactgggcaggaggtccagaaaagatggaatgactttaaacgcagaacgaaggaaaaacttgctagggtaccccactcgacacaaggtgcgggtccggccgccgaagatgcgttctcggctgaagaggagactatcttcgcgatcttgggtccaggagtagccgcgcctggggctggtgctggtgccgaggaaccacctgcggccccgtccagtcagccccccccaccctcagcatgccctcagagatatgtccttagtgaagaccgaagagaagacaggcgggcagacacctctgcccatagtaaagcaggaagtagtagtcctgagccgtgggcccgaccatcttgcacacctcaagagggcggctgtccccgacccaaagagcgggaatcccccccaccttctgcgctgcagcctgtacagctgcctcggctcgccctgtcgcccccacctcctgctccaccattgcccccgcctcctccactcgcccaggtagcaccctcacctccctctccacctccgcctcctcgaccaccacccacattaagcgctagcgacccctcccttgatttcctgagggcccaacaagaaaccgcaaacgcgattcgcgagcttgcaggcactctgcgccagggtctggcaaagctgagtgaggcactgagcgcgctgctccctctgctgcccggaacacctgtggactctctgcctccacccctgccacctccccccccgcctccccccccacccaggcctgtcttacccccccccgcaccgaaggtggaaataacacccgagccagtgagtgtggtcgctgccgtggttgacggagcagttgtggcagcaaggggcgtgataatcgctcctcggtctgaggagggagctccccgaccccctcccgccccgttaccacctcacgattccccaccccacaaacgtagaaaaggctttcctacaaggaagagacggggccgctggaagtccccttag

SEQ ID NO: 12459 - DNA, 708 bp, Artificial Sequence
  Description of Artificial Sequence: Synthetic coding sequence
atgaggacgcaggtctacgagggcctgtgtaagaattatttctcacttgctgtgctgcagcgtgaccggattaagttgctcttctttgatattcttgtatttcttagcgtgttcttgctgttcttgctctttctggtggatatcatggccaacaacacaacttcgttaggttctccatggccagaaaatttctgggaagacctgatcatgtccttcaccgtctccatggctattggtctagtactcggcggcttcatctgggccgtctttatatgcctgagccgcagacggagagctagcgctcctatctcccagtggagctccagcaggcggagccgctcaagctatacgcatggactgaatcgcactggcttctatcgacacagtggatgcgagcgacgtagtaacttgagcctagcgtcccttacttttcaacgtcaagcctctctggagcaagcaaattctttcccccgaaagtcatctttccgggcgtccacttttcacccattcctccagtgtccaccactcccagtagagactgagtcccagctggtcacactgccctctagcaacatctcaccgactatcagcacgtcccacagcctgtctaggccggattactggtcctctaattcactccgagtaggcctctctacaccaccccctcctgcctacgaatccatcataaaggcttttccagacagctag

SEQ ID NO: 12460 - DNA, 651 bp, Artificial Sequence
  Description of Artificial Sequence: Synthetic coding sequence
tagcgggacaggatcaagcttctgttttttgatatcctggtgttccttagcgtctttctcttgtttctgctgttcttagtggatatcatggcaaacaacaccacctccctgggaagcccttggcctgagaacttttgggaggacctgattatgtcgtttaccgtgagtatggcaatcggcctcgtactgggaggcttcatttgggcagtgttcatctgcttgtcacggcgccggcgtgcgtcagcacccatctcacaatggtcctcatccaggagaagtagaagcagctatacacacggactaaatcggactggattctataggcatagtggatgtgaacggagaagcaatttatccctggcttccctcaccttccagagacaagcctctctcgagcaagctaattcattcccacgcaaaagctctttccgggcctcgaccttccatccgttcctgcagtgccctccccttcccgttgaaactgaatcccaacttgtgacactcccatcctctaatatctcccctacaattagtacttcccacagcttaagtaggcccgattactggtcatccaattccctgcgggttggtctgagtaccccaccaccgcccgcatatgaatccatcattaaggcattccccgattcctag

SEQ ID NO: 12461 - DNA, 1833 bp, Artificial Sequence
  Description of Artificial Sequence: Synthetic coding sequence
atgcagtatagccaccattgcgaacaccttctggaaaggctgaacaagcaacgcgaggcgggatttctatgcgactgcactattgttatcggggagtttcagttcaaggcacaccgcaacgtgttagcgtctttttccgagtacttcggtgctatatatcggagtacatccgaaaacaatgtgttcctggaccagagccaggtgaaagccgacggctttcagaaactcctggagtttatatatacgggcactctaaatttagactcatggaacgtgaaggagatacatcaggcagcagactacctgaaggttgaagaagtcgtcactaaatgcaaaattaaaatggaggattttgcctttatcgcaaaccccagcagtaccgagatcagttctatcacaggcaatatcgagctgaatcagcagacctgcctgctcaccttgagggactacaacaatagggagaagagtgaagtatcaaccgacctgatccaggctaatccaaagcagggtgccttggcaaagaaatcttcccagacaaagaagaaaaagaaagcttttaactctccgaagacagggcagaataagacagttcaataccctagtgacatcttggagaacgcctctgttgagctgtttctggatgccaacaagctgccgactccggtagtggaacaagtggctcagatcaacgacaacagcgaactcgagttgactagcgtggtcgagaatacctttcctgcacaagacattgtgcatactgtgacggtgaagagaaaaagagggaagtcccagcctaactgtgcactgaaagagcattcaatgtctaatatcgcatctgtgaaatccccatatgaagccgaaaattcgggagaggaacttgaccagcgatattctaaggccaagccaatgtgcaatacttgcggtaaggtgttctcagaagcttccagccttcgaagacatatgaggattcacaaaggcgtaaagccgtacgtctgccatctgtgcggaaaagcttttacacaatgcaatcagttgaaaacacacgtgcggacgcacactggggagaagccctataaatgtgagttatgtgacaaaggattcgcccaaaagtgtcagctggtttttcattcccgcatgcatcatggggaagagaagccctataagtgtgatgtgtgcaacttacagtttgcaacctcttcaaatctgaaaatacatgctagaaagcactctggcgaaaaaccgtacgtctgcgacagatgtgggcaacgattcgcccaagcttctacactgacctatcacgtgagaagacacaccggggagaaaccctatgtgtgcgatacatgcggaaaagccttcgccgtgtcttcgtctctcatcacacatagccggaagcatacaggggagaaaccttacatttgcgggatctgcgggaagagtttcattagctctggagaacttaataaacacttccggtcacacactggggagcggccctttatctgcgagctgtgtggcaacagctacaccgatatcaaaaacttaaaaaagcacaagaccaaagtacattccggtgcggacaaaaccctggatagctccgccgaggatcacaccctgtctgagcaggactcgatccagaaatctcccttatccgaaaccatggatgttaagccgagcgatatgaccctccctctagctttgcctctcgggactgaggatcatcacatgttgctgcctgtgacagacacgcagtctcccacgtccgacacactcctcaggagcactgtcaacggctactccgaacctcagttgatttttctccagcaactgtactag

SEQ ID NO: 12462 - DNA, 1833 bp, Artificial Sequence
  Description of Artificial Sequence: Synthetic coding sequence
atgcagtatagccaccactgcgagcatctgctcgaacggttgaataagcagagagaggctggcttcctctgtgactgtacaattgtgatcggcgagttccagtttaaggcacacaggaacgttctggcatcgttcagcgagtactttggcgcaatttaccggtcaacgtcagaaaacaatgtgtttttggatcagtcgcaggtcaaggcggacgggttccagaagctgctggagtttatctacactggcactctgaacctggatagctggaatgtcaaagagatccaccaggcggcggattacttaaaagtggaggaggtggtgacaaagtgcaagattaaaatggaggattttgccttcatcgccaacccttcctcaaccgagatctccagtatcaccggaaacatagagctcaaccagcagacgtgccttctgacccttcgagattacaacaatagggaaaagtcagaagtatccacagacctgatacaggccaatcctaagcaaggagcactggccaagaaatcctcacagaccaagaagaaaaaaaaggcctttaacagccctaagacaggacagaataagaccgtgcaatacccgagtgatattctggagaatgcttcagtcgaactattcctcgacgctaataaactgccaaccccggtggtggagcaggtggcccagatcaacgacaactctgaacttgagctcacctctgtagtcgaaaatacgttccctgcccaagatattgtccacaccgtcaccgttaagagaaagcgcggcaaatctcagccaaactgcgctctaaaggaacatagcatgtctaacattgcatcagtcaaaagtccatatgaagctgagaatagtggtgaagagctcgatcagcggtactccaaggccaagccgatgtgcaatacctgtggcaaggtgttctccgaagcctcttccctgcgccgacacatgcgtatccacaagggggtcaagccctatgtatgtcacctgtgtggtaaagccttcacccaatgcaatcaactgaaaacccacgttcgcacccacacaggggagaaaccctacaagtgcgagttatgcgacaagggctttgcacagaaatgccagttggttttccatagtcggatgcatcacggggaagagaagccgtataagtgcgatgtgtgcaacctgcagttcgccactagctcaaatctaaagattcatgcacgcaaacacagtggagagaagccatacgtttgtgacaggtgtggtcagaggttcgcccaagcttctacacttacttaccatgtgcggcgccacactggagaaaagccttacgtgtgcgatacatgcggcaaggcctttgctgtttcgtccagtctgattacccattctcgaaaacataccggagaaaaaccctacatctgcggcatctgtggcaagtcttttatttcgtctggcgagctcaacaaacactttcggtcccataccggcgagcgaccttttatttgcgagctgtgtggcaactcctacacagacataaaaaatctgaagaaacacaaaaccaaagtgcatagcggtgcggacaaaacactcgacagttcagccgaggatcacaccttaagcgaacaggatagtattcaaaaatctcctctctctgagacgatggatgtgaagccaagcgacatgaccttgcccttagctttgcctctggggaccgaggaccatcacatgctcttgccggtgaccgatactcagagccctacttccgacaccctgttacgctcaactgttaacggctattcagaacctcagctcattttcctccagcagttgtactag

SEQ ID NO: 12463 - DNA, 1503 bp, Artificial Sequence
  Description of Artificial Sequence: Synthetic coding sequence
atgcagtattctcaccactgtgaacacctgctagagcgactgaataagcagcgcgaggcggggtttttgtgtgactgtacgatcgttatcggcgagttccagtttaaggcccatcgcaatgttttggctagcttttccgaatattttggtgctatttacaggtctacctcagagaacaacgtattcctggaccaaagccaggtaaaggcagacggctttcaaaagctgttggagtttatttacactggcactttgaatctagacagttggaacgtaaaggagattcaccaggcagcagattatctcaaggtggaggaagttgtgacgaagtgtaaaataaaaatggaggatttcgccttcattgccaatccgagtagtaccgagatttcttccatcactggcaatatcgaactgaatcaacagacttgtttgcttacgctgagagactacaataacagggaaaagtccgaggtgtctacagatctaatccaagcaaaccccaaacagggcgccctggccaagaagagttctcaaacaaagaaaaagaaaaaagcattcaacagtccgaagaccggacagaacaagactgtgcagtatccaagtgatatcctggaaaatgcgagcgtggaactgttcctggacgctaacaagttgccaacgcccgtcgtggagcaggtggctcagatcaacgataacagtgaattggagttaacctccgtggtcgagaacacctttccggcgcaagacatcgtccatacagtaacagtcaaacgaaaaagagggaaatcccagccaaattgcgccctgaaggaacactccatgagcaatattgcttctgtcaagtctccctacgaggccgagaattctggagaggagcttgaccagagatacagcaaagctaaacccatgtgcaatacctgcggcaaggtgttctcagaggcaagttcacttcgtcggcacatgcggattcacaaaggagtcaagccgtatgtgtgtcatctgtgcggcaaggcgttcacacagtgtaaccaactgaagacgcacgtaaggacccatactggcgaaaagccctacaaatgcgagctctgtgataaaggtttcgcccagaagtgtcagcttgttttccatagccggatgcatcatggcgaggagaaaccttacaaatgtgacgtgtgcaacctccaattcgccacctcgagcaatctcaagatccatgcgcgcaaacattccggtgaaaagccttacgtttgtgaccggtgtggacagcgctttgcacaggccagcacacttacgtaccatgtgcgacgccacaccggagaaaaaccgtatgtctgtgatacgtgtggcaaagccttcgctgtgtcctcttcactgataacccatagcaggaagcataccggggagaaaccgtacatctgtggaatatgcggaaagtccttcattagttcgggagaactcaataagcatttccgtagccacactgtggtctggagcatgaactag

SEQ ID NO: 12464 - DNA, 1746 bp, Artificial Sequence
  Description of Artificial Sequence: Synthetic coding sequence
atgcaatactcgcaccactgcgagcatctcctggaacggctgaacaaacagagggaggccggtttcctctgcgactgtaccatagtcatcggggagttccagttcaaggcccacaggaacgtgcttgcgagcttctctgagtattttggcgcaatctatagatcaacatcagaaaacaatgtcttcctggaccagtcccaggtgaaagccgatggtttccagaagctactggagttcatttacacaggaactctcaacttagattcctggaacgttaaggaaattcaccaagctgcagactatctcaaggtcgaggaggtagtgacaaagtgcaagatcaaaatggaagatttcgcctttatcgctaatccatcatccaccgagatctccagtatcacaggaaacattgagctgaatcagcaaacatgcttgctgacactccgagactacaacaaccgggagaagtccgaggtgagtactgatttaatacaggccaacccgaaacaaggcgctctcgcaaaaaaatcttctcagaccaagaagaagaaaaaggccttcaatagtcccaagacaggtcagaataaaaccgtgcagtatccaagcgacatcctggaaaatgcaagtgttgaactgttcctggacgcgaataaattaccgacacccgtggtggagcaagttgctcagatcaatgataactctgaactcgaactcacaagcgtcgtagaaaatacttttcccgcccaggatatcgttcacaccgtaacagtcaagcgcaaacgtgggaagagccaaccaaattgtgccctgaaagagcactcaatgtcaaatatagcttcagtgaaaagtccctatgaggcggaaaactcaggtgaagaattggaccaacggtacagtaaggcaaagccaatgtgcaatacctgcggaaaggtgttcagcgaagcgtcgagtctccgcaggcatatgaggatacataagggagtcaaaccgtacgtgtgtcacctctgtgggaaagcctttacccagtgcaatcagctaaagacccacgttaggactcatactggcgagaagccctataagtgtgagctttgcgacaaggggtttgcccagaagtgccagcttgtgttccattctcgcatgcaccacggggaggagaaaccctataaatgcgacgtttgcaatctgcagttcgcgacttcatcaaacttgaagatccatgctcggaaacattcaggggagaaaccatatgtgtgcgaccggtgtggtcagaggttcgctcaggcgagtaccctcacataccacgtgaggcggcacacaggcgagaagccatatgtgtgtgatacctgcgggaaagctttcgctgtcagctccagcttgatcactcattcccgcaagcataccggcgagaagccgtacatctgcggcatatgcggcaagtcattcatttcatctggcgagctcaataagcatttcagaagtcatactggcgctgacaagacattagattcttccgccgaggaccacacactgtctgaacaggattccattcagaaatccccactgtctgagactatggatgtcaagcccagtgacatgactctgccgcttgcactgcctctggggaccgaagatcaccatatgctgttacctgtgaccgatactcagtctcctactagtgataccttgcttcgctcaaccgtgaacggttacagcgaaccacagcttatttttctgcagcagctgtactag

SEQ ID NO: 12465 - DNA, 1167 bp, Artificial Sequence
  Description of Artificial Sequence: Synthetic coding sequence
atgttgaaagttaagcggctggaggaattcaacacttgttacaatagcaaccaactggagaagatggccttctttcagtgcagagaggaagtagaaaaggtgaagtgctttctcgaaaagaattcaggcgaccaagacagcagaagcggacacaatgaggccaaggaggtctggagcaacgccgatctgacagagaggatgccggtgaagtctaaaaggacatctgctctcgccgtggatattcctgcgccccccgctcctttcgaccacagaattgtgactgccaagcagggcgccgtgaactccttttatactgtgagtaaaaccgagatcctgggtggaggaaggtttggtcaagtgcacaaatgcgaggagaccgcgactgggttgaagctggccgccaagataataaaaaccaggggtatgaaggacaaagaggaggtcaaaaatgaaattagcgtaatgaaccagctggaccacgctaatctgatccagctctatgatgcattcgagagcaaaaatgacattgtgctcgtgatggagtacgttgacgggggggaattgttcgacaggataatcgatgaatcatacaacctcacggagctcgataccattctgttcatgaaacagatatgtgagggtatccggcatatgcaccaaatgtatatactgcatctagatttgaagaccacgtcctttcaatgctctagattcctcattgacacctcaatactgcctctgtgtttactaaattgtcgttataagcctcgcgagaagttgaaggtaaacttcggcacccccgagtttctggccccagaggtcgtcaactatgactttgtgagtttcccaacagatatgtggtccgttggcgtgattgcatacatgctgttgagtggcttgtctcctttcttgggcgacaacgatgcagaaactctaaacaacattttagcctgcaggtgggaccttgaagacgaagagttccaggatatcagcgaggaggctaaggagtttattagtaaactgttgatcaaagagaaatcttggaggatcagcgcatctgaggccctaaagcacccatggctgtccgaccacaaattacatagccgcctgaacgcccagaaaaaaaaaaaccgcggaagcgacgctcaagatttcgtcaccaagtag

SEQ ID NO: 12466 - DNA, 1167 bp, Artificial Sequence
  Description of Artificial Sequence: Synthetic coding sequence
atgctgaaggtgaaaaggctggaggagtttaacacatgttataactctaaccagctcgagaagatggcatttttccagtgcagggaggaagtggaaaaagttaaatgtttcttggagaagaacagtggtgaccaggacagcaggtcgggtcacaacgaggcgaaagaagtttggtcaaacgcagatcttactgagagaatgccagtgaaaagtaagaggacgtctgccctcgcagttgatatacccgccccaccagcgcccttcgaccaccgcatcgttaccgcaaaacaaggtgctgtgaattcgttttacacggtgagcaagaccgagattctgggtggcggccgatttggccaggtgcacaagtgcgaggaaacagcgacaggacttaaattggcggcaaagatcattaagacgagaggtatgaaggataaggaggaggtaaagaatgaaataagtgttatgaaccagttggatcatgctaacttgattcagctatatgacgcctttgagtccaagaacgatattgtgttagtgatggagtacgttgatgggggagagctgtttgatcgcataattgatgagagttataacctgacagagctggacacgatcctctttatgaaacagatctgtgaggggatacggcacatgcatcagatgtacatccttcatctggacctgaagcctgagaatattctctgtgtcaacagagatgctaaacagattaaaattatcgactttgggcttgctaggagatacaaaccacgcgaaaaactgaaggtaaactttggaaccccagagttcctggctcccgaagtcgtaaattacgatttcgttagttttcccacagacatgtggagcgtcggtgtgattgcatacatgcttctatcaggtctcagtccatttctgggtgacaatgatgccgaaacactgaataatattttggcctgtcgctgggacttagaggatgaagagttccaggatatcagcgaggaggcaaaagaattcatatcaaagctgctcattaaggaaaagtcttggcgaatcagtgcttctgaagccttgaaacacccctggctgtctgaccacaaactacattctagactcaatgctcagaaaaagaagaatcgcggaagcgacgcccaagacttcgtgaccaaatag

SEQ ID NO: 12467 - DNA, 576 bp, Artificial Sequence
  Description of Artificial Sequence: Synthetic coding sequence
atggctatgcacaataaggccgctccaccgcagatccccgatactagacgcgaactggcggagcttgttaagcggaaacaagaacttgccgagactctggcgaacctggaaagacagatttatgcctttgaagggtcctatctagaggatacccagatgtatgggaacatcatacggggctgggacagatatctgacgaatcagaagaactctaatagcaagaacgatagacgtaatcgaaagttcaaagaagctgaacggttgttctctaagtcaagcgtgaccagcgcagcagccgtgagtgccctggcgggagtgcaggaccagcttatagagaaaagggaacctggttccggaacagaaagcgacacctctccggattttcataatcaggagaatgaacccagccaggaagaccccgaggatttggacggtagcgtccagggggtcaaaccccagaaagctgcttcatctacttcgagtggctcgcaccattcatcacacaaaaaaagaaagaataagaatcggcatagaattgaccttaagttgaataaaaaacccagagccgattactag

SEQ ID NO: 12468 - DNA, 579 bp, Artificial Sequence
  Description of Artificial Sequence: Synthetic coding sequence
atggccatgcataataaggcagctcccccacagatcccagacactagaagagagctagcagagctcgttaagcgtaaacaggaacttgcagagactctcgctaacctggagagacagatttacgcgttcgaaggaagctacttggaagacacccagatgtatggcaacatcatccggggctgggacaggtacttgactaaccagaagaactctaactctaagaacgaccgacgaaataggaaatttaaggaggctgaaagactcttctctaaatcgagcgttacctctgcggccgccgtgtcagcacttgcaggagtgcaggatcagttaatcgaaaaaagagagccaggctccggaacggaatccgataccagccccgactttcacaaccaagagaacgagccttcccaggaggacccagaagatctggacggttctgtacagggggtgaagcctcagaaagccgcaagttcgacttcctctggttcccatcacagcagccataagaaaagaaaaaacaagaacaggcaccgtatgaacgtcagtcccaagacaggatggcaccagctgcacttgtag

SEQ ID NO: 12469 - DNA, 510 bp, Artificial Sequence
  Description of Artificial Sequence: Synthetic coding sequence
atgtcactgttcttcatatcccaggaaacactggccaacctggaacgccagatctacgcttttgaaggcagctatcttgaggacacccaaatgtatggtaacatcatcaggggctgggataggtacctcacaaatcaaaaaaatagtaacagcaaaaacgatagacggaatcgtaagttcaaggaggctgagcggcttttctctaaaagcagtgtgacttccgccgcggcagtgagtgctttggcaggcgtgcaggatcaattgatagagaagcgggaacccggctcagggactgagtctgacacctccccagacttccacaatcaagagaacgagccctctcaggaggaccccgaagatttggatggatccgtgcaaggcgtgaaaccccagaaagcagctagctccacctcctctgggtcgcaccattcaagtcacaagaaacgtaagaacaagaatcgccaccggatcgaccttaagttaaacaaaaaaccaagggccgactactag

SEQ ID NO: 12470 - DNA, 606 bp, Artificial Sequence
  Description of Artificial Sequence: Synthetic coding sequence
atggccatgcataataaagccgccccacctcagatcccagatactcggagggagttggctgagctcgtaaagaggaagcaagagcttgccgagacattggccaacctcgaaaggcagatatacgcctttgaaggtagttatttagaggatactcaaatgtacgggaacatcatccggggatgggatagatatcttacaaatcaaaaaaatagtaactcgaagaatgacagacgcaaccggaaattcaaagaggcagagcggctattctcaaagagctcagttacgtcagcggcagcagtgtccgctctggctggcgttcaggaccagctaatagagaaacgtgaacccgggtctggtacggagtccgatacctccccggacttccataatcaggagaacgaaccttcccaggaagaccctgaagatctagacggatcagttcagggtgtcaaaccccagaaggcagcttccagcacaagcagcggcagccatcattccagccacaagaaaaggaaaaataagaacagacactctccttcaggtatgttcgactacgacttcgaaattgatcttaagctaaataagaagccacgagcagattactag

SEQ ID NO: 12471 - DNA, 576 bp, Artificial Sequence
  Description of Artificial Sequence: Synthetic coding sequence
atggcgatgcacaataaagcagctccaccacaaatccctgacacacgtagggagcttgccgagttagtgaagcgcaaacaggaattggccgaaaccctggccaatctggaacgacagatttacgcctttgagggcagttacctggaggacacacagatgtacgggaatatcatccgagggtgggacagatacttaactaatcagaagaactccaatagcaagaatgaccgcaggaacagaaaatttaaagaagcagagaggctgtttagtaagagctcagtgacatccgctgcagctgtcagcgcgctggcgggagtgcaagatcagctcatcgagaagagagagcccggttccggaacagaatctgatacctctccagacttccacaatcaggagaacgaaccgtctcaggaggacccagaggacctggacggttccgtgcaaggggtgaaaccccaaaaggccgccagtagcacaagctctgggtctcaccatagctctcacaagaagaggaaaaacaaaaaccgacactctccttctggcatgtttgactatgatttcgagtatgtctactag

SEQ ID NO: 12472 - DNA, 291 bp, Artificial Sequence
  Description of Artificial Sequence: Synthetic coding sequence
atgaccagcgctctggagaactacatcaatcggaccgtcgccgtcatcaccagtgacggtcggatgattgttggtactcttaaaggatttgaccaaaccataaatctgatcctggacgagagccacgaacgggtcttcagttctagtcagggggttgagcaagttgtgctggggctgtatatcgttcgaggagataacgtggccgtcatcggcgagatcgacgaggaaaccgattccgccctggacctgggtaatattcgggccgagccactgaacagcgtggcccactag

SEQ ID NO: 12473 - DNA, 1764 bp, Artificial Sequence
  Description of Artificial Sequence: Synthetic coding sequence
atgtcacagatgctccacatagagataccaaacttcggaaacacagtcctgggatgcttgaatgagcaacgactgctggggctttattgtgacgtgtctattgtggtgaaggggcaggcatttaaggcacatcgcgccgtgttggctgcctcctctctttacttccgagatctgttcagcggaaattcaaaatcagctttcgagctgcctgggagcgtcccaccagcatgttttcagcagattctctcattttgctatactggccggctgactatgacagcctccgagcagcttgtggtgatgtatacggctggctttcttcaaatccagcacatcgtcgaacgcgggacagaccttatgttcaaggtgagttctccccactgtgactctcagacggcggtcatcgaagacgctggtagcgagcctcagagtccttgtaaccagctccagccagccgccgccgctgccgccccttacgtggtctccccaagtgtgcctattcccctactgactcgagtcaaacacgaggccatggaactacctccagccggccctggcctagcacccaaaaggccactggagacaggcccacgcgatggcgttgcggtggcagcaggtgccgccgtcgcggccggaacggcccctctgaagctgcctcgggtaagctactatggcgttccaagtctcgccactttgattcccggaatacagcagatgccatatccccaaggcgagagaactagcccaggggcctcttcgctgcccaccaccgatagccccacctcttaccataatgaggaagacgaggaggatgatgaggcatacgatacaatggtcgaggagcagtatgggcagatgtatattaaagcttccggcagctacgctgttcaggaaaaacctgagcctgtcccactggagtcacgctcctgcgtgctgattaggcgggaccttgtggctctgcccgcctccctgatctcccagataggatacagatgtcacccaaagctctattctgaaggcgaccccggcgaaaagctggagttggtggcaggatccggagtgtatatcacaagaggccagctgatgaattgccacctgtgcgctggagtgaaacacaaggtgttactgagacgccttctcgccacgttctttgatcgaaatacccttgctaactcctgtggcacggggatccgaagcagtacctccgatcccagcaggaagcccctggattcacgagtcctgaatgccgtgaagctgtattgccagaatttcgccccctctttcaaagagtcagagatgaatgtcatcgcggcggatatgtgtacgaatgcccggagggtaaggaagcgctggcttcccaaaatcaagtccatgcttcccgaaggagtggaaatgtatcgcacagtcatggggagtgccgctgccagcgtacctttggaccccgaatttcccccagccgcggcccaagtatttgagcagaggatctatgctgaaaggcggggcgatgccgctaccattgtggctttgcgcaccgacgctgtgaatgtggacctatccgccgctgccaatcctgcctttgacgccggggaggaggtagatggtgccggctcggtcatccaggaagtggctgcccctgaacctttacccgccgacggccagagcccccctcagccgttcgagcaaggggggggagggccgtccagaccccagacccccgccgctgccgctaggaggccagaaggtacatacgctggcaccctgtag

SEQ ID NO: 12474 - DNA, 1764 bp, Artificial Sequence
  Description of Artificial Sequence: Synthetic coding sequence
atgagtcaaatgctccacattgagatccccaacttcggaaacacagttctgggctgtttgaatgaacagaggctcctgggcctgtactgtgatgttagtatcgtagttaagggtcaagcttttaaggctcatagagcagtgttagcagcctcttcgctttactttcgcgatttgttttctggtaactccaagtccgcatttgaactacctggcagcgttcctccggcctgcttccagcagatactttcattctgttatactgggaggctcaccatgactgcatcagagcagcttgtcgttatgtacaccgcgggattcttacagatccagcacatagttgaaaggggcaccgatctcatgtttaaggtctcatctccacactgcgacagtcagacagcagtcatcgaagatgcggggagcgagccccagtctccctgtaaccaactacagccagctgctgccgctgccgcaccctacgtggtatctccatccgtgcccattcccctgctcactcgcgttaagcatgaagcaatggagttaccacccgctggaccggggttggcgcccaagaggccactggagacaggccccagagatggtgtggctgtagcggcaggcgctgctgtggcggcaggcaccgcccctctgaagctcccgcgggtgagctactacggggtgccaagcctggcaacacttatccccggcatacagcaaatgccatacccccagggcgagaggacctcccctggggcttcctctttgcccactaccgattcaccaacctcctatcacaatgaggaggacgaggaagatgacgaagcctacgataccatggtggaggaacagtacggccaaatgtacattaaggcatctggcagttacgcagtgcaggagaaacctgagccagtgccgctcgagtctaggtcatgtgtgttgatccgtcgggatctagtcgctctacccgcttcactgattagccagattggctaccggtgtcatcctaagctctacagcgagggagatccaggcgaaaaactcgaactagtcgccggctcaggcgtgtacatcacaagaggtcagttgatgaattgtcacttgtgcgcgggggtaaaacataaagtgctcctgagaaggctgctggcaactttcttcgaccgaaacactctggccaatagctgcggaactgggatcaggtcttcaaccagcgacccttccagaaaaccactggacagcagggtcctcaacgccgttaaactttattgccagaatttcgctccatcattcaaagaaagcgagatgaatgtcatagccgctgatatgtgtactaatgccaggagagtcaggaagcgttggcttccaaaaattaaatctatgctgccagagggtgtcgaaatgtacaggaccgtgatgggctccgctgcagcctccgttcccttagaccctgagtttcctcctgcagccgcgcaggtgttcgagcagcggatttatgcagagcgcagaggcgacgcagcaaccattgtcgccctgaggactgacgccgttaacgtcgatctgtcagccgccgcgaaccctgcgttcgatgccggagaggaggttgacggcgctggatcagtgattcaggaggttgctgcgccggaacccctgccagccgatgggcagagcccaccccaaccctttgaacagggtggcggcgggccttcaagaccacagaccccagccgccgcggctagacgcccggagggtacctatgcaggcacgctgtag

SEQ ID NO: 12475 - DNA, 3078 bp, Artificial Sequence
  Description of Artificial Sequence: Synthetic coding sequence
atgcaccgcaaaaaagtggacaatcgaatccgtatcctcatcgaaaacggcgtggccgaaaggcagagaagccttttcgtggtggtgggagatcgggggaaggaccaggtcgtgatcctacaccacatgttgtcaaaagctacagtaaaagctcgaccaagcgtgttatggtgctataagaaggaactgggctttagctctcaccgcaagaagcggatgaggcagctccaaaaaaagattaaaaacggtaccctgaacatcaaacaggacgacccttttgaactgtttatcgccgcgactaacatcaggtactgctactacaatgaaacgcacaagatcctgggaaatactttcggcatgtgcgttctccaggatttcgaagccttaacgcctaacctgctggcccgtaccgtggaaaccgtggaggggggtgggctagtggtgatcttgctacggacgatgaactccctgaaacagctgtatacagtaactatggatgtgcattcaaggtatagaactgaagctcaccaggacgtggtgggccgcttcaacgagcgattcatcctgtctctggctagctgcaagaagtgcctggttattgacgaccaattgaatattctgcccatctccagccacgttgcaacgatggaagccctgcccccccagaccccagatgagtccctggggccctctgatctggaactgcgggagttgaaggagtctctgcaggacacccagcctgtaggggtgctcgtggactgctgcaaaacattagatcaagccaaggcggtgcttaagttcatcgagggcatctccgaaaaaacattgaggtcaaccgttgctctaactgcagccagaggtagaggcaaatcagccgctctcggattagccatcgcaggggccgtcgcctttgggtactccaacatcttcgtgacatccccaagccccgataatttgcatactttattcgagttcgtgtttaagggtttcgatgccttgcagtaccaggagcacctcgactatgagatcatacagagcctcaatcccgaattcaataaagccgttatcagggtaaatgtcttcagggaacaccggcagacaatccagtacatccatcccgccgatgccgtgaaattaggccaggccgaattggtggtcattgacgaggctgccgctattcccctcccactagtgaagtcactgctgggaccttatcttgtgtttatggcttcaacaatcaacggctacgaaggaaccgggcggagcctgagcttaaaattaattcaacaactaagacagcaatccgcccaatcacaagttagcactaccgccgagaacaagaccaccaccaccgcgaggctcgcttctgctaggaccttgtacgaagtgtcgctgcaagagagcattcgatatgctcctggagatgccgtggagaaatggctaaatgacctcctctgcctggactgtctcaacatcacccggatcgtgagcggctgccctctgccagaggcatgcgagctgtactatgtcaatcgagacaccctgttttgttaccacaaggctagtgaggtgtttctgcagcgccttatggccctttacgttgcatcccattataaaaactctccaaacgacctgcagatgctgagcgacgcaccggcccaccatttgttctgcttgctgccacctgtgccgccaacacaaaatgccttgccagaagtgctggctgtgatccaggtctgtctagaaggcgagattagtagacagtctatcctcaactcgttgagccgggggaagaaagcatccggtgaccttatcccatggacagtctccgaacaattccaggacccagactttggtgggctgtcaggtggccgcgtagtcagaatcgcggtccatcccgactaccagggtatggggtatgggagccgggccctccaacttttacagatgtattatgaagggaggttcccttgcttggaggaaaaggtcctggagaccccccaggagatacataccgtatcttccgaggcggtgagtctgctagaagaggttatcacccctaggaaagacctgcccccactgctcctcaaacttaacgagaggcctgccgagcggcttgattatctgggggtcagctatggccttaccccaagattactgaaattctggaagcgcgcaggcttcgttccagtatacttacggcagactccaaatgacttgacaggggaacattcctgtataatgttgaaaacattgaccgatgaagacgaggccgaccaagggggctggttggcggccttttggaaggactttcgtaggcggttcctggcgctcctgtcctaccagttctctacattctccccctcattggctctaaatattatacagaacaggaatatgggtaaaccagcgcagcctgcccttagtcgcgaagaactagaggccctgttcctgccctacgatctcaagcgtttggaaatgtactcaagaaacatggtggactatcatctgatcatggatatgatacccgccatatctagaatctactttcttaatcagttaggggatctagccctctcagcagctcagtcagccctgttgctgggcattggactgcaacacaaatcagtagaccagctggagaaagagatcgagcttccatcgggtcaactcatgggcttattcaaccggatcatccgaaaggtggttaagttatttaatgaggtgcaggagaaggctatcgaggaacaaatggtagctgccaaggatgtggttatggaacctactatgaagacactgtcggatgacctggacgaggccgcaaaggagttccaagagaaacacaagaaagaggtgggaaagctcaagtcgatggacctgagtgaatatatcatacgcggcgatgacgaagagtggaatgaggttctgaataaagccggcccaaatgcgtcgattatttcactcaagtctgataagaagagaaaactcgaagccaaacaggagccaaaacagtccaaaaagctgaagaaccgagagactaagaataaaaaggatatgaagctgaagcggaagaaatag

SEQ ID NO: 12476 - DNA, 2862 bp, Artificial Sequence
  Description of Artificial Sequence: Synthetic coding sequence
atgcggcagttacagaaaaagatcaagaacggcactcttaacattaagcaggacgacccattcgagctttttattgcagcgaccaacatcaggtattgttattataatgaaacacacaagatacttggcaacacatttgggatgtgcgtgttacaagactttgaggctttaactccaaacctgctcgcgagaacggtagagactgtggaggggggggggctggtcgtcattctactgcggacaatgaacagcttgaaacagctttatactgtgaccatggacgtgcattctagataccgaacagaggcccatcaggacgtcgttggacggttcaacgagagatttatcttatccctggcaagctgcaagaagtgccttgtgatcgatgaccaactcaatatcctgccaatatcgtcccacgtggccaccatggaagccttgcccccccaaacgcctgatgagagtctggggcccagcgatctggaactgagggagctaaaggagagcctgcaggacactcagccagtgggcgtgctggtcgattgttgcaagacactggatcaggccaaagctgtgctaaagtttatagaggggatctccgagaagacgcttagatccactgtggccctgactgctgctcgcggtcgaggaaagagcgccgctctcggactggcaatcgctggagccgtggcctttggttatagcaatatcttcgttacctccccgtcccccgacaatttacacaccttgtttgagttcgtctttaagggattcgatgccctgcaatatcaagaacatctcgactacgaaatcatacaaagcctgaacccagagttcaacaaggctgtcatcagggttaacgtgttccgcgagcaccgccagaccattcagtacatccaccctgctgacgccgtgaagctcggtcaggctgagctggttgtgatcgatgaggctgccgctattccactgcccctcgtcaagagcttactaggcccttacctggtttttatggcttccacaatcaacggctacgaaggtacaggcagatcactatccctaaagctgatccagcagctgcgtcagcagagcgcccagtcccaggtaagcaccacagcggagaataagactactaccacagctaggctcgcttcggcgagaacactctacgaagtcagtcttcaggagagcatacggtacgcacccggcgacgcggtagagaaatggctgaatgatcttctgtgcctggactgtctgaatattactagaatagtatctgggtgtccactacccgaggcctgtgagctatactacgtgaaccgtgacactctgttctgttatcataaagctagcgaagtgtttttacaacggctgatggctctctacgtggcctcacattataaaaattctcctaacgacctgcagatgttatctgatgcccctgctcatcatctgttctgtctgcttccgccggtgcctcctacccagaacgctctgccagaggtgctggccgtgatccaggtctgtctggagggtgagatatcgcgccagtcaattctaaattccttgagcagagggaaaaaggccagtggagatttgattccttggaccgtgagcgaacagttccaggaccctgattttgggggcctatcagggggaagggtggtccggatcgcagtgcaccccgactatcagggcatgggctacggctctagagccttgcagctcctgcaaatgtactatgagggacggtttccttgtcttgaggagaaggtattggagacacctcaagagatccatacggtgtccagtgaagccgtcagtttgctggaggaggttatcacaccaagaaaggatctgccaccgctgttgctcaaattgaacgaacggccggcagaaaggctggattacctgggggtgtcttatgggctaacacctcggttgcttaaattctggaagcgggcaggctttgtgcccgtttaccttaggcagacccccaatgacctgacaggcgaacactcctgtataatgcttaagacacttaccgacgaggacgaggcagatcagggagggtggttggccgctttttggaaggatttccgtagacggttcctcgccctactatcttaccagttcagtactttcagtcctagtctggcgctcaacattatacagaatcggaatatgggcaagcctgcccaacccgcactaagccgtgaggaactggaggcgctcttcctgccatatgatcttaagcgtttggaaatgtattcaagaaacatggtagattaccatttgattatggatatgattcctgccatttcgcggatctactttctgaaccagcttggtgatctggccctgagcgccgcccagagcgcgctactacttgggataggacttcagcacaaatccgtcgaccagctcgaaaaggaaatcgaattgccatctggccagctgatgggcctatttaacagaattatcaggaaggtggtgaagttgttcaacgaggttcaagagaaagccatcgaagaacagatggtcgctgctaaggacgtcgtgatggaaccgacgatgaaaacgcttagtgacgaccttgacgaagccgcaaaggaattccaggaaaagcacaaaaaggaggtgggtaaactcaagtctatggacctgagcgagtatatcatcaggggcgatgacgaggaatggaacgaggtcctgaacaaggcaggccccaacgcatccattatatccctgaaatcagacaagaagcgcaaactggaggccaagcaagaaccaaagcagtccaaaaagcttaaaaatagggaaacaaagaacaaaaaagatatgaaactcaagcggaagaagtag

SEQ ID NO: 12477 - DNA, 711 bp, Artificial Sequence
  Description of Artificial Sequence: Synthetic coding sequence
atgacaagtgaaaaggggccctccacgggtgaccccaccctgaggcgtcggattgagccatgggagttcgacgtattctatgacccacgcgagttgagaaaggaggcctgcctgctctatgagatcaagtggggcatgtcccgaaagatttggcgcagctcaggaaagaacacaacgaatcatgtcgaagtgaacttcatcaaaaagtttacctccgaacgggatttccacccatcaatgagttgctctattacctggttcctcagttggagcccctgctgggagtgctcccaagccatccgggagtttcttagcaggcacccaggtgtcaccctcgtgatctacgtggccagactgttctggcacatggaccagcaaaatcgccagggtctaagagacttagtcaactctggagtgacaattcagatcatgcgcgcctccgaatactatcattgctggcgtaactttgtgaattatccccccggcgacgaggcccattggccccagtatccccccctgtggatgatgctgtatgccttagagttgcattgtatcatcctgtcactgccaccttgtctgaaaattagcaggcgctggcaaaaccaccttacattcttcaggctgcacttgcagaattgccactatcagaccataccccctcacatccttctcgcgaccggactgatccatccgagtgtcgcctggaggtag

SEQ ID NO: 12478 - DNA, 870 bp, Artificial Sequence
  Description of Artificial Sequence: Synthetic coding sequence
atgagtgttgatcctgcttgcccacagtcccttccctgcttcgaggccagtgactgtaaggagtctagccctatgccagttatctgtggcccagaggaaaactatccgagccttcagatgtcttcagctgagatgccccataccgaaactgtgagccctctgccgagctccatggatcttctgattcaggactctccagacagctcaactagccccaagggaaagcagcccacttcggccgagaaatcagtagctaagaaagaagataaggtcccggtcaagaaacagaaaacaaggactgtgtttagcagtactcaactttgcgttttgaacgaccgctttcaaaggcagaaatatctgtctctacagcagatgcaggaactctccaatatcctgaatctgtcctataagcaggtaaagacctggttccaaaaccagagaatgaagtctaaacgctggcagaagaataactggccaaagaacagcaatggcgtcacacagggctgtctggttaatccgaccgggaatctccccatgtggagcaatcagacatggaataatagcacctggtctaaccagacccagaacattcaatcctggtctaatcactcttggaatacacagacgtggtgcacccagtcttggaacaaccaagcttggaacagccctttctataactgtggcgaggaatccctgcagtcctgcatgcaattccagccaaatagtcccgcttcagatctggaggccgctttagaggctgcaggcgaaggcctgaatgtcatacagcagactacccgctacttcagcacaccccagacgatggatctctttctgaattactccatgaacatgcaacctgaggacgtgtag

SEQ ID NO: 12479 - DNA, 567 bp, Artificial Sequence
  Description of Artificial Sequence: Synthetic coding sequence
atgcacagagcgaggtggctcacacctgttatacctgctttatgggaggccgaggctggaagatcacgggggcaggaaatcgagactatattggccaataaaaagcagtccgcaatgccgtgggaccaagaccctgaacagtcaaccgggaactacagcgaagatgagcagaatgggaagcagaagtggcgagaagagggtgaggcagggagaaagcgcgaacgggagaaagaagaaaagaatgagaaggaactgcaggacgaacaagaaaacaaacgcaagcgcgagaatgagaagcagaagcagtaccctgaaaaaagattggtaagcaaaagtctgatgcatacactgtgggcaaagttcaagctgaatcggtgccccaccattcaggaatctctgtctctgtcatttgagttcgatatgacacacaagcagattagccagtggttctgtaaaacgagaaagaaatataacaaggagatgtctaagcggaagcacaagaagaaacacatgagatggagatccctgtgttgtcagggctggagtcgcactccagcccttaagtag

SEQ ID NO: 12480 - DNA, 2691 bp, Artificial Sequence
  Description of Artificial Sequence: Synthetic coding sequence
atggcagccagggccgtcctggacgaattcacagccccagcagagaaggccgaactgctggagcaaagcaggggcaggattgaggggctgtttggcgtttcccttgccgtgcttggagccctgggggcagaggaacctttgcctgctcgcatctggctgcagctgtgcggcgcgcaggaagccgtgcatagcgcaaaagagtacattaagggcatttgcgaaccggagttggaggaaagagaatgctaccccaaagacatgcactgcattttcgtaggtgctgagagcctgtttttgaagtccctgatccaggacacatgtgccgatctgtgcatattagacataggcctgcttggaatccgtggcagcgccgaggccgtggttatggcacgaagccacatccagcaattcgtcaagctattcgagaacaaggaaaacctacccagctcccaaaaagagtctgaggtaaaaagagagttcaaacagttcgtggaggcccatgccgataattatactatggacctcttgatccttcctacatcgctcaagaaggagctactcacactgacccagggtgaggaaaacctatttgagaccggggatgacgaggtcatcgaaatgagagatagtcagcagaccgaatttacccagaatgctgccaccgggctaaacatttccagggacgagaccgtattacaagaggaggctagaaacaaagccggcacaccggtatcagagttgactaaacaaatggacacagtgctcagctcctcgcccgacgtcttatttgacccgattaacgggctcactcctgacgaagaggccctctccaatgaacgcatatgccagaaaagaagattcagcgactccgaggaacgacataccaaaaagcagttctctttggagaacgtgcaggagggcgaaatcttacatgacgccaaaacccttgcagggaacgtgatagctgacctttccgacagctctgctgatagcgaaaacctttcgccggacattaaggagactaccgaagaaatggaatacaatatactggtgaattttttcaagaccatgggatactctcaagaaatagtcgagaaggtcattaaagtttacgggcccagcaccgagcccctgttgctgcttgaggagatcgagaaggagaataagcggtttcaggaggacagggaattcagcgctggtacagtttaccccgagacaaacaagacaaagaataagggagtctattcaagcactaatgaactgacaactgattctactccaaaaaagacacaggcgcatacacagcagaacatggtcgagaaatttagtcagctgcctttcaaagttgaggccaaaccttgcactagcaactgtcggattaatacatttcgaacggtgccaattgagcagaagcacgaggtctggggcagcaaccagaactacatatgtaatacggaccctgagaccgacggcctgtcaccttcggttgccagccctagccctaaagaagtgaactttgtatccagaggcgcatcgtctcaccagccacgggtaccactatttcctgagaacggactgcatcaacagcccgagccacttctgccgaataacatgaagtctgcctgtgagaagcgcttgggctgctgttcaagtcctcactccaagcccaactgcagcacgttgagtcccccgatgcccctgccacagctgctaccatctgttactgatgcaagaagcgccggcccttctgaccatattgactcttctgtgaccggcgttcaaaggtttcgagacacacttaagatcccatataagctggaattgaagaacgagcccggcaggactgatctaaaacacatagtgattgatggaagcaatgtggccatcacccacggcctcaagaaattcttttcctgccggggaatcgcaatcgcagtggagtacttctggaaattggggaatagaaacataaccgtattcgtcccccagtggaggacgaggcgggacccaaatgtcaccgaacagcacttccttacacagctgcaggagctcggaatactctccctcacaccggctcgaatggtttttggggaacgcatagcaagccatgacgataggttccttcttcatttagcagacaagacaggtgggattatcgtcacaaacgataatttccgagaatttgtgaatgagagtgtgtcgtggcgggagattatcactaagagactgctgcaatatacctttgtgggggatattttcatggtccccgatgatccgctggggagatccgggcccagattggaggaattcctccagaaggaagtgtgcttaagagacatgcagccactgctcagcgccctgccaaacgtcggcatgtttgatccatcattccgcgtacctgggacgcaggctgcatcaactagccaccaacctccaactaggatacaaggtgcccccagctcccattggctgccacagcaacctcacttcccactcctaccagcactgccctcactgcaacaaaacttgcctatgcccgcacagcgaagctctgcagaaaccaacgagctcagggaggcgctgttgaaaatatttcctgacagtgaacagcgactgaagatcgatcaaattctggtggcacacccatatatgaaggatctcaacgccttaagtgcaatggtcttagattag

SEQ ID NO: 12481 - DNA, 1848 bp, Artificial Sequence
  Description of Artificial Sequence: Synthetic coding sequence
atggcccaaaagaaatacttacaggccaaactcacccaattcctgcgggaagataggatccagctgtggaagcctccatacaccgatgaaaacaagaaagtgggtcttgctcttaaggacctggctaaacagtactctgaccgactagaatgttgcgagaatgaagtggagaaggtgattgaggagatcagatgtaaagcgattgagcgcggaaccggcaacgataattaccgcaccaccggtatcgccactatcgaagtgtttttaccgccgaggctgaaaaaggatcgtaaaaacctcttggaaacccgcctgcacattaccggtagagagcttcgatccaagatagctgagacctttggtctgcaagaaaattatatcaagattgtgataaataagaagcagctccaactcgggaaaaccttggaagagcagggagttgctcacaatgtcaaagccatggtgttagaactaaaacagtcggaagaagacgccaggaagaattttcagcttgaggaggaggaacaaaatgaggctaagctgaaggaaaagcagatccagcggacgaagcggggacttgagatcttggccaagagagccgccgagacagtggttgatcccgaaatgaccccttatctggacattgctaatcaaactgggaggtcaatcaggatcccgcctagtgaacgcaaggcactgatgctcgcaatgggctaccatgaaaaaggccgcgccttcttaaaaaggaaagagtacggcattgctctcccttgcctcctggatgccgacaaatatttttgtgagtgttgtagagaacttctcgataccgtggataactatgcagtgcttcagctggatattgtttggtgctattttaggctagagcagctggagtgtcttgacgatgccgagaagaaattaaatttagcacagaagtgctttaagaattgctacggtgagaaccatcagcgtctggtgcacattaagggtaactgcggcaaggagaaggtgctgtttctacggctgtatctgctgcaaggaatacgaaattaccacagtggcaatgacgtggaggcatacgagtatcttaataaggcaaggcaattgttcaaggaactgtatattgatccctccaaggtggataacctgctacaacttggcttcaccgctcaggaagcaagactgggcctccgagcatgtgatggaaacgtggaccacgcggctacacacatcactaatcggagggaagagctggctcagatacgtaaggaggagaaagagaaaaaaaggaggagactggaaaacatcaggtttctcaaagggatggggtattccacacacgcagcccagcaggtcctgcacgccgcttccgggaacctcgacgaggccctgaaaattttgctgagtaacccacagatgtggtggcttaatgatagcaaccctgaaacggacaaccgacaagagtcgccgtcccaggagaacatcgatcgcctggtctacatgggttttgatgcccttgttgccgaggctgccttgcgtgtgttcaggggaaacgttcagctggccgcccagactcttgcacataacggcggatcccttccgccggagctcccactgagccctgaggattctctttccccgcccgccaccagccccagcgacagcgctggaactagctccgctagcacagacgaggacatggagacggaagctgtaaacgaaatcctggaagatatccccgagcatgaggaagactacctcgactctacactggaggatgaggaaattattatcgctgagtatttatcatacgtggagaatcgcaagtctgcgaccaagaaaaactag

SEQ ID NO: 12482 - DNA, 1806 bp, Artificial Sequence
  Description of Artificial Sequence: Synthetic coding sequence
atggcccagaagaagtacctgcaggcaaagctgactcaattcctgcgagaggaccgaatccagctctggaagcccccttacacagatgaaaacaagaaggtggggcttgccttgaaggatcttgcaaaacaatactcagataggttggaatgttgtgaaaatgaagtggaaaaggttatcgaggagataaggtgtaaggccattgagagaggcactggcaacgacaattacagaaccactgggattgccactatcgaagtgtttctccccccgcggcttaagaaggataggaagaatctgctcgaaacacgcctgcacattacaggtagggagctgcgctccaagatagccgagactttcggtctgcaggaaaattacataaagattgtgattaacaaaaaacagctgcagctcggaaagactcttgaagagcagggtgtcgcgcataacgttaaggctatggtgctggaactgaagcaaagcgaggaggatgctcgcaaaaactttcagctcgaggaggaggaacagaacgaagccaaactgaaagagaagcagatccagaggacaaaacgaggtctcgaaatcttggccaagcgcgctgcagaaacagtagtggaccccgaaatgaccccatacttggatattgcgaatcagaccggacgaagcatccgcattcctccctccgaacggaaagccctgatgctggcgatggggtatcacgagaagggtcgtgcattcctgaagagaaaagaatacggaattgcacttccatgtctcctagatgcagataaatacttttgtgagtgttgtcgggaactactggatacagtggacaactacgctgtcttgcaactcgatatagtttggtgttattttaggctggaacagcttgagtgcttggacgatgccgaaaagaagctgaacctggctcagaagtgcttcaagaactgctacggggagaatcaccagagacttgttcacattaaaggaaactgtggtaaagagaaggtgctgtttttgaggttgtatctcttgcagggaattcgaaattaccactctggaaatgatgtggaagcctatgaatacctgaataaagctcgccagttgtttaaggagctgtacattgacccatccaaggtggataatctcctccagttggggttcactgcgcaggaggccaggctgggccttcgcgcttgcgatgggaacgtagatcacgcagcgacccatatcaccaataggagggaggaactcgcccagatacggaaggaagaaaaggagaagaagagacggagactcgaaaacattaggtttctcaagggcatgggatactctacccatgcggcacagcaaatcttactatcaaacccccagatgtggtggctgaacgactctaaccctgaaacggataaccggcaggaatccccttcccaagagaacatagatcggcttgtgtatatgggattcgatgccttggtggcagaggccgctctgcgggtttttagaggtaatgttcaacttgctgcccagacgctggcccataacgggggtagtctgcctcctgagctcccactctctccggaggactctctcagccctcccgctacgtcgccgtcagattccgcgggcacctctagcgcaagcactgatgaagacatggaaacggaagccgttaacgaaattcttgaagatatccctgagcacgaggaagactacctggatagcaccctcgaggacgaagagatcataatcgctgagtacctaagctacgtggagaacaggaagtcagcgacaaaaaagaattag

SEQ ID NO: 12483 - DNA, 465 bp, Artificial Sequence
  Description of Artificial Sequence: Synthetic coding sequence
atggcacagaagaaatatctacaggcaaagcttactcaatttctgagagaagacagaattcaattatggaagcctccctacaccgatgagaataagaaagtcggcctggccctcaaggatctggcaaaacaatatagcgataggctagagtgctgcgaaaacgaggtggagaaagtgattgaggagatacgctgcaaggcaatcgagcgggggaccggtaatgacaactaccgcacaactgggatcgccacaatcgaggtatttctcccgcccaggctgaagaaggaccgaaagaatctgctcgaaacccggctgcatatcacaggaagagagttacgcagcaaaatcgccgagacattcggactgcaggagaattacatcaaaatcgttatcaacaagaaacagctgcagttaggcaagacattggaagagcagggagtggcccacaacgtaaaggctatgtag

SEQ ID NO: 12484 - DNA, 765 bp, Artificial Sequence
  Description of Artificial Sequence: Synthetic coding sequence
atggcccagaagaagtacctacaggcgaaactgacgcagtttctacgggaggataggatccagctctggaaacctccctatacggacgaaaataagaaggtcggactagctcttaaagatctggcgaagcagtatagtgaccgcttggaatgctgtgagaacgaggtggagaaggttatagaggagatacgctgcaaggcgatcgaaaggggaaccgggaacgacaattatcgcacgaccggtatcgccactatagaggtgttcctgcctcctcgacttaaaaaagatcgcaaaaatttactagagacaaggctgcatataacaggacgggagctgcggtcaaaaatagcagagacattcggcctgcaggaaaactacattaaaatcgtgatcaataagaagcagctgcaattaggcaaaactctggaagagcagggtgtcgcacataacgttaaagcgatggtgctagaactcaagcaatctgaggaggatgcacggaaaaacttccagctcgaggaagaagagcagaacgaggccaaactcaaagagaagcagatccagagaaccaagagggggctagagattctcgccaagagagccgctgagactgtcgttgaccctgagatgaccccctacttagatatagctaaccaaacgggacgatcaatccgcataccaccatctgagagaaaggctctcatgttggcgatgggataccacgagaagggtcgagccttcctgaagcggaaagagtatgggatctag

SEQ ID NO: 12485 - DNA, 495 bp, Artificial Sequence
  Description of Artificial Sequence: Synthetic coding sequence
atggcccagaagaaatacttacaggctaaactcacccagtttcttcgtgaagacaggatacaactctggaagcccccttacaccgacgagaataaaaaggtgggcttagccctaaaggatcttgcgaagcagtattccgacaggctcgaatgctgcgaaaatgaggtagagaaagtcatagaagagatccggtgtaaagcaatcgagcgtggaacggggaatgacaactataggactactggtatagctaccatagaagtctttttgccaccgagactgaagaaagacaggaaaaacttactagaaacccggctgcatatcactggtagggagctgagatctaaggcggtgagaggaggattccgcaaatggcacgctacccacatgcggcgccggatagcagaaacatttggtctgcaggagaactacatcaaaatcgttatcaacaaaaaacagctgcaactcggcccctacgtgtcgtacggaatttcatag

SEQ ID NO: 12486 - DNA, 1806 bp, Artificial Sequence
  Description of Artificial Sequence: Synthetic coding sequence
atggctcaaaagaagtatctacaagcaaagctcacgcagttccttagagaggatagaattcagttgtggaaaccaccctacacagacgaaaacaagaaggttggcctggccctgaaagacttggcaaagcagtatagtgaccgtctggagtgctgcgaaaatgaggtggaaaaagtgatcgaggagattaggtgtaaagctatcgagcgcggaacagggaacgataactaccggaccactgggattgctactatcgaggtttttctcccccccaggcttaagaaggatagaaaaaacctcctggagacacgacttcacatcaccggacgagagctgcgttcgaagatcgccgagacttttggactgcaagaaaactacataaaaatcgttataaacaaaaaacaactgcagctcgggaagacactggaagaacagggagtcgcacataatgtcaaggctatggtactggagctcaaacagagtgaagaggatgcaagaaagaactttcagctggaagaggaggaacagaatgaggcaaagctcaaagagaagcagatacagaggaccaagagggggttagagattctggcaaaacgcgctgccgagactgtggtcgatccagaaatgaccccctacctcgacattgccaaccagaccgggaggtcaatccgaattccccctagtgaacggaaagccctgatgttagctatgggctaccatgagaaggggcgggccttcctcaagaggaaggaatacggaattgccctaccctgcctgctcgacgcggataaatacttttgcgaatgctgccgcgaactcctcgacacagtagataactatgccgttctgcagctggatatcgtatggtgctacttccggctggaacagttggagtgcctcgatgatgcagagaagaaacttaatctggctcaaaagtgcttcaagaattgttacggagaaaatcaccagcggctggtgcacataaaaggaaattgcggcaaggaaaaggtgctgtttttacggctctatttgcttcagggtatacgaaactaccattctggcaatgatgtggaagcttacgagtatctcaacaaagcaaggcagcttttcaaggaactgtatatcgacccctccaaagtcgataacctgctgcaactcggatttaccgcccaggaggctagattgggtcttcgcgcttgcgacggcaacgttgatcacgcagccactcacatcactaatcggcgagaagaactagcacagatcagaaaagaggagaaggagaaaaaaaggaggcgactggaaaacatccggtttctcaaagggatggggtacagcacacacgccgcgcagcaaatcttgttaagtaaccctcagatgtggtggctgaacgacagcaacccagaaactgataatcgccaggaatctccatcacaggaaaacatcgaccggctggtgtatatgggcttcgacgccttggtcgctgaggccgctctcagggtctttcgagggaatgtccagttagcggcccagacacttgctcataatggcggttccctgccaccggaactgccattaagtcctgaggacagtctctctccgcccgccacatcgcccagtgacagtgctggaacttcgtcagcttcaactgatgaagacatggagactgaggccgttaacgaaatccttgaggatattcccgaacacgaggaggactatctggattctaccctggaagacgaggagatcattatagctgagtacctgagctatgtggagaacaggaagtctgccactaaaaaaaattag

SEQ ID NO: 12487 - DNA, 1920 bp, Artificial Sequence
  Description of Artificial Sequence: Synthetic coding sequence
atgaaaacaaatggtgggcgctgcagaatccgcgctctgtgctggtcccggagagagtggagaggggcagggatggcccaaaagaaatacctgcaggctaagctcacccagtttctgagagaagaccgcattcagctctggaagcctccctataccgatgagaacaagaaggtgggactggcactgaaggacctggctaagcagtactcagatagactggaatgctgcgagaatgaagtagaaaaagtgatagaggagattcggtgtaaggctatagaaagggggaccggcaacgacaattaccgtacaactggcattgcgaccattgaggtctttctccctccaaggctgaagaaggataggaagaacctactggaaacacgccttcacatcacgggtcgggaactacggagcaaaatcgccgaaacctttgggctccaggagaactacatcaagattgtaatcaacaagaagcaactgcaactcgggaaaacgctggaggaacagggcgtggcccacaatgtaaaggcaatggtgctcgaactgaaacaaagtgaggaggatgctcgtaagaactttcaattggaggaggaggagcaaaacgaggcaaaactgaaggagaagcagatccagcggaccaaacgcggccttgagatcctcgccaagcgcgcagccgaaactgttgtcgaccctgaaatgactccctatctggacatcgccaaccagacgggaagatccattcggattccaccttctgaacgaaaggccctgatgttagctatgggttatcacgaaaagggtcgggccttcctgaaaaggaaggagtatggaattgcgctgccatgcctcctagacgccgataagtatttctgcgagtgttgccgcgaattgttggacacggtggataattacgccgttctccagcttgacatcgtgtggtgctactttaggttggaacaactcgagtgtttggatgacgcagagaaaaagctgaacctagcgcagaaatgtttcaagaactgttacggcgaaaaccaccagcggctggttcacattaagggcaattgcggcaaggagaaggtcctcttccttaggctctaccttctccagggcattcgtaattatcactccggaaacgacgttgaagcctacgagtatcttaataaggcccgtcaactctttaaggagctctatattgatcccagtaaggtggataacctgttacagctcgggtttaccgcgcaggaggctcgcttggggcttcgtgcctgcgacggcaatgtcgaccacgccgcgactcacattaccaatcgacgcgaagagcttgcgcaaatacgcaaagaggagaaggaaaagaagcggcgtaggctcgaaaacattcgtttcttaaagggcatgggctatagtacccacgcggcacaacaagtgcttcacgctgcctctgggaacctggacgaagcgctgaaaatactgctctctaacccacagatgtggtggttgaatgactccaacccagagaccgacaatcggcaagaaagcccctcacaggagaatatcgatagacttgtgtacatgggcttcgacgcattagtcgccgaagctgctcttcgcgttttcagaggcaatgttcagctcgcagcccagacattggcccacaacggggggtccctgccaccagagctgcctctgtcacccgaagattcgctctcacccccagccacatccccaagtgactctgctgggactagttccgcctctacggatgaagatatggagactgaggccgttaatgagattctggaagacatcccagaacacgaagaggattacctggatagcacactggaagacgaagagattataatagccgagtatcttagctatgtcgaaaatcgcaagagcgcgaccaagaaaaactag

SEQ ID NO: 12488 - DNA, 246 bp, Artificial Sequence
  Description of Artificial Sequence: Synthetic coding sequence
atgcttatcaaagtaaagacactgacaggaaaggagatagagatagatattgagccgacagataaagttgaaagaatcaaagagagggtggaagaaaaagaaggtatacctccccaacagcagaggcttatatacagtggaaaacagatgaatgacgaaaagaccgccgctgattacaagatcttgggcggaagtgttctacacctggtactggccttacgcggcggaggaggtttgcgccagtag

SEQ ID NO: 12489 - DNA, 819 bp, Artificial Sequence
  Description of Artificial Sequence: Synthetic coding sequence
atgtttgttaaatcagagacactggagctcaaagaggaggaagatgtgctagttcttctgggatctgcatccccggcgctggcggccctgacccccttatcctcctctgccgacgaggaagaggaggaagaaccaggagcatctggaggggctaggcgccagcgtggggcggaggcgggacaaggcgcccgagggggtgtcgccgcaggcgcagaaggctgtcggcctgcccgcctgctcgggttagtgcacgactgtaagcgcagaccctcaagagccagagccgtgtcccgcggggctaagaccgcagaaaccgtgcagcgcattaagaaaacccgtcgcctgaaggctaacaacagggagcgcaatcgcatgcataacctgaacgccgccctggacgccctacgcgaagtgcttcccacttttccggaagatgctaagttaaccaaaatagagactctcaggttcgctcacaactatatttgggctcttactgaaacgctcaggctcgccgaccactgtgggggcggaggcgggggcctcccgggagccctcttcagcgaggcagtattgctgtctcccggtggagcaagcgcagccctcagctcatctggagatagcccgtcaccggcatcaacctggtcttgcacaaattccccagctccttccagcagtgtgagctcgaactctacatccccgtactcatgtacactgagccccgcgagtcctgccggctctgacatggattactggcaaccccccccaccagacaagcatcgttatgccccacacctgcctattgccagggactgtatatag

SEQ ID NO: 12490 - DNA, 1158 bp, Artificial Sequence
  Description of Artificial Sequence: Synthetic coding sequence
atgcctcagaatgttgccaaaacagagcctgtatctattctgcagccgcaaaccacggttaatcccgatagaataaagcagaccctgccaagttcaccaacaactacgaagtcaagccccagtgacccaatgaccacgagccgggcaaaccaggtgaagataatagtgcccaactccactgcaggactcattataggaaaagggggagccaccgtcaaggcggtaatggagcaatctggggcttgggtccagctctcccagaaacctgacggcatcaatctgcaggagagagtggtgaccgtgagcggggagcccgagcagaaccgcaaagcggtcgagctgataatccaaaagatacaggaagatccccaaagcggcagctgtctaaacatctcttacgcaaatgtgacaggccccgtggctaatagtaaccccaccggaagtccctatgccaataccgcagaagtgctgcccaccgcagccgccgctgccggactgcttgggcacgccaatttggcgggggtggccgcctttccagccgtcctgagtgggttcaccgggaacgacttggtggctataacgagcgctcttaataccctggcttcctacggctataatctgaataccctcgggctagggctgagtcaagccgccgccacaggcgcattggctgccgccgctgccagcgccaatccagcagcagccgccgcaaatttgctggctacttatgcttccgaggcttcagcctccggatcaacagcaggcgggactgccgggactttcgcactcggctcccttgcagctgccaccgccgctaccaatggctatttcggagccgccagccccctggccgcttcggctatactcggaactgagaagtccactgacggttctaaggatgtcgtcgaaatcgctgttccggagaatcttgtgggcgcaatacttggcaagggtggcaagacactggtagagtatcaggagctcaccggcgcccggatccaaataagtaagaagggggaattcgtgcctggaaccagaaatagaaaggtgacaatcacaggaacgccggccgctacccaggctgctcaatatctaattacccaacgaataacttatgagcagggcgtccgtgccgctaatcctcagaaggtcgggtag

SEQ ID NO: 12491 - DNA, 546 bp, Artificial Sequence
  Description of Artificial Sequence: Synthetic coding sequence
atgatggctgcagcccccattcagcagaacggaacccacacaggcgtccccattgacctcgatccccccgattctcggaagagacccctcgaggccccacccgaagcaggctcaaccaaacggactaacacaggtgaggacgggcaatattttctgaaagtgctgatccctagttatgctgccggttcaattattggcaaaggcgggcaaactattgtccagctgcaaaaagagacgggggcaactatcaagctgtctaagtctaaagatttttacccaggcaccaccgagagagtgtgtctgatccaaggcacagtcgaagctctgaacgcagtacatgggtttatagctgagaaaatccgtgaaatgcctcagaacgttgccaagacagaaccagtgagcatcttacaaccccagacgaccgtgaatcccgacaggataaaacagacactgccgagcagccccaccacaaccaagtcgtctccaagtgaccccatgaccacctcgagagccaatcagaagcataacatttcctggatttcttag

SEQ ID NO: 12492 - DNA, 1452 bp, Artificial Sequence
  Description of Artificial Sequence: Synthetic coding sequence
atgatggcagctgctccaatccaacaaaacgggacccacactggggtcccaattgaccttgacccacctgacagcagaaagcggcctctcgaagctccccctgaagccggcagcacaaaaagaacgaatacaggtgaagacgggcagtacttcctcaaggtccttatcccttcgtacgccgctggcagtataatcggtaagggcggacagaccattgtgcagctccaaaaagagacaggggccaccatcaagctatctaagtctaaagacttctacccaggcaccacagagagagtgtgtttgatacagggcaccgtggaggccttgaacgcagtccacgggttcatcgctgagaagatccgggaaatgcctcagaatgttgccaagacggagcctgtttccatcctgcagccgcagaccaccgtgaatcctgatcgaattaaacaggtgaagattatagtgccaaactccaccgccggcttgattattggaaagggaggcgctaccgttaaagctgtgatggaacagtcaggtgcctgggtgcagctctcgcagaagccagacggaattaacctgcaagagcgagttgtaacggttagcggggagcccgaacaaaacagaaaggcagttgagctcataatccagaagatccaggaagatccccagtccggctcctgcttaaacatctcctatgccaacgtgacaggtccagtcgcaaacagtaatcctacaggttccccctacgccaacacggccgaagttctacctaccgcagctgccgcagctggtcttttgggccatgccaacctggccggcgtggccgcattccccgccgtgctgtctggtttcaccggcaatgatctggtcgccatcacaagcgcactcaacacgctggcgtcatatggttacaacctcaatacactaggattggggttgagccaggcagcagccactggagctctcgcggctgcggcggcaagcgccaaccccgctgcggctgccgctaacctactggcgacttacgccagtgaggcctcagcatcaggaagtaccgccgggggtacggcaggcacctttgcactgggaagtctcgcagcagctaccgccgcaacaaatggatactttggcgccgccagcccactggcagcttcagcgattctgggaacggaaaaatccacagatgggagcaaggacgtcgtggaaatcgccgtgcccgaaaatttagtaggagcaatcctggggaagggcggcaaaacccttgtcgagtaccaggaattgacaggtgctcggatacaaatctcgaaaaagggtgagtttgtaccagggacccggaaccgcaaggtcaccattacgggcaccccggccgccacacaggcggcgcaatatctgattacccagcggattacctacgaacagggagtaagagctgccaaccctcagaaggtgggttag

SEQ ID NO: 12493 - DNA, 1524 bp, Artificial Sequence
  Description of Artificial Sequence: Synthetic coding sequence
atgatggcggccgctccaatccaacagaatggcacacacactggagtaccaatcgatctcgacccacctgactctcggaaaagacctctagaggccccccccgaagccggatcgaccaagcgcaccaacaccggcgaggatggccagtactttctgaaggtgctaataccatcgtatgcagctggctctatcattgggaaaggaggccagactatagtccagcttcagaaagagaccggtgccacgatcaaattgtccaagtcaaaggacttttacccaggtacgacggaacgagtgtgcttgattcaagggaccgtcgaagcgcttaacgccgtgcacggatttattgccgagaaaattcgagaaatgccgcagaatgtggctaagactgaaccggtttccatactgcagccacagaccaccgtgaatccagatcggatcaaacaaacgttacctagtagccctacaacaacaaaatctagtcccagcgaccctatgacgacgtctcgcgccaaccaagtgaaaatcatcgtgccgaacagcacagcgggcttgattattggaaaggggggggcaacagttaaagctgtcatggagcagtcaggcgcatgggttcaattgtcccaaaaacccgacgggattaatctgcaggaaagagtcgtgacagtgtcaggcgaacccgaacagaacaggaaagccgttgagctgataatacagaaaattcaggaagatccacagtcgggctcttgtcttaatatttcatacgcaaacgtcaccggcccagtggctaactctaacccaacagggagcccctacgccaatactgcggaagtgctccctacagctgctgcagccgctggcctgctaggccatgctaatctggctggcgtcgctgcttttccagccgtgctaagcgggtttactgggaacgacctggtagcaattacaagcgcacttaatactctagcctcatacgggtacaatctcaacacacttggcctcggtctttcacaagcagcggccacgggcgccctggcagcggccgcagccagcgcaaatcccgcagcagccgccgctaacctgctggcaacctatgcctccgaggctagcgcttctggaagcacagcaggggggacagccggtacattcgctctgggttcgctcgcagcagcaacggccgctaccaacggatacttcggggccgccagccccctagctgccagcgctattcttgggactgagaaatcaacggatggtagtaaagacgtggttgagatcgctgtgcccgaaaatctggtcggcgccattcttgggaagggaggcaagactctcgtggagtaccaagagctgaccggagcacgaatccagatcagcaagaaaggcgaattcgtgcccgggactaggaatagaaaggtgacaattacaggcaccccagccgcaacacaagctgcacaatacttgatcacccaaagaatcacatatgagcagggagtcagagcagctaatccccaaaaggtcgggtag

SEQ ID NO: 12494 - DNA, 1479 bp, Artificial Sequence
  Description of Artificial Sequence: Synthetic coding sequence
atggaacctgaggctcccgatagtcggaagcgtcccctggagacacctccagaagtggtctgtacaaaacgatctaacactggagaagagggtgagtatttcctgaaggtgttaataccctcatatgccgccgggtccatcatcggtaagggtggccaaacaattgtgcagctccaaaaagaaactggcgctactattaagctttcaaagagcaaggacttctaccctgggaccacagaaagggtttgcctcgtgcagggaacggcggaggccctgaacgccgtgcattcttttatcgccgagaaggtgcgggagataccgcaggctatgactaaaccggaggtggtgaatatcctccagcctcaaaccactatgaaccctgatagagctaagcaggcgaaactgattgttcctaatagtacggctgggcttatcatcgggaagggcggtgccacagttaaggccgtgatggaacagtcaggagcctgggtccagttatctcagaagcctgagggaattaacctccaggaacgcgtggtgactgtctctggcgagcccgagcaggtgcataaagcagtttcagccattgtccagaaagtgcaggaggatcctcaatcctcttcttgcctgaacatctcctacgccaatgtagctggcccagtggctaacagtaatccaaccggttcaccctacgcaagtccggctgatgttctccctgcagcggctgcagcatccgctgcggccgcctctggactgctgggccccgctggcctagccggagtcggggcttttccagctgcgctgcccgccttttcaggaacggacttactggcaatatctacggcactgaatactctagcttcctatggctataatacaaacagcttaggcctcggattaaattccgccgcggcatcgggagtgctggccgccgttgctgcaggcgccaaccctgcggccgccgcagctgccaacctgctcgcatcctacgccggcgaggcaggcgccgggccggcaggcggagccgccccccctcccccccctccacctggtgccctcgggagcttcgctttagcggccgcagcaaacggttacctgggtgcaggtgccggcggcggtgccggtggtggcggcggtcccctggtggcagcagctgctgccgcaggtgcggcgggagggtttctaacggcggaaaagcttgccgcagagtcagctaaggaactggtggagatcgccgtgcctgagaatttggttggggctattctgggcaagggagggaaaacgttggtagagtaccaagagctcacgggagcacgaatccagatctcaaaaaagggcgaattccttccaggaacaaggaacaggcgcgtcactatcacgggaagccctgctgccacccaggcagcacagtaccttatatcccagcgtgtcacttatgaacagggagtccgcgcgtccaacccacaaaaggtaggctag

SEQ ID NO: 12495 - DNA, 840 bp, Artificial Sequence
  Description of Artificial Sequence: Synthetic coding sequence
atggagaacagtgagaaaaccgaggttgttttgctggcttgcgggtcatttaatccgataacaaacatgcaccttcggctgttcgagctggctaaggattacatgaatggcaccggccggtatacagttgtgaaaggaatcattagtcctgtgggagatgcctacaaaaagaagggcctgatccctgcttaccacagggtgatcatggcagagcttgctactaagaatagcaagtgggtcgaagttgacacttgggaatcacttcaaaaggagtggaaagagactttgaaggtgttgaggcaccatcaggagaagcttgaggcgtccgattgcgaccatcagcaaaactctccaaccctggagcggccggggaggaagcgtaaatggaccgagacccaggactcctctcagaagaagagcctcgaacctaagaccaaagcagtgccaaaggttaagctgctttgtggtgcggacctgcttgagagttttgcggtgcccaacttgtggaaaagcgaggatataactcagatagttgcaaactatgggctgatctgcgttaccagggctggaaacgacgctcagaagttcatatacgaaagcgatgttctatggaaacacagatcaaatattcacgttgtcaacgagtggattgcaaatgatatcagcagtacaaagatccgtagagccctgcggaggggccaatctatccgatatctggtccctgatctggtgcaggagtatattgagaaacacaacctctactcttcagaaagcgaagacaggaacgcgggggtgatactggctcccctgcagcgcaatacagccgaggctaaaacctag

SEQ ID NO: 12496 - DNA, 483 bp, Artificial Sequence
  Description of Artificial Sequence: Synthetic coding sequence
atggaaaatagcgaaaaaaccgaggtagtactgctcgcatgcggcagtttcaatcccattaccaacatgcaccttcgcctgttcgagctggctaaagactacatgaatggtacaggccggtacaccgttgtgaagggtatcatttctccggtcggcgatgcctataaaaaaaagggtcttatacctgcttaccaccgggtgatcatggctgagcttgccactaagaattcaaagtgggtcgaagtcgatacctgggaaagcctgcagaaggagtggaaagaaaccctgaaggtgctgcgccatcaccaggaaaaattggaagcgagcgactgcgaccaccagcagaattctcctactttggagcgccccgggagaaagcggaaatggacagaaacacaagacagtagccagaagaagtccctcgagcccaagacaaaggatggggtgagtctgtatcacccaggctggtccgccgtggcatag

SEQ ID NO: 12497 - DNA, 840 bp, Artificial Sequence
  Description of Artificial Sequence: Synthetic coding sequence
atggaaaacagcgagaagactgaggtcgtcctactggcttgcggatcattcaacccaataacgaacatgcatcttaggctgtttgagctggcaaaggactacatgaacggcaccggacgctatacagtagtgaaaggaattattagtccagtgggcgacgcctataagaagaaagggctcattcccgcatatcatagagtgatcatggccgagttagcaactaaaaatagtaaatgggtagaggtcgacacctgggagagcctacagaaagagtggaaggagaccctaaaagtcctgaggcaccatcaggagaagctggaagcctcagactgcgaccaccagcaaaatagtccaactctagaacggccgggacgtaagcgaaaatggactgagacacaggactcaagtcaaaagaaaagcctggaacccaagaccaaagccgtgcccaaagttaaactgctctgcggcgctgacctgttggagtcctttgccgtccccaacttgtggaaatctgaggacataacacagattgttgctaactatggtctaatctgcgtcacacgcgctggaaacgatgcacagaaattcatttatgagtcagacgttttatggaagcatagaagcaacatccacgtggtcaatgaatggattgccaacgatatatcgagtacaaaaattcggcgggctctgaggaggggacagagtatcaggtatttagtgccagacctcgtccaggagtacatcgaaaaacacaacctctacagctccgagtcagaggatcgcaacgccggggtgattctggcccctctgcagagaaatacagctgaggcgaaaacatag

SEQ ID NO: 12498 - DNA, 1239 bp, Artificial Sequence
  Description of Artificial Sequence: Synthetic coding sequence
atggcccccgtggaacacgtggtcgctgacgccggggccttcctgcggcacgccgccctgcaagacatcggaaagaatatttatactatccgggaagtcgttactgagatacgggacaaggccacacggagaaggctggcggttctcccctatgaattgcgttttaaggagcccctaccagaatacgttcgcctggtcaccgagttctcaaaaaagaccggagactatccgtccctgagcgccaccgacatccaagtgttggccttgacctaccagcttgaggctgagtttgtcggcgtgtcacacctgaagcaagagcctcagaaggtcaaggtgtccagctccattcaacatcccgagactcccctgcatatctccggcttccatcttccatacaaacctaaaccccctcaagaaactgaaaaggggcactccgcctgtgagcccgaaaacctcgagttcagttcattcatgttttggcggaatccactcccgaacattgaccatgagcttcaggaattattaatcgacagaggtgaagatgtgccgtccgaagaagaagaggaggaggaaaatggctttgaagatcggaaagatgattcagacgacgacggaggaggctggattaccccgagtaacatcaagcagatacagcaggaattagagcagtgcgacgtgcctgaggacgtgagggtgggatgccttacaaccgacttcgccatgcagaatgtgcttctgcagatgggcttacacgtgctagccgtgaacgggatgctcatccgtgaggcacgctcatatatcctgcgttgtcacgggtgttttaaaacaacatccgacatgtctcgagtgttctgctcccattgtggcaataagaccctcaagaaagtgagtgttacagtgtcagatgacgggacgcttcacatgcatttctctcggaaccccaaggttctgaacccacgaggcctgagatactcactgcctaccccaaaaggcggaaagtacgctatcaatccccacctgacagaagatcagaggttcccacagctgcgcttatcccagaaggcacgacagaaaaccaatgttttcgctccagattatatcgccggtgtttcaccatttgtggaaaatgacatcagctcacggtcagcgaccttacaggtgagagattccactctaggcgccgggaggaggcgactcaatccgaacgctagtaggaaaaaattcgtcaagaagaggtag

SEQ ID NO: 12499 - DNA, 1236 bp, Artificial Sequence
  Description of Artificial Sequence: Synthetic coding sequence
atggacggtcgcgccgagttgccagcatttcctcgggccggagcacctccactagccgcctcagacactgtccctgccgcacccgagggcgccggcgccgcccgcccagcagccccactccgtccaactagtttctccgtgctggatatcctggacccaaataagtttaattcgaggaggagacgctgcgttctccttggccctgtggcgcccgctgcttgcgcaccatgcgcctctgccccatgcgcgcctgctccagccgcaagtgggagacctccacgggccgaggagctggagagacgagccctcgcaggggccggaggagtgggggcagcaggagccgagcctcctaatgcaggcgacccttttaaggcaggcgaagccgaaactaacgacaccaacggctattcatccgggggtgggggacacagcccctccgcggattcaggcgatgaggttcctgacgacgaagatgatgatgaagacgaggcgccagagactgaagcagcaagaggagctgaggaggctcgcggtggcggtggcggtctgggagctcggggctccggctgtcagggggcggctgaaacagatgcaagtccgggagcaactgtggacgaagctgccgccccaggccccagagagaattccccagtcgctcagggcccccccggcggagcggcagcccctggcggcgccggcacaaccccccagggcaccgcaaccgccgccaagcccaaacgcaaaaggacgggatcagactccaaatcgggtaaacctcgccgggctcggactgcctttacttacgagcagttggtggccttagagaacaaatttaaggctacccgttacctgtcagtatgtgaacggcttaaccttgcgctcagcctgagcttgaccgagacccaggtcaagatttggtttcaaaaccgaagaacaaagtggaaaaaacagaaccccggagcagacacaagcgccccaactggcggtggtggtggcccgggacctggcgccgggccaggcaccggcctgcccggcggcttgtccccgctgagtccaagcccgcctatgggtgcccccctagggatgcacggccccgctgggtacccggcccacggacccggaggcctcgtgtgcgctgcccaactccccttcctgagctcgccggctgtgctctcaccgttcgtgctggggtcgcagacatacggcgcccctgcgttctatgccccacacctctag

SEQ ID NO: 12500 - DNA, 1095 bp, Artificial Sequence
  Description of Artificial Sequence: Synthetic coding sequence
atgatgctgccaagcccagtgaccagcaccccttttagtgtgaaagacattttaaatctggagcagcagcatcagcattttcatggcgctcacctacaggccgacctcgaacatcactttcatagcgcaccgtgcatgctagcagctgccgaaggtacgcaattctccgatggcggagaagaggacgaggaagatgagggcgaaaaactctcatatttaaactcgctggcagctgccgacgggcatggggacagcggcttatgtccccaggggtacgtgcacactgtgctgcgggactcctgcagcgagcctaaagagcacgaggaagagcctgaggttgtgcgggaccggagccaaaaatcttgccagctgaagaagtccctcgagacggcaggcgactgtaaggccgccgaagagtccgaaagacccaaaccccggagcagacggaaaccgagggtgctcttctcccaggcccaggtgtttgaacttgagcgtaggtttaaacaacaaaggtatctgtccgcccccgagcgagagcacctcgcgtccagcctcaaactcacatctacccaagtgaagatatggtttcagaatcgacgctataagtgtaagcggcagaggcaagacaagagcctcgagctcggagctcacgccccccctcctcccccccgccgcgtggccgtccctgttctggttcgtgatggaaagccatgcgtgaccccctcagcgcaggcctatggagctccatactccgttggagctagcgcgtattcttacaatagctttcctgcttatggatatgggaacagtgcggctgccgctgctgcagccgccgcagcggcagcagcagccgccgcttattcaagtagttacggatgcgcgtacccggctgggggagggggtggggggggcggcacctccgccgctacgacagccatgcagcctgcctgcagcgccgccgggggcgggcctttcgtcaatgtgtctaacctaggcggcttcggtagcgggggcagtgcccaacccctgcatcaaggtactgcagcgggagccgcctgcgcccaaggaactcttcaaggtataagggcgtggtag

SEQ ID NO: 12501 - DNA, 1104 bp, Artificial Sequence
  Description of Artificial Sequence: Synthetic coding sequence
atgctggcagtaggggccatggaagggacccgccagagcgcttttctgctgtccagcccacccctggctgcactccacagcatggcagaaatgaaaaccccactctatccggccgcatatccccccctcccagccggccccccgagctcgtcgagctcgagcagttcttccagctcgccttccccaccgctggggacacacaatccagggggccttaaaccccctgccacaggcggtctgtcaagcttgggtagtcctccgcagcagctcagtgcagcgacccctcacgggataaatgacatactttcgcgcccttccatgcctgtcgcatccggcgctgccctgcccagcgcgagtccttcggggagtagcagttcttcatcctcaagcgcatctgcttcatccgcatctgcagccgctgccgccgctgccgccgccgcagcagcagcatcctcccctgctggcctgctcgccggcctgccacgtttcagttcactgagcccccctcctcctccaccaggattatatttctctccgagcgccgccgcagttgccgcagttgggcgctaccctaagcctctcgctgaactgccaggccgaaccccaatcttctggcccggagtcatgcagtctcccccgtggcgggatgccagattggcctgcacccctcaccagggatctatcctactggacaaagatggtaagcggaagcatactcggccaacattttcgggccaacagatctttgccctggagaagacgttcgagcagacaaaatatctggcaggacctgaacgggcccgacttgcctacagccttgggatgaccgaaagtcaggtcaaggtttggttccaaaacagacggaccaagtggcgcaagaagcatgctgctgagatggctaccgctaagaagaagcaggattctgagactgagcgccttaagggggcctccgagaatgaagaggaggatgatgactataacaagcccctggatccaaacagtgatgacgaaaagattacacaactgctgaaaaagcacaagtcaagctccggtggaggcggtgggcttctcctacacgcttcagaaccagaatcatccagttag

SEQ ID NO: 12502 - DNA, 834 bp, Artificial Sequence
  Description of Artificial Sequence: Synthetic coding sequence
atggatacaaaccgaccaggcgctttcgtcctctcaagcgctccccttgctgccctgcataacatggccgagatgaagactagtttatttccttacgccttgcaggggcctgccggctttaaggcacctgcacttggcggcctgggtgctcagttgccactaggaaccccacacgggatctcagatattttaggcaggcccgtgggcgcggcgggcgggggcctcttaggggggctgccacggctgaacgggctggcgtctagcgcgggggtgtattttggaccggccgcagcagtggctcgcggctaccccaagcccctggcggagctaccagggcgaccacctatattctggcctggggttgtgcaaggcgccccttggagggacccaagattggcaggccctgcccccgccggtggagtgctggacaaggacggcaaaaaaaaacactccaggcctacattctctggccagcagatttttgcccttgagaagacatttgaacagaccaaatatcttgccggtcctgagagagctcggctcgcctatagcctaggaatgaccgagtcgcaggtgaaagtgtggttccagaacagacgcactaaatggagaaaacgtcatgctgtcgaaatggcctcagccaagaagaagcaggactctgatgctgagaagttgaaagtggggggttcagatgccgaggatgacgacgaatacaaccgcccgctggatcccaattctgatgacgagaagatcacacgactgctcaaaaaacataagccaagtaacttggcacttgtttccccatgcggggggggggctggagacgccctgtag

SEQ ID NO: 12503 - DNA, 225 bp, Artificial Sequence
  Description of Artificial Sequence: Synthetic coding sequence
atggtcgcgctgcgggggctgggctctggactgcagccgtggtgccctctggatctgcggctcgagtgggtcgataccgtctgggaactcgacttcacggagacagagcctctggacccttccattgaggctgagattattgagaccggcctcgccgcatttaccaagctttatgagtccctactgccatttgctacgggcgaacatggaagtatggaagtgtag

SEQ ID NO: 12504 - DNA, 108 bp, Artificial Sequence
  Description of Artificial Sequence: Synthetic coding sequence
atggtggcactgaggggcctaggaagcgggttacagccctggtgcccactggacctgcgtctcgaatgggttgacacagtttgggaactggatttcacagaaacctag

SEQ ID NO: 12505 - DNA, 4497 bp, Artificial Sequence
  Description of Artificial Sequence: Synthetic coding sequence
atggtggccttacgcggactcggtagcgggctgcagccatggtgcccgcttgatctcaggctggagtgggttgataccgtctgggagctggactttacagaaacggagccgttagatccctctattgaggccgagattattgagacggggctggctgcatttacaaaattgtatgagtctctccttccattcgctacaggggagcacggcagcatggagagtatttggacctttttcattgaaaacaacgttagccactccacacttgttgctttgttttaccattttgtgcaaatcgtgcacaaaaaaaacgtatctgtgcaatacagagaatatggacttcacgcagcggggctgtacttcctgctcttagaggttccgggctccgttgccaaccaggtgttccatccggtaatgttcgacaagtgcatccagacgctcaagaagagctggcctcaggaaagtaacctgaatagaaaacggaagaaggaacagcctaaatcatcccaggccaacccaggtcggcacaggaagcgaggcaagccaccgcggcgggaggacatcgaaatggacgagattattgaggagcaagaagatgagaacatttgcttctctgctcgggacttgtcgcagatacgcaatgccattttccacctactgaaaaacttcctacggttgctgccaaagttctcccttaaggaaaagccccagtgtgttcagaattgtatcgaagttttcgtttcactgactaatttcgagcctgtattacacgaatgtcacgttactcaggccagggccctcaatcaggccaaatatattcccgaactggcctactatggtctgtatcttttatgcagtcctattcacggagaaggggacaaggtcatctcgtgcgtgtttcaccaaatgctctcagtgatccttatgcttgaagtcggcgagggttctcacagggcccccctcgccgtgacatcgcaagtgatcaactgtaggaatcaggccgtgcagttcatttctgccctcgtggatgaacttaaagagagcatcttccctgtggtacgcatcctcctgcagcacatttgtgctaaagtagtggacaaaagcgaatataggacgtttgctgcccagtccctagttcagttactttccaaactgccatgtggagaatatgccatgttcattgcctggctgtataagtactccaggtcttctaaaatcccacatagagtgtttactcttgacgtggttctggccctactggaactgcctgagagagaagtggacaatactttgtctctggaacatcaaaagttcctgaaacacaagttcctggtacaagagattatgttcgatcggtgtcttgacaaagcacccacagttcgcagcaaagccctgtctagcttcgcccactgtttggaactgaccgtgacatccgcgagcgagagcatcctggaactgctcattaactcaccgacctttagcgtgattgagtcccatcccgggaccttgctgcgcaactcttcagccttctcttaccagcgccagaccagcaacaggagcgagccctccggagagattaacatcgactcaagcggagaaactgtagggtctggcgagagatgtgtaatggctatgctgcgtcgccgtatacgggatgaaaaaacaaatgtaaggaaaagcgcgctgcaagtgctggtctccatactgaaacattgcgatgtgtccggcatgaaagaggatctttggattttacaggatcagtgccgagatccggcagttagcgtgcgaaaacaagcactacagtcattgaccgagcttctgatggctcaacctaggtgtgtgcaaatccagaaggcctggttgcggggtgtcgttccagtggttatggactgcgagagtactgtccaagaaaaggccctcgagttcctcgaccaattgcttttacagaacatcagacatcattctcatttccactcaggcgacgattctcaggttctggcctgggcactgttaactttgttgactaccgaatcccaggaactgtcaaggtacctgaataaagcttttcacatatggagtaagaaagagaaattctccccaacttttatcaacaatgtgatatcacacacaggcactgaacactccgctcccgcctggatgctgctgagcaagattgccgggagctcccctcgcctcgactactcgcgaattattcagtcttgggagaaaatttcatcacagcagaaccccaactccaatacactgggtcatatcctgtgcgtgattgggcacattgccaagcatcttcccaagtcaacccgcgacaaagtgacagacgcagtgaagtgcaaacttaatggttttcagtggtcccttgaggtgatcagctctgccgtggacgccctccagagactttgccgagcaagcgccgaaacgccagcagaagaacaggaactactcacgcaggtctgtggagacgtgctaagcacatgcgagcacaggctcagcaatatcgtgttaaaagagaatgggacgggcaacatggacgaggatttgctcgtgaaatatatcttcaccctgggagacatagcgcagctgtgtccagctcgggtggaaaagaggatatttctccttattcagagcgtgctcgcctcatccgccgacgccgatcattctccctcctcccaaggaagctcagaagctcccgcgtcgcagccacccccacaggtgaggggcagcgttatgccgtctgtgatacgcgcccatgccattatcaccctaggaaagctttgcctgcaacatgaggacctcgctaagaaaagcatccccgcgttagtccgcgaactggaggtgtgcgaggatgtcgccgtgcggaacaatgtcatcatcgtgatgtgcgacctctgtatccgttacactataatggtggacaagtatatcccaaacatctccatgtgccttaaggatagcgatccttttatccgcaagcaaaccctcattctgctcacgaacctgctgcaggaggagtttgttaaatggaaaggtagcctgtttttccggtttgtaagtacgctgatagattcacaccctgatatagccagctttggcgaattctgtctggcacatttgctgctgaagcgcaacccagtcatgttttttcagcactttattgagtgcattttccattttaacaattacgagaagcacgagaagtataataagttcccacaatcagagcgagagaagcgactgttcagtctgaagggaaagtccaacaaggaacggaggatgaagatttataagttcttgttggaacacttcacggacgagcagcggtttaacattacttctaagatatgcctttcaattctcgcctgcttcgccgatggaatactacctttggatctggatgcttctgagctgctgagtgacaccttcgaggttctttcgagtaaggaaatcaagctcttagcaatgcgatcaaagcccgacaaagacctgctcatggaggaagacgatatggccctggctaacgtcgtgatgcaagaggctcagaagaaactgattagccaggtgcagaagcgaaactttattgaaaatataattccaatcatcattagcttaaagaccgttctcgagaaaaataaaatccccgctctgcgcgagctcatgcactatcttcgagaggttatgcaggactatcgggacgaactgaaggatttctttgcggtggataaacagttggcgtccgaactcgagtacgacatgaagaagtatcaggagcagctggtccaggagcaggaattggccaagcacgccgatgtggctggtacagccggcggagctgaagtggcacctgtagcacaagtggctttatgtcttgagacagtccccgtcccagccgggcaggagaatcccgcgatgagcccagcggtatcacagccttgtacgccacgggcttctgcgggtcatgtggctgtgagtagccctactcctgaaaccggacccctccaaaggctgctacccaaggccaggccgatgtccctcagcactattgcgattctgaattcagtaaagaaggccgtggagagtaagtctcgacacaggtcccggagtctgggagttttacccttcaccctaaatagtggatccccagaaaagacctgctctcaggtttcttcatactcattagagcaggaatctaacggcgaaattgagcatgtgacaaagcgagctatcagtactcctgaaaaatcaatctccgacgtgacttttggagccggggtgtcctacattggaacccctcgtacgccgtcatccgctaaagaaaaaattgagggcagaagccagggcaatgacatcctttgtctgtctctgccggacaaaccgcccccccagccgcagcagtggaacgtacgctcaccagcccgaaataaggacacccctgcctgttcccgccggagtctgagaaagacacctttgaagactgccaattag

SEQ ID NO: 12506 - DNA, 2667 bp, Artificial Sequence
  Description of Artificial Sequence: Synthetic coding sequence
atgctcttggagtgtttcatcaacattaattatatcaaaaaggaggaaggcagacggttcctgtcatgtctcttcaactggaatattaattttatcaaaatgatccacggcactatcaagaatcagctccaggggctccagaaatcattaatggtgtatatcgcagaaatctatttccgagcttggaaaaaggccagtggcaagatactggaggcgatcgagaacgactgcattcaagacttcatgttccatggtatccatctcccccggcgttccccagtacattccaaggtccgcgaggtgctgagttatttccaccatcagaagaaagtgcggcagggcgtggaggagatgctgtatcgattatataaacctatcctgtggcgagggctgaaagctaggaactctgaagttcggagcaacgccgctctgttgtttgtggaagctttccctattagggaccccaacctacacgcaatcgagatggattctgaaatacagaagcagttcgaggaactctattccctcctggaggacccttacccaatggtgcgcagcacagggatactgggagtgtgcaagatcacctcaaagtactgggagatgatgccacccaccatcctcatagacctactcaagaaagtcactggggagttggcattcgatacatcctctgccgatgttcgctgctcggtctttaagtgccttccaatgattctggacaacaaattaagtcacccattactcgaacagttgctgccagcactgaggtacagcttgcatgacaactccgaaaaggtacgcgttgcattcgtggacatgctgctgaaaatcaaagcagtgcgcgctgctaaattttggaaaatatgcccaatggaacacatcctcgttcggctcgagaccgattctagacccgtctcacgacgtctggtctccttgatttttaactcttttctccctgtgaaccagcctgaggaagtgtggtgcgaacgttgtgttaccctggtccaaatgaaccacgccgcagcaagacgcttctaccagtacgcccacgagcacaccgcatgtactaacatcgcaaagttaattcatgttataaggcactgtttaaatgcgtgcatccagagggccgtcagggagccgcccgaggacgaagaagaggaggatgggcgcgagaaggaaaatgttactgtgctcgataaaaccctgagtgttaatgacgtggcctgtatggccggcctcctcgagatcatcgtcattctgtggaagtccatcgatcgatccatggaaaacaataaagaagccaagctgtacactatcaacaagtttgccagcgttctcccggagtacctgaaggtgttcaaagacgacagatgcaagattcctctattcatgctcatgtccttcatgcccgcaagcgccgtcccacccttcagctgcggtgtaatctccacattgcgatctagggaggagggggcagtcgataagagctattgcacactgctggattgcctgtgttcttggggacaggtgggacacatcttggagctggttgacaattggcttccaacagagcatgcccaggctaagagcaacacagctagtaaaggaagggtgcagattcacgacactcgtcctgtgaaacccgaactggccctcgtgtacattgaatacctgctcacacacccaaagaacagggagtgtctgctctctgcaccaagaaagaagctgaaccacctgctgaaagctttggagacttcaaaggccgacctggagtcgttactgcagacccctgggggcaaacctcggggcttttccgaggcagcagcccctcgggcttttggccttcattgcagactcagcattcatctgcaacataagttttgttctgagggcaaggtgtatttatcaatgctggaagacaccgggttttggctggaaagcaagatactgagtttcatccaggatcaagaggaggactacctgaaactgcatcgtgtcatttatcaacagatcattcaaacatatctcacagtctgtaaagacgtggtcatggtggggctcggagatcatcagtttcagatgcaactgctgcagcgtagcctcggcatcatgcagaccgtaaaggggtttttctacgtcagtttgttactggacatcctgaaggagatcactggttcgtccctgatccaaaagacagattctgacgaggaagtcgctatgctgttagatactgttcaaaaggtgtttcagaagatgttagagtgtatcgcacggtcctttcggaagcagcctgaggaggggcttcgcgtgagcgatgtagaggagctaacacctcctgagcacctgtccgatctaccaccattttccaggtgcctgataggaattatcattaagtccagtaacgtcgtgaggtcttttttggacgaactgaaggcttgcgtggcatcaaacgatattgaaggaatcgtgtgcttgacggccgccgttcatatcattctggtgataaatgcgggcaagcacaaatcctccaaagtcagggaggttgctgcgaccgtgcatcggaaactgaaaacatttatggagatcacactcgaggaggatagtatagaaaggtttctgtacgagtcaagttcacggaccttaggagagctgctgaactcgtag

SEQ ID NO: 12507 - DNA, 3432 bp, Artificial Sequence
  Description of Artificial Sequence: Synthetic coding sequence
atggagaaaagagagacatttgttcaggcagttagcaaggagctggtcggagagtttctgcagtttgtgcaactagacaaagaagccagcgatcccttctcactgaatgagctgctggacgagctatctaggaaacagaaggaggagctgtggcagcgtctgaagaacctcctcacagatgtgctcctggaatcgcctgtggatgggtggcaggtggtcgaggcccagggagaggataacatggagaccgaacacggttctaaaatgaggaaaagcatcgaaatcatctacgccatcacctccgtgatactcgcttcagtgagcgtcattaacgagtccgaaaactacgaagcactgctagaatgtgttatcattctgaacgggattctgtacgcgttacctgaatccgaacgtaaactgcaatccagcatccaggacttgtgcgttacttggtgggaaaagggcctccccgcaaaagaggataccggtaagacggcttttgttatgttactgagacggagcttggaaacaaaaacgggagccgacgtgtgtcggctctggcgcatccaccaggcactttactgctttgactatgatctcgaggagagcggagaaataaaggacatgctgctggagtgctttataaatatcaactacatcaagaaagaggagggccgcaggtttctaagctgtctttttaattggaatattaatttcatcaaaatgatacatggcacaattaaaaatcagctgcaagggctgcaaaagtctctaatggtttatatagcagaaatatattttcgtgcttggaaaaaagctagcggaaagatcctggaggctatcgaaaacgactgtatccaggattttatgttccacggtatacacctaccccgtcgatccccagtgcactctaaagtccgggaagtcctgagttatttccaccaccagaaaaaagtcagacaaggcgtcgaggaaatgttgtaccgattgtataagcccatactgtggcgtggtcttaaagcccgaaatagcgaggtgcggtctaacgccgccctcctgtttgtggaggccttccctatacgtgatcccaaccttcatgccatagagatggattctgagatccaaaaacagtttgaagaactttactcactgcttgaggacccttacccaatggtgagatctaccggaatccttggggtttgcaaaataacatctaaatattgggaaatgatgcctcccacaattctcattgatctgctcaagaaggtgaccggagaactggcatttgatacgtcatccgcagacgtgcgctgttccgtcttcaagtgcctccccatgattctagacaacaagctgagtcatccattgttggagcagctgctgcccgcactgcgatactccctccatgataactctgagaaagttcgggtcgcatttgtcgatatgttattgaagatcaaggcagtgcgtgccgctaagttctggaaaatctgtcccatggaacacatcctggtccggttggagaccgactcccgccctgtctcacgacggctagtgtcactgatctttaattcatttctccctgttaaccaacccgaggaggtttggtgcgaacgctgtgtgacgttggtccagatgaaccatgcagccgctcgccgcttctatcagtacgctcacgagcacactgcatgcactaatatcgcaaaactgatacatgtcattagacactgtttgaacgcttgcattcagcgagctgttcgtgaaccccccgaggacgaagaagaggaagacgggagagagaaggagaacgtcacagttctggataaaaccctatctgtcaatgacgtggcttgtatggccggactgctggagatcattgttattctttggaagagcatcgatcggtcgatggagaacaacaaggaggcgaagctgtacacaattaacaaattcgctagtgttctgccggaatacctgaaagtgttcaaagacgacagatgcaagataccactctttatgctcatgagcttcatgcctgcaagtgcagtgcccccattctcatgcggcgtgatctccacccttaggtccagggaagaaggtgcagtcgataagtcttactgcactttgcttgactgcctgtgctcctggggacaggtgggacacatcctggagttggtagacaattggctacccaccgagcatgctcaggccaagtcaaataccgcttcaaaaggaagggtccaaatccatgatactcgtcccgttaagcctgaattagccctggtgtacatagagtatctcctgactcatcctaaaaatcgagaatgcttgctctcagctcctaggaaaaaacttaaccatctactaaaggcactggagacttctaaagctgatctcgaaagcctgctgcagacaccaggcggcaaacccaggggctttagcgaggccgcagccccccgggcattcggcttgcactgtaggctgtcgatccatctgcaacacaagttctgttccgaaggcaaagtctacctcagtatgctcgaagacacaggattctggcttgaatccaaaattctctcttttattcaggatcaggaggaagattatctcaagctccatcgggtgatctaccaacagataattcagacctacctgactgtgtgcaaggacgtcgtcatggtcggactgggcgatcatcagtttcagatgcaactactgcagcggtcattggggattatgcaaaccgtcaagggttttttctacgtctccctccttctcgacatcctgaaggagataacgggctcatctttaatccaaaaaaccgacagtgatgaggaagttgccatgctgctggatactgtgcagaaggttttccagaagatgctggaatgcatcgctaggtcgtttcggaagcagcctgaggagggcctccgtctgctgtactctgttcaacggcccctgcacgaatttattaccgctgttcagagccgccacaccgacacgccagtgcacaggggcgtgctgagtacccttattgccggtccagttgttgagatatcacaccagctacggaaagtgagtgacgttgaagaactaacacctcccgaacatctgagcgacctgcctccgttttccagatgtctcatcgggatcattatcaaatcttcaaacgtggtgcgcagcttcttggatgagttgaaggcctgcgtggcctcgaacgacatcgagggcattgtgtgcctcactgccgccgtgcacatcattctcgtgattaatgctggcaaacacaagagctctaaggtcagagaggtggccgccacagtgcataggaagttgaaaacgtttatggagatcacgctcgaggaggatagtatcgagcgctttctgtatgaaagctcgtcccgtacgctcggcgagcttctaaactcctag

SEQ ID NO: 12508 - DNA, 3471 bp, Artificial Sequence
  Description of Artificial Sequence: Synthetic coding sequence
atggagaaaagagagactttcgtacaagctgtgtcaaaggaacttgtgggagagttcttacaattcgtgcagttagataaggaagcatctgatcccttcagtttgaatgagctcttagatgagctgtcaaggaaacagaaggaagagctatggcagcggttaaaaaatctgctgactgatgtgctcttagagtctcccgtcgatggttggcaggtggtggaggcccagggcgaagacaacatggagactgaacacgggtccaaaatgcgcaagtcaatcgaaatcatttacgctattactagcgtgatcttggcctctgtgagtgtcatcaacgagagcgagaactatgaggcgctcttagagtgtgtgatcatcctgaatggaattctttatgcacttcctgaatcagaacgcaaattacagtcttcgatacaggacctgtgcgtgacatggtgggagaaggggttgcctgcaaaagaggacacagggaagaccgctttcgtaatgctcttgagacgcagtctggaaacgaaaacaggagctgacgtgtgccgcctctggaggattcaccaggccctttactgtttcgactatgatctggaagagagcggagagattaaggatatgctcctggagtgtttcattaatatcaattacattaagaaggaggaagggcggcgtttcctcagttgcctgtttaattggaacatcaatttcatcaagatgattcacggcactattaagaaccagctgcaggggctgcagaaatcgcttatggtttacatcgcagagatttatttccgtgcttggaagaaggcctctgggaagatcctggaggcaattgaaaacgattgtatccaggattttatgtttcatggaatccatctcccacgcagatccccggtgcacagtaaggtgagggaagttctgagctattttcaccatcagaaaaaagtcaggcagggagtcgaggagatgttatatcgactgtataagcccatcctgtggcgcgggctgaaagcacgaaattcagaagttaggtccaacgctgcgctcttgttcgtggaagccttcccaatcagggatccaaatttacatgctattgaaatggatagcgagatacagaagcagtttgaggaactgtatagcctgctcgaagacccctacccgatggtgcggtccacaggcattctaggtgtctgtaaaatcacctctaagtactgggagatgatgccccctactattctcatcgaccttctgaagaaggttacaggggagctggcattcgatacaagcagcgctgacgtgagatgctctgtgttcaagtgcctgcctatgattttggacaataaattgtcgcatccattgttagaacagttgctgccggccctaaggtactccctgcatgataattccgagaaggttcgggttgccttcgtagatatgctcctgaagatcaaggccgtaagggccgcaaagttttggaagatttgccctatggaacacatcctggtgaggcttgaaaccgatagccgccccgtatcccgccgacttgtgagcttaatttttaattccttccttccagtaaaccaaccggaagaggtttggtgcgaaagatgtgtcaccctggtgcagatgaaccatgcggcggctcgtcgattctaccagtacgcccacgaacatacggcatgcacaaatatcgccaaactcatacatgtaatccgtcattgtctgaatgcctgcatccagcgagcagtgagggagccaccagaagatgaagaggaggaagatggtcgagaaaaggagaatgttactgtcttggataagaccctcagcgtgaacgatgtcgcatgtatggccgggctgttagaaattatagtgattctctggaagtctattgaccggtcaatggagaacaacaaggaagcaaagctgtacactatcaataagtttgcctccgtgctgcctgagtacctaaaagtcttcaaggacgatcggtgcaagattcctctcttcatgctcatgtctttcatgcccgcgagcgcagtcccacctttcagttgcggggtgatttctactcttaggtcccgcgaagagggggccgttgataagtcttattgcacacttctcgattgtctgtgctcttggggacaggtgggtcacatcctggagcttgtggacaattggttgcctactgaacacgcacaagcaaaatctaatactgcgtcaaaaggtagggtccagattcatgatacacggcctgtgaagccagagctagctttagtgtacatcgagtacttgctgactcatcccaagaaccgcgaatgtttgcttagcgcacccagaaaaaaactgaatcacctgctcaaggctctcgaaacctcgaaggccgacctggagtccttgctgcagactcctggaggcaaacctcgaggcttctcagaggccgcagcacctcgggcctttggccttcactgcagactgtccattcacctgcagcacaaattctgtagtgaaggtaaagtctacctgtctatgctggaagacacaggcttctggctagagtcaaagattctcagctttatccaagatcaggaggaggattacttgaaactgcaccgtgtgatttatcagcaaattattcaaacttatttgaccgtgtgcaaagatgttgtaatggtgggtcttggagaccatcaattccaaatgcagcttctgcaaaggtcactcggcatcatgcagacagtgaagggctttttttatgtttcccttctactggacatccttaaagagatcactggttcaagtttgattcagaaaaccgactcagacgaggaggtcgctatgcttcttgataccgttcagaaggtgtttcagaaaatgctcgaatgtatagcccgtagcttcaggaaacagccggaagaggggctccgactcttgtatagcgtacagcgacctctgcatgagttcattactgccgttcaatctcgtcatactgacactcccgtacacagaggcgtcttaagcacgctgatcgcaggccccgtagttgagatatctcatcagctgcgcaaggttagtgatgtggaagaactcactccacctgagcacctgtccgatctgccccccttttccagatgtctcataggtatcataattaagagtagcaatgttgtgagatcatttctagacgagttgaaggcttgtgttgcatctaacgatatcgaagggatcgtgtgcctcacagcagctgtacatattatccttgtgataaacgcgggaaagcataagagctccaaagtcagggaagtcgcagcaaccgtccacaggaaattaaagaccttcatggaaatcacactggaagaggatagtatcgagcgatatgaggatctgctgtgctgtccaggttgggccctaacaccaggcctattggatagcatttatcccagcgctagcgtgccaatcgggtag

SEQ ID NO: 12509 - DNA, 3432 bp, Artificial Sequence
  Description of Artificial Sequence: Synthetic coding sequence
atggaaaaaagagaaactttcgtgcaagcagtgtcaaaagagcttgtcggggagttcctgcagtttgtccagttggataaggaagcttctgatcctttctcgctgaatgagctcctcgacgagctatctagaaagcagaaagaagagctttggcagagacttaagaacctactgaccgacgtgctgctcgaatcccctgtggacggatggcaggtggtcgaagcccaaggagaagacaatatggaaactgaacacggaagtaagatgaggaaaagcatcgaaatcatctatgctatcacaagcgtgatcctggcttccgtttcagttatcaacgaatctgagaattatgaggctcttctcgagtgcgtcattatcttgaatggcatcctgtacgcactgccagaatccgagcggaagttacaaagtagtatccaggatttatgtgtgacctggtgggaaaaaggactccctgctaaagaggacactggcaaaacagcttttgtaatgctgctgagacgatctctcgagacaaaaacgggcgccgatgtgtgcaggctgtggaggatccaccaggccctctactgttttgattacgacttggaagagagtggggagataaaggatatgcttctagagtgtttcataaacatcaattatattaaaaaagaggaaggccggaggtttctctcatgtctgtttaattggaatatcaacttcatcaaaatgatccatggaactatcaaaaaccagctccaggggctgcaaaaaagtctgatggtatacattgcggagatctacttccgagcttggaagaaagctagcggcaaaatccttgaggcaatcgagaacgattgcatccaggatttcatgtttcacggaatccacctgccccggcgttccccggtacacagcaaggtgagggaggtgctcagctacttccaccatcagaagaaggtcagacagggcgtggaggagatgctctaccgcctgtataaacctatcctttggaggggactcaaagcacgtaacagcgaagtgcgtagcaacgccgccctcctctttgtcgaagctttccccattcgggaccctaacctccatgctatagaaatggacagcgagatccaaaaacagtttgaggaactgtatagtctccttgaggacccctatccgatggtccggtctacaggtattctaggtgtgtgcaagatcacctcaaagtactgggagatgatgcctcctactatcctgatcgacctgctgaaaaaggtcactggagagctggcatttgatacgtcatccgctgacgtcaggtgtagtgtattcaagtgcctgcccatgattcttgacaacaagttgtcccatccgttgctggagcagctgctgccagccttgcgctattctttgcacgacaactcagaaaaggttcgggtcgccttcgtcgacatgttgcttaaaattaaggctgtgcgggcagccaaattctggaagatttgtccgatggagcatattctggtccgccttgagaccgacagcagacctgtgagtcgaaggttagtgtccctgatttttaattcattccttcctgttaatcaacccgaggaggtttggtgtgaaagatgcgtcactcttgtacagatgaaccacgccgccgcccgccgtttctaccagtatgcacatgagcacaccgcttgcacgaacatcgccaagctgattcacgttatcaggcactgcctcaatgcttgtattcaaagggctgtgagagagccccctgaggatgaggaggaagaagatggcagagagaaggaaaacgtgaccgtgctggacaagaccctcagcgttaatgatgtggcatgtatggcggggctgctggagatcattgtgattctgtggaaatccattgatcgctccatggaaaacaacaaggaggcaaagctttacaccatcaataaattcgcgagtgtgctgccggagtacctgaaggttttcaaagacgatcggtgcaaaatcccactgttcatgttgatgtcatttatgccggcatccgctgtgccgccattttcttgcggggtaatttctaccctcagaagtagggaagaaggagcagtggacaagtcatactgcaccctgctggactgcttgtgctcatgggggcaggttggccatattcttgagctggttgacaattggcttcccactgaacacgctcaggcaaaaagcaacactgcatcaaaaggccgagtacagattcatgatacgaggcccgtgaagcccgagctggctcttgtctatattgagtaccttttgacgcaccctaaaaatagagagtgtctcctatccgcgccacggaaaaagctgaatcaccttctgaaggctctggaaactagcaaggccgatctggagtccctgctccaaacccccggcggcaaaccacggggcttcagtgaagcagcagcccctcgggcatttggactccactgtcgcctgagcatccacctgcaacataaattttgttcggagggcaaagtctacctcagcatgttagaagacacgggattctggctggaatccaagatcctcagtttcatccaagaccaggaagaagactacctcaaacttcatcgcgtgatctaccaacaaatcattcagacttacttgaccgtgtgtaaagacgtcgttatggtcggcctcggcgaccatcagttccagatgcaactcttgcagcgcagccttggcattatgcagaccgtgaaaggatttttttacgtttctctgcttctcgacattctgaaggagatcacggggtcctctctaatccagaagacagattctgacgaagaggtagcgatgctcttggatactgttcaaaaagtttttcagaaaatgcttgagtgtattgcgcgtagctttcgtaagcagcctgaggagggtttacgacttctttactccgtacagcgaccactgcacgaattcataaccgccgtccagtctagacacactgacacgcccgtccacagaggagttctgagcacattgatcgctggaccagtagtggagatctcacaccagcttcgtaaagtgtcggatgtggaggagctgacaccacctgagcacctgtcagacctaccgcctttttcacgctgcctcatcggcataatcattaaatcgtccaacgtggtccgaagcttcctggacgaactcaaggcctgcgtggcaagcaacgatatcgaagggatcgtgtgtctgactgctgcagttcacatcattctggtgattaatgccggtaagcataaatccagcaaggtgcgggaggttgcagctaccgtgcaccgaaagttaaagaccttcatggaaattacactcgaggaggatagcatcgagcggtttttgtacgaatctagttctcgaactcttggagagcttttaaatagttag

SEQ ID NO: 12510 - DNA, 2697 bp, Artificial Sequence
  Description of Artificial Sequence: Synthetic coding sequence
taactggaggaaagcggcgagattaaagacatgctgctggagtgtttcattaacatcaattacattaaaaaggaggagggcaggcggttcctgagttgtctgttcaattggaacattaacttcattaagatgatccatgggacaatcaagaatcagcttcaagggctgcagaagtctcttatggtctacatcgctgagatctacttccgcgcttggaagaaggcctcaggcaaaattctcgaagccatcgaaaacgattgcattcaagacttcatgtttcacggcatccatttgcctagaagaagtcctgtccactccaaggttcgtgaggtcttgagctacttccatcaccaaaagaaagtaaggcaaggggtcgaggagatgctgtacaggctgtacaaacctatcctttggagggggctcaaggcacgaaacagtgaggttaggagtaacgccgccctgctttttgtggaagccttcccaatcagggatcccaacttgcacgccattgagatggactctgagatccagaagcagtttgaagagctgtacagtctgctcgaggacccctaccctatggttagaagcacagggattctgggggtgtgtaaaatcacctcgaaatattgggagatgatgccgccaaccattctgattgacctgcttaagaaagtcaccggagagctcgccttcgatacttctagcgcagacgtacggtgcagcgtttttaaatgtcttccgatgatcctggacaataagctgtctcaccctcttcttgaacagctgctgcccgccttacggtacagcttgcatgataactccgaaaaggtgagagtagcgtttgtggacatgcttctcaagattaaagccgtgagagccgcaaaattctggaaaatttgccccatggaacatatcctcgtgcggctggagacagacagccggcctgtgagtaggagactggtgtcactgattttcaatagcttcctccccgtgaatcagcctgaagaagtgtggtgcgagcgctgtgtgacgctggtccaaatgaaccacgcagcagcgaggagattctatcagtacgctcacgaacacacggcctgcaccaacatcgcaaagctcattcacgtgattcgccactgcctgaacgcctgcatccagcgcgccgtgcgtgagccgcccgaggatgaggaagaagaagatggtagagaaaaagagaatgtcacggtactggataagacactgtcagtgaacgacgtggcctgtatggcaggactcctggaaatcatcgtaatcctttggaagtccatcgatcgctcaatggaaaataataaagaagctaagttgtacacaatcaataaattcgcctccgtgctgcctgaataccttaaggtgtttaaggatgatcgttgcaaaatcccccttttcatgttaatgagctttatgcccgccagcgcagtacctcccttttcttgcggcgtcatatctacactgcggtcccgagaggaaggcgctgttgacaagtcttactgtaccctgctggattgcctgtgttcatggggccaggtggggcatattttagagctcgtggataactggctaccaaccgaacacgcacaggcgaagtccaacactgcctctaaggggagagtccaaatccacgacacacggccagtcaagcctgaattggctcttgtctacatcgagtatcttctcacacatccgaaaaacagagaatgtctgctttccgctccaagaaagaaactgaaccatcttctgaaagctctcgaaacctctaaagcggatctggaaagcctgttgcagaccccaggtggcaagccccggggcttttctgaagctgctgccccacgtgcctttggtttacactgtagacttagcattcatctgcagcataagttctgctctgaggggaaagtctacctcagcatgctggaggacactggcttctggctcgagagtaaaatattaagcttcatacaggatcaagaggaggactatctcaaattacatcgcgtcatctatcaacaaatcatccagacctatttgacagtgtgcaaggacgtcgtaatggtgggattaggagaccaccagttccaaatgcagctcctacaacgatcattaggtatcatgcagactgtgaagggcttcttctacgtgtccttgttgctggatatcttaaaagagattactggcagcagcctgattcaaaaaaccgattctgacgaagaggtggcgatgctgttagatactgtccagaaagtgtttcagaagatgttggagtgtattgcacggtcatttcgcaaacagcctgaggagggattacgcgttagtgatgtcgaagaactgacccctcctgagcatctgtccgatctgcccccatttagtagatgtctgataggcattatcataaagtcttcgaacgtcgttcgtagttttctcgatgagctaaaggcgtgcgtggcttctaatgacatcgagggtatagtctgcttgacagccgcagtgcatatcatcctcgtcatcaacgcaggtaagcacaaatccagcaaggtgcgggaagtcgccgccactgtgcatcgtaaacttaagacatttatggaaattaccctggaggaggactcaattgaacgttttctgtacgaaagctctagtcggactctgggcgagctcctcaactcatag

SEQ ID NO: 12511 - DNA, 3471 bp, Artificial Sequence
  Description of Artificial Sequence: Synthetic coding sequence
atggagaagcgtgagacgttcgtgcaggctgttagcaaggagctggtaggcgagttcttgcagtttgtccagttggacaaggaagcctcagatccattttctctgaacgaactactggacgaactgagtaggaaacagaaagaagagctctggcaaagattaaagaatttattaaccgacgtgctgctggaaagccccgtggatggatggcaagtggtggaggcgcagggagaggacaatatggagaccgaacatgggtccaagatgagaaaaagcatagaaatcatctatgccatcacaagtgtcattctggcctcggtatccgtaatcaatgaatctgagaattacgaagccctgctggaatgcgtaatcatccttaatgggatcctttacgctttgcctgaaagtgaacgaaaattgcagagtagtattcaggatctgtgtgtcacatggtgggaaaagggtctcccggccaaagaagacactggcaaaactgccttcgttatgctactgaggcgtagtctggagaccaaaaccggtgccgacgtttgtcgcctgtggcgcatacaccaggcactgtactgtttcgactatgatctggaggagtccggagagatcaaggacatgctcctggagtgtttcataaacatcaattacatcaagaaagaagaaggtcgtcgatttctgagctgtctgttcaattggaacatcaattttattaaaatgatccatggcacaattaagaaccaactgcagggactacagaagagccttatggtctacatcgcggagatatacttccgagcttggaagaaagccagcgggaagatactggaggcgatcgagaacgattgtatccaggactttatgttccacggcatccatttacctaggaggtctccagttcactctaaggtgcgagaagttctgagctattttcaccaccagaagaaggtgcgccaaggtgtggaggagatgctgtatagactatacaaacccatactgtggcgtggactcaaggccagaaactcagaagtcagatctaatgccgccctgctgttcgtggaggcttttccaatcagggatcctaacctgcacgctattgaaatggactccgaaatccagaaacaattcgaggaattgtactccctcctggaagatccatatcccatggtcaggagcactggtattctgggagtgtgcaaaatcacgagtaagtactgggagatgatgcctcccacaatcttgatcgatttactaaagaaggttacaggagaactggctttcgatacctccagcgcagacgtccgatgctctgtctttaaatgcctccctatgatcttagacaacaaactgtctcatccattgctggagcagctgctgcccgcacttcgatattcattacatgataactcggaaaaggtacgtgtggcttttgtggacatgctcttaaagattaaggctgtgcgcgctgcgaagttttggaaaatctgccctatggagcatatcctggtgagactggaaaccgactcccgccccgtatctcggaggctggtgagcctgatctttaacagcttcctccctgtcaaccagcccgaggaagtctggtgcgaacgctgcgttacgctggttcagatgaaccatgccgccgcaaggagattttatcagtacgctcacgagcatacagcctgtactaacattgctaagctcatacacgtgattaggcactgcttgaacgcatgcatccagcgggccgtccgggaaccaccggaagacgaggaggaagaggacggcagggaaaaggagaatgtgactgtccttgacaagacgctcagcgttaacgatgtcgcttgcatggcaggattgctggagatcattgtcatcctgtggaagagcatagatcgttctatggaaaacaacaaggaggcaaagctgtacaccatcaataaattcgcctctgtcctgcctgagtacttgaaggtattcaaggacgaccgttgtaaaatccccctgttcatgctaatgtcattcatgcccgcgagcgctgtccctcccttcagctgcggagtgatatcaaccttaaggagtcgcgaggaaggggccgttgacaagagctactgtactctcctcgactgcttatgttcatggggccaggtgggccatatcttggagctggtggacaactggctcccaacagaacatgcccaggcaaagagcaacactgcgtccaaaggacgcgttcagatccacgacactcgccctgtgaagcctgagcttgccctggtgtatattgagtatctcctgactcacccaaagaatcgggagtgtctattaagtgcacctagaaagaagctcaatcatctcctcaaggctctggagacttctaaggccgatctggaaagcctgctgcaaactccgggaggcaaaccgcgcgggttttctgaagcagctgctccaagagcattcgggcttcattgccggctcagtatccatctgcaacataagttctgtagcgaaggcaaagtgtacctctccatgctggaagacactggtttttggctcgaatccaaaattctctcatttatccaggaccaggaggaagattatcttaagcttcacagggtgatctatcaacagattatccaaacatatctgacagtctgtaaagatgtagtaatggtagggctgggcgatcaccagtttcagatgcagctgttacagcgcagtctggggatcatgcagaccgtgaagggctttttttacgtcagcctactgctggacatacttaaagagattaccggcagttctcttatacagaaaaccgattccgatgaggaggttgctatgctcctcgacaccgtgcagaaggtcttccaaaagatgctggagtgcatcgcccgatcgttccggaagcagccagaggaagggttgcggttgctgtacagtgttcagagacctctccacgagtttatcacagctgtacagagcagacacaccgataccccggttcaccggggggtgctttctacattaatcgcaggccccgtcgtagaaatttcccaccagctcagaaaggtgtctgacgttgaggaactaacacctccagaacatctgtcagatctgcctcccttcagccggtgtttaatcggaattataatcaaatcaagcaacgtggtgcgcagtttcctggatgagctgaaagcgtgtgttgcttccaatgacatcgaagggatagtttgcttaactgcagccgtgcacatcattctggtgatcaacgccggaaagcataagagctcaaaggtgcgcgaagtcgccgccaccgtgcaccgcaagctcaagactttcatggagattactttggaagaggatagcatcgaaagatatgaggatctgctgtgctgtcccggctgggctctcaccccaggtctgctggacagtatctacccgtccgcctctgtaccaatcggctag

SEQ ID NO: 12512 - DNA, 1794 bp, Artificial Sequence
  Description of Artificial Sequence: Synthetic coding sequence
atggagcacatcctggtccgactggaaaccgatagtagaccagtgtcacgacgccttgtgtcacttatttttaattctttcctgcctgtgaatcagcctgaggaggtgtggtgtgagcggtgtgtgacccttgtacagatgaaccacgcggctgccaggcggttctatcaatatgcccacgagcataccgcgtgcacaaatatcgcaaaacttatacatgtcatcaggcactgccttaacgcctgcattcaacgcgctgttcgggaacctcccgaggatgaggaggaggaggacggacgcgaaaaagaaaacgtgactgtgcttgataaaacattatctgtcaatgatgtcgcctgcatggccggcttactggaaattattgttattctttggaaatccattgaccgcagcatggagaataataaggaagctaagctgtacactattaacaagtttgcctccgtgctgccagagtacctaaaggtgtttaaggacgacagatgcaagattcctctgttcatgctcatgtcattcatgccagccagcgccgtccccccatttagttgcggcgtcataagtactctgagatcaagggaagagggtgccgtcgacaaatcatattgtacactgcttgactgcttgtgcagctggggtcaagtaggacatatcctggagctggttgacaattggctgcctaccgagcatgcccaggctaagtccaatacagcctctaaagggagagtgcagatccatgacacccgtccagtgaagccagagttggcattggtgtatatcgagtacctcctaactcaccctaaaaaccgcgagtgcctgctgtcagcccccagaaaaaaactgaaccatctactcaaggcactggagacctcaaaagcagacctggagagcctgctccagacacccggcggtaaaccaaggggattttcggaagccgcagcccctcgagcctttgggttacactgccggctttccatccacttacagcacaagttttgttcagaaggcaaggtgtatctgtccatgctcgaggacaccggattctggttagaaagcaaaatcctatcttttatccaagaccaggaagaggattacctcaagctgcatcgggtgatatatcaacagattatccagacctatctgactgtgtgtaaggatgtggtcatggttggcttaggtgaccaccagttccagatgcaacttttgcagaggagtctggggatcatgcaaaccgtgaaaggtttcttttacgtttcgctgttactcgacattttgaaagagattaccgggtccagtctgatccagaaaaccgactcagatgaggaggtggccatgctacttgatacggtgcaaaaagtttttcagaaaatgctcgaatgcattgcacgcagttttaggaagcagcccgaagagggcctccgcgtgtcagacgtcgaagagctgactcccccggagcacctttccgacctgccacctttttctcggtgcctgatcggtatcatcattaagtcctcaaatgtcgtgcgctcttttctagatgagctgaaggcgtgcgtggcctctaatgacattgaggggatcgtttgcctgactgctgcagtccacatcatcctggttatcaatgctggtaagcacaagtcatccaaggtacgcgaagtcgcagccaccgtccaccggaagcttaaaaccttcatggaaattacactagaagaagactctattgagcggtttctttatgaatccagctcccgcactctgggcgagctcttaaatagctag

SEQ ID NO: 12513 - DNA, 1716 bp, Artificial Sequence
  Description of Artificial Sequence: Synthetic coding sequence
atggaacacattctggtgaggctggagacagattcccgaccagtttcccggaggctagtgagcctgatctttaattcttttctgccggtcaaccaacctgaggaagtgtggtgcgagcgatgtgtgactctagtgcaaatgaaccacgccgctgctaggcgattctatcaatacgcacacgaacataccgcttgcactaacatcgccaaacttattcacgtgatacgccactgtctgaatgcctgcattcaaagagcagttagggaaccgcctgaagatgaagaggaggaagacggtagagagaaagagaacgtcactgacgatagatgtaagattcccttgtttatgcttatgtccttcatgccggctagtgctgtgcctccttttagctgcggggtcatctctacccttcgctctcgcgaagagggggccgtggataagtcatactgcactctgcttgattgtctgtgtagttgggggcaagttgggcatattctggagctggtagacaattggcttcctaccgagcacgcccaggccaagagtaatacggcaagcaagggacgagtacagatacatgacacaagaccggtaaagcccgagctagccttggtttacatagagtacctccttactcatccaaagaatcgtgagtgtcttctgtcggccccacgaaaaaagctgaaccacctgttgaaagcactggaaacttccaaggcagacctagagtcacttctgcagacccccggagggaaaccacgaggctttagcgaagccgctgcccctagggcctttggattgcactgtcgcctgtcgatccatctccaacacaagttttgttccgaaggaaaagtgtacctcagcatgttagaagatactggattctggcttgagtcaaagattctgtctttcattcaggaccaggaagaggattacctcaagctgcaccgcgtgatatatcagcaaatcatccagacctaccttacagtgtgcaaggacgtggtgatggtaggtctgggggaccatcagttccagatgcagctccttcaaaggtctttgggtattatgcaaaccgtaaagggcttcttttatgtgagcctgctgttggacatattgaaggagattacaggctcctcactgatccagaagacagactcggatgaagaagtggcgatgctactggacactgtgcaaaaggtattccaaaagatgctggagtgcattgcaagatcctttaggaaacagccagaagaagggctccggttgctgtactccgtgcagcgtcccctgcatgagttcattaccgcagtacaaagtcgacataccgatacacctgtccataggggggtgctgtccacactcatcgcaggtcctgtggtggaaatatcacaccagctcagaaaggtctccgatgtagaggagttgaccccccccgaacacctgagcgatctaccccccttctcccgctgtctcatcggaattatcatcaaatccagcaatgtcgttcgctcctttttagatgagctcaaggcatgtgtggcctccaacgacatcgaggggatcgtgtgcttaacagccgctgtgcatatcatactcgtgattaatgccggtaaacataagtcttcaaaggtccgtgaagtggcggcaacagtgcatcgaaaactgaagacattcatggagattacattagaggaagacagcattgagcggatttag

SEQ ID NO: 12514 - DNA, 1821 bp, Artificial Sequence
  Description of Artificial Sequence: Synthetic coding sequence
atggaagatgtcgaagcccgcttcgcccacctcctgcagcccatccgggacctcacgaagaattgggaagtggacgtggccgctcaactcggcgaatatctcgaggagcttgatcagatttgtataagcttcgacgaagggaagacgacaatgaactttatcgaagccgctttactgatacagggaagcgcatgcgtctatagtaaaaaggtggagtacctttactctcttgtttaccaggccctggatttcatatctggaaaaaggagggccaagcagctctcttccgttcaggaggatcgcgctaatggcgtcgccagttcgggcgtgcctcaggaagccgaaaatgagttcctgagcctggacgatttcccggactctcgcacaaatgtggacctcaaaaacgatcagaccccgtccgaagtgctgatcatccccctgttaccaatggccttggttgccccagatgaaatggagaagaacaacaacccactctattctagacagggggaggtgctggcgtccaggaaggatttcaggatgaacacctgcgtgccacacccgcgtggagccttcatgcttgagcccgagggcatgtcgccaatggaacccgccggcgtctctcccatgcctggtactcagaaggacaccgggcggaccgaagagcagcccatggaagtgagtgtttgcaggagtcctgtgcctgccttaggtttctcccaggagccaggcccttcacccgagggtccaatgcccttgggcggcggcgaagatgaggacgccgaagaggccgtcgagttgcccgaagcatctgcccctaaggctgctttagaaccaaaggaatcaaggtctcctcagcaatcggctgctttgccacgtagatatatgttgagagaacgtgaaggagctccggagccggccagctgtgtgaaagaaacccccgacccatggcagtcactggaccccttcgattccctggagtctaagccctttaagaagggaagaccatactctgtgcctccatgcgtggaggaggcacttggccagaaacgcaaacgaaagggggcggcgaagctccaggatttccaccagtggtatctggccgcttacgctgatcacgccgacagccgacgcctgcgccggaaagggccctcctttgccgatatggaggtcctctactggacacatgttaaagagcaactggagacattgcgcaagctccagcggcgagaggtggctgagcagtggctcagaccggccgaggaagatcacctcgaggacagtcttgaggatctcggggcagccgccgatgatttcttagaacccgaagaatacatggagccagagggggcggatccacgggaggcagcagacctggacgcagtacccatgtcactctcttatgaggaactggtgcggagaaacgtcgaactcttcattgccacatcacagaagtttgtgcaggagacagaactgtcgcaaaggatcagagactgggaagacactgtacaaccccttctgcaggagcaggagcagcacgtgccattcgatattcacacgtacggcgatcaactggtaagtcgtttcccccagctgaacgaatggtgtcccttcgccgaactggttgcaggccagcctgccttcgaagtgtgccggagcatgcttgcctccttacagctagccaacgactacaccgttgagataacacagcagcccggcttggaaatggcggttgataccatgagcttgagactgctgacgcatcagagggcccacaagcgcttccagacctatgccgccccttccatggctcagccctag

SEQ ID NO: 12515 - DNA, 900 bp, Artificial Sequence
  Description of Artificial Sequence: Synthetic coding sequence
atggaggatgtcgaagccaggtttgcgcacctgttgcaaccaattagagatttgaccaaaaactgggaggttgatgtcgcggcacaattgggtgaatacctcgaagaacttgatcaaatttgtatttcatttgatgagggcaagaccaccatgaactttatagaggccgctctgctgatccaggggtctgcctgtgtttactctaagaaggttgagtacctatattcgttagtgtatcaagcgctcgactttatcagtggtaagcgtcgtgctaaacagttatcttctgtccaggaggatagagcgaatggagtcgcctcgtccggagtcccacaggaggctgagaatgaatttctgtccctggacgacttcccagactctcgcaccaatgttgacctaaaaaatgatcaaaccccttcagaagtactgatcataccgttgttacccatggcattggtagccccagatgaaatggaaaaaaacaacaaccctctatactcaagacagggagaagtgctagcttcccgcaaagattttcgtatgaatacatgcgtgcctcaccctaggggcgcgtttatgcttgagcctgagggcatgagtccaatggaacccgccggcgtgtctccaatgcctggtactcaaaaagacacaggaagaaccgaagagcagccgatggaagtttccgtttgtcggagtccagtacccgccctcggatttagccaggaaccaggcccctcaccggagggcccaatgcccctagggggtggtgaagacgaagatgcggaagaggctgtggaactgccggaggcgagcgccccaaaagctgctctcgagccaaaagagtctaggagcccgcaacaggtgggccccacttggaggcctgcggagcccgaattatag

SEQ ID NO: 12516 - DNA, 1818 bp, Artificial Sequence
  Description of Artificial Sequence: Synthetic coding sequence
atggaagatgtggaggcgcgatttgcgcatttattacagcccattcgggaccttacgaaaaactgggaagtggatgtggctgcccagctcggggagtacttggaggagcttgatcagatctgtatctccttcgatgaaggcaaaacaacaatgaactttattgaggctgcccttcttatccagggctccgcttgtgtatactctaagaaggtggagtacctgtatagtctggtgtatcaggctcttgacttcattagcggaaaacgacgtgccaagcaactgtcttccgttcaggaagatcgagccaatggcgttgcctcaagtggcgtgccccaggaggcagaaaacgagtttctgtctcttgatgatttccctgattctcgcaccaatgtagatttaaagaatgaccaaacaccctcagaggttctgattatacccctgctccctatggccctggtagcacctgatgagatggagaaaaataataaccctctatattcaaggcaaggcgaagtcctggcttcccgcaaggactttaggatgaatacatgtgtgccacacccaagaggggccttcatgttggagccagagggcatgagtcctatggaacctgcaggcgtgtctccgatgcccggtacacaaaaggatacaggaagaaccgaagagcagcccatggaagtcagcgtgtgcagatctccagtgcccgcactgggttttagccaggagcccggaccttcccctgagggcccaatgcccttaggcggcggggaggacgaagatgccgaggaagccgtggagctgcccgaagcgtctgcccccaaggctgcactggagccgaaagagtctcggagtccacagcagtccgctgctctcccgcgccgctatatgctgagggagcgcgaaggagcccctgaacctgccagctgtgttaaggaaacaccagatccgtggcaaagcctggacccattcgattctcttgagagtaaaccttttaagaaggggcgtccttactcagttcctccttgtgtggaagaggcactcggtcaaaaaaggaagcgcaagggcgccgctaaactgcaggacttccaccagtggtacctggccgcctatgccgatcatgctgatagccgtcggttacggagaaagggcccctcctttgccgatatggaagttttgtactggacacacgtgaaagagcagctagaaactctgcgcaagctacaaagaagagaggtcgctgagcagtggctgcggcccgccgaagaggaccatttagaggattctctggaagacttaggggccgctgacgattttctcgagcctgaggaatacatggagcccgagggagccgatccgcgggaggctgctgacctcgatgcagttccaatgtctctctcatacgaggagctcgttcgtcgtaatgtggagctgttcatcgcgacctcacagaagttcgtgcaggagactgaattgtcccagcggattcgggactgggaagatacggtccagccattgctgcaggagcaagaacagcatgtgcccttcgatatccacacctatggcgaccagctcgtctctcgattcccacagctgaacgaatggtgcccttttgctgagctggtcgcaggccaacccgcgtttgaagtatgccgctccatgctggcttctctgcagctggctaatgactacacagtagaaattacccagcagcccgggttggagatggccgtcgatacaatgtcactgcggctgttgacccaccagcgggcccataaacggttccagacctacgcagctccatccatggctcaaccgtag

SEQ ID NO: 12517 - DNA, 801 bp, Artificial Sequence
  Description of Artificial Sequence: Synthetic coding sequence
atgcaggggtccactagaaggatgggcgtaatgacagacgtccatcgcagattcctgcagctgctcatgacgcatggagtgctggaggagtgggacgtgaaacgactgcaaacccattgctataaagtgcatgatagaaatgccacagtggacaagttagaagactttataaacaatattaattccgtgctagagagcctttacatcgaaatcaagcggggagtgaccgaagatgatgggcggcctatttacgcccttgttaatctggcaaccacttccataagcaaaatggcaaccgacttcgcagaaaacgagctcgacctgttccgaaaggcactggagctcataatcgactcggaaaccggtttcgcctccagcaccaacattctcaaccttgtggaccaattgaaaggcaaaaagatgcggaaaaaggaagcggagcaggtgctgcagaaatttgttcagaataagtggctgatcgagaaagagggggagtttacgttacatggccgcgccatactcgaaatggagcaatacattagggagacgtacccagatgctgtcaagatctgcaatatttgtcatagtcttcttatccaaggacagtcatgcgaaacatgcggaatcaggatgcacctgccatgcgtggcaaaatacttccagtcaaatgctgaacctagatgcccgcattgcaatgattactggcctcacgagattcctaaggtgtttgacccagagaaagagagggagtccggggtgctcaagtcaaacaagaagtcccttcggagcaggcaacattag

SEQ ID NO: 12518 - DNA, 744 bp, Artificial Sequence
  Description of Artificial Sequence: Synthetic coding sequence
atgccaggacgatcttcttccaatagcggctccacaggcttcatatcatttagtggtgtcgagtcagcgctatcatccctcaagaactttcaggcatgtatcaactcaggaatggacactgcatcttccgtcgccctggacttagttgagagccagactgaggtgagtagcgagtactctatggacaaggccatggtggagtttgcgacactcgataggcaactgaatcactacgtcaaggccgtacagtcgacaattaaccacgtgaaagaggagcgccccgagaagattcccgatctcaaattactggtggaaaagaagttcctggctttgcaatctaagaactctgacgccgacttccagaacaacgaaaaattcgtgcagtttaaacagcagctcaaggagctgaaaaagcagtgcggcttgcaggccgaccgcgaagcagatggaaccgagggggtggatgaagatattatcgtgacacaaagtcagactaacttcacttgccctattactaaggaggagatgaagaaacccgtcaaaaataaagtctgtggtcacacctatgaagaggacgccatagtcaggatgatagaatccagacagaagcgtaagaaaaaggcgtactgcccccaaattggctgttcccacacagatattaggaagtctgatttaattcaggacgaggcacttcgccgagcaatcgagaatcataataaaaaacgccacaggcatagcgagtag

SEQ ID NO: 12519 - DNA, 582 bp, Artificial Sequence
  Description of Artificial Sequence: Synthetic coding sequence
atgcctgggcgcagtagctcaaacagtgggagcactggatttatttctttcagcggtgtcgaatctgctctgagctctctgaaaaatttccaggcctgcatcaacagtggcatggacacagcgagtagcgtggctctagatctcgttgagtcccagacagaagtgtccagtgagtatagcatggacaaagctatggttgagttcgccaccctcgacagacagctcaaccattacgtaaaagccgtgcagagcacgatcaatcatgttaaagaggagcgccccgagaagatacccgatctgaaactgctcgtggaaaaaaagttcctggcccttcagagtaagaactccgacgcagactttcagaataatgagaagtttgtccagttcaaacagcaactaaaggagctcaagaaacagtgcggccttcaggctgaccgggaggcggacgggacggaaggagtggatgaggatataatagttacccagagtcagaccaatttcacttgcccaattaccaaagaggagatgaagaaaccggtcaagaataaagtatgcgggcatacatacgaggaagacgcctag

SEQ ID NO: 12520 - DNA, 138 bp, Artificial Sequence
  Description of Artificial Sequence: Synthetic coding sequence
atgccgggccgctctagttcgaatagtggctctaccggttttatctcattcagtggcgtggaatctgccttgtcgtcacttaagaattttcaggcttgtatcaactccggcatggatacagcctcctctgttgcatag

SEQ ID NO: 12521 - DNA, 744 bp, Artificial Sequence
  Description of Artificial Sequence: Synthetic coding sequence
atgcctggacggagctcctctaactccggttccacaggcttcatctccttctccggcgttgagtctgcattgagcagtctcaagaattttcaggcctgtatcaattccgggatggacacggctagcagtgtggcactggacttggtagagtcacagaccgaagtctctagcgagtactctatggataaagctatggtggagttcgcgacattggataggcaattgaatcactacgtgaaggcggtgcagagcactataaaccacgtaaaggaagagcggcccgaaaagattcctgacttgaagctcctcgtagaaaagaaattcctcgccttacagtctaaaaattccgatgccgatttccagaacaacgagaagtttgtgcagttcaagcaacagttaaaggagttgaaaaaacagtgcggccttcaggcggacagggaggctgacggcacagagggagtggacgaagatattattgtcacacaatcgcaaaccaactttacatgcccgataacgaaggaagaaatgaaaaagcccgttaaaaacaaggtgtgtggacacacgtacgaggaagacgccatcgttcgtatgatcgaaagtcgacagaaacgaaagaaaaaggcctattgtcctcaaatcggatgtagccacacagatattagaaaatctgatctgatccaagatgaagctctcagacgagctattgagaaccacaacaagaaacgccatcgccactccgagtag

SEQ ID NO: 12522 - DNA, 420 bp, Artificial Sequence
  Description of Artificial Sequence: Synthetic coding sequence
atgcctggtcgtagctcttcaaacagcggatccacagggtttattagttttagtggagttgaaagcgccttatcgtccctgaagaacttccaagcttgtattaactccggtatggatactgcctctagcgtagcccttgacctcgtagaaagccagactgaagtctccagcgaatacagcatggacaaggccatggtagagtttgccactttggacaggcagttgaaccactacgttaaggccgtccagtcgacaatcaaccatgttaaggaggaaagacccgagaagatacctgacttaaagttgctggtagaaaaaaagtttctggcactgcagtctaaaaactctgatgcagactttcaaaataacgaaaaatttgtacagttcaaacagcagctcaaagagctgaaaaagcagtag

SEQ ID NO: 12523 - DNA, 705 bp, Artificial Sequence
  Description of Artificial Sequence: Synthetic coding sequence
atgctggacggccggcagcggcggggcagcaatgcccctacgtcggatatgccaggtactacactcaaccgctacggacggacgtggccccgctggggctggctgtggacaccaacaggcggcgcactacgaaaaagaaaggtgaaggccatggaggtggacatcgaagagcgccctaaggagctcgttagaaagccatacgtgctgaacgacctagaggcagaggcttccctgccggagaagaaaggaaacacgctttcaagagacctcattgactacgtccgatacatggtagagaaccacggtgaagattacaaggcaatggctgtgatgaggcgaattactatcaaaatcccacagaatcgatttggcgtgcgttctacaagcattaatgccttcacacagcagagcggtaaaaccagctctatactgtgtcgcaggggcagatggcgatggtccgattggttcactagtcagctgccacaggccgaggcctcccccggtcccgtgaagctagagcctgggtgcaaagcgcgcagatgctgcgttgctccggaggagctggcccgatcacacggcatacggcgtctgcatgtgcacacacccagatctggagaggggacggtcctacgcgggagcaatttgtatagctctggtggcagccgtaaatcacagaacctgcttttctcgggctgggtgatgtag

SEQ ID NO: 12524 - DNA, 537 bp, Artificial Sequence
  Description of Artificial Sequence: Synthetic coding sequence
atgccaaaggctaaggggaagacacggaggcagaaatttggctacagtgtgaataggaagcggctgaacagaaacgccagaagaaaagcagcaccccgcatcgagtgctcacatatacggcacgcatgggaccacgcaaagtctgtcagacagaaccttgcagagatgggcctcgcggtggaccctaatcgggccgtgcccctccgaaaacgcaaggtgaaggctatggaggttgatatagaagagcggcctaaagaactggttcggaagccgtacgttttaaacgatctggaggccgaggcgtctctaccagagaaaaagggcaacaccctgagccgcgacctgattgactatgttcgctacatggtggagaaccatggagaagactacaaggcaatggccagagacgaaaaaaattactatcaggatacccctaagcagatcagaagtaaaattaacgtatataaacgcttttacccagcagagtggcaggactttctcgactctctgcagaaacgaaagatggaagttgagtag

SEQ ID NO: 12525 - DNA, 696 bp, Artificial Sequence
  Description of Artificial Sequence: Synthetic coding sequence
atgcctaaagcaaaaggcaagacacgcaggcagaaattcggctatagtgtgaataggaaacgcctgaaccgcaacgccaggagaaaagctgcaccgcggattgagtgcagtcacattcgccacgcctgggaccacgccaagtcagtccgacagaatttggccgagatgggcctggctgtagaccccaaccgcgcggtcccgctccgaaagcggaaagtgaaagcaatggaagtcgatatagaagaacgccccaaagagttagtgcgcaaaccttacgttctcaacgacttggaagctgaggcctcacttccggagaaaaagggtaacacactgagtcgtgatctaatagattatgttcggtacatggtagaaaaccacggcgaggattataagcagagtgggaagacaagctccatcttgtgtcggcggggacgctggcggtggagcgattggtttacctctcagcttcctcaggcagaggcctctcctggacccgtgaagctagagcctggatgcaaagctaggaggtgctgtgtggccccagaagagttggccagatcccacgggatccgcaggctacatcacgtgcataccccccgctccggggaaggtactgtgttgaggggttctaacctatattcttccggcggatctcgcaaatctcaaaatttgttattcagtgggtgggtgatgtag

SEQ ID NO: 12526 - DNA, 711 bp, Artificial Sequence
  Description of Artificial Sequence: Synthetic coding sequence
atgcctaaggcaaaggggaagaccaggcgacagaaattcggctactctgtcaataggaagcggctcaaccgcaatgcgaggcgaaaagccgcccctcgcatcgagtgtagccatatccggcacgcctgggatcatgctaaatctgtcagacagaacctggccgaaatggggctcgcagtcgaccccaaccgagccgttccgctgcggaaaagaaaagtgaaggctatggaagtggatatcgaggagaggcccaaggagctagtgcggaaaccctatgtgctcaacgacctggaagctgaagctagtctgcctgagaagaagggcaacactcttagccgggacctgatcgactacgtgagatacatggtggaaaatcacggcgaagattacaagtctggcaaaacgtcaagcatcctgtgccggcgaggaaggtggcgatggtccgactggttcacaagccagttgcctcaggctgaggcctccccaggaccagtgaaactcgagccagggtgcaaggccaggcgatgctgcgtggcgcccgaagagttagctagatcccacggcatcagacggctgcacactagagctcacagcccgctctggggacgtaactgctcacagcgtctgcagttcatcttcatctggggatttactgagaagcctgagccagccgtgtttagagtgggagacgtgaatattgtgtgcacatag

SEQ ID NO: 12527 - DNA, 2439 bp, Artificial Sequence
  Description of Artificial Sequence: Synthetic coding sequence
atgggcagaaagcttgacccaaccaaggagaagagggggccgggacggaaggcacgcaaacagaaaggggccgaaaccgagctggtgaggtttctccccgccgtctcagatgaaaactcaaagcgcctctcgagccgagctcgcaaaagagcagctaaacgacggctgggaagcgtggaagcaccaaaaaccaacaagtctcctgaagccaagccattgcccggaaagctgcccaaaggaatcagcgcgggcgccgtacagactgccgggaagaagggcccccagagcttattcaacgctccacggggtaagaagcgtcctgccccgggaagcgacgaggaggaagaagaggaagactctgaagaagatggaatggtgaatcacggcgacctctggggttccgaagacgacgctgatacggtcgacgattatggcgcagactctaatagcgaggacgaggaggaaggggaagcgctactccccattgagcgtgccgcacggaaacagaaggccagggaggcagccgccggcatccagtggtctgaggaggaaacagaggacgaagaagaggagaaggaagttactccagaatccggaccgcccaaagtggaagaagctgacggcgggctgcaaattaatgtggacgaagaaccctttgtactgcccccagccggcgaaatggaacaagatgcccaggcaccagacctgcaacgggtccataagcgaatccaggacatcgtgggaattctgcgagatttcggggcccagagggaggaagggcgttcccgaagcgaatacttgaacaggctcaaaaaggatctggccatctattactcatatggcgacttcctcctgggcaagttaatggacttgtttcctctgtccgagctggtggagtttctggaagcaaacgaggtcccccgaccagtgactttgcggaccaatacactcaaaacacgaagaagggacttagcccaggcgcttataaatcggggggtaaacttagaccctctcggtaagtggagcaagaccgggctagtggtgtacgattcatccgttcccatcggggctacacccgaatatctcgccggacattatatgctgcagggtgcctcctcaatgttacctgtcatggcccttgcacctcaggagcacgagcgtatcctcgatatgtgctgtgcccctgggggcaagacctcctatatggcgcagttaatgaagaacactggtgtgatcctggctaacgacgccaacgccgaaaggttgaagagcgtggtcggcaatcttcatagacttggtgtgaccaatactatcatatctcattacgatggccgccagttcccaaaggttgtaggagggttcgatagggttctacttgacgctccatgctcagggactggtgtcatctcaaaagacccagccgtcaaaactaataaggatgagaaggacatattgcgctgcgctcatctgcagaaagaactgctcttgagcgccatcgatagcgtcaatgcgaccagcaagacaggtgggtatctggtctactgtacttgctcaatcacagtggaagaaaacgagtgggtagtggattatgccttaaagaagcggaatgtccggttagtcccaacagggttggacttcggacaggagggctttacccggttcagggaacggcggttccaccctagccttcgctctacaaggcgattttatcctcatacccacaacatggatggcttcttcatagcgaaatttaaaaaattctcgaatagcattccacagtctcagaccggtaactccgagactgccacccccacgaacgtggatctcccccaggtaattcccaagagcgagaatagttcccaacccgccaagaaggctaagggagcagccaaaactaagcagcagctccaaaaacaacagcaccccaaaaaggccagcttccagaaactgaatggaatttctaaaggtgccgattccgagctatcgacagtgccttccgtgactaagactcaggcctcgtcttccttccaggacagtagtcagccagccggcaaagccgaggggattagagagccgaaggtgaccggcaagcttaaacagcgatcccctaagctccagagttctaagaaggtcgccttcttacgtcagaacgcaccgccgaaagggaccgacacccaaaccccagcagtccttagtccgtcaaagacccaggctactctgaaaccaaaggaccatcatcagccccttggacgagccaaaggagtggagaagcagcaactgccagagcagccttttgagaaggccgcattccagaaacaaaatgatacaccaaagggcccccagcctccgacagtgtctcctatcaggagctcgagaccccctcccgctaagagaaaaaaatcccagtctcggggcaattctcagctgctcctgtcctag

SEQ ID NO: 12528 - DNA, 2427 bp, Artificial Sequence
  Description of Artificial Sequence: Synthetic coding sequence
atggggcggaaactggatccaacgaaagaaaaaagaggccctggtagaaaggccagaaaacagaagggggcagagactgagttggtgcggttcttgcctgctgtttccgacgagaacagtaagcggctatccagtcgggctagaaagcgtgccgctaagcgccgactcggctcggtggaggcaccaaagaccaataagtcacccgaagcaaagccactgccaggaaagctgccaaaaggggccgtgcagaccgcagggaagaaaggcccacagagtctctttaacgccccacggggaaaaaagcgtcccgcaccaggctccgatgaagaggaagaggaagaggattccgaggaggacggaatggtaaaccatggagatctgtggggaagtgaagatgatgcggacactgtggacgactacggcgccgacagcaactcggaggacgaggaggagggcgaagcactgctcccgatagaacgggcggcgcggaaacagaaagcaagggaagctgctgccggcatccagtggtccgaggaggagacagaagatgaagaggaggaaaaggaggtgaccccggaaagtgggcccccaaaggtggaggaggcagatggcgggctgcagattaacgttgatgaagaaccattcgtgctccctccagcaggcgaaatggaacaggacgctcaggcacccgatctgcagcgcgtgcataagcgaatccaagacatcgtgggaattctgcgggattttggcgctcaacgcgaagaggggcgctcacggtccgaatacttgaaccgccttaaaaaagacctggctatctattattcttacggcgactttctgttgggcaagttgatggatctctttcccctgagcgaactggtggaattcctggaagcaaacgaagtgcccaggccagtaaccttacggactaacacactaaaaactcgtaggcgagacctcgcccaggcgctgattaaccgcggtgtcaatctggatcccctgggtaaatggtccaaaactgggcttgtggtgtatgattcttccgtacctataggcgccactcctgagtacttagctgggcactacatgctgcagggcgcctcatccatgctgcccgttatggccctcgctcctcaagagcacgaacggatactcgacatgtgttgtgccccgggggggaaaaccagctacatggcccaactcatgaaaaatactggggtcattctggccaacgacgccaatgccgaacgcctaaagagtgtcgtgggaaacctgcaccgccttggtgtgaccaacacaattatttctcattacgacggcagacaattcccaaaggtggtgggtggatttgaccgcgtgttactggatgctccttgcagtggcacaggagtgattagtaaggatccagccgtgaagacaaataaggatgagaaggacattctacggtgtgcacatttacaaaaggaactgctcttgagcgctattgatagcgtgaatgcaacctccaagaccggtggttacctcgtctactgcacgtgttcaattaccgtcgaggaaaatgagtgggtggtggattacgctttgaagaaaaggaatgtgcgcttggtccctacggggttggacttcggacaagaaggattcacaaggttcagggagcggcggttccacccatctttacgttcgacgagacggttctaccctcacacccataacatggatggctttttcattgccaagtttaagaaatttagcaactccataccacagtcacagaccggaaattcggagaccgctacccccaccaacgtcgatcttccccaggtgataccgaagtcagaaaactccagccagcctgccaaaaaggcgaaaggtgccgccaagaccaaacagcagctccagaaacagcagcatcctaagaaggcctcattccagaaactgaacggcattagcaaaggggctgattccgagctgtctactgtgcccagcgtgaccaagactcaggcctcttccagctttcaggactctagtcagccagccgggaaagctgaaggtattcgggagcccaaagttacgggcaaactgaagcagaggtcccccaaactccaatcgtctaagaaggtggcattcctgaggcagaatgctcctcccaagggcaccgatacccagaccccagctgtgctatctccctcaaaaacacaagccaccctgaagcccaaggaccaccatcagcccctggggagggccaagggcgtggaaaagcaacagcttccggagcaaccctttgagaaggccgcgttccagaagcaaaatgacacacctaagggacctcagccaccgactgtgtcccctatacggagttcgcggcctccacctgcaaagcgcaaaaagtctcaaagtagagggaatagccagcttctattgagctag

SEQ ID NO: 12529 - DNA, 2439 bp, Artificial Sequence
  Description of Artificial Sequence: Synthetic coding sequence
atgggaagaaaactcgaccccaccaaggaaaaaaggggcccaggaaggaaagcgagaaaacagaagggagcagaaacggagttggtaaggttcctgccagccgtgtccgatgagaacagtaagcgcctaagctcccgagccaggaaacgtgccgccaaaagaagactgggatctgtggaggctccaaagacgaataagagtccagaagccaagcctctgcctgggaaattgccgaaagggatcagcgccggggccgtccagactgctggcaagaaagggcctcagtctctgttcaacgctcctcggggcaaaaaacggcctgccccagggagcgatgaggaagaagaagaggaagactctgaggaagacggtatggtgaatcacggagacctgtggggatcggaggacgacgccgacaccgtcgatgattacggcgccgactcaaattctgaggatgaagaagagggggaggcccttctccctatcgagagagccgcccggaaacagaaagcccgggaagccgccgcaggaatccagtggagcgaggaggagactgaggatgaggaagaggaaaaggaagtcactcctgagagcggacctccaaaggtagaagaggctgacggcggcctccagatcaatgtggatgaagagccatttgttctgcctcctgctggagagatggaacaggacgcccaggcccccgatttgcagcgggtgcacaaacgaatccaagacatcgtcgggatcttgagagattttggcgcccagagagaagaagggaggtctcgaagcgagtatctgaataggttgaaaaaagaccttgcgatttactactcctacggcgattttcttctgggcaagctgatggatctgttccccctgagtgagttggtggaatttctggaagcgaatgaagtgccacggcccgtcaccctccgaaccaacactttaaagacacggcgtagggatctcgcccaagcactaattaaccgtggcgttaacctcgaccctctgggaaaatggtcgaagaccggcttggttgtgtatgactctagtgtccccattggggcaaccccagagtacttagccggacattatatgctgcagggggctagctctatgctgcctgtgatggcgctggctccgcaggagcacgagcgcatccttgacatgtgctgcgccccagggggcaaaacctcctatatggctcagcttatgaaaaacacaggcgtcattctggctaacgacgccaacgccgagcgactcaagtctgtcgtgggcaacctccaccggctcggcgtcactaacaccattatcagccactatgacggccgacagtttcccaaggtcgttggcgggttcgatcgagttctgcttgatgcaccctgcagtggaacaggtgtcatttccaaggacccggcagtaaaaaccaataaagatgaaaaggatattctgcggtgcgcacacctgcagaaggaacttttgctttcagctattgatagtgtgaatgctactagcaaaaccgggggttacttggtgtactgtacctgttctattaccgtggaagagaacgagtgggtcgttgactatgccctgaaaaaaagaaatgttaggcttgtcccaactgggttggacttcgggcaggaaggctttaccagatttagagaaaggagatttcacccgtctcttaggagtacacgacggttttacccgcacacacataacatggacgggtttttcatcgccaagttcaagaaattctccaatagtattcctcaatctcagaccggcaatagcgagaccgccacacccactaacgtggacctgccacaggtgataccgaagagtgagaattcctctcagccagccaaaaaggctaaaggcgcggccaagactaagcagcagctgcagaaacagcagcatccgaagaaggcatcgttccagaaattaaatggtatttccaagggggcagacagtgaacttagcactgtgccctcagtcacaaagactcaggcttccagcagtttccaggatagcagccagcctgcagggaaagcagaggggatcagagaacccaaagtcaccgggaaacttaagcagagatccccaaagctccagtctagtaagaaggtcgctttcctgaggcagaatgcaccccccaagggaactgacacgcagacaccagccgtgctgagcccttcaaaaacacaggctactctgaaacctaaagaccatcaccaacccctgggccgcgccaagggcgtagagaagcagcagctgcccgaacagcctttcgaaaaggccgccttccagaagcagaatgatacacccaaaggcccccagcccccgacagtctcaccaattcgatcgagcaggcctccacccgcaaagaggaaaaaatctcagtccagggggaatagccagctcctgctgagctag

SEQ ID NO: 12530 - DNA, 2427 bp, Artificial Sequence
  Description of Artificial Sequence: Synthetic coding sequence
atgggacgcaaattggatccaacaaaagagaaaagaggacccggcaggaaggctagaaagcagaagggagctgaaacagagctggtgcgcttcctgcccgctgtgtccgacgagaattcaaagaggctttcatccagagcacgcaagcgagcggccaagcgtaggctagggtctgtggaggccccaaaaacaaacaaaagccccgaggctaaacctttgccagggaagttacctaaaggcgccgtgcagacggccggcaagaaaggcccccagtcgcttttcaacgctcctcggggtaaaaagcggcccgcgcccggcagcgatgaggaggaggaagaggaggattccgaagaggatggcatggtgaatcatggggacttgtggggcagtgaagacgacgctgacactgtggatgactatggggcagattctaattctgaagacgaagaggagggagaggccctgctgcccattgaacgagccgctcggaaacagaaagctcgcgaagcagcggccgggatccagtggagtgaagaggagactgaggatgaggaagaagagaaagaggtgacgcctgaaagcggccctcctaaggttgaagaggcggatggtgggttgcagatcaacgtggacgaagaaccgtttgtgctgcctccagctggtgaaatggaacaggacgcacaggcccctgacttgcagcgcgtccataagaggattcaggatattgtgggcattctgcgtgatttcggagcccaacgcgaagaggggagaagcagatctgagtatctgaaccggctgaaaaaggatctggcaatttactacagttacggcgattttttactgggaaaactcatggaccttttccctctgtccgaactggtagaatttctcgaggctaacgaggtgccgcggccggtgactttacgcactaatacacttaagactcggcgcagggatctggcccaagccctcattaaccggggggtgaacttagacccattgggcaagtggtcgaaaacaggccttgtagtgtatgatagctctgtcccgatcggcgcaacgccagagtatctggctggccattatatgctgcaaggggcctcctctatgctgcctgtaatggcgctcgccccacaagagcatgaacgcatactcgatatgtgctgcgcaccaggaggcaaaacgtcttacatggcacagctgatgaaaaacaccggagttatcctggcaaatgacgccaacgcagagaggttaaagtcagtggtaggtaatctgcaccggctcggtgtaaccaatacaatcatatcccactatgacggtcgtcaattccctaaagtcgtgggaggattcgacagagtgttgctggatgctccctgtagtgggacaggggttatttcaaaagacccagccgtgaaaacaaataaggatgagaaagatattttgcgttgcgcacacctccagaaggaattattgctcagtgccatcgattcagtaaatgcaacttcaaagaccggcggctacctggtttattgcacgtgctctattacagtggaagaaaacgagtgggttgtcgactacgctctgaaaaagcgcaatgttagacttgtgcccaccgggctggactttggtcaggagggttttacaaggttcagggagcgccggttccacccaagcctaaggagcactaggcgcttttaccctcacacacacaatatggacgggttttttatagcaaagtttaagaaattttctaactccattccccagtcgcaaaccggcaacagcgagaccgccacacccaccaacgtggacctacctcaggtaatcccaaagagtgagaattcatctcagcccgctaaaaaggccaaaggcgcggccaagacaaaacagcagctgcagaagcagcagcaccctaagaaggcctccttccagaagctgaacggcatcagcaagggggccgacagcgagctaagcaccgtgcctagcgttaccaaaactcaggcttctagttctttccaggactcgtctcagcctgccggcaaggccgaaggcatcagggaacctaaagtcactggcaaacttaagcagcgttctcctaagctccaatctagtaagaaggtggcctttctccggcagaatgccccacctaaaggcactgacactcagacacccgccgtgctaagcccgtccaagacacaggctactctgaaaccgaaggaccaccaccagccgttgggccgggcaaagggggtggagaaacaacagctccccgaacagccttttgaaaaggcagccttccagaaacaaaacgatactcctaagggcccccagcctcctactgtttcaccaatacggtctagtaggcccccgccagcgaaacgtaaaaagagtcagagccgcgggaactcccagcttttgctgtcttag

SEQ ID NO: 12531 - DNA, 2538 bp, Artificial Sequence
  Description of Artificial Sequence: Synthetic coding sequence
atgggaagaaaactggatcccaccaaggagaagagggggcccgggaggaaggcccgtaaacagaagggggctgaaaccgagcttgtgcgcttccttccagctgtgtcagacgaaaattcaaagagacttagctctcgcgctcgaaagcgagcagccaaaaggcggctggggagcgtggaggcacccaagaccaacaagagtcccgaggcaaagcctctgccaggcaagctccccaagggaatctcagcgggcgcggtgcagactgctggcaagaaagggccccaaagtctgttcaatgcacccagggggaagaagaggcccgccccgggctccgacgaggaggaagaagaagaggactcagaagaagacggaatggttaatcatggggatctctggggctctgaggatgatgcagacacagtggatgattacggcgccgactctaactctgaggatgaagaggaaggcgaggcagccggggtgcagtggctggggttgggcagcctgcaaccaccaccacctggctttaagcagttctcttgtctcagtttccccagcagctgggatctccagcttttaccgattgagcgcgccgctaggaagcagaaagctagagaagccgccgccgggatccagtggagtgaggaggaaaccgaagatgaggaagaagagaaagaagtaactcctgagtcggggccccccaaagttgaagaggctgatggggggcttcagattaatgtcgacgaagagccattcgttctgcccccagccggcgagatggaacaggacgctcaggcaccagacctccagagggtgcataagcgcatccaggatatcgtaggaatcctgcgcgacttcggggctcagagggaggagggaaggtcccgctctgagtatctaaacaggctgaagaaagatcttgcaatttactattcatatggagatttcctgcttggaaagctcatggaccttttccccctaagcgaactcgtggagtttctcgaggccaatgaagtgccacgtcctgtcacccttcgaactaatactttgaaaacgcgcaggagagatttggcccaagcactgatcaacagaggagtgaatctggacccactcggtaagtggagcaaaaccggcctggtagtctacgactctagcgtgcctatcggggcgaccccagaatacctggcgggccactacatgctccagggagctagctccatgctgcctgtcatggctctagcccctcaggagcacgagcgcatcctcgacatgtgctgtgctccaggcggcaaaacttcctatatggcccagctcatgaagaatacaggggtcatcttggcgaacgacgcgaacgccgaaagactgaaatccgtggtgggcaatctgcaccggctcggagttaccaacaccatcatatcacactacgacggacggcaatttccaaaggtcgtgggaggctttgatagagttttattagatgccccatgtagcgggacaggggtgatcagcaaggatccagctgtgaagaccaataaggatgagaaggatattctgcgctgcgcccacctgcagaaagagttactgctgtccgcaattgatagtgtgaatgccacaagcaagactggcggctacttagtctattgcacctgcagtattacagtggaagagaatgagtgggtggtggactatgcacttaagaagcggaatgtgcggctggttccaacgggattagatttcggccaggaggggttcaccagatttcgggagcgtcgctttcatcccagcctgcgctccacccggcggttttacccgcatacccacaacatggatggtttcttcatcgctaagtttaagaagttctcgaatagtattccgcaatctcaaaccggcaatagcgaaactgccacccccacgaatgtagatctgccgcaagtgattcccaaaagcgagaactcctcacagccggccaagaaggcaaagggcgccgctaagaccaaacagcagctgcagaagcagcaacatcctaagaaagccagtttccagaagctgaatggcatatcaaagggtgctgactctgagttgtcaacggtgccgtcggtgaccaagacccaagctagctcttcgttccaagatagcagtcagcctgcaggcaaggccgagggcattcgagaacctaaagttaccggaaagttaaaacaacgatcgccgaaacttcagtctagtaagaaggtagcgtttttaaggcagaatgcacctcccaagggaacagacactcagacccccgcagtactgagccccagcaaaactcaggctaccctgaagcccaaagaccaccatcaacccctcgggagggccaagggggtcgagaaacagcaactgcccgaacaaccttttgagaaggcagctttccaaaaacagaatgacactccaaagggcccacaaccgccaaccgtgagccccatcaggtcatccagaccccccccagccaagcggaaaaaaagtcaatccagaggaaatagtcagctccttttgtcgtag

SEQ ID NO: 12532 - DNA, 1887 bp, Artificial Sequence
  Description of Artificial Sequence: Synthetic coding sequence
atgggcaggaagttggatcctaccaaagagaaaagaggtcccggacgtaaagctcggaaacaaaaaggtgctgaaaccgaactggtgcggttccttcctgccgtgtccgacgagaatagcaagcggttaagttcccgcgcacgcaagagggccgctaagaggcgtctaggcagcgtagaggctccaaagactaataagagccccgaagcaaagcccctgcccgggaaattgcctaaaggagccgtgcaaacagcgggaaaaaagggacctcaaagcttgtttaacgccccacgcggtaagaaacgccccgcacccggatccgacgaggaggaggaggaggaggattctgaggaggacggcatggttaaccacggagacctctggggcagcgaagatgatgcagacacagttgacgattatggcgctgacagtaacagtgaggatgaagaggagggggaagcgttgctgccaatcgagagagcggcccgtaaacagaaggcacgtgaggcagccgcggggatccagtggagcgaagaagaaaccgaagacgaggaagaggagaaagaggttacgcctgagtcaggcccccccaaagttgaagaagcagacggaggtttacagattaatgtagatgaggaaccatttgtgttaccacccgccggagagatggaacaagacgcccaggcgccagatcttcagcgggtgcacaaacggatacaggacatcgttggtattcttagagacttcggcgcgcagagagaggagggccgcagccgctctgagtatctcaaccgactgaagaaggacctcgcaatttactattcctacggagattttctcctaggcaagttgatggacctctttccactgtcagagctagttgagtttctggaggctaacgaggtgccgcgtcccgtgactctgagaaccaacacgttgaaaacaagaaggagggatcttgcacaagctcttattaatcgcggcgtgaacctggatcccctcggaaaatggtccaagaccgggctagtggtctacgatagctccgtccccatcggagctactccagaatacctcgcaggccactacatgctgcagggggcgtcctctatgctaccagtgatggctctggcccctcaggagcacgagcgtatcctcgacatgtgttgtgctcctgggggcaagacatcttacatggctcagctcatgaaaaataccggtgtcatccttgcaaatgatgccaatgctgaacggctgaagtcagtcgtcggaaatcttcatcgacttggtgtcaccaatactataatatctcattacgatggccgtcagttccccaaggtggtaggcggttttgatagggtcttactggatgccccgtgctcgggcacgggggtgattagcaaggacccagctgtgaagactaacaaagacgaaaaggatatactgagatgtgcgcatcttcaaaaagagcttttgctctcggctatcgacagtgtgaacgcaacttcaaagacggggggctacctcgtgtattgcacatgcagcatcacagtagaggagaatgaatgggtcgttgattatgcattaaagaaacggaacgtgcggttggtgcccactggcttggattttggtcaggagggattcacccgattccgtgagagacggttccacccatctctgagatctacccgtcggttttacccacatacgcataacatggatggattctttatagcgaagttcaagaagttttcaaactctatccctcagtcccagacagatggtgtgctgttgtgtcggtcaggctggacagcggttgtgcagagtcaactgatcgcaacctctacttttcaagtccaggccattctagtgccacagacacccaagtag

SEQ ID NO: 12533 - DNA, 582 bp, Artificial Sequence
  Description of Artificial Sequence: Synthetic coding sequence
atggcactcagcactgactatgccctgcgaactggagccttcgaacccgcagaagcctccgtgaacccccaggaccttcagggctccttgcaggagctcaaggagagggccctaagtcgttataatctggtcagaggtcaggggccggagcgccttgttagtggaagcgacgattttacgctgttcctgtggagcccggctgaggacaaaaagccccttactaggatgaccggccatcaggccctgattaaccaggtcttgttttctcctgactcgaggatcgtcgctagcgccagcttcgacaagtccattaaactttgggatggtcggactggcaagtacctcgcttctctcagagggcacgttgcagctgtgtaccagatagcctggtctgccgactcacggctgctagtgagtggctcttcagattccaccttgaaggtgtgggatgtgaaggcccagaagctcgcaatggacctcccgggccacgcagacgaagtgtatgctgtcgattggtctcctgacggacagagagtggctagcggggggaaggacaaatgtctaaggatttggagacggtag

SEQ ID NO: 12534 - DNA, 915 bp, Artificial Sequence
  Description of Artificial Sequence: Synthetic coding sequence
taaagttctaaagatggctccgtcagaatctgggatactaccgccggacggtgtgagagaattctcacaggacatacccagtccgtgacatgtctccgatggggcggggatggactgttgtactccgctagccaggaccgaaccattaaagtgtggagggcgcacgatggggtactctgcagaaccctgcagggtcatgggcactgggtgaatacaatggctttaagcactgactatgcccttaggacaggagcttttgagcccgccgaggcttccgtaaacccgcaagatctgcagggctccttacaggagctgaaagaacgcgctttatccaggtacaacctggtgcgggggcagggccccgagcggttggtatctgggtccgacgatttcacactgtttctctggtcacccgctgaagataagaaacccttaacccgtatgacaggccaccaggcccttatcaatcaggtcctcttctctcccgactcaagaatcgtggcatctgcctcctttgacaaatccatcaagttgtgggacggacggaccggcaaggacgactttcacagtgtgacctggtgtagttccggcagttcagcagctgcacggtcctggttaatcaccacgtcagcttcttgggtgcaagtcatccttttaccccagcctccacgttatctggcaagtcttcggggccacgtagcagccgtctatcagatagcttggtcagcagatagtcgcctcctggtgagcggtagctctgatagtacactgaaggtgtgggatgtgaaggcccaaaagctggcaatggacttgcccggccacgctgacgaagtctacgctgtggattggagtccagacggtcaacgggtggcttctggcggaaaggacaaatgcttgcgcatttggagaagatag

SEQ ID NO: 12535 - DNA, 1458 bp, Artificial Sequence
  Description of Artificial Sequence: Synthetic coding sequence
atggctgccgcggtgcccgatgaggctgtggctagggacgtgcagaggttactggtccaattccaggatgagggcgggcaactactcggcagcccgtttgatgtgccggtggacataacacccgatcgcttgcagctcgtgtgcaacgcattgctggctcaggaagatcctctgcctttggccttcttcgtccatgatgcagagatcgtaagctctttaggaaagaccctggaatcacaggccgttgaaaccgaaaaagttttagacatcatttaccaaccccaggccatcttcagggtgcgtgccgtgactaggtgtaccagcagcttggaggggcacagtgaagccgtgattagcgtcgctttcagtcccacaggcaagtatctggcctccggctctggtgatacaaccgtcagattctgggatctgagtactgagacacctcactttacctgtaagggacacaggcactgggtgctgagcatatcttggagtcccgatggtcgcaagttggctagtggttgcaaaaacggtcaaatcctgctatgggatcctagcactggaaaacaagtgggccgaacactggctggccactctaagtggatcaccggcttgagttgggagccgctgcatgccaatcccgagtgtaggtatgtggccagcagtagtaaggacggtagtgtacgtatctgggacacgactgcgggcaggtgcgaacggattctgactggccatactcagtctgtgacgtgtctgcgttggggcggcgatgggcttctttacagcgcctcacaggatcgcaccattaaagtgtggcgcgcacatgatggggtcctgtgtaggaccttgcaggggcacgggcactgggtgaacactatggctctgagtaccgactacgcacttcggacaggcgcatttgagcccgccgaagcaagtgtcaatccccaggatctccaggggagtttgcaggaactgaaggagcgcgcgctcagcaggtataatctcgttaggggccaaggtccagagagattggtgagcggtagcgacgactttacccttttcctctggtctcctgccgaggacaagaagccattaactagaatgactgggcatcaagctctcataaaccaggtcctcttcagtcccgatagcaggattgtcgcctcagcttctttcgataaatcgataaagctgtgggatggtcggactggcaaataccttgcatctttgcgtggtcacgtggccgcagtgtatcaaattgcctggagcgctgactcccgcctgctcgtctccggctctagtgacagtaccctgaaagtgtgggacgtcaaggcccagaagcttgccatggacctgccgggccatgctgatgaggtctacgccgtcgattggtctcccgatgggcagcgcgtggcctccgggggcaaggacaaatgtctgcgtatctggcggcgatag

SEQ ID NO: 12536 - DNA, 1386 bp, Artificial Sequence
  Description of Artificial Sequence: Synthetic coding sequence
atggcagccgctgtgcccgacgaggcagtcgctagggacgttcagcgcttgctggtacagttccaagatgaggggggccagctgctggggagccccttcgacgttccggtggacataacacctgaccgtctgcagttagtctgtaacgcgctgctcgcccaggaggacccactcccacttgcattcttcgtgcacgacgccgagatcgtgtcctcccttggcaaaaccctcgagtcacaagccgtcgagacagagaaggttctggatatcatataccagcctcaggccatattcagggtacgagccgtcacacgctgtacctcttcgctggaaggccatagtgaggccgttatatctgttgccttctcccctaccggtaaatatctggcctcaggcagtggggacactaccgtccggttctgggatctatctacagaaaccccgcatttcacctgcaagggccatcggcattgggttctgagcattagttggtctcctgatgggaggaagctggcttccggttgcaaaaatggacagattctgttatgggagccactgcacgccaacccagagtgtcggtatgtggcatcctcgagcaaggatggctctgtccgcatttgggacaccaccgccggtcggtgtgagaggatcctgactgggcatacacagtccgtgacatgcttgaggtggggcggggatggtctgctgtacagcgccagccaggatcggaccataaaagtgtggagggcgcatgatggggtgctgtgtcggaccctacaggggcacggccattgggtgaacacgatggccttaagcaccgactacgccttgaggaccggagcgtttgaaccggcggaagcaagtgtgaatccacaggaccttcaaggatcgctccaagagttgaaggaacgggccctgagcagatacaatttggtgagaggacagggccctgagcgattggtgtcaggaagcgatgatttcacactttttctttggtcccccgctgaggataagaaacctctcacccggatgaccggccaccaggcgctgataaatcaggtactcttttcccccgacagtaggattgttgcctccgcctcattcgataaaagtatcaagttatgggatggccgtactgggaagtacttagcttcgctcaggggtcacgtggccgctgtgtaccaaatcgcctggagtgcggatagccgtctcctggtttccggatctagcgattccactctcaaggtctgggatgtgaaggcacagaagctggcaatggacctgcctggtcatgcagatgaggtttatgctgtggactggagccctgacgggcagagggtggcctcaggaggaaaggacaagtgcctgcgcatatggcgaagatag

SEQ ID NO: 12537 - DNA, 582 bp, Artificial Sequence
  Description of Artificial Sequence: Synthetic coding sequence
atggctctatcaacagattatgctcttcggacaggcgctttcgagccagctgaagcgagtgtgaacccacaggacctgcaagggagcctgcaggagctgaaggaaagagctctatcaaggtacaacttagtccgcgggcagggcccagaacgcctcgtgtccggcagtgacgacttcaccctgttcctatggagcccagcagaggataaaaaacccttgacacgcatgacaggccaccaggccctgattaatcaggtcctgttctctcccgacagccgcatcgtcgccagtgcgagctttgataagtcaatcaagttgtgggacggacggactggcaagtaccttgcctcactgcgaggacacgtagccgcagtgtatcagattgcctggagcgcggactccaggctgctggtgagtgggagttccgatagtactctgaaggtgtgggatgtgaaggcacaaaaactggccatggaccttccgggacatgccgacgaggtctacgcagtggactggagtcctgatggccagagggtggcaagcggaggcaaggacaaatgcctgaggatctggcgtaggtag

SEQ ID NO: 12538 - DNA, 756 bp, Artificial Sequence
  Description of Artificial Sequence: Synthetic coding sequence
atgcctagccccaggccaaggggatcaccacccccggcccccagtggatccagggttcgtcccccgcgcagcggccggtcacccgccccaaggagtcccaccgggccaaacacacctagggccccgggcagatttgaaagtcctttttccgtagaggctattctggcacgccccgacccctgtgctccggccgcctcacaaccctctggatctgcgtgcgtgcacccagccttttggaccgctgccagtctctgcgccactggggggctgccatgggcctgcccgactagctggctgcccgcttatttgagtgttggtttttatcctgtgccgggcccgcgtgtggcacccgtgtgcgggctgcttggcttcggtgtcacgggtcttgaactggctcactgttccgggttatgggcattccccgattgggcacctactgaggatctgcaagatactgagcgccagcaaaagcgggtcaggactatgttcaatctggaacaactcgaagaactggagaaggtgttcgccaagcagcataatctggtcggaaagaagagagctcagctggccgcccggctgaagcttaccgagaatcaagtccgcgtgtggtttcagaatcgtcgcgtgaagtaccagaaacagcagaagctccgtgccgccgtaactagtgcagaagccgcttcactcgatgaaccgtccagttctagcattgcctctattcagtcggatgatgccgaatctggtgtagacggttag

SEQ ID NO: 12539 - DNA, 1110 bp, Artificial Sequence
  Description of Artificial Sequence: Synthetic coding sequence
atgttctgctgtttaggctacgagtggctgtctggcggatgcaagacttggcacagtgcctgggtaatcaatactttggcagaccaccgacacagaggcactgattttgggggatccccctggcttctgatcatcacagtgtttttgaggtcttataaattcgcaatttctctgtgtacatcttatctctgcgtgagcttcttgaaaacgatttttccctctcaaaatggacacgacgggtccacggatgtccagcagcgcgcacgcagatctaactgccggcgccaggaggggataaaaatagtgcttgaggacattttcactctgtggcggcaggttgagacaaaagtaagggctaaaattaggaagatgaaggtcaccaccaaggtcaacaggcacgacaagatcaacggcaagaggaagaccgccaaagaacatctgagaaagctgtccatgaaagagcgcgagcacggcgaaaaggagcggcaggtcagtgaggctgaggagaatgggaaattggacatgaaagagatacacacctacatggaaatgttccagcgtgcccaggcattacgtcgccgggcggaggattactatcggtgtaaaattactccttctgccaggaaaccactgtgcaaccgcgtccgcatggctgcagtcgaacaccgccattctagcggcctgccatattggccatacctgacagccgagacccttaaaaaccggatgggtcatcagcctccgccacctacccagcagcactctatcattgataattcactgtccctgaagacaccctcggaatgtgtcttgtaccctctcccaccctctgccgatgacaatctgaagaccccccctgaatgcctgctcacgcctttgccaccttcagccctgccaagcgccgacgataacctgaaaacgccagccgaatgtctgctctatccactgcctccgagcgccgatgataacctgaaaacaccaccagagtgtttactgacacctcttccaccgtctgcaccgccctctgctgatgacaatctgaaaacccctccagagtgtgtgtgcagcctaccgtttcaccctcagcgcatgatcatcagcaggaattag

SEQ ID NO: 12540 - DNA, 1110 bp, Artificial Sequence
  Description of Artificial Sequence: Synthetic coding sequence
atgttctgctgcctgggttacgagtggctgagcggtgggtgtaagacctggcactccgcttgggtaattaatactctggccgaccatcggcatcgaggcactgacttcggggggtccccctggcttttgataataaccgtgttcctgaggagctacaagttcgccatctcactctgtacatcatatctttgcgtctccttcctgaaaactatcttcccgtcccagaacggccacgatgggtctactgatgtgcagcagcgcgccaggagatctaattgtcggcggcaggaaggtattaaaatcgtgttagaagacatctttactctatggcggcaggtcgaaacaaaggtgcgcgcaaagattcgcaaaatgaaagtgactactaaagtcaatcgccatgacaagataaacgggaaaagaaagaccgcaaaggagcaccttcgaaaacttagtatgaaagaaagggaacatggcgaaaaagagaggcaggtcagtgaggcagaggagaacggcaaactcgatatgaaggagattcatacatatatggagatgttccagcgagcacaggccctccggcgcagggctgaggattattatagatgcaaaattactcccagtgctaggaagcctctctgcaatcgagtgcgtatggctgcagtggaacataggcactcttccggactgccctactggccgtatttaacagcagagacactgaaaaatcgaatgggccaccagccccctccaccaacgcaacaacactctatcatcgataacagcctgtccctgaagaccccttcagagtgtgtcctctaccctctacccccctctgccgacgataatctgaagacgccacctgagtgccttctgacccctctacccccctccgcactccctagcgccgacgacaacctgaaaaccccggcggagtgtctgttgtaccccctgccgccctctgcagatgacaatttgaagacacctcctgagtgcttgctaaccccccttccaccatccgccccccccagcgctgatgacaacctgaagactcccccagaatgtgtgtgttcccttcccttccacccccaacggatgatcattagtagaaattag

SEQ ID NO: 12541 - DNA, 1110 bp, Artificial Sequence
  Description of Artificial Sequence: Synthetic coding sequence
atgttttgctgcctcggctacgaatggttgtccggcggttgcaagacctggcattccgcctgggtgataaacacgctggccgaccacagacatcggggcacagactttggagggtctccttggttgttaataattactgtctttctaagatcctacaaatttgcaatctctttgtgtacgtcctatctgtgtgtttccttccttaagacaatttttccatcccagaatggccatgatgggagtacagatgtacagcagagagcaaggcgctccaactgtcgccgccaggaaggaatcaagatcgtgcttgaagacatttttaccctgtggaggcaagtcgagactaaggtgagagctaaaatccggaaaatgaaagtgacaactaaggtgaaccgacacgataaaatcaatgggaagaggaagacagctaaagagcatctgaggaaactgtccatgaaagagcgagaacacggcgagaaagagcgacaggtgtctgaggctgaggagaacggaaagcttgacatgaaagagatccacacgtatatggaaatgttccagagagcacaagcgctccgccggagggccgaagactactacaggtgcaaaattaccccttctgctaggaagccattgtgtaacagagtaaggatggccgcggtcgaacacagacactcttccggtcttccgtactggccgtacttgaccgctgaaaccttgaaaaatcgaatgggccatcagcccccacctcccacacaacaacactctattatcgacaattcgctatccctgaagacaccatccgaatgcgttctgtacccactcccaccctctgccgacgacaacttgaagacgccccccgagtgcctcctgacccctctgcccccatccgccctgccatcagctgatgacaatttgaaaacccctgcagaatgtctgttgtatcccctaccgccctcggcagatgacaacctcaagaccccacctgagtgtctattgacgcccctgccccccagtgcgccgccctccgcagatgataatcttaaaaccccaccggaatgcgtgtgtagcctgcccttccatccacagagaatgatcatctcaagaaattag

SEQ ID NO: 12542 - DNA, 699 bp, Artificial Sequence
  Description of Artificial Sequence: Synthetic coding sequence
atgttctgctgcctaggctatgagtggctgagcggtggctgtaagacctggcatagcgcatgggtgattaatactttggcagatcatcggcatagaggcacggacttcggcggttcgccgtggctgctgataattacggtgtttctgaggtcctataaattcgccatctcgctttgcactagctacctgtgcgttagtttccttaagacgatcttcccatcacagaatggtcatgacggctccacagacgtgcagcagagggcccgacggtccaattgtcgtcggcaagagggcatcaaaattgtgctcgaggacatttttaccctatggagacaggtggaaacaaaggttagggccaaaatccgtaagatgaaggtgacaacaaaggtaaacagacacgacaagattaacggcaaacggaagacggctaaggagcacctcagaaaactgagtatgaaggaacgggagcacggggagaaagaacgccaggtctccgaagccgaagagaacggcaaacttgacatgaaagaaatccacacctatatggaaatgttccagcgagcccaggctcttagacgcagggccgaggattactatcggtgcaagatcaccccaagcgcacgcaaacccctgtgcaacaggtgtacatacaacctggttctccctgggagcgagaaaaaatattattctcatgcctag

SEQ ID NO: 12543 - DNA, 699 bp, Artificial Sequence
  Description of Artificial Sequence: Synthetic coding sequence
atgttttgctgtctaggatatgaatggctttcaggaggctgcaagacatggcattccgcatgggtgataaatacactggctgaccaccggcaccgcggaaccgattttggagggtctccttggcttctgataatcaccgtgtttttgcggagctacaaatttgccatcagtttgtgtaccagttacctgtgtgtttcattcctgaagaccatatttccctctcagaatggacacgatggctccactgacgtccagcagcgcgccaggcggtcgaactgcaggagacaggaaggcattaaaattgttctggaggatatcttcaccttgtggcgtcaggtggagacaaaagtccgagcgaagatcagaaagatgaaggtgacgaccaaagtgaacagacatgataaaatcaacggcaaacgcaagacagcgaaggagcatctcagaaaactatccatgaaagaacgcgagcacggggaaaaggaaagacaggtgagtgaggccgaggaaaacggcaagcttgatatgaaggaaatccacacatatatggaaatgtttcagcgcgcccaagcgttgaggagaagagcggaggattactacagatgtaaaatcactccatctgcccggaaacctctatgcaacagatgtacatacaacctggttctccccgggagcgagaagaagtactactctcatgcgtag

SEQ ID NO: 12544 - DNA, 1110 bp, Artificial Sequence
  Description of Artificial Sequence: Synthetic coding sequence
atgttctgctgtctcggctatgagtggctctccggagggtgtaaaacctggcattcggcatgggtgattaatacgcttgcagatcatcgccaccgcgggacagattttggcgggagtccctggttactgattattactgtcttcctccgtagctacaaattcgccatctctctgtgcacctcatacttgtgtgtttcttttctgaaaactattttcccctcacagaacgggcatgacgggtccaccgacgtccagcagagagcccgccgaagcaattgcaggcgccaggaagggattaaaatcgtcttggaggatatattcaccctgtggcgtcaggtcgaaaccaaggttcgcgccaagatccggaaaatgaaggtgactaccaaagtgaatcggcatgataagatcaatgggaagagaaaaaccgctaaggagcatctgaggaaattgagcatgaaagaaagagagcatggtgaaaaagagcgccaggtgagtgaagccgaggagaatggcaagctcgacatgaaggaaatccacacgtacatggagatgttccagagggcacaagcattgaggagaagggccgaggattactaccggtgtaagatcacaccctcagctcgcaaacctctctgcaacagagtaaggatggctgccgtcgagcaccggcactcttctgggctgccttactggccttacctgaccgccgagacactcaaaaatcgaatgggacaccagcccccaccccctacgcaacagcacagtatcatcgacaattcgctctctctgaagacaccaagcgagtgtgtgctataccccctgccgccctctgccgacgataacctcaaaaccccccctgaatgcctgctcacaccccttccaccttccgcactgccctctgcagatgataatctaaagacacccgccgaatgtttgctgtaccctttgcctccttccgcagatgacaacttgaaaacacctcctgaatgtctgctcacaccccttccgccaagcgcacccccctccgccgatgataatctgaagactcctccggagtgtgtctgttctctgccgttccacccccaaagaatgattattagtcgcaattag

SEQ ID NO: 12545 - DNA, 2067 bp, Artificial Sequence
  Description of Artificial Sequence: Synthetic coding sequence
atggaaaacggggtgttagggaacgcattggagggcgttcacgtggaggaggaggagggtgagaagacagaagacgagtcactggtggaaaataacgacaatattgacgaggaagcccgcgaggagctcagagaacaggtgtatgatgccatgggtgaaaaggaagaggctaagaagacggaggataaaagcctggccaaacctgaaaccgacaaagagcaggatagcgagatggagaagggcggacgggaggatatggacattagtaagagcgccgaagagccccaagagaaggtcgacctgaccctcgattggctcaccgaaacgtccgaagaggcgaaaggaggtgccgctcctgagggacccaatgaggccgaagttacgtctggaaagcccgaacaggaagtccccgacgcagaggaagaaaaaagcgtcagcggaaccgacgtgcaggaggaatgcagggagaagggaggacaagagaagcaaggcgaagtgatcgtcagtatcgaggagaagccaaaggaagtctctgaagaacagcctgtggtcacactggagaaacaggggaccgcagtcgaagttgaggcagaatctcttgacccgacggtcaagcccgtggatgttggcggtgatgaacctgaagagaaagtcgttaccagcgaaaacgaggccgggaaagccgtattagagcagctggtggggcaagaggtgccaccggcggaggagtcacccgaggtaacaaccgaggccgcagaggccagcgcagttgaggcgggaagcgaggtttccgagaaaccgggtcaagaagcccccgtgctcccgaaggacggagccgtaaatggtccgtccgttgtcggcgatcaaactcctatcgagccccaaactagcattgaacggctaacagaaaccaaggatggttccggcctggaggaaaaggtacgtgctaagctggttccatcccaggaggagactaagttgtctgtggaggagtccgaagctgcaggggatggtgttgacaccaaagtggcacagggtgcaactgaaaagagtcctgaggataaagtgcagatcgctgccaatgaggagacacaggaaagggaggagcagatgaaagaaggcgaagagaccgagggaagcgaagaagacgacaaagagaacgacaaaaccgaagaaatgccaaatgactcagtgctggaaaataagagtctgcaggaaaacgaggaggaggagatagggaacctggaactagcatgggatatgcttgatttagccaagattatcttcaaacgccaggaaaccaaagaagcccagctctatgcggcacaggcgcaccttaaactcggtgaagtgtccgtcgaatcggagaattatgtgcaagcggtggaagagtttcagtcttgcctcaacctgcaggagcagtatctggaggctcacgaccgcctgctggcagaaacccactaccaactaggcctggcatacggatataactcccagtatgatgaggccgtagcgcaattcagcaaaagtatagaagtgatagagaatagaatggctgttcttaatgaacaggtgaaggaagcggaaggctctagcgccgagtacaagaaagaaatcgaagagcttaaggaactcctccccgagatcagggagaaaatagaagacgccaaggagtcacagcgctcgggtaacgtcgccgagctagccttgaaggccactctagtggagagttccacttccggcttcacgcccgggggaggcggctcctctgttagtatgatcgcgtcacgcaaaccgacagacggcgcttcgagcagtaactgcgtcaccgacatttcccacttggtgcgcaagaaaaggaaacccgaggaagaaagccccagaaaagacgatgctaagaaggccaaacaagaacccgaggttaacggcggctctggtgacgccgttcctagcgggaacgaagtgtctgaaaatatggaagaggaggctgagaatcaggccgagtcacgagctgcagtggaagggaccgttgaggccggagccaccgttgagtccactgcatgttag

SEQ ID NO: 12546 - DNA, 2367 bp, Artificial Sequence
  Description of Artificial Sequence: Synthetic coding sequence
atggccatggaatccacagcaacagccgccgtggccgccgagctagtgagcgccgataagattgaagacgtacctgcaccaagcacttctgctgataaagtcgaatctctagatgtggattcagaggcaaagaagctgctgggtttggggcagaagcacctggtaatgggtgatattcctgctgccgtgaatgctttccaggaagctgcaagcctcttgggaaagaaatacggcgagacagccaatgagtgtggtgaggcattctttttttatggaaagtccctcttagaactcgctcgtatggagaacggggtgctgggcaacgcactggaaggagtccacgtcgaagaggaagagggagaaaaaactgaagatgagtctctggtggaaaataatgataacattgatgaggaagcccgagaggaattaagagaacaggtgtatgatgctatgggagagaaggaggaggcaaagaaaaccgaggataagtcgttggccaagcctgagaccgacaaagagcaggactcagaaatggagaaagggggacgggaggacatggacatctctaagtctgcagaagagccacaggagaaggtggacctgaccctagactggttgaccgaaacgtctgaggaggccaaaggtggcgctgcccctgagggccctaacgaggccgaggtgacatccggcaaaccagagcaggaagtcccagacgctgaggaagagaagtccgtcagcggcacagatgtccaggaggaatgtcgcgaaaaaggggggcaggaaaaacagggggaagtgattgtgtcaatcgaggaaaagcctaaagaggtttcagaggagcagccagtcgtaacactggagaaacagggaaccgcggtcgaggtggaggctgagagcctggaccccacagtcaagcccgtggacgttggcggcgatgaacccgaagagaaagttgttaccagcgagaacgaggcgggcaaagctgtgctcgaacagttagtgggacaggaggtccccccggccgaagagtcaccagaggtcaccactgaagctgccgaagccagcgctgtggaagcaggctcggaagtttccgaaaagccgggacaggaggcgcctgtcctcccaaaggacggggcagtcaacggcccctccgtggttggagatcagactcctatagagccacagacttcaatcgagcgcctgacagaaaccaaggacggatccggcctagaggagaaagtgcgggcgaagctagttccaagccaggaagagaccaaactctctgtcgaagagtccgaggccgccggtgatggcgtagatactaaagtcgcacaaggagccactgaaaaaagccctgaagataaagtacagatagccgcgaatgaagaaactcaagaacgagaggagcagatgaaagagggcgaggagacagaagggtcagaagaggatgacaaagagaacgacaaaaccgaggagatgcccaatgactccgtgctggagaacaaatctctacaagaaaacgaagaagaggagatcggtaacctggaactcgcctgggatatgcttgacctggccaagataatcttcaagagacaagaaaccaaggaggctcaattatacgccgcgcaggcacatctaaaactaggcgaggtctctgtggagtctgaaaattacgtgcaagccgtggaggagttccagagctgtctgaatttgcaggagcagtatctggaagctcacgatcgactcctggctgagacgcactatcagctaggattggcatatggatacaactcccagtatgatgaggctgtggcccagttttccaagtccatcgaagtgatcgagaaccgaatggctgtcttgaatgaacaggttaaagaggccgaaggcagctcggccgaatataagaaggagattgaggaattaaaggagctgctcccggagatcagggaaaaaattgaagacgcaaaagaatcacagcgatctggcaatgtggccgagctggccttaaaggcaacgctggtggagtcgtctacatccggattcactcctggaggcggggggagcagtgtgagtatgattgcatcacggaagccgactgatggggcttcatcatctaattgcgtgacagacataagccacctcgtaaggaagaagcgaaaacccgaggaagagagcccgaggaaggatgatgccaagaaggctaaacaggagccggaggtaaacgggggaagtggagacgctgtgccatccggaaatgaggtgagtgaaaatatggaggaggaagctgaaaaccaagcggaatctcgtgcggccgtagaaggaacggtggaagctggcgccacagtcgaatccacagcatgttag

SEQ ID NO: 12547 - DNA, 1350 bp, Artificial Sequence
  Description of Artificial Sequence: Synthetic coding sequence
atggctatggaatctactgcaacagccgcagtggcagcggaactggtgtcagcagataagattgaggatgtgcctgctccttctaccagtgcagacaaggtggaatccctggatgtcgatagtgaggctaagaaacttctagggcttggtcagaaacacttggtgatgggtgatatcccagccgccgttaacgcattccaggaagccgcttcattgctcggtaaaaagtacggtgaaacagcaaatgagtgtggtgaggcctttttcttttacggcaaatcactcctggagttggccagaatggagaatggagtgctaggtaatgcactggaaggtgtacatgtggaggaggaagagggcgagaaaactgaagatgaatcactggttgaaaataacgataacatagatgagacggaggggtccgaggaggatgacaaagagaatgataaaactgaagagatgccaaacgatagcgtgctggaaaacaagtcgctgcaggagaacgaggaggaggagattggaaacttggagctcgcctgggatatgttagaccttgccaagattatttttaaaagacaggaaacgaaagaggcacagttgtatgccgcccaggcccacctgaaactcggggaggtatccgttgaatcggagaactacgtgcaggccgtagaggagtttcagtcgtgcctaaacctgcaggagcagtacttggaagctcatgaccgcctgttggctgaaacccactatcaattgggcctggcctacggctataatagtcagtatgatgaggctgtggcgcagttttctaagtccatcgaagttatcgaaaatcgaatggcagttcttaacgaacaagtgaaggaggcagagggctcatccgctgaatacaaaaaagaaattgaggagctgaaagagctcctacctgagattagggagaagatagaggacgccaaagagtctcagagatcagggaatgtcgctgagctggccctgaaggcaacacttgtggagtcctctacttcaggatttacgccgggcgggggggggtcctctgtgtccatgatcgcttcccgtaagcctactgatggcgcaagctcttctaattgtgttactgacatctcccatctggtgaggaaaaagcgcaaaccagaggaggaatcccctagaaaggacgatgctaagaaggctaagcaggagccagaagtgaacggagggtccggcgatgccgtcccctcagggaatgaggtctctgagaacatggaggaagaagccgaaaatcaggcggagtcacgcgccgctgtggaagggacagtagaagctggcgccactgtggaaagcacagcttgctag

SEQ ID NO: 12548 - DNA, 2373 bp, Artificial Sequence
  Description of Artificial Sequence: Synthetic coding sequence
atgtttctcctgttgcttcatttgcaaattaaatggagagctaccataaatcttctttcagtgacagaggatggccttcactttgtagagtattacctgaacaggattattcacctcgatgtggacagtgaagctaaaaaactgctcgggctgggacagaagcatctggtgatgggggatatccctgctgcagtgaacgcctttcaggaggccgccagcctgttggggaagaagtacggagagacggccaatgagtgcggtgaggccttttttttctacggtaagagccttctagaactggcacgcatggagaacggcgtgttaggcaacgcactcgagggggtgcatgtcgaggaggaggagggcgagaagacggaagacgagagtctagtcgagaacaacgacaacatagatgaggaggcccgagaagaactgcgcgaacaggtctatgatgcaatgggagaaaaagaggaggccaaaaagaccgaggataagtcattggcaaaacccgaaactgataaggagcaggatagtgaaatggagaagggtggacgagaagatatggatatttctaagagtgccgaggaaccccaggagaaagtggacctgactctcgattggctcacagagacttccgaggaggcgaaaggaggcgcagctcccgagggacctaatgaggcagaggtcacgagtgggaaacccgagcaggaggttcctgatgctgaggaagaaaagtcagtgtcgggcacagatgttcaggaagagtgccgggaaaaggggggacaggagaagcagggggaggtgatcgtgtctatcgaggaaaaacctaaggaagtgtcagaagagcaacctgtggtgaccctcgagaagcagggaaccgcggtggaagtcgaagccgaatcactggaccccaccgttaagcccgttgacgtgggcggggacgagccggaggagaaggtggttactagtgagaacgaggcaggtaaggctgttctagagcagctcgtaggacaggaggttccccctgcagaagagagccctgaagtcactacagaggcagcagaagcatcggcggtcgaagccggctcagaagttagcgaaaagcctgggcaggaagctcctgtcctgcctaaggacggcgccgtcaatggtccgtctgtggtgggggatcagacccctatcgagcctcagactagcattgagcggctgaccgagaccaaggacggtagtggcctcgaagagaaggtgagggccaagctggtccccagccaggaagaaacaaaattgtctgtggaagaatctgaagcagctggagatggcgttgataccaaagtagctcagggcgccacagagaagtcccccgaggacaaagtccagatcgcagccaatgaggagacccaggaacgggaggagcagatgaaggagggtgaagaaaccgaagggtctgaagaagatgacaaggaaaacgacaaaacggaagagatgcccaacgactcggtacttgagaacaagagtctgcaagagaatgaggaggaagaaattggtaatcttgagctagcatgggatatgcttgacctcgccaaaataatctttaaaaggcaggaaacaaaagaggctcagctgtacgctgcacaggcccaccttaagctaggcgaggtgagcgtagaatccgagaattacgttcaggccgtggaggaattccagtcctgtttaaatctgcaggaacaatacttggaggctcacgatagattacttgctgagacacattaccagctagggctggcctatgggtataactcccagtacgacgaggcagtggcacagtttagcaaaagtattgaagtgatcgaaaatagaatggctgtgttgaacgagcaggtcaaggaagcggagggtagctcagcggagtataaaaaggagatagaggagctgaaggagctcttacccgaaattagagagaaaatcgaagatgccaaggagtcccagagatccggcaatgtggcggagcttgcactgaaggctaccctggtggaaagcagtacctccgggttcaccccggggggagggggttcatcagtgtccatgatcgcaagtaggaagccgacggacggtgctagcagctccaactgtgtgactgatatttcccatttggttcgtaagaaacgaaaacccgaagaagagtccccacggaaggatgacgcaaagaaggctaagcaggaaccagaggttaatggcggaagcggcgacgcagtcccatccggtaacgaggtgtcagaaaatatggaagaagaggccgagaaccaggccgagtcaagggccgctgttgaaggtaccgtagaggccggcgccacagtagaatccacggcttgctag

SEQ ID NO: 12549 - DNA, 771 bp, Artificial Sequence
  Description of Artificial Sequence: Synthetic coding sequence
atggcaatggagtctaccgccacggcagccgtggctgcagagttagtatcagccgacaagattgaggacgtccccgccccttcaacatcagccgataaagtggaaagcctggacgttgattcagaagccaagaaactgttgggtttgggccaaaagcacctagttatgggggacatacccgcagccgtcaacgccttccaggaagccgcatccctgcttggcaagaagtacggcgagactgcgaacgagtgcggagaagccttcttcttttatggaaagtcgctgcttgagctggctcgtatggagaacggtgtcctcggcaacgcacttgaaggagtgcacgtggaagaggaagaaggagaaaaaaccgaggacgagagtctagtggagaacaatgataacattgacgaaactgagggctctgaggaggatgacaaagaaaatgataagaccgaggagatgcccaacgattcggtgctggagaacaaaagcctacaggagaatgaggaagaagaaattggcaacctagaattggcatgggatatgctggatttagcgaaaataattttcaagcggcaagagacgaaggaagctcagttgtacgcagcacaagcacatcttaaactgggcgaagtatctgtggaatccgagaattatgtgcaggccgtagaggagtttcagtcttgtctcaatcttcaggagcaatatctcgaagcccacgaccgtcttctggcagagacccactatcagctcggcttggcttatggctag

SEQ ID NO: 12550 - DNA, 2175 bp, Artificial Sequence
  Description of Artificial Sequence: Synthetic coding sequence
atggcaatggagagtacggccaccgcggcagtcgcagccgaattagtatcagccgacaaaattgaggatgtacccgcccctagcacctctgccgataaggttgagcgcatggaaaacggcgtgcttggcaatgccttggagggggtgcatgtagaagaggaggaaggggagaaaaccgaggatgaaagcctagtcgagaataacgacaatattgatgaggaggcgagggaagaactgcgcgagcaggtatatgatgctatgggcgaaaaggaagaggcgaagaagacagaagataagagcctagcaaagccggaaaccgataaggagcaggacagcgagatggagaaaggcggtagggaagacatggatatttctaaatcggctgaggaaccacaggagaaggtagacctcaccctggactggcttactgaaacatctgaggaagccaaggggggggctgccccggagggcccaaacgaggctgaagttacatccggtaagcctgaacaagaggtgccggacgccgaagaggaaaaatcagtcagtgggacagacgtgcaggaagagtgtcgcgagaagggcggccaggagaaacagggcgaagtgattgtgagcatcgaagagaaaccaaaagaggtgtccgaggaacagccagtagtaaccctggagaagcagggcacagcagttgaggtcgaagcagagtcccttgaccctaccgtgaaaccagtagacgtgggcggagacgaacctgaagaaaaggtcgttactagtgagaacgaagccggtaaagcagtcctggagcagctggtaggacaggaagttccaccggccgaagaaagtcctgaggtcaccacagaggccgctgaggccagcgcagtggaagcaggatctgaggtgtccgagaagcccggacaagaggcccccgttctgcccaaggacggtgcggtcaacggccctagtgtggtaggggatcaaactccaatcgagccccagacctcaatcgagcggctcaccgaaaccaaagatggcagcgggctggaagagaaggtgcgcgccaaactagttcctagtcaggaagagacgaaactcagcgtcgaagaaagcgaagctgccggggacggggttgacaccaaagtggctcagggagccaccgaaaagtccccagaggacaaggtccagatcgccgcaaacgaggagacccaggagcgcgaggagcagatgaaagagggagaggagactgagggtagcgaagaggatgataaagaaaatgacaaaacagaggagatgcccaatgactccgtgctggaaaataaatctttacaggagaatgaggaagaagagatcgggaacctggaacttgcttgggatatgttagacctggctaagatcatcttcaaaagacaggagaccaaggaagcgcaactgtatgctgctcaggctcacctaaaattgggcgaggtatccgtcgaatccgaaaactatgtacaggctgttgaggagttccagtcttgcctgaatttacaagagcagtatctggaagcacacgaccgtctgctcgctgaaacccactaccagctcggcctcgcctatggatataacagccaatacgatgaagccgtcgcccaattctccaaaagcattgaggtcatcgagaataggatggctgtgctgaacgaacaagtcaaggaggccgaaggatccagcgcagaatataaaaaagagatcgaggaactgaaggagctcctgcccgagattagagagaaaatagaggatgccaaggagtcccagagaagtggaaacgtcgccgaactggccttgaaggcaacactggtggaatcatcaactagcggttttacacctggaggaggtggctcctcagtgagtatgatcgcctctcggaagcccactgacggcgcatcatccagcaattgtgttactgacatatctcaccttgtgagaaagaagcggaaaccggaagaggaatcaccccgcaaggatgacgccaagaaagccaagcaagagccagaggtgaacggaggtagtggcgacgctgtgccgtcaggcaacgaagtgagtgagaatatggaggaggaggctgagaaccaggcagaaagccgggccgctgttgagggcaccgtggaagccggcgccactgtcgagtctaccgcttgctag

SEQ ID NO: 12551 - DNA, 453 bp, Artificial Sequence
  Description of Artificial Sequence: Synthetic coding sequence
atgaggtcgtgctgcgtggtccaagctggtctgcagctgctcgcgagcagtgatcctccatcttctgccagtcaaagtgccaggatcacaggagtgaaccaccgtacccctccccgagagataaagtctaataaaactgttcttcacctggctgttcaggcagcaaaccccactctggtgcagttgctcctcgaactcccccggggggatctccggacatttgtaaacatgaaggcccatggaaatacggcactccacatggccgcagctctgccccccggcccggctcaggaggccatcgtaaggcacctcctggcggccggagctgatcctactctaagaaaccttgagaatgagcagcccgtgcatttgctaaggccgggcccaggtcccgaaggcctgcgccagctcctcaagcgatctcgggtcgcccctcctggtctgagctcatag

SEQ ID NO: 12552 - DNA, 1398 bp, Artificial Sequence
  Description of Artificial Sequence: Synthetic coding sequence
atgtgggtatgccttaggggcatcctggattcacaagccttctggcatgaaactctgagacggtgggagtgtctactggcagagatgaaggtctctcgcggcgaacggtcgcactgccctacccagacagtcaaaaagctgctagaggagcagcgtcgccgtcaacagcagcaaccggatgctggcggcgtgcaggggcaatttctccctccgcctgagcagccactgacccccagcgtgaatgaagcagtgactggccatccaccctttcctgcccacagcgaaacagtaggctccggacccagtagtcttggttttcctgattgggacccgaatacccatgcagcctacactgattccccgtattcatgccctgctagtgccgccgaaaactttctgcctcccgatttctaccctccaagcgaccccgggcagccctgtccgttcccccagggcatggaggccggcccatggagggtgagtgcacctccttccgggcctccacaatttcccgctgtggtgcctggcccctctttagaggtggctagggctcacatgctggcactggggccccagcagttattagctcaggacgaagaaggagacacactgttgcatctgttcgccgctagagggctccggtgggcagcgtacgccgctgcagaggtgctccaagtatacaggaggctggatattcgtgagcataagggcaaaactcccctgctggttgccgctgcagcaaaccagcctctgatcgtagaggacctgctcaaccttggtgccgagcccaacgcagcggaccatcaaggtagatcggtgttgcatgtagctgcgacgtacggtctgccaggagtcttgttggcagtgctgaacagtggcgtgcaggtcgatttggaagcgcgggattttgaaggcctgactccacttcataccgccatccttgcgctgaacgtcgctatgcgtccaagtgatctctgccctagagtcctttctacacaggccagggacaggctagactgcgtccacatgctcctacagatgggggctaaccatacaagccaggaaatcaagagcaacaagaccgtgctgcacttggccgtgcaggctgccaatccaacactggtgcaactcctcctcgagctaccccgaggcgatctgaggacattcgtcaatatgaaggcacacgggaatacggcccttcacatggcagccgctctgccgcctgggcctgctcaggaggctatagtaagacacctgctagcagcgggggccgacccgacgctccgtaacctggaaaatgagcagcccgttcatctgctgagacccggtccaggtcccgagggcctcagacaactattgaaaaggtcacgcgtggctccacccggcctttcttcttag

SEQ ID NO: 12553 - DNA, 942 bp, Artificial Sequence
  Description of Artificial Sequence: Synthetic coding sequence
atggaggccgggccttggagggtcagtgctccacctagcgggcctccgcaatttccggctgtggtgcctgggccgagcctagaggtcgcacgggcacacatgctcgctcttggaccccagcagctgctggcacaggacgaggagggagataccttattacatctgttcgctgcccgtggcttgcggtgggccgcttacgcagcagctgaggtactgcaggtgtatcggcggcttgacatcagagaacacaaaggtaagacgccccttctggtagctgccgctgctaatcagcctctgattgtagaagacttacttaatctcggtgctgaacccaacgcagccgaccaccagggacgcagcgtcttacatgtcgcagcgacgtatggcttacctggcgtgctgctggctgtgctgaattcaggcgtccaagtggatctcgaggcgcgagattttgagggcttgacaccgctgcatacagcgattttggcactgaacgtggccatgcgaccatcggacctttgccctagagttctgtctacccaagcacgggaccggctggattgtgtgcacatgctcttgcagatgggtgcgaaccacactagccaggaaatcaaaagtaataagaccgtgctgcatctggccgtgcaagccgccaatcccaccctggtgcagctactgctggaattgcccagaggtgacctgcgcacatttgtgaacatgaaagcccatggaaacacagccctgcatatggctgccgctctgcctccaggccctgcccaggaggcaattgtgcgacatctgctcgcagccggcgcggatcctacgcttcgcaacctggagaacgaacaacccgtgcacctcctgaggcctggaccaggccccgaaggccttaggcagctgttgaaacgctcacgcgtagccccgccaggtctctcctcttag

SEQ ID NO: 12554 - DNA, 543 bp, Artificial Sequence
  Description of Artificial Sequence: Synthetic coding sequence
atgagaccactcaccgaagaggagacacgcgtcatgttcgaaaagattgctaaatatattggtgagaacctccagctgttagtggaccgccctgacggcacctactgctttcgtctgcacaacgatcgcgtgtattacgtatccgagaagataatgaaactcgcagccaacatttccggagacaagcttgtgagtctggggacatgttttgggaagtttacaaagacccataaatttagattgcacgttaccgcattggactatcttgctccatacgcgaagtacaaagtttggattaaaccgggcgcggagcagtctttcttgtatgggaatcacgtcttaaaatcagggctcggtcgaattaccgagaatactagccagtatcagggcgtggtggtatactcaatggctgacattccactgggatttggagtcgctgctaaatccacccaggactgcaggaaggtcgaccccatggcaatcgtggtgtttcatcaggcagacatcggcgagtacgtgcggcacgaggaaaccctgacgtag

SEQ ID NO: 12555 - DNA, 402 bp, Artificial Sequence
  Description of Artificial Sequence: Synthetic coding sequence
atgaggccactgacagaggaagaaacccgcgtgatgttcgagaaaatcgccaaatacattggagaaaaccttcagctgcttgtggacaggccggatggaacgtactgtttccgccttcacaatgacagggtctactacgtctcagagaagatcatgaaacttgcggccaatatctccggagacaagctggtctcccttggcacatgctttggtaaattcaccaaaacacacaagtttcggctccacgttaccgccttggactatttggcaccctatgctaagggttttggcgtggctgccaaaagtactcaggactgcaggaaggtggatcctatggcaatagtagtctttcaccaggccgacatcggcgagtatgtcagacatgaagaaacccttacatag

SEQ ID NO: 12556 - DNA, 249 bp, Artificial Sequence
  Description of Artificial Sequence: Synthetic coding sequence
atggcgactttcccacctgccaccagtgcccctcagcagccacccggtcccgaagacgaagacagtagtcttgacgaatctgacctctactccctggctcacagttatcttggaggcggggggaggaaaggcagaacaaagagagaagcagccgctaatactaaccggcccagtccgggcggacatgagcgcaaactcgtgactaaactccagaattccgagaggaagaaacgaggcgcacgcagatag

SEQ ID NO: 12557 - DNA, 303 bp, Artificial Sequence
  Description of Artificial Sequence: Synthetic coding sequence
atggctacattcccgcccgcaacatctgccccccaacagcctcctggaccggaagacgaagactcttctttggacgagagtgatctttattccctggctcactcttacctgggcccactgataatgcctatgcccacgagtcccctgacccctgctctagtcacaggaggcggaggacgtaaagggcggacgaagagagaagcagccgctaacactaacaggccatcccccggcggacacgagcggaagcttgtgacaaaactgcagaacagtgagcggaaaaaacggggggctcggcgatag

SEQ ID NO: 12558 - DNA, 420 bp, Artificial Sequence
  Description of Artificial Sequence: Synthetic coding sequence
atgacacattccctagtttgtccagaaacagtatcccgggtcagctccgtcttgaacaggaatactcgccagttcgggaaaaagcacttgtttgaccaggatgaggaaacctgttggaactctgatcagggaccatcccagtgggtcacactggagttcccgcagctcatccgggtgtctcagctgcagattcaatttcagggtggattttccagcaggcggggatgccttgaaggctcacaggggacacaggccctgcataaaattgtcgatttctacccggaagataacaatagcctgcagacttttcctatccccgccgcggaggtcgacaggctgaaggtgactttcgaagatgcaactgacttttttggtagggtcgtaatttatcaccttagagttcttggagagaaagtgtag

SEQ ID NO: 12559 - DNA, 1740 bp, Artificial Sequence
  Description of Artificial Sequence: Synthetic coding sequence
atgaacactgctcccagcaggcctagccctacacgtcgcgacccttacggtttcggcgacagtagagattcgagaagagataggtctccgattagggggtcccctaggcgggagcctcgtgatggtcgtaatggcagagacgcccgggactctagagatatccgggatccaagggatctgcgcgaccaccgccacagcagagacttaagagatcatagagactctcggtctgtgagagatgtgcgggacgtgcgcgacttgcgtgacttccgggatctgcgcgactcccgcgatttccgcgaccaacgggaccccatgtacgatagatacagagatatgcgagactcgcgtgatccgatgtacaggagagaaggatcctacgaccgctatctgcgcatggacgattattgcagacgaaaggacgactcatattttgatcggtatcgggattcatttgatggtagaggtcctccagggcccgagtcccagtcacgagctaaagagcgcttgaaaagagaggagcggcgacgggaggaactgtatcgtcagtattttgaagagatccagcgcagatttgacgcagagcgtcccgtggattgctcagtaatagtcgttaacaagcagacaaaggactacgcagaatccgtgggaaggaaagtgcgggatcttggaatggtggtggacctcattttcttgaatacggaggtttcactgtctcaagccctggaggatgtaagtcgcggaggttccccctttgccattgtgatcacgcagcagcaccagattcacaggtcctgcacggtgaatatcatgttcgggacaccacaagaacacagaaacatgcctcaggccgatgctatggtcctcgtcgccaggaactacgagaggtataaaaacgagtgccgcgagaaggagcgcgaggaaattgctcgccaagcggcaaagatggcggatgaagcgatactgcaggagcgagagagaggggggcccgaggagggcgtgagagggggccatccccctgcgattcagtcactgatcaacctgcttgccgacaatcgatacttgacagccgaggagactgataaaatcattaattacttgagggaacgaaaggaacggctgatgcgtagctcaaccgacagcttgcccgggccgatttctaggcagcctctgggcgcaacatcaggagcctctctgaagactcaaccctcgtctcagcctttgcaatctgggcaggtgcttccttcagctacccccacccctagtgctccacccaccagccagcaggaattacaggccaagatcctctccctgttcaattcaggaactgtgaccgccaattcctccagcgcaagcccttcagtggccgccggtaatactcccaatcagaatttttccactgctgccaactcccagcctcagcagagatctcaggcttcaggaaaccagcccccttctattcttggccagggcggctctgcacagaatatggggcccaggcctggcgctccctcccaggggctctttggacagccctccagtcgactggcccctgcaagcaatatgacttcgcagcggccagtgagctcaactggaatcaactttgataatcccagcgttcaaaaagcactggatacactgatacaatcaggcccagccttgtctcatctggtgtctcaaacaactgcccaaatgggacagccacaagcccctatgggctcctaccagcggcactactag

SEQ ID NO: 12560 - DNA, 315 bp, Artificial Sequence
  Description of Artificial Sequence: Synthetic coding sequence
atgtacgataggtacagggacatgcgtgacagccgggacccaatgtatcggagggagggatcatacgatcggtacctgcggatggacgattactgtaggcgtaaggatgactcttatttcgatagataccgggattcttttgacggcagggggccaccaggacctgagtctcaatcccgggctaaggagcgtctgaaacgcgaagagcggcgccgtgaagaactttaccgacaatacttcgaagagattcagaggcggttcgacgccgagagacctgtcgattgttctgttatcgtcgtgaacaagcaaacttag

SEQ ID NO: 12561 - DNA, 1278 bp, Artificial Sequence
  Description of Artificial Sequence: Synthetic coding sequence
atgggcagtaagatgaacctgatcgagcattcacacttgcctacgaccgatgagtttagcttctcagagaatctatttggcgtgttaaccgagcaagtggccggccctcttggtcagaatctggaggtcgagccatactcccaatattccaacgtacagtttccccaagtgcagcctcaaatatcctccagttcatattatagcaacctcggtttttaccctcaacagcctgaggagtggtattcgcctggaatttatgagctaaggcgcatgcccgcagagaccctgtaccagggagaaaccgaagtcgccgagatgcccgtcaccaagaagccacgcatgggtgcctccgctggcaggatcaagggagatgagctgtgcgtggtttgcggtgatagggcctccggataccactataatgccttgacctgcgaaggctgcaaagggcttctgaccgagatacagtgcaagagcaaacgcctccggaagaacgtgaaacagcatgccgatcagaccgtgaatgaggactcagagggccgggaccttaggcaggtgaccagcacaaccaaaagttgcagggaaaagaccgaactcactcctgaccagcagacccttttacatttcataatggatagctacaacaaacagcgcatgccgcaagaaatcactaacaagattcttaaggaggaattctctgctgaagagaatttcctgatccttaccgaaatggccacgaatcatgtgcaggttctagtggaattcacaaaaaagctgcctgggtttcagaccctggatcacgaggaccaaatagctttgcttaagggatccgctgtggaagctatgtttctgcgcagcgcagagatctttaacaagaaactcccttccggtcattccgatctgctagaggaacgaatccggaactctggtatctcagacgagtatatcacccctatgttctcgttttataagagcatcggagagctgaagatgacccaggaggagtacgctctgctgacagccattgtgatcctttctcccgatcgccaatacatcaaagatcgcgaggcagtggagaaattacaggagccactgctggatgtgctgcagaagctctgcaagattcaccaacctgagaaccctcagcacttcgcgtgccttctgggtcgcctgacggaactgaggactttcaatcaccatcacgccgaaatgttaatgtcatggcgcgtgaatgatcacaagtttactcctctgctatgtgaaatctgggatgtgcaatag

SEQ ID NO: 12562 - DNA, 1740 bp, Artificial Sequence
  Description of Artificial Sequence: Synthetic coding sequence
atggaggtgaatgcgggcggggtgattgcttacatatcctcgtcatccagcgcgtccagtcccgccagctgtcacagcgaggggagtgaaaactcctttcaatcctcctccagttcagtgcccagctctcccaattcctcgaattcagacactaacggcaatccaaagaacggtgacttggctaacatcgagggaatccttaagaatgacaggatcgactgctccatgaagacatcgaagtcctctgctccaggcatgacgaagtcacacagtggtgtgacgaaatttagcggaatggttctcctttgtaaagtttgcggtgacgtcgcatccggctttcattacggcgttcatgcatgcgaaggatgtaagggctttttcaggaggtctatccagcagaacatccaatacaagaagtgcttgaagaacgagaactgctccattatgcgaatgaaccggaatagatgtcagcaatgtaggtttaagaagtgtctctcggtaggaatgagtagagatgccgtccggtttggacgtattcccaagagagaaaagcagagaatgctgatcgagatgcagtcagctatgaaaacaatgatgaactcgcaattcagtggccacctacaaaacgatactctggtggagcatcacgagcagacagcccttccggctcaggagcagttgcgccccaaaccccagttagagcaagaaaacattaagtcaagctcccccccctctagcgactttgccaaggaggaggtgatcggtatggtgacgagggctcataaggatacctttatgtacaaccaggaacagcaggaaaactccgccgaatctatgcagcctcagaggggggagcgtatccccaagaatatggagcaatataacttgaaccatgaccactgcggcaacggactgagttctcacttcccttgcagcgagtcccagcagcacctgaacgggcagttcaaaggacggaacattatgcactatccaaatggccacgcgatatgtatagcaaatggtcactgcatgaacttctctaatgcctatacccaacgcgtgtgtgacagggtaccaatcgatggctttagtcagaatgagaataagaactcttacctctgcaacactggtgggagaatgcatctcgtgtgtcctctgagtaagtctccctatgtcgacccacacaagtccgggcacgagatctgggaggagttctcaatgtcttttacgccagcggtaaaagaggttgtcgagtttgccaagcggatccctggattcagagacctatcgcagcatgaccaggtaaatctgctgaaggcaggcacatttgaagtgctcatggtgcggtttgcttccctttttgatgccaaagaaagaacagtgacatttctctccggaaagaagtactctgtggacgaccttcacagtatgggcgccggagacctgttgaattctatgtttgaattcagcgagaaactcaacgctctacagctttctgacgaggagatgtctctgttcaccgccgtggtcttggtgtctgccgatcgcagcggtatcgagaacgtcaatagtgtggaagctcttcaagagacacttatccgggcattgcggaccctgataatgaagaaccatccaaatgaggccagcatttttactaagttgcttctgaagctgcctgacttacgatcactgaacaacatgcatagcgaggaacttcttgccttcaaggtccatccatag

SEQ ID NO: 12563 - DNA, 1227 bp, Artificial Sequence
  Description of Artificial Sequence: Synthetic coding sequence
atggaagttaacgctggcggcgtcatcgcatacattagcagctccagcagcgcctcaagtcctgcctcttgccactcagaagggtctgaaaatagttttcaaagcagctccagcagtgtgccctcctcaccaaattcctcaaactccgacacgaatggaaacccaaaaaatggagatttggctaatattgaaggtattttgaagaatgataggatcgactgcagcatgaagaccagtaaatcgtcggcacctggaatgaccaagtcacattccggtgtcactaaattcagcggcatggtccttctttgcaaagtgtgtggggacgtggcgtccgggtttcattatggggtgcatgcctgtgaaggctgtaaggggttctttaggcgctccatacagcaaaatattcaatataagaaatgcttaaaaaacgagaactgttccatcatgagaatgaatcgaaatagatgccagcagtgcaggttcaaaaaatgcttgagcgtcgggatgtctcgcgacgcagtgcgattcggaagaattcccaagagagaaaagcagcgaatgctcatcgagatgcaaagcgcgatgaagaccatgatgaactcacagttcagtggacatttgcagaatgacacgctcgttgaacaccatgaacagacggccttacctgcccaggaacaattgcggcccaaaccccagctggagcaagagaacatcaagagcagttcccctccgtcctcggactttgccaaggaggaagtcattgggatggtgactcgggcacataaagatactttcatgtacaaccaagagcagcaggaaaattcggctgaatctatgcaacctcagcgcggcgagagaattccaaaaaatatggagcagtataacctgaatcacgaccactgcggcaacggcctgtcttctcattttccctgctctgagtcacagcagcatctcaatggtcaatttaaaggacgaaacatcatgcactaccccaatggacacgcaatctgtattgccaacgggcactgtatgaacttctccaatgcatatacgcaacgggtttgtgatagagtccccatcgacgggtttagccaaaatgagaataaaaattcttacctgtgtaataccgggggacgcatgcacttgtactctgtgcatattcagcccaagttccatcagaagcaacaataccacactatctcaagccttaaccacgaagttctttag

SEQ ID NO: 12564 - DNA, 1740 bp, Artificial Sequence
  Description of Artificial Sequence: Synthetic coding sequence
atggaggtcaacgctggaggcgtgatcgcttatataagctctagctctagcgcctccagtcccgcgagctgtcactcagagggaagcgaaaatagctttcagtcttcttcaagcagtgtgccctcttcaccaaacagtagcaactcagacacaaacggcaatcccaaaaatggggatctcgctaacattgagggcatcctcaagaatgataggatcgattgcagcatgaaaacatcaaagtcttccgccccagggatgaccaagtcccattcaggtgtgacgaaattctcaggcatggtgctcctctgcaaggtgtgtggggatgtcgcaagcggattccactacggggttcatgcttgcgaaggatgcaaaggtttttttagaaggagcattcaacagaacattcaatacaagaagtgcctaaagaacgagaactgtagtatcatgagaatgaacaggaacaggtgtcagcagtgcaggtttaaaaagtgcctgtcagtcggaatgagcagggatgctgttcgattcggtaggatcccaaagcgagagaagcaaaggatgttgatcgagatgcagtcagctatgaaaacaatgatgaatagccaattctctgggcatcttcaaaatgatacactggtggaacatcacgagcaaaccgctttgccagcccaggagcagctgcgtcctaaaccgcagcttgaacaggaaaatattaaatcttcaagtcccccctcatcggatttcgctaaagaagaggtcatcggcatggtcactagagctcataaggacacatttatgtacaatcaggagcagcaggagaacagcgccgagtcaatgcagccgcagcggggagagcgcattccaaagaacatggaacagtacaatcttaatcacgaccattgcggcaatggcttgtcatcccacttcccatgctccgaaagccagcagcatctgaacgggcaattcaagggcaggaatattatgcattatcccaacggacacgccatctgcattgctaatggacactgtatgaatttctccaatgcctacacccagcgcgtctgcgaccgagtcccaattgacggtttttctcaaaacgagaataagaatagttacttatgtaataccggcgggcggatgcatctggtctgtcctctgagtaaatccccctacgtagatccacacaagagtggccacgagatttgggaggagttctccatgagctttactccagctgtgaaagaggttgtggagttcgcaaagaggatccctgggttccgagatttgtcgcaacacgatcaagtaaatctgctgaaagcaggcaccttcgaggtgttgatggtgagatttgcctcgctgtttgatgctaaggagcggaccgtaacctttctttctggaaaaaagtactctgttgatgatcttcactcgatgggggccggcgatctgctcaatagtatgttcgaattctcggagaaactgaatgccctgcaactctctgatgaggaaatgtcattgttcaccgctgtggtgctcgttagcgccgacagaagcggcattgaaaacgtgaactcagtagaagctctgcaggaaaccctgatccgggctctacggactttaattatgaagaaccatccaaacgaggctagcatcttcaccaagttgcttcttaaattgccagatctgagaagcctgaataatatgcacagcgaggagctcttggcctttaaggtacacccatag

SEQ ID NO: 12565 - DNA, 1449 bp, Artificial Sequence
  Description of Artificial Sequence: Synthetic coding sequence
atggtcatgcagtttcaaggccttgaaaaccctatacagatctccccacattgcagctgcacaccgagtggtttcttcatggaaatgatgtctatgaaaccagccaaaggggtgctaaccgagcaagtcgccggtccccttggccagaatttggaggtcgaaccgtactcacaatactctaacgtgcagtttccccaggtgcagccacagatcagttcgagcagctactatagtaaccttggtttctatccgcagcaaccagaggagtggtacagtcctggaatatacgaattaagaagaatgcctgcggaaacactgtatcagggggaaaccgaggtcgctgaaatgccagtcaccaaaaagccccgtatgggtgcatctgcaggtcggattaaaggtgatgagctatgtgtcgtgtgcggcgatcgggcctctggctatcactacaacgctttgacatgtgaaggctgtaaaggtttctttagacgctctataaccaaaaatgccgtgtacaagtgtaaaaatggaggcaactgcgtgatggatatgtatatgcgccgcaaatgccaggagtgcaggcttcgcaaatgcaaggaaatgggaatgttagcggagtgcctcctcacggagatccagtgcaaatccaaaaggctgcggaagaatgtaaaacagcacgcagaccaaaccgtgaacgaggacagtgaggggagagatctgcgtcaggtgacatcaaccaccaaaagctgtcgcgagaaaaccgagttgaccccggaccagcagactttgctgcacttcatcatggattcatataataagcagagaatgccacaggagattaccaacaagattctgaaagaagaattttcagccgaggaaaactttttgatcttgacagagatggcgacaaaccatgtgcaggtgctggtcgagttcaccaaaaagctgcctggattccagaccctcgaccatgaagaccagatagccctcctgaagggctctgccgtagaagccatgtttctccggagcgcagaaatcttcaacaaaaagcttcccagtggccactcggacctcctggaggaaaggattaggaacagcggtattagtgatgagtacataaccccgatgttttcattctataagtccataggggaactcaagatgacacaggaggaatatgcccttctcactgcgatcgtaattcttagtcccgatcgtcagtacatcaaagatcgggaggccgttgaaaaactgcaggagcccctcctcgacgtgttgcagaagttgtgtaagatccaccagcccgagaacccccagcattttgcgtgcctgcttggtaggctgacagaactcaggacctttaaccatcatcatgctgagatgttaatgtcctggagagtgaacgatcataaatttacccctctcctatgtgaaatctgggatgtccagtag

SEQ ID NO: 12566 - DNA, 1431 bp, Artificial Sequence
  Description of Artificial Sequence: Synthetic coding sequence
atgggcagcaagatgaatctcattgaacattcccatctccctacaacagatgaatttagcttcagcgaaaacctcttcggagtcctgacagagcaggtcgccgggcctctaggacagaacctcgaggtggagccctacagtcagtacagcaacgtgcaatttccccaggtgcagcctcaaatttcatcgagttcctattacagtaacctcggtttctacccgcaacaaccagaggagtggtacagtcccggaatttatgagctgcgccgcatgccagctgaaaccttatatcagggcgaaactgaagttgccgagatgcccgtaacaaagaaaccccggatgggagcgagtgccgggcggatcaaaggcgatgaattgtgcgtggtttgtggggacagggccagtggatatcattataatgccctgacatgcgaaggatgtaaaggtttttttaggcggtccattacaaaaaatgctgtgtacaagtgtaaaaacggcggtaattgtgtgatggatatgtatatgagacggaagtgccaggaatgtaggctccgcaagtgcaaggaaatgggtatgttggccgagtgcatgtacactggtttgctcacggaaatacagtgtaaaagcaaaagactaaggaaaaatgttaagcagcacgctgatcagaccgtgaacgaggatagtgagggccgggatctcaggcaggtgacaagtacgaccaagagttgtcgggagaagaccgaactgacacccgatcaacaaacactgctccacttcatcatggacagttataacaagcaaagaatgccccaggaaattacgaacaagatcctgaaagaggaattttcagcagaagaaaactttctcatcctgacagaaatggctacgaatcacgtacaggtactggtggagtttacgaagaagctccccgggttccagacactcgaccacgaagatcagatcgccctgctgaagggctccgctgtggaggctatgttcttgcgtagcgccgaaatcttcaataaaaaattaccttctggccatagtgacttactcgaggaaaggataagaaactcagggattagcgatgaatacattactccaatgttctctttttataagagcattggcgagctgaagatgacacaggaagagtacgcgctgctgaccgcaatcgttatcctgtctccggatcgacagtacattaaggatcgcgaagctgtggaaaaactgcaggaacccctgttggacgttctccaaaagctttgcaagatccatcaacccgagaaccctcagcactttgcgtgtcttctgggaagattaaccgaattacgcaccttcaaccaccatcacgctgaaatgctgatgtcgtggcgggtgaacgatcacaaatttacacccttactatgcgagatttgggacgtgcagtag

SEQ ID NO: 12567 - DNA, 1419 bp, Artificial Sequence
  Description of Artificial Sequence: Synthetic coding sequence
atgggcagcaagatgaatttgattgaacattctcatttgcccacaacagatgagtttagtttcagcgagaacctgtttggtgtcctgaccgagcaagtagccggaccccttgggcagaatcttgaggttgagccctattcccaatatagtaatgtgcaatttcctcaagtgcagccacagataagcagctctagttactacagtaatcttgggttttatccccagcaaccagaggaatggtattcccccggtatctacgaactcagaagaatgccggcagaaacactctaccaaggggagaccgaagttgccgaaatgcctgtgactaagaaacccagaatgggtgctagcgcaggtcgtatcaagggcgatgagctttgtgtggtgtgtggagatcgtgccagcggctaccattacaatgcactgacctgtgagggctgcaagggattcttcagacggtccattactaagaatgctgtctataaatgtaagaacggaggtaactgtgtgatggatatgtacatgaggaggaagtgccaggagtgtagattgcgcaagtgcaaggaaatgggcatgctggcagagtgcctgctaactgagattcagtgcaagtctaaacgcctaagaaaaaacgtgaagcaacatgcagaccagaccgtaaacgaggacagcgaaggtcgggatctacgccaggtcacttcaacaactaagtcatgccgtgaaaagacagagctgacacctgatcagcaaaccctcctgcactttatcatggacagctataacaaacagagaatgccccaagagatcacaaataagattctgaaggaggaattctctgcagaggaaaatttcctgatcctgaccgaaatggctactaaccatgttcaagtgctcgttgaatttacgaagaaactccctggcttccagacactcgaccacgaagaccagattgcacttttgaagggatctgcagttgaagctatgttcctgcggtccgctgaaatattcaataaaaagctcccctctggacactccgacctgctagaggagagaattcggaattccggtatcagtgatgaatacattacgcctatgttctccttctacaagtctataggggaactgaagatgacacaggaagaatacgcgctgctgacagccattgtaatactctctccagaccgccagtacatcaaagatagggaagctgtcgagaaattgcaggaaccactgctggatgtgctccaaaagctctgcaagatacaccagccagaaaatccccaacatttcgcctgtcttttagggagacttacagaactgagaaccttcaatcatcatcatgccgagatgcttatgagttggcgcgtgaacgaccacaagtttactcctcttctgtgcgaaatatgggatgtgcagtag

SEQ ID NO: 12568 - DNA, 1461 bp, Artificial Sequence
  Description of Artificial Sequence: Synthetic coding sequence
atggtaatgcagtttcaggggctggaaaatcctatccaaatctctccacattgcagctgtacacccagtgggttcttcatggagatgatgtcaatgaagccggcaaagggagtattgacagagcaagtcgcaggacccttgggccaaaaccttgaagtggagccatactctcaatattctaacgtccagttcccccaggttcagcctcaaatcagtagttcctcatactatagtaacttgggattctatccacaacagccggaggagtggtacagtccaggtatctacgagctgcggcgtatgcccgccgagacgctataccagggcgaaaccgaggtggcagaaatgcctgtaacaaaaaagccccggatgggcgcttctgccggaaggatcaaaggtgatgaactgtgcgtggtgtgtggtgatagagcatccggctaccattataacgctctgacctgtgaagggtgcaaaggcttttttcgtaggtccatcaccaaaaatgcagtttacaagtgtaaaaacggcggtaattgcgtcatggacatgtatatgcgtcgcaaatgtcaggagtgtcgacttcggaaatgtaaagagatggggatgctcgcagagtgcatgtatacaggcctgcttaccgagattcagtgtaaatcaaagagattacgtaagaatgtgaaacaacacgcagatcagacggtgaacgaagacagtgagggccgggatcttagacaagttacgtctactactaaatcctgccgagagaagacggaactgacccctgatcagcagactcttctccactttataatggactcttacaataagcagagaatgccacaggagataaccaataagatccttaaagaggagttttctgccgaagagaacttccttatcctgacggaaatggctaccaatcacgttcaggtgctggtggagttcaccaagaagctaccaggattccagactttggaccatgaagaccagatcgccctgttgaagggaagcgcagtagaggccatgttcctcagaagtgccgaaatcttcaataaaaagctaccgtccggccatagcgacctcctggaggagaggatacgcaacagcggaattagtgatgagtacatcacccccatgttctctttttataaatcaatcggcgaattgaaaatgactcaagaagagtacgccctattgaccgccatagtcatactgagcccagatcgacagtacatcaaagaccgagaagcagtggagaaactgcaagagcccctactggatgtactccagaaattgtgcaaaatccaccagcccgagaatcctcagcactttgcttgcctattgggcagactgacagaactccgcaccttcaaccatcaccatgccgagatgttaatgtcatggagggtcaatgaccacaaattcacgccattgctttgtgagatctgggacgtgcaatag

SEQ ID NO: 12569 - DNA, 1074 bp, Artificial Sequence
  Description of Artificial Sequence: Synthetic coding sequence
atggcctcgagagaagacgaactgcggaactgtgtggtttgtggcgaccaggccaccggttaccacttcaacgctctgacctgtgagggatgtaagggatttttcaggaggacagtatctaaaagtatcggcccaacctgcccatttgcaggaagttgcgaagttagcaagactcagaggagacactgccccgcttgccgcctccagaaatgtctggacgcgggaatgcggaaggacatgattctgtctgccgaagctcttgctctgcgcagggctaagcaagcacaacggcgcgcgcagcaaacccccgtgcaattgtcaaaagagcaagaagagctaatccggaccctactgggagcccacacacgtcacatgggtactatgttcgagcagttcgtgcaattccgcccaccagcccacttgttcattcaccaccagccgttacccacactagccccggtgctgcctctggtgacccacttcgctgacatcaacacatttatggtgctgcaggtgataaagtttacaaaagacttgcccgtttttcggtccctccctatagaagatcagataagcctgctcaagggggccgccgttgaaatctgccacattgtactgaacaccaccttttgcctgcagacacaaaactttttgtgtggtccactgcggtacaccatagaggatggcgcaagggtttctcctacggtgggatttcaggtggagttcctcgagctgctcttccacttccacgggacattaaggaagctgcagcttcaggaaccagagtacgtccttctggcagctatggcattgttctcgccggccccatatctcactgaccgcccgggcgttacgcaaagggatgagatcgatcagctgcaagaggagatggccctcaccctccagtcttacataaaaggccagcaacgtcgcccaagagataggtttctgtacgctaaattgctcggacttcttgccgaactccgctccatcaacgaggcctatggttaccaaatccagcacatacagggtctgtccgctatgatgcccctgttgcaagaaatctgcagctag

SEQ ID NO: 12570 - DNA, 1074 bp, Artificial Sequence
  Description of Artificial Sequence: Synthetic coding sequence
atggccagtagggaagacgagttgcgcaattgcgttgtgtgtggggaccaggctactggctaccactttaacgccctgacgtgcgaaggctgcaaaggctttttccgccgaacagtgtccaagtcaatcggtcccacatgtccatttgcgggctcatgtgaggtcagcaagacccagcgccgccactgtcccgcgtgtcggctgcaaaaatgtcttgacgctgggatgcgtaaggacatgatcttgtccgctgaggcacttgccttgcgccgcgccaaacaggctcagcgacgcgcccagcagactcctgtccagttgagcaaggaacaggaggagctcataagaacccttttaggagctcacaccagacacatgggtacaatgttcgagcagttcgtgcaatttagaccaccggctcacctgtttatacatcaccaaccgttacctactttagctcccgtgctcccactggtcacacacttcgccgacattaacacattcatggtcctccaagtgattaagttcacgaaggatctgccggtattccgctctttaccaattgaagaccaaatctcactactgaagggcgccgccgtggagatatgtcacatcgtcctgaacacaacattctgtctgcaaacacagaatttcctctgtgggcccctgaggtacaccatagaagatggagctcgggtgagcccaacagtgggattccaggtggaattcttggaactgttgttccactttcatggaaccctccggaaactgcagctacaggagcccgagtacgtgctgttggccgctatggctttgtttagccccgcaccttacctgacggatcgcccaggtgttacacaaagggacgagattgaccagctgcaggaggagatggctttaactcttcagagttatattaaagggcagcagagacgccccagagaccgcttcctgtacgcgaagcttctcggcctcctcgctgaactccggagcattaatgaagcctacggatatcaaattcaacatattcaagggctttcagctatgatgccactgttgcaggagatttgctcatag

SEQ ID NO: 12571 - DNA, 975 bp, Artificial Sequence
  Description of Artificial Sequence: Synthetic coding sequence
atgctgccaaagcgatcgcgtagaactgtgtctaagagtatcggccccacatgcccatttgcaggatcctgcgaagtgtccaagactcaacggcgacactgtcctgcgtgcagattgcagaaatgtttagatgccggcatgcgcaaggacatgattctatccgcagaagctctagccttaaggagggcaaaacaggcgcaacgccgcgcacagcaaacacctgttcaactgtccaaggaacaggaggagctaatccgcacactgctgggggcccacactaggcacatgggaaccatgttcgagcagtttgtgcagtttcggcctcctgcccatttgtttatccaccaccaaccactccctacactggctccggtgctccctctcgtgacccactttgctgatattaacacgtttatggtcctacaggtcatcaaatttactaaggacctgcccgtgtttagatctctccccatagaggatcagatttcgctcttgaagggtgccgccgtcgagatctgccacatcgtgttgaacaccacgttctgtctccagacgcagaacttcctatgcggacccctgcgatatactatcgaagatggggccagagtcggttttcaggtcgaattcctagagctgttgtttcactttcacggaacacttcggaaactgcagctacaggaacccgagtatgttctactggccgcaatggccctgttcagccctgctccctatcttaccgataggccaggtgtgactcagagagatgagatagaccagttgcaagaagagatggcgctgactttgcagagttatattaagggtcaacagcgccgaccacgcgacagattcctttacgccaagcttctgggcctgctcgctgagctgcgcagcattaacgaagcctatgggtaccagattcagcatatccagggcctatccgcaatgatgcccctgctccaggagatttgctcttag

SEQ ID NO: 12572 - DNA, 1059 bp, Artificial Sequence
  Description of Artificial Sequence: Synthetic coding sequence
atggctagtcgcgaagacgaactcaggaactgcgtcgtgtgtggcgaccaggccaccggctatcactttaatgccctgacctgcgagggctgtaaaggcttctttagacggacagtgtcgaaatcaatcgggccgacatgcccattcgcaggcagctgtgaggtatcaaagactcaacgtagacactgtccagcatgcagactccagaagtgcttagacgctgggatgagaaaagacatgatcctgtctgctgaggccctggccctgcggcgggccaaacaagctcagcggcgagcccaacagaccccagttcagctgtcgaaggaacaggaagagctcattcgaacgctgttaggcgctcacactagacatatggggacaatgttcgaacagtttgttcagtttcggccgcctgcccacctctttatacaccatcaacctttacctaccctcgcgccagtcttaccactagtcactcattttgctgacattaatacctttatggtgttacaggtcataaaatttaccaaggacttgccagtctttcgttcactccccatcgaagatcagattagtcttctgaagggcgccgccgtggaaatttgccatattgttttgaacaccactttttgtcttcagacccagaactttctttgcggccccctacggtacaccatagaggacggagcgcgggtgtctcccactgtgggcttccaggttgaatttctggagttgctcttccatttccatggtacgcttaggaagctacagttgcaagaaccggagtatgttttacttgcagcaatggccctgtttagcccagatagaccaggagtgacacagcgcgacgaaattgaccagctgcaggaagagatggcactgacactccagtcttatataaagggacagcagagaaggcccagagaccgcttcttgtacgcaaagctgttgggcctgctggccgaacttaggagtatcaatgaggcttacggataccaaatccaacatattcagggcctgagtgccatgatgccactgctgcaagaaatctgcagctag

SEQ ID NO: 12573 - DNA, 1047 bp, Artificial Sequence
  Description of Artificial Sequence: Synthetic coding sequence
atggcctcccgcgaggatgagcttcgcaattgtgtcgtgtgtggcgatcaggctaccggatatcattttaacgcactgacctgtgaaggttgtaaaggcttcttcaggcgaaccgtaagcaaatctatagggccaacttgtccattcgcaggcagttgcgaagtttcaaaaacccagcgccgacactgtcccgcctgccgcctgcagaaatgtctggacgccggcatgcgaaaggatatgattctgagtgcagaggctctagcactgcggcgggctaaacaagcacaacgcagagcccagcagacccccgtgcagttgtccaaagagcaggaagagctgattcggacactgcttggcgctcatactcggcacatgggaacaatgttcgaacagttcgtgcagttcaggcctcccgcacacttattcattcaccatcagcctttaccaactctggcccccgtgttgcctctggttacacattttgcagatatcaacacttttatggtcctccaggtgattaaattcaccaaggatctcccggtttttagatctttgccgattgaggaccagatttcattactcaagggcgcagccgtggagatttgtcatatcgttttgaacaccaccttctgtctccagacccagaatttcctctgtggaccactgcggtacacaatcgaagacggggcgcgggtagggtttcaggtggagttcctcgagctgctatttcactttcatgggactctgcgcaagctgcagctacaagaacctgagtacgtccttttggcagctatggcacttttctcacccgacaggccgggcgtcacccaaagagatgagatcgatcaactccaagaagagatggctctgacattgcagtcctacatcaaagggcagcagcggcgcccgcgggaccggttcctctatgccaaactgctcggcctactggccgagctgagatcaattaatgaggcctacggttatcagatccagcacatccaaggtctcagcgccatgatgcccctcctccaagaaatttgtagctag

SEQ ID NO: 12574 - DNA, 930 bp, Artificial Sequence
  Description of Artificial Sequence: Synthetic coding sequence
atggctagtcgtgaggacgagctccgtaactgcgtggtttgtggtgaccaggccaccggatatcatttcaatgcactgacctgtgaggggtgcaaagggtttttccggaggacggtgtctaagtcaatcggcccgacgtgtccattcgctggcagttgtgaggtaagcaaaacacagcggcggcactgcccagcctgccggcttcagaagtgtttagatgctgggatgaggaaagatatgattctgtcagccgaggccctcgctctccgtcgtgccaaacaggcgcagcggagagcccagcaaacacctgttcaactgtctaaagagcaggaagagctgatccggactcttctgggggcacatactaggcacatgggaacaatgttcgaacagtttgtacagttcaggcctcctgcccatctgtttattcatcaccagcccctccccacattggcacccgtgctgcccctggtcacacatttcgccgacatcaacacctttatggttctgcaagtgatcaagttcacaaaagacctgccggtgttccgcagcttacccatcgaggatcagattagcctgctcaaaggggctgccgttgagatatgccacatagtgctgaacaccaccttttgccttcagactcagaacttcctgtgtggtcctttgcgctacaccatcgaggatggagctagggatcgacccggagtaacccagcgggacgagattgatcaactacaggaagagatggcattgactctacagtcttatatcaagggacagcaacggcgccctcgagatcggttcctatatgctaagctgttaggcctgttggctgagctcagaagcataaacgaggcatacggctaccagattcagcacatccagggcttgtcggctatgatgcccctcctccaagagatatgttcatag

SEQ ID NO: 12575 - DNA, 945 bp, Artificial Sequence
  Description of Artificial Sequence: Synthetic coding sequence
atggctagcagagaggatgagctgcgcaactgtgtggtttgcggagatcaagcaaccggatatcactttaatgcattaacctgcgagggctgcaagggattctttcggaggacagtgtctaagagcatcggcccaacctgccccttcgcgggctcatgcgaggttagcaaaacccagcgccgacattgccctgcctgtcgcctgcagaagtgcttagacgcaggtatgcgtaaggacatgattctgagcgctgaagctctcgctcttcgtagagctaaacaagctcaacggcgagcccagcaaacccccgtgcagctgagtaaggagcaggaagaacttatccggacactgcttggagcacacaccaggcatatgggaaccatgttcgagcaatttgtccagtttcggccacctgcccacctcttcatccaccaccagcctttgcctacattagctccagtgctgcctcttgtaacccactttgcagatatcaatacatttatggttctgcaagtgattaaatttactaaggatcttcccgtcttccgcagtctgcctatcgaggatcaaattagcttgctgaagggcgcagccgtggaaatatgtcacatagtgttgaacaccacattttgtctgcagactcagaattttctgtgcggtcctcttcggtatactatcgaggatggcgctagggccccctatctgacggaccgccccggagtgacccagcgggacgaaattgatcagttgcaggaggagatggcgcttaccctgcagtcctacataaaaggacagcagcgacgcccgcgagatcgctttctatacgccaaacttcttgggttactggccgagctgcgcagtattaatgaagcctatggctatcagattcagcatattcagggcctgagcgccatgatgccgctactgcaagagatttgttcatag

SEQ ID NO: 12576 - DNA, 948 bp, Artificial Sequence
  Description of Artificial Sequence: Synthetic coding sequence
atgctgcccaagcgatcccgaaggaccgtgtccaaatctatcggacccacttgcccctttgccggcagctgcgaagtgtctaagacgcaacgccggcattgccctgcatgcagactgcagaagtgccttgatgctggcatgcgcaaggatatgattctttcagctgaagcactagctcttagacgcgcaaaacaggcacagagacgggcacagcagacccctgtgcagttgtccaaagaacaagaggaactcatacgaactttgctaggtgcacatactcgccacatgggtacaatgttcgagcagttcgtgcagtttcggccccctgctcatctgtttatccaccaccagcctctgcctacactggccccagttctgcctcttgtgacccatttcgcagacatcaataccttcatggttttgcaggtgatcaagtttaccaaagatttgcccgtcttccgtagcttgccaatagaggaccaaatttctttgctcaagggagcagcagtggagatctgccacatcgtgctgaacactaccttctgcctccagacccagaacttcctgtgcggccctctgcggtacacaattgaagatggcgcccgcgtttcgccgacagtggggttccaggtagagttcctcgaattgctgtttcattttcatggaacactgcgcaaactgcagttacaggagcccgaatacgtcctgctggctgctatggcattgttttctcccgccccctacctcactgaccggccgggtgtgacacaaagagacgaaattgatcagctacaggaagaaatggcactaactttacaatcctacattaaggggcaacagagacgtccacgagaccggagccctggcaccccgtggattcactggtctggaaagatgctggggcccaaaatcgggccagggagtaaaggcgcacagtggctgcagtag

SEQ ID NO: 12577 - DNA, 1023 bp, Artificial Sequence
  Description of Artificial Sequence: Synthetic coding sequence
atggctagcagggaggatgagctgagaaattgcgtggtctgcggagatcaggccaccggctaccacttcaatgcgcttacttgtgaagggtgcaagggattcttccggcggaccgttagtaagtcaataggccctacttgcccctttgccgggtcatgtgaagttagcaagacccagcgcaggcattgtcccgcatgccgactgcaaaagtgcctggatgctggtatgcgcaaagacatgatcctgtctgccgaggcgttggccctccgaagagctaaacaggcccagaggcgggcccagcaaacccctgttcagctttcaaaagaacaggaagaactaatcaggacactgttaggggcccacactcgacacatgggcaccatgttcgagcagtttgtccagtttcggccccctgctcacctgttcatccaccatcagccactccccacactcgcacctgtgttaccgctcgtgacccactttgccgacatcaataccttcatggtcttacaggtgattaaattcactaaggacctacccgtctttagaagtctgcccatagaggaccaaatcagcctgctgaaaggcgcagcggtcgagatctgtcacatagtcctaaatacgacattttgcttgcaaactcaaaatttcctttgtggtccactcagatacactattgaggacggagcgcgcgtgggcttccaggtagaatttctagagctgctattccactttcacggaaccctacggaagctgcaattacaagaacccgaatatgtactgctggccgctatggccttgttctcccccgccccttacctgacagatcgtccaggagtcactcagagagatgagattgatcagcttcaagaagagatggccctcacactgcagtcatatattaaaggacagcagcgtaggcctagggacaggtctcctgggaccccgtggatccattggtccggtaaaatgctggggcctaagataggcccgggttctaagggtgcccagtggctgcagtag

SEQ ID NO: 12578 - DNA, 921 bp, Artificial Sequence
  Description of Artificial Sequence: Synthetic coding sequence
atgttgcccaaacgttccagacggacagtttccaagtctattggcccaacttgcccttttgcagggtcctgcgaagttagtaaaacccagagacgccattgccccgcctgtaggttgcagaagtgtcttgacgccggaatgagaaaagatatgattctgagtgccgaggcattagccctgaggcgggcaaaacaggcgcagaggcgggcgcaacagactccggttcaactgtctaaggagcaggaggagctgattcgaactcttctgggagcgcacacgagacacatggggaccatgttcgaacagttcgtccagtttaggccaccagcacatctattcatacatcaccagccattacctaccctggcgccagtgcttccattggtcacacacttcgcggatattaacacgttcatggttctgcaggtgattaagttcacgaaagatctgcctgtgttcagatctttaccgatcgaggatcagattagcctcctcaaaggtgctgccgtagaaatatgccatatcgtcctgaatactactttttgcctccagactcagaattttctgtgcggcccactccgctacacaatcgaagacggcgcaagggtaggttttcaagttgagttcctagaactgctgttccattttcacggcacactccggaaactacagctccaggaaccagagtatgtgctcttggccgccatggccctgttttctcccgatcgccccggcgtgactcagagggatgaaatcgaccaactgcaggaagagatggctcttactctgcaaagctacatcaaaggccagcagagaaggcccagagaccgtagcccagggacaccttggatccactggtctgggaagatgttgggccccaagatcgggcccggctctaaaggcgcgcaatggctgcagtag

SEQ ID NO: 12579 - DNA, 1020 bp, Artificial Sequence
  Description of Artificial Sequence: Synthetic coding sequence
atggctagtagggaagatgaactgcggaattgcgttgtgtgtggtgaccaggcaacaggttatcacttcaacgcactaacctgcgagggctgcaaagggttctttcgccgcaccgtctcgaaaagcattggtccaacatgtcctttcgccggttcctgtgaagtatccaagactcaacggaggcactgccctgcctgtagactgcagaaatgtctggatgcaggaatgagaaaagacatgattctaagcgccgaagcactggcccttcgcagggccaaacaggcccaaagacgagcgcagcagactccagtgcagttgtccaaggaacaagaggaattgatcagaactctgcttggcgcgcacaccagacatatgggtaccatgttcgagcagttcgttcagttccggccacccgctcacctatttatccaccaccagccgttgcccaccctggctccggtgctccccctggtaacccattttgccgacattaacaccttcatggttctccaggtaattaagtttacaaaagatctcccagtattccgatctttgccaatcgaggaccagatcagcttactgaagggggcagccgtggagatctgccatattgttctgaacactacgttctgcttgcaaacgcagaatttcctttgtgggcccctgcgatacactatcgaagacggcgcccgggtgagccctacagttgggtttcaggtagagttcctggagctgctatttcacttccatggcactctcaggaaattgcagctccaggaacccgaatatgtgctcttggcggcgatggccctgttctcacctgataggcccggggtcacacaacgggatgagatcgatcagctgcaagaggagatggctctcactctgcagtcctatatcaaaggccagcagagaagaccacgcgatcgcagcccaggaacaccatggattcattggtctgggaaaatgctgggccccaagatcgggcctggaagcaagggcgcccagtggttacagtag

SEQ ID NO: 12580 - DNA, 360 bp, Artificial Sequence
  Description of Artificial Sequence: Synthetic coding sequence
atggccagccgtgaggatgagctccgtaattgtgtagtgtgcggagaccaagccactggctaccattttaacgctctgacttgtgaagggtgtaaagggtttttcagaagaactgtgtctaaatcgatcgggcccacatgcccctttgcagggtcgtgtgaggtatccaagacccagcggcggcactgcccagcctgtagacttcagaaatgtttggatgcaggaatgcgcaaggatacctcctcatcatctgtccatcctagtcctgctttggcccaccccgggccctgcgctgcctctgggcacacacttagacgtcatcagcactttcacgggacagcttctcaccaggtgtattag

SEQ ID NO: 12581 - DNA, 444 bp, Artificial Sequence
  Description of Artificial Sequence: Synthetic coding sequence
atggcctccagagaagatgagttaaggaactgcgtggtatgcggggaccaggcgacaggatatcattttaacgcactgacatgcgagggatgtaaaggtttttttcgaagaacagtctcaaagtccataggccctacttgtccatttgccgggtcatgcgaagtgtccaagactcagaggcgacactgccccgcttgccggctgcaaaagtgcttagacgcgggaatgaggaaagatattccctgccctctgaaaactaggtcaccattttctagggaacagctttggaagtccgtgacgagttattcgatccctctgtcagtgagcaaacacaaaacctctagcgcgggtcttttcgctacacagctgaaaatggagcccgtcactgatctggaactccctcgggagatgcgcctaatctcctgcaagcgacggtggcactag

SEQ ID NO: 12582 - DNA, 843 bp, Artificial Sequence
  Description of Artificial Sequence: Synthetic coding sequence
atgctgcccaaaaggtcccggcgtaccgtgtcaaaatctatagggcccacctgtccattcgcaggcagctgcgaagtgagtaagactcaacgacgtcactgtcctgcatgccgattacagaagtgcctcgacgcaggaatgcggaaggacatgatcctgagtgccgaggctctcgctttacgcagagccaagcaagcccagagaagggcgcagcagaccccagtgcagctgtccaaggagcaagaggaattgatcaggacactacttggcgctcatacccgccacatgggcaccatgtttgagcagttcgtgcagtttaggccgccggctcacttattcattcatcaccagcctttgcccacgctggcacccgttttgcccctggttactcatttcgctgacataaatacattcatggttcttcaggtaattaagttcactaaagacctccccgtgttccggtccctgccaatcgaggatcagatttctttgcttaagggcgctgcagttgagatctgtcatatcgttttaaatactacgttctgcctccaaacccagaacttcctgtgcgggccactgcggtacacaattgaggatggtgcacgagatcgccccggtgtgacgcagcgggatgagatcgatcagctgcaggaggaaatggctctgacacttcaatcctacattaaggggcagcagagaagaccgagagatcggttcctgtatgcaaagctcctcgggctgttagctgagctgagaagtatcaatgaggcctacggctatcagatacagcatattcagggattatcagcaatgatgccgttacttcaggagatttgttcctag

SEQ ID NO: 12583 - DNA, 891 bp, Artificial Sequence
  Description of Artificial Sequence: Synthetic coding sequence
atggcttcacgagaggacgagctgcggaactgcgtggtgtgtggagaccaagccaccggataccatttcaacgctcttacttgcgagggatgcaaaggcttctttcgtaggacagttagcaagtctattggaccgacatgtccattcgcaggatcatgcgaggtgtcaaagacccagcggcgccattgtccagcatgccgcctccagaagtgtttggacgctggcatgcgaaaagatatgatcttatccgccgaggccttagctctaaggcgcgcaaagcaggctcagagacgggcacagcaaaccccggtgcagctgagcaaggagcaggaagaattaattaggacactcttgggcgcccatacaaggcatatgggcacaatgtttgaacagttcgtgcaattccgccccccagcccacctctttatccaccatcagccactaccaactcttgcccccgtgctcccgcttgtcacgcacttcgcagatatcaacactttcatggtgctgcaggttatcaaatttaccaaagacctgccagtgttccgaagcctgcctattgaagaccagatctcgctcctgaagggtgctgccgtggaaatctgccacatcgtcctgaatactaccttctgcttgcagactcagaacttcctttgcggccctttacggtatacaatcgaagacggcgccagggaccgtcccggagtgactcagcgtgacgaaatcgatcaactgcaggaagagatggcacttaccttgcaaagctacatcaaaggccaacaaagacgcccgcgagaccgaagtccagggactccatggatccattggtctggcaagatgctggggccaaaaattgggcccggctctaagggggcacagtggctgcagtag

SEQ ID NO: 12584 - DNA, 825 bp, Artificial Sequence
  Description of Artificial Sequence: Synthetic coding sequence
atgcttccaaaacgtagcagaagaacagtatctaaatcgataggccccacgtgtcccttcgcggggagttgcgaggtaagcaaaacgcagcgccgccactgcccagcttgccggctgcagaagtgcctcgatgcgggcatgcgcaaagatatgattttaagcgccgaggctctggccctaagaagggccaagcaggctcagagacgagctcaacaaactcccgtacagctgtctaaggagcaggaggaactcatcaggaccctgttgggggctcatactcggcatatgggtacaatgttcgaacagtttgtacagtttcgacctcctgcccacctgttcattcatcaccaacctctgccaacactggcccccgttctgcccctggtcacacattttgccgatataaacacattcatggtactgcaggtaatcaagttcaccaaagacctgcccgtctttagatcccttccaattgaggatcaaataagtctgcttaagggtgcagcagtggaaatctgtcatattgtgttgaacacaaccttttgcctgcagacgcaaaattttctgtgtggccccctccggtacactatcgaggatggggcccgtgtgtcccccacagtgggctttcaagtggagttcctggagctacttttccattttcacggaacactgaggaaactccagctgcaggaaccggaatatgtccttctggcggctatggccctcttcagtccaggagagcacttgcccaaaccaagagcattttgctgcaccacaagtgcccagatactgagctcccttagcccctctacacaggcattctag

SEQ ID NO: 12585 - DNA, 273 bp, Artificial Sequence
  Description of Artificial Sequence: Synthetic coding sequence
atgctaccaaaacggtcccggcgtaccgtgtccaaatcgatcgggcctacctgtccctttgccggctcttgtgaggtctcaaaaactcagcggcgtcactgtcccgcctgccggctccaaaagtgtctggatgcgggaatgcggaaggataccagctcctcgtctgtccatccctctccagcactcgcccacccaggtccttgtgccgcttccggccatacattgagaagacatcagcacttccacggcactgcatcacaccaggtttattag

SEQ ID NO: 12586 - DNA, 357 bp, Artificial Sequence
  Description of Artificial Sequence: Synthetic coding sequence
atgctgcccaagcgttctaggcgcaccgtgtctaaaagcataggccctacttgtccattcgctggctcctgtgaggtaagcaaaacacagcggcgacactgccccgcatgtcgactgcagaaatgcctggatgcagggatgaggaaagacatcccttgtcccctaaaaactagatcgccctttagccgcgagcagttatggaaaagcgttacttcctactccatcccgctctccgtctccaagcacaaaacatccagtgccggattattcgcaacgcagcttaaaatggagcctgtaactgatctggaactgcctcgagagatgaggctgatttcctgcaagcggcggtggcactag

SEQ ID NO: 12587 - DNA, 936 bp, Artificial Sequence
  Description of Artificial Sequence: Synthetic coding sequence
atgcttcctaagagaagccgacgcaccgtaagcaagagcatcggacctacctgtccctttgcagggtcctgtgaagtctccaaaacacaacggcgccattgcccagcgtgccgcttgcagaagtgcctggacgcgggaatgcgcaaagacatgatactgtctgcagaggctctcgccctgcgtcgggctaaacaggctcagcggagggcacagcagacccccgtgcagctgtccaaggagcaagaggagcttattaggactctgttaggcgctcacactcggcacatgggaacaatgttcgaacaattcgttcagttcagacctcccgcacacctctttattcatcaccaaccattgccgaccctcgctccagtgcttccgcttgttacacacttcgctgacattaacacctttatggtgcttcaggtgatcaagttcactaaagatctccccgttttccggagtctaccaatcgaggatcagatatccttactaaaaggtgccgccgttgaaatttgtcatattgtgctgaacacaaccttttgcctccaaacccagaacttcctctgcgggccactaaggtacaccatcgaggatggcgccagggtcgggtttcaggtggaattcctggaactcttgtttcactttcacgggacactgcgcaagctgcagttgcaggagcccgagtatgtgttgctcgcagctatggcactgttcagccccgcaccctatttaaccgatcggccgggagtgacacaacgcgatgaaatcgaccagctgcaggaggaaatggccctgacactccagtcttacataaagggtcagcagaggagacctcgtgatcgctcccctggaacgccgtggatccactggagtgggaagatgctgggacccaagataggaccgggtagcaagggtgcacagtggctgcagtag

SEQ ID NO: 12588 - DNA, 273 bp, Artificial Sequence
  Description of Artificial Sequence: Synthetic coding sequence
atgctgccaaagcgctcgcgcagaaccgtgtccaaaagcatcggtcccacatgtccctttgccggatcttgcgaagtcagtaagactcagcgacgacattgccctgcgtgcagactgcaaaagtgtctggatgcaggcatgaggaaggatacttccagctcatcagtgcatccatcccctgcactggcccaccctggtccgtgtgccgcctctggacacactttacgaagacaccagcactttcatggaacggcttcccatcaagtatactag

SEQ ID NO: 12589 - DNA, 960 bp, Artificial Sequence
  Description of Artificial Sequence: Synthetic coding sequence
atgctccctaagaggagccggcggactgtgtctaaaagcattggccctacgtgtccgttcgccggatcctgcgaagtgtcgaaaactcaaagaagacactgcccggcttgtcgacttcagaaatgtttggatgctggtatgcggaaagatatgatcctgagcgcagaagccctcgctcttaggagagcgaagcaggcccagcgacgcgctcagcaaactccagttcaactgtccaaagagcaggaggaattgattcggacgctcttgggcgctcacaccaggcatatggggacaatgtttgaacagtttgtccaatttcgccctccagcgcacctcttcatccaccatcagcctctcccgactctggcgccggtgttacctctggtgacacactttgcagacattaatacctttatggttcttcaggttatcaagtttaccaaagacttacccgtcttcaggagcctgcccatagaggaccaaatttctctactgaaaggggccgctgtcgagatctgccacattgttctcaatactaccttctgtttgcagactcaaaactttttgtgcgggcctttgcggtatactatagaagacggggctagagttggcttccaggtggagttcctcgaactcctgtttcattttcacggtaccctgagaaaactccagctgcaggagcccgagtacgtcttgctggcagccatggccttgttcagccccgaccgtccaggcgtcactcagcgcgacgaaatcgaccagctgcaagaagagatggcactcactttgcagtcttacataaagggccagcagcgacgacctagggacaggtttctttacgctaagttattgggtttgctggccgagctccggtcaattaatgaagcctacggctatcaaatacagcatatccagggcttaagcgcgatgatgcccttgctgcaagagatttgtagctag

SEQ ID NO: 12590 - DNA, 357 bp, Artificial Sequence
  Description of Artificial Sequence: Synthetic coding sequence
atgttgccaaaacgatcacggaggaccgttagtaagtctattggcccaacctgccccttcgccgggtcatgcgaggtctcaaaaacccagcgacggcattgcccagcgtgccggttacagaaatgtctggacgccggcatgcggaaggatatcccatgtccgctcaaaacgaggagcccattctcacgggagcagttgtggaaaagcgtgaccagctacagcattccactctccgtcagtaagcacaaaacttcctctgccggtctgttcgccacccagctgaaaatggaacctgtcaccgatcttgagctgccccgcgagatgaggcttatatcttgcaagagacgctggcactag

SEQ ID NO: 12591 - DNA, 444 bp, Artificial Sequence
  Description of Artificial Sequence: Synthetic coding sequence
atggcctcgcgagaagacgaattacggaattgcgtcgtttgcggtgaccaagctaccggatatcattttaacgcgttgacttgcgagggatgtaagggattcttccgacgcacagtgtctaaaagcattggaccaacctgcccttttgccggcagctgtgaggtttcaaagactcaaaggaggcactgcccggcctgcagactgcagaaatgcctcgatgcaggcatgaggaaagacatcccctgtccactgaaaacaaggagccctttttctagggaacagttgtggaagtctgtgacctcctacagcatcccgctgtctgtctctaagcataagacctcaagcgctggcctatttgcaactcagctgaagatggaaccagttacagaccttgagctgccaagggaaatgaggttgatctcatgtaagaggaggtggcactag

SEQ ID NO: 12592 - DNA, 273 bp, Artificial Sequence
  Description of Artificial Sequence: Synthetic coding sequence
atgcttcctaaacgttcccgcagaaccgtttccaaatcgataggaccgacttgtccctttgcaggcagctgtgaagtgtctaagactcaaaggcgacactgccctgcatgtaggctgcaaaaatgcctggacgcgggtatgaggaaagatacttctagttcctctgtgcatcctagccctgctcttgcacacccaggcccttgcgcggcatccggccacacccttaggaggcatcagcattttcatggcaccgcaagtcaccaagtatactag

SEQ ID NO: 12593 - DNA, 804 bp, Artificial Sequence
  Description of Artificial Sequence: Synthetic coding sequence
atgttacctaaacgcagtagaagaacggtgagcaagtcgattggtcccacatgcccgtttgccgggtcatgtgaggtgtccaaaacacagagacgacactgccccgcctgtcgactccagaagtgtttagatgctggcatgaggaaagacatgatcctctctgccgaggccttggccctccgccgggccaagcaggcacaacggcgcgcgcagcagaccccagtacagctttcaaaggaacaggaggaactaatccggaccttgctgggagcccacacaaggcacatgggcacaatgtttgagcagttcgtgcagttcaggccccctgcgcacttatttattcatcaccagccactgccaacgctcgccccagtgttgcccttggttactcactttgctgatattaacaccttcatggtactacaggtcataaagtttaccaaggatctgccggtattcagatcactgcccatcgaagatcagatctcccttttgaaaggcgccgccgtggaaatctgtcacatagttctgaacaccactttttgcctgcagacacagaatttcctgtgcggtcctttacgttataccatcgaagacggcgcgcgggaccggcctggcgtgacgcagcgggacgaaatcgatcagctccaagaggaaatggcactgacactgcaatcttacatcaaggggcagcagcgtagacctcgtgacagatcccctggtaccccatggattcactggtctggcaaaatgctgggtcccaaaatcgggcctggatcgaagggtgctcagtggttgcaatag

SEQ ID NO: 12594 - DNA, 717 bp, Artificial Sequence
  Description of Artificial Sequence: Synthetic coding sequence
atggcctctagggaggacgaactgagaaactgtgtagtgtgcggagatcaagctaccggctaccactttaacgcactcacatgcgaaggatgtaagggcttttttagacggactgtctccaagagcatcggtcccacctgtcctttcgctgggtcctgtgaggtgagtaagacccagagaagacactgtcctgcctgtcggctgcagaagtgcctggacgcgggcatgcggaaggatatgattctgtcagccgaggccctggcgctgcgccgggcaaaacaggcccagagacgggctcagcagacaccagtgcagctgtccaaggaacaagaggaattaattaggaccctgctgggagcgcacaccaggcacatgggcacaatgtttgagcaatttgtacagttcaggccaccagcccacttgttcatacatcaccaacctcttcccacgctggcaccggttctgcccctggtgacacactttgccgatattaacacctttatggtgctgcaggtgatcaagttcacaaaggatctaccagtgttccgctctctccccatagaggatcagatcagcctgctgaaaggggccgccgtggaaatctgtcatatcgtgctcaataccacgttctgtcttcagacacagaacttcctgtgtggtccgctgagatacacaatcgaagatggagctcgcggggagatggtcctcgagcagtag

SEQ ID NO: 12595 - DNA, 1452 bp, Artificial Sequence
  Description of Artificial Sequence: Synthetic coding sequence
atggcaactattgaggagatcgcacatcagatcatagagcagcagatgggagagatcgttacagagcagcagacagggcagaagatccagattgtgacggctttggatcacaacacgcagggtaaacaatttattttgaccaaccacgacgggagcacaccgtcaaaggtcattcttgcaaggcaggattctaccccaggtaaggtatttcttactacccctgatgccgccggagtgaatcaactgtttttcacaaccccagacctttccgcccagcacctgcagttgctgacggataatagccccgatcagggtccaaataaggtcttcgatctttgtgtagtatgcggtgacaaagcctccggccgccactatggagccgtgacttgtgagggatgcaagggtttcttcaagcgtagtatccggaagaatctcgtctactcatgtaggggcagcaaagactgcataatcaacaagcatcaccgaaatcgttgtcaatactgccgcctgcagcgctgtatcgcattcggtatgaagcaggatagtgtgcagtgcgaaagaaagcctattgaggtctctagggaaaaatcctcaaattgtgcagcatcgacggagaaaatttatataagaaaagatctgaggtctcccctgacggcgactccgaccttcgttaccgatagcgaaagcaccagatctaccggacttctcgacagcggcatgttcatgaatatccacccaagtggcgtcaaaaccgagtccgccgtgctaatgacaagcgacaaagctgaaagttgccagggagacctttcaaccctggccaatgtggtgacatctctcgccaacctggggaaaactaaggacttgtctcagaattccaacgaaatgtcaatgattgaatcgttgagtaacgatgacactagcctgtgtgaatttcaagaaatgcagaccaacggcgacgtgtccagggctttcgacacactggccaaagcattgaatccaggagaatccactgcttgccagagctccgtcgcgggaatggaaggatcagtgcacctcatcactggcgacagttctatcaactacaccgaaaaggagggccctctgctgtccgacagtcacgtagcctttaggcttacgatgccttcacccatgcccgagtacctcaatgtgcactacattggggaaagcgctagccgactgctctttctatccatgcattgggccttgagtattccttcgttccaggccctgggccaagagaacagtatctcactggttaaagcctattggaacgagctcttcacactgggtctcgcacagtgttggcaagtgatgaacgtggctaccattctcgccactttcgtcaattgcctgcacaattccctccagcaggatgccaaggtgatcgctgcactgatccacttcacccggcgcgccattaccgatctatag

SEQ ID NO: 12596 - DNA, 1812 bp, Artificial Sequence
  Description of Artificial Sequence: Synthetic coding sequence
atggcaactatcgaggaaattgcccatcagatcattgaacagcagatgggggaaatcgttaccgagcagcaaactggccagaaaatccagatcgtgaccgccctggatcacaatacccaaggtaagcagttcatcctaacaaaccacgatgggagcacccccagcaaggtgatcttagcgcggcaggactcaactcccggaaaggtcttcctcacaacaccagacgcggccggagttaaccaattgtttttcacaacacccgatcttagtgcccagcatctgcagctactgactgataacagccctgaccagggtccaaataaggtattcgacctgtgcgtggtgtgcggcgacaaagcttcagggcgccactacggcgcagtgacctgtgaggggtgcaaaggattcttcaagagatccattcgaaaaaacctggtatactcgtgtcgcggcagcaaagattgtataattaacaagcaccacaggaacagatgtcaatactgccgactgcagcgatgtatcgcattcggaatgaagcaggacagcgtgcagtgcgaacgtaaaccaatcgaagtatctcgcgagaaatcatctaattgcgccgcgagtacagagaagatatatatacgaaaagatctgagatcgcctcttaccgcgactcccacttttgtcactgattctgagtcaacacgttcaacagggctgctggattctggcatgtttatgaacatacatccaagtggcgttaagaccgaatcagctgtcctcatgacaagtgataaagctgagtcctgtcaaggcgacctgagcacactggctaacgtggtgacctcactggcaaatctagggaagacaaaggacctcagccaaaactccaatgaaatgtccatgattgaaagcctgtcaaatgacgacactagtctatgtgagtttcaagagatgcagactaacggtgatgtctccagagcttttgacacactggctaaggctctcaacccaggcgaatccactgcctgtcaaagctccgtcgctggaatggagggaagcgtccatctgatcacaggcgactcctccataaattacactgaaaaggaaggtccccttttgagcgatagccacgtggccttccgacttactatgccctccccaatgccagaatatctcaatgtgcattatattggagaaagcgcgagccgccttctattcctatctatgcattgggccttgtcaattcccagcttccaagccctcggacaggaaaactcaatatcactggttaaggcctattggaatgaacttttcactttggggttggcccagtgttggcaggttatgaatgtcgccacgattctggcaacgttcgtcaattgcttgcacaactctctccagcaggacaagatgagcaccgagagacgtaaactactgatggagcatatcttcaaactccaggagttttgtaactctatggtgaagttgtgcatcgacgggtatgaatacgcatacttaaaggccatcgtattgttctcaccagatcacccctctctcgaaaatatggagcagatcgagaagttccaggaaaaggcgtacgtggagttccaggactatatcaccaagacgtatccggatgacacctacaggctctctcgtctcctgctgaggctccctgctctacggctgatgaacgcaacaattaccgaggagctgttcttcaagggcctgatcggtaacatccggatcgactctgtgatccctcacatcctgaagatggaacctgccgactacaacagtcagatcattggtcactctatctag

SEQ ID NO: 12597 - DNA, 1404 bp, Artificial Sequence
  Description of Artificial Sequence: Synthetic coding sequence
atggcaactatcgaggagattgcccaccagatcatagagcaacagatgggcgaaatagtgaccgaacaacagaccgggcaaaagattcagatcgttacggccctggaccataacacccagggtaaacaatttattctcacaaaccacgacgggagcacacccagcaaggtcatccttgctcggcaggactctacacctgggaaggtttttttgactactccagacgctgccggcgttaaccagctatttttcaccaccccagacctgtcagcacagcacctccagctccttacagacaattcccctgaccagggcccaaacaaggtgttcgatctctgcgtggtctgcggagataaggcctcaggtaggcactatggcgccgttacctgtgagggctgtaagggattttttaaacggtctattagaaaaaatcttgtctactcctgtcgcggcagcaaagactgtatcattaataaacaccaccgcaaccggtgccagtattgccgactccagcggtgtattgccttcggaatgaagcaagatagcgtgcaatgtgagcggaaaccaatcgaggttagtcgtgagaaatccagcaattgtgccgcctccaccgagaagatctatattaggaaggacttgaggtcacctctgactgccactccgacgtttgttaccgattcggaaagcactcgaagcactggacttttagactccggaatgtttatgaacattcaccccagcggtgttaaaactgagtcagctgtgttgatgacatccgataaggccgaatcttgccagggagatttgtccacattggcaaatgtggtcactagcctagcaaatctcggcaaaacaaaggatctgtcacagaacagtaatgagatgtcaatgattgagagtctcagcaacgacgatacctccctgtgcgaattccaggagatgcagacaaatggagatgtgtcccgagcctttgatacactggccaaggcactcaaccctggtgagagtactgcatgccagagctccgtcgccggcatggaaggatctgttcacctgataacaggcgactcgtctataaactacaccgaaaaggaaggacctctgctaagcgacagtcatgttgcattccgtttgaccatgccttcccccatgccagagtatctgaacgtccattacatcggcgaatccgcctccagactactattcctgtctatgcactgggctctgtctatcccatcatttcaagccttaggccaggaaaacagcatttccttggtcaaagcatattggaatgagttgtttaccctggggcttgcccagtgctggcaggttatgaatgtggccaccattctggcgacttttgtcaattgtctccataactcgctccaacaagccgaaggctag

SEQ ID NO: 12598 - DNA, 51 bp, Artificial Sequence
  Description of Artificial Sequence: Synthetic coding sequence
atggctacaatcgaggagatagcccatcagattatcgagcagcagatgtag

SEQ ID NO: 12599 - DNA, 969 bp, Artificial Sequence
  Description of Artificial Sequence: Synthetic coding sequence
atgtgccccgtggataaggctcacaggaatcagtgccaggcctgtcgtctcaagaagtgtctgcaggctggcatgaatcaggatgctgtgcagaatgagcgtcagccccgcagcactgctcaggtccacctcgattcgatggagagcaatactgagtccaggcctgaaagcctggtcgccccccccgctcctgcaggcagaagcccgcgaggacccacccccatgagcgctgccagggcacttggccaccattttatggcctccctcatcactgcagagacatgtgccaagcttgagccggaagacgcagatgagaacatcgatgtgacaagcaatgacccagaatttccgtccagtccctactcctcgtcttcaccctgtgggctcgacagtatccatgagacatctgcccggttattatttatggcagttaagtgggctaaaaatttgccagtgtttagttcactgccttttcgagatcaagtgatcctgttagaagaggcatggagcgagctgtttctactaggcgccatccagtggtccttgccactggattcctgtccactattggcaccaccggaggcttcagcggctggaggagctcagggacggctgacgttggcgagcatggaaacccgggttctgcaggagaccatctccagattcagagccttggcggtggaccccaccgaatttgcctgcatgaaagccctggtcctgttcaaacctgagacaagggggctgaaggacccagagcatgtggaagccctccaggatcagtcccaggtaatgctgtctcagcacagcaaagcccatcatccttcccaaccggtaaggtttggaaaactgctcttactgctgccaagcctcagattcatcacagcggaacgaatcgagttgcttttctttcggaagacaatcggtaatacacccatggagaaattactgtgtgatatgtttaagaactag

SEQ ID NO: 12600 - DNA, 1104 bp, Artificial Sequence
  Description of Artificial Sequence: Synthetic coding sequence
atggaaacgagacccactgcacttatgagtagcacggttgccgcggctgctcccgcagctggagccgcttcccgtaaagaatcacctgggcggtgggggttgggggaggaccctacaggagtttcacctagcctccaatgccgcgtctgcggagattcctcgagcggcaaacactatgggatttatgcatgtaacggttgtagcggcttttttaagaggtcagtacgaaggcggttaatttatcggtgccaagtgggcgccggaatgtgcccggtcgataaggctcacagaaatcaatgtcaggcctgccgtctaaaaaagtgtttgcaggcggggatgaatcaggacgcagttcagaacgaaaggcaaccccgttcgaccgcccaggtccaccttgatagtatggaaagcaacaccgagagtagacccgaatcactcgtagcccctcccgcaccagccggaagaagcccacgcggtccaacacccatgtccgcggcccgggcccttggacaccacttcatggctagcctcattaccgccgagacatgtgcaaaactcgaacccgaggatgccgacgagaatattgatgtgacttctaacgacccagagttcccatcctctccttacagctcttccagcccctgtggcctagacagtatccatgagacatccgctcgcttgctctttatggcagtgaagtgggctaaaaatctgcctgtttttagctctctgcccttccgtgaccaagtgatccttttggaagaggcgtggtccgagctttttctgctgggcgctattcagtggtcactgccactggattcttgcccgctactagccccccctgaggccagcgcagccgggggcgcccagggaaggctcactctagcatctatggagactagggttttgcaggagacaatcagcaggtttcgcgccttagccgtggaccccactgagttcgcatgcatgaaggctctcgtgctctttaagcccgagacccgggggctcaaggatccggaacatgtggaagctttacaggaccagtcgcaggtaatgctgtcccagcatagcaaggcacaccacccttcccagcctgtccgctag

SEQ ID NO: 12601 - DNA, 1431 bp, Artificial Sequence
  Description of Artificial Sequence: Synthetic coding sequence
atggagcgcgatgaacctccccccagcggaggaggggggggaggcggatccgccggctttctcgagccacctgctgccctaccacccccacccagaaacggattctgccaggacgagctcgcagagctcgaccccgggactaatgatcgggctgagcaacgcacgtgcctaatttgcggagatcgggcaacaggtttgcattatggcattatttcctgcgagggctgcaagggattctttaaacgctctatttgcaataagcgggtgtaccggtgcagtcgcgacaaaaactgtgtgatgagccggaaacagagaaataggtgtcaatattgtcgcctgttgaagtgtttacagatgggcatgaaccgcaaggccatccgagaagacgggatgcccggaggcagaaataaatcaattggtcccgtacagatctcggaagaggaaatcgagcgaatcatgagcggccaggaatttgaggaggaagccaatcactggtctaaccacggggactctgaccactcttcaccagggaatcgagcttccgagagtaaccagcctagtccaggatctacactctcctcttcacgcagtgtcgagcttaacggatttatggcatttagggaacagtacatgggcatgagtgtacccccccactaccaatacatcccacacctattttcatattctggccacagcccgttactccctcagcaagcccggagtctcgatcctcaatcatacagtctgatccatcagcttctgtcggcagaggacttggagccactgggcacacctatgctcatagaggacgggtacgcagtgacgcaggctgagttgttcgcactgctttgtcgcttggccgacgagctattattccgccaaattgcatggatcaagaaattgcctttcttttgcgagctttctattaaggactacacctgcttgctgtcttcaacatggcaggagctcattctgttgagctcgctcacagtgtacagtaaacagatttttggcgagctggcggatgtgactgcgaaatattcaccctcagatgaggagcttcatcgtttctccgacgaaggcatggaggttatagaacgcctcatttatctgtaccacaaatttcatcaactcaaagtgtctaacgaggagtatgcatgtatgaaagctattaactttttgaatcaggatatccgggggctaacatcggcctcccagctcgaacagttaaacaagcgttattggtacatttgccaggactttactgagtataagtacacccaccagcctaaccgctttccagacttaatgatgtgcctgcctgaaattcggtacatagctggcaagatggtgaatgtgcctctggaacagctccctttgttgttcaaggtggtgctgcatagctgcaagacatccgtaggcaaggaatag

SEQ ID NO: 12602 - DNA, 1428 bp, Artificial Sequence
  Description of Artificial Sequence: Synthetic coding sequence
atggagcgagatgagcctccccctagcggggggggcggtggaggcgggagcgctggcttcctcgagcccccggctgctttgccaccccctcctcggaacggattctgccaggatgagctggctgagttagaccctggcacaaacgatcgagcggagcagcgaacatgtcttatttgcggagatcgtgctactggcctgcattacggaattatctcttgcgaaggttgtaaagggttctttaagcggagcatctgcaacaaacgggtttacagatgctcaagagataaaaactgcgtaatgtcacgtaagcagaggaaccgctgccagtattgccgattgctcaagtgtctgcagatggggatgaataggaaggccatacgggaagatgggatgcccgggggccgtaataagagcataggccctgtccaaatttccgaggaagagatcgaaaggattatgtccggacaagagtttgaggaagaggctaatcattggagtaatcacggtgattctgaccatagcagccccggcaatagagcatctgaatcgaatcagccttcaccaggcagcaccttgtcatcccgatcagtggagctcaacggattcatggcatttagagagcagtacatgggcatgtccgtccccccgcactatcaatacatcccccacttgtttagctattcaggccactccccattactccctcagcaggcccgatccctggacccacaaagctattccctcatccaccagctattgtcagctgaagacttggagccgttaggcacgcctatgctgattgaggacggttatgcggtgactcaggcggaactgtttgcgctgctctgtagactggccgatgaactgctcttccgacagattgcttggattaagaaacttcctttcttttgtgagttatctatcaaagactacacctgtctgttgtcctccacttggcaggagttgattctgctttcgagtctcactgtctattcgaagcaaatctttggcgagttggctgatgtgactgctaagtacagccccagcgatgaggaactccatagattttctgacgagggaatggaggtcatcgagcgcttaatctacctctaccacaaatttcaccagctgaaggtcagcaacgaggagtacgcatgtatgaaagccattaacttcctgaaccaggacattcgtggcctaaccagcgcgtcccagctggaacagctgaacaagcggtattggtacatatgtcaggacttcacggagtacaagtacactcaccagcccaatcggtttccggacttaatgatgtgccttcctgaaatccgctacatcgcgggcaaaatggttaatgttcccctcgagcagctgcctttactgtttaaggttgttctgcatagctgcaagaccagtgtgggcaaagaatag

SEQ ID NO: 12603 - DNA, 1443 bp, Artificial Sequence
  Description of Artificial Sequence: Synthetic coding sequence
atggagagagacgagcccccaccttccggcggtggtggcgggggtggttcagctggatttctggaaccccccgccgccttacctccccctccaagaaatggattttgccaggacgaactcgcagaactggatcctggaaccatctcagtttccgatgatagggcggaacagaggacttgcttgatttgcggtgatcgcgcaaccggcctgcactacgggattattagctgcgagggctgtaagggttttttcaaaagatctatttgcaataaacgggtttaccgttgcagtcgggacaaaaattgtgtcatgtcccgtaaacagcgcaaccgctgccagtactgccgcctgctgaaatgtctgcagatgggaatgaataggaaggccattcgtgaggacggcatgcctggcggaagaaataaaagtataggccctgtacaaatcagcgaagaagagatcgaaaggatcatgtccggccaagagttcgaggaagaggctaaccattggtccaatcatggcgactccgatcacagtagccctggcaatcgcgcgtccgagtccaaccaaccaagccctggttctacactctcatcaagtaggtccgtggaattaaatggctttatggcctttagggaacagtacatgggcatgagtgttcccccccattaccagtacattccacacttgttctcctatagcggccattctcctcttctgccccaacaggctaggtcactagacccccagtcatacagcctgatccaccaactcctctctgcagaggatctcgagcccttgggcactccgatgctcatcgaggacggctatgccgtcacacaggcagagctgttcgccttactttgtcgactcgccgatgaactgctcttccggcagatcgcttggatcaaaaaactgccgtttttctgcgagctgtccatcaaggactacacctgcttattatctagtacatggcaggaactcatactcctctcaagcttgacagtgtattcaaaacaaatcttcggagaactggctgacgttacagctaagtacagccctagcgacgaggaactgcatcgcttcagcgacgagggtatggaagtgatagagagactgatttatctctaccacaaatttcatcagctcaaagttagtaatgaggaatacgcctgtatgaaggccatcaatttcttgaatcaggacattaggggtttgacgtcagctagtcagctggaacagctaaataaacgttactggtacatctgccaggacttcaccgagtataagtacacgcaccagcctaaccgtttccccgacctgatgatgtgtttgcctgaaatccgatatatagcgggcaaaatggtgaacgtcccgctggagcagttgcctctcctttttaaagtggtgcttcactcctgtaaaacgtccgtggggaaagaatag

SEQ ID NO: 12604 - DNA, 1677 bp, Artificial Sequence
  Description of Artificial Sequence: Synthetic coding sequence
atggccattccaggtcgacagtatggactaatcctgccaaagaagacccagcaactgcatcccgtgctgcagaaaccctccgttttcggcaatgactccgatgatgacgatgaaacgtcggtaagcgagagcctccaacgcgaagcggctaagaaacaggcaatgaagcagacgaagcttgaaatccagaaagcactggcggaagatgcgacggtttatgaatacgattctatctacgacgaaatgcaaaagaaaaaagaggaaaacaaccccaaactgctcctgggaaaagacagaaagcccaaatacattcacaatctgttaaaggccgtcgagatccggaaaaaggagcaagaaaagcgcatggaaaaaaagatccagagagaaagggagatggaaaagggtgaatttgacgataaagaagcttttgtaacatccgcgtataagaagaagctccaggagcgcgccgaggaggaagagagagagaaaagggcggcggcattggaggcctgtctggatgtgactaagcagaaggacttgtcagggttttaccgccatctactcaatcaggcagtcggcgaagaggaagttcccaagtgcagttttcgcgaggcaaggtccggaattaaggaggagaaatcaagaggtttcagtaatgaagtgtccagtaaaaacaggattccgcaagaaaaatgcatactccagacagacgtgaaagtggaggagaatcctgatgctgattccgacttcgacgccaaaagttcagccgacgacgagatcgaggagacccgtgtcaactgccgaagagaaaaggtcatcgagactcccgaaaatgacttcaaacaccaccgttcccagaatcactcccggtcaccctccgaggagcggggccactccactaggcaccacaccaagggatctcgcacaagccggggccacgaaaagcgcgaagaccagcaccagcagaagcagagccgggatcaggaaaatcactacaccgatagagactataggaaagaacgcgactcccatagacaccgagaagcttctcatagggacagtcactggaagaggcacgagcaggaggataaacctcgcgcacgcgatcagcgtgagcgcagcgatagagtttggaagagggagaaagatagagagaagtattcccagcgcgagcaagaacgggaccgccaacagaatgaccagaatcggccatcggagaaaggagaaaaggaagagaaatctaaagccaaggaagaacatatgaaggtccggaaggagagatatgaaaacaacgacaaataccgagaccgcgagaaaagagaagttggtgtgcagagcagtgagagaaatcaggacagaaaagaatccagtccgaacagccgggctaaagacaaattcctcgaccaagagcggagtaataagatgaggaatatggcgaaagataaagaacggaaccaagagaagccaagcaactctgagtcttctctgggtgctaaacaccggctgacagaggaggggcaagaaaaggggaaagaacaggagcgccccccagaggcagttagcaagtttgctaaacgtaataacgaagagacggttatgtctgccagagataggtacctggcacggcagatggcccgcgtgaacgccaaaacatatatcgagaaggaagacgactag

SEQ ID NO: 12605 - DNA, 1062 bp, Artificial Sequence
  Description of Artificial Sequence: Synthetic coding sequence
cttaaaatgaccaagctggagatccagaaggccctggctgaggacgccacagtctatgagtacgactccatctacgatgaaatgcaaaagaaaaaagaggaaaataatccgaagctgcttctcgggaaagatcgcaagcctaaatacatccacaacctcttgaaggccgtggaaattcgaaagaaagagcaagaaaaaaggatggagaaaaaaattcaaagggagagggagatggagaaaggagagttcgatgataaagaagcctttgtcacctcagcctataagaagaagctccaagagagggccgaagaggaggaacgggaaaaaagggccgcagctcttgaagcttgcttggacgtcacgaagcaaaaggatctgagtgggttttatagacacctgctcaatcaggccgttggcgaggaagaagtgccaaaatgttcatttagggaagcccggtctggtattaaggaagaaaaatccagaggtttttccaatgaggtttcatcaaagaatcgcattccccaggaaaaatgcatcctgcagacagacgtgaaagtcgaggagaaccccgatgccgatagcgacttcgacgctaagtcatcagcggacgacgagatagaagaaacgcgagtcaactgcaggcgggagaaggtcatcgagactcctgagaacgacttcaaacatcatagatcccaaaatcactctcggagtcctagcgaagagagagggcactccacaagacaccatacaaaggggtccaggaccagcagagggcacgagaaaagagaggaccagcaccagcagaaacagtcgagggaccaggagaaccactacactgaccgagactacagaaaagaacgggatagtcaccgacacagggaagcttctcaccgcgactcacactggaaacgccatgaacaggaggataagcccagagccagagatcaacgcgagcgctcggaccgagtgtggaaacgggaaaaggatagagagaaatattctcagagagaacaggaacgtgaccgtcagcagaatgatcaaaataggcctagcgagaagtag

SEQ ID NO: 12606 - DNA, 1470 bp, Artificial Sequence
  Description of Artificial Sequence: Synthetic coding sequence
atgctgctctgtatgaacatgactgtgttcatgatgaagtgtcggaaaaaagaagaaaacaacccaaaactattactggggaaggaccgcaagcctaagtacatccataacttactgaaagcggttgagatccggaaaaaggaacaagagaagcgcatggagaagaagattcaaagggaacgagagatggaaaagggcgaatttgacgacaaggaagcattcgtgacatccgcgtacaaaaaaaagctccaggaaagagcagaggaggaggagcgtgagaaaagagctgcagcacttgaagcgtgtctggacgtgacaaaacaaaaagatctttccggtttctatagacatctgcttaatcaagcggtcggggaagaggaggtccccaagtgctccttccgggaggccaggtccggcataaaggaggaaaagtcacgcggcttctccaatgaagtttcgagtaagaatcgcattccccaagaaaaatgcattctgcagacggacgtgaaggtggaggagaacccagacgctgattccgattttgacgccaagtcaagcgcagacgatgagatcgaagaaacaagagtgaactgccggcgtgagaaggtgatcgaaacccccgagaatgatttcaagcaccacaggtctcagaatcactcacgctctccctcagaggagagggggcactctacccggcaccacactaaagggtctaggacgtccagggggcacgagaaacgagaagaccaacaccagcaaaagcagtccagggatcaggaaaatcattacacagatagagactaccgcaaggaacgcgactctcaccgtcatcgcgaggcttcacatcgggattctcactggaaaagacacgaacaggaggacaagccgcgggccagagatcagagagagcggtctgaccgcgtttggaaacgggaaaaagacagggagaaatattctcaacgggagcaagagagagacaggcagcagaacgaccagaacagaccaagcgaaaagggagagaaggaagagaaatctaaggccaaagaagaacacatgaaggtgcgaaaggagagatacgagaataacgataagtatagggacagggaaaaacgggaggtaggcgtacagtcttccgagcgaaatcaagatagaaaagagtcaagcccgaactcacgggctaaagacaaattcctcgaccaggagcgttctaacaaaatgcggaatatggctaaagataaggaacggaaccaggagaagccatctaatagtgaaagcagcttgggcgccaagcaccgtttgacggaggagggccaggagaaaggaaaagagcaggagaggccacctgaagccgtatccaagttcgcgaagcggaacaacgaggaaacagtgatgtctgctcgtgatcgctatctggcccgccaaatggccagggtaaatgctaagacgtatatcgaaaaagaggatgattag

SEQ ID NO: 12607 - DNA, 474 bp, Artificial Sequence
  Description of Artificial Sequence: Synthetic coding sequence
atgggaaaacacgaattccgttctaacattccctgtcacctggtggatatctcctgtggacttccatgtagcgcaactctgccatgcgggatgcacaaatgtcagcggctgtgccataagggtgaatgtctggtggacgaaccctgtaaacagccttgcaccacacctcgagcagattgcgggcatccttgtatggccccctgccacacctcttccccctgcccagtgactgcatgtaaggccaaggtcgtcgaactccaatgtgagtgtggacggaggaaagaaatggtgatttgctctgaggcgagctctacgtaccaaagattggtgattgctgcaatctcaatggcttccaagatcacagatatgcagttgggcggatccgtcgagatcagtaagctgatcaccaaaaaggaggttcaccaggccagactggagtgcgacgaggagtgctctgccctagaacgaaagtag

SEQ ID NO: 12608 - DNA, 2502 bp, Artificial Sequence
  Description of Artificial Sequence: Synthetic coding sequence
atggctgaggccccccctgtcagtggaacattcaaattcaatacagatgctgcagagttcattccccaggaaaagaagaattctggactgaactgcggcactcagcggagactggatagcaaccgcatcggcagacggaattacagctctcccccaccttgtcacttgtcgagacaggtgccctacgatgaaatctccgccgtgcaccagcatagttaccatcccagtggcagtaaacctaagagccagcagacatcgtttcaaagctctccctgcaataagagtcccaagtcccacggcctgcagaatcagccttggcagaagcttagaaacgaaaaacaccatattcgcgtcaaaaaagcccaaagtctcgccgaacagacctcggatactgctgggctggagtcttctactcggtctgaatcaggaaccgacctaagagaacactcccctagcgaaagcgagaaggaggttgttggcgctgatcctagaggtgccaagcctaaaaaggccacccagttcgtgtacagttacggcagaggcccgaaggttaagggcaaactgaagtgcgagtggtcgaatagaacgactcccaagcccgaggacgccggcccagaaagtaccaaacctgttggcgtgtttcatccggatagttccgaggcctcttctcgtaagggcgtactggatgggtatggcgccagacgtaacgagcagagaaggtaccctcagaaacgccccccttgggaagtggagggggcccgaccccgccccggcaggaatccccccaagcaagagggacatagacacacaaacgctgggcacagaaataatatgggtccaattccaaaagatgatctgaacgagcggcccgcaaagtcaacatgcgactctgagaatctagccgtgatcaacaagtcctctcgacgtgtggaccaggaaaaatgcactgtgcgccgacaggatcctcaggtcgtgtctccattctccagaggaaaacagaatcacgttcttaagaatgtggaaacccacacaggctctctcatcgagcagttgacaactgagaaatatgaatgcatggtatgttgcgaactggtccgagtgacagcccctgtttggagttgtcagagctgttatcacgttttccacctgaactgcattaagaaatgggcccgctcccccgctagccaggctgatgggcagagtggctggcgatgccctgcgtgccagaacgtgagcgcacatgtgcctaacacctatacttgcttctgcggcaaggtcaaaaatcctgagtggtcccggaatgagatcccacacagctgcggcgaagtttgccgcaagaagcaacctggccaggactgcccacacagttgtaatctgctgtgtcatcccggcccctgccctccatgtcccgcctttatgacaaagacctgcgaatgtggccgaacccgccatacagttcgctgtggccaggctgttagtgtccactgttccaatccgtgtgagaacatcttgaactgcgggcaacaccaatgcgcagaactgtgccatgggggacagtgccaaccatgtcagatcattttgaatcaagtctgctattgtggcagcaccagccgcgatgtgctctgcgggacagatgtggggaaatcggatgggtttggcgactttagctgcttgaagatctgcggaaaagatctgaagtgcggaaatcatacttgtagtcaggtgtgccatccccaaccctgtcagcagtgcccgcggctgccccagttggttcgttgctgtccatgcgggcagacacccctgtcacaactcttggagttggggtcatcttcacgcaaaacctgcatggaccccgttccatcctgtggaaaagtgtgcggaaagcctcttccatgcgggtcgttggacttcatccacacttgcgagaagctctgccacgaaggggattgcggtccctgctccaggacctctgtgatttcttgccggtgttctttcagaaccaaggaactgccttgcacttccctgaaatctgaggacgctacctttatgtgtgacaaacgttgtaataaaaagcgactgtgtggccgccacaaatgtaatgagatctgttgcgtggataaggaacataagtgtccactcatctgcggccgtaagctccggtgtgggctccatcgctgcgaggaaccttgccatagaggaaattgtcaaacatgctggcaggcgtcctttgacgagctgacatgccactgcggtgcctccgtaatctatcctcctgtgccatgcggcacacggcctcccgagtgtacacagacgtgtgcccgggtgcatgaatgcgaccatcccgtataccatagttgtcattcggaggagaagtgccccccttgcacttttttgacccaaaagtggtgcatgggcaagcatgaacaaagccattactgggccagcacgcagaagaagcggtcccattacatgaagaaaattcccgcacacgcttgtctgtag

SEQ ID NO: 12609 - DNA, 3075 bp, Artificial Sequence
  Description of Artificial Sequence: Synthetic coding sequence
atggccgaggcacctcccgtttctggcacgttcaaattcaatactgatgcagcagagtttatcccccaggaaaagaagaattccggtctcaactgcggtacacaacgccggctggactccaatcgtattggaaggcggaactactcatctcctccaccatgtcatctttccagacaggtaccttacgatgaaattagcgccgtgcaccagcattcttaccatccttcaggatcgaagcccaaatcccagcagaccagcttccagagcagcccatgtaataaatctccaaagtcccacggactgcagaatcagccctggcagaagctgcgaaacgaaaagcatcatattcgggtgaagaaagctcagtcacttgccgagcagaccagtgacaccgccggacttgaaagttccacacgaagcgagtccgggacagatctgcgggagcatagccccagtgaaagcgagaaggaggttgtgggcgcagaccctcggggggccaagcctaaaaaggccacccaatttgtgtactcgtacggccggggccccaaagtgaaagggaaactcaagtgcgaatggtccaataggactacccccaaacccgaagatgccgggcctgagtctacaaagccagtgggcgtgttccacccagatagctctgaggcatcatcgaggaaaggcgtgctcgatggctatggtgctcgccggaatgagcagcgtcggtatccgcagaagaggccaccttgggaggtcgagggggcaaggccacggcctggcaggaaccctccaaagcaggaggggcacagacacaccaatgcgggccatcggaacaatatgggccctattccaaaagacgatctgaatgagaggccagcaaagtcaacttgtgattcagagaatttggccgtaattaataaaagttccaggagggttgatcaagagaagtgcacagtgagacgccaagatccacaagtcgtgtcaccattcagccggggtaagcagaatcacgtgctgaaaaacgtggaaacccatactggctcactgattgagcagctgaccacagagaagtatgaatgcatggtgtgttgcgagctagttcgggtaaccgcaccagtctggagctgtcagagctgttatcatgtgttccacctgaactgcatcaagaaatgggctaggagcccagcatcccaggctgatgggcagagcggctggaggtgccctgcctgccagaatgtgtcagcacacgttcctaatacatacacatgcttttgcgggaaggttaagaacccggagtggtcccgcaatgagatcccacacagctgcggggaagtgtgccggaagaagcaacccggccaggattgcccgcactcctgtaacctgctgtgccatccaggcccttgccccccatgccctgcattcatgaccaagacctgtgagtgcggccgcacccgccacacggtgaggtgcggtcaggccgtctcggtgcactgtagcaatccatgcgagaacatcctgaactgcgggcagcatcagtgcgcagaactgtgccatggtggacagtgtcagccgtgtcagattatacttaatcaagtgtgctattgtggaagcaccagtagggatgttctttgcgggactgatgtcggcaaatcagatggtttcggggatttcagttgtctaaagatttgtggtaaggatttaaaatgcggaaatcatacttgctcacaggtttgtcacccacagccttgccagcagtgtccccgactgccacagttggtgcggtgttgtccatgcgggcagactcctctgtcccagttgctggagctggggtcttccagtagaaagacttgcatggaccctgtcccctcatgtgggaaagtctgtggtaaaccactgccttgtgggagtcttgacttcatccacacatgtgagaagttgtgccacgagggggattgcggaccctgtagtcgcacatccgtgatttcatgccgatgctcctttcggactaaggagttgccatgcacttccctgaagagtgaagatgctaccttcatgtgcgataaacgctgcaataagaagagactgtgcgggaggcacaaatgtaacgaaatttgttgcgtcgacaaggagcacaagtgtccactgatctgcggtcggaagttgcggtgcgggctgcatcggtgcgaggagccatgccacagagggaactgtcagacttgctggcaggcctcattcgatgagctcacatgtcactgtggagcaagcgtcatctaccctcctgtaccctgcggaactcgccccccagagtgcacacaaacttgtgcgcgagtccacgagtgtgaccaccccgtctatcactcatgtcattccgaggaaaaatgcccaccctgtacttttcttacccaaaagtggtgcatgggcaaacacgaatttcgctcgaacatcccgtgtcacctagttgacattagttgcggattgccctgtagcgcgacacttccttgtggaatgcacaaatgccagagactgtgtcacaagggcgaatgtctggtggacgaaccatgcaaacaaccttgcacgacaccacgcgctgattgtggtcatccctgtatggccccatgccatacatcttccccttgccctgtcacagcctgtaaggcaaaggtggagttacaatgtgagtgtggtcggagaaaagagatggttatttgcagcgaggcctctagtacctaccaaaggatcgccgctatttcaatggctagcaaaattaccgatatgcaactgggtggcagtgttgagattagcaagcttatcaccaagaaggaagtgcatcaggctcgcttggagtgtgatgaagaatgtagtgctctagagcggaaaaaaagactggcagaggctttccacatatctgaggatagtgacccattcaacattaggagtagtggttccaagttctcagattcactgaaggaggatgcccggaaggatttgaagtttgtctccgacgtcgagaaagagatggagacgttggtggaggccgtcaacaaagtagaggtcgaaacaagccattggacttttctgtag

SEQ ID NO: 12610 - DNA, 3363 bp, Artificial Sequence
  Description of Artificial Sequence: Synthetic coding sequence
atggcagaggccccgcccgtctcgggtacattcaaattcaacacggatgcagccgaatttatcccccaggagaaaaaaaatagcggtctgaactgcggcactcagaggagattggatagtaatcggattggtcgaagaaactactcatccccgcctccctgccacctgagcagacaggtcccttatgacgaaattagcgccgtgcaccagcacagctatcatccgagcggaagcaagcccaagtcccaacaaacgtcttttcagagctccccctgtaacaagagtcccaagtcccatggattgcagaaccagccttggcagaagttaaggaatgagaagcatcatatccgggtgaagaaggcccagtcactggctgaacagacaagcgacacagctggactggagtctagcaccaggagcgagagcggcaccgaccttcgagagcactctccatcagagtctgaaaaagaggtcgtcggtgccgacccccggggggccaagcccaaaaaggcgacccagtttgtatatagctacggcagggggcctaaggtgaagggaaaactgaaatgcgagtggtctaatcgaaccacgccaaaacccgaggatgctgggccggagagcacaaagccagtgggagtattccatcccgactcaagtgaggcgagctcccggaaaggcgtcctggatggctacggagcacgtcgcaatgagcagcggaggtaccctcagaagaggccaccatgggaggttgagggcgccagaccgagacccggtcggaaccctcccaaacaggagggtcaccgtcatactaacgctggacacagaaacaacatgggacctattcctaaagatgatttgaacgagcgacccgctaagtctacctgcgactcagagaacttggctgttatcaacaagagttcacggcgggtcgaccaagaaaaatgcacggtgaggaggcaggatccgcaggttgtgtcaccattctcaagggggaaacaaaaccacgtgctgaaaaatgtggaaacccacacgggctctctgattgaacagctaactacagagaaatacgaatgcatggtttgttgcgagctcgtgcgcgtcaccgccccggtctggtcatgccagtcttgctatcacgtcttccacctgaactgcatcaagaagtgggcgcgctcacccgcgagccaggctgacggccagtcagggtggcggtgccctgcttgtcagaacgtgtccgcacacgttccaaacacatatacatgcttctgcggtaaggtgaaaaacccggagtggtctagaaacgaaatcccccactcatgcggcgaagtctgtcggaaaaagcaacccggtcaggactgcccacactcttgtaatctgctgtgccaccctggaccctgccctccttgtccggcttttatgaccaaaacgtgtgagtgcggccggacaaggcataccgttcggtgcggccaagctgtctctgtgcattgttcaaacccgtgtgagaatatcctgaattgtggacagcatcagtgcgcagaactgtgccacggaggacaatgccaaccatgtcaaatcatactgaaccaggtctgctattgcggcagtaccagccgcgacgttctgtgtggcacagacgtcggtaaatcagatggatttggagacttctcatgcctgaaaatctgtggtaaggaccttaagtgtggaaaccatacatgttctcaggtgtgtcatcctcagccatgccagcaatgcccaagactgccccagctggtgcgatgttgcccctgcgggcagacacctctctcccaattgctggaactgggttctagcagcagaaaaacttgtatggatccagtgccaagctgcggtaaggtgtgcggcaagcctctgccatgtggctccctggatttcattcacacttgcgagaagctttgccatgaaggagattgcggcccctgttctcgaacctccgtaatctcttgccgctgttcttttagaactaaggaattaccgtgtaccagcctgaaaagtgaggacgctacatttatgtgcgacaagagatgtaataagaagcgtctctgcgggagacataagtgtaacgagatatgctgcgtcgacaaagagcacaagtgcccactgatatgtggtaggaaactgagatgtggcctgcaccgctgtgaggagccatgccatcggggcaactgccagacttgttggcaggcttcctttgacgaacttacatgccactgtggcgcatctgtcatttaccctcccgtgccatgcggtacaaggccaccggagtgcacccagacttgcgctagagtgcatgaatgcgatcatcccgtgtaccatagttgtcattcagaggagaaatgcccaccatgtacatttctgactcagaaatggtgcatgggtaagcatgaattcaggagcaatattccatgtcatttggtggacatctcatgcggacttccatgcagtgccacactcccatgtggtatgcacaagtgccagcgcctctgtcacaagggcgagtgcctggtggacgaaccatgtaagcagccttgcaccacccccagggcagactgcggccacccgtgtatggccccctgccacaccagcagtccttgtcccgtgactgcctgcaaggctaaggtggaactgcaatgtgagtgtggccgccgtaaagaaatggtcatttgctccgaagcatcttctacatatcagagaattgccgcaattagcatggcctcaaagataacggacatgcagctcggggggtccgttgaaatatcgaagctcatcaccaagaaagaagtgcaccaagctaggctggaatgcgatgaagagtgtagtgccctcgaaagaaaaaagcggttagccgaagcttttcatatctcagaagactccgacccgttcaatattcgctctagtggcagtaagttcagcgacagcctgaaagaagacgccagaaaagacttaaagttcgtttctgatgtggaaaaagaaatggagacactggtggaggcagtcaacaaaggtaaaaattctaaaaagagccacagctttccacccatgaatcgggaccacagacgcataatccacgacctcgcccaggtgtatgggctagaatcagtcagctacgacagcgagccaaaacgtaacgtggtggtaaccgcgatccgaggtaaatctgtgtgtcccccaacaactttaactggtgtcctggagcgagagatgcaagcccgtcctccgccccctatcccacaccaccgacaccagagcgacaagaacccaggcagcagcaacctgcaaaaaatcacgaaggagcccataatcgattactttgatgtccaagactag

SEQ ID NO: 12611 - DNA, 2391 bp, Artificial Sequence
  Description of Artificial Sequence: Synthetic coding sequence
atggcggaggcgccaccagtgtccggtacatttaaattcaatacggatgcagccgaatttatcccgcaggagaagaaaaacagcggacttaactgtggaacacaacggagactcgattccaatcgcatcggaagaaggaactacagtagcccgcccccatgccatctttctaggcaggtgccatacgacgagatatccgccgtccatcagcacagctaccacccatccggttctaaacccaaatctcagcagacttcattccagtcgtcaccgtgcaataaaagtcccaagagtcatggcctccagaaccaaccctggcagaagctgaggaacgagaagcatcacatcagagtcaagaaagctcaatccctggccgaacaaacctctgataccgcaggtctggagtccagcacccgcagcgaatcaggcactgatttaagggaacactctccatctgagagtgaaaaggaagtagtgggcgctgacccgcgcggtgcgaaacccaagaaagctactcaattcgtctattcctatggacgcgggccgaaggtgaagggaaagctcaagtgcgagtggtccaacagaactacgcccaagcccgaggacgcaggaccagagagtacaaaacccgtgggagtattccaccctgattcttccgaggcttcatcccgtaaaggtgtcctggacggctacggagccaggcgcaacgaacaaaggaggtatccccaaaaacgaccaccttgggaagtcgagggagcccgcccacgtccaggacgaaatccccctaagcaggagggccataggcatacaaatgccgggcaccgtaacaatatgggaccaatcccaaaggacgaccttaatgaacgaccagctaagtccacctgtgatagcgagaatctcgctgtgataaataagtcatccaggcgggtcgaccaggaaaaatgtacagtgcggcggcaagatcctcaagttgttagtcctttttctcgaggaaagcagaaccacgtgctgaagaacgtggagacacatacaggaagcctgatagaacagctgacaacagagaagtatgaatgtatggtgtgttgcgagctcgtcagagtgaccgcgccagtttggagttgtcagtcatgttatcatgtgttccacctcaactgcattaagaaatgggccagaagtccagcttcacaagccgacggccaaagtggttggaggtgccccgcctgtcagaatgtttctgcccacgtgcccaatacttacacttgcttttgcggtaaagtgaagaatcctgagtggagccgcaacgagatcccccattcgtgtggcgaggtctgcagaaagaaacaacccggacaagactgtccccattcttgtaacttattgtgccaccccggcccttgcccaccctgtccagcttttatgaccaaaacatgtgaatgcggtcgaactagacacacggtccgttgcggacaggctgtgagcgtccattgctcaaatccttgtgagaacatcctgaactgtggacagcaccagtgtgccgaactctgccatggcggccaatgtcagccatgccaaatcattttgaatcaggtctgctactgtggatccacctctcgcgatgtcctttgcggcaccgatgtgggtaagagcgacggcttcggagattttagttgcctcaaaatatgtggaaaagatcttaagtgcggaaaccatacgtgtagccaggtgtgtcatccgcagccttgccagcagtgccctagattgccacagctggtaaggtgttgtccctgcggccagacaccactctcccagctgctcgagctggggtcttctagccgcaaaacttgcatggatcccgtgccaagctgtggaaaagtctgtgggaaacccttgccctgtgggtccttggactttatccacacttgcgagaagctgtgccacgaaggcgactgtggaccctgctcccgcaccagcgttatatcttgtcgatgctcttttcggaccaaagaactgccttgcacctcgctaaaaagtgaagatgcaacatttatgtgcgataagcgttgtaacaagaaacgactgtgcggcagacacaaatgcaatgagatctgctgcgtcgacaaagagcataagtgcccactgatctgcggaaggaagcttcggtgtggcctgcacaggtgcgaagagccctgtcaccgggggaactgtcagacttgttggcaggcctccttcgacgagttaacgtgtcattgtggagctagcgttatttaccctccagtgccgtgtgggacccgtcctccagaatgtacccagacctgtgcacgcgttcacgagtgcgaccaccccgtgtaccactcatgccacagtcgtagcgttcctttagctcttagttag

SEQ ID NO: 12612 - DNA, 1917 bp, Artificial Sequence
  Description of Artificial Sequence: Synthetic coding sequence
atgcaggtcagttcactgaacgaggtgaaaatctattccctgtcctgcggtaagagcttacccgagtggctcagcgataggaagaagagggccctgcagaagaaagatgtcgacgtgaggcggcggatcgagcttatccaagacttcgaaatgccaactgtctgcactaccattaaggtctccaaagacggccagtacattctagccaccggtacttacaaaccacgcgtcaggtgctacgatacatatcagttgagcctgaaatttgagcggtgtcttgactccgaggtcgtcacattcgagatcctctctgatgactacagcaagatcgtatttctgcacaacgaccgctacattgagttccacagccagagtggattttactacaagaccaggatccctaagttcggccgggatttctcctatcattacccatcatgtgacctgtattttgtgggtgcctcatccgaggtttatcgtctaaatttggagcagggacgatacctcaacccactccaaacagatgcggctgaaaataacgtgtgcgacattaactcagtgcacgggttattcgcaacagggaccatcgaaggtagggtggaatgttgggatcctcggacccgtaaccgtgtagggttactagattgcgccctgaattccgttacagcggatagcgagatcaactctttacctactattagcgcgctgaaattcaacggtgcgctcacaatggctgtgggaacgacaaccggacaagggaaaatattcacaagcctcgaaccagagcacgacctgaacgacgtctgcctatatccgaattccggtatgctcctgaccgctaacgaaactcccaaaatgggtatttactacatccccgtgctcggcccagctccacgctggtgtagtttcctggacaacttgacagaagagcttgaagagaacccagagtcaacagtgtatgatgactacaaatttgttaccaagaaggatctggagaacctgggcttgacacatctgatcggcagtccttttctgcgggcttacatgcatggttttttcatggacataaggctttaccacaaggtgaagctgatggttaaccccttcgcttacgaggaatacagaaaggataagatcaggcaaaaaatcgaggagacccgggcccagagggtgcagttaaaaaaactccccaaggttaataaagagctcgcattgaaactgattgaagaagaagaggaaaagcaaaaaagtacttggaagaagaaggtcaagtccctgcctaatatcctaacagatgatcgatttaaggtgatgttcgaaaatcccgactttcaggtcgatgaagagagcgaggaatttagactgctgaatcctctcgtatcaaagattagtgaaaaaagaaaaaagaagttaaggctcctcgaacagcaggagttgagggaaaaagaggaggaagaagaacctgagggcaagccctcagatgctgagtcttccgaaagcagcgacgacgagaaagcctgggtagaagaggtgcgaaagcagaggagactgttacagcaggaggagaaggtgaagcgccaggagcggctgaaagaagaccagcagaccgtactgaagccccaattttatgaaatcaaagctggtgaagaattcaggagctttaaggatagcgctacgaaacagaaacttatgaacaagacactcgaggaccgtctgaagattgaagcaaagaatgggactctcagcgtttctgacaccactgtcggtagcaagcagttgacatttactctgaagaggtcagagcagcagaaaaaacagcaagaggcggaaaaactgcataggcaggaaagaaagcggctcagaagatctgccggccacctgaagagccgccataagaggggacggtccttccattag

SEQ ID NO: 12613 - DNA, 2067 bp, Artificial Sequence
  Description of Artificial Sequence: Synthetic coding sequence
atgcaggtcagtagcctgaacgaagttaagatctacagcctgagctgtggaaaaagcctacctgagtggctctccgatcgcaaaaagagagccctccagaaaaaggatgtcgacgtaagaaggcgcattgagcttatacaggactttgaaatgcccaccgtgtgcacaacgattaaagtgtccaaggatggacagtatattctggcaactggcacatacaaaccccgggtaaggtgctatgacacctaccagttaagcctgaagttcgaaaggtgcctggattcagaagtagttacattcgaaatattatccgatgattattctaagatcgtatttctacataatgatcgatatatcgagtttcacagccagtcaggattttactataaaacccgaatcccaaagttcggacgtgacttctcataccattacccatcctgtgatctgtatttcgtgggcgcttcaagcgaagtgtatcggctgaatttggaacagggccggtacctgaatcctttgcagacagacgcagccgagaacaatgtctgcgacatcaattctgtccatgggctcttcgctaccggaaccattgagggtcgggtggaatgctgggaccctcgcacacgaaatcgtgttggactcttggattgtgcgttaaacagcgtgacagcagattccgagattaacagcctccccacaattagcgctctgaagtttaatggtgcattgactatggcagttggaacaacaacaggacaggtgctactgtacgacctgcggtccgacaagcccctgctcgtcaaagatcatcagtacggcctgccaattaagtctgtgcattttcaagatagtctggacttgattctttcagccgatagcagaattgtgaagatgtggaacaagaatagcgggaaaatcttcactagcctcgaacctgagcacgatctgaacgatgtctgcctgtacccaaacagcggcatgctactgacggcaaatgagactccaaagatgggaatctactatattcctgtgttgggccccgcaccacgatggtgtagctttttggataatctcactgaagaactcgaagaaaaccctgaatccactgtctacgatgactataaattcgtcactaaaaaggacctggagaacctcggccttacccatctgatcggttcccctttcctccgcgcctatatgcacgggttctttatggacattaggctgtatcacaaggtgaaactgatggttaatccttttgcctacgaagaatatcggaaggataaaataaggcagaagatcgaagagacgcgtgctcagagagtgcaacttaagaagcttcctaaggtgaataaggagctcgccctcaagctaatcgaggaagaagaggagaaacaaaaatctacatggaagaaaaaggtgaaaagcctccccaatattcttaccgacgaccgtttcaaagtcatgttcgaaaacccggattttcaagtagatgaagagtccgaagaattcagactacttaaccccttagtctccaagatatccgagaagaggaagaaaaaactccggctgctggagcagcaggagctcagagagaaagaggaagaagaagaaccggaaggaaagccttctgatgccgagtcttctgagtcaagtgacgatgagaaggcatgggtcgaggaagtacgcaagcagcggaggctgctccaacaggaggaaaaggttaagcggcaagaacgcctgaaggaggaccagcagacggtccttaagccccagttctacgaaattaaagccggggaagagtttagaagtttcaaggactcggctacaaaacaaaagcttatgaataagaccttagaggaccgtctcaagattgaggccaaaaacggtacactcagcgtgagcgatactaccgtgggcagtaaacagctgacttttacgctcaagcgatcggaacagcagaaaaagcagcaagaggctgaaaagctgcaccgtcaggagcgaaaaagattaagaaggtctgccggacacttaaaaagtcgacataaaaggggcagaagttttcattag

SEQ ID NO: 12614 - DNA, 1989 bp, Artificial Sequence
  Description of Artificial Sequence: Synthetic coding sequence
atgcaggtctcctcactgaacgaggtgaaaatctattcccttagctgcggtaaaagcctcccagagtggctctctgacagaaagaaaagggcattgcagaaaaaggacgtggacgtgaggcggagaattgaactgatccaagactttgaaatgccgacagtctgcaccacaatcaaagtttcaaaggatggccaatacatcctggctacagtcgtcacctttgagatcctcagcgacgactactccaagattgtgttcctgcacaacgacaggtatattgagttccatagtcagtcaggcttttactataaaacgcggatccccaaattcggacgcgatttctcttatcattaccccagctgtgacttatatttcgtgggggcttcatcagaggtgtaccggctcaacctcgaacagggtagatatttaaaccccctgcaaacggatgcagcagagaataatgtgtgtgacattaattccgtgcatggattatttgctacagggactatcgagggcagagttgaatgctgggaccccaggacccgtaatcgagtaggattgcttgactgcgcactgaactccgtcactgctgactcggaaataaattcactccctacgatctctgccctcaagtttaatggagcgctgacaatggcggtgggcacaaccactggtcaggtgttgctgtatgacctccgatcagataaacccctgctggtcaaagaccatcaatacggacttccgatcaaatcagtgcactttcaggactccctggacctaatcctttcagccgattcacggatcgtgaagatgtggaacaaaaatagcggaaaaatctttacctctctggagccagagcacgacctgaacgacgtatgtctgtatccaaattcaggaatgttactgacagccaacgaaacccccaagatgggtatttattacattccagttttggggccagcaccgagatggtgttctttcctggataatcttaccgaggaattagaggagaatccagagagtactgtgtacgacgactataagtttgtaacgaagaaagaccttgagaatcttgggcttacgcatctgattgggtctccattcctgcgcgcttatatgcatggattctttatggacattagactgtatcacaaagtgaaacttatggtgaacccatttgcctacgaggaataccgaaaagacaagatcaggcagaaaattgaggaaaccagggcccagagagttcagctcaaaaagctcccaaaagttaacaaggagctagcactcaaactcatagaggaggaggaggagaagcagaagtctacatggaaaaagaaggtgaaatctctgccaaatatcttgactgatgaccggtttaaagttatgttcgagaaccccgatttccaggtagacgaggaaagcgaggagttccggctgctgaaccccctggtgtccaagatctctgagaagaggaagaaaaagcttcgcttattggagcagcaggaactccgcgaaaaggaggaggaggaagagccagagggaaagccctcggacgcagagagtagcgaatccagcgatgatgaaaaggcgtgggtagaagaggttcgtaagcaacgacggttactacagcaagaagaaaaggtaaagagacaagagcgtctcaaagaagatcagcaaactgttctgaagcctcagttctatgagattaaggctggcgaggagttccgctccttcaaggattctgctaccaaacagaagctaatgaacaagactctggaggatagactgaagatcgaggccaagaatggcactttgagcgtgtctgacacaacagtaggctctaagcagctgacattcaccctgaagagaagcgaacagcaaaagaaacagcaagaagcagaaaagctccaccggcaggagcgcaagagattgaggcgctccgcagggcacttgaaatctcgacataaaagaggccgcagtttccattag

SEQ ID NO: 12615 - DNA, 1917 bp, Artificial Sequence
  Description of Artificial Sequence: Synthetic coding sequence
atgcccacagtttgtacgaccatcaaagtgagtaaggatggacagtatatactggccactggaacttataagcctcgggtgagatgctacgacacttaccagctgagcctgaagtttgaaaggtgtctggattctgaagtcgttactttcgaaatcctctcggatgattattccaagatcgtgtttcttcacaacgaccgctacatcgaatttcactcgcagtcaggattttactacaagactaggataccaaaatttggtcgagatttctcttaccactacccatcttgcgatctttactttgtaggggcaagctcagaagtttacagacttaatttggagcagggaagatatctgaacccgctgcagacggatgccgctgaaaataatgtttgtgatattaactcggtgcacggattgttcgcgactggaaccatagaaggtcgggtagaatgttgggatcctcgtacgcgtaaccgcgtaggcctcctggattgcgcactgaacagcgtgactgcggatagcgagattaactccctgcctaccattagtgctctcaagtttaacggagcccttaccatggctgttggcaccacgactgggcaggttctgctgtatgacctccgttccgacaaacccctgttagtgaaagaccatcagtacggtttgcccattaaaagcgttcactttcaggactccctggacttgatcttgtcggctgacagtcgcatcgtgaagatgtggaataaaaacagtggcaaaatatttactagcttggaaccagaacacgacctgaatgacgtgtgtctctatccaaatagtggaatgctcctgacagctaacgagacaccaaaaatggggatttactatataccagtattaggccctgccccccggtggtgttcgtttctggataacttaacagaggagcttgaggagaacccggagtccactgtatacgacgattataagtttgtcacaaaaaaggatttggaaaatttgggccttacccatctgatcggctctccctttctcagagcatatatgcacggcttctttatggacataagactgtaccataaagtgaaactgatggtcaatccattcgcctacgaggaatatcggaaagacaagatccggcagaagatagaagaaacaagggcacagcgcgtgcagctcaaaaaactccccaaagtaaataaagagctggccctgaaactaatcgaagaggaggaggagaagcagaaaagtacctggaagaagaaagtcaaatcactcccaaatatcttgaccgatgaccgatttaaagttatgtttgaaaatcctgactttcaggtggacgaagaaagcgaggaatttaggctgttgaaccctctggtcagcaagataagcgagaaacgtaagaagaagctccgactgttggagcagcaggagctgagagagaaagaggaagaggaagagcccgagggaaagccgtctgatgcagagtcgtccgaaagctcagacgacgagaaagcttgggtggaggaagtacgaaagcagagaaggctcctgcagcaggaagagaaagtcaaaagacaggagaggctcaaagaggatcagcagactgtcttgaagccccagttttatgagatcaaagccggagaggaattccgcagcttcaaggatagtgccactaagcagaagttaatgaataaaactctggaagacaggcttaagatcgaggcaaaaaacggaactctctcagtgtccgatacaacagttggatctaagcaactgacgttcaccctcaagcggtccgaacagcaaaagaagcaacaggaggccgaaaagttgcatcgacaggaaaggaagagattacgccggtctgctggtcaccttaaatctcgccacaagaggggacgatcttttcactag

SEQ ID NO: 12616 - DNA, 2160 bp, Artificial Sequence
  Description of Artificial Sequence: Synthetic coding sequence
atggctgctttagaggaggaattcacactgagttccgtggtgctgtcagcaggaccagaaggattactcggcgtggagcagagcgacaagacggatcagttcttggtgaccgattcggggcggaccgttatactgtacaaagtaagcgatcaaaaaccgctgggctcatggagcgtgaaacaggggcagattataacatgccctgccgtgtgtaattttcagactggagagtacgtggtggtgcacgataataaagtcctgagaatatggaacaatgaagatgtaaacctggacaaagtctttaaggctaccctgagcgccgaagtttataggattctgtccgtacaaggcaccgagcctttggttctgtttaaggagggcgccgtccgaggactggaggccttgctcgcagacccccagcagaaaatcgaaaccgtgatctccgacgaggaagtgattaagtggaccaaattcttcgtagtttttaggcacccagtcttgatctttattactgagaaacacggtaattacttcgcttatgtccagatgtttaattctcgtattctgacaaagtacacactgttactcgggcaggacgagaacagtgtcatcaaaagctttacagctagcgtggacagaaagttcataagtctcatgagcctctcgtctgatggatgcatctacgaaacactgattcctatccggcccgctgatcctgagaagaatcagtccttggttaagagcttactactcaaggctgtggttagtggaaatgccaggaacggtgtcgccttgacagcattggatcaagatcacgttgctgttttgggcagccctctggccgcttctaaggagtgcctcagtgtgtggaatatcaaatttcagactctccagacgtcaaaggagttgcctcaaggtacttcaggccaactgtggtactacggagagcatctgttcatgctccacggcaaatccctgacagttatcccttacaagtgtgaggtaagttctttggctggggcactcggaaaactcaagcattcccaggaccccggcacacacgtggtcagtcactttgtgaactgggagaccccccagggatgtggcttgggattccagaacagcgaacagagtcgccgaattctacgcagacggaagattgaggtttccctccaacctgaagttcctcctagtaaacaactcctctcgaccataatgaaagatagtgaaaaacacatagaggttgaggtacgaaagttcctggctcttaaacaaactcccgattttcacaccgtcatcggcgatactgtcaccggtctgttggagaggtgcaaagccgagccctctttttacccaaggaattgtctgatgcagctcattcaaacacacgtgcttagctactcactgtgtcctgatttgatggagattgctctgaaaaagaaggacgtgcagctgctgcaactctgtctgcagcaatttcccgacattcccgagtccgtgacttgtgcctgtctcaagatcttcctatccatcggggatgactcactccaggaaactgacgtcaacatggagtcagtattcgactattctattaattctgtgcatgacgagaaaatggaggagcagaccgagatcttgcaaaatggattcaatcccgaggaggacaaatgcaataactgtgatcaggagttgaacaaaaaacctcaggacgagaccaaggaaagtacttcgtgtccagtcgttcagaagcgcgccgctttactcaacgctattctccatagcgcctactcagagacgttccttctcccacatctcaaggacatcccagcgcaacacattaccctcttcctcaagtatctctactttctgtatctcaaatgtagcgagaacgccactatgacgctgcccgggattcacccaccaacattgaatcaaataatggactggatatgtcttctgctggacgcaaattttaccgttgtagtcatgatgcctgaagcaaagcggttactgatcaacctatataagctggttaagtcacaaataagcgtgtatagcgaactgaataaaattgaggtctcattcagagaactgcaaaaattgaaccaggagaaaaataaccggggcctttacagcattgaagtgctggaattgttttag

SEQ ID NO: 12617 - DNA, 1614 bp, Artificial Sequence
  Description of Artificial Sequence: Synthetic coding sequence
atgttcaacagtcgaatcctgaccaagtataccctgctgcttggacaagatgaaaatagtgttattaagagtttcacagcttccgttgaccggaagttcatcagcctgatgtcactgtcctcagacggctgtatttacgagacactgattcccataagacccgcagatccagaaaagaaccagtcactagttaagtccctgctgctgaaggctgttgtgtcagggaatgcccgtaatggtgtagctctgacagccctggatcaggaccacgttgccgttttagggtccccacttgccgcttctaaggagtgcttatcggtgtggaatataaagttccaaacccttcagacgtccaaggaactgccgcaaggaacaagcggccagctgtggtattacggtgagcacctgttcatgttgcacggtaagtctcttactgtgataccatataaatgcgaagtttcctccctcgccggagccctagggaagttaaaacattctcaggatccgggaacgcatgttgtgtcccactttgtgaattgggaaacgccccagggatgtgggctggggttccagaacagtgagcaatcacggagaattctgagacgtaggaagattgaagtgagtttacagcctgaggtgccccctagcaagcagctacttagtacgattatgaaggacagtgagaagcacattgaggttgaggttcgtaaattcctggcgctgaagcagacacccgatttccacactgtgatcggggatactgtgacaggcctgcttgaacgttgtaaagcagagccatctttctacccacgaaattgtctcatgcagttaattcaaactcacgttctatcatattcactttgtccagatctgatggagattgctttaaagaagaaggacgtccagctcctgcagctttgcctgcaacagttccctgacatccccgagagcgtgacttgcgcttgcctcaaaatcttcttgagcatcggcgatgactccctgcaggaaaccgatgtgaatatggagtcagtcttcgactatagcatcaattctgtgcatgatgagaagatggaagaacagacggaaatactccagaatgggttcaatccagaggaggataagtgtaacaactgtgatcaggagctgaataagaaacctcaggatgagacaaaagagtctacatcatgcccagtagtccagaagagggctgcgctcctcaacgccattctgcactccgcctattccgagactttccttctgccacacctgaaagacattccagcgcagcacatcacactcttcctgaagtatttatactttctgtacctgaaatgcagcgaaaatgcgactatgacacttcccggcatccaccccccaaccctgaaccaaatcatggactggatttgcctccttctcgacgccaatttcaccgtggtcgtaatgatgcccgaagcaaagaggcttctgatcaatctctataaacttgtcaagtctcaaatatccgtctactccgagctcaacaagattgaggtgtctttcagggaactgcagaaactaaaccaagagaaaaacaatagaggcctgtacagtatcgaggttcttgaactgttttag

SEQ ID NO: 12618 - DNA, 642 bp, Artificial Sequence
  Description of Artificial Sequence: Synthetic coding sequence
atgggaaggaataagaaaaagaagcgggacggcgatgacagaaggccaagacttgtgttatctttcgatgaggaaaagcgtcgcgaatatttaaccgggttccacaagaggaaagtggaaagaaagaaagcggcaatcgaagagataaagcaacgccttaaggaagagcagcgaaaactgagggaagaaaggcaccaggaatatctgaaaatgctcgctgagcgagaagaggccttggaggaagctgatgagcttgatcgcctggtgacggcaaagacggagtccgtgcagtacgaccatccaaaccataccgtgactgtgacaactatctcagatcttgaccttagtggggccagactcctaggactgacccctcccgagggcggagcgggcgaccgttcggaggaggaagccagctccaccgagaagcctacaaaggcgctgccaagaaagtcacgggatcccttactgagtcagcggatcagcagtcttaccgccagcttgcacgcccacagccgcaagaaggtgaagcgcaagcaccctcggagagcacaggatagcaaaaagcctccaagagcccctcggacctctaaggcccagaggcggagattgactggaaaagctcgacacagcggcgaatag

SEQ ID NO: 12619 - DNA, 642 bp, Artificial Sequence
  Description of Artificial Sequence: Synthetic coding sequence
atgggcaggaataaaaaaaaaaagcgggatggcgacgaccgcaggccaaggctggtactatccttcgacgaagagaagaggagggagtatctgacaggctttcacaagaggaaggtggagcgtaagaaagcggccatcgaggaaataaagcagcgcttgaaggaagagcaaagaaagttaagggaagagagacatcaagagtacctgaaaatgctagccgagagagaagaggctctggaagaggctgatgagttagatagacttgtgacagccaaaacagagtctgtacagtacgatcacccgaaccacacagtaactgtgacaacgatatctgacttggacctgtccggtgcccgacttctggggttgacaccccccgaaggaggcgcaggagacagatcagaggaagaagctagttcaacagagaagcccaccaaggcccttccccgcaagagcagggatccactcctttctcagcggatctcaagcctgacagcgagtctccacgctcatagccgcaaaaaggttaaacgcaaacaccctcgtagagcgcaagactccaagaaaccaccacgggctccaaggacttcaaaagcccagaggcgtaggctcactgggaaggcccgtcactctggagagtag

SEQ ID NO: 12620 - DNA, 1917 bp, Artificial Sequence
  Description of Artificial Sequence: Synthetic coding sequence
atggagtcagaaagagacatgtacagacagttccaagactggtgcctgcgaacttacggcgactctgggaaaacaaagaccgtgactcgaaagaaatatgagaggattgtccagctgctgaacgggtccgagtcctcaagcactgacaatgcgaagttcaagttctgggtgaagagtaagggctttcagctgggccagcctgacgaggttcgaggaggtggcgggggagctaagcaggtgctctatgtccctgtcaagacaaccgatggcgtgggcgtcgatgaaaagctctccctgagaagagtggccgtagtggaggatttttttgatattatttactccatgcatgttgaaactggccctaacggcgaacaaattagaaagcacgccgggcaaaagcgcacctacaaggccatatcagaaagctacgcattcctgccccgtgaagcagtgacacgcttccttatgtcgtgtagtgaatgtcagaaaaggatgcacttgaaccctgatggtactgaccacaaggacaacggtaaaccgcctactctagttacaagcatgatcgactacaatatgccaattacgatggcttacatgaaacacatgaaactgcagttactgaattcccaacaggacgaagacgaatcatccatcgaaagtgacgagttcgatatgagtgattctacacgcatgtcagccgttaatagtgacctgtctagtaacttggaggagcgaatgcaaagcccacagaacctgcacgggcagcaggatgacgacagtgctgcggaatcctttaacggaaacgaaactctcggccactcaagtattgcatccggaggaacccactcccgggaaatgggcgattcaaatagcgacggaaaaaccggtctcgaacaggacgaacaaccattgaacctgtcggatagccctttatctgcacagctgacatcagaatacaggatcgatgaccacaattccaacggtaaaaacaaatataaaaacttgctgatctctgatctcaagatggaaagggaggctagggagaacggctctaagagtcctgctcatagctacagcagctacgatagtggaaaaaacgaatcagttgacaggggcgccgaggatctgagtctgaacagaggagatgaagatgaggatgaccatgaggatcatgacgactctgagaaggtcaatgagactgatggagtcgaggccgaacggctgaaggcattcaatatgtttgtcaggctgttcgtcgatgaaaacctggaccggatggttcccatttcaaagcagccaaaggagaaaattcaggctatcatcgactcctgccggcgccagtttccagaataccaggagcgcgccagaaagagaattcgaacctacctgaagagctgcaggaggatgaagcgatcaggctttgagatgtcccgtccaattccttctcacttgactagcgccgtggccgaaagcattctggcctcagcttgtgaaagtgagagtaggaatgcggccaagcgcatgcgcctggagcggcagcaagacgaaagcgcaccagcagacaagcaatgcaagccagaggccactcaggccacttactcaactagcgcggttcctggctctcaggatgttttatatattaacgggaatggcacctattcttaccattcctaccgcggcctgggcggagggcttttaaatctaaacgacgccagctcatcaggaccaactgacttatccatgaagaggcagctggctacatcgtcaggcagttcctcaagttccaattcgcgaccacaactgagtcccacggaaataaacgctgtcagacagctagtggctggctatagagagagtgctgcctttctccttagatcagccgacgaactggaaaatctaattttacagcaaaattag

SEQ ID NO: 12621 - DNA, 1269 bp, Artificial Sequence
  Description of Artificial Sequence: Synthetic coding sequence
atgcacgttgaaactggccctaacggtgaacagattcggaagcacgcaggccagaagcgaacctataaggccatctccgagtcctatgccttcttaccaagggaggcagtgacaagatttctgatgtcctgctccgagtgccaaaagcggatgcatctgaacccagatggcacggaccacaaggacaacggcaaaccaccaaccctcgtcacctcaatgatcgactacaacatgcctatcacgatggcgtatatgaagcacatgaagctccagctgttaaacagccagcaggacgaggacgagtcgtctatcgaatctgatgaattcgacatgagtgatagcactcgcatgagtgctgtgaactcagacctttcctcgaacctcgaggagagaatgcagagtcctcaaaatttgcatggacagcaagatgatgattctgccgctgagtcctttaatgggaacgaaacactgggtcattctagcattgctagcggcggcacacactctagggaaatgggggactccaactctgatggcaagactggcttagagcaggatgagcagcccctcaatttgagtgactccccactgtctgctcaattgaccagcgaatacaggattgatgatcataacagtaacggaaagaacaaatataaaaatctgcttatctcggatctcaaaatggaacgggaggccagagaaaatggctcaaaatcacccgcccattcttactcttcctatgattcaggtaagaacgagtctgtggaccggggcgcagaagacctgagcctgaacagaggggatgaggatgaggacgaccacgaagaccacgacgatagtgagaaagtcaacgaaacagacggtgtggaggcagaaaggctgaaagcgttcaatgatgagagtgccccagctgataaacagtgcaagcctgaggccacccaggccacctacagcacatcagccgtaccaggatcccaggatgtgctgtacataaatggcaatggaacctacagctatcattcctatcggggcttgggcggagggctccttaacctgaatgacgcttcaagtagcgggccaaccgacttgtcaatgaaacgtcagctcgccaccagctccggctctagctccagctccaactctcggcctcagctgtcgccaacagaaattaatgccgtgcgtcagctggtggctggctatcgggagtcagcagcttttctgttgcgcagcgccgacgagctagaaaacctcatactgcagcagaactag

SEQ ID NO: 12622 - DNA, 600 bp, Artificial Sequence
  Description of Artificial Sequence: Synthetic coding sequence
atggaccagactatgttagatgattccgccgcagaaagcttcaacggcaacgaaacactcggtcactcatccatcgcctccgggggcacacatagtcgggaaatgggtgactcaaactcagacgggaagactgggctcgagcaggacgagcagccactgaacctgagcgactctcctcttagtgctcaattaaccagcgaatacagaatcgatgaccataattctaacggcaagaataaatacaaaaatctgttaatcagtgatctcaaaatggagcgggaggcccgcgagaatggatcgaaatcaccggctcattcatactccagttatgattcagggaagaacgagagtgtggaccggggcgctgaagacctgagtctcaaccgcggcgatgaagacgaggatgatcatgaagaccatgacgattcagaaaaagtgaacgaaaccgacggagtggaggcggagcggcttaaggcattcaattcgagaccgattccttctcacctgacctcagctgtagcagaaagcatcctggcctccgcgtgcgagagcgagtcccgcaatgcggccaaacgaatgcggttagaacgccagcagtag

SEQ ID NO: 12623 - DNA, 1062 bp, Artificial Sequence
  Description of Artificial Sequence: Synthetic coding sequence
atgggcgattctaattccgacggcaaaacgggcctggaacaggatgagcagcccttgaatctctctgactccccactgagcgcccagctgacctctgagtaccggattgacgaccataactctaacgggaagaataagtataagaacttgcttatttccgacctgaagatggaaagagaagcaagagaaaacggcagtaaaagcccggcgcattcctatagcagttatgactccggcaagaacgagagtgtcgataggggggcagaagacctgagcctcaaccggggggacgaagacgaggatgaccatgaagaccacgatgacagtgagaaggtgaatgaaactgacggtgtcgaggcggaacggctgaaggccttcaatatgttcgttaggctgtttgtggacgaaaacttagaccgcatggtccctataagcaagcagcccaaagagaagatccaggcgattatcgactcatgcaggcgacagtttccagagtaccaggaaagagcgcgtaaaagaatcaggacatacctgaagagttgtagaaggatgaaaaggtcaggattcgaaatgagtcgccctattccgtctcaccttacatcggcagtagccgaaagcatccttgcatccgcttgcgagtccgaatccagaaatgccgcaaagcgcatgcggctcgagaggcagcaggacgagagtgctcccgcggacaaacagtgcaagcctgaagcaacccaggccacatactctacctccgccgtgccagggtcgcaggatgtcctttatatcaacggcaacggcacctactcataccattcataccgcggcctaggaggggggttactcaatcttaatgacgccagttcaagcggtccaactgatttgtcaatgaagcgtcagctggcaacaagtagtgggtcttcgtcatctagcaatagtaggcctcagctgtctcctactgagatcaatgcagtccggcagctggtggctggttatcgtgagtcagccgctttcttactccgctctgcagacgagctggagaatctgatcctgcagcagaattag

SEQ ID NO: 12624 - DNA, 1260 bp, Artificial Sequence
  Description of Artificial Sequence: Synthetic coding sequence
atgtcgtgttcagagtgccagaagagaatgcacctgaatcctgacggtactgatcacaaagacaacggaaagcctccaaccctcgtgacttccatgatcgattataatatgccgattacaatggcttacatgaaacatatgaaactccagctgctgaatagccagcaggacgaggacgagtcttctattgagtcagatgaatttgacatgagcgactctactaggatgtctgccgtcaattctgacctctcctccaacctcgaagaacgaatgcaaagcccacagaatctgcacggccagcaggacgacgattctgccgccgagagcttcaatggaaatgagacattgggccacagtagcatcgcttccggcggaacacactctcgcgagatgggagactctaatagtgatggtaaaacaggtctcgagcaggacgaacaaccccttaacctgagtgattcccctctgtctgcccagttaactagtgagtataggatcgatgatcacaatagcaacgggaagaacaaatataagaacctgttaattagcgatctgaagatggaacgcgaggcaagggaaaacgggagcaagtctcctgcccatagttacagcagctacgattcaggcaaaaacgagagcgtggatcggggggcagaggatctctcactgaaccgcggagacgaggacgaagacgatcacgaggaccatgatgatagcgaaaaagtgaatgaaaccgacggggttgaggccgaacgattgaaagccttcaactctcgtcctattccttcccaccttacctctgcagttgcggagtccatccttgcaagtgcttgtgagtctgagtcccgaaatgcggctaaacgcatgaggcttgagagacagcaggacgagtcggcccctgcagacaaacagtgtaaacccgaggccacccaagctacatattctacctccgcagttccaggctctcaggacgtcctatatatcaacgggaatggtacctattcctatcactcctatcgcggactcgggggaggcctcctgaatttaaatgacgcctcttcttccggaccaaccgacctgagtatgaagagacagctggcaacatcttctggcagcagcagtagttccaatagccgaccgcaactgagcccaactgagattaacgcagttcgccaacttgtagccggctatcgcgagtctgccgcctttctgctgcgctcggccgacgaattggagaacctcattctgcagcagaactag

SEQ ID NO: 12625 - DNA, 1695 bp, Artificial Sequence
  Description of Artificial Sequence: Synthetic coding sequence
atggctgatctcatgcaggagacatttttgcatcatgcgactgatggagtgggggtggacgaaaagttgtccttgcgccgtgtcgccgttgtagaggattttttcgacatcatctattcaatgcatgttgagactgggccaaacggcgagcagatcaggaaacacgctgggcagaaaaggacctataaggccatcagcgagagctatgcattcctgcccagagaggcagtcaccagatttctgatgagctgctccgaatgtcagaagaggatgcacctcaacccagatggcacagaccacaaagacaacgggaagccacccacgctagtgactagtatgatcgactacaacatgccgattactatggcatatatgaaacatatgaaacttcagctcctgaactcccagcaggatgaagacgaaagctcaattgaatccgatgagttcgacatgtccgatagcacacgaatgagcgcagttaactctgatctgtcatccaatttggaggagcgcatgcagtctccccagaatctgcacggccagcaggacgatgattctgccgcagaaagctttaacggcaatgaaactctaggacattcttcaattgcctccggcgggacgcactcacgggagatgggtgattcaaattctgatggaaagaccgggctggagcaggatgaacaacccctaaacctttcggattctcctttaagcgcccagctcacctccgaatacaggattgatgaccataatagtaacggtaaaaacaaatataagaatctccttatttctgatctgaaaatggagcgcgaagcgcgcgagaatggctcaaaatcccccgcacattcttactcctcatacgactctggaaaaaacgagtccgtcgatcgcggagctgaagatttgagcctgaatcgtggcgacgaagacgaggatgatcacgaggatcacgacgattccgaaaaagtgaatgagacggacggtgtggaggctgagagactgaaagcatttaatatgtttgtacggttgttcgtggatgagaacctggatagaatggtacccattagcaaacagcctaaggaaaaaatccaggcaattattgactcatgcaggcgtcagttcccagagtaccaggaaagggcaaggaagaggatccgtacttacctcaagtcatgccggcgtatgaaaaggtccggcttcgaaatgtctcgaccgattcctagtcacctgacaagcgccgtggccgagtctattctggcaagcgcctgtgagtccgaaagcaggaacgctgccaaaaggatgaggctggagcgccaacaggatgagtctgcgcccgccgacaaacagtgtaaacccgaagccactcaggccacttattccacctccgcagtccccgggtcacaggatgtgctctacattaacggcaatgggacttactcgtaccatagctatcgcgggctggggggagggctgcttaatttgaacgatgcttcatcctccgggccaacagacctctctatgaagcggcagctggccacctcctctggcagctcttcaagctcaaacagtcgtcctcagctgtctcctacagagatcaacgctgtacggcagcttgtcgccggatacagggagtctgctgcctttttgctacggtctgcagacgaattagagaacctcatcctccagcagaattag

SEQ ID NO: 12626 - DNA, 2109 bp, Artificial Sequence
  Description of Artificial Sequence: Synthetic coding sequence
atggctgatagcggtctgctgctgaagagaggctcctgcaggtctacctggcttcgggtgcggaaagccaggccacagcttatcctctctaggagacctcggcgccgactggggtctctgaggtggtgcggcagacgtcggttgcgatggcgcctactgcaagcacaggcctcgggagtggattggagggaaggagctcgacaggttagtagggctgcagccgcccgcaggccaaatacggccaccccttcgccaatcccaagccccactcccgccagcgagccagaatctgagccagagcttgagagcgcttcctcatgccaccgtccgcttctaatccctcccgtccgccccgtcggtccgggcagggccctactgctactccctgtcgagcaggggttcactttttcgggaatatgtagggtgacttgcctgtacggacaggtgcaggtgtttggattcacaataagccagggtcaaccagctcaagacattttctcagtctatacgcattcttgtttgtccatccatgctctccattattcccagcctgagaagtcaaagaaggaacttaagcgcgaggcaagaaacctcctgaaatcccacttgaacctagatgatcggcggtggtccatgcagaacttcagtcctcagtgttctatcgtgcttctggaacacttgaagacagctaccgtaaactttataaccagttatccggggagcagttacatattcgtgcaagaatcccctacaccccaaatcaagcctgaatacctggcgctccgtagtgtcggcatcaggcgggaaaagaaacgaaagggcctccagctgaccgaatccactctgagcgcacttgaggagctggtgaacgtgtcctgcgaagaagtagatggatgtcccgtaatactggtgtgcggctcacaggatgtcggtaaatccactttcaacaggtatctcatcaaccatctgttgaactccctaccttgtgtcgactacctggaatgtgatttgggacaaactgagttcactcctcctggctgtatttcacttctcaatatcaccgagcccgttcttggtcctccgtttacccacctgaggacgccccaaaaaatggtctattacgggaagcctagctgtaagaacaactacgaaaattacatcgacattgttaaatacgtgttctctgcctacaagcgagaatcgcccctcatcgtaaacaccatgggctgggtatcagaccaaggcctgctgctgttgatcgacttgattcgcttgctgtctccctcccacgtcgtccaattccgatctgaccactccaagtatatgccggacctgaccccccagtacgtcgacgatatggacggcctgtacactaaaagcaagacaaagatgcggaacagacggttccggctggccgcgtttgctgatgctctggagtttgccgatgaagagaaggagtcgccagtggaattcacgggtcacaagctcattggggtctacaccgatttcgccttccgaattactccacgtaatcgggaaagccacaataagattctgcgcgatctcagtatcctgagctatttgagccagctgcaacctcctatgccaaaaccactcagccctctccactcattgacgccttatcaggtgccgtttaatgcggtggctctccgaattacacactctgatgttgcaccaacacacatcctttatgccgtcaatgccagctgggtgggcctgtgtaaaatccaggacgacgtccgggggtatactaatggccccattcttcttgcacagactccgatctgcgattgcctggggtttggcatctgtaggggcattgacatggagaaaagactgtatcacatactgactcccgttccgccagaagagctccgcacggtaaactgcctgctggtgggcgcgattgcaatcccccactgcgtgctgaagtgtcaacgagggatcgagggtacagttccatatgtcacaaccgattataattttaaactgcccggggcctccgaaaagatcggagcccgggaacctgaggaggcgcataaagaaaaaccataccggaggccaaaattttgcaggaagatgaaatag

SEQ ID NO: 12627 - DNA, 2583 bp, Artificial Sequence
  Description of Artificial Sequence: Synthetic coding sequence
atggcagcctccaggtctgctggagaggcaggacccggcgggtcacaggggagagtcgtccgtatgaaaagacggggcgggaggggacccagacgcggcccagctgggggtggtgaaaaggcgctgaaaaggcttaaactggccgtggaggagttcgttcatgctaccagcgagggtgaagccccaggcgggtgcgagggtaggggagcccccgtctcatttaggcctggcggacgcaaatcacggaaagagctccgtaaggagaaaaggcatctcaggaaagcaagacgattacagcggaccgctggccccgagcaaggtccagggttgggcggacgaagcggcgcggaggaagcctctggacaccggcaggacactgaagagagggcaagacccgcccctagccgggacccatcccccccaagaaagccaaggccctctcgtgtcaaggcaaaggccaccgcagctacagcaaaaacacggccatccgccgccgctacggctgccgcaagaaaacgcgcactcctggctgctaatgaggaggaagatcgggaaattaggaaacttgagcgctgcttgggcttgaataagcgcaaaaagaaagacgggagttcctctgtgcccttatctttcgcaagagatggtctcgattacatcttgggggcactggaatcaggaaagaattctggcctgtacgactcttcaggagaggaggaagaggacgcgggccagacgctgcctgagtcggatctggagagcgatagccaggacgaatctgaggaagaagaagaaggtgatgtagaaaaggagaagaaggcccaggaggcggaggcccagagtgaggacgacgacgaggataccgaagaggaacagggggaggaaaaagaaaagggtgcccaggaaaagcgccgtggtaagcgcgtgagattcgccgaggacgaagagaaatctgagaacagctcagaagatggggacattaccgacaaatcactgtgcgggagcggggagaaatatatccctcctcacgtgagacaggccgaggagacagtggacttcaagaagaaagaggaattggagagactgaaaaagcacgtcaagggtctccttaatcggctgtccgaacctaatatggccagcattagtgggcagctcgaggaactgtacatggctcattctcggaaagatatgaacgacacgcttacatcggcactgatgggcgcctgcgttacagccagcgccatgccttctaggctcatgatggaacatgtgctgctggtgagtatactacaccacactgtggggatcgaagtgggagcccacttccttgaagcagtagtgcgtaagtttgatgctatctacaaatacgggagtgagggaaaggagtgtgacaacctctttacagtcatagcccacttatacaacttccacgttgtgcaaagtcttttgatcttcgacatcttgaagaaactcattggaactttcacggagaaagacatcgagctgattctgctaatgctgaagaatgtgggattctcactgaggaaagacgatgccctgtctttgaaggagttaataacagaggcacagacgaaggcttccggggccggcagcgagtttcaggaccagacacggattcgatttatgctcgaaaccatgctggcgttgaagaataatgacatgaggaagattcccggttatgaccctgagcccgttgagaagctacgcaagctgcaaagggctctcgtgagaaacgctggaagcggctcagaaacccagctgagggtgagctgggactccgtattgtctgcggaacagacaggacgctggtggatcgtcgggtctgcctggtccggcgcccctatgatcgacaacagccaccatacacatttgcagaaacaactggttggaacagtgtccagtaaaatcctcgaacttgctaggaagcagcggatgaatactgatattcgtaggaatatcttctgcaccataatgacctccgaggatttcttagatgccttcgagaaactgctgaaactggggctcaaagatcagcaagagcgtgagattatccacgtactcatggattgttgcttgcaggagaaaacatacaacccattttatgcattcctggcgagcaagttttgcgagtatgagagaagattccagatgacgtttcagttctccatctgggacaagtttagagacctggagaatctaccagcgacaaatttctcgaacctggttcacctggtggcccatcttttgaagactaagagtctttctttatcgatcttaaaagtcgttgaattctccgagctggataaaccccgggttagattcctgcgcaaagttctctccattcttctgatggagaccgaagtagaggacctgagcctgattttcacgcgtgtgagcgacaaccccaaattgggggtgttaagagagggactgaagttatttatttcccacttccttctgaaaaatgcccaggctcatcgctctgcggacgaggctaacgtgctgagggaaaaggccgatctcgcgacaaagtgtctgcaggggaaagctagtttgaggatgtag

SEQ ID NO: 12628 - DNA, 4917 bp, Artificial Sequence
  Description of Artificial Sequence: Synthetic coding sequence
atggccgctgccgctggaggcccttgcgtgcgcagcagtagagagctctggactattctgttaggcaggtcggcccttagggaactgtctcaaatcgaggcagagttgaacaaacactggcgccggctgctggagggtctaagttactacaagccaccttctccctcatctgctgaaaaggtaaaggctaacaaggacgtggcgtcccctctgaaggagctcggactgcggatatctaagttcctcggacttgacgaggagcagagcgtgcagctactccaatgttacctccaagaggactataggggcactcgggactccgtgaagacggtgctctatttcgaaatggcccccagcgatctgttagtgctgaccaaaatgtttaaagaacagggatttggatcacggcagacgaatcgacacctggtggacgagaccatggacccgtttgtcgacagaatagggtacttcagcgctctgatcctggtggagggaatggacattgaatctttgcacaaatgcgctttggatgaccgccgggaattgcatcagtttgcgcaggatggtctcatctgtcaggatatggactgtctcatgctcactttcggggacattcctcaccacgcccccgtgctactcgcctgggccttgctccgacacacactcaaccctgaggaaactagttctgtagtccgtaaaattggcggcaccgccatccaactgaatgtgttccaatatctgaccaggctgttgcagtctcttgcctctgggggcaacgattgcactaccagcactgcatgtatgtgtgtgtatgggctgctgtccttcgtgctcacatccctggagctgcacactctgggcaaccagcaagacattatcgacactgcatgcgaggtgctggccgacccctccttacctgagttgttttggggtaccgaaccgacgtctgggcttggcattatccttgattctgtctgcggaatgttcccacacctcttatcacctcttctgcagctacttcgcgcactggtaagtgggaagtccacagcaaagaaagtgtattcatttcttgataaaatgagtttctataacgaactgtacaaacacaagccacatgatgtgattagtcacgaggacggaacactgtggcgccgccagaccccgaaattactttaccccctgggtggtcagacaaatttgcgcattccccagggaactgtggggcaggtgatgctggatgaccgcgcatacctggttcgctgggaatattcttacagcagttggactctgtttacctgcgagatagaaatgcttctgcatgtcgtgagtaccgcagatgttatccagcattgccagcgggtcaagcccatcatcgatctggtacataaagtaatttctaccgatctgtctattgccgattgcctacttccaataacgtcaaggatctacatgctattacagaggctgacaactgtcatcagtccgcctgttgatgtgatcgccagctgcgtgaactgtctgactgttctggccgcacgaaaccccgctaaggtttggacagacttgagacacactggttttctgcctttcgttgcgcatcctgtgtcctccctctcacaaatgatctctgcagagggtatgaatgctggcggctatggtaacctcctgatgaactcagagcagccacagggcgagtatggggtgaccattgccttcttgcgtctgattaccacactggtgaagggacagttaggaagcacccaaagccaggggctggtgccatgcgtgatgtttgtgctgaaagaaatgctgccatcttatcataagtggagatacaattctcatggggtgcgtgaacaaatcggatgcctaatcttagagctgatccatgccatccttaatctttgtcatgaaaccgacctccactcctcccacactccttctcttcagttcctgtgcatttgttcgctcgcatatactgaggctggacagacagtcatcaatattatgggtattggcgtggacactatagacatggtcatggctgctcagcctcgaagtgacggcgccgaaggccaggggcaaggtcaattgcttatcaaaacagttaagctggccttctctgtgacaaacaacgtgattagactgaaacctccatcaaacgtagtcagccctttggaacaggcgctatcacaacatggagctcatgggaataacctcattgcagtgctggccaaatatatctaccacaagcacgaccccgcactgccacgacttgccattcaattactgaaacgactggctaccgtggcgcccatgtcggtgtatgcgtgcctgggaaatgacgccgctgccattcgggatgcctttttaacccgactccagagcaagattgaggatatgaggatcaaagtgatgatcctggagttcttgaccgtcgcagtggagactcaacctggactgatcgagttgtttcttaaccttgaagtgaaagatggttctgatggatccaaggaattctctctagggatgtggtcatgcctacacgccgtgttagagttgatcgatagccaacagcaggatcgctactggtgtccccctcttctgcatagggctgctatcgctttcctgcatgcactgtggcaagatagacgtgacagcgctatgctggtcttgaggactaagcctaagttctgggagaatctaacgtcaccactttttggtacattatccccaccaagcgaaacctccgagccaagtatcctggaaacttgcgctctgattatgaagataatctgtctggaaatttactacgttgtgaaggggagtctcgatcagtcactcaaagataccctgaagaaattcagcatcgagaaacgatttgcttactggtcaggctacgttaagtcccttgcggtacacgtggctgagactgagggctcctcatgtacaagtctccttgaataccagatgctggtttctgcatggagaatgctgttgattatcgccacgacccatgctgacataatgcatctgactgattctgtggtgcgtcggcagttattcttagacgtgctagatggaaccaaggccctgttgctcgtgcctgcgtctgtgaactgtttacggctagggtccatgaagtgcacactgctgttaatcctgctccgtcaatggaagagggagttggggagtgttgatgaaatattaggaccactcacagagatcctggagggggttttacaggccgaccagcaactcatggaaaagacgaaagcaaaggtgtttagcgcttttatcactgtgcttcaaatgaaggagatgaaagttagcgacatcccgcagtacagccagctggttctcaatgtctgtgagacactccaggaggaagtcatcgctcttttcgaccaaactagacactcactagccctgggctctgccaccgaggataaagactctatggagactgatgactgctcgcgatcacgccatagggaccagagggatggcgtatgcgttctcgggcttcacctcgccaaggagctgtgcgaggtggatgaagatggcgactcatggcttcaggtgacccgtaggctacccattcttccaaccctcctcactactctggaggtctctttgcgcatgaagcagaacttgcattttactgaggccactcttcaccttctgctcacattggccaggacccagcagggggctacagctgttgctggcgccggcatcacacagtcgatttgcctgcccctcttatcggtgtatcagctgagcactaatggcaccgctcagacaccctctgccagcaggaagtctttggacgccccgagttggccaggagtatatcgactcagcatgtcactgatggaacaattgcttaagaccctgaggtacaacttcctgcctgaagcccttgacttcgtgggcgttcatcaagagagaacgctgcagtgcctaaatgccgttcgcacagtgcagagcctagcctgcctggaggaggccgatcatacggtgggatttattcttcaactctctaactttatgaaggagtggcacttccacttgcctcagctcatgagagatattcaagtgaacctgggatacctctgccaagcatgcacgtcccttcttcacagtagaaagatgctgcagcattaccttcaaaacaaaaatggcgacggcctcccctcagcagtcgcccagcgcgtccagcggccaccatcggcagccagcgccgctccctcttcaagtaagcaaccggccgccgatacagaggcttctgaacaacaggctctccacaccgtgcaatatggcctgctgaaaatcttgtccaaaacactggctgcccttagacacttcacacctgacgtgtgtcagatactgctggatcagtctttggacctggccgagtataatttcctcttcgccctgagtttcacgacaccaacctttgacagcgaggtcgccccctcttttggaaccctgctggcgactgttaacgttgcattgaacatgctgggcgaactggataagaagaaagaaccgctgacacaggccgttggactcagcacacaggccgagggcacccgaactttgaagtccttgttgatgtttacaatggaaaactgtttttacctgctcatttcccaagcaatgagatacttgcgcgatcctgcggtacacccaagggacaagcagcgcatgaagcaggagctgagcagtgaactgtccaccctgttgtcaagcctgtctagatatttccgcaggggagctccaagtagtcctgccacgggagtacttccctcccctcaggggaaatccactagcctgtccaaagcatctcctgagtcccaggaacctctgattcagcttgttcaagccttcgtgaggcacatgcagcgctag

SEQ ID NO: 12629 - DNA, 5250 bp, Artificial Sequence
  Description of Artificial Sequence: Synthetic coding sequence
atggccgccgctgccggtgggccctgcgttcgctcctctcgtgagctgtggaccatcctgcttggccgctcagctctgcgggagctgagtcagatcgaagccgagctgaataagcattggcgtcggttactggagggactatcctactacaagcccccatcgcccagctctgctgaaaaggttaaggctaataaggatgtagccagcccattaaaagagctggggcttcggatatcgaaatttcttgggttggatgaggaacagtccgtgcagcttctccagtgctatctgcaggaggattatcgcggcacgcgggactccgtcaaaactgtcctgcaggatgagcgacaaagtcaagcattaattcttaaaatcgccgactattactacgaagagaggacatgcatcctgaggtgcgtcctgcatctgctgacctacttccaggatgagaggcacccatatcgcgtggaatacgccgattgcgtggacaaactggagaaagaactcgtgagtaaatatagacaacagttcgaagagctgtacaagaccgaagccccaacatgggaaacgcatggcaacctgatgaccgagcgacaggtctccaggtggtttgtgcagtgtttgcgtgagcagtcaatgctcttagaaattatattcctctactacgcttattttgagatggccccaagcgacctgctagtactgacaaagatgttcaaagagcagggtttcgggtctaggcagacaaatagacatctggttgatgagaccatggatccttttgtggatcgaataggatatttctccgcactgattctggtcgagggcatggatattgagtcacttcacaagtgcgcgctcgacgatagacgagagttgcaccaattcgctcaggacgggctgatctgtcaggatatggactgtctcatgctcacctttggggacatacctcatcacgcacctgtgctgctggcatgggcgctgttaaggcatactctcaatccagaggaaacgagttctgttgttaggaagattgggggcacagccatccagttgaatgttttccaatacctgacccggcttctgcagagtctggctagtggcggtaacgattgtacaacctctaccgcgtgcatgtgtgtatacgggctgcttagcttcgtcctcacaagcttggaactccacacgctcggtaaccagcaggatataattgataccgcctgcgaagtgctagctgacccttctcttccggagttattttggggcaccgagcctactagcggacttggtatcattctcgattctgtgtgtggcatgttcccgcatctactgagtccacttttgcaactacttagagccttggtcagcggaaaatcgaccgccaagaaagtatacagcttcctggataaaatgtccttttataatgaattatacaagcacaaaccacatgacgttatctcccatgaagatgggaccctatggaggaggcagactcctaagcttttatatccgctgggaggacagacaaatttaaggatcccccaggggacagtcggtcaggtgatgctggatgatcgcgcgtacctcgtgcgttgggagtactcgtattccagctggaccctgttcacctgcgaaatagaaatgttacttcacgtggtctccacggcggacgtgatccagcactgtcagcgagtcaaaccaattatcgatctcgtccacaaagtcataagcactgatctgagcatcgctgactgcctcctgcccattacaagtaggatttatatgcttcttcaacggttaacaactgtcatttcgccacctgttgacgttatcgctagctgtgtgaattgcctcacagtcctggccgctcggaacccggccaaggtgtggacagacttaagacacacaggctttctcccgtttgtcgctcacccagtcagttctctgtcgcaaatgatatcagccgaagggatgaatgccggtgggtatgggaacctcctcatgaattctgaacagccgcagggagagtacggagtaacaatagcttttctgcggctcataactaccctggtgaaaggacagctggggagtacacagagccaaggccttgtaccttgcgtcatgtttgttctgaaggaaatgctgccgagctaccacaagtggaggtacaatagccacggcgtacgtgaacagatcggctgcttaatcctggagttgatccatgcaatcctgaacctctgccacgagaccgacctacattcaagtcatacaccaagcttgcaatttctgtgtatttgctctcttgcttataccgaggccggacagaccgtaattaacattatgggtatcggggttgataccattgatatggtgatggcagcacagcccaggagtgacggggccgagggtcagggacaaggccagttattgattaaaacagtgaaacttgccttttcagtcaccaacaatgtcattaggctgaaaccgcctagcaacgtggtgtccccactcgaacaagccctgtcacagcacggcgcccacgggaacaacctgatagcagtgcttgctaagtatatttaccacaaacatgatccagctttgcctaggctcgcaattcagctcctgaagaggctagccacagtggcacccatgagcgtgtatgcttgcctgggcaatgacgccgctgccattagggacgcctttttgactcgtcttcagagcaagatagaggatatgcgcatcaaggtgatgatactcgagtttcttactgtggccgtggagacacagcctggcctgatcgaactgttcctgaatttagaggtgaaggatggtagcgacggttcaaaagagttttctctagggatgtggtcatgtctacatgctgtgctcgagctgatcgacagtcagcagcaagatcgttactggtgtcctcctttactccaccgggcagctatagcatttctccatgcactgtggcaagatcgccgtgatagtgctatgcttgtcctcaggactaagcccaagttttgggaaaatctgacatctccattattcggaacgctcagtccacccagcgagacttcagaaccgtcaattctggaaacttgtgctctgattatgaaaataatttgcttagagatctattatgtagtgaaaggatcccttgatcagtctttgaaggacaccctgaaaaagttctctatcgaaaagcgattcgcctattggtcagggtatgtcaaatctcttgccgttcatgtggcagagaccgagggctcctcctgcaccagcttactggagtaccagatgctcgtgagcgcatggagaatgctgttgattatagcaaccacccacgctgatatcatgcacctcacagacagcgtcgtgcgccgccagctgttcctcgacgtcctggacgggacaaaggctttactgcttgtccccgcctctgtcaattgcctccgccttggctctatgaagtgtaccttgcttttgatactcctcaggcagtggaagcgagagctaggctcggtggacgaaattcttgggccccttactgagatcctggagggtgtgctccaggccgatcaacagctgatggagaagacgaaagctaaagtgttctctgctttcataaccgtgctacagatgaaggagatgaaagttagcgatatcccgcaatattcacagctagtgctgaatgtctgtgagacactgcaagaagaggtgattgctctctttgatcagacaagacactctcttgctttgggctcggcaaccgaggataaagacagcatggaaactgatgactgctcccgtagcaggcatcgcgatcagagggatggcgtgtgcgtgctggggcttcacctggcgaaagagttgtgcgaggtggacgaggacggggactcctggctgcaggttactcggcgcctcccgatcctgcccaccctgctcaccactctggaggtgtctttacgcatgaaacaaaacctccatttcaccgaagcgacgctccacctcctgttaactctcgcacgcacccaacagggtgccacggctgtcgccggggcgggcattacccagagcatatgtctccctcttttgtcagtgtatcagctgtctacaaatggtactgcacagacgccaagcgcctctcggaagtctctggacgctccctcgtggcctggtgtctatcggctctccatgagcctcatggagcaactccttaaaacactgagatataacttcctccctgaggctctggattttgttggagtgcaccaggaacggactctgcagtgtctgaacgctgtcagaacggttcagtcactggcatgcctagaagaggccgatcacactgttggattcatcctgcagttgagcaactttatgaaagagtggcacttccacctcccccaactaatgagggacatccaagtcaatctggggtacctgtgccaggcctgtacctctctcttacactctcgaaaaatgctgcaacattatttacagaacaagaatggcgacggcctacccagcgcggtggctcagcgtgttcaacgtcctccttctgcagcctctgccgccccatcatcctccaaacagcctgcagccgataccgaggcttctgagcaacaagctctgcacacagttcagtatgggctgctgaaaattctctcaaagactctcgcagcactgagacatttcacacccgacgtttgtcagattctactggaccagagtctggacctggcagagtacaacttcttatttgccctgagctttaccacacccacatttgactctgaggtcgcgccgtccttcggcaccttgctcgctaccgtcaatgtagccttgaacatgctgggcgagctggacaaaaagaaggagcccttaactcaggccgtgggactctccacacaggctgaaggcactcggaccctgaaaagcctccttatgttcaccatggaaaattgcttctacctcctcatatcgcaggctatgagatacctgagggaccctgcagtgcatcctcgggataagcagaggatgaagcaggaattatccagtgagctgagtactttactgagctccctaagtaggtatttcaggaggggtgctccttctagtccagctaccggtgtcctgcctagtcctcaaggaaagtcgacaagcctcagtaaagctagccctgagtcccaggagcctttgatccagctggtacaggcatttgtccggcacatgcagcgctag

SEQ ID NO: 12630 - DNA, 219 bp, Artificial Sequence
  Description of Artificial Sequence: Synthetic coding sequence
atgcagttcacttcaatttcaaatagtctgacctcaacagctgccattggattgagcttcaccacatcaacgaccactactgctacattcaccacaaatacgacaaccacaataaccagcggcttcactgtcaaccagaaccagctgctttcacgcggattcgaaaatcttgtgccctacaccagcactgtgcgctttgtcttttacatggaaaaatag

SEQ ID NO: 12631 - DNA, 801 bp, Artificial Sequence
  Description of Artificial Sequence: Synthetic coding sequence
atgcagttcacatccatttccaattcacttacctctaccgcggcaatcgggctgagtttcactaccagtaccactactacagccacgtttaccacgaataccactacaactattacgagcggttttactgtgaaccagaaccagttgttaagtagaggatttgaaaatctcgttccatacacaagtacagtttcagtcgttgctacgcccgttatgacttatgggcaccttgaaggactgatcaacgaatggaatttggaattggaggaccaggagaagtattttctcctacaggctacacaggttaatgcctgggaccatactctgatcgagaacggagagatgatcaggatcctacatggcgaagttaacaaggtaaaacttgaccagaagcggctggagcaagagttagattttattctgagccaacaacaggagttggagttcctcttaacatacctggaggagtctaccagggaccagtctggcctgcactatctgcaggacgctgatgaggagcacgtcgaaatctaccggctcgccgaatccattgatgcacagttaaagcagatggcacaggacctgaaggatgtggtcaatcatctgaacacctttgaatcttcttcagataccaccgatcctctccaccagatttgtcgtatcctgaacgctcacatggattcattgcaatggattgacagaaattccgggatgttacgccgcaaggttgaagtggtgacgagggtgttcgaggactacaggcacgaagagcatgcccacaacgttaataccgccttctag

SEQ ID NO: 12632 - DNA, 555 bp, Artificial Sequence
  Description of Artificial Sequence: Synthetic coding sequence
atgcaattcacgagcatcagcaacagtctcacaagcactgctgctatcgggctttcatttacaacttcaactacaactacagccacctttaccactaacacaacaactactatcacctccggatttaccgtaaaccagaatcagctcctgtccagaggtttcgaaaacctcgtcccctacacttctacggtcagcgtggtggcaactcctgtgatgacctatgggcaccttgaggggcttataaacgagtggaatttggagttagaagaccaagagaagtacttcctgctccaggccactcaggttaacgcctgggatcacacactaatcgagaacggcgagatgatccgcattctgcatggtgaggttaacaaagtgaaactggaccagaagagactcgagcaggagctcgattttatactgtcgcagcagcaggagcttgaatttcttcttacctatttggaggagtcaactcgagaccaaagtggccttcactatttgcaggacgcggacgaggagcatgtggagatctccacccggagcgccgaattttag

SEQ ID NO: 12633 - DNA, 411 bp, Artificial Sequence
  Description of Artificial Sequence: Synthetic coding sequence
atgcagttcacctctatttcaaattccctcacctctacagcagctatcgggctctcctttaccacttcaaccaccacaactgccacttttactactaacaccacaaccactattacgagcggattcaccgttaatcagaaccaactgctctctcggggcttcgagaaccttgtgccttacactagtacagtcagtgtagtcgcaacccctgtgatgacctacgggcacttagagggattgatcaatgagtggaatctggaactggaggaccaggaaaaatactttctgttgcaggcaacccaagtgaacgcctgggatcataccttgatcgagaacggcgaaatgattaggattctgcacggggaagtaaacaaagtcaaactggaccagaagcgactcgaacaggaatag

SEQ ID NO: 12634 - DNA, 597 bp, Artificial Sequence
  Description of Artificial Sequence: Synthetic coding sequence
tagcccgttatgacttatggacacctcgagggcctgataaatgaatggaacttagagctggaagaccaggaaaaatatttcctgctgcaggccactcaggtgaatgcctgggatcacaccctgattgagaatggagagatgatacgcattctccacggggaggtaaacaaggtaaagctggatcagaaacgtctcgaacaagagcttgattttattttatctcaacagcaggagcttgaattccttttaacttacctcgaggagtctaccagggatcaatcaggactgcattatcttcaggatgcagatgaggagcacgtggaaatctacaggctcgccgaaagtatcgatgctcagctgaagcagatggcccaggatctgaaagacgtggtgaaccatctaaacacgtttgagtcatcttccgacaccaccgatcctctgcaccagatctgtcgtattctgaatgcccacatggattccttacaatggatcgaccggaattccgggatgctgaggcgcaaggtggaagtggttacccgagtctttgaggactacaggcacgaggagcacgcacacaacgttaacacggccttttag

SEQ ID NO: 12635 - DNA, 1383 bp, Artificial Sequence
  Description of Artificial Sequence: Synthetic coding sequence
atggccgaaagcgagaatcgaaaggaactgagtgaatcatcgcaggaggaagctgggaatcagataatggtagaggggttgggggaacatcttgagagaggggaagacgctgccgccggcttgggcgatgacggaaagtgtggcgaggaggcagccgccggcttaggcgaagaaggggaaaatggagaagatacagccgccgggtcgggtgaggatggaaagaaaggtggggacacagacgaagattccgaggctgaccgtcccaaaggcttaatagggtatgtgctcgatactgattttgtggaatccttaccagtcaaagttaaatacagggtgctcgcccttaaaaagcttcagacgagagccgctaacctggagtctaaatttctgcgtgaattccacgacatcgaacgaaaattcgccgagatgtatcagccactactcgaaaaaaggagacaaatcattaacgctatttatgaaccgactgaggaggaatgcgaatataaatccgactctgaggattgcgatgacgaggaaatgtgtcacgaagagatgtacgggaacgaagagggcatggtacacgagtatgtggacgaggacgatggctatgaggattattactacgactacgccgtggaggaagaagaagaggaggaagaagaggatgacatagaggctacaggcgaggagaataaggaggaggaagacccaaagggcatcccagacttttggctcactgtgttgaagaacgttgatactctcacccctctcattaaaaagtatgacgagccgattctgaagctgttaacagatattaaggtgaagttgtccgacccaggagagcccctctcttttacacttgagtttcacttcaagcctaatgagtacttcaagaacgagctcttaacaaagacctacgtgctgaagtctaaactcgcatactatgacccacatccctacaggggcacagcaatagaatactccaccgggtgtgaaatcgattggaacgagggcaagaatgtgactctcaagactatcaaaaagaagcagaagcacagaatctggggtacaattcgcaccgtgacagaggatttcccaaaggactcattcttcaattttttcagtccccatgggatcaccagcaatggccgcgatggaaatgatgatttcctgctgggacataatctgaggacctatatcataccacgttctgtcttattcttttccggggatgccctcgaaagtcagcaggagggggtggtcagggaagttaacgatgcaatctacgacaagattatatatgataactggatggctgctatcgaggaagtgaaggcatgttgcaagaacttggaggcactcgtggaggatattgatcgatag

SEQ ID NO: 12636 - DNA, 957 bp, Artificial Sequence
  Description of Artificial Sequence: Synthetic coding sequence
atgtatcagcctcttttagagaagcggcgccaaattatcaatgctatttatgaaccaacagaagaggaatgtgagtacaagtctgatagtgaggactgcgacgacgaggaaatgtgtcatgaggagatgtacggcaacgaggagggtatggttcacgaatatgttgacgaagacgacggatacgaagattactactatgactacgctgtggaggaggaggaagaagaagaagaggaagatgacatagaagccaccggtgaggagaacaaggaagaagaggaccccaaggggatcccagacttctggctgacagttctgaagaacgtggataccctaacacctctcatcaagaaatatgatgaaccaatcttgaaactgctcacagacataaaggtgaagttgtctgacccgggcgaacccctatcatttaccttagaattccattttaaacctaatgaatacttcaagaacgaactcctaaccaagacttatgtgttgaagagtaaactagcctactacgaccctcacccgtaccgcggaaccgccatcgaatattctacgggctgtgaaatcgactggaacgagggaaagaacgtgactctgaagacaattaaaaaaaagcagaagcatcgaatctggggaacgattaggacggttacagaagactttccaaaggattcattttttaactttttctcacctcacggaatcacctccaacggtagggacggcaatgacgacttcctcttgggacacaatttgcggacttatattatcccacgctccgtgctgtttttctctggcgacgcgcttgagtcccagcaggaaggagtggtaagagaggtaaatgatgccatttacgataagatcatttacgataattggatggccgcaatagaggaagtcaaagcctgctgcaaaaacttggaggctctcgtggaagatattgaccgctag

SEQ ID NO: 12637 - DNA, 489 bp, Artificial Sequence
  Description of Artificial Sequence: Synthetic coding sequence
atgctgttcggtcgtattccactgagatacgctattctgatgcaaatgcggttcgatggaaggctgggctttcctggcgggtttgtggatacccaggatcgctctctggaggacggactcaaccgggagctgcgggaagaactgggagaggccgctgcagcattcagagtggagcgtacagattacagaagttcccacgtcggctccggcccccgcgtggtagcacacttttatgcaaaacgattgaccttggaggaactgttggcagtggaagcaggagctactcgggcgaaggaccatgggcttgaggtcctgggattggtgcgtgtacccctctataccctgagggatggtgttgggggcttacccacgtttttagaaaactctttcatcggcagcgcccgcgagcaactcctggaggccctgcaggacttgggactgcttcagtccggcagcataagcggactgaagatcccggcccaccattag

SEQ ID NO: 12638 - DNA, 588 bp, Artificial Sequence
  Description of Artificial Sequence: Synthetic coding sequence
atggccggtgctcgccggctggagctgggggaggccctggcgttaggaagtggatggagacacgcctgccatgccctgttgtacgctccggatccagggatgctcttcggacgaataccacttagatacgccatactgatgcagatgaggtttgacgggcgactgggattcccgggtggcttcgtggacacccaagatcgaagtctcgaagacggactgaatcgggagttgagggaagagttaggggaggccgcggcagcctttcgagttgagcgaaccgactaccggtctagtcacgtcggctccgggccccgcgttgttgcgcatttctacgccaaacggcttactttggaagagctgctggcagtagaagccggagccaccagggcgaaggaccatgggctagaagtgctagggcttgtccgtgtccccttgtataccttaagggacggtgttggaggactgcctacgttcttggagaattcttttattgggtctgcccgtgagcagctgttggaggcgctgcaagacctgggactcctgcagtccggctccatatctggcctaaagattcctgctcatcactag

SEQ ID NO: 12639 - DNA, 480 bp, Artificial Sequence
  Description of Artificial Sequence: Synthetic coding sequence
atgcaaatgagattcgatggtagactcgggttccctggtggcttcgttgatacacaggacaggagcttggaggacggcctaaaccgcgaactgcgggaagagttgggagaagccgctgctgcttttcgagtggagcgtaccgactaccgctcctcccatgtgggaagcggtcccagagtggtggcccatttctacgctaagcgactgacccttgaggagttgctggccgtagaagcaggcgccaccagagctaaagaccatggactagaggtgttgggcttggttcgggtgccgctgtacacactccgcgatggtgtgggtgggctgcccactttcttagagaactcattcataggctctgctcgcgagcagctgctcgaggcagcccttcacgggcccatgaaaaccgaaatgcggaccctcgtgctcggccgggagggacggacctgggaatgctttctcattggaagtgagagatag

SEQ ID NO: 12640 - DNA, 684 bp, Artificial Sequence
  Description of Artificial Sequence: Synthetic coding sequence
atggccggggcaagacgcttggagttgggagaggccttggcgctcggatctggttggcgtcatgcctgtcatgcactgctctatgctcctgaccctggcatgctgtttgggcgaatcccactccggtatgcaatccttatgcagatgaggttcgacggtcggcttgggtttccaggcggcttcgtcgatacccaggacagatccctcgaggacggattgaacagggaactgagagaagagttaggagaagctgcagccgccttcagggtggaaagaaccgattaccggtcctcccacgtgggctccggccccagggtggtggcccacttttacgccaagcgacttacccttgaagagctcttagctgtcgaggccggggccacccgcgccaaggatcatggcctcgaagtaggccccgcatgggatagcgttcccttccctatctcatcttctccaaaggcatttagccctccccggaagcatccttggagaaaggtgttcgcccccttgacattgcctagtccgcaactgtcatggtggtcatgggacagagatcacctgtactccgaactggtgctgccaacatgggctttttgcaagggcttgtcccaccccctccccggggagatcttgtcacgcacacattcatccatgtcactgtgctgttctctgctgaccgtgtag

SEQ ID NO: 12641 - DNA, 768 bp, Artificial Sequence
  Description of Artificial Sequence: Synthetic coding sequence
atgcttcgcccgcagagaccaggggatctccagttgggtgccagcctgtacgagctggtggggtaccgacaaccaccttccagcagttcctctagcacctcatcaacgtcttctacgtcgagtagtagcacaactgcaccactgttaccaaaagcagctcgcgaaaagccagaggctccagccgagccccctgggcccgggcccggatccggggcgcaccccggcggtagtgcccgtccggatgcaaaggaggagcagcagcaacagttgcggcgaaaaattaattcccgcgaacgcaaaaggatgcaggacctaaacctggccatggatgcgttacgcgaggtgatattgccctacagcgccgcccattgtcagggtgccccagggcgaaagctatccaaaattgcgacactgttgcttgccaggaactatatcctgttgctcggcagctccctacaagagctgagacgggctttgggggagggtgcagggccagctgctcctaggctcctgctagctggcctgcccctgctcgccgcggctccgggctccgtccttctggctcctggagcggtgggcccaccggacgcattaaggcccgcgaaatacctttcacttgcactggacgagccgccctgtggacaatttgccctgcccggcggtggtgcaggaggcccaggcctctgtacctgcgccgtgtgtaagttcccccacctggtgccagccagccttgggctcgctgccgttcaagctcaattctcaaaatag

SEQ ID NO: 12642 - DNA, 816 bp, Artificial Sequence
  Description of Artificial Sequence: Synthetic coding sequence
atgtattacgcagtcagtcaggcccgcgttaacgcagtgccggggaccatgctgcgcccacagaggcccggggatctgcagctgggggcaagcttatacgaactggtgggatacagacagcctcccagcagcagctcaagttccactagctctacctcatcgaccagcagctccagcacaacagccccactgctgccgaaagcggctagggagaagcccgaagcccccgccgagccaccaggccctggcccaggaagtggtgctcaccctggcggatccgctagacctgatgctaaggaagaacagcagcagcaactgagaagaaagataaattctagagagagaaagaggatgcaggatctgaacctggctatggatgcattaagagaggtgatcttgccttatagtgccgctcactgccagggagcaccaggaagaaaactgtcgaagatcgctactctgctcttggcacggaactatattctgctcttaggatcttctctgcaggaactgcgcagggcattgggggagggggccggtccagcagccccaagactcctgcttgccggcctgcctctcctggccgctgcacccggtagtgttcttctcgcccctggcgccgtcggaccccccgacgccctgagacccgcaaagtatctctccctcgcactggacgaaccaccttgcggtcaatttgctctgccaggcggcggtgcaggcgggcctggactgtgcacctgtgctgtgtgcaaatttccccatttggttccagcctcgctggggctcgcagcagtacaggcccaattttccaagtag

SEQ ID NO: 12643 - DNA, 99 bp, Artificial Sequence
  Description of Artificial Sequence: Synthetic coding sequence
taaggtcctggactgtgcacttgtgctgtgtgcaagtttcctcacctcgtacccgcatctcttggcctcgcagcagtacaagcacagttctccaaatag

SEQ ID NO: 12644 - DNA, 1485 bp, Artificial Sequence
  Description of Artificial Sequence: Synthetic coding sequence
atggagcttagccttgaaagtctgggcgggctccattcagtcgcccacgctcaggctggtgagctactctcccccggccacgctagaagcgcagccgcacaacatcgcggcctggttgcgcctggccggcccggcctcgtcgctggaatggcctctcttctcgatggcggagggggtggtgggggcggaggggccggaggggcagggggcgcggggagtgccggagggggcgccgattttcgcggagagctggctggaccattgcacccagctatgggcatggcctgtgaggctcccggtctaggcggaacttacacaacattaacgccactccagcaccttccccctttggctgccgtcgccgacaaattccaccagcatgctgctgcagcagcagtcgctggtgcgcacggaggccacccacacgcgcacccacatccggctgccgccccacctccaccccctccacctcaacggctcgctgcaagcgtctccggtagcttcactttgatgagagacgagagagcagcattagcatctgttggtcacctttacgggccctatggcaaagagctgcctgccatgggctccccgctctcacctctgccaaacgcgctcccccccgcccttcatggggcgcctcaacccccgccaccccccccgccccctccattggccgcatatggtccaccaggtcatctcgccggcgacaaacttctgcctccggcagccttcgagccccatgcagcgcttctgggcagggccgaagacgcgctggccaggggcctgcctggaggcggcggcggaaccgggtccggcggagctggatctgggagcgccgcaggcctgttggcacctttggggggcctggcagccgccggcgctcacggcccacacgggggcggcgggggcccaggaggcagtggcggtgggccttcggccggagcagcagcagaggagataaacactaaagaagtggctcagcgaatcacggctgaacttaaacggtactcgattccccaagcaattttcgcgcaacgtatactgtgtagaagccaggggactttaagcgacctgctacgtaaccccaaaccatggtctaagctgaaatcaggtcgtgagacgttccggcggatgtggaagtggttgcaggaacctgagtttcagcggatgagtgcactgagactagccgcatgcaaacggaaagagcaggagcagcaaaaagagcgcgccctacagccgaagaaacagaggctggtgttcacggacttacagcgaaggacactgatcgcgatcttcaaagagaacaaacggccttccaaggagatgcaggtgaccatctcgcagcaactgggattggaacttaacaccgtgtcaaattttttcatgaatgccagacggaggtgcatgaaccggtgggccgaggagccctcaactgctcctgggggcccagcaggtgctaccgctacattttcaaaagcttag

SEQ ID NO: 12645 - DNA, 2922 bp, Artificial Sequence
  Description of Artificial Sequence: Synthetic coding sequence
atggcctccatcttggacgagtatgaaaattctctttctagatccgccgtgctgcaacctggttgcccctcagttggtatcccccatagtggctatgttaatgcacagctggagaaggaggtgcctatctttaccaaacagaggattgacttcacccccagcgagagaataacaagcttagtggtgtccagtaatcagctctgtatgtcactcggaaaagacaccctgcttcgcatcgatctcgggaaggctaacgagcccaaccacgttgaactggggcgaaaggatgatgctaaagtacataagatgttccttgaccatacaggaagccatctcctgatcgccttatcctcgaccgaggttctctacgtcaacagaaatgggcagaaggttcgtcccttggctcgatggaagggccagctggtggaaagtgtcggctggaataaagccttggggacagagtcatcaactggccctattctggtcggcaccgcccaggggcatatttttgaggccgagctctctgcttccgaggggggactctttggaccagctccagatctgtactttaggccactatatgtcctgaacgaagaaggcggtccagccccagtatgttccctggaagccgagcgcgggccagacgggaggtcatttgtaatcgccaccaccaggcagcgcctttttcagttcattggaagggccgccgagggcgccgaagcacagggattctctggcctctttgctgcctatacagaccatcctccaccattcagggagtttccttccaacctgggatacagcgaattagcgttttacacccccaaactgagatcagcgcccagggctttcgcatggatgatgggagatggggtcttgtacggagccctcgattgcggccgccctgattctttgttatccgaagagcgcgtctgggaatatcccgaaggcgtggggcctggtgctagtccccccctggctatcgttttaactcagtttcactttttgcttctcctggcggaccgggtagaggcggtgtgcacgctgaccgggcaggtggtcctgagagaccacttcctagagaagtttggccccctaaagcacatggtcaaggatagtagcaccgggcagctctgggcttacactgagcgagccgtgtttaggtatcacgttcagcgcgaagctagagatgtctggcgcacttacctcgacatgaatcgcttcgatttggccaaggagtactgcagagagagacctgactgtttagatacggtattggcacgcgaagccgatttctgctttcggcagcggagatatctcgaatctgctaggtgctacgcacttactcagagttactttgaggaaatcgccctgaaattcctggaagcgcgccaggaggaagcactcgccgagtttctacagcggaagctggctagcctaaaacccgctgagaggacacaggcaacattgctgaccacttggctgacagaactgtacttgtcacggctcggcgctctgcagggagatccagaggcactcacactctacagggaaaccaaagagtgtttccgcacctttctgtccagcccccggcataaagagtggttattcgcttctagggcctctatccacgagctgctggctagtcacggggacaccgagcacatggtatactttgccgtgattatgcaggattacgaaagagtcgtggcttatcactgtcagcatgaggcctacgaggaggctctcgccgtcctggcgcgtcaccgcgacccccagctattttacaaattctcacctatactgatccgccacatacctcgccagctggtggacgcctggatagagatgggctcacgattggatgctcgacagctgatccccgctctcgtaaactacagtcaggggggtgaagtacagcaggtgagtcaggctattcgctacatggagttctgtgtcaacgtcttgggcgagacagagcaggccatacataattacctgctctctctgtatgccagaggtcggcccgatagtctcctcgcctacctggagcaggccggggcctcaccccatagggttcattacgaccttaagtatgccctccggctgtgcgccgaacacgggcaccacagggcctgcgtccatgtgtacaaagttctggagctgtacgaggaggccgtcgacctcgccttgcaggtggatgtagaccttgctaagcagtgcgcggatctgcccgaggaagacgaggagctgaggaaaaaactgtggctaaagatcgcccggcatgtagtgcaggaggaggaagacgtccagaccgccatggcttgtctggcctcatgtcctctactcaagatcgaagacgtattgcctttcttcccagatttcgtcaccattgatcacttcaaagaggctatctgttctagtttgaaagcctataaccatcatatccaggaactgcagcgcgagatggaagaagcaaccgcttcggcacagaggattcgcagagacctgcaagaactgcgtggcaggtacgggacagtggaaccccaggacaagtgcgctacatgcgactttcctctgttaaacaggcctttctacctcttcctgtgcggtcacatgtttcatgccgattgcctcctccaggcagtccgacccggcctgcccgcatataagcaggccaggttggaagaacttcagagaaagctaggcgccgcaccgccacctgccaagggaagcgcgcgtgccaaggaggccgaagggggggcagctactgccggcccctcacgcgagcagctgaaggccgacctagacgagctggtagctgctgagtgtgtgtactgtggcgagcttatgataagatccatcgatcgcccctttatagacccccagcgttatgaggaagaacagctgagttggctctag

SEQ ID NO: 12646 - DNA, 828 bp, Artificial Sequence
  Description of Artificial Sequence: Synthetic coding sequence
atgcccaaggtcttcctggtaaaaagaagatcgcttggtgtgagcgtgagaagctgggacgagttacctgatgaaaaacgggcggacacttatattcctgttgggctgggccgactgctccatgatcccccggaggactgccgctctgatggaggctcttcatccgggtccggatcctcttcagctggtgaacccggtggcgctgaatcaagtagtagccctcatgcgccagaaagcgagacccccgaaccgggagatgccgagggacctgatggccaccttgcaacgaaacagcgccctgtggcaaggtcgaaaattaagttcaccacagggacttgttcagacagtgtggtgcacagttgcgacctgtgcggaaagggcttcaggctccaacggatgctcaatcgccacctgaagtgccataaccaggtgaagcggcatctgtgcactttctgcgggaagggctttaacgacacctttgatctcaaacgacatgtcagaacgcatactggcatcaggccttacaagtgtaacgtttgtaataaggcttttactcagagatgctcactcgagagtcatctaaaaaagatccacggcgtgcagcagcagtacgcgtataagcaaaggcgggataaactctacgtttgtgaagactgtggttacaccggccctacccaggaagacctgtacctacacgtgaattctgctcaccccggttcgtcgttcctgaagaagacctccaaaaaactggctgccctcctgcaggggaaactcacctccgcacatcaggagaacacaagcctgagtgaggaagaagagaggaagtag

SEQ ID NO: 12647 - DNA, 1269 bp, Artificial Sequence
  Description of Artificial Sequence: Synthetic coding sequence
atgcagaactctcattccggtgttaaccagctgggtggcgtgtttgtgaacggaagaccgcttccagattccacgaggcagaagatcgtagagctagcacactccggggctagaccgtgtgatatctctcgcattctgcaggtctcgaacggatgcgtatcaaaaatcttaggaaggtactacgaaacaggttcgatccggcctcgggctattggcggcagcaaaccccgagtagccacccctgaagtggttagcaaaattgctcagtacaagcgcgagtgcccctcaatttttgcttgggaaattagggaccggctgttgtcggaaggggtttgcactaatgacaatattccgagcgtgtcctccattaatagagtgttgcgaaatttggccagcgagaagcaacagatgggggccgacgggatgtatgacaagctgagaatgctgaatggccagaccgggtcctgggggacaaggcccggatggtatcccggaacatcggtacctggccaaccaacccaggacggctgccagcagcaggaaggtggaggcgaaaacaccaactcaatcagctctaacggcgaagactccgatgaggctcagatgcgcctccaactgaagcggaagctgcagagaaacagaacatcttttacacaggagcagatcgaggccctggagaaggagtttgagcgcacccactaccccgatgtgtttgctcgagaacgcctggctgccaagatcgacctgcccgaagccagaattcaggtctggttttccaacaggcgggccaagtggaggagggaagagaagctacggaaccagagaaggcaagccagtaacacccctagtcatattcctataagtagcagtttctcgactagtgtttaccagcccattccacagcccactacaccagtcagctccttcacctccgggagcatgctcgggcgaactgataccgcactcaccaacacctatagtgctctgcctcccatgccgtctttcactatggccaacaacctaccaatgcagcctccagtgccgagccagacgtcgagttattcttgtatgctccctaccagccctagtgtgaacggtaggtcttacgacacctacacaccccctcacatgcagactcatatgaactctcagcccatgggaacatcaggtacgacctcgacaggtctcattagcccaggcgtgtctgtgcctgtgcaggtgcctggctctgaaccggacatgtcacagtattggcccagactgcaatag

SEQ ID NO: 12648 - DNA, 1311 bp, Artificial Sequence
  Description of Artificial Sequence: Synthetic coding sequence
atgcagaattctcattcaggcgtgaaccagctcgggggcgtttttgttaacgggcgcccactccccgactcaaccagacagaagatcgtcgaactggcacattcaggcgccaggccctgcgatatctcccgcatactgcagacgcacgctgatgccaaagtgcaggtgcttgataaccaaaatgtgtcaaacggatgcgtgtccaaaattttgggacggtactatgagacgggatccatccgtccacgggccatcggaggatccaaacccagggtggccactccagaagtcgtttccaaaattgcccagtacaagagggagtgcccttccatttttgcttgggagattagagacaggctcctatccgagggtgtctgtaccaatgacaacatccccagcgtgtctagcatcaacagagtgctgagaaacctggcttccgaaaaacagcaaatgggagccgacggaatgtatgataaactgcggatgctcaatggccagaccggttcttggggaactaggccggggtggtatccgggcacaagtgtgcctgggcaaccaacccaggacggctgccagcagcaggaagggggtggcgaaaacactaattcaatctcttccaatggagaggactcagacgaggctcagatgcgcctgcagctcaagaggaagctgcagcgaaataggacctcatttacccaagagcagattgaggctcttgaaaaggaattcgaaaggacccactaccctgacgtgtttgcccgcgagcgcctagcggccaagatcgatctgcctgaagcgagaatacaggtatggttctccaaccgcagagctaagtggcgacgcgaagaaaaactaaggaaccagcgccgccaggcttcaaacacgcctagtcacatccccatttctagttccttcagcacaagcgtctaccagcctattcctcagcccacgacaccagtgtcttccttcacctctgggtctatgctgggacggactgataccgcattgaccaacacctattcagctttacccccaatgccatccttcactatggctaataacctccccatgcaaccccccgtgcccagccagacgtcatcatacagctgcatgctcccaacctcgccatctgtaaacggtcgctcctacgatacatataccccaccccatatgcaaacacacatgaactctcagcccatgggaacatccggcaccacttcgactggattaatctcccctggggtctccgtgcccgtccaggtgcccgggtcagagccagacatgtctcagtattggcctcggctgcagtag

SEQ ID NO: 12649 - DNA, 1269 bp, Artificial Sequence
  Description of Artificial Sequence: Synthetic coding sequence
atgcagaacagccattctggcgtgaaccagctgggaggcgtcttcgtaaatggtagaccactgccggactctacacgccagaaaattgtcgagctcgcacactccggggcaagaccctgcgatatctctcgcattctgcaggtatccaatggctgcgtgagcaaaattctgggccgctattatgagaccggcagcataagaccacgcgccatcggcggttcaaagcctcgggtggctacgccagaggtggtcagcaagatagcccagtacaaaagagagtgcccaagcatctttgcatgggaaatccgcgatcggctcctgtcagaaggagtctgtaccaatgacaatattcctagcgtctcttcaatcaatcgggtattgcggaatctcgcttctgagaagcagcaaatgggcgccgacggcatgtatgacaagctgagaatgttgaacggccagaccggttcttggggcacacgtcctggatggtatccagggacctccgtgcccggacaacctacacaggacggctgccagcaacaggagggggggggagagaatactaactcaatttcttccaatggggaagactccgacgaggcccagatgcggttacagttaaagagaaaactccagcgcaaccgcaccagtttcacacaggaacagatagaggctctagaaaaggagttcgaacggacacactatcccgacgtttttgccagggagcggctggcagctaagatagacctgcccgaggccagaattcaggtttggttctcaaatagaagagcgaaatggaggagggaggaaaaattacgcaatcagagaagacaggcaagtaatactcctagccatattcctataagctcgtcgttcagcaccagcgtgtaccaacctataccgcagcccacgactcccgtgtcctccttcacaagcggttctatgctggggagaactgatactgccttgacgaatacgtatagcgcccttccccccatgccctcattcaccatggcaaataatcttccgatgcaaccccctgttccaagtcaaacctctagttatagctgtatgctgccaacttcgccctcagtgaatggccggtcctacgatacttacacaccaccacacatgcagacgcatatgaacagtcagcctatggggaccagcgggacgaccagtactggcctgatttcacccggggtctcagtaccagttcaggtccccggctcagaaccagacatgtcacaatattggcccaggctgcagtag

SEQ ID NO: 12650 - DNA, 1269 bp, Artificial Sequence
  Description of Artificial Sequence: Synthetic coding sequence
atgcagaattcccattcgggcgtgaaccagcttggcggcgtgtttgtcaacggtcgccccctgccagatagcactcggcagaagatcgtggagctggctcactccggcgccaggccatgtgacatcagccgtattctgcaggtatcaaacggctgtgtgtccaagatcctgggccgttattacgagactggcagtattaggccccgcgcaatcggcggatcaaagcccagggtggccacccctgaggtcgtgagcaagattgcacagtacaaaagagaatgccccagtatcttcgcctgggaaattcgtgaccgcttattgtccgaaggagtctgcactaatgataacatcccatccgtgagcagcatcaacagagtgctgagaaatctggcctccgaaaagcagcagatgggagccgatggcatgtacgataaattacggatgctgaacggacagacaggatcttggggcacacggccggggtggtatcccggcacctctgtccccggccagcctacacaagatgggtgccagcagcaggagggaggaggggaaaacactaattccatttcaagtaatggagaggattctgacgaggcccagatgaggctacagctcaagcgaaagctgcaacgcaatcgaacatcctttacccaggaacagattgaggccctagagaaggagttcgagagaacccattaccctgacgtgtttgctcgcgaacgtttggctgcaaagattgatctgcctgaggctcgcatacaggtgtggttttctaatcgcagggctaaatggcgccgcgaggaaaagcttcggaaccagcgacgacaagcctccaacacccccagtcacatcccgatctcttcttcattttcaacttccgtgtatcagcccataccacaacccaccactcctgtgagctccttcacaagtggaagcatgttgggacgcaccgataccgctctcaccaacacctactctgcactgccaccaatgccaagttttaccatggctaacaatctgccaatgcagccccctgtgccatcacagaccagttcatattcctgcatgctgcccactagtcccagtgtgaacgggagatcatatgacacttacacccctccacatatgcagacacacatgaatagccagccaatgggtacaagcggaacaacctcaactggactgatcagtccgggtgtgagtgtccccgtccaggttccagggtctgaaccagatatgagtcagtattggccaagactccaatag

SEQ ID NO: 12651 - DNA, 1311 bp, Artificial Sequence
  Description of Artificial Sequence: Synthetic coding sequence
atgcaaaactctcactcaggtgtgaaccaattgggcggggtcttcgttaacggacgccctctgccagactctacgcgccagaagatcgtggagctagctcatagtggcgctaggccctgtgacatcagccgtatcctacaaacccatgccgacgccaaggtgcaagtgctcgacaaccaaaatgtttctaatggatgtgtcagcaaaattcttggcaggtactacgagacggggtccatacggccgcgcgccattggagggagtaagccacgagtcgctacacctgaggttgtctccaaaatcgcccagtataaaagggagtgccccagtatttttgcatgggaaattagggaccgactcctgagtgaaggagtgtgcacgaatgacaacattcctagcgtgtcaagtattaacagagtcctaaggaatctggccagcgaaaagcagcaaatgggcgctgacggtatgtacgacaaactaaggatgcttaacggtcagactgggagctgggggacacgacccggatggtaccctggcacttctgtcccgggtcagccaactcaggatgggtgccagcagcaagaaggtggaggcgaaaacaccaatagtattagctcgaacggcgaagactcagatgaggctcagatgagactccagttaaaacgcaaactacaaagaaaccgcactagcttcacacaagagcagatcgaggcattagaaaaagagtttgagcgcactcactaccctgacgtgtttgcacgcgaacgtctcgctgcaaagatcgatttaccagaggcccgtattcaggtgtggttttctaaccgacgggcaaaatggcggagagaagaaaaacttcgtaatcagaggcgtcaggccagtaacacaccatcccacatcccaatttcatcttctttcagtactagcgtttatcagccaattccacagccgaccacaccagtatccagctttacgtcaggatccatgctgggccgcactgacacggctctgacaaatacctattcggcccttccgccgatgccatccttcaccatggctaacaatcttccaatgcaaccaccagtcccttcgcagacaagctcatatagctgtatgctcccaacatccccgtctgtcaatggcaggagttacgatacatacacaccccctcacatgcaaactcacatgaactctcaaccaatggggaccagcgggaccacttcaaccggactaatctcgccaggagtgtctgtgccggtgcaagtccctggatccgagcccgacatgtcgcagtactggcctagactgcagtag

SEQ ID NO: 12652 - DNA, 1269 bp, Artificial Sequence
  Description of Artificial Sequence: Synthetic coding sequence
atgcagaactctcactcaggggtcaatcagttggggggtgtattcgtgaacgggcggccgctgcccgatagtaccagacagaagatagttgaacttgcccatagcggggctagaccctgtgacatctccagaatcctgcaggtctcaaacgggtgcgtatcaaagatcctcggaagatactacgagacaggcagtattcgtcccagagccatcggcggtagcaagccgcgggtcgcgactcctgaggtcgtaagcaagatagcccaatacaagagggagtgtccttcgatattcgcctgggaaatccgagaccgccttctcagcgaaggggtctgcacaaacgataatatcccttcagtttcttccataaaccgggtgctgcggaacctcgctagtgagaagcagcagatgggcgcggatggcatgtacgataagctaagaatgctgaatgggcaaactgggtcatgggggacaagaccaggttggtatcctggcacgtccgtgcctgggcaacccactcaggatgggtgccagcagcaggagggaggaggagagaatacaaattccatttccagtaacggtgaagactcagacgaggctcagatgcgcctacaactgaaacgcaaactgcagcgtaacagaacaagctttactcaggaacaaattgaggcactcgaaaaggaattcgagagaacccattatccggacgtgttcgcgcgggaacgccttgccgcgaagattgaccttccagaagcacgtattcaggtctggttttccaataggagggctaagtggcggagagaggagaaactgcggaaccagcggcgccaggcgagcaacaccccctcacatatcccgatatcttcttcattcagtacctccgtgtatcagcctattccccagccgactacccccgtttcttcatttacaagcgggagcatgctcgggagaacagataccgccctgaccaacacctattcagctcttccaccgatgccctcgtttactatggctaacaatctacccatgcagccccctgttcccagccagaccagttcctattcttgtatgcttccgacaagcccctctgtcaacggccgtagctacgacacttatacgcctccccatatgcagactcatatgaactcccagcccatggggacctcaggcacaacatccacagggttgatctcccctggcgtgtccgtccccgtgcaggtgccggggtcagagccagacatgagccagtattggccacgattacaatag

SEQ ID NO: 12653 - DNA, 1311 bp, Artificial Sequence
  Description of Artificial Sequence: Synthetic coding sequence
atgcagaactctcattctggcgttaaccagcttgggggagtgtttgttaatggaagaccattgcctgattcaacccgacagaagatcgtggagcttgctcattcaggcgctaggccatgtgacatatccaggattttgcagacacacgctgacgcaaaagtccaagtcctcgataatcagaacgtatcaaacgggtgcgttagcaaaatcctcggtaggtattatgagactggaagtatccggccacgggctattggaggcagtaagcctagagtcgcgactcccgaagttgtctctaagattgcacaatacaagagagagtgtccgagcatttttgcttgggagatcagggataggctgctttcggagggagtctgcaccaacgacaatattccctcagtgagcagcatcaatcgggtactgcgaaatctcgcttccgaaaagcagcagatgggagccgacgggatgtatgataagctccgcatgcttaatggtcagaccggcagctgggggacgcgcccaggatggtaccctgggacttccgtgcctggccagcccactcaggatggatgtcagcagcaggaaggcggcggggaaaacaccaatagtatatcgtcaaacggtgaagactctgatgaagcccagatgcgccttcaactgaagagaaagctccaaaggaacaggacctcattcacacaagaacaaattgaagcactagagaaagagttcgagaggacccattatcccgacgtgttcgcgcgtgagagattggcggctaaaatagacctgccagaggcccggatacaagtatggttttccaatagacgggccaagtggaggagagaggagaagctcagaaatcaacgcagacaggcatccaatactccatcccacatcccaatttcttccagcttttcgacatcagtctaccagcctattccacagccgacaacgcctgtatcctcatttacctccggatctatgttaggccgcactgacactgccttgactaacacctacagtgccctgcccccgatgccgagctttaccatggccaataacctcccaatgcagccccccgtgcctagccagacctcgagttattcctgtatgctgcccacgtccccaagcgtaaacggtcggtcttacgacacttatacgccaccgcacatgcagactcatatgaactcacagcccatgggcacctcagggactacctccaccggactgatttccccgggggtgtctgttcccgtccaggtgccaggaagtgagcctgacatgtctcagtactggcctcggttgcagtag

SEQ ID NO: 12654 - DNA, 1269 bp, Artificial Sequence
  Description of Artificial Sequence: Synthetic coding sequence
atgcagaactctcacagtggtgtcaaccagctcggtggcgtattcgtgaacggacgacctcttcctgactccacccggcagaagatagtggagctagcgcactctggggccaggccttgtgacatttctagaattttacaggtctccaatggctgcgtatccaaaatactcggaaggtattacgagaccggcagcattcgaccacgcgctatcggcggatcgaaaccaagagtggcaacccctgaagtggtgtccaagatcgctcagtacaaaagagagtgcccgtccatctttgcctgggaaattagggaccgcctgttgtccgagggagtctgtaccaatgacaatattccaagtgtgtcaagcattaatagggtgctgaggaatcttgcctcggaaaaacagcagatgggcgccgatggtatgtacgacaaattgaggatgctgaacgggcagactgggtcttggggaactcggcctggctggtacccgggcacgtcagtccctggccagccaactcaggacgggtgccagcagcaggaggggggaggtgaaaacaccaattcaatatcttccaacggcgaagactcggacgaagcccagatgagacttcagctaaagcgaaaactccagaggaatcggacatctttcacacaagaacagattgaagccctggaaaaagagtttgagaggacacattacccagacgtgttcgctagagaaagactggcagccaaaattgacctgcctgaagctagaatccaagtatggtttagtaatcgaagagcgaagtggaggagagaggagaagctgcggaaccagcggagacaggcctctaatactccatctcacattcccatctctagttctttcagcacaagcgtctatcagcccattccccagcccaccacgccagtctcgtctttcacctctggatccatgcttggcaggacagacacagccctgaccaacacctactctgcattgccccccatgccaagtttcacgatggccaataatttacctatgcagccacccgtgccaagtcagacatcttcttactcttgtatgctgcctacgagcccctccgttaatgggaggtcttatgacacatacacacccccacatatgcagacgcatatgaactcccagcctatgggtacttccggtactacaagcactggccttatatcaccaggcgtgtcagtccccgtccaggtccctggatctgaaccagacatgtcccagtactggcctagactgcaatag

SEQ ID NO: 12655 - DNA, 1311 bp, Artificial Sequence
  Description of Artificial Sequence: Synthetic coding sequence
atgcagaactcgcactcgggtgtgaatcagctggggggcgtgttcgtcaacggccgccccttgcctgattcaacacgccaaaagatagtcgaacttgcgcactccggcgcacggccgtgcgacataagccggatcttgcagacccatgcagacgcaaaagttcaggtgctcgacaatcagaatgtgtcaaacggctgtgtatccaaaattcttgggcggtactacgaaaccggttcaatcaggcctcgcgcgattggcggctcaaagccacgcgtcgctacaccagaggtggtttccaagatcgcgcagtataagagagaatgccccagcattttcgcttgggagatccgggatcgcctgctttccgaaggtgtgtgtaccaacgataacatcccatctgttagctcaataaatagggtgctgcggaatcttgccagtgagaaacagcaaatgggcgcggacggtatgtacgataaactccggatgctgaatggtcagactggtagttggggcacccgcccaggatggtaccccggcacctctgtacccggacaacctactcaagatgggtgtcaacaacaggaagggggtggcgaaaacaccaacagcatctccagtaatggtgaggactctgacgaggcgcagatgcgactgcaactcaagcgcaaactgcagaggaacagaacttcattcacacaagaacagatcgaggccctcgaaaaggagttcgagaggactcactaccccgacgtcttcgctagggagagactggccgccaagatcgatctgcccgaggcccggatacaggtttggttttctaaccgacgcgctaaatggcgccgggaggagaaactgagaaaccagaggcgacaggcctctaataccccatctcatattcctatctcaagctcttttagcacttccgtgtaccagccaatacctcagcctaccaccccggtgtcctccttcacctccggctccatgctgggaaggaccgataccgcactgactaatacctatagtgcccttccccctatgccttctttcactatggctaacaatctcccaatgcaaccccccgtgcccagtcagactagctcatactcttgcatgctccccacatctccttcggtcaacgggcggtcttacgatacctacaccccaccgcatatgcaaacgcatatgaactcccagcctatggggacgtcgggtactacgtccactggactcatttcccctggagtctctgtgcccgtccaagtccctggctccgaacctgatatgtcccagtattggccccgcctgcagtag

SEQ ID NO: 12656 - DNA, 201 bp, Artificial Sequence
  Description of Artificial Sequence: Synthetic coding sequence
atgcagaacagccattccggggtcaatcaactcggaggcgtgtttgtaaatggacggccactccccgacagcacacgccagaagatagtggagctggcccactccggcgctaggccttgcgatatttctcggatcctgcagactcacgccgatgccaaagtccaggtactggacaatcagaacgtatccaatggatgctag

SEQ ID NO: 12657 - DNA, 120 bp, Artificial Sequence
  Description of Artificial Sequence: Synthetic coding sequence
atgcaaaacagtcattcaggtgtgaaccaactggggggagtgtttgtgaatgggcgcccgctgccagattctactagacagaagattgtggagctggcccattccggcgcaagaccctag

SEQ ID NO: 12658 - DNA, 375 bp, Artificial Sequence
  Description of Artificial Sequence: Synthetic coding sequence
atgcaaaattcgcacagcggagtcaaccagctgggaggcgtgtttgtcaatgggcggcctttgccagacagcacccgtcagaaaatcgtagaactcgcccactccggagctcgtccatgcgatatttcccggattctccaaacccacgccgatgctaaagtccaggtactcgacaaccagaatgtatcaaacggctgcgtttccagcatcaacagagtcttgcgaaaccttgcctccgagaaacagcaaatgggagccgatgggatgtacgataagctgcgaatgctgaacggacagaccgggtcctggggcacgcggcccggctggtaccccggaacttccgtccctggtcagccgacccaggacggctgttag

SEQ ID NO: 12659 - DNA, 177 bp, Artificial Sequence
  Description of Artificial Sequence: Synthetic coding sequence
atgcagaactctcacagcggagtcaatcagctgggcggagtttttgtgaatggccgacccttaccggactcaactaggcagaagatagtggagctggcacactctggagccagaccctgtgacatctctcggatcctccaagtatccaatgggtgcgtttccaagatccttgggtag

SEQ ID NO: 12660 - DNA, 9 bp, Artificial Sequence
  Description of Artificial Sequence: Synthetic coding sequence
atgcaatag

SEQ ID NO: 12661 - DNA, 1134 bp, Artificial Sequence
  Description of Artificial Sequence: Synthetic coding sequence
atgcaggtgtctaacggttgtgtttctaagattttggggagatactacgagacagggtccattaggccacgggcgataggcggttccaaacctcgggtggcaacacccgaggttgtcagcaagatagctcagtacaagcgggagtgtccgtcaatttttgcatgggaaatccgggacaggctcctgtccgagggcgtttgtaccaacgataatatccccagcgtttcaagcatcaacagggtgcttaggaacctggcctcggagaagcaacagatgggcgccgacggcatgtatgataaactcaggatgctcaacggacagactggcagctggggcaccagacctggttggtacccaggcacctcagtgccaggacagcccacccaagatgggtgtcaacagcaagagggcggaggcgaaaacaccaacagcatatcctctaatggcgaggacagcgatgaggctcagatgcggcttcagctgaaacgcaagctgcagcgtaaccggacaagtttcacccaggagcagatagaagcactcgaaaaggaatttgaaagaacccattaccctgatgtgttcgcacgagagcgcctcgccgcaaaaatagatctgccggaggctaggatccaggtatggtttagtaatcggagagctaagtggcgtcgggaagagaagctccgcaaccaaaggcgccaggctagcaatactcctagccacattcctatttccagctcattctcaactagcgtctaccagcccatacctcagcccaccaccccagtgtccagcttcacctctgggagcatgctcggtcggacagatacagcactcaccaatacttacagcgccctgcctccaatgccttcattcaccatggcaaacaatctcccaatgcagcctccagtgccaagccagacctcatcatactcctgcatgttgccaactagtccgtctgtcaacgggcgatcttacgacacctacactcctcctcacatgcagacccacatgaactcgcaacccatgggcacttcaggtacaacatcaaccggtctgatctccccgggggtgagcgtcccggtgcaggtgccagggagtgagcccgacatgagtcagtactggcctagactgcagtag

SEQ ID NO: 12662 - DNA, 1389 bp, Artificial Sequence
  Description of Artificial Sequence: Synthetic coding sequence
atgagctctgtgaagcggagcctgaaacaagaaattgttacacagttccactgtagtgcggctgaaggagacatagctaagctgaccggaatcctctcgcacagtccgagtttattaaatgagactagcgaaaatgggtggacagccctcatgtatgccgccagaaacggacacccagagatcgtgcagttcctgctggaaaaaggttgcgacaggagcatagtgaacaagtcccgccagacagccttggatatcgccgtgttctggggctataaacatatcgcaaatttgcttgcaaccgcgaagggcggcaaaaaaccttggttcctgacgaatgaagtggaggagtgcgaaaactatttctcaaaaactctcctggaccggaaaagtgagaaaagaaataatagcgattggctgctggcgaaggagagccatcccgcgaccgtatttatcctcttctccgatctaaatcccctcgttacactaggcggtaataaggaatcctttcaacagcccgaggtgagactctgccagctcaactacaccgatatcaaggactacttggcgcaaccggagaaaataaccctgattttcttaggtgtggagttggagataaaagataaactattaaactacgccggggaggtcccacgtgaggaagaagatggattggtggcttggttcgccctgggaattgaccctatagccgccgaggagtttaagcagcgccatgaaaactgttatttcctgcatccccccatgcctgctctactgcagctaaaggaaaaggaggctggagtcgtagcgcaagctaggagcgtccttgcgtggcactctcgatataaattctgcccaacctgtggtaatgccaccaagatcgaggagggaggatataaacgcctgtgccttaaagaggattgtccaagcttaaatggtgtccataacacttcctacccgagagtagaccccgtggttatcatgcaggtgatccacccagacggcaccaagtgcctgctggggcgccagaagcgatttccccctggcatgtttacttgccttgccggcttcatcgagccaggtgaaactatagaggacgccgtcaggcgcgaggttgaggaagagagcggggtgaaggtgggtcatgtacaatacgtggcctgccagccttggccaatgcctagtagcttgatgatcggatgcctagctctggccgtttctaccgagattaaagtcgataagaatgagattgaggatgctcggtggtttacaagggagcaggtgttggacgtcctgactaaggggaaacaacaagccttcttcgtgcctccatcccgggcgattgctcatcagttgattaagcactggatccgaatcaatccaaacctgtag

SEQ ID NO: 12663 - DNA, 84 bp, Artificial Sequence
  Description of Artificial Sequence: Synthetic coding sequence
atgtctccttgccccgaggaggcagcgatgagacgggaagtggtgaagcgtattgaaacagtggtcaaggacttgtggccctag

SEQ ID NO: 12664 - DNA, 1095 bp, Artificial Sequence
  Description of Artificial Sequence: Synthetic coding sequence
atggcactagcccttctggaggactggtgccgcattatgtccgtggacgaacagaaatcactgatggttaccggaatccccgccgatttcgaggaagccgagatacaggaggttcttcaggagactcttaaatctcttggacgctaccgtcttctcggcaagatatttaggaaacaggaaaatgcgaacgctgtcttgctggagctgcttgaagatacagatgtttctgctataccatctgaagtacagggcaaggggggggtatggaaggtgatcttcaagactcctaatcaagacactgagttcctcgagaggttaaacctcttcttggagaaggagggccagacagtatccggcatgtttagggccctgggacaggaaggcgtaagccctgccactgtgccctgtatctctccagaactgctggcccatttgctgggccaggccatggctcacgctccacagcccctgctgcccatgagataccgcaagttgagggtgttttcgggcagtgcagtgccggcgcctgaggaggaatccttcgaggtatggctcgagcaggccactgaaatcgtcaaggaatggccagttactgaagcagaaaaaaaaagatggctggcagagagcctacgcgggccggcccttgatttaatgcatattgtgcaagctgacaacccctccatctctgtcgaagagtgtttggaagcctttaagcaggtcttcggttctctggagagtaggcggaccgcacaggtccggtatctgaaaacataccaagaagaaggcgaaaaggtctcagcttacgtactgcgcttagagaccctgctgaggcgggccgtcgagaagagagctatcccacgacggattgccgaccaggttcgtctggagcaggtgatggccggtgccacgttgaatcaaatgctatggtgcaggctgagagagctaaaggaccaggggcctccaccctctttcttggagttgatgaaagtcatccgggaggaggaagaggaagaagccagcttcgaaaatgaaagcattgaagagcccgaggagagagacggctatggtcgatggaatcatgaaggggacgactag

SEQ ID NO: 12665 - DNA, 1392 bp, Artificial Sequence
  Description of Artificial Sequence: Synthetic coding sequence
atgccattgaccctgctccaagattggtgtaggggtgagcatcttaataccaggagatgtatgctgatcctggggatccctgaggattgtggagaggatgagttcgaggaaacactgcaagaggcttgtcggcacctgggccggtatcgcgtgatcggtaggatgtttcggcgagaggagaatgctcaggcgatcctgcttgaactcgctcaggatattgactatgccttactccctcgggaaatacctgggaaaggcgggccttgggaggtgatcgtaaaaccccgtaacagcgacggcgagttcctcaatagactcaatcggttcttagaagaggaacgccgaacggtgtcggacatgaatcgggtcctgggtagtgacactaattgctccgctcctcgggttactattagcccagagttttggacctgggcccagaccctgggtgccgccgtccagcccttactggagcagatgctgtatcgcgaactccgtgtgttttcgggcaatactatttccatccccggtgcccttgcctttgacgcatggttagagcacacaactgaaatgctgcagatgtggcaggttcccgagggcgagaagagacgtcgtcttatggaatgtctacgcgggcctgccttgcaggtggttagtgggctgcgggcatccaacgcctcaatcacagtggaggagtgtctggccgcgctgcagcaggtgtttggtcccgtggagtcacacaaaattgcgcaggttaaactgtgcaaggcctatcaggaagcaggcgagaaagtgagcagtttcgtgctgcgtctcgagccacttctgcaaagggctgtcgaaaacaacgtggttagccgccggaacgtcaatcagactcggttgaaacgcgtactgtccggcgctaccctgccagataagcttagggacaaactcaagctcatgaagcaacgtagaaagcctcccggctttctggccctggtcaaactgctgcgcgaagaggaggagtgggaggctaccttaggaccagaccgggaaagtctggaaggtctggaggttgcgcccaggccacccgcgcggattacaggagttggcgccgttcccttgccggctagcgggaattcattcgatgtcagaccttcccaggggtaccggcgcagacgaggacggggccagcatcgtaggggaggagtggctcgggccgggtcccggggttcgcgaaaacgcaaacggcataccttctgctattcttgtggagaagatggccatattcgtgttcagtgcatcaatcccagtaacctgctactcgtaaagcagaagaagcaggctgcagtagaatctgggaacggaaattgggcctgggacaagtcccatccgaaatctaaggcgaagtag

SEQ ID NO: 12666 - DNA, 1392 bp, Artificial Sequence
  Description of Artificial Sequence: Synthetic coding sequence
atgcccctgacactgctgcaggattggtgtcgtggagagcatttaaatacccgcagatgtatgctgatccttggcatcccggaagactgtggtgaggacgagtttgaagagacgcttcaggaagcgtgtaggcatctggggcgctaccgggtcatcggccgaatgtttagaagggaagagaatgcacaggcaattctactcgaactcgctcaggatattgactacgcccttctaccacgcgaaattcctggaaaaggcggcccttgggaggtgattgtgaaaccccggaattctgacggggagttcctgaataggttgaatagattcttggaggaagagcgcaggacagtttccgacatgaatagagtccttgggtctgacactaattgttccgccccacgggtgaccatctcacccgaattttggacctgggcacaaaccctcggagccgctgtacagccattgctggagcaaatgctttatcgtgagctgcgtgtgttctcagggaatacaatatctataccaggtgccctcgcctttgacgcatggttggaacacacaactgagatgctacagatgtggcaagttcccgagggcgagaaacggagacgcctgatggagtgcctccgcggacccgcacttcaggtggtgagtggcctgcgcgcttcgaatgcctcgataactgtggaggagtgccttgccgctctgcaacaggtattcggccccgtggagagtcacaagattgcccaggtaaagctgtgtaaagcataccaggaggccggtgagaaggtcagctcttttgtcttaagactggagcctctgttgcagcgagctgtggagaacaatgttgtttcgcgccggaacgttaatcagacccggttgaaaagggtgcttagtggggctaccctgcctgacaagctgcgcgacaaacttaaactgatgaagcagcgcaggaaaccccccggatttttggccctcgtcaagcttctgagggaggaagaggagtgggaggcgacacttggacctgaccgggaaagtctggaggggctggaagtagctccacgtccgcctgcacgcataacgggcgtcggtgcggtgcctcttccggcaagcggcaatagcttcgacgttcgcccctctcagggctataggcgacgtcgaggacgcggtcaacacagacggggtggcgttgccagggcagggagcagaggaagccgaaaacggaaaaggcataccttctgctacagttgcggtgaggacggtcatatccgcgtccaatgcatcaatccatcaaacctcctgctggttaaacagaaaaagcaagccgccgtcgagtcaggcaacggcaattgggcatgggataagagccacccaaagtctaaagcaaaatag

SEQ ID NO: 12667 - DNA, 1392 bp, Artificial Sequence
  Description of Artificial Sequence: Synthetic coding sequence
atgccactgaccctcctgcaggactggtgtcgcggggagcaccttaatactcgacggtgtatgctgattctgggaattcctgaagactgcggcgaagatgagtttgaagaaactctccaggaggcctgccgacacttaggacgctatcgggtcataggtagaatgtttcggagggaggaaaatgcccaggccattctcttggagctcgcccaggatatagactatgctttgctgcctcgcgagatacctggaaaaggcggaccctgggaggtgatagtgaagccccgtaattcagatggcgagttccttaatcgcctcaatcggtttctggaagaagaacggaggactgtgagcgatatgaaccgtgtgttggggtcggataccaactgtagtgcccctcgggttactatttcccccgagttttggacttgggcacaaaccctgggtgccgcagtgcagccattgctggagcagatgctttaccgggagctgcgcgtattctctggcaacaccatcagtattcccggggcattggccttcgacgcttggctcgagcatactaccgagatgttgcagatgtggcaggtgcccgaaggagaaaagcgccgcaggcttatggaatgtctccgcgggccagcactgcaggtggtcagcggccttagggcctctaacgccagcataacagtagaagagtgtcttgcagcactgcagcaagtattcggtcccgtggagagccacaagattgctcaagtgaaactgtgcaaagcctatcaggaagccggcgaaaaagtgagcagctttgtcctcagactggagccgctgttacaaagagccgtcgagaacaatgtggtttctcgcaggaacgtgaaccagacaaggttgaagcgcgtcctgagcggcgcgacacttcctgacaaactgagagacaaactgaaactgatgaaacaaagaaggaaaccccctggttttctggccctggtgaagctgctgagagaggaagaagaatgggaagcgacacttggccccgacagggagagcttggaaggtctggaggtagccccgcggccaccggcccgcatcaccggcgtaggcgctgtccctttacctgctagcgggaattcatttgacgttcgcccctcacaggggtaccggaggaggagagggcgaggccaacaccgtagaggcggagtggcaagagcgggtagcagagggtccagaaagagaaaaaggcacactttttgttacagctgtggggaggatggacacatccgtgtccagtgtatcaaccccagcaacctgcttcttgttaaacagaagaaacaggcagctgtcgagagtggcaacggtaactgggcatgggacaaatcgcatccaaaatccaaagctaagtag

SEQ ID NO: 12668 - DNA, 759 bp, Artificial Sequence
  Description of Artificial Sequence: Synthetic coding sequence
atggagtcagagatggagacacagtcagctagagccgaggagggcttcactcaggtgactaggaaaggggggcgaagggccaagaagaggcaggctgaacagttgtccgctgccggtgagggaggggacgccggccgcatggatacggaagaagcccggccggccaagagaccagtattcccaccattgtgtggcgatggcctgctgtctggcaaggaagagacccgaaagattccggtgccagccaacaggtacacacctcttaaagaaaactggatgaaaatcttcacacccattgtcgagcatttgggcttgcagattcggttcaacctgaaatctagaaacgtggagatccgcacgtgtaaggagacaaaggatgtcagcgccctgacaaaagccgctgattttgtcaaggctttcatccttggttttcaggttgaagatgctctggccctcattaggctggatgacctctttcttgagtcatttgaaatcaccgatgtgaagccactgaagggcgatcacctcagccgagccattggcagaatagctggaaagggaggaaagacaaagtttacaatcgagaacgtcaccagaacacgcatcgtgctggcagatgtgaaggtgcatattctcgggtcattccagaacatcaagatggccagaactgccatctgtaatttgatccttgggaacccaccgtccaaggtttatggaaatatccgggcagtcgcatcaaggagcgccgatcggttttag

SEQ ID NO: 12669 - DNA, 2322 bp, Artificial Sequence
  Description of Artificial Sequence: Synthetic coding sequence
atgaagatgcgaggagagaaacggagggacaaggttaaccctaaatcctcccaacggaaactgaactggataccctctttccccacttatgactactttaatcaagttaccctgcaactgctcgacgggtttatgatcaccctgagcacggacggggtcataatttgcgttgctgagaacatcagctccctcttgggccacctgcccgctgaaatcgtcggcaagaagctgctgagtcttctgcccgacgaggagaaggacgaggtgtatcagaagataatcctgaagttcccattactcaactctgagacccacatagagttctgctgtcaccttaagcgcggaaatgtggagcacggggacagttctgcttatgagaatgtgaagtttatcgtgaatgtcagggatatctgcaatgaattccctgtggtgtttagcggactttttagctctcatctctgcgccgactttgcagcttgcgtcccacaagaagatcgactgtacctcgtaggcaatgtgtgtattctccgaacacaactacttcagcagctctacacatccaaggccgtgagcgatgaggcagtcttaacccaggattccgatgaagagcccttcgtaggagaattatcatcgagccaggggcagcggggtcacacgtccatgaaggctgtctatgttgagcccgcggccgctgctgccgcggctgctataagcgatgaccaaatagatattgcagaggtggagcaatatggaccacaggagaacgttcacatgttcgtggactcagattctacatattgctcatctacggtgttccttgacactatgcccgagagccctgccttatccctgcaagatttccgtggcgagccggaggtcaaccccctctatagagctgatcccgtcgacctggagttcagtgtggaccaggtcgacagtgtcgaccaggaagggccaatggatcagcaggatcctgagaatccggtcgcccctctggatcaagcagggctaatggatcctgtcgaccctgaggatagcgtggatctgggcgcggctggagcctccgctcagcctctgcaaccttcatcacctgttgcctatgacattatcagccaggagctggaactgatgaagaagctcaaggagcagttggaggaaagaacctggctgctgcacgacgccattcagaaccagcagaatgcactggaattaatgatggaccatctccagaaacagcccaataccctcagacacgtcgtgatccctgacttgcaatcaagcgaagccgtccccaagaaacaacagaagcagcatgccggtcaggtgaaaaggccactgccgcaccctaaagacgtcaagtgcttctgtggcctgagtctttctaactctctcaagaacaccggcgaactccaagaaccatgcgttgccttcaaccaacagcaactggttcagcaggagcaacacctgaaggagcagcaaaggcagctgcgtgagcaactacaacagctgagagaacagcggaaagtacagaaacagaaaaaaatgcaagaaaagaagaaactgcaggagcagaagatgcaggagaagaagaaactccaagaacaacggcgacagaaaaaaaagaagttgcaagagaggaaaaaatggcagggtcagatgctccagaaagagccagaggaggagcagcagaagcagcaactgcaggagcagcccttaaaacacaatgtgatcgttggaaacgaaagggtccaaatctgtttgcagaatcccagggatgtgtcagtccctctttgcaatcatcctgtgcgcttcttacaggcgcagcccattgtcccggtgcagcgtgccgccgagcagcagccgagcggattttatcaggacgagaattgtgggcagcaggaggatgagtcacagagcttttatccagaagcataccaagggcccccggtaaaccagctgcctttaattgacacttcaaatagtgaagccatcagctcgtcttctatcccacaatttccaataacctcggattctaccatttcaaccctagaaaccccacaagactacatacgcttatggcaagagctgtcggacagtctcggtcccgtggtgcaagtcaatacttggtcgtgcgatgagcaggggacacttcacgggcaaccgacgtaccaccaggtgcaagtgtccgaggtcggtgtggagggcccgcctgacccacaagcctttcaaggacctgcagcgtaccaacccgaccaaatgagaagcgcagaacaaacccgcctcatgcctgccgaacaaagggattccaataagccctgctag

SEQ ID NO: 12670 - DNA, 3069 bp, Artificial Sequence
  Description of Artificial Sequence: Synthetic coding sequence
atgtttcgggaggtcaaatattatgctgtgggagacattgacccccaggtgatacagctgctgaaagcgggaaaggcaaaggaagtgagctacaatgcactggcctcccacatcatctccgaagacggtgataaccccgaggtgggggaggccagagaggtatttgacctgccagtggtgaaagtcagtagcgaagaccggtcagccttatgggcccttgtgaccttctacggcggagattgccagctcacacttaataagaagtgtacccacctgattgtgcccgagccgaagggagagaaatacgagtgcgcgttgaagcgcgctagcatcaaaatcgtgaccccggactgggtgctggactgtgtaagtgagaaaacaaaaaaagacgaagcgttctatcacccccggttgataatctatgaagaagaggaagaggaggaagaagaggaggaggaagttgagaacgaggagcaggatagccaaaatgagggatccacagatgagaagtcttcccccgccagctcccaagaagggtcaccctcgggtgaccaacagtttagtccaaaatcaaacacagagaaaagtaagggggaactaatgttcgacgattctagcgacagctcccccgagaaacaggaacgcaaccttaattggactccagccgaggtgccacagttggccgcagctaagagaagactccctcagggcaaagagcccgggctcattaacctgtgtgctaacgtgccacctgtgcccgggaacattttgccaccagaggtccggggaaatctcatggccgccggccaaaacctgcagagttctgagcgcagcgagatgattgctacatggtcaccggccgtgcgcacactccgtaatatcacaaacaatgcagatatccagcagatgaaccgcccaagtaacgtcgcacacatccttcaaactttaagcgctccaaccaagaacttagaacagcaggttaatcactcacaacagggacacactaatgcaaacgctgttctatttagccaggtgaaggtcacgccagagacgcacatgctacagcaacaacagcaagcacagcagcagcaacagcaacatcccgttctccacctccagccacagcagattatgcagctgcagcagcagcagcaacagcagattagtcagcagccctatccccagcagcccccccaccccttttcccagcagcagcagcagcaacagcaagcccacccccatcaattcagtcagcaacaactccaatttcctcaacagcagctgcacccccctcaacagctgcatcggccccaacagcaactgcagcctttccagcagcagcatgcactccagcagcagtttcatcagttgcaacaacaccagctccaacagcagcaactggcacagctgcagcagcagcactccctgctgcagcaacagcaacagcagcagatccagcagcaacagctgcaacgcatgcatcagcagcagcagcagcagcagatgcagagccagaccgctccccacctttctcagacgagccaagctctgcagcaccaggttccccctcagcagccaccacagcagcaacagcaacaacagccccctccttccccacagcaacaccagctgtttggacacgatcctgccgtagagatacctgaagaagggttcctgctgggatgcgtgttcgccattgccgactatccagagcagatgtccgacaagcagctgctcgccacctggaaacgcatcattcaagcacacggcgggacggtcgaccctactttcacttctcgttgcacgcatttactctgcgagagccaggtgagctcagcttacgcccaggccatcagggagcggaagagatgcgtgacagcccactggctcaataccgtgctgaagaagaagaagatggttcctcctcatcgggctctgcacttccccgtcgccttccccccaggtggcaagccgtgctcgcagcacattataagtgtgaccggatttgtagactcagatagagatgacttgaagttgatggcatatctggcaggcgctaaatatacaggatatctctgcagaagtaataccgtgctgatttgtaaagagccaaccggcctgaagtacgagaaggctaaggaatggcgtatcccttgcgtgaatgcacagtggcttggtgatattttactcggaaactttgaggccctgcgtcagatacagtacagtcggtacacagccttcagcctgcaggatccattcgctcccactcaacacttggttcttaatcttcttgacgcatggcgggtgcctttaaaagtgtccgcagagctgctgatgtccatccggcttccgccaaaattaaagcagaacgaagtagccaacgtgcagccctcttccaagcgagcccgcatcgaggacgtgcctcctcctactaagaaattgacgccagaactgaccccatttgttttgtttaccgggttcgagcctgtgcaggtgcagcagtatattaagaagctgtatattctcggcggagaggtagcagaatctgctcagaagtgcactcacttgattgcctcaaaggtcacacggactgtaaagtttctgaccgccatcagtgtagtgaaacacattgtcacccctgagtggctggaggagtgttttcggtgccagaagttcattgatgagcagaactatattctccgtgacgccgaggcggaagtgctcttttcattctctcttgaggagtccctaaaaagggcgcatgtgagtcctctcttcaaagccaagtacttctacatcactccaggcatttgtcccagcctcagcactatgaaggccattgtcgagtgtgccggcggcaaggtgctcagcaaacaaccttcttttaggaaactgatggagcacaaacaaaactccagtctgtctgaaatcatattgatctcatgcgagaacgacttgcacctctgtcgggagtatttcgccagagggattgacgtgcataacgctgaatttgtgctaacaggggtcctgacacagactctcgattatgagagctacaagtttaactag

SEQ ID NO: 12671 - DNA, 2682 bp, Artificial Sequence
  Description of Artificial Sequence: Synthetic coding sequence
gttcgcgtactcatccaggcaggggccctgtgttggagcctcccagaactgtcccagggtgaggttggcaaaggcgcctgcccagcggaggtcgggaagcacagagaccacttgcctagcagcgaccccgtcttaatgcaggcggaagccagcgtcgtgatgtgttgggtgtccagtgaggataggagcgcgctctgggctctggtcactttttatggcggcgattgccaacttaccctgaacaagaagtgcacacacctaattgtccctgaacctaaaggcgaaaaatacgagtgtgcgctcaaaagagctagcataaaaattgtgacgccagattgggtcctcgactgtgttagcgaaaaaacaaagaaagatgaagccttctatcaccccaggctgatcatttacgaggaagaagaggaagaagaagaagaggaggaagaggtcgaaaacgaggagcaggactcacagaatgagggatccacagacgaaaagtcaagtccggcctctagccaggaaggatcccccagcggtgatcagcagtttagccctaagagcaatacagagaaatccaaaggcgagctgatgtttgatgattcctcagactcaagccctgagaagcaggagaggaacttgaattggacaccagcagaggtaccacagcttgccgctgctaaacgcagactgccacagggcaaagaacctggtctgattaacctttgtgcaaatgtgccaccagtgcccggaaacatcctgcctcccgaagtccggggaaacctgatggccgccggccaaaacttgcaatctagcgagcgcagcgagatgatcgccacatggtcccccgctgtgagaacgctccggaatatcacgaataacgctgatatccagcaaatgaatagaccctccaacgtagcccacatactgcagaccctgtcagccccgactaagaacctggagcagcaggtgaatcactcacagcaggggcatacgaatgcaaacgcggtgctcttttcccaggtgaaggtcactcctgagactcacatgttgcagcaacagcagcaagcccaacagcagcaacagcagcatcctgtgcttcatttgcagccccagcagatcatgcagctgcaacagcagcaacagcagcaaatatcccaacagccctatcctcaacaaccaccacaccctttctcacagcaacagcaacagcagcagcagcccccaccatccccccagcagcatcagctttttggtcacgatccagcagtggaaatcccagaggagggttttctcctggggtgcgtctttgcaatcgcagattacccagagcagatgtccgacaaacagcttctggcaacatggaaaaggattattcaggctcatgggggaaccgtggatcccacattcacctcgcgatgtactcatttgctgtgcgagagccaggtttcctccgcatatgctcaggctatcagagaacgtaagcggtgtgtcaccgcccactggctgaatactgtgctgaagaagaagaaaatggtgccaccacaccgcgcgctgcatttccctgtggcatttccccctggcgggaaaccttgctctcaacacattattagtgtcactggcttcgtcgacagcgaccgggatgatttgaaactgatggcgtatctggccggagccaagtataccggttacctctgtcgcagcaacacagttttaatctgcaaggagcccacagggctgaagtatgagaaagccaaggagtggcgaataccctgtgtcaacgcacagtggctcggcgacattctactgggcaatttcgaagcactgaggcagattcagtactccaggtacacagcctttagtcttcaagaccctttcgcgcctactcagcacctggttctgaacctgttggatgcgtggcgtgtgccattaaaggtgtctgccgaactgttgatgagcatcagactgccgcctaaactgaagcagaatgaagtggcaaatgtgcaaccatcgtcaaaacgggcacgaatcgaagacgtgcctccccccaccaaaaaactcacacccgagttaactccatttgtgctgttcactgggtttgagcccgtccaggttcagcagtacattaagaagctgtatattcttggtggggaggtggcggagtccgcgcagaagtgcacacatttgatagctagcaaagtgacgcggaccgtaaagtttttgaccgcaatctctgttgtgaaacacattgtgacccccgaatggctggaagaatgtttccgctgccaaaagtttattgacgaacagaactatatcctacgggatgctgaggctgaagtgctgttctcgttcagtctggaggaaagcctcaagcgggctcacgtaagtccactgtttaaggcaaagtatttctacatcacacctggcatttgtccaagcctatcgaccatgaaagccatcgtcgaatgtgcaggcggaaaggtcctttccaaacagccttccttcaggaagctcatggaacataagcagaatagcagtctgagcgagataattttgatctcctgcgagaacgacctgcatttgtgccgcgaatacttcgctagaggtatcgacgtgcataacgccgagtttgtgttaactggagtgctgacccagaccctggactatgagagttacaaattcaactag

SEQ ID NO: 12672 - DNA, 3210 bp, Artificial Sequence
  Description of Artificial Sequence: Synthetic coding sequence
atgagcgaccaggcacccaaagtccccgaagagatgtttcgcgaagtgaaatactacgcagtcggagatatcgacccacaggtaatccagcttttgaaggctggcaaggcgaaggaagtatcctacaacgctttggccagccacatcattagcgaggacggtgacaatcctgaggtcggggaagcgagggaggtttttgatttgcccgtggtcaaaccaagctgggtcatcctgagcgttcagtgtggaacactgctgccagtaaacggattctcgccagagtcctgccagattttcttcggaatcacggcttgcctctcccaggtcagtagtgaggatcgcagcgctctgtgggcactggttactttttacggcggcgactgccagttgaccctgaataaaaagtgtacccaccttatcgtgcccgaaccaaaaggagagaagtatgaatgcgccctgaagcgcgcatctataaagatagtaacacccgattgggtcctcgattgtgtttccgaaaagactaagaaggatgaagcattttatcacccccgcctcattatttacgaagaggaggaggaagaagaggaggaggaggaggaggtcgagaacgaggagcaagactcccagaacgagggttcgaccgacgaaaagtcttcacccgcttcctctcaggagggatccccctctggagatcagcagttttccccaaagagcaacaccgagaagagtaaaggggaacttatgttcgatgatagttccgattcctcccccgaaaaacaggaacggaatctaaattggaccccagctgaagtgcctcagttggctgccgccaagcgacgcctgcctcagggcaaagaacccgggctgatcaacttgtgcgctaacgtgccccccgttccaggaaacatcctcccccctgaagtacggggcaaccttatggcggccgggcaaaatctgcaaagttctgagcgctccgagatgatcgccacgtggagtccagccgtccgcacgcttagaaatataacaaataacgctgacatccaacagatgaacaggccttccaacgtggcccacatcctgcagaccctttccgcacccacaaagaatttggagcagcaggtgaaccacagtcaacagggacatacaaacgccaatgccgtgctgttctcccaggtgaaggtgacacccgaaacacacatgttgcagcagcagcaacaagctcaacagcaacagcagcagcatcccgttcttcatctgcaacctcagcagataatgcagctgcagcaacagcagcagcaacagatctcccagcagccatatccccaacagccacctcacccgttctcacagcagcagcagcagcagcaacaggcacaccctcatcaattcagccagcagcagctccagtttccacagcaacagcttcaccccccccagcagcttcacaggcctcagcaacagctccagcccttccagcagcagcacgccctccagcagcaattccatcagctacaacagcaccagcttcagcagcaacagctggcgcagctccaacaacagcactcacttctgcagcagcagcagcagcaacagatccagcagcaacagttacagagaatgcaccagcagcaacaacagcaacaaatgcaaagccagacagccccgcacctttcgcaaacctcgcaggccctgcagcatcaggtgcccccacagcagccacctcagcagcagcagcagcaacagccccctcctagcccgcagcagcaccagctattcggacacgatccagcggtggagatccccgaagaagggtttcttctcgggtgtgtgttcgccatcgccgattaccccgaacagatgtcggataaacagctgctcgctacttggaagcggatcatccaggctcatggtggaacggtggaccccaccttcacctctcgctgtacacacctgctctgcgaatcacaggtgtccagtgcctatgcgcaggctatccgggagcgtaaaaggtgtgtcaccgcccactggttgaatactgtgttgaagaaaaagaagatggttccaccccaccgagctctgcactttcccgtcgcctttccccccggaggcaagccttgctcacagcatatcatcagtgtcactggatttgtggatagcgatcgcgacgatctgaaactgatggcctacttagctggcgccaaatacacaggttacctgtgtcggtccaatacagtgctcatctgcaaagaacccaccggtctgaagtacgagaaagctaaggaatggcgcattccctgcgtgaacgcacagtggcttggtgacatcctgctgggtaactttgaagccctgagacaaatacaatactccaggtacaccgcctttagcctgcaagatccattcgcccctactcaacatttagtgttaaacctgttggacgcatggagggtccccctcaaggttagcgccgaacttcttatgagtataaggcttccccctaaactcaagcagaacgaggtggctaacgtccagccgtcctctaagagggcccggatcgaagacgtcccacccccaaccaaaaaactcactcccgaactcaccccgttcgtactgttcaccggattcgaacctgttcaggtgcagcagtacatcaaaaaactatacatcttggggggagaggtggctgaatccgcccagaagtgtacacatttgatcgcgagcaaagtcacccggaccgtcaagtttctcacggctatttctgttgtgaagcacatcgtcactccagagtggcttgaagaatgcttccgatgtcagaaattcattgacgagcaaaactatatcctaagagacgctgaggctgaggtcctcttcagcttcagtttggaggagtcattaaagcgggctcacgttagtcctctgtttaaggccaagtatttttacattacccccggcatttgtccttcgctctccacaatgaaagccattgtcgaatgcgctggtggcaaggtgctgtcaaagcagccaagtttccgcaaactgatggagcacaagcaaaacagctcactctccgaaatcatcctgataagttgcgagaacgacctacacctgtgtcgggaatattttgctcgcggcattgatgtgcataatgcagaattcgtgctgaccggagtgttaacacaaaccttggattatgaaagttataaattcaattag

SEQ ID NO: 12673 - DNA, 3210 bp, Artificial Sequence
  Description of Artificial Sequence: Synthetic coding sequence
atgagcgaccaggcccccaaggtcccagaggaaatgttccgcgaagttaaatactatgcagtgggagacatagatccacaggtaattcagctcctcaaggccgggaaagccaaggaggtgagctataatgccttggcgagtcacattatcagtgaggacggagacaacccagaggtgggcgaagctcgcgaagtgtttgatctgcctgtggtgaagccctcctgggtgatcctctccgtgcagtgtggaacgctccttccagttaacggattctcccccgagtcctgtcagatctttttcggaataacggcatgtctcagccaggtgagctccgaggatagatcagccctgtgggctctggtgaccttttatggaggcgattgccagcttacgctcaataagaagtgtacccatctgatcgtaccggagcctaaaggagaaaaatacgagtgcgctttgaagagagccagcataaaaatcgtcacacccgattgggtgctggattgcgtttcagaaaagacaaagaaagatgaggcgttctaccaccccaggctgattatctacgaagaggaggaagaggaggaggaagaagaagaggaggtggaaaatgaagagcaggactctcaaaatgagggtagcacggatgaaaagtccagccctgcctcgtcacaggagggtagcccttccggggatcaacagtttagccctaagagcaacaccgaaaaaagcaaaggggaactaatgttcgacgattcctccgactcatcacctgagaaacaggagaggaacttgaactggaccccagctgaagtcccccaactggccgccgccaagaggcgattgccccaggggaaggaacccgggttgataaatctatgcgctaacgttccaccagtgccggggaatatcctgccgccagaggtcagaggaaatctaatggccgccggacaaaatctccagtccagcgagcgatcagagatgatcgccacctggagtccggcagtacggacactgaggaatattacaaataatgctgacatccaacaaatgaatcggccctctaacgtggcacacattcttcaaaccttgtccgcgcccaccaaaaatctagagcaacaggtcaatcatagtcaacaagggcacacgaacgcgaacgccgttcttttctcacaagtgaaagtgacacctgaaacccatatgttacaacaacagcagcaagctcagcagcagcagcagcagcacccggtcctccacctccaaccacagcaaataatgcagctgcagcaacagcagcagcagcagatctcacagcagccgtatcctcagcagccaccacatcctttcagccagcagcaacaacagcaacaacaggcacaccctcaccagttctcacagcagcagctgcagtttcctcaacagcagcttcatcccccgcaacagctgcatcgcccgcagcaacagttgcagcctttccagcagcagcatgcgctgcagcagcagttccatcaacttcagcagcatcagctccagcagcaacaactggcccagctgcaacaacagcacagtctgctccagcagcagcagcagcagcaaatacagcagcagcagctccagcggatgcaccagcagcaacagcaacagcaaatgcagtctcagaccgctccgcacctaagccagacctcacaggccctgcaacaccaggtgccacctcagcaaccacctcagcagcaacagcagcaacagcctccgccaagtcctcagcagcaccaactctttggtcacgacccagcagtggagattccggaagagggattcctgctgggctgtgtgttcgccatcgcagattatcctgaacaaatgagcgacaagcagctccttgctacctggaagaggattattcaagcccatggcggaacggttgacccaacatttacatctaggtgcacacacctgctctgtgagagccaggtttcaagtgcatatgcacaggccattcgtgagcggaagcgctgcgtcacagctcactggctaaatacggtgcttaaaaaaaagaagatggtgccaccgcatcgcgcactccacttccccgtcgcattccctcccggaggcaagccgtgtagccagcacatcatcagcgtgacaggtttcgtggactcagatagggatgacctgaagctgatggcctacttggccggagctaagtataccggttatctgtgccgaagtaacaccgtgctcatctgtaaggagcccacaggacttaagtatgagaaggctaaagagtggcgtataccttgcgtaaacgcacaatggctgggggatatactgttggggaacttcgaggctttgcggcaaatccagtatagtagatataccgcattttccctgcaggatccttttgcccctacacagcatctggtcctgaacctgcttgacgcatggagggtccccttaaaggtctcagcggaattactgatgagcatccgactgccccctaagttgaaacaaaatgaggtcgcgaacgtgcagccaagttccaagagagcacggattgaagacgtgcccccaccaaccaagaaactgactccagaactgaccccgttcgttctatttacagggttcgaacctgtccaggtgcaacagtatattaaaaagctgtatatactcggcggggaggtggctgagtcagcccagaagtgcacccatctgatcgcctcaaaagtcacaaggactgtcaagtttctaaccgccatatccgtagtgaaacacatcgtcacaccggagtggctcgaggaatgctttaggtgccaaaaatttattgatgagcaaaactatatcctgcgcgatgcggaagcagaggtgcttttttcattttccctggaagaatcccttaaaagggctcacgtgtctccactttttaaggctaaatacttttatatcacacctggaatatgcccttccctgagcactatgaaggctattgttgagtgcgctggcgggaaagttctgtccaaacagccatcattccgtaaactgatggagcacaagcagaattcatctctgtccgagattatcttaatcagctgtgaaaatgatctccacctgtgtcgggaatacttcgctagaggtattgacgtgcataacgcagagtttgttctgactggggtcctgacccagactctagattacgagagttacaaattcaactag

SEQ ID NO: 12674 - DNA, 4668 bp, Artificial Sequence
  Description of Artificial Sequence: Synthetic coding sequence
atgagcgagcagacacccgctgaagcgggggcagctggcgcacgcgaagacgcttgccgggactaccagtcctcactggaagacctaaccttcaattctaagcctcatatcaatatgctgacaattttggctgaggaaaacctgccttttgctaaggagatcgtctcgttgattgaggcacagaccgcaaaagcaccatcctctgaaaagctcccagtgatgtacttaatggattcaattgtcaaaaatgtgggtcgcgagtatcttactgctttcactaaaaatcttgtggctaccttcatctgtgtgtttgaaaaagtggatgaaaatacccgaaaaagcctatttaagctccggtcaacatgggatgaaatcttccccctgaaaaaattgtatgctctggacgtgagagtcaatagcctggatccagcatggcctatcaagccactccctcctaatgtgaacacatctagcatccatgtcaaccctaaattcttaaataagtcccctgaggaaccgtcgacgccaggcaccgttgtcagttcaccatccataagtaccccacctattgtccctgacatacaaaagaatctcacacaggaacagctaatacgccagcagctattagctaagcaaaaacaactattggagcttcagcagaagaagctcgaactggaacttgagcaggcaaaagcacagctcgctgtctctctctccgttcagcaggaaacctcgaatttaggacctgggtccgccccctccaaactacatgtctcgcagatcccccctatggctgtgaaggcccctcaccaggtgcctgtgcagtccgagaagtctaggccaggaccctctctccaaatccaagatctaaagggtactaacagagatcctcggctgaataggatctcacagcacagccacggtaaagatcaaagccataggaaggagttccttatgaataccctcaaccagagcgacactaagaccagcaaaaccataccttcggagaaactcaactcatccaagcaggagaagtcaaaatctggcgagaagatcacaaaaaaagaactggatcaactagattctaagtccaaatctaaaagtaaatcgcctagtcctctgaagaataaattgtctcatacaaaggacctcaagaaccaggagagcgagtcaatgagattaagcgacatgaacaaaagggatcccaggctcaagaagcacctgcaggacaagaccgatggaaaagacgatgacgtgaaggaaaaacgaaagactgccgagaagaaggataaagacgaacatatgaaatcatccgagcataggctggccggttcgagaaacaaaattataaacggtatagtgcagaagcaggacacgattactgaggaaagtgaaaaacaggggaccaagcccggaagatcctctacacggaagcgtagcagatcaaggagtccgaagagtaggagccctattattcattccccaaagcggcgcgataggcgatcacccaaaaggcgtcagcgtagtatgtccccgactagcacacctaaagctggaaagatccggcaatcaggggcgaagcagagccacatggaggagttcaccccccccagtagagaggataggaatgcaaaaaggtcgacgaaacaggacattagggatcctcggagaatgaaaaagacagaggaggagcgaccacaagaaactacaaaccagcatagtacgaaatccggaaccgaacctaaggagaatgttgagaactggcagtcgagtaaatcagcgaagcgatggaaatccggctgggaagagaataaaagtttgcagcaagtcgacgagcattctaagcccccccacttacgccacagggaatcctggtcatccaccaaaggaatcctcagccctcgcgctcccaagcagcagcagcataggctgtcagtcgacgccaatctgcagattccaaaagaactcaccctggccagcaagcgcgagctgttacagaaaacatccgagcggctcgcctccggtgaaatcacccaggacgacttcctggtggtcgtacaccagatccgtcaattattccagtatcaggagggcgttcgggaagaacagaggtctcctttcaacgatcggttccccttgaaaagacccaggtacgaagattcagataaaccgttcgtagactcacccgccagccggttcgccggattggatacgaaccagcgcctcactgccctcgctgaggatcggccgctgtttgatggaccctcaaggccgagcgtggcgcgtgatggacctaccaaaatgatcttcgagggcccaaataagctgagcccaagaatcgacggcccccctacccctgcatccctcaggtttgacggctcacctggtcagatggggggcggtgggcccttgagattcgaggggccgcaggggcaactgggcggtggctgcccactgcgatttgaggggccccccggccctgtgggtactccactgagatttgaaggcccaattggccaagccggtggaggcgggtttagatttgaagggtccccggggttacggttcgaaggatcacctggaggattgcgctttgaggggcccggcgggcaaccagtaggcggcctacggtttgaaggccaccggggccaaccagtgggtgggctgcggtttgaaggtcctcacggccagccggtggggggactgcgcttcgacaacccccgcgggcagccggtggggggactcagattcgagggaggtcatggccctagcggagccgctatacgcttcgatggaccacacggccagcctggaggcggaatccgctttgagggacccctgttacagcagggcgttggcatgcggttcgaaggaccccacgggcaaagcgtggcaggccttcgttttgagggccagcataaccagctcggagggaatttgcggttcgagggaccacacggacagccgggcgtcggaatccgcttcgagggaccactggtccagcaaggaggcggcatgcggtttgaaggacccagtgtccccggaggaggactccgaatcgagggacctttaggccaaggaggtccacggttcgaaggatgtcacgccctccgctttgatggacaacccggccagccatctctccttccacgctttgatgggctgcacgggcagcctggtccgcggttcgagaggactcctggccagccaggaccacagcgctttgatgggcccccaggccagcaggttcagcctcgctttgacggggttccacagcgctttgacggaccccagcatcaacaggcgagcagatttgacattcctctcgggcttcagggaactcggttcgataaccacccttcgcagcgactggaaagcgtgagtttcaatcaaactggcccttacaacgatccgccaggcaacgcttttaacgctccctcacagggactgcagttccagagacacgaacagatatttgactcaccacaaggccctaactttaatgggcctcacggcccaggcaatcagagttttagcaaccccttgaaccgtgcttccggacactacttcgacgaaaagaatctccaaagttcacaatttggtaatttcggcaacattcctgccccaatgaccgtgggcaacatccaggcaagtcagcaagtcctgtccggggtggctcagccagttgccttcggacagggacagcagtttctcccggtacacccacagaacccaggctttgtgcagaacccttccggcgcgttaccaaaggcttatccagacaaccacctgagtcaggtcgatgtgaacgagcttttctctaagcttctgaaaactggcatcctgaagctctctcagacagacagtgctaccacccaggtttccgaagtgaccgcccagcctccccccgaagaagaagaagatcagaatgaagatcaggatgttcctgatctgaccaattttacagtggaggaactgaaacagaggtatgacagtgttattaatcggctttataccggcattcaatgttactcgtgtggaatgagattcacgacctcacagactgacgtctacgctgaccacctggactggcactaccggcaaaaccgcactgaaaaagatgtgagtagaaaagtcacccaccgaagatggtattatagcctaaccgattggattgagttcgaggagatcgcggatctggaggagcgtgcaaagagccagttcttcgaaaaagtgcacgaggaggtagtgcttaagacacaggaggcagccaaagagaaggaatttcagtctgtccctgcgggtcccgcgggcgccgtggaatcatgcgaaatctgtcaggagcagtttgagcagtattgggacgaggaagaggaggagtggcatctcaagaatgccatcagggtagacggaaagatctatcatccctcgtgttacgaggattaccagaacaccagctcgttcgactgtaccccatcccctagtaaaacaccagtcgagaatccattgaatatcatgctcaatatcgtgaagaacgaacttcaggaaccctgcgactctcccaaggtcaaagaagagagaatagacacacctcctgcctgcactgaagagtccatagcaacaccaagcgagatcaagactgaaaatgacaccgtagagagcgtttag

SEQ ID NO: 12675 - DNA, 2355 bp, Artificial Sequence
  Description of Artificial Sequence: Synthetic coding sequence
atgtccgagcagacccctgctgaggctggagccgccggcgcccgggaagatgcttgccgagattaccaatctagcctagaagacctgaccttcaactctaaaccccacatcaatatgctaacaattcttgccgaggagaacctgcctttcgctaaagagattgtttccctgatagaggcccagaccgcaaaagcaccctcctcggagaagctaccagttatgtacctcatggattccattgttaaaaatgttggcagggaatatctcaccgcatttactaagaatctcgtggccacttttatctgtgtgttcgagaaagtggacgagaatacgcggaaatctctgttcaagcttagatcaacctgggacgaaattttcccgctcaaaaaactgtatgcactggacgtcagggtcaacagcctcgacccagcctggcccattaaacccttgcctcccaatgtgaacacaagcagcattcacgtcaatcctaagtttctgaacaaaagtccagaagagccttccactcccggcaccgtggtctcaagcccgtccattagcacacctcccatagtgcccgacatccaaaagaatctgacccaggagcaactcatccggcagcagctgctcgcgaagcaaaagcagctgctagaattgcagcagaagaagctagaactggaattagagcaggccaaggctcagctggctgtctcactgtctgttcagcaggaaacaagtaacctgggtcctgggtccgccccatctaaactgcacgtatctcaaatccctcctatggcagtcaaagctccccaccaggtcccggtgcagagtgagaaaagcagacccggacctagtctacagatccaggatttgaaaggaactaaccgggatccaaggctcaaccgcatttcccagcattctcacggtaaagaccagtctcaccgaaaggagttcctgatgaacactttgaaccagagcgacaccaagaccagtaagaccattccctcagagaagctgaattctagcaaacaggagaaaagcaaatccggggagaagatcactaagaaggagttggaccagttagatagtaagtcaaagagcaaatccaaaagcccctctccactgaagaacaagttgagccataccaaggacttgaaaaatcaggaaagtgagagcatgcggctatcagatatgaacaaacgcgacccccggctgaaaaagcatttgcaagataagacagacggcaaagacgacgatgtgaaagagaagcgcaagacagccgagaagaaagacaaagacgaacacatgaagtcatccgaacatcggttggcgggttcgcggaacaaaattatcaatggcatcgtgcagaagcaggacaccattacagaagaatcggagaagcaggggacaaaacctggtagatcttcaacccgcaagcggtcacgctcccgttctcccaagtcgcggtccccaataattcactcaccaaaaagacgggatagacgctcacccaaaagacgacaacgttcaatgtcccctacgtctacccctaaggccggaaaaattcggcaatcaggagcgaagcagagtcatatggaagagttcacccccccctcacgtgaggaccggaacgcaaagcgcagtacaaagcaagacatacgcgacccacgacgcatgaagaagaccgaagaagagaggccccaggagaccacaaaccagcactcaaccaagtctggaacagaaccaaaagagaacgtggagaattggcagagtagcaagtctgccaaaaggtggaagtctggctgggaagagaataagtcactgcagcaggtcgatgagcattccaagccgccacatctgcgtcaccgcgagagctggtcctctaccaaggggatcctgtctcccagagcaccaaagcagcagcagcatagactcagcgtcgatgctaatctccagatcccaaaggaactgacgctcgctagcaagcgggagttgttgcagaagacatccgagcgccttgcatctggggagatcacccaagacgattttctggtggtggtccatcaaatccgacagcttttccagtaccaggagggggtgagggaggagcaaaggtctccattcaatgaccgctttccgctcaagaggccccgttacgaagatagcgataaaccctttgtcgattcccctgcaagcagatttgccggtttggacaccaaccaaagactgacagccctagcagaggatcggcctctctttgacgggcctagtcggccctctgtggcccgagatggaccaactaagatgatttttgaagggcccaataagttgtcacccagaatagatggtccaccctag

SEQ ID NO: 12676 - DNA, 4344 bp, Artificial Sequence
  Description of Artificial Sequence: Synthetic coding sequence
atggctcatagtaaaactaggacaaatgatgggaaaatcacataccctccaggagtgaaagagatcagcgacaaaatctctaaggaggagatggtccggcggctgaagatggtcgtgaagacatttatggacatggaccaggattctgaagaagagaaagaactttaccttaacctcgctttgcatttggcttctgatttttttttgaaacaccctgataaggacgtgcgactgcttgtcgcctgttgccttgccgacatttttaggatctacgcccctgaggcgccctacacttcgccagacaagttgaaagacatctttatgtttattactcgccagctcaagggactcgaagacactaaatccccccagtttaaccgatacttctacctcctggaaaacatcgcatgggtgaagtcgtacaatatatgttttgagctcgaggacagtaacgagatattcactcaactgtaccggactcttttctccgtaataaacaacggacacaaccagaaggtccacatgcatatggttgatctgatgtctagcatcatctgtgaaggcgacaccgtgtcacaagagcttctggacacagttctggtgaacttggtacccgcccacaaaaatttaaataaacaggcttacgacctggccaaggctctgcttaaacgcaccgcccaagccatcgagccttatattacaaacttttttaaccaagtattaatgctgggtaagaccagcatttcggatctgtccgaacatgtcttcgatctcatcctcgaactgtacaacatagacagtcacctcctgctgtcagtcttgccccagttggaatttaagctgaagagcaacgacaatgaggaacgtttacaggtggtgaagttgctagcaaagatgttcggcgctaaggacagtgaactggcttcacagaataagccgctttggcaatgctatctggggaggtttaatgacatccacgtgccaatcaggctggagtgcgtgaagttcgcttctcattgtctgatgaaccatcctgatttggccaaggatctgaccgagtatctgaaagtacgcagccacgaccctgaggaagccatccggcatgatgttattgtgagcatcgtaaccgcggctaaaaaggatatcctgttagtgaacgaccacttgctaaactttgtgagggagcgtaccttagacaaacgctggcgggtaagaaaagaagcgatgatgggactggctcagatttacaagaaatacgcgctgcagtcagccgcggggaaggacgcggcgaagcagattgcttggattaaagataagctgctgcacatatattaccagaactccattgacgaccgcctgctggtggaacgcatatttgctcagtacatggtgcctcacaatctggaaacaacagaacgaatgaaatgtctgtattatctttacgcaaccctggacctcaatgccgtcaaggctttaaacgaaatgtggaaatgtcagaacttactgagacaccaggtgaaggatctcctggacctcataaagcaaccaaaaaccgacgcctctgttaaggcgatcttctctaaggtgatggttatcaccagaaatcttccagaccccggaaaggcccaggatttcatgaagaaatttacccaggtacttgaggatgatgaaaagatacggaaacagctggaggtactggttagccccacttgttcctgcaaacaggccgaaggttgcgtgcgagagatcacaaagaagctgggtaaccccaagcagcctactaaccctttcctggagatgattaagttcctgttggagaggatcgcacccgtccacattgacactgaaagtatttccgccctcattaagcaggtcaataagtccatcgacggtaccgctgacgacgaggacgagggcgttccgaccgaccaggcgatccgggcgggtctggagctgctcaaagtgctcagctttactcacccgatttctttccactccgcagagacatttgagagcctgttggcctgtctcaagatggatgacgaaaaagttgccgaggctgcacttcaaattttcaaaaacactggatcaaaaatagaggaggatttcccacacatacgttccgcactgctccccgtgctgcatcacaaatcaaagaagggacctccaaggcaggccaagtacgccattcactgtatccacgctatcttttctagtaaggagacacagtttgctcaaattttcgagcctttgcacaaaagcctcgatcccagtaatctggagcacctgatcaccccgctcgtcacaataggacatatcgcccttttagctcctgaccaatttgccgcacccctcaagagtctcgttgccacatttatcgttaaagacttgctgatgaacgacaggttgccaggcaagaaaactaccaagctgtgggtgcctgacgaggaggtgagtcccgagacaatggtgaaaatacaggccatcaagatgatggttcggtggctccttggtatgaagaacaaccatagcaaaagtgggacgtctaccctgcggctgctgacaactattctgcattcagacggagacctcacagagcagggtaagatttctaagcccgacatgtcccgccttcggttggctgccggctcggccatcgtgaagctagcgcaggagccctgctaccacgagataatcaccctggagcagtaccagctgtgcgccctggctatcaatgatgagtgctaccaggttaggcaggtattcgcccagaagctgcataagggtctgagccgtctgcggctcccacttgagtacatggctatctgcgccctgtgcgccaaagatccggtcaaagagagaagagcacacgctaggcaatgtctggtgaagaatatcaacgtccggcgggaatatctgaagcaacacgccgctgtttctgagaagttgctctctctgcttcccgagtatgtggtaccatacacaatccatctgttggcccacgacccggactacgttaaggtgcaggatattgagcagctgaaggatgtaaaggaatgcctttggtttgtgctcgagattttgatggccaaaaatgagaacaatagccacgcattcatcaggaagatggtagaaaacattaaacagaccaaggacgcgcagggaccggacgatgctaaaatgaacgaaaaattgtataccgtttgtgatgtggccatgaatattatcatgtctaagagtacaacctactctctggagagccccaaagatccggttctgcctgccagattctttacacagccagacaagaacttcagcaatacaaagaactatctgcctcccgaaatgaaaagcttttttaccccgggaaaaccaaaaacaaccaacgtcctgggggccgttaacaaacctctctctagcgccgggaaacagagtcagacaaagtccagtcggatggagaccgtgagcaatgcctcctcttcttcaaacccgtcctcacctggcaggataaaagggagattagattctagtgaaatggaccatagcgagaatgaagattatactatgagctccccgcttccaggcaagaagagcgacaagagggatgatagcgacttggtgcgttcagagctggagaagcccagaggtcgaaagaagacaccagtgacggagcaggaagagaagctcggtatggatgatctgaccaaactagtgcaggaacagaaaccaaaaggctcacagcggagccgaaagcgcgggcacaccgcctccgagagtgacgagcaacagtggcccgaggaaaagcgcctgaaggaagacatcctcgaaaatgaggacgaacagaattctccccccaaaaagggcaaaaggggccgtcccccaaaacccttgggagggggcactcccaaggaagaaccaacaatgaaaacatctaagaagggctctaaaaaaaaatccggtccccctgccccggaagaggaggaggaagaggagagacagtcgggaaataccgagcaaaagtccaaatccaagcagcaccgagtcagccgacgcgctcagcaacgggctgaatcgcccgagagttctgccatcgaatcaactcaatccacaccacagaaggggcggggccgcccatccaagactcccagcccttcacaaccgaagaaaaacgttagagtcggccgctctaagcaggccgccactaaggagaacgatagttccgaagaagtggacgtttttcaggggagtagccctgtcgatgatatcccacaagaggagacagaggaggaggaagtcagtacagttaacgtgaggagaaggtccgccaagagagagcgacgatag

SEQ ID NO: 12677 - DNA, 3909 bp, Artificial Sequence
  Description of Artificial Sequence: Synthetic coding sequence
atggcgcactccaagaccaggacgaacgatgggaaaataacatacccccctggcgtgaaagagatttctgataaaatcagtaaggaagaaatggtccgacggttgaagatggtcgtgaaaacattcatggatatggatcaggattcagaggaagagaaagaactgtatctgaatctcgccctccacttggccagtgacttctttttgaagcacccggacaaggatgttcgccttttggttgcgtgctgcctggccgatattttccgaatttatgcccccgaggcaccctatactagccccgacaaattgaaagatatctttatgtttattactcggcagttgaagggacttgaagatacaaagtcaccccaattcaatcggtacttctacttgctggaaaacatagcctgggtcaaatcttataacatctgctttgagctggaggatagcaacgagatattcacccagctgtaccggacactgttctctgtcataaataatggccacaatcaaaaagtccatatgcacatggtagatctgatgtcttcgataatttgcgaaggcgacacagtgtcccaggaactgcttgacaccgtgctagtcaatctggtccctgcacataaaaatttaaacaaacaggcatacgatctggccaaggctttactgaagagaacagctcaagccatagagccctatataaccaacttcttcaaccaggtgttgatgctgggcaagactagcatttcagaccttagtgagcatgtctttgacctgatcttggaactgtacaacatcgactcccacctgctgctgagtgtcctgccacagctggagttcaagttgaagagcaatgacaatgaggagcgcctgcaggttgttaagctgctggcgaagatgttcggtgctaaggatagcgaactggccagccagaataaacctctttggcagtgctatctggggagatttaatgacatccatgtcccaatccggttggaatgtgtgaagttcgctagccactgtctgatgaaccaccctgacctcgccaaagatttaacagaatatctgaaggtcagaagtcacgatcccgaggaggcgatcagacacgacgtcattgtgtccattgtaactgcggcaaagaaggacatcctgctcgtcaacgatcacctcctgaattttgtgcgcgaacggaccctggacaagaggtggagagtcagaaaggaggccatgatgggcctggcgcaaatctataagaaatacgcccttcagtccgccgccggcaaagatgccgcaaaacagatcgcttggatcaaggacaaattgctgcatatctactaccagaacagtatagacgacagactcctggttgaacggatattcgcacagtatatggtgccacataacttagaaaccacagaacgcatgaaatgtctgtattatctctacgcaaccctcgacttaaacgcagtcaaagcgctgaatgagatgtggaagtgtcaaaatctgttgagacatcaggtgaaggatctgctagacctaataaagcagcctaagacagatgcctccgtcaaagctatcttttcgaaggtgatggtgatcacccgcaacttgccagaccctggaaaagcacaagactttatgaagaagtttacgcaagtcctggaggacgatgagaaaatccggaaacaacttgaagtacttgtgagtcctacctgcagttgtaaacaagcggagggctgtgtacgggaaatcactaaaaagctcggcaacccaaagcagcccacaaaccccttcctggaaatgatcaagttcctacttgagaggatagcccctgtgcacatcgacaccgagtctataagcgccctgatcaagcaggtgaataagagtattgacggaactgctgatgacgaagatgagggagttcctacggaccaagccataagggccggattggagcttctgaaggtactttctttcactcatcctatctcctttcacagtgccgagaccttcgagagtctcctggcatgtctgaagatggacgacgagaaggtcgctgaagcagcactgcagattttcaaaaacacaggcagcaagatcgaagaggactttccgcatatccggtccgccctcctcccagttctgcaccataagtccaagaaaggaccaccccggcaggccaagtatgccattcactgtatccacgctatattctcctcgaaagaaacacaattcgctcagattttcgaacctctgcataagtccctcgacccctccaaccttgaacacctcattacccctctggtgacaatcgggcacattgccctcctagctcctgatcagttcgccgcgcccttgaagagtctggtcgcaacctttatcgtcaaggacttgctaatgaacgacagactgccaggtaagaagacaacaaagctgtgggtaccagatgaagaggtgagtccggaaactatggtgaagatccaagccatcaagatgatggtgagatggctcctgggcatgaaaaacaaccatagcaagagcggaacaagcaccttgcgcctcttgactactatcttgcactcagatggtgatctgactgaacaaggaaagattagtaagccagatatgagtagactcagattagctgctggttcagccattgtgaagttggcacaagaaccttgctaccatgaaattatcacccttgaacagtatcagctttgcgccctggccattaacgatgaatgctaccaggttcgtcaggtgttcgctcagaagctgcacaagggcctttctagactccggttacccttggagtatatggctatttgcgccttgtgtgccaaggacccggtgaaggagcggagggcgcacgcgaggcagtgcctagtaaaaaatattaacgtgcggagggaatacttaaaacagcacgccgcggtctccgagaagctgttgtcccttttgccggagtacgtggtgccgtatacaatccacctgctcgctcatgatcctgactatgttaaggtccaggatatagaacagctcaaggatgttaaggaatgcctgtggttcgtgttggagatcctcatggcaaagaatgaaaataactcccacgcattcatcaggaagatggtcgaaaacatcaagcagacgaaagacgcacaaggtccagacgatgctaagatgaacgaaaagctctatactgtttgcgacgtggccatgaatattatcatgagcaagagcactacttacagcctagagagtccaaaggatccagtgctgccagcacgtttcttcacgcaaccagacaaaaattttagcaacaccaagaattatctgccccccgagatgaagtccttctttacacccggtaagcctaaaaccaccaacgtgctgggggcagtgaataaacccctgtcatctgctggcaaacagtcccaaactaagtccagccggatggaaaccgtctccaacgctagtagcagctcaaaccctagctcccctggtcggatcaaaggtagactcgatagtagcgaaatggatcactccgagaatgaagactacacaatgagttccccactgcctggcaagaagagtgacaagagggacgattctgatctggtgcggagcgagttagagaagcctcggggtcgaaaaaagacgccggtgacagaacaggaggagaagttggggatggacgaccttacaaagcttgttcaggaacaaaaacccaaaggctcacaacgctcccgaaaacgcggccacactgccagtgagagcgacgagcagcagtggccagaggaaaaacgactgaaagaggacatactagagaatgaggatgaacaaaattctctccctttacatcagaaagatgcctctgatcggaggactacgatgcagatcgtgaaatag

SEQ ID NO: 12678 - DNA, 2115 bp, Artificial Sequence
  Description of Artificial Sequence: Synthetic coding sequence
atggcaaatgaaaaccacggcagtcccagagaggaagcctctcttctgagtcacagtccgggcacctccaatcaaagccagccatgtagtccaaaacccatcaggctggtgcaggatcttcccgaagagctggtgcacgccggatgggagaagtgttggtcaagacgggagaaccgtccctactactttaacagattcacgaaccagtcattgtgggaaatgccagtcctgggccaacacgatgtgatctcagatcctctcggactcaacgctacccccctgccgcaggattcttccctcgtggagacaccaccagcggaaaataagccgagaaagcgtcagctgtctgaggagcagccttctggcaatggcgtgaagaaacctaaaatagagatcccagttacacccactggacagagcgtcccttcctctccttctataccaggaactccaacactgaagatgtgggggacgagccccgaggataagcagcaagccgctctgctgaggccaactgaggtgtattgggacctggacattcagacgaatgccgtcatcaaacataggggcccgtctgaggtgctgccaccacatcccgaagtggagctgctgcggagccagctgatcctgaaattgcgtcagcattaccgtgaactgtgtcagcagcgggaaggcatcgagcctcctcgtgagagttttaaccgctggatgctagagcgaaaagtggtggataaaggcagtgatcccctgctgccctcaaattgtgaaccagtggtatctccaagcatgtttcgtgagatcatgaatgacattccaattcgcctgagccgcataaaattccgcgaggaggcaaagagactgctcttcaagtacgccgaggccgcccggaggctgatcgaatcccggagtgcgtcacccgattcccggaaagttgtgaagtggaatgttgaagacactttttcatggctgcgaaaggaccactctgcaagcaaagaggattacatggatcggctggaacacctgcgcaggcaatgcggtccccatgttagtgcagcggccaaggacagtgtcgaaggaatatgctctaagatttaccatatctcactggaatatgtgaagagaattcgcgagaagcatctcgccattttgaaggagaacaacatctccgaagaggttgaggctccggaagtcgaaccacggctggtgtactgttacccagtgagactggccgtgtcagctccacccatgccctcggtagagatgcacatggaaaataacgttgtgtgtattcgctataagggggagatggttaaagtgagtaggaattatttcagcaaattgtggctactgtataggtatagttgcatcgatgactcagcgttcgagcgcttcttgccccgcgtctggtgtctcctgcgaaggtatcagatgatgtttggcgtgggcttgtacgaaggaaccgggctgcagggatcccttccggtgcacgtgtttgaagcgctgcaccggttgttcggggtctcatttgaatgttttgcatcaccgctgaattgctatttcagacagtattgtagcgcgtttcctgacactgatgggtacttcggaagcaggggaccttgccttgactttgctccgttgagcggttcctttgaggcgaacccacctttttgcgaggagttgatggatgcgatggtatcacactttgagaggctactcgaatcatctcctgaacctttatcctttatagtcttcatccccgaatggcgggaacctccaacacccgcactgacccgtatggaacagtcgcgctttaagcgtcatcagctaatcttgcctgctttcgaacacgagtatcgatcaggttctcagcacatttgtaagaaggaagagatgcactacaaggccgtgcacaacacagccgtgttattcctgcagaacgacccagggttcgcgaaatgggcacccacaccggaacgcttacaggagttatctgcagcttatcggcagtccgggcgaagccattcctcaggctcaagttcttcatcttcctccgaggcaaaggaccgtgattctggtcgagagcagggacccagtcgcgagccccaccccacatag

SEQ ID NO: 12679 - DNA, 2133 bp, Artificial Sequence
  Description of Artificial Sequence: Synthetic coding sequence
atggccaatgagaaccacgggagtccccgtgaagaagcatcactgctgtcacatagtccagggacttctaaccagagccaaccctgtagtcccaaacctatacgtctggtacaggacctccctgaggagctggtgcacgcaggttgggagaaatgttggagtcggagggagaacagaccctactacttcaaccgttttaccaatcaatccctgtgggagatgccggttttgggccaacatgacgtgatatcagacccacttggcctgaatgctactccccttccccaggatagttccctggtggaaacccccccagctgaaaacaagccccgaaaaaggcagctgtcagaagagcagccttcaggtaacggagtgaagaagcccaaaattgaaattccagtaactccaacaggccagtccgtgccttccagcccctcaattcccggaacacccaccctgaaaatgtggggaaccagccctgaggataagcagcaggcggccctgcttcgacccacagaggtatactgggatctcgatatacagactaatgcggttataaagcataggggaccaagcgaggttttacccccccaccccgaggtggaacttctcagaagccagcttattctgaaactcaggcagcattacagggaattgtgtcagcagagagagggcatcgagcctccgcgagagagcttcaaccgctggatgctggaaaggaaggtggtcgacaaaggttccgacccacttttgccatctaactgcgagccagtggtgtcccccagcatgttccgcgagattatgaacgatatccctatacggctgtctcggatcaagtttcgcgaggaggccaaacggctcctgttcaaatacgccgaggccgccaggagactcattgagtctaggagcgcgtcccccgactcccggaaggtggttaagtggaatgtcgaagacactttctcttggttacgcaaagatcactccgcatctaaagaggactacatggacaggcttgaacaccttcggcggcagtgtggaccccacgtcagtgctgccgctaaagactcagttgaaggcatttgtagcaagatttatcacatttctctcgagtacgtaaaacgcatccgagagaagcatctggctattctaaaagaaaacaatatatccgaggaggtcgaggcacccgaggtggaaccaaggctggtatactgctatccagtacggctggcggtgtcagcgccaccaatgccatctgtggagatgcatatggaaaataatgttgtttgtattcggtacaaaggagaaatggtgaaggtctctcgaaattacttttctaaactttggctactgtacaggtattcatgtattgacgactcagcctttgaacgctttcttccacgcgtgtggtgtctattacggaggtaccagatgatgttcggggtgggactttacgagggaacaggactgcagggctccctgccagttcacgttttcgaggcattgcataggcttttcggtgtctccttcgaatgttttgcgagtcccttaaattgctactttcggcagtattgtagcgcatttcctgacacagacgggtacttcggatcgcgcggtccttgtctcgactttgccccactgagtggttcttttgaggctaaccccccattttgtgaagaactgatggacgctatggtcagccacttcgagagactgctggaaagctcacctgagcccctgagcttcatagtgtttattcctgagtggcgcgagccccctacccctgccctcacccggatggagcagtccagattcaaacgtcatcaactcatcttacccgcattcgagcacgagtataggagcggtagccagcatatatgtaagaaagaagaaatgcactacaaagccgtccataatacagctgtgctgttcttacagaacgaccccgggtttgccaagtgggctcctactcctgaacgcctgcaggaattgtcggcagcttaccgacaaagtggacgaagccatagcagcgggtcttcgtcctcatcatcttcagaggcgaaagacagagatagcggtcgcgagcaaggcccttcaagggagccccatcctgtggccaccctgttccacctgtag

SEQ ID NO: 12680 - DNA, 498 bp, Artificial Sequence
  Description of Artificial Sequence: Synthetic coding sequence
atgagtgttactctgcacactgatgtgggcgacattaagatcgaggtcttttgcgagaggaccccgaagacatgtgagatggagtcaagatgcgtcccccaggccggcgtgcaatggcgcgacctgggctctctacagccccccccgcctggatttaagcaggtcttttgcctgtccttgccacggaccggccgcggaggaaattcgatctggggcaagaaatttgaggatgaatattccgagtacctcaaacataacgtgagaggggtcgtgagcatggccaataacgggcctaacactaacggtagccaattcttcattacttacgggaagcagccccatctcgacatgaagtacacagtgtttggcaaggttattgatggcttggagacactggacgagctggaaaagctgcccgtaaacgaaaagacttatagacctctcaatgacgtgcacatcaaagatataacaatccacgccaaccctttcgcccagtag

SEQ ID NO: 12681 - DNA, 486 bp, Artificial Sequence
  Description of Artificial Sequence: Synthetic coding sequence
atgagtgttacgctgcataccgacgtcggcgacatcaaaattgaggtgttttgtgagcgtacacctaagacatgcgagaattttcttgcactgtgtgcgagcaattattataacggctgcatcttccatcgaaacatcaaggggttcatggtgcagaccggagacccgaccggtactggccgaggcggtaactcaatatggggaaagaagtttgaagatgagtactccgagtatctgaaacacaacgtgcggggcgtggtttccatggcgaacaatgggcccaatacgaacggctcgcagttcttcattacatacgggaagcaacctcacctggatatgaagtataccgtctttggtaaggtgatcgacgggcttgaaaccctggacgaactcgaaaaactacccgtgaatgagaaaacctaccggccccttaacgacgtacacattaaggatattactatccacgccaatcccttcgcacagtag

SEQ ID NO: 12682 - DNA, 498 bp, Artificial Sequence
  Description of Artificial Sequence: Synthetic coding sequence
atgtccgtaactctgcacactgacgtgggggacatcaaaatagaggttttctgcgaaagaacccctaaaacttgcgagatggaaagccgatgtgtgccacaagcaggtgttcaatggagggatttggggtcactgcaacctccacctcctggattcaaacaggtcttttgtctgtccttaccgcgaacgggccgcgggggaaatagtatctgggggaaaaaattcgaagacgagtactctgagtacctgaaacataacgttaggggggtagtgtctatggctaacaacggccctaatacaaatggatcacagttctttatcacttatggaaaacagcctcatctggacatgaagtataccgttttcggaaaggttatcgacggactggagactctggacgagctcgagaagttgcctgttaacgaaaagacgtataggccgttaaatgacgtgcacattaaggacattaccatacatgccaaccccttcgctcaatag

SEQ ID NO: 12683 - DNA, 243 bp, Artificial Sequence
  Description of Artificial Sequence: Synthetic coding sequence
atgagtgtgacattgcacacagacgtgggagacattaagattgaggtattctgcgagaggacacccaagacatgcgagaactttttggcactgtgcgcctcaaattattacaatgggtgcatctttcatcgtaatataaagggctttatggtccagacaggcgaccctaccggtaccggacggggtggcaactccatctggggcaagaagtttgaagacgagtactccgaatacctgaaatag

SEQ ID NO: 12684 - DNA, 1941 bp, Artificial Sequence
  Description of Artificial Sequence: Synthetic coding sequence
atggctgctgaatccggatccgatttccaacaaaggcgccggcgtagaagggatcccgaggagcccgaaaaaacggagctgagcgagcgggagctggccgtggccgtcgctgtatcacaggagaatgatgaggagaatgaggagcgctgggtgggaccattgccggtcgaggcaacacttgccaaaaagagaaaggtcctggaattcgagagagtttatttagacaatctccccagtgctagcatgtacgaacggagctacatgcaccgagacgtgatcacacacgtggtatgcaccaaaacagactttattataacagcctcccacgacggtcacgtgaagttctggaagaaaatcgaagagggcatcgagtttgttaaacattttaggagccatctcggagtaatcgagagtatagctgtgagtagcgaaggtgccctgttttgctctgtgggcgatgataaagcaatgaaggtttttgatgtggtcaactttgatatgattaatatgcttaagctgggctattttcccgggcagtgtgaatggatttattgccctggagatgccatatcaagcgtcgccgccagcgagaaatctacagggaagattttcatctatgatgggaggggagacaaccagccactacatatcttcgataagctgcacacctcccctttgacacagatcaggcttaatcccgtttataaagcggtagtcagttccgacaaaagcggcatgatcgaatactggactgggcctccgcatgagtacaagtttccaaaaaacgtgaattgggagtacaaaacagacaccgacctctatgaatttgccaaatgtaaagcctatccaacaagcgtttgtttctcccctgacggcaagaaaatcgccaccatcggttctgacaggaaggttcgcatctttcgatttgtcaccggaaaactgatgcgtgtcttcgatgaatctctctccatgtttactgaactgcagcaaatgagacagcaattgcctgacatggagttcggccgccggatggctgtggaaagggaactggaaaaggtcgacgctgtacgcctcattaacatcgtgttcgacgagaccggccacttcgtgctttatggcacgatgttaggcatcaaggttattaatgtggagactaaccgctgcgtaagaattctgggtaagcaggagaacatcagagtcatgcagctggccctgttccagggtattgctaagaaacaccgggccgccactacaatcgagatgaaagctagtgagaaccccgtactccagaacatccaagcagatcctactatcgtgtgtaccagcttcaaaaaaaatcggttctacatgtttacaaagagagagccggaagatacgaagtcggccgactcagaccgcgacgtgtttaacgagaagccaagtaaggaggaggtgatggcagcaacacaggccgaggggcccaaaagggtctccgactcggcgattattcataccagtatgggggatattcatactaagctctttcccgttgagtgccccaaaaccgtagaaaacttctgtgtgcactccaggaacggatactataatggacacaccttccaccgcattatcaaggggttcatgatccaaacaggagaccctacaggaaccggaatgggaggcgagtccatttgggggggagagttcgaagacgaatttcactcaacactgaggcacgatcgaccgtatacactatccatggccaacgcaggttcaaatactaatggctcccagttcttcattactgtcgtgccaactccctggctggacaataaacacacagtttttggacgtgtgactaagggcatggaagtggtacagcggattagtaacgtcaaggttaacccgaagacagacaaaccatacgaggacgtcagcatcataaacataaccgttaagtag

SEQ ID NO: 12685 - DNA, 1851 bp, Artificial Sequence
  Description of Artificial Sequence: Synthetic coding sequence
atgagacgtacaaagagtgcaggtctggacctgtacctttggcgtcagcactggccacgtcgagggaagcaaccccatgaggtgggtatatccaacagttacctggtattagaattcgagcgggtgtacctggataacctaccgtctgcttctatgtatgaaaggtcctacatgcatcgtgacgtaatcactcacgtggtatgtacaaagaccgacttcattatcactgccagccacgatgggcacgtaaagttctggaaaaaaattgaagagggcatagagtttgttaagcacttcagatctcacctgggtgtcatcgagagtatcgccgtgtcatcagaaggagccttgttctgctccgtcggggatgataaagctatgaaggtcttcgacgtggttaacttcgatatgatcaatatgttgaaactcggctatttccctggccagtgcgaatggatttattgcccaggtgacgccatctcatcagtcgccgcctccgagaaatcgacgggtaagatattcatctatgacgggagaggagacaatcagcctttacacatctttgataagttgcataccagcccattgactcagatcaggctgaatcctgtgtacaaagccgtcgtgagcagtgataagagcggcatgatcgaatattggactggtcctccacacgaatacaagttccctaaaaatgtcaattgggagtataagaccgatactgacctgtacgagtttgcaaagtgtaaagcatatcctacttccgtctgcttctctccagatggcaagaaaatcgctacaattgggtccgacagaaaagtcaggatttttcgcttcgtcaccggaaagctcatgagagtgtttgatgagtcattatctatgttcaccgagttgcagcagatgcgccaacagcttcccgacatggaattcggccggcgtatggctgtggagcgggaactcgagaaagtggacgcagtgcgcctgatcaatatcgtttttgacgagaccgggcacttcgtactctatgggacgatgttaggaattaaggttattaatgtggaaaccaaccgctgcgtacggattctcggaaaacaggagaacattcgggtcatgcagcttgcactcttccaaggtattgccaagaagcacagggccgcaacaacgatcgagatgaaagctagtgagaacccagtcctgcaaaatatccaggccgatccgactattgtctgcacgtcctttaagaagaacaggttctacatgtttacgaagagagagcccgaagatacaaagagcgcagactccgacagagacgtgttcaacgagaaacctagcaaagaggaggtgatggccgctacacaagccgaaggtccaaaaagagtgtccgacagtgcaatcatccacaccagcatgggggacattcacaccaagctcttccccgtggaatgtcccaagactgtagaaaacttctgcgtacactcgagaaacggttactacaatggccatacttttcaccgcattatcaaggggttcatgattcagaccggcgatcctaccggcactggcatgggcggggagtctatctggggaggggagtttgaggacgaattccactccaccttacggcacgatcgcccctacacactgagtatggcaaacgctgggtccaataccaatggctcccagttttttataaccgtggtgccaacaccctggctcgataacaaacacactgtgtttggtcgagtaaccaaaggcatggaggtcgtgcagaggatctccaacgtcaaagtcaatccgaaaactgataaaccatacgaagacgtgtcaatcatcaacatcaccgtcaagtag

SEQ ID NO: 12686 - DNA, 1473 bp, Artificial Sequence
  Description of Artificial Sequence: Synthetic coding sequence
atgaaagtgtttgacgttgtgaatttcgatatgattaacatgttaaagctcgggtacttcccaggccagtgcgaatggatctactgtcccggtgacgccatcagctccgtcgccgcatcggaaaaatcaacaggaaagatttttatatacgatgggagaggcgataatcagccactccacatcttcgacaagctgcatacgagccctcttacgcaaattcgtctgaaccctgtctataaagcagtcgtctccagtgacaagtcgggtatgattgaatattggacgggcccccctcatgagtacaaattccccaaaaatgttaattgggagtacaagacggacactgacttatatgaattcgcgaagtgtaaggcatatcccacctctgtgtgcttttccccggacggaaagaaaattgcaaccattggcagtgacaggaaggtccggatttttcggtttgtcaccggaaaactgatgcgagtgttcgacgagagtctgagtatgtttacggagctgcagcagatgcgccaacagctgcccgacatggagtttggcaggaggatggcagttgagagagagctcgaaaaagttgacgctgttcgattaattaatattgtgttcgacgagacgggccatttcgtgctgtatggaactatgttggggattaaggtgattaacgtcgagaccaatagatgcgtaagaatactgggtaagcaggaaaatattcgtgttatgcagctggccctcttccagggaatcgcaaagaaacaccgcgctgcaaccactatcgagatgaaggccagcgagaatcccgtgctgcagaatattcaggccgatcctaccatcgtatgcacatccttcaagaagaataggttctacatgtttacgaagcgagaacctgaggatactaaatccgctgatagcgatagagacgtctttaacgagaagccaagcaaggaagaggtgatggccgccacacaggcagagggccctaaacgcgtcagtgacagtgcaatcatccacacatccatgggggatatccataccaaactgttccctgttgaatgtcccaagactgttgaaaacttttgcgtacactcgagaaacggatactataatgggcatacattccacaggattataaagggattcatgatacaaaccggcgatccaacaggaaccggcatgggcggcgagtccatatggggtggagaattcgaggatgaattccactcgacactgagacatgatcgtccttacactcttagcatggccaatgccgggagcaacactaacggctctcagttctttattacagtggtgcctactccttggctggataataagcatacggtcttcgggcgcgtaaccaaaggaatggaggttgttcaacgaatcagtaatgtaaaggttaatcctaagacggacaagccttatgaggacgtcagcatcatcaatatcacagtcaagtag

SEQ ID NO: 12687 - DNA, 906 bp, Artificial Sequence
  Description of Artificial Sequence: Synthetic coding sequence
atggctacgacaaagcgggtgctgtatgtcggtgggctggccgaggaggttgatgacaaggtcttgcacgctgccttcatccccttcggggatattaccgacatccagattccactggattacgagactgagaaacatagagggtttgccttcgtagaattcgagctcgctgaggatgccgcggcggctattgataacatgaacgaatccgagctgtttggcagaaccatcagggttaatctggctaagcccatgcgcattaaagagggatcaagcagaccggtctggagcgatgatgattggttgaagaagttttctggaaagactctagaagagaacaaggaggaggagggatctgaacctcctaaggccgagacccaggagggggaaccaattgcgaagaaagcgagaagcaatccacaagtctacatggacatcaagattggcaataaaccagcaggccgcattcagatgctcctcagaagcgatgtggtccccatgacagcagagaatttccgatgtctgtgcactcatgaaaagggctttgggttcaagggatcgagctttcatcgtatcatcccacagttcatgtgccagggcggcgacttcacgaatcacaatggaaccggggggaagtccatatatggaaaaaagttcgatgacgagaacttcattctgaagcatacggggccaggtctgctgtccatggcaaattccggccctaatacaaacggaagccaattttttctaacgtgtgataagacagattggctagacggtaaacacgtagtcttcggggaagttactgaaggattggatgtccttcgtcagattgaggcccagggctcgaaggacgggaaacccaagcaaaaggtcattatcgcggactgtggcgaatatgtgtag

SEQ ID NO: 12688 - DNA, 891 bp, Artificial Sequence
  Description of Artificial Sequence: Synthetic coding sequence
atggcaactaccaagcgggtcctatatgtcggcgggttggccgaagaggtggacgacaaagtgctacatgccgcttttattccatttggcgacataaccgacattcagatccccctagactatgaaacagagaaacacaggggattcgccttcgttgaattcgaacttgccgaggatgccgcagccgcaatcgataacatgaacgagtctgagctatttgggcgtaccatcagggttaatctcgccaagcctatgcggattaaagagggttccagtagaccagtatggtcggacgacgattggctcaaaaaattcagcggtaaaacactggaagagaataaagaggaagagggttcagagcctcccaaggctgaaactcaagagggagagcctatagccaaaaaggctcgctctaatccccaggtgtatatggacatcaaaataggcaacaagcccgccggtcggattcagatgctgttgcgctccgacgttgtcccgatgaccgctgagaattttcgttgtctctgtacacatgagaagggattcggcttcaagggctctagttttcacagaattattccccaattcatgtgtcagggcggggattttaccaaccataacgggacggggggaaagagcatttacggtaaaaagttcgacgacgagaacttcatcctaaagcacaccggacctggactcttgtccatggccaattccgggccaaataccaatggcagccaattcttcctcacatgcgataagactgactggttagatggcaaacatgtggtcttcggggaagtcactgaagggctggacgtgctgcgccagattgagaaacaggaggaaagcgccataacatcccaacctcgttcatggaagttgacctag

SEQ ID NO: 12689 - DNA, 945 bp, Artificial Sequence
  Description of Artificial Sequence: Synthetic coding sequence
atggcaacgaccaagcgggtcttgtatgtgggtggtttagctgaggaggttgatgacaaggtgctgcatgccgctttcatacctttcggagacatcaccgacattcagatccccctggattatgagaccgagaagcatcgcggatttgcgtttgtcgaattcgagctcgcggaggatgcagcagccgccattgacaacatgaacgaaagcgagctattcggaagaaccataagggtgaatctcgcgaaacccatgcggataaaggagggatcttcacgccctgtgtggtcagacgatgactggttgaagaaattctcaggtaaaacccttgaagaaaacaaagaggaggagggcagcgaaccccccaaggcagagacccaggaaggagaacccatcgctaagaaggctcgatccaatcctcaagtgtatatggatatcaagatcgggaacaagccagccggtagaattcagatgctactccgaagcgatgtcgtgcctatgacggccgaaaacttcagatgcctgtgcacgcatgagaaaggtttcgggttcaagggttccagcttccacaggatcataccccagttcatgtgccaggggggagacttcacaaaccataacggcactgggggaaagtctatatacggcaagaagttcgatgacgaaaactttatcctcaaacacaccggcccgggccttcttagcatggcgaactcaggcccaaacaccaatggctctcaattctttctgacatgtgacaagaccgattggcttgacgggaagcatgttgtgttcggagaagtgacagagggccttgacgtgcttcgacagattgaggtcgctccggacacaaaggcttctaaggcccgaggatccaggaagaacaaggatggccaggagaggaattggggtaaatcccagaaagtggaaagccacaccatttag

SEQ ID NO: 12690 - DNA, 6243 bp, Artificial Sequence
  Description of Artificial Sequence: Synthetic coding sequence
atgtcttctagcccatctcggtcagccgccgatatatacatcagagagtattttcactcacacgtgagtgggggacatcccgaagcaacgcccctgagggtcatgtatactgatagacccctgagccagacggaccccgtaacactgcaatactgttgcctgaccgatgatcgtcaggccttcagaccccccacgcgtgccgaactagccagacatagggtcgttgtgacaactacgagccaggcacgggaactcagagtgcctgttggtttcttctcacacatcttaatcgatgaagccgctcagatgcttgagtgtgaggcactgactcctttagcctatgcaagccatgggacacgcctagtcctggctggagaccatatgcaggttacccccaggctgttcagcgtcgcccgagctcgggccgccgagcacacactgctccacaggttatttctgtgctatcagcaggaaacccacgaggtggctcgtcagagtcgtctggtgttccacgagaattaccgatgtactgatgctatcgtttccttcattagccggcatttctatgttgccaagggcaatccgattcacgcacgaggcaaagtgccaccacatccccgccactatcctctaatgttttgtcatgttgccggcagccctgaccgagacatgagcatggcctcatggcttaatctggcagagatcgcacaggtggtggagaaagttcaggaagcatataacacctggccctcttgttggggtggtcgggaacaaaggtgtatatgcgtggtctctcacggagcccaagtatcggctttacgccaggagttgcgccgccgcgatcttggacaggtgtctgtaggttcattcgaaatcctgcccggcagacaattcagagtggttgtattaagtacggtccacacttgccagtctcttctcagcccgggtgctctggctcctgagttctttacagacgcaagagtgctaaacactgtgctcaccagagcccaaagccagctcgtggtcgtcggcgacgccgtggcactctgctctttcggcgcctgcggaaagctctgggagagcttcatacgtgaatgcgtggagaggcatagtgtctgcccggaaggtctcagcatggagcaagtggagcagggagtcgcacagaggcggagatggccaccgaggggcacacaggccggggccgcgggcaattgggaggccgcgcccgagcccgttggagatctggcggaagaacaagccgcagtggtcaccgcgatggtgaaggcagaacccggagacgaggccctttccccggcttccagagatattaccgcaactacggcccagacggaagccgcagccgcccccgctggcgatgctgtgaaggaggatgtcgtgccaggcgcctgcgcagctggggcagccgctgctgccggcgtcgaatctacagaagcagaggacgccgaagctgacttctggccatgggacggggagctcaatgcggatgacgccatcctgcgtgagctcctggacgagagccagaaggttatggtcactgtgggtgaagatggcctactcgacactgttgcaaggccagagtccctccagcaggcaaggctgtacgagaatctgccgccggcagctctgcggaaactcctgcatgccgagcctgagaggtatcgccactgttcattcgtccctgaaactttcgagcgagccagtgcgatcccgcttgatgatgcctcttccggccccattcaagttaggggtcgcctagattgcgggatggcattcgcgggagacgaggtcctcgtccagttgctgtctggcgacaaggcccccgagggtagattgcgaggtcgcgtactgggagtcctaaaaaggaagcgacatgaactagcctttgtctgccggatggacacatgggaccctcggatcatggtacccattaacgggtccgtcacaaaaatctttgtcgcggagctcaaggacccctcacaggtgccaatctattcgctgcggaaaggaaggctgcagcgagtcggactcgagcgcttgacagctgaggcgagacactccaggcttttttgggtgcaaattgtgctttggcgtcaggggttttactacccacttggcattgtacgggaggtgctgcccgaggcgtccacttgggaacagggcttgcgcattctgggacttgagtattctctcagagttcctccatccgatcaagcaacaatcactaaggtcctccagaagtaccatactgaactgggtcgcgttgccggacgaagggaggattgcagggctttcctcactttcactgtcgatccacagggcgcttgcaacttggatgacgctctttcggttagggatcttgggccaaggtgcgaagtggctgtccacattacagatgtggcctcctttgtccctcgcgatggagtgctcgacgtcgaggcacggagacagggagcagccttctatgcccccggccgcgagcccgttccgatgttgcctgcctcgttgtgccaggacgttctgagcttgttgcccggacgggataggctggcaatcagcctctttttaactatggagaaagcctctggccaactcaagtcccttaggtttgccccatccgtcgttcagtccgaccgccagctgtcctacgaggaggcggaggaagttataagacagcatcccggcgctggcagagaactgccagcccggttggacagcgtggacgcttgtgtagtggcggcatgctatttttcccgcctgcttaggcgacataggcttaggagcgattgtttttacgaacaacccgacgaagatggtactctcggattcagagccgcgcacatcatggttaaagagtacatgatccaattcaacagactggtggcagaattcctcgttgggtcggaatgtacacgtaccgtgacacccttgcgatggcagcccgccccacggagccaacagctgaaagctctgtgtgaaaaacatggtgatcgggttccattgtccctgcatctggggcaccacctccacggggggggtggaagccctccagacactcgactgcatctgcttgcttccttatggaagcaggttcagtttgccgcccgcacccaggattacgaacagatggtggacctcgtgaccacagacgacatgcatccattcctggcacccgcaggaagggatctacgaaaggccctggagcgaagtgcttttggtcgctgtgcacgtggccaccagcaacagggtgggcactactcactgcaggtcgattggtacacttgggctacaagtccgattaggaggtatctagatgtggtactccagcgtcaaatattactggcactgggacacggcggcagcgcttatagcgcaagagatattgacgggctgtgccaggctttcagcctgcagcatgccttagcacaaagttatcagaggcgcgctcggagcctacacctggccgtccaattaaaggcacagccactggacaagctcggcttcgtagtggacgtggaggccggctcacgttgcttccggctactgttccccagcaatcgagaaacgttgcccgatccatgtccagtgccatacggcagcttacagctagcagaacatccccatgctctagctggtcggcctggtttaagactgttatggcgccggcgggtatacagcgcgcagggaagctcccctcctcttcccctccctggcactgtccccgacccccataccctcgctgttgagactgccttgtggaagcagctgttagagctcgtggaattacagcgatggcccgaagccgctgccctaatccaagaaaaaggggaagcgagtcagcgcagagaactggtgcaggtgcagaggtctcattgcggccattttcttgaggtcgcgagggaattgggctcgggagatacactccaggtccagctgggtacatccttgcagcacggttttttggtcccctcacctcagttgtggactgtagcgcctgggttctccctctgtctggagcacgtcgagcggcctggggactgcttttcgggccgggtctatcgggcgcctagggatcgctatcgagatgtggacgagtacgcgtgtgtttgggagcccttttgcgccctcgaatccgccacgggggcagttgccgaaaacgattcggttacgctgcagcatctatccgtgtcttgggaggcctcaaggacaccccaggggcaactacaaggtgcattccggttggaagctgcatttttagaagaaaactgtgcagatatcaacttttcgtgttgttacctatgtattagattagaaggccttccagctcccaccgccagccctcgtcctggcccctcctccctcggacctggccttaatgtggaccccgggacctacacctgggtggcccacggacagacccaagactgggaccaggagcgcagggccgatcgccaggaggccccacgcagagtccatctgttcgtgcaccatatgggcatggagaaggtaccggaggaagtcctccggccaggtaccctgtttactgttgagctgctccccaaacaactccctgatctgcgcaaggaggaggctgtgcgcggcctggaggaggcgtctcctctcgtcacctcaatagcattgggacggccagtgccccagcctctttgccgcgtgatcccttcacgctttctcgagagacagacatataatatccccggcggaaggcataaactcaacccatcccagaacgtcgccgttagggaggcactggagaaaccgttcacagttatccagggccctcctggcaccggcaagactattgtgggcctgcacatagtgttttggtttcacaagtcaaaccaggaacaggttcagccagggggtcctcctcgaggcgagaagcgtcttgggggcccatgcatcctatactgtggaccctctaacaagagtgtagatgtgctggctggcctgttgctccggcggatggaactgaagccccttagagtgtacagtgaacaggcagaggcctccgagttccctgtccctagagttggatctcgtaagctgttgagaaagagtccccgggagggccgtccaaatcagagcttacggtccataacgctccatcataggattcggcaggccccaaatccctattcctctgaaattaaggcttttgatacccggcttcagagaggagagctcttctccagggaggatctggtgtggtacaagaaggtactgtgggaggcacgaaagttcgaacttgatagacatgaggtgattctctgcacctgcagctgcgcggcaagtgcttcactgaagatactggatgttcgacaaatactggtcgatgaggctggaatggcaacagaacccgagaccttgattcctctggttcagttcccccaggccgagaaggtcgtacttctgggcgatcacaagcagcttagaccagtggtaaagaacgaaagattacagaatctgggcctggatcgctcgctgttcgagcgataccatgaggatgcccatatgctcgatacgcagtatagaatgcacgaggggatttgtgccttccctagcgtggctttctacaaatctaagctgaaaacctggcagggccttaggcggccacccagtgttctcggacatgcaggaaaggagtcttgtcccgtcatcttcggacacgttcagggccacgagcgtagcctcttagtatctactgacgagggaaacgagaacagtaaggccaatctggaggaagtggccgaagtggtcagaattacaaaacagctgacattgggcaggacggtggagccgcaggacattgccgtgcttacaccgtacaatgcgcaagcatctgagatttctaaagctctaagacgtgagggtattgctggagtggccgtttcgtcaataacgaagtcccagggttctgaatggcgatacgtgctggtatccacagtccggacctgcgcaaagtcagatctggaccagaggcccacaaagagttggcttaagaaatttctgggttttgtcgtggaccctaaccaggtgaacgtagcagtcacaagagcccaggagggtctgtgtttgataggcgaccacctactgctgaggtgctgcccactctggcgcagtctgctggacttctgtgaagcccaacagaccctcgtaccagctggtcaggtacgtgtgtgccgtagaccaactatgccgtcctag

SEQ ID NO: 12691 - DNA, 7950 bp, Artificial Sequence
  Description of Artificial Sequence: Synthetic coding sequence
atggccgtgtgggaagctgagcaactagggggcctgcagcgtggcgatttgctaacccctcccgcccctgatggggacggaagaaccgctccccttggccagccccccggcgcccaactgtactgtcccgcttgcctcgttacctgtcacagccaggaagctttcgaaaatcactgcgcctcctccgagcacgcccaaatggttgcattcgatcaggcgttgccgtgggaacacaggtctcctccacctgggctatccaaattcgagctctgccctaaacctgacctgtgtgaatatggagatgcctgtacaaaggcccacagcgcacaggagctccaagaatgggtgcgcagaacacaggctgtggagctccgtgggcaggccgcctggcaggacggccttgtgccttatcaagaacgtttactggccgaataccaacgatcctcatctgaagttctggtcctggcagagaccctggatggcgttcgcgttacctgcaaccagcctctgatgtaccaggcacaggagaggaagactcagtattcctggactttcgcggtgcattctgaggagcccctccttcatgtcgcgctgttgaaacaggaacctggcgcagactttagcctagtggccccaggtctgccacctgggcgactttatgctcgaggcgagagattcagggtcccgtcttccacagccgactttcaggtaggagtgcgggtacaggcagcatcctttgggactttcgaacagtgggttgttttcgacttcggccgacggccagttctgctgcagaagctgggtttgcagctcgggcaaggaaggaggcccggcccatgtaggaatctggctctaggccaccccgaggaaatggagaggtggcacacaggcaacagacatgtggtacccggcgttgagcgcacggcggagcagacagctctcatggccaagtacaagggtcccgctcttgctctcgagtttaacaggtcatcagtggcctctgggccaatcagcccaacaaactacaggcagcggatgcatcagtttctgtatgaggaggaagctgcccaacagcagctggttgctaaactgacgctccgcggacaggtattcctgaagaccgctctgcagactcccgcgctcaatatgctgttcgccccacccggcgccctttatgccgaagttccagttccctcttccctgatgccagacactgatcagggcttcctgctgggcagggcggtgtctacagccctcgtcgcacctgtgcctgctccggataacacggtgtttgaggtccgtttggagcggcgcgcttcttctgagcaagctctctggctgctcctgcctgcccggtgctgtttggcgttaggtctgcagccagaagctcgcctggtgttagaggtacagttccagattgatcccatgaccttccgcctgtggcaccaggcagtagataccctcccagaggaacagctggtagtccccgacctgcctacctgcgccctcccgcgcccctggagcgtgccgccattgcgtagaggcaatcgcaagcaggaacttgctgtcgcccttattgcagggtggggtccaggtgatggtagaagagtgccccccttgttgatttatgggccttttgggacgggtaagacgtacacccttgctatggcatccctcgaagttattcgacggcccgagactaaggtgttgatctgtacgcataccaattccgccgccgacatttacattagagagtactttcactcccacgtgagtgggggtcatccggaagccaccccactgcgggtgatgtacacggatcgaccactttcccaaacagatcccgttaccctacagtactgctgtcttactgatgatcggcaggcatttcgaccccctactagggcagaattagcgcgccacagggttgtggtgaccaccacctcccaggctcgcgagctgagggtgcccgtgggcttttttagccacattcttattgacgaggccgcccaaatgttggaatgcgaagcgctgaccccattggcgtatgcttcccacgggaccaggctggtcttggccggagatcacatgcaggtcacgcctagactgttctctgtcgcacgggcccgagctgcagaacacactctgctgcaccgccttttcctgtgctaccagcaagagacacatgaggttgcacgccaatctcggttagtgtttcatgaaaattaccgctgtacggatgctattgtgagcttcatctcccgacatttctacgtggcgaaggggaatcctatccatgcaagaggcaaggtgcccccacatccccgccattaccccctgatgttctgtcatgtggcaggctcacctgaccgcgatatgtcaatggctagttggcttaacctggccgagattgcccaggtggtagaaaaagtccaggaggcctataacacttggcctagttgttgggggggacgagaacagagatgcatctgtgtggtgtcacatggtgcacaggtgtcagctttgcggcaggaactgagaagacgcgatttaggacaggtatctgtcggcagtttcgagatcctgccaggtaggcaatttcgtgtagtggtgttgtcaactgttcacacctgccaatctcttctcagcccaggggccctggcaccggaattcttcaccgacgcccgcgtgcttaatactgttttgacacgcgcacagagccagctagtcgtagtgggcgacgctgtggctctgtgctcatttggcgcctgcggtaaactctgggagagtttcatccgcgaatgtgtggaaagacattctgtatgcccggaaggtctcagtatggagcaggtagagcagggcgtggctcagaggcgaaggtggccaccccgcggcacacaggctggagcggcaggaaattgggaggcggccccggagcccgtcggcgacctagccgaggagcaggccgctgtggtgactgccatggttaaggccgagccaggagatgaagcactgtccccagcatctcgcgacatcacggccactactgcacagactgaagccgctgccgctcccgctggcgatgccgtgaaggaggatgtggtcccaggtgcatgcgccgccggggcagcagccgctgcaggggtggaatcaaccgaggctgaggatgcagaggccgacttttggccgtgggacggggaactgaacgccgacgacgccatccttagagaactgctcgacgagtcacagaaggtgatggttaccgtgggagaagacggactgctggatactgtggcccgaccagaaagcctgcagcaggcacggctctatgaaaatctgcccccggcagccctgcgcaagctgctacacgcagagcccgagaggtaccgacactgtagcttcgtgcctgagacctttgaacgagctagcgcaatacccctcgatgacgcatcttccggcccaatccaggttagagggcgcttagattgcggaatggctttcgccggcgatgaggtgctggtccaattattgtccggcgacaaggcccccgaaggccgcctgcgggggagggtgctgggagtgctaaaaagaaagagacacgagctcgctttcgtgtgtaggatggatacgtgggacccccggataatggtcccaatcaacgggagtgtgaccaaaatctttgtggccgagctgaaggatccaagtcaagtgccaatatacagcctccgcaaaggcagactgcagagagtaggcctggaacgcctgacagccgaagcccggcacagcaggctgttctgggtgcagatagtgctctggagacaaggattctattacccactgggaattgtccgggaagtgctcccagaggcctcaacatgggagcagggactgcgaatacttgggttggagtattcattacgggttcccccatcggatcaggccacaattaccaaggtccttcagaaataccatacagaactaggccgcgtggccgggagaagggaagattgcagagccttccttacttttacagtggatccgcaaggtgcttgcaatctggatgatgcactttcagtgagagacctgggtcctcgttgcgaagtggccgttcatatcactgacgttgcaagctttgtacctcgtgatggcgtgctggacgtggaggcccgtcgtcagggcgccgcattttacgctcccggaagggagccagtgcctatgctccctgcaagtctgtgtcaggatgtgctgagccttctcccaggtcgggatcggcttgctatctcccttttccttactatggagaaggcctcaggacagctcaaatctttgcgtttcgccccaagcgtcgtccagtccgatcgccaactgtcttatgaggaggctgaagaagtgatccggcaacaccctggggctggcagggaactcccggcacgactcgacagcgtcgatgcatgcgtcgtcgccgcttgttacttctccagactgctgcgccggcatcggctgcggagcgattgtttttatgagcagcctgacgaagacgggaccctgggttttagagccgcccacattatggtgaaggaatacatgattcaatttaaccgcttagtggcggaattccttgtgggaagtgagtgtacacgcactgtcacaccccttcgctggcagccagccccacgctcccagcagcttaaagcgctgtgtgaaaaacacggtgacagagtaccacttagcctccacctaggtcaccatctgcatggcggaggaggttccccaccagacacgaggcttcacctgttggcttctttgtggaagcaagtccagttcgcagccaggacccaagactacgagcagatggtcgacctggttacaacggacgatatgcacccattcttagctcccgcgggccgcgatctccgcaaagcactcgaaagatcagcctttggtcgatgtgctcgcggccatcagcaacagggaggccactattcactccaggtggactggtatacctgggcgacatccccgatacgacgatacctcgacgtagtgctgcagcgacagatattgctggctctcggccatgggggatccgcctactccgcaagagacattgacggactttgccaggcttttagtctgcagcacgctctggctcagtcttatcagcggagggcaagatccctgcatctggccgtgcaactgaaggcccagccgctggataagctgggattcgttgtggatgtggaggccgggtctaggtgcttccgtttgctctttccttcaaatagggagaccttgccagatccgtgtccagtgccttatggaagtctgcagctggccgaacatcctcatgccctcgccggaagaccggggctcaggctactgtggaggagaagagtgtactcagcgcaggggtccagccctcctctgccccttcccggtactgttcccgaccctcataccctggcggtggaaactgccctgtggaagcaacttctggagctggtggagctgcaaaggtggcctgaggccgccgctcttatccaagagaaaggcgaggcatcccagaggcgcgagctggtgcaggtccagcgatcgcattgtggacattttcttgaggtggcccgggagctggggagcggagacaccctccaagtgcagctgggaacctctttgcagcacggctttctggttccatcaccccaactttggactgttgcccccggcttcagcctgtgtctggagcatgtggaacgtccgggagattgcttctcaggaagagtgtacagagcgcctagggaccggtacagagatgtcgatgagtatgcatgcgtctgggaaccattttgtgctcttgaatccgcaacaggggctgtcgctgagaacgactcagtgactctccagcatctctccgtcagttgggaggcctcaaggacccctcaaggacagctgcagggggcatttcgcctggaggccgccttccttgaggagaactgtgcggatatcaatttctcgtgttgttacctatgcattcgtcttgaaggactcccggcacccacagcaagcccgcgccccggaccttcttccctaggccctggcctcaacgtggatcccggcacttatacatgggtagctcacggtcagacacaagactgggaccaagagagaagagcggatcgacaggaggcacccaggagagttcacttgtttgtgcaccacatgggcatggagaaagtacccgaggaggttctccggcctgggactctgtttacagtggaattgttgccaaagcagttacctgacctgagaaaggaagaagccgtgcggggcttagaggaggcttcccccctggttacctccatcgctttaggacgacccgtcccccagccgttgtgccgggtcattcccagccgcttcctcgaacgccagacatataatatcccagggggacggcacaagctgaacccatctcaaaatgtggccgtgagagaggcactggagaagccatttactgtaatccaggggcctcccgggaccggaaagacaatagtgggactgcatatcgtcttctggttccataagagcaatcaggagcaagttcagcctggcggcccccccaggggcgagaaacgtctgggcggaccctgcatcctatattgcggcccgagcaataagagtgttgacgtcctcgccggactgctgctgcgccgaatggaactgaaacccttacgtgtttactccgaacaggctgaagccagcgagttccccgtcccgcgagttggcagccgcaaactgctcaggaagagcccgcgcgagggaaggcccaatcaatctttgcgcagtatcactctgcatcacagaattcgccaagcaccaaacccttactcatctgaaatcaaagcgtttgacactaggctgcagcgcggtgaactattttcccgcgaagacctcgtatggtacaaaaaggtattgtgggaagcccggaaattcgaactcgatcgccatgaggtaatcctttgtacgtgctcttgtgcagcctctgctagcctgaaaatcctcgacgtgaggcaaatcctggtcgacgaagctggcatggccaccgaaccggaaacgctcattcctctggtccagttccctcaggccgagaaagtagtgctactaggagatcacaagcagctcaggcccgtggtgaagaacgaaaggctgcagaaccttggactcgaccgctccctgttcgagcggtaccacgaggacgcccatatgttagacacccagtacagaatgcacgaaggcatctgcgcattcccatcagtggcgttctacaaaagtaagctgaagacttggcagggtttaagacgcccaccatcggtgctgggtcacgccggaaaggagagctgccctgtcatcttcgggcatgtccagggccatgagcgatccctgctcgtaagtaccgacgagggaaacgagaatagcaaggcgaatctggaggaggtggccgaggttgttagaattaccaagcagttaacactgggccgtactgtggagccgcaggatatagccgtcctcactccttacaatgcacaggcctcagaaattagcaaggcccttcgcagagaaggtatcgcaggggtcgctgtgagctccatcaccaagtcccagggaagtgaatggcggtacgttttagttagtactgtgcggacatgtgccaaaagtgatttggaccagcgccccaccaagtcttggctgaaaaaattcctcggcttcgtggtggatcctaaccaggtcaacgtggctgtgacccgtgctcaggagggcctttgcctaatcggggatcatctgctcctcagatgctgcccgttatggaggtccctgctcgatttctgcgaagcccaacaaacattagtccctgctggccaggtcagagtctgtcgccggccaaccatgcctagttag

SEQ ID NO: 12692 - DNA, 4995 bp, Artificial Sequence
  Description of Artificial Sequence: Synthetic coding sequence
atggccgccaggcgggggcgccgagacggcgttgcaccaccacctagcggcggtcctggccccgaccccggaggaggggcgcgaggaagcggatggggatctagatctcaggccccctacggtacccttggtgctgtatccggcggcgaacaggtgttacttcatgaggaggctggggacagcgggttcgtaagcctgtccagactgggtccatcacttcgcgataaagatctggagatggaggagctaatgctgcaggacgaaacactgcttgggactatgcagtcatacatggatgcctccctgatcagcctgatcgaggatttcggcagtcttggcgagagccgcctgagtctggaagaccagaatgaagtttctctgttaactgcgctaacagagattctggacaatgcggactccgagaacctgtccccttttgatagcattccggatagcgaattacttgttagtcccagagaggggtccagtctgcacaaactgctgactctgtcccggacacctccagagcgagacttaattactcccgttgacccacttggcccctcgacaggttccagccgtggcagcggagtggaaatgagcctccctgatccaagttgggatttttcaccaccatcgttcctagagacctctagtcccaagctccctagttggaggcccccccggagccggcctcgctgggggcagtcacctcctccacagcaacggtctgatggggaggaagaggaagaggtcgctagtttcagcgggcagatactggctggcgaactggataactgcgtctcctctattcccgacttcccaatgcacctggcttgcccggaagaggaagacaaggccactgccgcagaaatggcagtccctgccgccggcgatgagtccattagtagcttgtcagaactggtgcgggctatgcacccctattgcctgccaaacttgactcaccttgcctcgctggaggacgaactgcaggagcaacctgatgacctcactttgccagaggggtgcgtggttctggagatcgttggtcaggctgcaacagcaggagacgacttagagataccggtggttgttcgccaggtgagtcccgggcccagacccgttttactggatgactcattggaaacctcttctgcactgcagctcttaatgcctacgctggagtcggagacagaagctgccgttcctaaggtgacactgtgctcagagaaggagggtctgtccttgaacagcgaagagaagctggatagcgcctgcctgctgaaacctagggaggtggtggagcccgttgtgcctaaggagccgcagaacccaccagcgaatgccgcgccaggttcacaaagagcccgaaaagggagaaaaaagaagagcaaagaacagccagcagcctgcgtggaaggatacgccaggcgcctcagatcatctagtagaggacagtcaacagtgggaactgaagtgacatcccaggtggacaacctccaaaaacaaccgcaggaagagctgcagaaagagagcggtccactgcagggcaaaggaaaacctagggcttgggcacgcgcatgggctgctgccctggaaaatagcagccccaagaatcttgaaaggagtgcaggccagagtagccccgccaaggaaggcccactagatctttacccgaaacttgcagacactattcagacgaatccgataccgacccacctgagtctggttgatagtgctcaggcaagtcccatgcccgtggactctgtggaggctgatccgactgcggtggggcctgtactggcaggccccgttccagtggatcctggcctcgtcgatctggcatccaccagcagcgagctggtggagccattgcccgcagagcccgtgttgatcaatcctgtgttggcagattcagccgccgttgatccagcagtcgtccctatttccgacaacttgcctcctgtggacgccgtcccttctggcccagcaccagtcgacctcgcactcgtcgacccagtgcctaatgatttgactccagtcgatcccgttctcgtaaaatcaagacccaccgacccccgccggggggctgtgtcctcagcattaggggggagcgcacctcaacttctggtcgaatcagagtctctggaccctcctaaaaccataattcccgaggtgaaggaggtcgtcgacagtttgaagatcgaaagcgggactagtgcaactacccacgaggcgcgacccagacccctttcgctctctgagtacaggagacggcgccaacagagacaggctgaaactgaggagagatcccctcagccaccaacaggcaaatggccgtcgttaccagaaaccccaaccggactcgccgacattccatgcctggtcatcccccccgcgccggcgaagaagacggctttgcagagatcccctgagacgcccttagaaatctgtctagtgccagttgggccaagccccgcttccccttcgcccgagcctcccgtgtctaaacccgtggcctcttcccctactgaacaggtgccctcccaggagatgcctctcttagctaggccgtcccccccagtacagtcagtttcgccggcagtgccaacaccaccctcaatgtcggctgctctgccatttcccgcaggggggctcggcatgccaccaagcctgccgcccccaccattgcaacctccctccctgccactcagtatgggtcctgtgctgcccgacccctttacacattatgctcctctaccttcctggccctgttatccccacgtatctccaagtggatatccatgcctgccccctccaccaactgtacctctggtgtccggaactccaggagcctacgccgtaccgcccacctgctcagttccctgggccccgccacctgctcccgtaagcccctatagctcaacctgcacgtacgggcctctggggtggggtcctggaccccagcacgcccctttttggtctacggtccccccacctccgttgcctcctgcctctataggtagagcagtcccgcagcccaaaatggaatccagagggacccctgccggacctcctgaaaacgttctgcctctgtcaatggcgcctccactgagcctcggactgcccggccatggcgctccacagactgagccaactaaggtcgaagtgaagccagtgccagcctcaccacacccaaagcataaagtaagcgccctagtgcaatctcctcagatgaaggccttggcctgcgtgtctgcagagggagtcaccgttgaagaaccggcttcagaaaggctcaaacctgagacccaggaaacacgcccgcgggagaagccccctctcccagccacaaaggcagtccccactcccagacagtcaacagtgccaaaactgccggctgtgcatccagcccgcctacggaagctgtccttcctgccaacacctcgcacgcagggctctgaggacgttgttcaggccttcattagcgagattggaattgaggcctctgacctctcttctctgctggagcaattcgaaaaatctgaggcgaagaaagaatgcccacctccagcccctgctgattccttggcggtcggcaactccggtggtgttgacatcccacaggaaaagagaccccttgatcggctccaggcacccgagctcgccaatgtggcgggattaactcccccagccacccctcctcaccaattgtggaagccactggcggcagtctccttgttggccaaggccaagagccccaagagcaccgctcaagagggcactctgaaacccgaaggcgtaaccgaggcaaaacatcctgccgccgtgcggcttcaagagggagtgcacgggcccagccgggtccatgttggctcaggtgatcacgattactgtgtccggtcccgcaccccccctaagaagatgccagctctcgtgatccctgaggttggcagtcggtggaatgtgaagaggcatcaagacattaccatcaagcctgtgctgtcactggggcctgccgccccccctcccccatgtatcgcagcctctcgcgagcctttggaccacaggacttctagcgagcaagccgatccgtctgctccttgtctggccccatcaagtctgttatctcccgaggccagcccttgtcggaacgacatgaatacacggacccctcccgagcctagcgccaaacagagaagtatgcgctgctacaggaaagcctgcaggtctgccagtcccagttcacaggggtggcagggccgtcggggtcgcaactcaaggtctgtgtcatcaggctctaacaggacatcagaagcttctagttctagtagttcctccagttcttctagcagatccaggtcacgtagcctctctcccccccacaaacggtggcgtcgcagctcttgctcctcctccgggaggtcccgcagatgcagttccagctcttcttcttctagctccagctctagttcctcctcttcatcctcttcctcacggagccgaagtcgatcaccttcaccccgtcgcaggagcgacaggagacggcggtattcttcataccggtcccatgaccattaccagagacaacgggtcctgcagaaggaacgggctatcgaggagaggagggtcgtgttcattggaaaaattccagggagaatgacccgcagtgagctgaagcaacgcttctccgttttcggcgagatcgaagaatgtactattcattttcgggtgcaaggcgacaattatgggttcgtcacatacaggtatgctgaggaagccttcgcagcaatagaatccggccacaaactcaggcaggccgacgagcagccatttgacttatgcttcggagggagacgacaattctgcaaacgcagctattcagatctcgattcaaaccgagaagacttcgaccccgctcctgtaaaatcaaaatttgattcgctggacttcgacacactgctcaaacaggctcagaaaaatcttagaaggtag

SEQ ID NO: 12693 - DNA, 4203 bp, Artificial Sequence
  Description of Artificial Sequence: Synthetic coding sequence
atggccgccaggagaggtagaagagacggcgttgcacccccaccttcagggggtcctggccctgaccctggcggaggtgctcgtgggtcgggctggggaagccggtcccaggccccttacggtaccctgggagccgtgagtggcggggaacaggtacttttgcatgaggaggctggcgactctggttttgtgagcctgagtaggctcggtcctagtctacgagataaggatctggagatggaagaattgatgctgcaggacgagacactgctgggtacaatgcaaagctatatggacgcttcactaatttctctgattgaagactttggtagcttgggcgagtctcggctgtccctggaggaccagaatgaggtgtctctcctaacagccctgactgaaattctcgacaatgcagactccgagaacctttccccttttgactcaattccagactccgagctgctggtgtcccctcgggagggctcttctctgcacaaactcctaaccctatcaagaacaccacccgaaagggacctgattactcctgtagaccctttaggcccttctacgggaagctcacggggctctggggttgagatgagcctgccagacccatcatgggacttcagccccccctcctttctggagacatcaagccctaagttgccctcgtggcggccacctaggagtcgtcccagatgggggcagtcccctcccccccaacagcggtcagacggggaggaagaggaggaggtcgccagcttttctggccaaattctggccggcgagctggacaactgcgtgtcttctattcctgactttcccatgcatctcgcctgccccgaggaggaagacaaggccaccgcggctgagatggctgtgcccgctgccggagacgagagtatttcttccttgagtgagctagtgagagccatgcatccatactgcctgcctaatctcacgcatctggcttctttagaagacgagcttcaggaacaacccgacgatctgacattaccagaggggtgtgtggttctagaaatcgtaggtcaggctgccacggccggagatgatctcgagatccccgtggtcgtgagacaggtaagccctggacccaggcctgtgctgcttgacgattccctggagacaagttcagctctgcagctgctcatgcctacattagaaagcgaaacggaggctgcagtgcccaaggttaccctgtgctccgagaaagagggacttagcctcaactcagaagaaaagctggatagtgcctgcttactgaagccgcgagaggtggtcgagcctgtggtacccaaagaacctcagaatcctcccgcaaatgctgccccgggaagtcaaagagctcgcaaaggacggaagaaaaagtccaaggaacagccagcagcatgcgtagaaggttacgcacgccgactccgaagctcctctcgagggcaatcaaccgtcgggacagaagtgacctcccaagtggacaatctccagaaacagcctcaggaagaactgcagaaagagagcggtcctctgcagggcaagggcaagcctagagcttgggctagggcttgggcggcggctttagagaatagttctcccaaaaaccttgaacggtcagccggacagtccagtcctgccaaagagggtcctctggacttgtatcctaaattagcagatactatacaaacgaatcctattccgacccacctgagtctggtggatagtgcccaggcctcacccatgcccgtcgactctgtggaggctgatcccacggctgtgggacccgttttggccggacccgtacccgtggatcctggcctggtggacctggcgtcaacttcaagcgaactagtggaaccactgccagccgaacctgtactgattaatcctgttctggccgactccgccgctgtggacccagccgtggtccccatctcagataatttgccacccgtggacgccgtgccatccggccccgcacctgttgatctcgctttggttgacccagtgccaaacgatctgaccccggttgatcctgtgctcgtaaagtctagaccaactgatcctagaaggggagcagtttcaagtgctctcggtggatctgctccccagctgctggtcgaaagcgaatccctagatccaccgaagacgatcatcccagaagtcaaggaggtcgtggatagcctcaagattgagtccgggacatccgcaaccacgcatgaagcaagaccacggccactgtcactgagcgaataccggcggcggaggcagcagcgccaggcagagaccgaggagaggagcccacaacccccaacagggaagtggccctcactgcccgaaacgcctacaggccttgccgacattccctgtctggttatcccccccgcccccgccaaaaaaaccgcactgcagcggagtcccgagacccctctagagatctgcctggtgcccgtgggcccgagccctgcctctcccagccctgagccccccgtttctaagcccgtggcttcctcacccaccgaacaggtcccctcgcaggagatgccactacttgcgagaccgagcccacccgtgcagagcgtgtcacccgctgtcccgacgcccccttccatgagcgccgccttacccttccctgcgggcggcctgggaatgcccccatcattgccacctccgccgctgcagccacccagtcttccactgtctatgggcccagttttgcccgacccgtttactcattatgctcctctcccgtcctggccctgctacccacatgtttctccttctggatatccctgtctgcctcccccacctacggtaccgctggtttctggcactccgggagcatacgccgtgccacctacatgttccgtgccatgggccccccctccggctcctgtgtcaccgtactctagcacatgcacctacggcccgctgggttggggccccggaccccaacacgcccccttctggtccaccgtgccccccccccccctgcccccagccagtatcggacgtgccgtccctcaacccaagatggagtcacgcggaacacccgcaggaccgccagagaatgtcctccccctttctatggcacccccactcagcctgggactgcctgggcacggcgccccgcaaaccgaacctacaaaggtggaggtgaagcccgttccggcctcaccccacccaaagcacaaggtgagcgcattggtccaatccccacagatgaaagctctggcctgcgtgagcgctgaaggggtgaccgtagaggagccggcatcagaacggcttaagccagaaactcaggaaaccaggccgcgagagaagccccccctccccgccaccaaggcagtaccaacccccagacagagcacggtccctaagctgcccgccgtccatcccgccaggctgagaaagctgagtttccttcccacacctcggactcagggttcagaggatgtcgtccaggcctttatcagcgaaattggcattgaggcctcggacctctctagtctgctcgaacagtttgagaagagcgaagcgaaaaaggaatgtcctcctccagcccccgcagatagcctggcggtggggaactctggctccagttgctcgtctagcggaagaagccggagatgctcttcgtcctcctccagctcctcctccagctccagcagctcctcttcaagttctagcagccgcagtagatctcgaagcccctcacctcgaagacgcagtgacaggagaaggcgttatagttcgtaccggagccacgatcactaccagagacagcgagtgcttcagaaggagcgggccatcgaggaacgccgtgtagtgttcatcggtaaaatcccaggaagaatgacacggagcgagctgaagcagagattttccgtgttcggggagatcgaagagtgcacaattcacttcagggtgcaaggcgataattatggtttcgttacttacagatatgccgaggaggccttcgcggccatcgagagtggccataagctccgccaggcagatgagcagcccttcgacctctgttttggagggcggagacagttctgcaaacggtcgtacagtgaccttgactccaatcgcgaggattttgatcccgctcccgtgaaatctaagtttgactctctggactttgacactctgttaaagcaagcccagaaaaacttgaggcgttag

SEQ ID NO: 12694 - DNA, 537 bp, Artificial Sequence
  Description of Artificial Sequence: Synthetic coding sequence
atggctgacgggaaagctggcgatgagaagcctgagaaatcgcagagagcaggggctgctggcgggcctgaggaggaggccgagaagccagtgaaaactaaaaccgtctccagtagtaatggcggggagagttctagtcggagcgcagagaaaagaagcgcggaggaggaagcagcagaccttcctaccaagcctaccaaaatcagcaaattcggcttcgccatcggatctcaaaccacgaagaaggccagtgctatatcaataaagctcgggtcctctaagccaaaagagaccgtgcccacactggcgccgaagacgctgtccgttgcagctgccttcaatgaagacgaggacagcgaaccggaagagatgccaccagaggctaaaatgaggatgaagaacatcggcagggacacaccaacatccgccgggccaaactccttcaacaaagggaagcatgggttctctgataatcagaagctgtgggaacgaaacataaagtcccatcttggcaatgtgcacgaccaggataactag

SEQ ID NO: 12695 - DNA, 4950 bp, Artificial Sequence
  Description of Artificial Sequence: Synthetic coding sequence
atggacgacgatagcttagacgagctggtggcccgcagccccggacctgatggccacccacaagtgggaccagctgaccccgccggcgatttcgaagagtcctcggttgggtctagtggcgatagcggtgatgattctgattcagagcatggtgatgggaccgatggggaagatgagggagcctcagaggaagaagacctcgaggacagaagtggatccgaggattctgaagacgatggagaaacactgctcgaggtggcagggactcaaggcaagctggaagcagccggcagcttcaatagtgacgacgacgccgagagctgccctatttgtttgaatgccttccgagaccaggctgtgggtaccccagaaaattgtgcacattacttttgcttagactgcatagtggagtggtccaagaacgccaactcttgcccggtggataggacactcttcaagtgcatttgtatccgtgctcagttcgggggcaaaattcttcggaaaatcccagtcgaaaatactaaagcatcagaggaggaggaggaccctactttttgtgaagtatgcggcagatcggacagagaagacaggctgctattatgcgacgggtgcgatgcagggtaccatatggaatgtctggatcccccactccaggaggtccccgtcgatgagtggttctgcccagagtgtgccgcacccggagtcgtgctggcagcagatgccggacctgtttccgaagaagaggtctccctactactcgctgacgtggtgcctaccacgagccggctgagacctagagccggccgaactcgcgcaatcgcacggacaaggcaatctgaacgcgtacgagcaactgtcaataggaatcgcattagcacagccagaagagttcagcatacgccaggaagactaggctcgtcacttctcgacgaggcaattgaggcagtggctactggcctgtcaactgctgtgtaccagagacctttgactccccgcacaccagcacgccgtaagagaaagacgcgacgtcgcaagaaggttcctggtaggaagaaaacacctagtgggccctcggccaaaagcaagtcctcagctacaagatctaaaaagcggcaacatcgagttaaaaaacgccgcggcaaaaaagtcaagagcgaggctaccaccaggtcccgaattgcccgcaccttagggctccgacgtccagtgcacagcagctgcatcccttccgtcctaaagcccgtggaaccttctctggggctgctgcgggctgatattggtgcagcctctctgtccctgtttggtgatccatatgaactagatcctttcgattccagcgaggaactgagtgccaaccccctcagcccactttccgctaaaaggagggcgctgagccggtccgctcttcagtcgcaccagccagtggcaaggcctgtgtcagtgggcctatcacgtcggcggctccctgcagctgtgcccgagccagacctagaagaagaacctgtgccggatcttttgggttcaatccttagtgggcaaagcctgttgatgctcggatcttccgatgtcatcatacatagggatggaagcttatccgctaaacgggccgcgcctgtctcgtttcaaagaaatagcggaagtctcagtaggggcgaagaaggcttcaagggctgcctgcaaccccgcgctctaccaagtgggtccccggctcagggcccaagtggaaaccgtcctcagtccactggcctgagttgtcagggtcgttctcggactcccgctcggacagcaggcgcgccggtacgtcttgacctacctgccgccccgggggcggttcaagcaagaaatctatccaatggttctgtacctggattccgacagtctcactctccctggttcaatggcaccaacaaacacactctgcccctcgcatccgccgcttcaaagatctcaagcagggactccaaacctccttgccgctcagtggtgccaggccctcctcttaaaccggccccccggagaaccgacatctctgagctcccaaggataccgaagatcagaagagatgacggcggtggacgtcgcgacgctgccccagcacatgggcagtctattgaaattccgtccgcttgcatctcccgactcacaggcagggaaggaaccggccagcccggcagaggcacgcgggcagagagcgaggccagtagtcgggttccccgggaacctggggtgcatactggctcctctcggccaccggcccccagctcacatggctccctggctcctctcggtccttctcgcggaaaaggtgtgggatctactttcgaatccttccgtatcaacatacctgggaatatggcacactcctcccagctgagtagtcccggcttctgcaatacatttaggccagtggacgacaaagaacagaggaaagaaaatcctagccccctcttcagcattaagaagacaaagcaactcagaagcgaggtatatgacccttctgatcccactggctccgactcatccgccccgggcagcagccccgagcgctccggaccaggcttgctaccctccgaaatcacacgaacgatttccatcaacagtcccaaggcacaaaccgtccaggcggttagatgcgtaaccagctacacggttgagagtatcttcgggacagaaccagaaccacccctgggaccgtcttcagcaatgtcaaagttgcgcggcgccgtcgcagcagagggcgcatccgataccgaacgggaagagcctaccgaaagccagggcctggcagcacggcttcggaggccatctcccccagaaccttgggatgaggaagatggggcttcctgttcaaccttcttcggatccgaggagagaaccgtgacatgcgttaccgtcgtggagcccgaggccccacctagtcctgacgttctgcaggccgccacgcaccgggttgttgagctgagacctccctctcggagcaggtctacgtcaagttcaaggtcaagaaagaaggctaagaggaaacgcgtgtcgcgcgagcacggccggacccgctccggcactcgcagtgagtccagagatagatcgagtcgctctgcttccccctccgtcggcgaggagcggccccgccggcagagaagcaaggcaaagtcccgccggtcttccagcgaccggtccagctcccgtgagcgtgccaagcgaaaaaaagccaaagacaagagcagggaacataggcgcgggccttgggggcattctagaaggactagtcgcagcaggtcaggctccccaggctcctctagctacgaacattacgagtctcgcaagaaaaagaaaagacgttccgcgtcccggccacggggccgcgagtgctcacccaccagtagcctggagcgcttatgccgccacaagcaccagagggagcgctctcacgaacgtccagataggaaagaaagtgtagcttggccgcgcgatcgcaggaagcggcggagccgatcccccagtagcgagcacagagcgagggagcatcgcagacctagatctagagagaagtggccccagactcgttcccactcacctgagaggaaaggagcggtgcgggaagcgtctcctgctcctctggcacagggggagccaggcagggaagacttacccactcgtctgccagctctgggagaagcccacgtgagccctgaagtggccacagctgataaggcccctctgcaggctcctcctgtgttagaggttgcggctgagtgcgaaccggacgatctggacttggactacggtgactccgtcgaagcggggcatgtgtttgacgacttttcatcagatgcagtcttcattcagctcgacgacatgtcctctccaccttcgcctgagtcaaccgattcttcaccagagcgagacttccctctcaagcctgccctgccgccagcatcactcgctgttgccgctatccaacgcgaagtctccttgatgcacgacgaagacccaagccagcctcctcctttacccgaggggactcaggagcctcacctgctgagacccgatgcagcagaaaaagccgaggcaccatccagcccagacgtggcccctgctggcaaagaagatagccccagcgcctccggcagagtgcaggaagctgcccgtcctgaagaggttgtgtctcagaccccgctgctgcgctcacgggctctggtaaaaagggtgacttggaatctccaggaaagcgagtcctcagcacccgccgaggaccgcgccccaagggctcccctgcacaggccacagaaaccacgcgaaggcgcctgggatatggaagatgtggcccccactggcgtgcgacaggtttttagcgagttaccttttccatctcatgtgctgccagagccaggctttccggacaccgatcctagccaggtttactcccctggcctgcctccggcccctgcccagcccagttctatccctccgtgcgctctggtatcacaacctactgtccagttcatcctccagggatcactgccattggtcggatgtggcgcagctcagacgctggcaccagtgccggccgctctgacccccgcgtccgagcccgcgtcacaagcaactgcagcaagcaatagtgaagagaaaacgccagcgccgaggctggccgccgagaaaactaagaaggaggaatatatgaaaaagctgcatatgcaagaacgtgccgtagaagaggtgaaactggcaataaagccattctatcaaaagcgcgaggtgacaaaagaagaatataaagatattcttaggaaggcagtgcagaaaatttgccactccaaaagtggcgagatcaatcctgtcaaagtggccaacctggtcaaagcatacgtggacaaataccggcatatgcgcaggcataaaaagcccgaggcaggcgaggagcccccaacccagggggctgagggttag

SEQ ID NO: 12696 - DNA, 4947 bp, Artificial Sequence
  Description of Artificial Sequence: Synthetic coding sequence
atggatgatgacagcctggacgagctggtcgcccggtctcctggccccgacggacatcctcaggtgggccccgctgaccctgccggggactttgaagaatcttccgtggggagtagtggcgactcaggcgatgactctgattccgagcacggcgacggaacggatggagaagacgagggggcatccgaagaggaggacttagaggaccggagcggatcggaagacagtgaagatgatggtgagacactgctcgaggttgcgggcacacagggaaagttagaggcggcaggaagcttcaactcggatgatgacgcggagtcttgtcctatttgcctgaatgcgttcagagaccaagccgttggaactccagagaactgtgcacactacttttgcctggactgtatcgtcgagtggtccaagaacgccaatagctgccccgtggacagaactctgttcaagtgcatttgcatcagggctcagttcggaggcaagatcttgcgcaagattccggtagagaacaccaaggcatctgaagaagaggaggatcccacattctgtgaggtgtgcggacgatccgatcgcgaggacaggttgctcctgtgcgatggatgcgacgctggataccacatggagtgcctggatccgcctctgcaggaagtcccagtggacgaatggttctgtcctgaatgtgctgctcccggagttgtgttagccgccgacgcaggacctgttagcgaggaggaagtgagtttgctgctcgctgacgttgtaccaaccacttctcggctccgacctcgtgcagggcgcacccgggccatagcgcgaaccagacagagcgaaagggtgcgggctaccgtgaaccgcaacaggatctccactgcacgaagagtgcaacacacacctggtcgtctgggatcctcactgctggacgaggcaattgaagcagtggccaccggactgtccacagcagtgtatcagcgacctctgaccccgcgaacacccgcaaggaggaagcgcaagactcgccgacgtaagaaagtgcccggccgaaaaaaaacaccatccggaccttctgcaaaatcaaaaagctcagccacaagatcaaagaagaggcagcaccgcgtgaagaagaggcggggcaagaaggtcaaatcagaggcgactactcgatcccgtatcgcccgcactctgggtctacggcgtcctgttcattcaagctgcatccctagtgtcttgaagcctgttgaacccagcctgggcctcttgcgtgccgacatcggtgcggcctctctgtccttgttcggcgatccctacgagctggaccctttcgacagtgaagagctcagtgccaaccctctttcccccctgagcgcaaaaagacgtgctctgtcgagatccgcgctacagtcacatcagcctgtggcccgacccgttagcgtgggcttaagtcgcaggaggttgcccgccgccgttccagagcctgacttggaagaagagcctgttccggacctcctgggtagcattttatcgggccagagtctgcttatgctcggctcatctgacgttattatccaccgggacggaagcttatctgctaaacgcgctgctccagtttcgttccaacggaatagcgggtctctgagccgcggcgaggaggggtttaagggctgcttacaacccagggcactaccgtctggctcacccgcacaaggacccagcgggaacaggccccaaagtaccgggctgagctgtcagggaagatccaggaccccagctcgtactgctggggccccagttcgcctggacctaccagcagcccctggtgctgttcaggctcggaacctgtcgaacggctctgtccctggctttagacagtcccactccccttggttcaatggcacaaacaaacatactttgcctctcgcatctgccgccagcaagatcagtagcagagactccaagcccccttgcaggtccgttgtccctggacctccgttgaaaccggcccctcgccgaacagacatttccgaactaccccggatccctaaaatccgaagggatgatgggggggggagacgggacgccgccccagcccatggccagtcaatagagatcccatccgcctgcattagcagactaaccggcagggaaggaactgggcagccaggccgagggacgcgggccgagtctgaagctagctccagagtgcccagagaacctggagtgcatacaggcagctcacggccgcccgctccctcctcccacggatccctcgcccctctgggcccttcaaggggaaagggagtaggctcaacgtttgagagttttcgaataaatatccctgggaacatggcacactcctcccagctgagttcccctggcttttgtaatacattcaggcccgttgatgataaagagcagcgtaaagagaatccctccccactcttcagcattaagaagactaagcaactgagatcggaggtttacgaccctagtgaccctaccgggagtgactcctccgcacctggcagctcacccgagaggtccggcccaggcctgctcccttctgagatcacccggacgatcagtattaactcgccaaaggcacagaccgtccaggccgtgaggtgcgtaacttcatacacggttgagagtattttcggcaccgaaccggagccgcctctggggccaagcagcgcaatgagcaagctgcgcggggctgtagccgccgagggggccagcgataccgagagagaagagccaactgagtcacaagggctggcagcacgcctccgcaggccatccccgcctgaaccatgggacgaagaagacggcgcctcctgttcgacattctttggctcagaggagcgtaccgtgacatgtgtgactgtggtcgagcctgaggcccccccaagtcccgatgtgcttcaggctgcgactcaccgagtggttgaactacggccacctagtaggagccggtctacctcaagctcgagaagccggaaaaaagctaagcgtaagcgggtatcgagggagcatggaaggacacgctctgggactagatcagagtcccgcgacagatccagcagaagtgctagcccgagcgtgggggaggaacgccctcgtcgacagcgatctaaagcaaagtctcgccgtagcagctcagataggagtagtagccgcgagcgagctaagcgcaaaaaggccaaggacaaatcacgtgaacataggagaggtccatgggggcatagtaggagaactagtcggtctcgaagcggaagtcctgggtcttcctcctatgaacactatgaaagccggaaaaagaagaagaggaggtcggcaagtagacctcgtggtcgggagtgtagccctacaagtagcctcgaaaggctatgcaggcataagcatcagcgggaaaggtcccatgagagacccgaccgtaaagaatccgtcgcgtggccccgagaccggcgtaaacgtcggtcaagatcgccttcttctgagcatcgcgccagagaacataggagaccaaggagcagagaaaaatggccacagacgaggagccactccccagagcggaagggggctgttagggaagctagtcccgccccacttgctcagggtgaacccggtagagaagatctccctacccgcttaccagccctgggcgaagcacatgtaagtccagaggtagccacggccgataaagcccctcttcaggccccccccgtgctggaggtcgccgccgagtgtgagcccgatgatctggatctagattacggggacagcgttgaggcaggccacgtctttgacgatttttcatccgacgctgtttttatccagctcgatgatatgagcagcccccccagcccggaatcgacagactcctcccccgagcgagactttcctctcaaacccgccctcccgccagccagcctagctgtggcagcaatacagagagaggtgagcttgatgcatgacgaagatccctcacagcctcctccactccctgaagggacccaggagccacatctactgcgaccggatgccgccgagaaggctgaggctccatcttccccggatgtggctcccgccggaaaagaggacagtccctccgcttccggcagagtacaggaagctgcgagacccgaggaggtggtttcccaaacacctctgttgcgctctcgcgctctggtgaagcgggtcacctggaacctgcaggagtcggagtcatcagcaccagccgaggatagagctcccagggctcccttgcatagaccacagaaaccgcgggaaggggcgtgggacatggaagacgtcgcaccgaccggagttcggcaggtgttttcagagctgccgtttccaagccacgtcctcccagaaccaggatttcctgatactgaccccagccaggtctactccccaggactccctcctgcccccgctcaacccagttctatccccccatgtgctctggtcagccaacccacagtccagtttattctccaggggtctctacccctggtcggatgtggcgcggcacagacactagccccagtaccagccgctctcacccccgctagcgaaccggctagtcaggccacagccgcgagcaacagcgaggagaagacaccagccccgagattggctgccgagaagactaaaaaggaagagtacatgaagaaactccacatgcaagaacgagcagtcgaggaagtgaagctggctatcaagcctttctaccaaaaacgggaggtcacaaaggaagagtataaggacatacttagaaaggcagtccagaagatctgccacagcaagagcggcgaaatcaatcccgtcaaggtcgccaacctggtgaaagcctacgttgacaagtatagacacatgcgtagacataagaaacccgaagccggggaagagccccctacgcagggtgcagagggctag

SEQ ID NO: 12697 - DNA, 2115 bp, Artificial Sequence
  Description of Artificial Sequence: Synthetic coding sequence
atgtgggagaaaatggagaccaagactatagtgtacgatctggacacgtcaggaggactgatggagcagatccaggccctgctcgctcctcctaagactgacgaagctgagaaacgcagtaggaagcctgagaaagagcccaggcgctctggaagagcaacgaaccacgactcctgcgactcctgcaaagagggcggcgacctgctgtgttgcgaccattgtccggcagccttccatctccagtgttgcaatccacctctgagcgaggaaatgcttcctcctggcgaatggatgtgccacaggtgcactgtgaggaggaagaaacgcgaacagaagaaggagctgggacatgttaacggcctggtagataaatctgggaaacgcaccaccagtccctcttcggatactgatctgctagaccggtctgcttctaagacagaattgaaggctatcgcacacgccaggattttggaacgtagggcgagcaggcccggcacgcccacttcctcagccagcacggagacgcctaccagcgaacagaatgacgtggatgaggatataattgacgtggatgaggaacccgtcgctgctgaacctgactacgtccagcctcagctgagaagaccattcgagctgctgatcgccgctgccatggagagaaaccccacccagtttcagctacctaacgaactgacatgtactactgcactccctggaagttcaaagcgtagaaggaaggaagaaactaccgggaaaaacgtgaagaaaactcagcacgagctggaccacaatgggctggtgccactgccagttaaagtttgcttcacatgcaacaggtcttgtagagtggcccctctcattcagtgcgactattgccccctcttgtttcatatggattgcctcgaacctcccctcacagccatgccactgggccggtggatgtgtcccaaccatatcgaacatgtggtgttgaaccagaagaatatgactttgtctaatcggtgccaagtgttcgaccgatttcaggacaccgtgtctcaacatgtcgtcaaggtggacttcctgaacagaattcataaaaaacaccctcctaacaggcgcgtgctgcagtccgtcaaaagaaggagtctgaaggttcctgacgcaatcaaatcccagtatcaattcccacccccactgattgctcctgccgctattcgggacggcgaactgatttgtaatggaatcccagaagagtcccagatgcacttgttgaactcagagcatctggcaacacaggccgagcaacaggaatggctgtgtagcgttgtagctcttcagtgttccatcctgaaacatctgagtgccaaacagatgccctcccattgggacagcgagcagactgagaaagccgatatcaaacccgttattgtgacagattcttctgtaaccacgtcactgcaaactgcagacaagacaccgaccccatcccattatccgctctcctgtccatcaggaatttcaactcagaattcgttgtcctgttcaccgcctcaccagtcaccagccctcgaggacatagggtgtagcagttgcgcggagaagagtaagaagaccccatgcggtaccgccaatggccccgtgaatacggaggtcaaggctaatggaccccatctgtactcaagtcccacagactctaccgatccacgaaggcttcccggagctaacacacccctaccagggctcagccataggcagggctggcctcgcccactcacgccacctgctgccggcggtcttcaaaatcacacagtgggcatcatagtcaaaacggagaacgctacagggccatccagctgtccccagcgctcccttgtccccgtcccatccctgcctccaagcattcccagttcatgcgccagcattgaaaatactagcactctgcagcgcaagactgtgcagagccaaattgggccaccactgacagatagccgtccactggggtcgcctcctaacgctacaagagtactcacgcccccgcaggccgccggagacggaattttggctactacagccaatcagagattcagtagccccgcgccctcctcaggcgagtgctgtagcgctctggggtag

SEQ ID NO: 12698 - DNA, 3015 bp, Artificial Sequence
  Description of Artificial Sequence: Synthetic coding sequence
atgtgggaaaaaatggagacaaagacaatcgtgtacgacctggatacaagtggggggctgatggagcagatccaggccctgctcgctccgccgaagacagatgaagccgaaaagcgaagccggaagccagaaaaagaacctaggagatctggccgagccacaaatcacgactcttgcgactcttgtaaagagggtggagatctactgtgttgtgatcattgtcctgcggcttttcaccttcagtgttgtaatccacctctttccgaagagatgcttcccccgggggaatggatgtgccaccgatgtactgttaggcgtaaaaagcgcgaacagaaaaaagagctgggccacgtgaacggcctcgtcgataagagtggcaagcgcacaacctccccaagtagcgacacagacctcctggatagatccgcttccaaaaccgagctgaaagctatcgcccacgcccggattttagaaaggagggcgtcccgtcctggcactccgaccagctcagcttccacagagaccccgacctctgaacagaatgatgtggatgaggatatcattgatgtcgacgaggaaccagttgcggctgagcctgactacgtgcagccgcagctgcgcagaccgttcgaactgctcatagccgccgccatggagcgtaaccctactcagtttcagctgccaaacgaacttacatgtaccaccgcacttccaggctccagcaagaggcgaagaaaagaggaaaccactgggaagaatgtcaaaaaaacccagcacgagctggaccacaacggcctcgtgccattgccagtgaaagtttgtttcacttgtaacagatcctgtagagtcgcgcccttaatccagtgtgattattgcccactactattccacatggattgtctggagccacccctcactgctatgccattgggtcggtggatgtgcccgaatcacatagaacacgtggtgctgaaccagaaaaacatgactttatcgaatcgttgccaggtgttcgaccggttccaggacacagtgtctcagcacgtggttaaggtggattttttgaacagaatccataaaaaacatccccccaaccgccgggtgctgcagtccgtgaagcgcaggtcactgaaggtgcctgatgctataaagagtcagtaccagttcccccccccacttattgctccagcggccattagggatggcgaattgatttgcaacggcatcccggaggagagtcagatgcatttgctcaattccgaacaccttgcaacccaagccgagcagcaggagtggctgtgcagtgttgttgctctgcagtgcagtatattgaagcatctgagtgcgaagcaaatgcccagccattgggactcagaacagaccgaaaaggccgatatcaagcctgtgattgtgaccgatagcagtgtgacaacttcgctacagacagccgataaaacccccactccctctcactatcctcttagctgcccttccgggattagcactcagaactccctgtcttgctctcctccccatcagagtccagccctggaggacattggctgcagctcatgcgctgaaaagagcaagaagacaccttgtggaacagctaacggtcctgtgaatacggaagtcaaggctaatggcccgcacctctactcttctcctaccgattccaccgatcctcgtagactacctggagctaacacccccctaccaggcctgagtcaccgtcaggggtggccgcgccctctcaccccacccgctgcaggtgggctgcaaaaccacacagtcggcattattgtgaaaaccgagaatgccacaggcccatcctcttgtccgcagagatctctcgtgcccgttccatcactgccacctagcataccttcaagctgtgcctcaattgaaaatacgtccaccctgcagcgcaagacagtgcagagccagattggaccgcccttgacagattccagacccttaggcagcccacccaacgccacacgcgtgctcacccccccccaggccgccggcgatgggatcctcgccacaactgctaaccagcggttctcctctcctgcaccgtcaagtgatggtaaggtgtccccaggtaccctgtctattggcagcgctttaactgtgccctcttttccagcaaacagtacagccatggtggacttgacaaacagcctccgggcatttatggacgtgaacggtgagattgagatcaatatgttggatgagaaacttataaagtttttggccctccaacgaatccaccagctctttccctccagagtacagcccagtccaggctcagtgggaacgcatcagctcgcttccggtggccaccatatcgaggtccagagaaaagaagtgcaggctcgagctgtcttttacccactgctgggtttagggggggcggtgaatatgtgttaccgcactttgtatattggaactggggctgatatggacgtctgccttactaattacggccattgcaattatgtgtccggaaaacatgcatgcattttttacgatgagaataccaagcattatgagctgctgaattatagcgagcatggaacaacggttgataacgtgctctatagctgtgattttagcgagaagaccccacctactccaccttcctcaattgtagctaaggtacagtccgttatcaggaggagaaggcaccagaagcaggatgaggagccaagtgaggaggcggccatgatgtcctcccaggcccaagggccacagagacgtccctgtaactgtaaggccagctcttcaagcctgattggcggatcgggcgctggctgggaaggaaccgctttattgcatcacggttcatatatcaagctcggttgtctacagttcgtattcagtattaccgaattcgctactaagcagcctaaaggggacgcaagcttgttgcaagatggcgttctggccgagaagttgagcctcaaacctcatcaaggacccgtcctgagaagtaactctgtaccttag

SEQ ID NO: 12699 - DNA, 2550 bp, Artificial Sequence
  Description of Artificial Sequence: Synthetic coding sequence
atgtgggaaaaaatggagacaaagacgattgtgtatgatctggacacgagtggcgggttaatggagcagattcaggcgctgctggctcccccaaagaccgatgaggctgaaaaaaggagtaggaagcctgaaaaggaaccgcggaggtccggcagggcaaccaatcacgactcctgcgacagctgcaaagaaggcggagatctcttgtgttgtgaccattgtcccgcagcctttcacttactagtctaccaggatttcgtggcaccaatttctctattccatggaaccttccacgacgggcctacgtgtagcttcgcacaaaagcgggagcagaagaaagaattggggcacgtgaatggtctggtggataagtctggcaagcgaactacctctcccagctcagacacagatctgttggacaggagcgcctccaagactgaattgaaggcaatagcccacgcgagaattttagaaaggcgcgcatccaggcccggcacgcctactagcagcgcttctactgagactccgacgagcgagcagaatgatgtcgacgaggatatcatcgacgttgacgaggagcccgttgctgcggagcctgactacgtgcaaccacagttaaggagaccatttgagctgctaatcgccgccgcaatggaacggaacccaactcagttccagttgccaaatgaactgacctgcacaaccgcccttcctggcagctcaaagaggcgaagaaaggaggagaccacaggcaagaacgtcaagaagacccaacatgaactagaccacaatggactggtcccactccccgttaaagtgtgttttacctgcaatagatcctgccgcgtggcccctttgattcaatgcgactactgccccttgctctttcatatggattgcctagaaccccccttgaccgctatgcccctcggccgctggatgtgcccaaatcacatcgaacacgttgtccttaatcagaaaaacatgactctgtccaaccggtgccaagtcttcgatcggtttcaggacactgtttctcaacatgtggtgaaggtggattttctcaacaggatacataagaagcacccaccaaataggcgggtacttcagtccgtcaagcggagatccctcaaggtgcctgatgccatcaagtcacagtaccagtttcccccacccctaatagctcctgctgctatccgagatggtgagctgatctgtaatggcattcccgaggagtctcagatgcatttactgaacagcgagcatctcgctacgcaggctgaacagcaagaatggctatgcagcgtggtcgcgcttcaatgctcaattctaaagcatctctctgcaaaacaaatgccaagtcactgggactccgagcagaccgaaaaggccgatataaaaccagtgatcgtcactgactctagcgtgaccacatccctgcagacagccgacaagacacctaccccctctcattatccgctgtcgtgtccctctggaatcagtactcagaattccctgagctgttctccgccccatcaaagccccgctttagaggacattggatgctcgagctgcgccgagaagagcaaaaaaacaccttgcggtacagccaacggacccgtgaatactgaagtaaaggctaacggcccccacctctattcctctcccacagattccacagatccacgaaggctgcctggggctaatacccccctacccggcctgtcccatcgtcagggatggccaagaccgctaacgccacctgccgccgggggtctgcagaaccacaccgtggggataatcgtcaagacagaaaatgccactggcccatccagctgcccccaacgctctctcgtaccagtgccgagccttccaccctccattccatcatcatgtgccagcatagaaaacaccagtacactgcaaaggaagacagtgcagagtcagatcgggcctcctcttactgactctcgacctttaggtagcccgcccaatgctacacgagtccttacccccccgcaagcagcaggggatggcattctggccactaccgccaatcagcgcttctcatctccggccccaagttccgatggcaaggtctctcctggcaccctctccatcggttcagcactcactgtccccagttttccagccaatagcaccgccatggtggacctgactaattctctcagagcgtttatggacgttaacggggagatcgagattaacatgctggacgagaagcttatcaaattccttgcactccaacggattcaccagctgttccccagccgcgtgcagcccagtcctggaagtgtgggaactcatcagctcgcctctggcgggcaccatattgagggggctcatgtgcacacctgccatcacattatccgtagcccactttacgtatgcgagtggtctccctgtctgcacggtgagtcggagttgccagttagtcagacaagtctttgcgcatttcacgggctcaacaaagccccatggtttttctccgaggagtctcgcaataaaatggcgaccaccgcattctag

SEQ ID NO: 12700 - DNA, 903 bp, Artificial Sequence
  Description of Artificial Sequence: Synthetic coding sequence
atggactcagacagctgcgccgcggccttccatcccgaggagtactcaccaagctgtaaacggcgaaggacagtggaggattttaacaagttttgcacatttgtactcgcttacgccggatacatcccgtaccctaaggaggaattacctctgcgatcgtccccatccccagccaattccaccgccggaactattgactccgatggatgggatgcaggcttctccgacattgcatcttctgtcccgctgcccgtcagcgatcggtgcttctctcatttgcaacctacactgcttcagcgggctaaaccgagcaactttcttctggatcggaagaagaccgataaattgaagaagaaaaagaagcgtaagagacgggactcggacgccccaggaaaggagggttatcggggaggcctgctgaaactggaggctgctgacccatacgtggaaactccaacctcccctacccttcaggatatcccgcaggctcctagtgacccatgctctggatgggactccgataccccttcctcaggcagttgtgctactgtgagcccagatcaggttaaggaaatcaaaaccgagggaaaacgcacgatcgtcaggcaagggaagcaggtggtgtttagagatgaggactcaaccggcaatgacgaagatatcatggtggattccgacgacgacagctgggatctggtgacatgtttttgcatgaaaccattcgctggacgacctatgattgagtgcaatgagtgccacacctggatccacctgtcgtgcgcaaaaatccggaaatctaacgtgccagaagtctttgtatgtcaaaagtgccgggactcgaagttcgatatccgccgttccaaccgtagccgcactggaagcagaaagttgtttttggattag

SEQ ID NO: 12701 - DNA, 2373 bp, Artificial Sequence
  Description of Artificial Sequence: Synthetic coding sequence
atggaggagaaacggcgtaagtattccattagctccgataattctgacacgaccgactcccatgctacttcgaccagtgcatccagatgctcgaagctcccctcttcaaccaagtctggctggcctcgccagaacgagaagaaaccttccgaagtcttccgaacagacttaataaccgccatgaagattcccgatagttaccagttgagtcctgacgattattatatactcgctgacccctggcgccaggaatgggaaaaaggagtacaggttcctgccggagcggaagccatccctgagcccgtggtgcggattcttccacctctggagggcccaccggcccaggcctctccaagcagcactatgctgggcgagggctcccagccagactggcctggcggaagcaggtacgacctggacgagatcgatgcttattggctagagctcatcaattcagagctcaaggagatggagcggccagagctggacgagctgaccctcgagcgggttttagaagaattagagacgctgtgccatcagaatatggcccgggctattgagactcaagaggggttaggaatagagtacgacgaagatgtggtctgcgatgtgtgcagatctcccgagggagaagatggcaacgagatggtgttttgtgataagtgcaacgtctgcgtgcaccaggcttgctacggaatcctgaaggtgcctaccggttcttggctgtgtcgcacgtgcgccctgggagtccagccaaaatgtcttctgtgtcccaaacgtggaggggccctcaagcctacccggagcggaactaaatgggtacatgtgtcttgcgcactgtggatcccggaagtatccattggatgcccggagaaaatggagcccataactaagatctcgcacattcccgcatcccggtgggcgctgtcctgctcactctgcaaagagtgcaccgggacgtgcatccaatgctccatgccttcttgcgtgacggcttttcatgtgacctgtgccttcgaccacggcctggaaatgaggactatcctggctgataacgacgaggtaaaatttaagtccttttgccaggaacattccgatggtggcccaaggaacgaacccactagtgaacccaccgaaccttcacaggccggcgaggatctggagaaggtgaccctgagaaagcaaaggttgcagcagctggaggaggatttttatgagcttgttgaacctgctgaggttgctgagagattggacttggcagaggccttggtggactttatttatcagtattggaaactgaagcggaaggcgaacgccaaccagccactgctcacccctaagacagacgaagtggataatcttgcacagcaggaacaggatgtgctgtaccgtcgcctcaaactgttcacacacctgcgccaggaccttgagcgcgtgcgcaacctctgctacatggtgactagacgcgaaaggacaaagcatgccatttgtaagcttcaggagcagatctttcacctccagatgaagctgatcgagcaagatctgtgccgaggactgtctactagttttccaatcgacggaaccttctttaatagctggctggcccagtcagtgcaaataaccgccgaaaacatggccatgagtgagtggcccttgaataacgggcacagggaggaccccgcacctggtctgctgtctgaagagttgctgcaggacgaggagactctgctgtcctttatgcgggatccttcacttcgacccggcgacccggcccgtaaggcaagagggcggactagattgccagcgaaaaagaaacccccaccacccccaccacaagatggtccgggttcccgaacaactccggacaaggcccccaagaagacctggggccaggacgcaggcagtggaaaaggtgggcagggaccaccaactagaaagccacccagacgcactagctctcacctgccaagtagccctgccgctggagactgcccaattcttgccacccccgagtcaccgccgcctctggccccggagacccccgatgaggctgcatcagtcgctgccgattcagatgtacaggtgcccggcccggccgcaagtccaaagccactgggccgcctgcgtccgccacgggagtccaaggtgactcggcggttgcccggagcccggcccgatgcaggcatgggaccccccagtgcagtggcagaaaggccaaaggtgagcctccatttcgacacggaaactgacggttacttttcggacggcgagatgtccgactccgatgtggaagcagaggacggaggggtccaacggggaccaagagaggcaggtgcagaggaggtggtcaggatgggggtgctcgcctcatag

SEQ ID NO: 12702 - DNA, 2382 bp, Artificial Sequence
  Description of Artificial Sequence: Synthetic coding sequence
atggaggagaagcgaaggaagtacagtatcagttccgacaatagcgatacaacagattcacatgccacttcaacatcagcctctagatgtagcaaactcccttctagcacaaagtccggatggccccggcagaatgaaaaaaagcctagcgaggtgttcagaaccgacttaattaccgctatgaagatccccgactcttatcaactgagccccgacgattattatatcctagctgacccctggagacaggagtgggagaagggggtccaggtgcccgccggcgccgaagcaattcccgaaccagttgtcagaatcctgcctcccttggagggcccacccgcccaagcctccccatctagtacaatgctgggagaaggttctcagcccgactggcctggcggctcccgctacgatcttgacgaaatcgatgcttactggctggagttgattaactctgagcttaaggagatggagcgtcccgaactggacgagttaacgttggaaagggtgctcgaggaacttgagaccctctgtcatcagaatatggcgcgggccatagagacgcaagagggactgggaatagagtatgatgaggacgtggtgtgtgatgtttgtcggtcacccgaaggcgaggacggtaacgaaatggtcttttgtgacaagtgcaatgtgtgtgtgcaccaggcttgctatggcattctcaaggttccaacaggctcatggttgtgcaggacatgcgccctgggagtgcagcccaaatgtttgctgtgtccaaagagggggggcgcactcaagcccactaggtctggcacaaaatgggttcatgtgagttgcgcactttggatcccggaagtatcgataggatgcccagaaaagatggagccaattaccaagataagtcatattcccgcctcccggtgggcgctctcctgcagtctctgcaaggagtgcacagggacctgtatccagtgttcgatgccaagttgcgtgacggccttccatgtgacatgcgccttcgaccatggactcgaaatgcggactattcttgcagacaatgacgaagtgaagttcaagtctttctgtcaggagcattcagacggcggacccaggaatgagcccacctcagagcccaccgaacctagtcaggctggagaggatctagagaaagtcaccctgagaaagcagcggctgcaacagctagaggaagatttctatgaactggtggaaccagcagaggtcgcggaacggctagacctggctgaggcactggttgattttatttaccagtattggaaattaaaaagaaaggccaatgccaatcagcccctgctcactccaaaaaccgacgaggtggacaatctcgcacaacaggaacaggacgtcttatatcggcgcctgaaactcttcacccatctgcgacaggacctggagcgcgtgcggaacctttgttatatggtgacacggcgagagagaacgaagcatgccatctgtaagttgcaagaacaaatctttcacctgcagatgaaactgatcgagcaggatctctgcagagaacggtcagggagacgagctaaaggcaagaaaagcgacagcaagcgaaagggctgcgaagggtcgaaagggtcaactgaaaaaaaggaaaaggtgaaggccggcccagatagtgttttggggcaactggccggattgtcgaccagcttcccgatcgatggcacgtttttcaactcatggctggcccagtccgttcagattactgcggagaatatggcaatgagtgaatggccactcaacaacggccatagggaagatcctgctccaggcctgctgtccgaagaacttctgcaggatgaagagaccctactcagcttcatgcgagacccaagtctgagacctggagatccagccaggaaagccagaggtcgcacccgcctgccagctaagaagaaacccccccgcagaacttcttcacatctccccagctccccggccgctggcgactgcccaatactcgccactcccgagagccccccacctctcgcacccgagaccccagacgaggcggcctctgtcgccgctgattctgacgtgcaggtgccaggacccgccgcaagtccaaaacctttgggccggcttcgtcctcctcgagagagtaaagtcactagaaggcttcccggagcgcggccagatgccggaatgggtcctccaagcgctgttgccgagcgacctaaggtatcacttcacttcgataccgagaccgatggctatttctcagatggagagatgtccgatagcgacgtcgaagctgaggatggcggggtccagagaggcccccgggaagctggggcagaggaagtggtgcggatgggcgtgctggcctcttag

SEQ ID NO: 12703 - DNA, 768 bp, Artificial Sequence
  Description of Artificial Sequence: Synthetic coding sequence
atggaagaaaaaaggcggaaatactcgatctcatctgacaattccgatacaactgattcacatgcaacttcaaccagcgctagtcgctgctcaaaactgccaagcagtacgaaaagcggctggccacgacagaacgaaaaaaaaccttccgaggtctttcgtaccgacttaattactgccatgaagattccagactcttatcaattgagtccagatgattattatatcctggccgatccgtggcgccaggagtgggagaaaggagtgcaagtgcctgccggcgcggaggcgatcccagagccggtagttcggatcctgcctcctttggaaggtcctcccgcccaggccagcccctccagtaccatgctgggggagggctcacagccggattggcccgggggttcacgctacgacctcgatgaaatagacgcctactggctggaattaattaactccgagctgaaagaaatggagaggcctgagctcgatgagttgactttagagagggtgttggaggagctcgagaccctgtgccatcagaatatggcgcgcgcaatcgagacacaagaaggcttggggatcgagtacgacgaggatgtggtttgtgacgtgtgcaggtctcccgagggggaggacggaaatgaaatggtcttctgtgataagtgcaacgtctgtgtgcaccaggcatgctacggtattctgaaggtgccgacagggagctggctgtgtcggacatgcgctctgggggtgcagcctaagtgcctctag

SEQ ID NO: 12704 - DNA, 2376 bp, Artificial Sequence
  Description of Artificial Sequence: Synthetic coding sequence
atggaagaaaagcggcgcaagtactctatcagctcagacaactcagatacaactgattcgcatgcgacctctacatcggcaagtcgctgttctaaactcccctccagcacaaaatcaggctggcctcggcagaacgaaaagaagccctctgaggtgttcaggacagacctcattaccgcgatgaaaattcccgattcataccaactctcgcctgatgactactatatccttgccgatccttggagacaggaatgggagaaaggcgtccaggtcccggccggcgctgaagctattccagagccagtggtacgcatcttgcctcccctggaaggcccaccagcccaggcctctccttcgtcgacgatgcttggcgaagggtcccagcccgattggcctggaggctctaggtacgacctcgacgaaattgatgcctactggttggagctaatcaattccgaactaaaagagatggagagaccagaactggacgaactgacacttgagagggttctggaggagctggagaccctgtgtcaccagaacatggcacgggccatcgaaacacaggaaggccttggaatcgagtatgacgaagatgtggtatgcgacgtgtgtcgcagcccagagggggaagacggaaacgagatggtgttttgcgacaaatgtaacgtctgcgttcaccaggcctgttatgggattctcaaggtgccgacgggatcctggttatgtaggacatgcgccctcggcgtgcagccgaagtgtctcttgtgcccgaagagggggggcgccttgaaacccaccagaagtggtacaaagtgggtccacgtcagttgcgcgttgtggatcccagaggtgtcaattggatgtcccgagaagatggaaccaatcacaaagattagccacatcccagcctctcgttgggcactgagttgtagcctgtgcaaagagtgtacgggaacatgtattcagtgctctatgcccagctgtgtgaccgcgttccacgtcacatgcgctttcgatcacggactagaaatgaggaccattctcgctgacaatgatgaggtcaagttcaagtctttctgccaggagcatagcgacggcggaccgcggaacgagccaacatctgagccaactgagccctctcaagcaggagaagatctcgaaaaagtgactctacgaaagcaaagactccagcagctggaggaagacttctacgagcttgtcgagccagcagaggtagccgagcgcctggacctcgctgaagctcttgtggacttcatctaccaatattggaaactgaagcgcaaagcaaatgccaaccagcctctgctcacccccaagactgatgaagtcgataatctggcacagcaagagcaggacgtactgtatagacggctgaagctttttacacatctgcgccaggacctggagcgggtgcgcaatctgtgctacatggtcacgaggcgcgagcgtaccaagcatgcgatttgtaaactccaagaacagatctttcacctccaaatgaaactgattgaacaggatctttgccgtgccgggctgtccactagctttcctattgatggtacattcttcaacagctggctggctcagtctgtgcagatcacggctgagaatatggccatgagtgaatggcctttgaataatggacatcgggaggatcctgcaccaggactgctgtcagaggaactgctgcaggacgaagagaccctactgtcattcatgcgcgaccctagcttacgaccgggcgatccagcccgcaaagcaaggggaaggactcgactgcccgcaaagaaaaagcctcccccacctcccccccaagatggtccgggatccagaactacgccggataaagctcccaagaagacttggggccaggatgctgggagcggcaaaggagggcagggaccacctacacgcaaaccgccacggcgtacttcttcccatctcccgtccagccccgctgcaggagattgcccgatccttgcaacccccgaaagccctccacccctggcccccgaaactcctgatgaggctgcctccgtcgcagctgatagtgatgtgcaggtcccaggacctgcggcctctcctaaacccctcggacgcctgagaccaccccgcgaaagtaaagtgactaggagattgcctggtgccagacctgacgccggtatgggaccgccttcagcagtggcagagaggcccaaagtgagcctgcattttgatactgagactgatggttatttctccgatggcgaaatgagtgattctgatgtggaggcggaagacggtggcgtgcagcggggaccacgtgaggctggtgcggaggaggttgttagaatgggagttcttgcatcatag

SEQ ID NO: 12705 - DNA, 2553 bp, Artificial Sequence
  Description of Artificial Sequence: Synthetic coding sequence
atggtacctactgccgccatagcagtaggtggctacttcctcggaggcatggaggaaaaacggcgcaaatatagcatttcgtctgacaattccgacacaacagacagccatgctaccagcacctctgcctctcgctgctcgaagcttccttcgtccacaaaatcaggctggcctaggcagaatgagaaaaagccctccgaagttttccgcacagacctgatcacagcaatgaagatcccagattcgtaccagcttagcccagatgattactacatactggcggatccctggcgccaggaatgggaaaagggagtgcaagtgcccgccggggctgaagccatccctgaaccggttgttcgcattctgccgccactagaaggccctccggcacaagcctcgccttcgagcaccatgcttggggagggatcccagccagactggcccggaggatctaggtatgacctcgacgagatcgacgcctactggctcgaactgataaattctgagctcaaggaaatggagcggcccgaattggacgagctgacgttagagcgggtgctggaggagctggagaccctttgccatcagaatatggcacgcgcaattgagacacaggaggggctcgggatcgaatacgacgaggacgtggtgtgtgatgtttgcagatcccctgagggagaagacggcaatgaaatggttttctgtgataaatgcaacgtgtgcgttcatcaggcctgctacggtatcttgaaggttcctacagggtcttggttatgtagaacctgtgccctgggggtccaaccaaagtgccttctgtgccccaagcgcggaggagcccttaagcctacccggagtggaacgaagtgggtccatgtctcttgtgctctgtggataccagaggtttctattggctgcccagaaaaaatggagcccattaccaagatcagccacattcctgcttcaaggtgggctctgtcatgctcactgtgtaaggagtgtacaggaacctgtatacagtgctctatgccatcatgcgtgacagctttccacgtcacctgtgccttcgaccacggactcgagatgaggacaatcctggctgataacgatgaagtgaagtttaagtccttctgccaggagcactctgacggcggccccaggaatgaacctacaagcgagccaacagaacctagccaagccggtgaggatctcgagaaggtgacacttcgcaaacagcggctgcagcagctggaggaggacttctacgagctggtagagccagcagaagttgccgagcgcctggatctagctgaggccctggtggacttcatataccagtattggaaactaaagagaaaggcaaacgctaaccagccccttctgacaccaaagaccgatgaagtagacaatctcgcccagcaagaacaggatgtactttatcggagactgaagttatttacgcacctgcgtcaggaccttgagcgggtgagaaatctgtgttacatggtcacacgcagggagcggaccaagcacgcaatatgcaaactgcaagagcagattttccacttgcagatgaagcttatcgaacaagacctttgtcgggagcggtccggacgccgcgccaagggaaaaaaatctgacagtaagcgcaaaggctgcgaaggcagtaaaggttctaccgaaaagaaagaaaaggtgaaagccgggcctgattccgtgctcggacagcttgcagggctctctacttcattccctatcgacggaacatttttcaactcttggctcgcacagtccgtgcaaatcaccgctgaaaacatggcaatgtccgagtggcctctaaacaatgggcacagagaagacccagcacccggactcctctctgaggagttgctacaagatgaagagacacttctgtcgtttatgcgtgaccctagcctgcgccccggtgacccagcacgcaaggccagaggtcgcactaggctccctgccaaaaagaaaccacctcctccgccaccccaagacgggcccggcagtaggaccactcccgataaggcccctaaaaagacatggggccaagacgctggcagcgggaagggcggccagggaccccctacacgaaagccccccaggcggacctcctcacacttaccaagttcaccagccgcgggggattgccccattctggccacccccgagagtcccccgccattggcgccggaaactccagacgaagccgcgtccgtggctgccgattccgacgttcaggtgcctgggccagccgccagtccgaagcctctggggcgcctacggcctcctagggagagcaaagttacccgaagactccctggcgcccgtccagatgccgggatgggtcctccttcggcggttgctgagcggccgaaggtttccctgcatttcgacaccgagacagatggctacttcagtgacggggagatgtcagattccgacgtagaggccgaggatggaggagtccagaggggcccgcgcgaggccggcgcagaggaggttgtgagaatgggcgtcctggccagctag

SEQ ID NO: 12706 - DNA, 450 bp, Artificial Sequence
  Description of Artificial Sequence: Synthetic coding sequence
atggaggaaaagcgcaggaagtactctatttcctcagacaatagcgatacaacagacagccacgccacatctactagcgcctcccggtgctccaagcttccttccagcacaaaatctgggtggcctcggcagaacgagaagaagccgagcgaggttttccgcacagacctgatcaccgccatgaaaatcccggattcatatcagctttcaccagacgactactatatcttagccgatccttggcgccaggagtgggagaaaggggttcaggtccctgccggagctgaggcaatccccgagccggtggttagaattttacctcccctggaaggccctccagctcaggcaagccctagcagcacaatgcttggagaggggagccagccagactggcccggagggagccgctacgatctggatgaaattgatgcttattggctagagctctag

SEQ ID NO: 12707 - DNA, 1053 bp, Artificial Sequence
  Description of Artificial Sequence: Synthetic coding sequence
atgggctgcttctttagtaaacggaggaaggctgacaaagaatcacgacccgaaaatgaagaagaacggcctaaacagtactcctgggatcaacgggagaaggtggaccctaaagattatatgttctccggcctcaaggacgagaccgttggccggttgccaggcacggtcgccggccaacaattcctcatccaagattgtgaaaactgcaatatttatatctttgatcactcagccacagtaactatcgacgattgcacgaattgcatcattttccttggaccagtgaaggggtccgtattttttcgcaactgccgtgattgtaagtgcacactggcctgccagcagttcagggtcagagattgccgcaaactggaggtgttcctatgctgtgctacccaacctattatcgagtcctcttcaaatattaagtttggctgttttcagtggtattaccctgagctggcctttcaattcaaggacgctggtcttagcattttcaacaacacatggtccaatattcacgactttaccccggtctctggggagctgaactggtccctattaccggaggacgcagttgttcaagattacgtgcctatccctaccactgaggaactgaaggccgtgcgagttagcaccgaggctaatagaagcatcgtacctatatctcgcgggcaacgacagaagtccagcgatgagagctgtctcgtggtgctatttgctggagactacaccatcgcgaacgcaaggaagttgattgacgaaatggtgggcaaagggttctttctcgtgcagaccaaggaagtgtctatgaaggctgaggacgcccaacgggtctttcgagaaaaagcaccagatttcctgccactcttgaacaaagggcccgttatcgccctcgaatttaatggtgacggggctgtcgaggtgtgtcaactgattgtcaacgaaatcttcaacggcacaaagatgttcgtgagtgagtctaaagaaactgcatcaggagacgttgactctttctataatttcgctgatatacaaatgggaatctag

SEQ ID NO: 12708 - DNA, 2472 bp, Artificial Sequence
  Description of Artificial Sequence: Synthetic coding sequence
atgaaacgacaccgtcccgtgtcctcttcagattcctccgatgagtccccctctacatcttttacatctggtagcatgtacaggattaagtctaagatacctaacgagcacaaaaagcccgctgaagtctttcgcaaagacctgatttcagccatgaagttgccagactctcaccacataaatccggactcttattacctcttcgccgatacgtggaaagaagaatgggagaaaggggtacaggttccagcaagccctgatactgtcccccaaccctctctgagaattatcgcagagaaggtcaaggatgtcctgttcattagacctcgcaagtacattcactgctcaagccctgataccaccgaaccaggctatattaacattatggagctcgccgcttccgtatgccggtatgatctggacgatatggatatcttctggcttcaggaattgaacgaggaccttgcagaaatggggtgcggcccagtggatgagaacctgatggaaaagactgtcgaggtgttggaaagacactgtcatgagaacatgaatcacgccatcgagactgaagagggcctgggcatcgagtatgacgaggacgtgatatgcgacgtttgtaggtctcctgactccgaagagggaaatgacatggtgttctgtgataagtgcaatgtctgcgtgcaccaggcttgttacgggattcttaaggttccagaagggagctggctttgcaggagttgcgtcctcggaatctaccctcagtgcgtgctgtgcccaaaaaaaggcggggccttaaagacgactaagactggtactaagtgggcccatgtgtcttgcgccttgtggatccccgaggtgagcatagcgtgccctgagcgcatggagccaattaccaaaataagtcacattcctccaagcaggtgggcgctcgtctgcaatctctgtaagctaaagacaggagcttgtatccagtgtagcatcaagagctgtatcaccgctttccatgttacttgcgcgttcgaacatggattggagatgaagacgattctcgacgagggtgacgaagtaaagttcaaaagttactgtctcaagcattctcaaaatcgacagaagctcggagaagccgagtacccacaccatcgagctaaggagcaatcccaggcaaagagcgaaaagacgagcctccgcgcccaaaagttacgtgaactcgaggaagagttttactcacttgtgcgggtcgaagatgtcgctgctgaattaggcatgcccacactcgccgtcgactttatttataattactggaaactgaaacggaaatccaacttcaataaacctctgtttccgccgaaagaagacgaagagaacggactggtccagcctaaggaagagtctatacatactaggatgagaatgttcatgcatcttagacaggacctggagcgtgttaggaacttgtgctatatgatatcacgccgcgagaagctcaaactgagccacaataaaatccaggagcagattttcggccttcaggtccagctactgaaccaggaaattgatgcggggcttcccttgaccaacgccctcgaaaacagcttattttatccacctccacgcattactctgaaactaaagatgccgaagagcacgcctgaagaccataggaattcttctaccgagacagatcaacaaccacatagcccggatagctcaagctcagtccatagcataagaaatatgcaggtgccccaggagtctctcgagatgcgaaccaagtcttaccccagatacccgctcgaatctaagaacaatagacttttagctagtctgtcgcattccagatctgaggcaaaagagtctagcccagcgtggcggacaccgtcttccgagtgctaccacggccagtctctgggaaaaccactggtcctgcaggccgcattgcacgggcaatctagcattgggaatgggaaatctcagcccaacagcaagtttgccaagagcaatgggcttgaaggaagctggtccggaaatgtgacccagaaagactctagttcagagatgttttgtgatcaagaacctgttttctccccgcacttggtttcacagggctcgtttcgaaaaagcactgtggaacacttctcccgaagcttcaaggaaactacaaatagatgggtcaaaaatactgaggacctgcaatgctacgttaaacctaccaaaaatatgagtcccaaggaacagttttggggtaggcaagtgctgaggaggtctgctgggagggcgccataccaggagaacgatgggtattgcccagatctggaactctcagacagcgaggccgaaagcgacgggaataaagaaaaggtgagggtgcgtaaagattcctctgaccgggagaacccaccacacgactctcggcgcgactgtcacgggaaaagtaagacacacccactctctcacagcagcatgcagagatag

SEQ ID NO: 12709 - DNA, 561 bp, Artificial Sequence
  Description of Artificial Sequence: Synthetic coding sequence
atgaaaagacaccggcccgtgagttcgtctgattctagcgatgagagccccagcacgtcttttaccagcggcagtatgtacaggattaagagtaagataccaaatgaacataagaagccagcggaagttttcaggaaagatctcatttctgccatgaaactccctgattcccaccacatcaatcctgattcttattatctgttcgccgacacatggaaagaggaatgggagaagggagtgcaggtgccagccagcccagacactgtaccgcaacccagcttacgtataattgccgaaaaagtgaaggacgtgctgtttatacggccacgcaagtacattcactgttcaagtcccgacacaaccgagccaggatacatcaacattatggaactggcagccagcgtatgccggtatgatttggatgacatggatattttctggctgcaagagctgaacgaagatctggctgaaatgggttgcggccccgttgatgagaatcttatggaaaagaccgtcgaagtgctggagcggcactgccacgagaatatgaatcacgcatag

SEQ ID NO: 12710 - DNA, 345 bp, Artificial Sequence
  Description of Artificial Sequence: Synthetic coding sequence
atgaagcggcaccggcctgtgtctagctcagattccagcgacgaatccccttctaccagtttcacgagcggatctatgtatcggattaaatccaaaattcctaatgagcacaaaaaacctgctgaagtttttcgcaaagacctgatcagtgccatgaagctcccagatagtcaccacataaacccagattcctattacttattcgctgatacctggaaagaggaatgggaaaagggcgtgcaggtcccagcatccccggacaccgtcccccagccgagtctcaggataattgcagaaaaagtcaaagatgttctctttatccggccacgtaagtacatccactag

SEQ ID NO: 12711 - DNA, 1632 bp, Artificial Sequence
  Description of Artificial Sequence: Synthetic coding sequence
atgactaagcacccccctaataggcgaggcattagttttgaagtaggagcccagctcgaagcccgagacagactgaagaactggtacccagctcacatcgaagatattgattatgaagaaggtaaggttcttatccactttaaaaggtggaaccaccggtacgatgagtggttctgctgggattccccctacctgcggccacttgaaaaaatccaactcagaaaggagggcctgcacgaagaagatggctcctctgagtttcaaattaatgagcaggtacttgcctgttggtccgactgtcggttctatccagctaaggttacagccgtgaacaaagatggaacatatactgtgaaattctacgatggagtggtccaaacggtcaagcatattcatgttaaggccttcagcaaggaccagaacattgtcgggaatgcccggcccaaggagactgaccacaagtctctgagcagcagtcccgacaagagagagaaattcaaggagcagcgcaaggccacagtgaatgtgaagaaagataaggaagacaagccactcaagaccgagaagcggcctaagcagccagataaggaaggcaagctcatttgctctgaaaaaggaaaggtgtccgaaaaaagcttacctaagaatgagaaggaagataaggagaacatttccgagaacgatagagagtatagtggagatgcacaggttgataaaaaacccgaaaatgatatcgtgaaatctccgcaggaaaacctgcgtgagcctaaaaggaagcgcggccgacccccatcgattgcccctactgccgtggatagtaattcacagacattgcagccgatcacgttggagctccgacggagaaaaatttcaaaaggatgcgaagtgcctctgaagcgcccacggctcgacaaaaatagcagccaggaaaaaagcaagaactacagtgagaacacggacaaagacctttcacgacgacgatcaagcagattgtcaacgaacggaactcacgaaattctggaccccgatctggtcgtgtcggatctagtggataccgatcctctgcaagatacgcttagttcaacaaaggaaagtgaggagggtcagctgaagtcagccctggaggccggacaagtttcttctgccctgacctgccacagcttcggggatggctccggtgctgcaggcttggagcttaattgccctagtatgggcgaaaatactatgaagacagaacccacatcccccctagtggagctgcaggagattagtacagtggaggtgaccaatacgttcaagaaaacagacgattttggaagcagtaacgcgcctgccgtagatctggaccacaagttcaggtgcaaggtggtcgactgcttgaaattcttcaggaaggccaaactgctgcattaccatatgaaatactttcacggaatggagaaaagcctcgagcctgaggaaagtccaggcaaacgacatgtgcagacacgcgggcccagcgcctccgacaaaccgagtcaggaaacactcacaagaaaaagagtgtctgcgtcaagcccaacaactaaagataaggagaagaataaggagaagaaatttaaggagtttgtccgggtgaaacctaagaagtag

SEQ ID NO: 12712 - DNA, 1650 bp, Artificial Sequence
  Description of Artificial Sequence: Synthetic coding sequence
atgaccaagcacccacccaacagacgaggtatatcctttgaagttggagcgcaactggaggccagagatagactgaagaattggtacccggctcatatcgaagatattgattacgaagagggaaaggtcctgattcactttaagagatggaaccatagatatgatgaatggttctgttgggacagcccttacctgaggccgctggaaaaaatccagctgaggaaggagggcctgcatgaggaggatggatcaagcgaatttcagattaacgagcaggtcctagcctgctggtccgactgccgattctaccccgcgaaggtgacggccgttaataaggatggcacctacaccgttaagttctatgacggtgtagtgcagacagtgaagcatatacatgtcaaggcgttctccaaggatcaaaacattgtgggcaatgcacggccgaaggagactgaccataagtctctgtcaagctcccccgacaagagggagaagttcaaggaacagcgcaaagccacagtgaacgtgaagaaggacaaagaagacaagccgttgaagacagagaaaagacccaagcagcccgacaaggaaggaaagctcatttgctctgagaaggggaaagtcagcgaaaagagtttgccaaagaatgagaaagaagataaagagaacatatctgaaaacgaccgagagtacagcggcgacgcccaggtagacaaaaaacccgaaaacgatatcgttaagagcccgcaagaaaacctgagggagcccaagcggaaaagagggagaccgccatctattgcccccactgctgtcgacagcaatagccagaccctgcagccaatcacactagagctcagacggaggaaaatcagtaaaggctgtgaagtgcccttaaagcgccctcgcttagacaagaacagttcccaggaaaaatccaagaattattcagagaacacagacaaggacctctcccgccggcggagcagtaggctatccaccaatgggacccacgagatccttgatcctgaccttgttgtttcagacttggtagatactgaccccctccaggataccttgagctcaactaaagagagcgaggaaggccagttaaaatccgcccttgaagccggccaggtctcgtctgccctgacttgtcactcatttggtgacggcagcggagccgcaggcctcgagctgaactgtccctcaatgggggaaaacacaatgaagacggagcctacctcacccctggtggagctacaagagatcagcaccgtggaagtgactaatacattcaagaagacagatgattttggttctagtaacgcaccagccgttgacctcgatcacaaattccggtgcaaagtggtggactgccttaagttctttaggaaggccaagttgttgcactaccatatgaagtattttcacggaatggaaaagagtttggaaccagaagaaagtccagggaaacgacatgtgcagaccagagggcccagtgcctccgacaagcctagccaggaaactctcacgaggaagcgcgtatcagcctctagcccaacgacaaaggataaagagaaaaacaaagaaaaaaagtttaaagagttcgtgcgcgtgaagcctaagaagaagaagaagaagaaaaaatag

SEQ ID NO: 12713 - DNA, 3039 bp, Artificial Sequence
  Description of Artificial Sequence: Synthetic coding sequence
atgacgaagcaccctcccaatagacgggggatttcattcgaggttggcgctcagctggaagctcgggatagacttaagaactggtaccccgcccacatcgaagacatcgattacgaagagggtaaagtactgatccatttcaagcgttggaaccaccgctatgatgagtggttttgttgggatagtccatatcttagacctttagaaaagatacagctgagaaaagaggggctccatgaggaagacggttctagcgaatttcagatcaacgaacaggtgctcgcctgctggagcgactgccggttctaccccgcaaaggtcaccgccgtgaacaaagatggcacctacacagtgaagttctatgatggggttgttcagacagtaaagcacatccacgtaaaggcatttagcaaagaccagaacatcgtgggcaatgcccgacccaaggagacggaccacaagagcctgtcaagctctcctgacaaacgcgagaaattcaaggagcagcggaaggccaccgtaaatgtcaagaaagataaagaagacaagcctctgaagacagagaaaaggccaaagcagccagataaggaaggtaaactgatctgctcggagaagggaaaggtgtccgagaagagccttccgaagaacgaaaaggaagacaaggagaatattagtgagaacgaccgagaatatagcggcgacgcccaggtcgacaaaaaacctgaaaatgacattgtcaagtcgccccaggaaaaccttcgggagcctaaacgcaaaaggggtagaccgccttccatcgctccgacagccgtcgatagcaatagccagacactccaacccattacactggaattacgcaggaggaaaatctccaaaggctgtgaagtgccccttaagcgcccccgcttggataagaactcaagtcaggaaaagtcaaagaactactccgaaaatacagacaaagatctctctaggcggaggagcagccggttaagcaccaacggcacccacgagatccttgaccccgacttggtggtatcagatctggtggacaccgacccattacaggacaccttgtcctcgactaaagagtccgaggagggccaactgaagtcagctctggaggcaggacaagtgtcctcagctctgacgtgccacagctttggagatggctcaggtgccgcggggctggagctcaactgtccttctatgggtgaaaatacaatgaaaactgagccaacatccccactagtagagctccaggagatatctaccgtagaggtcactaatacattcaagaaaacagatgatttcggcagcagcaatgctcccgccgtcgacttagaccataaattccggtgcaaggtggtcgattgcctcaagtttttccggaaagcgaagcttcttcactaccatatgaaatacttccatgggatggaaaaatcccttgagccagaagagagccctgggaagaggcacgtgcagacccggggaccttcagcttccgataaacccagtcaggagactctgacccgaaagcgggtgtctgcgagcagccccaccacaaaagataaggagaaaaacaaagaaaagaagtttaaggagttcgtgcgcgttaaacctaagaaaaagaagaaaaagaaaaagaagactaaacccgagtgtccctgttccgaggaaatctccgatacctctcaggagccctctcctccaaaggcctttgcggtcactcgctgtgggtcctcacacaagcctggagtgcatatgagtccgcagctgcacgggccagaatcaggacatcacaagggaaaggtcaaggctctggaagaagataatctcagcgaatcctcaagtgaaagtttcctctggtctgacgacgaatacggtcaggacgtcgatgtaaccaccaaccctgacgaggagctagatggcgatgacaggtacgatttcgaagtggtccgttgcatttgcgaagttcaggaagaaaatgacttcatgatacagtgtgaggagtgtcagtgttggcagcatggtgtctgtatgggactgctggaagagaacgtgccggagaagtacacatgctacgtgtgccaagacccacccggtcaacgcccagggttcaagtactggtacgataaagaatggctgtcacggggccatatgcatggtctagcttttcttgaagaaaattacagtcatcagaatgccaaaaagatcgtggccactcaccagctgctgggcgatgtccagcgggtgatagaggtcttacacggcctccaattgaagatgagcatactccagtcccgcgaacaccccgatttacctctatggtgccagccttggaaacagcactctggagaaggccgttcacattttagaaatatcccggtgaccgacacgaggtcaaaagaggaggccccttcatataggacgctcaacggggccgttgagaaacctcggcccttagcattgcccctaccaaggagcgttgaagagtcatatatcacatctgaacattgctaccaaaagccccgggcatattacccagcagttgagcagaagttggtggtagagaccagaggctctgcactggacgacgcggtaaaccccctccacgagaacggcgacgatagtctcagcccacggctgggctggccactggatcaagacaggtccaagggggacagtgacccaaaaccagggtctcccaaggtaaaggagtatgtctctaagaaagctctgcctgaagaagcacctgccagaaaactgctggaccgcggaggcgaaggtctgctgagtagtcagcaccagtggcagttcaacctgctgacacatgtcgagtcacttcaagacgaggttacacaccggatggacagtatagagaaggaactggacgttttggaatcttggttagactatactggagagctggaacctcccgagccactggcgcgacttccccagctgaaacactgcatcaagcaattgttgatggacctgggaaaggttcagcagattgccctatgttgctccacatag

SEQ ID NO: 12714 - DNA, 819 bp, Artificial Sequence
  Description of Artificial Sequence: Synthetic coding sequence
atgaccaagcacccccctaacagacgcgggatatctttcgaggttggggctcagcttgaggctagggatcgcttaaaaaactggtatccggctcacattgaggatatcgactatgaagagggcaaagtgctcatacactttaagagatggaatcatcgctacgacgagtggttttgctgggattcaccatacctaagaccccttgagaaaattcagttacggaaagagggtctgcacgaggaggacggaagttctgaattccagatcaatgagcaggtgctagcttgctggtctgattgtagattttatcctgccaaggtgaccgcagtgaacaaagatggaacctatacggtgaaattctacgacggggtggtccagacggtcaagcacatccatgtaaaggcgttctcgaaggaccaaaacatcgtgggcaatgcaagacctaaggaaactgaccacaaatcccttagctcgagtccagataagagagaaaaatttaaagagcagcgtaaagcaaccgtcaatgtcaaaaaggataaagaggacaaaccacttaagaccgagaagagacctaaacagcccgacaaagagggcaaactaatttgcagtgagaaaggtaaggtgagtgagaagtccctccccaagaatgagaaggaagacaaggaaaacattagtgaaaacgatagggagtactccggagatgctcagaagacccgccagaccccattccactctagctattgctgcggtttcaagctgtccaactttgccaccaataatataggaactgaaaaaaaagaaaatatcaagcgcatgtag

SEQ ID NO: 12715 - DNA, 2289 bp, Artificial Sequence
  Description of Artificial Sequence: Synthetic coding sequence
atggagggcccccggtctagcactcacgtgcctttggtcctgcccctactcgtgcttctgctgttggccccagcccggcaggccgccgcccaacgctgtccccaggcatgcatctgtgacaattctaggcggcacgtggcctgcaggtaccagaacttaaccgaggtcccagacgccatcccagagctgacacaacgattggatctacaaggaaacctgcttaaggtgattcctgcagccgcctttcaaggggtgccacaccttactcacctggatcttcgacactgtgaagtggagctggtcgccgagggggccttccgcggcctgggaaggttactccttctaaatctggcgtccaaccacttgagagaactgccccaagaagctcttgacgggctgggttcattaaggagactcgaactcgaagggaatgccctagaggagctgagaccggggacattcggcgcacttggggctctggcgactctgaatctggcacacaatgccctcgtatacttaccggctatggctttccagggactcctgagggtacgatggctccgactctcccacaatgccctgagcgtgctcgcacccgaagccttggctggactccccgctctgcgacgcctcagcttgcaccataacgaactgcaggccctgcctggacctgtgctgtcccaagcgcgtggcctggcgagactggaacttggacacaaccccctgacttatgccggtgaagaggatggcctcgctcttcccgggttaagggaactgttactcgacggcggagccctacaggctctgggcccgcgcgcttttgcacactgtccacgtctccatacactagatctccgagggaatcagcttgacaccctgccacctcttcaaggcccaggacaactacgcaggctgcgcctgcagggtaatcccctatggtgcgggtgccaggcacggcccctactcgagtggctggcccgggcgagggtgaggagcgacggcgcttgtcaaggtccaagaagactgagaggggaggccctagatgctttgcgtccttgggatctgcgctgccctggcgacgcggcccaggaggaagaagaactagaagagagggcggtcgcaggtcctcgggccccccctcgaggtccaccgagaggccctggagaagagcgggccgtggccccttgtcctagagcctgcgtatgtgttcccgagtctcggcactcgtcatgcgagggttgtgggcttcaagcagtgcccagggggttcccgtccgacacacagttactggatctccgtcggaatcacttcccttccgttccaagggccgctttccccggactcgggcaccttgtgtcactgcacctccagcattgtgggatcgcagagctggaggccggcgccctggcaggcctgggcaggcttatctatctatacctgtccgataaccaactggccggactttcggcggccgcactcgagggcgccccccgcttggggtacctgtatctggagcggaacagatttttacaggttcctggagctgcgctgcgcgccttgccctccctgttcagtcttcaccttcaggacaatgctgtggaccggctcgctccaggagatttgggcagaacccgcgccctccgttgggtgtatctatccggaaaccggatcactgaggtgtcactgggggcacttggcccggcccgagaactggaaaaactgcatctggatcgaaaccagttaagagaggtgccaactggcgcacttgagggcttacctgctctgctcgagctgcagctgagcgggaatcccctgagagcactgcgagatggggcgtttcagccggtgggccggtctttgcagcatctcttcctgaactccagcggcttggaacagatctgcccaggggctttctccggtctcggacctggtctgcaaagcctccatctgcagaaaaatcaactgcgagcacttcccgcgctgcctagcctcagccagctcgaattgatcgatctgtcctcaaatccgtttcattgtgactgccagcttttaccgctccaccgctggctgaccggactaaacttaagagtcggcgctacttgcgccactccaccaaatgctagggggcaacgcgtaaaagccgccgccgctgttttcgaggattgccctgggtgggcggcaaggaaggctaagcgcacacccgccagcaggccctccgcaagaagaacacccattaagggaagacaatgtggagccgacaaagtgggcaaggagaaggggcgcctgtag

SEQ ID NO: 12716 - DNA, 1146 bp, Artificial Sequence
  Description of Artificial Sequence: Synthetic coding sequence
atgaagactgtcaaggagaagaaagagtgtcagcgtttgagaaagagcgctaagacccgcagggtgactcaacgaaagccttcaagtggcccagtgtgctggctctgtctaagagagccaggcgaccccgaaaagctgggcgaatttctgcagaaggacaacatttccgtccattacttttgtctcatccttagttctaaactcccacagcgggggcagtcaaatagagggtttcacggcttcttgcccgaagatatcaagaaggaggccgccagggccagccgcaaaatttgtttcgtgtgtaaaaagaaaggtgcggctattaattgtcagaaggaccaatgcttgcgtaattttcatctcccttgcggtcaagaacgcggctgcctgagccagttcttcggcgagtacaagtcattttgtgacaagcacagaccaacacagaacatccaacatgggcatgtaggcgaggagtcctgtatcctgtgttgtgaggatttgtctcagcagtccgtagaaaacatccagtccccttgctgtagccaggccatctaccaccgcaaatgcatccagaaatacgctcacacatcagcgaaacatttttttaagtgtccgcagtgtaacaaccggaaggaattcccccaggagatgctcagaatgggcattcatatccctgatcgagacgccgcctgggaactggaacccggtgccttttctgacctgtaccaacgctatcaacactgtgatgccccaatctgcctctacgaacagggcagagactcattcgaggacgagggacgatggtgccttatactgtgtgctacttgtggtagtcatggcacacaccgcgattgtagcagtttacgatccaactccaaaaaatgggaatgcgaggagtgttcccctgctgccgccaccgactacataccggagaacagtggcgacatcccatgctgtagctcaacttttcatcccgaagaacacttttgccgggacaacacccttgaggagaatccaggattgagctggaccgattggccagagccctcgcttctcgagaaacctgagagctcccgaggaaggagaagctattcatggagatctaagggtgtacgaattactaactcatgcaagaaatctaagtag

SEQ ID NO: 12717 - DNA, 1029 bp, Artificial Sequence
  Description of Artificial Sequence: Synthetic coding sequence
atgaagacagtgaaagagaaaaaggaatgtcagcgactgcgtaagagtgccaagactcgcagagtgacacagcgaaagcccagttcagggcccgtctgttggctctgcctcagagagccaggagatccagaaaaactcggagagtttctccagaaagataacatctccgttcattatttttgtcttattctatcatcaaagctgcctcagaggggccagtctaataggggcttccacggcttcctgccagaggatattaaaaaagaagcagcacgggccagccggaaaatatgcttcgtgtgcaagaaaaaaggcgcagccataaactgccagaaagatcaatgcctgcggaactttcacttgccctgtggtcaggagaggggatgtctgtcacagttctttggagaatataaatcgttctgcgataagcacagacctacgcagaatatacagcacggccacgtgggtgaagagtcatgtatcctgtgctgcgaagacctgagtcagcagtccgttgaaaatatccagagcccatgttgctcacaagctatctatcatagaaagtgtattcagaagtacgcccataccagtgctaagcattttttcaagtgtccccagtgtaacaaccgcaaagagtttccccaggagatgttgcggatgggcattcacattcctgataggaggtggtgcctgattttgtgcgccacatgtggcagtcacggcacacaccgtgattgtagctccctacgatccaatagcaagaaatgggagtgcgaagaatgttctcccgcagcagccacagattacatccccgaaaatagcggcgacatcccatgctgttcttccacttttcaccccgaggagcacttctgcagggataatacactggaagaaaatcccggcctctcttggaccgactggccggaacctagcctgctggagaaacccgagagctcgcggggccggcgctcctactcatggcggtcgaaaggggtccgaataaccaactcttgcaagaagtcaaagtag

SEQ ID NO: 12718 - DNA, 873 bp, Artificial Sequence
  Description of Artificial Sequence: Synthetic coding sequence
tttaatcgaaagatttgttttgtctgtaagaagaaaggagcagcaatcaattgccagaaagatcagtgccttcgaaacttccacctgccttgtggacaggagaggggttgtttatcccagttctttggcgagtataaaagcttctgcgataagcaccggcctactcagaacatccagcacgggcacgtgggggaagaatcatgtatcctgtgctgcgaagatctgagccaacagtctgttgaaaatatacagtctccatgttgcagccaagccatctatcaccgaaaatgtatccagaagtacgcacacacctctgcgaaacacttctttaagtgtcctcagtgcaataatcgtaaagagttcccccaggagatgcttcggatgggaatacacattcccgattcccgagatgccgcctgggagctcgagccaggtgccttctccgacctctatcagaggtaccaacattgtgacgctcccatatgtctatatgagcaaggtcgggactccttcgaagatgagggtcgatggtgcctgatattatgtgcaacatgcggaagtcacggcacccatagggattgttcctccctgcgcagcaattctaagaagtgggagtgtgaggagtgttcccccgctgccgcaaccgactacataccggaaaatagcggcgatatcccctgctgtagctcgacttttcacccagaagagcacttctgccgcgacaacaccttggaggagaaccctggtttatcctggacggattggccagaacccagcctgctagaaaaacccgaatcttccaggggtcgacgctcttatagttggagaagcaagggagtaaggataacaaattcctgcaaaaagtcaaaatag

SEQ ID NO: 12719 - DNA, 642 bp, Artificial Sequence
  Description of Artificial Sequence: Synthetic coding sequence
atgctgcgcgagcctggtgatcctgagaagctgggagagtttttacagaaagacaacatcagtgtgcattatttctgtctaattctgtcttcgaaacttccacaaagaggccaatcaaacaggggatctatggatttttgtcttaaaactagcaagcggcggcagcccggattattgggaagatccgctctgtgtgcaaggaaaagagaactgctttccaccgctcgcaggattagcgcgtctgagacgtcaatttgtctggtagcaaagaaaggcgtggcatttcataatttcctggagagcaccaatcatttcgtgacaaacattgctcagcataggacttctaacatgggcatgtggggacgcaaggcggcctcctacgtcgttaagacgtacccaaatcgtgttctaagaacctcccgggcacgagtcgtggtgaagcccagcactaccgctagtgcctacagaaatatgcctacacaccagcagtccattagctctaacgtgcacagcgtcacgatcgagagagtctcttcccgtaatgcggaaaatgggaactcctacagcaggcaagaagtcgtgccccactctgtgtgttacatgaggatcccacgaaatccccaggggttgctgctctcatag

SEQ ID NO: 12720 - DNA, 72 bp, Artificial Sequence
  Description of Artificial Sequence: Synthetic coding sequence
atgaagacggttaaagaaaagaaggagtgtcagcgcctaagaaaatccgctaagacgaggagggtgacgtag

SEQ ID NO: 12721 - DNA, 1146 bp, Artificial Sequence
  Description of Artificial Sequence: Synthetic coding sequence
atgaagaccgtgaaggagaaaaaggagtgtcagcggttgagaaaatccgccaagacccgccgggtcacacagaggaaaccttcctcgggccctgtgtgttggctgtgcctacgggagcctggcgaccccgagaaactgggggagtttctacagaaagataacatctctgtgcactatttctgtctcatcctgtcatcaaaactaccccagcggggccagagcaatcgtgggttccacggattcctccctgaggacataaagaaagaggccgcccgggcttcccgtaaaatctgctttgtctgtaagaaaaagggcgcagctatcaactgtcagaaagatcagtgcctgcggaatttccacctgccttgcggacaagagagaggctgtctgagtcaattctttggagagtacaaatccttttgcgacaagcaccgaccaacccagaacatccagcatggtcacgtgggcgaggagtcgtgcattttatgctgtgaagacctgagccagcagtccgttgaaaatatacaatctccatgctgctctcaagcaatttaccataggaagtgtatccagaagtacgcgcacactagcgccaaacattttttcaaatgtccacaatgtaacaataggaaggagttcccacaagaaatgctgagaatgggcatccatatcccggatcgggacgcagcctgggaattggagccaggggcatttagcgatttgtaccagagatatcaacactgcgatgcccccatctgcctttacgagcaggggagggatagctttgaggacgagggccgttggtgtctgatcctttgtgcaacttgcgggtcacacggcacccaccgggattgtagcagtctgcgaagtaactcgaaaaaatgggaatgtgaagagtgttcgcccgcagccgcaacagactacattcccgagaactcgggggacattccatgctgctcaagtactttccatcctgaagagcatttttgccgagataacactctggaggaaaaccccggcctctcttggacggattggccggagccttccctgctggagaagccagagtcctctcgagggcggaggagctactcttggcggtctaaaggagtcagaattacaaacagctgcaagaagtccaagtag

SEQ ID NO: 12722 - DNA, 1557 bp, Artificial Sequence
  Description of Artificial Sequence: Synthetic coding sequence
atggatcagactcccccagcacgccccgagtacctcgtcagtggaattcgcacccctcctgtgcggagaaattctaagctggctacactggggagaatctttaagccttggaagtggcgcaagaagaagaatgagaagctgaaacagacgacttctgctctggaaaagaagatggctggccgccaaggccgagaggagttgatcaaaaagggactcctcgaaatgatggagcaagatgcggagtccaagacctgcaaccccgacggaggtcccaggtcagtccaatccgaacctcccaccccaaagagtgagactctgacctccgaggacgctcagccgggttctccactggccaccggcacagatcaggtgtcgcttgacaaaccattgtctagcgcggcacacctggatgatgccgcaaaaatgcccagcgccagttccggggaggaagccgacgcaggcagtctgctgcctaccaccaacgagctgtctcaggcgctggcaggtgctgattccctcgactcccccccgcggcccctggaacgttcagtggggcagctgccctcccctcccctcttaccaactccaccacccaaggccagcagcaaaacaaccaaaaatgtgacaggacaggccaccctcttccaagcttcctctatgaagtctgcagatccaagtctcaggggacagctctctacgcccaccggcagtcctcacctaaccaccgtccatcgccctctccctcccagccgggtcatcgaggaattacaccgggcgctggccacgaaacaccgtcaggatagtttccaaggtagagagtctaaaggatccccaaaaaagcgccttgatgtgcgcctgtcccggacgtccagtgtggaacgcggaaaagaacgcgaggaagcctggagcttcgacggcgccttagaaaataagcgcacggccgccaaagagagcgaggagaacaaagaaaatttaataatcaactcagaacttaaagatgatctgcttttataccaggacgaggaagccttaaatgatagtatcatctctggcaccctgccacgcaaatgtaagaaggaattacttgcagtgaagctcaggaataggccaagcaagcaggagcttgaggaccgtaacatcttcccgagacgaaccgatgaggagagacaggaaatcagacagcagatcgaaatgaaattgtctaagcgcctcagccagagacccgccgtggaagagttggaaaggagaaatattcttaagcagaggaatgaccagactgagcaagaagaacgacgagagataaaacagcggctcacccgaaagttgaaccagaggcccacagtggatgaattgagagatcggaagatccttattaggttttcagattacgtcgaagtggctaaggcgcaggactacgacaggcgagccgataaaccctggactagacttagtgccgcagacaaagctgcgatccgtaaggagctgaatgagtacaagtcaaacgaaatggaggtgcacgcttcctccaagcacctaacccgatttcatcgaccatag

SEQ ID NO: 12723 - DNA, 1347 bp, Artificial Sequence
  Description of Artificial Sequence: Synthetic coding sequence
atggatcaaaccccaccagccaggcccgagtatctggtcagcggcattcgcacacccccagttcggcggaactccaagctggcaacccttgggcggatttttaaaccatggaaatggaggaagaaaaagaatgagaagctcaaacagaccactagcgcgttagagaaaaaaatggctggccgccaagggcgcgaagaactcatcaagaaggggctattagaaatgatggaacaggacgccgagtccaaaacctgtaatccagacggagggcccagaagcgtgcagtccgagcctccaacgcctaaatcagaaacactgacatctgaggatgcacagcccggtagtccccttgcgaccggtacggaccaggtgtcacttgataagccactttcaagcgctgcacacctggacgatgccggccaagccaccctattccaggcgtccagtatgaaaagtgcagatccatcgttacgggggcagctttcaacccctaccgggtctccacacttgacaaccgtgcatcggcctctccccccatctcgtgtgatcgaagagctgcatcgggcccttgccactaaacaccgtcaggactccttccagggaagggagtctaagggaagtccaaagaaaaggctggatgtcagactgtcaagaacaagctccgtcgaaagaggaaaggagcgggaagaggcttggtctttcgacggcgcacttgagaacaagcgtaccgcggctaaggagtctgaagagaataaggaaaatctgattatcaacagcgagcttaaggacgacctgctcctgtaccaggatgaggaagctttgaacgactccatcatcagtgggaccctgccaaggaaatgtaaaaaggaactgctcgcggttaaactcaggaaccgtcccagtaagcaggagctcgaggataggaatatcttccccaggcgtactgacgaagaaagacaggagattagacagcaaattgagatgaaactgtctaaacggctatctcagagacctgccgtagaagagctggagaggaggaatattctcaagcagcgcaatgatcagaccgaacaagaggagcggagggaaataaagcagcggctaacaaggaagttgaatcagcgtccgacagtcgatgaactaagagacaggaagatcctgattcgtttctctgactacgtcgaggttgccaaagctcaggactacgacaggagggctgacaagccctggacccggctgtctgccgctgacaaagcagcgatacgcaaggagctgaatgagtacaagagcaacgaaatggaggtccacgcctcgtcaaagcacttgaccagatttcatcgcccttag

SEQ ID NO: 12724 - DNA, 1680 bp, Artificial Sequence
  Description of Artificial Sequence: Synthetic coding sequence
atggccgctagcgaggatggttcgggctgtctggtgtctcgcggccggtcccaatcagaccccagtgtgttgaccgactcctcagctaccagctccgcggacgctggcgagaaccccgacgagatggatcaaacccctccagccaggcccgaatatctagtgagcggcatcagaacgcctcctgtccgccgtaacagcaaacttgccactctgggccggatcttcaagccatggaagtggagaaaaaagaaaaacgagaagctcaaacagacaacatctgcactagagaagaagatggctggcagacaggggagagaagaactgattaagaaaggactactggaaatgatggaacaagatgccgagtcaaagacctgtaatcccgatggagggccaagaagtgtacagtctgagcccccgactcctaaatcagagaccttaacttcagaggatgctcagccagggtcacccctggctactggcactgaccaggtaagtttggacaagccactgtcttcagccgcccaccttgatgacgccgccaagatgccgtctgccagtagtggagaggaggctgacgccggctcattgctgcctacgacaaacgaactttcccaggctcttgctggggctgattcattggattcccccccaagacccctggaacggtccgtcggccagctacctagcccacctctactcccaacaccgccccctaaggctagttccaagacaactaagaatgtgacaggacaggcaactctctttcaggcaagtagcatgaaatcagcagacccctccctgagggggcaactgagcacacccacaggcagtcctcacctgaccacagtgcacagacctttacctccttccagagtcattgaagagctgcacagagccctggctacgaaacaccggcaagactcttttcaagggagggagtccaagggctcacccaagaagcggttagacgtgcgcttgtctcgtacctcaagtgttgagagggggaaggaaagagaagaggcttggtcttttgacggggctcttgaaaacaagcgcaccgcggccaaggaatccgaggagaacaaagagaacttaataattaattccgaactaaaagacgaccttttactctaccaggacgaagaggccctgaatgattccataataagcggaactttaccgcggaaatgtaagaaagaacttctcgccgttaaactgagaaacagaccttccaaacaagagctggaagaccgcaatatctttccccggaggaccgacgaagagcgccaggagatcaggcagcaaatcgagatgaaactgtctaaaaggctgagtcagcgcccagccgtggaagagctggagcgtcgcaatatcctaaagcagagaaacgaccagacagaacaagaggaacgtagagagataaagcagagactgactcgcaaactgaaccaaagacccactgtggacgagctgcgggatcgcaaaatcctcatccgcttctccgactacgtggaggtcgctaaagcgcaggattacgacaggagggcagacaagccatggacaagattatcagctgccgacaaggctgctatcaggaaggaactgaatgagtacaaatcgaatgagatggaagttcacgcgtccagcaagcatcttacgcgctttcacagaccatag

SEQ ID NO: 12725 - DNA, 1557 bp, Artificial Sequence
  Description of Artificial Sequence: Synthetic coding sequence
atggaccagacacctccagccagaccggagtacttggtgtcgggaatcagaacccctcctgttaggagaaacagcaagcttgcaaccctggggcggatattcaagccctggaaatggcgtaagaaaaagaacgaaaaactgaagcagacaacctcggctcttgagaagaaaatggcgggtcggcagggccgggaggaactaataaaaaagggactgctggagatgatggaacaggatgctgaaagcaaaacttgtaatcctgatggtggtccccgctcagtccaatcagagcccccgacgccaaaatcggaaaccctgaccagcgaagatgcccaacccgggagtcctcttgcaacggggactgatcaggtgagcctcgacaagcctctcagctccgccgctcacctggatgacgcagccaagatgccaagtgcatctagcggggaagaggcggacgccgggagtttgttgccaaccacaaatgagcttagccaggcactggccggcgccgactctctggatagtccaccaaggcctctggagcggagcgtggggcagctcccatccccccctctcctgcccactccacccccaaaagctagcagcaagactaccaagaatgtgacgggacaggccactctcttccaggccagctccatgaagagtgccgatccatctctgcgtggtcagctgagcactcctacgggttcccctcacctgaccaccgtgcatcggcccctgcctccctcgagggttattgaggaactacaccgggcactggcaactaaacatcgacaggactcctttcagggtcgcgagagcaagggctcgcccaaaaagcgcctagatgtaaggctgtctaggacgagctcggtggagcggggcaaggagagagaggaggcatggtcattcgatggggcactggaaaataagcgtaccgccgcaaaggagagcgaggagaacaaggaaaacttaattataaacagcgagctgaaagatgatctgctgctctatcaagatgaggaagcccttaacgactccataatttccggaacattgccaagaaagtgtaagaaggaactgctagcagtgaagctgagaaacaggccgtcaaaacaggagctcgaagatcgaaacatcttccctaggcgcacagatgaggaaagacaggagatcagacagcaaatcgagatgaagctgtctaaaaggttgtctcaacgacctgccgtggaggagctggagcggcggaatatcttgaaacagcgaaatgatcagaccgagcaagaagaaaggcgtgagatcaaacaaagactaactaggaaattgaatcaacgccctacggtagatgaattaagagacagaaagatcctgatcaggttttcagactacgtggaggtggctaaggcccaggactacgaccgtagagcagacaaaccctggaccaggctgtcggctgctgacaaagcagctatacggaaagagctaaatgagtataaatcgaacgagatggaagtccatgccagcagcaagcacctgactaggttccatcgtccctag

SEQ ID NO: 12726 - DNA, 1347 bp, Artificial Sequence
  Description of Artificial Sequence: Synthetic coding sequence
atggaccagacaccacccgcccgacctgaatatctcgtgtctgggattcgaacaccaccggtgcgccggaatagcaaacttgcaacactgggccgaattttcaagccctggaaatggcgaaaaaaaaaaaacgagaaactgaagcagactacaagcgccctggaaaagaaaatggcgggaaggcagggtcgcgaggagttgattaagaaaggtcttctggaaatgatggaacaggatgcggaatccaaaacctgcaacccggatgggggtcctcgcagcgtacagtctgagcctccaactcctaagagcgaaacccttaccagcgaagacgcgcaacctggatcccccctagccaccggcacagaccaggtgtctctggataaacccttatcctccgctgcgcatctggatgacgcaggccaggccactctgttccaggcctcctctatgaagtccgcagacccgagtctgcggggccagctcagcacacctaccggcagcccccacctgaccactgtccaccgcccccttccaccttctagagtgattgaggagctgcacagggccctggcaacaaagcaccgacaggatagcttccaggggagggagtcgaaagggagtccgaagaaaagactcgacgtaagactgagcagaaccagctcagttgaacgcggtaaagagcgagaagaagcgtggagcttcgatggcgctctggagaacaaacggactgccgctaaggaatccgaagaaaataaagagaatttaataatcaattctgagctcaaggacgatctgcttctgtaccaggacgaagaagcattaaatgactcaatcatcagtgggactttgcctcgtaagtgcaaaaaagagctgctggctgttaaactgcgtaatcgcccctcaaaacaggagttggaggatagaaatatcttcccccgtaggacagatgaggagaggcaagagatccgccagcaaattgaaatgaagctgtcaaagagactgtctcagcgccctgccgtggaagagctcgagcgccgcaacattttaaaacagagaaacgaccagaccgagcaggaggagcgccgggagattaagcaacggctgacccgcaagctcaatcagcgccccaccgttgacgaactgcgggataggaagattctcataaggttctccgactacgtggaagtcgcaaaagcgcaggattacgatagaagagcggacaagccttggacaaggctttccgctgcggataaagcagctataagaaaagagctgaatgagtataaatccaacgaaatggaggtacatgctagttccaaacatctgacacggtttcatcgcccttag

SEQ ID NO: 12727 - DNA, 126 bp, Artificial Sequence
  Description of Artificial Sequence: Synthetic coding sequence
atggctgcctccgaagatgggagcggatgccttgtgtctcgcggaagatcacagagtgatccatcggtgttgaccgactcttcagccacgtccagcgccgatgctggagaaaatccagatgagtag

SEQ ID NO: 12728 - DNA, 1557 bp, Artificial Sequence
  Description of Artificial Sequence: Synthetic coding sequence
atggatcagacaccgccggccaggcctgagtacctggtgtcaggcattaggacccccccggtgcgccgaaactcaaagcttgccacgctgggcaggatttttaaaccttggaagtggaggaaaaaaaagaatgaaaagctgaagcagaccacatctgctcttgagaaaaagatggccgggagacaaggccgggaagagctcatcaaaaaaggcctcttagaaatgatggaacaggatgccgaaagcaagacgtgcaatccggacgggggccctaggtctgtccagtctgaaccccctacacccaaaagcgaaacactaacttctgaggatgcccagccaggctcgcctctggctaccggaaccgatcaggtgtccctggataaaccgctcagttctgcggcccacctggacgatgcggccaagatgccctcagcctcctctggcgaagaagccgacgcgggttccctccttcctaccactaatgagctctcacaggcacttgcgggcgctgactccctggatagtcccccaagaccacttgagcggtctgtagggcaactcccctcccctcccctccttcctacaccccctcctaaggcgagtagtaaaacaaccaaaaacgtcacaggacaggcaacactgttccaggcttcttctatgaagtccgcagatccatccctgaggggccagctgtccacgccaactggtagcccccatctgacaactgtccaccgaccccttcctcctagtcgcgttatcgaagagctacatagggctttggctacaaagcacagacaggactctttccaaggtagagagagcaagggctcccctaagaagcggctggacgtccgactgagtaggacctcctcagttgagagaggtaaggagcgagaagaagcttggtctttcgatggagccctcgagaataagagaacggccgctaaggagtctgaagagaataaagaaaacctgatcataaattctgaactgaaagacgatctgctgctgtaccaagatgaggaggccttgaacgatagtatcatttccggcaccctgcccaggaaatgtaaaaaggaacttctggccgtgaaactgagaaaccggccctctaagcaggagctggaggaccgcaacatattcccaagaaggacagatgaagagcgacaagagatccggcaacagatcgaaatgaaattgtccaagaggctctcacagcgcccagccgtggaagagctggaaaggcgcaacatcctaaagcaaaggaatgaccagaccgagcaggaggagagacgcgaaattaagcagcgtcttactcgcaagcttaaccagcggcctactgtggatgaattacgcgatcgaaaaatcctgattcggttctcagactacgtggaggtggctaaggcgcaggattacgatcggagagccgataagccatggacccggctatctgcggctgacaaggccgccatccgtaaagaacttaacgagtacaagtccaacgaaatggaggtacacgcatccagcaagcacctcacgcgattccacaggccttag

SEQ ID NO: 12729 - DNA, 2430 bp, Artificial Sequence
  Description of Artificial Sequence: Synthetic coding sequence
atgtatgaggcgcttccgggaccggcccccgagaatgaagacggactggtgaaggtgaaagaggaagatccgacttgggaacaagtctgtaactcccaggagggctcctcccacacccaggaaatctgccgcctcaggttccgccacttctgctaccaagaggcccatgggccccaggaagctcttgcccaactacgagagctgtgtcaccagtggctgaggcccgaaatgcatactaaggaacagattatggaactgcttgtcctggaacagttcttgacaatcctgcctaaagagctccagccatgtgttaagacatatccactagagagcggagaagaagctgtgaccgtgcttgaaaatcttgagacaggctcaggagacactggtcagcaggcctcggtgtacatccagggccaggacatgcatccaatggtggccgagtaccaaggcgtgagcctagagtgccaatccctccaactcctgcctggtatcacgaccctgaagtgcgaacctcctcagcgcccacagggaaaccctcaggaggtgtcaggccctgtgcctcacggcagtgcacacttacaggagaagaacccccgcgacaaggctgtggtcccagtgttcaaccctgtgagatctcagacccttgttaagactgaggaagagacagcccaggccgtggctgccgagaagtggtctcacttatccctcactagaaggaacctctgcggcaactccgcacaggaaacagtgatgtctctatcccccatgacggaagaaattgttacaaaagacaggttgtttaaggccaaacaagagaccagtgaggaaatggagcaatcaggcgaggccagtggtaagcccaaccgtgagtgcgcgcctcagattccgtgctccactcccatcgccacagagaggaccgttgcacacctcaataccctgaaggacaggcacccaggcgacttatgggcacggatgcacatttctagtctggaatacgccgctggagatattacacggaaggggaggaagaaggacaaggcacgagtgtcggagttgctccagggcctgagcttctccggggattccgacgtagaaaaggataatgagcctgagattcagccagctcagaagaaactgaaagtttcctgtttccccgaaaagagttggacaaaacgggatatcaagcccaatttcccgagctggtccgcattagatagcggattgctcaaccttaagagtgagaagcttaatcccgtggaattgtttgagctattcttcgacgatgagacctttaatttgatcgtcaacgagaccaacaactacgctagccaaaagaatgtttcactggaggtaacagttcaggaaatgagatgcgtgttcggcgtgctgctgctctctgggttcatgaggcatcccagaagggagatgtactgggaagtatccgacaccgatcaaaacctcgtgagggacgcgattaggagagaccgctttgaactgattttctctaatctacacttcgctgataatggccatcttgaccagaaagataaattcacaaaactccgccctctgatcaagcagatgaacaagaactttctgctgtacgcgcccttggaggaatactactgcttcgacaagtcgatgtgtgagtgctttgatagtgatcagtttctgaatggcaagcccattcggattgggtacaaaatctggtgcggcacaacaacacaaggatacctggtgtggtttgagccataccaggaggagtccaccatgaaggttgacgaagatccagatcttggcttaggcggcaatctggtgatgaattttgctgacgttctgctcgaacgaggacagtatccgtaccatctttgcttcgatagcttctttacaagcgtgaaattgttgtccgccctgaaaaagaagggcgtgcgagccaccggtacaattagggagaatcgcacagaaaagtgtcctctcatgaacgtggaacatatgaagaaaatgaagagaggttatttcgatttcagaatcgaggagaacaacgagattatactctgtcgctggtacggggacggcattatatccttgtgcagcaatgctgtaggaatagaaccagttaatgaggtgagctgttgtgatgccgataacgaagagatcccccagatcagccagccatccattgttaaggtgtacgatgagtgcaaggagggggtggctaaaatggatcagataataagcaaataccgtgttcgcatccggagcaaaaaatggtactcaatcctcgtgagttacatgatcgatgtagccatgaacaatgcttggcagctgcaccgggcatgcaacccaggtgcgtcacttgatcctctggatttcagacgattcgtggctcacttttacctcgagcacaacgctcacttgagtgactag

SEQ ID NO: 12730 - DNA, 2430 bp, Artificial Sequence
  Description of Artificial Sequence: Synthetic coding sequence
atgtacgaggccttgcctgggcccgcgccggaaaacgaggatgggctggtcaaggtgaaggaagaggaccccacctgggagcaagtgtgtaattcccaggaagggtcgagccacacacaggagatatgccgccttcggtttcggcatttttgctaccaggaggcccacggcccacaggaagcactggcccagcttcgcgagctgtgtcaccagtggctgcgaccagagatgcatactaaggagcagattatggaactgcttgttcttgagcagttcctgacaatcctacctaaggagctgcaaccgtgcgtgaagacttatccgctggaatctggcgaggaagcggtgaccgtcctggaaaacctcgagactggctctggggatacagggcagcaagcctctgtgtacattcaggggcaagatatgcatcccatggtggccgagtatcaaggagtctccctagagtgtcaatctttgcagctcctacccggcattacaacactaaagtgtgagcccccacaacggccccagggaaatccgcaagaggtcagcggccccgttccacatgggagcgcccacctgcaggagaaaaaccctagagacaaagctgtggtgccagtattcaatcccgtccggtctcaaacactcgtgaagaccgaagaagaaacggctcaggctgtggcggccgaaaagtggagtcatctctcactaacaagacgaaacctgtgcggcaactctgcacaggagactgtcatgagcctgagtcccatgaccgaggagattgtgaccaaagatcgcctgttcaaagcaaagcaggaaacaagtgaagagatggagcaatccggcgaggcatccgggaagcccaacagagaatgcgctcctcagattccttgttctacgcccatcgccaccgagagaacagtggcgcacctgaatactttaaaagatcgacacccgggtgacctgtgggctagaatgcatatttccagtttggaatatgccgccggcgatatcaccaggaagggaaggaagaaagacaaggctagagtgtcagagctgctgcagggactgtcctttagtggcgactccgacgtcgagaaggataacgagccagagatccagccagcccaaaaaaaactcaaggtgagctgctttcccgagaagtcatggacaaagagagacattaagccaaacttccccagttggagtgccctggactccggcctcctgaacctaaagagtgaaaagctgaacccagtcgaactgttcgagctgttttttgatgacgagacatttaatcttattgtaaatgaaactaacaactatgccagccaaaagaacgtgtctttagaagtaacagtgcaagaaatgcgctgcgtctttggggtcctgttactgagtggctttatgcgccaccccagacgagaaatgtactgggaggtcagcgacaccgaccagaatctggtcagagacgctatccgtcgcgaccggtttgaactgattttcagtaatcttcacttcgccgacaatggccaccttgaccagaaggacaagttcactaagctgcgacccctgataaagcagatgaacaaaaactttctgctctatgccccactcgaggagtattactgctttgataaaagcatgtgtgagtgcttcgactccgaccagtttctcaacggaaaaccgatcagaatcggttataaaatttggtgcggcaccaccactcagggttatctggtgtggtttgaaccatatcaggaagaaagtactatgaaagtggacgaggatcccgatctcggcctgggtggaaacctggtcatgaatttcgccgatgtcctcctcgagcgggggcagtacccgtaccacctgtgctttgatagtttctttactagcgttaaactcttgagcgcactgaaaaaaaaaggcgttcgcgccactgggaccatcagagagaaccggacggagaaatgtccattaatgaatgttgaacacatgaagaagatgaagcggggctattttgattttcgcatagaagagaacaatgagataattctttgcagatggtacggggacggaattatttccttgtgttccaatgccgtagggatcgaacccgtgaacgaagtatcatgttgtgatgccgacaacgaggagatccctcagatcagccagcctagcattgtcaaagtgtatgacgagtgcaaggagggggtcgccaaaatggaccaaatcatcagcaagtaccgagttcgcattcgctccaaaaaatggtatagtatcctcgtttcatatatgatcgatgtcgcaatgaataatgcttggcagctccacagagcctgcaatcccggcgcgtccctggaccccttagattttcgccgctttgtcgcgcacttttacttggaacataacgctcatctgtccgattag

SEQ ID NO: 12731 - DNA, 2418 bp, Artificial Sequence
  Description of Artificial Sequence: Synthetic coding sequence
atgtgggaccaggggggccagccttggcagcagtggccgctgaaccaacaacagtggatgcagagcttccagcaccagcaagatccgagccaaatcgactgggccgccctggctcaggcctggatcgctcaacgggaggcatctggacagcaatccatggtggaacagccgccaggcatgatgccaaacggacaggatatgagcacaatggaatcaggtccgaataatcacggtaatttccaaggcgactctaatttcaaccgcatgtggcagcccgagtggggcatgcatcagcagccccctcatccgccacccgatcagccttggatgccgcccacacctggacccatggacatcgtgcctccaagcgaagattccaacagccaggacagcggggagttcgctcctgacaaccgacatatatttaatcagaacaaccacaatttcgggggcccacccgacaatttcgcggtcggcccagttaaccaatttgactaccagcacggagccgcttttgggccgcctcagggcggttttcacccaccatactggcagccagggccacccggcccgcctgcccctccgcaaaacagaagagagcgccctagctctttcagggaccggcaaaggagcccgattgccttgccggtgaaacaggaaccaccacagattgacgcggttaaacgcagaaccctcccagcctggattagggagggcctcgaaaaaatggagcgggagaagcaaaagaaactcgagaaagaacgcatggaacagcagcggagccaactgagcaagaaagagaagaaggccactgaggacgccgagggaggcgacggccctcgattacctcaaaggtctaaatttgacagtgacgaggaggaggaagatactgagaatgtggaggccgccagcagcgggaaggttacaagaagtccctcccccgtccctcaggaggaacacagcgaccctgaaatgacagaggaggaaaaggagtatcagatgatgttgctcaccaaaatgctcctcaccgaaatcctcttggacgtgactgatgaggaaatatattatgtggctaaagacgcacatcgcaaagccaccaaagctccagcgaagcagctggcacaatcctcggcattggcgagtctgaccggtctgggaggactaggcggatacggaagcggagatagcgaggatgagcggtctgaccgcgggtcagagagttccgatacggacgacgaggagttgaggcatcgaatacgtcaaaagcaagaggcattctggcggaaggagaaagagcagcaactgctgcatgacaagcaaatggaggaggagaagcagcaaacggaacgggtcaccaaggaaatgaatgagttcatccacaaagaacagaactccctgagcctgctcgaagcaagagaggctgatggggacgtcgtgaatgaaaagaaaaggaccccaaatgagacaacaagcgtgctggagcccaaaaaagaacataaagagaaggagaagcagggcaggtctcgttccggtagctcctccagtgggtccagcagctcaaacagccgaactagcagcacaagttctactgtgtcaagttcttcatacagttccagttctggcagtagtagaacttcctctcgcagctccagcccgaagaggaaaaagcgccattctcgctcaagatcacctacaatcaaagcccgtcgttccaggtcacggtcctatagccgtaggataaaaatcgaatctaaccgggcccgagtgaaaatccgcgaccgacggcggagcaatcggaactcgatagagagggagagacgtaggaacagatcacctagtcgcgaaaggaggcgatctcggtctagaagccgcgaccgccggaccaatcgcgccagccggagccggagtcgagataggaggaagatagatgatcagcgtggcaatctgtccggaaactctcacaaacataaaggcgaggctaaggaacaggaacgaaaaaaggagaggagtagatcaattgacaaggatcgcaagaagaaagataaagaacgagagagagaacaggacaaacgcaaggagaaacagaagcgcgaggaaaaggatttcaagttctcaagtcaggacgataggctgaaacgcaaacgggagtcagagagaactttttctcggtctggtagcatatccgttaaaatcattagacatgattccaggcaagactcaaagaaatcaacgaccaaagattccaagaagcactctggctcagactcttccggtcgtagctcctctgaaagcccgggtagctcaaaagagaagaaggcaaaaaagcctaagcacagtagatcccgcagcgtggagaaatcacagcgatctggaaagaaggcatcaagaaagcacaaaagtaaatccagatcgaggtag

SEQ ID NO: 12732 - DNA, 2418 bp, Artificial Sequence
  Description of Artificial Sequence: Synthetic coding sequence
atgtgggatcagggcggacagccttggcagcagtggccgttgaaccagcagcagtggatgcagtccttccagcaccaacaggatccctctcagatagactgggcagcactggcccaggcatggatcgctcagagagaagcctcagggcagcagtctatggtggaacagccacccggcatgatgcctaatggccaggatatgagtaccatggagtcaggccctaacaaccacggtaattttcagggagacagcaacttcaatcggatgtggcagccagaatggggaatgcaccagcaaccgccccaccccccccctgatcagccatggatgccacccacccccgggcccatggatatcgtccccccctcagaggactccaactcccaggactccggagagtttgcgcctgataatcggcatatctttaatcagaataaccataacttcgggggaccgccggataattttgccgtgggtccagtaaatcaattcgactaccagcatggggccgcattcggcccacctcaggggggctttcacccaccctactggcaaccaggcccacctggaccccctgctccccctcagaatcgccgagagcgcccctcctctttccgggataggcagagatctccgatagccctcccagtgaaacaggagccccctcagattgacgccgtgaagaggcgcacgctgccagcatggattagagaaggcttagagaaaatggagcgcgagaaacagaagaagctggagaaagaaagaatggaacagcaacgctcacagctgtccaagaaagagaaaaaggctaccgaggatgcagaggggggtgacggacctcgcctgccccagcggtcaaagtttgacagtgatgaggaggaggaggacaccgaaaatgttgaagccgcgtccagcggtaaggtgactcgaagcccgagcccagtcccccaggaggagcacagcgaccccgaaatgactgaggaagaaaaagagtaccagatgatgctgcttacaaaaatgctccttaccgaaatattactagacgtgaccgacgaagaaatttattacgttgcaaaggatgcccatcgtaaggctaccaaagctccagctaagcagcttgcacagtcctcagcactggcgtccctgaccgggctgggaggactggggggatacggctcaggggattccgaggacgagcgcagcgaccgcggatcagaatctagcgacactgatgacgaggaactgagacacagaatccgccagaaacaggaggcattctggaggaaggaaaaagagcagcagctgttacatgacaagcagatggaggaagagaagcagcagaccgagcgcgtgaccaaagagatgaatgagtttatacacaaggaacaaaacagtctgtcactgctggaggctcgcgaggctgatggggacgttgtgaacgaaaagaaacggaccccaaatgagactacaagtgtgctcgaacctaagaaagagcataaggagaaggagaagcagggccggtcccggagcggaagcagcagttcaggaagctcaagctcgaacagccgaacctcatcgacttccagcaccgtgtctagcagctcttattctagcagttccggctcttctcggacctcatcaaggtcgtcaagccccaaaaggaagaaacgccatagccgctcaagaagcccaaccatcaaagcaagaagatctaggtctagaagttatagtagacgcataaagatcgaaagtaacagggcgagggtgaaaatccgagaccgtcgtcgtagtaatcggaattccattgaaagagagaggagaagaaacaggtctccaagtagggaacgaagacgcagcagaagtcgtagcagagacagacggacgaatcgggcttcacgaagcagatcccgggaccgcaggaagattgacgatcaacggggaaatctctccggtaattctcacaagcacaagggggaagccaaggaacaagagaggaaaaaagaacgctctcgctccatcgacaaagatcgaaaaaaaaaggacaaggaaagggagcgggagcaagataagagaaaggaaaagcagaagcgcgaagagaaggattttaaattcagctctcaggacgatagactgaagcgaaagagggaaagtgagcgcaccttctcccgctctggctcgattagcgtgaagattatacggcatgactcaagacaggacagcaaaaagtcaaccaccaaggactctaagaagcactccgggtctgattcaagcggcagatcaagtagtgaatcacctggcagtagtaaagagaaaaaagcaaaaaaacccaagcactcacgcagccgtagcgtggaaaagtcacaaagatctggaaagaaggcctcgcgaaagcacaagtccaaatcgagaagtaggtag

SEQ ID NO: 12733 - DNA, 1830 bp, Artificial Sequence
  Description of Artificial Sequence: Synthetic coding sequence
atggagtccactgcatatcccctgaacctgagccttaaggaagaagaggaggaagaagagattcagtcccgcgaattagaggacggtccagcagacatgcaaaaagtaagaatttgtagcgagggtggctgggtgccagctctgtttgacgaagtggccatctacttctccgatgaagaatgggaggttctgaccgagcaacaaaaggccttatacagagaggttatgaggatgaattatgagactgtgctctccttggagttcccgttcccaaaaccggacatgatcaccagactcgaaggcgaggaagagtcccaaaattccgatgagtggcaacttcagggcgggacatctgccgagaacgaagagtccgacgttaagcctcccgactggccgaaccccatgaatgcaacgagtcagttccctcaacctcagcactttgactcttttgggctgagactgcccagggatattaccgaactccccgaatggtcagagggctaccccttctatatggcaatgggttttccaggatacgacctgagcgcagacgatatcgcaggtaagtttcagttcagcagaggcatgagacggtcctatgacgccggattcaaattaatggtggtggaatatgccgagtcgaccaataactgtcaggctgccaagcagtttggcgtgctggagaagaacgtcagagattggcgcaaagtcaagccccaactccagaatgcccacgcaatgcgccgggcgtttagaggacctaagaacggtcgattcgccctcgtggatcagcgcgtggctgaatatgttcgctacatgcaagcgaagggagatcctatcacccgcgaagcaatgcagctcaaggccctagaaattgcacaggagatgaacattccagagaaagggttcaaagcaagtttggggtggtgccgaaggatgatgcgtaggtatgatttgtcactacggcataaggtcccggtgcctcaacatttgcccgaagatcttaccgagaagctggtgacttatcagcgcagtgttctcgctctgcggagagcccatgactatgaggttgcccaaatggggaatgctgacgagacccccatctgtctagaagtaccctcccgcgtcactgttgataaccagggggagaagccagtgctggtcaaaacccctggcagggaaaagttgaaaattactgccatgttaggcgtcctcgccgacggccgcaagcttcccccttatatcattctgcgtgggacctacatcccgccaggcaagtttccttctggaatggagattagatgtcacaggtacgggtggatgacagaagatcttatgcaggactggctcgaagtggtttggagacggcgaacaggggctgttcctaaacagcggggcatgctgatcctgaatggattccgcggtcatgccaccgacagtgttaaaaactcaatggagtccatgaacacggatatggtgatcatcccaggtggactgaccagccaactacaggtgcttgatgtggtcgtgtataagccactaaatgatagtgttagagctcagtatagcaactggttattggctggaaacctagcattatcccctactggcaatgccaagaagccaccccttggtctcttccttgagtgggttatggttgcatggaactccattagctccgagagtatcgtccagggattcaaaaagtgtcatatcagctcaaacttggaggaggaggatgatgtcctgtgggaaatcgaatccgagctgcctggcggcggggaacctccaaaagactgcgacaccgaaagtatggccgagtcgaactag

SEQ ID NO: 12734 - DNA, 1830 bp, Artificial Sequence
  Description of Artificial Sequence: Synthetic coding sequence
atggagtcgacggcatatcctttaaatctgagcctaaaggaagaggaggaggaagaggagatacaatccagggaactggaggatggacccgctgacatgcagaaggtgcgcatatgttcggaaggtggctgggtgcctgctctgtttgatgaagtggccatatatttcagtgatgaggaatgggaggtcctgaccgaacagcagaaagccttgtatagggaagtgatgagaatgaattacgagaccgtgctatctctggagttcccattccccaagccagacatgattactcgtctcgagggcgaggaggagtcccagaattcggacgaatggcagctgcagggcggcacatctgctgagaatgaagaatcagatgtcaagccccccgattggccaaatccaatgaatgcaaccagccagtttcctcagccccagcactttgatagcttcggattgcgtctgcccagagatataacagaactgcccgagtggagcgaagggtaccctttctacatggctatgggttttcccggatacgatctgtccgcggacgacattgcgggtaagtttcagttttcaagaggaatgcgccggtcgtatgatgcaggtttcaagcttatggtggtagaatacgccgagtcaacaaacaactgccaggcagcgaagcagtttggagtgctcgagaaaaatgtccgggattggcggaaggtgaagccccaactccagaacgctcacgccatgcgaagagcattccgggggcctaagaacggccggtttgccctggttgaccagcgcgtcgccgaatatgttagatacatgcaggccaagggggaccccattacccgggaggcgatgcagctgaaggcactcgaaatcgcccaagagatgaacattccggaaaaggggtttaaagcctcccttggatggtgtcgacgtatgatgcggcggtacgatttatccctcaggcataaggttccagttccccagcacctgcctgaagatttgactgaaaagcttgtcacgtatcaaagatcagtcctggcgctacggagggcccacgactacgaagtcgcccagatggggaatgctgacgagacccctatctgtctcgaagtgccctcccgggtgactgtggataatcagggtgagaaaccagtcctcgttaagacaccaggccgagaaaaacttaaaattaccgccatgcttggcgtgctggctgacgggcgcaaactgccaccttatataattttgaggggcacctatattccccctggcaaatttccctccggcatggagatccgctgtcacaggtacggctggatgacggaggacctgatgcaagactggctagaagtagtctggcgaaggcggaccggggcggtacccaagcagcgggggatgctgattctgaatgggtttcggggacatgctacagacagcgtcaagaacagtatggaaagcatgaacacagacatggtgataattccaggaggcctgactagccagctccaggtgttggatgtggtggtctataaaccactgaatgactcagtcagggcccagtacagcaattggctgctggctggcaatctggccctgtcacctactggaaatgctaaaaaacctcctctgggactgtttctagagtgggttatggtggcctggaactccatttcgagcgagagcatcgtccagggctttaaaaagtgccacatcagcagcaatctggaggaagaggacgacgtgctgtgggaaattgaaagtgaactgcccggagggggggagccccctaaggactgcgatacagagtcaatggctgagtctaactag

SEQ ID NO: 12735 - DNA, 630 bp, Artificial Sequence
  Description of Artificial Sequence: Synthetic coding sequence
atggagtccacggcatacccgttaaacctgagtctaaaagaggaagaggaagaagaggagattcaaagtagggaactggaggacggacctgccgacatgcagaaggtccgcatttgttcagagggtgggtgggttccagccctctttgatgaggtggcaatttatttcagcgacgaagaatgggaggtgctgacagagcagcaaaaagctctgtatagagaggtgatgagaatgaattacgagaccgtgctgtctttagagttccccttcccgaagccagatatgatcaccagactggagggggaagaggagtctcagaacagcgacgagtggcagcttcagggtggaacatcggctgaaaacgaggaatccgacgtcaaacctcccgactggccaaaccctatgaatgctacaagtcaattccctcagccgcaacactttgattcattcggtctgcgcctcccacgagacataactgagttacccgagtggagcgaggggtatcccttttacatggccatggggttccccggatacgacctgagtgctgatgatatcgctggtaaattccagttttcccgaggtatgaggaggtcttacgacgcgggttttaaactcatggtcgtctag

SEQ ID NO: 12736 - DNA, 1575 bp, Artificial Sequence
  Description of Artificial Sequence: Synthetic coding sequence
atggagttccccttcccaaagccggatatgatcactagactcgagggtgaggaagaaagccagaactctgatgagtggcagctgcagggaggtactagtgccgagaacgaggagagtgacgtcaaacccccggactggcccaatccgatgaatgccaccagtcaatttcctcagcctcaacatttcgattcttttggcctgcgccttcctagagacatcaccgagctgcccgaatggagcgaaggatatcctttttatatggccatgggatttcctggatatgatctcagcgctgatgacatagctggaaaatttcagttctctcgtggcatgcggcggagttatgacgccggttttaaattgatggttgttgaatacgcagaatccactaacaactgtcaggcagccaaacagtttggagtcctggagaaaaatgtcagggattggcgcaaagtgaaaccccagctgcagaacgctcacgctatgagaagggccttcagggggcccaagaacgggcggttcgcgttggtagatcaacgggttgcagagtatgttaggtatatgcaggctaaaggtgaccccatcacccgtgaggctatgcagcttaaggccttggagatcgctcaggagatgaacattcccgaaaaggggtttaaagccagcctcggatggtgtcgccgtatgatgaggcgctatgacctctctcttcggcacaaggtgcccgtgcctcagcatctcccagaagatctgaccgagaagttagtgacttatcagcggagtgtgctggcactaagacgagctcatgactacgaggttgctcaaatgggaaacgccgacgaaacccccatctgtttagaggtgcctagtcgtgtgaccgtggacaaccagggggagaagcctgtgttggttaagactccaggccgcgaaaaactcaaaattacggccatgctcggagtgctagccgacggtcggaaactgccgccttacataattctgaggggaacgtacatcccacctgggaaattcccctcaggtatggagattcgctgtcatcgatatggctggatgactgaagacttaatgcaggactggctggaagtcgtgtggcgaagaagaacaggcgccgtcccgaaacagagaggcatgttgatcttaaatggtttcaggggccatgctacagattccgtcaaaaactccatggagtccatgaacaccgacatggtcatcatacccggcggcctgacaagccagctgcaggtgttggatgtcgtggtatataagccacttaatgactccgttagagcccaatactccaactggctcctggcgggcaatttggcgctaagccccaccggcaacgctaagaagcctccacttggcctgttcttggaatgggtgatggttgcctggaactctatctccagcgaatctatcgtgcagggcttcaagaagtgtcatataagcagcaacttggaggaggaagatgatgtgctttgggagatagagagtgagctgccaggcggaggagaacctccgaaagactgcgatactgaatccatggctgaaagtaattag

SEQ ID NO: 12737 - DNA, 2211 bp, Artificial Sequence
  Description of Artificial Sequence: Synthetic coding sequence
atgaaagagatgtctgcaaacacagtactagatagtcagcgccagcaaaagcattacggaattacttctccaatctccctcgcatcaccaaaagagattgaccatatatacacacagaaactcatcgatgctatgaaaccattcggcgtttttgaggacgaagaggagctgaaccaccgcctggtagtccttggcaaactgaacaacctggttaaagaatggatctccgacgtgagcgagagtaaaaacctgccccccagtgtggtggcaaccgttggcgggaagatcttcaccttcggcagttaccgcctcggcgtccacacaaagggcgcagatatcgacgcactctgtgtggcgccccgtcacgtcgaacgttccgactttttccagagcttcttcgagaagttgaaacaccaggatggtatccgaaatctgcgggccgtcgaggacgccttcgtaccggtgattaaatttgagtttgacggtatagaaatcgacctggtgtttgccaggctagctatacagactatcagtgataacttggatctccgagacgatagcagactgaggtctctggacatccgatgtatacggtctctgaacggatgtagagtgaccgacgagattctacaccttgtccctaacaaggagacttttaggttaaccctgcgagccgtgaaactttgggcaaaaagaagagggatctatagcaatatgcttgggttcctgggcggggtctcttgggcgatgctagtcgctcgcacctgtcagctatatcccaatgccgccgcatccacactggtccacaaattttttttggtcttttcaaagtgggaatggcctaaccctgtcctgttgaagcagccagaggaatcgaatttgaacttacctgtgtgggatcccagggtcaacccctcagacaggtatcatctgatgccgatcatcactcctgcctatccccaacagaactctacctacaacgtcagtactagcacaaggaccgtgatggtggaggagtttaagcaggggttagccgtgaccgatgagatcctccaggggaagagcgattggagcaaactgttagagccccccaatttttttcaaaagtacaggcactacattgttcttacagcctccgcgtctaccgaggaaaaccatttggagtgggtcggtctggtggagtcaaaaataagagtcctggtgggcaatttggaacgcaacgaattcataacactggcccatgttaatccccaaagttttccaggcaacaaagaacatcataaggataataactatgtgtcaatgtggttcttaggcattatctttaggcgggtggagaatgctgagtctgtgaacattgatctgacgtacgatatccaatctttcactgacacggtctataggcaagcaaataatatcaacatgttaaaagaggggatgaagatcgaggcaacccatgtgaagaaaaagcaacttcaccattatctccctgcagaaatactccaaaagaagaagaagcagagtctaagtgacgtgaatcgtagttcaggtggactccagagtaagagactgagcctggactcatcttgcctggattcatcacgagacacggacaatgggacaccttttaattcgcccgcctctaaatctgatagtccatctgtgggcgaaaccgagcgcaatagtgcagagcccgcagcagtgatcgtggagaaacccctgagcgttcccccagcacaaggccttagtattcccgtgatcggggcaaaagtggattcgacagtgaagactgtgtctccccccactgtttgtactattcccaccgtggtgggtaggaacgtgatccctaggattactacacctcacaatcctgcccaaggacagcctcatttaaatggcatgtccaatataacaaaaaccgttactcctaagcggtctcactctccaagcatcgacggcacaccgaaacgtttgaaagatgttgagaagttcattcgcttggagagcactttcaaagacccgcgaacagccgaagagcgtaagcgcaagtcagtggatgcaatcgggggcgagtccatgcccattcccaccatcgatacctcacgcaagaagcgattacccagcaaagagctcccagattctagcagtccggtacccgctaacaatatccgtgtgataaagaactcaattcgcctgaccctcaacagatag

SEQ ID NO: 12738 - DNA, 1212 bp, Artificial Sequence
  Description of Artificial Sequence: Synthetic coding sequence
atgcccataattactcccgcataccctcagcagaactctacttacaatgtttccacatcaacccgaaccgttatggtcgaagagtttaaacagggcctggccgtgaccgacgaaatcctccagggaaaatctgattggtcaaaactccttgagcctccaaacttcttccagaagtaccgccactacatcgttctcactgcctccgccagcacagaagaaaatcatctggagtgggttggcctggtagagagcaaaattcgggtgttggtggggaacctcgaaaggaatgagtttatcacactcgcacacgttaatcctcagtcgtttcccgggaataaggaacaccataaagacaataactatgttagcatgtggttccttggtattattttccggcgcgtggagaacgctgagagtgtgaacatagaccttacctacgatattcagtccttcacagatactgtgtatcgacaggcgaataacattaacatgctgaaggaggggatgaaaatagaagccacacatgtgaaaaaaaaacagttgcaccactacttgccagccgagattctacaaaagaagaagaagcagtccctttccgacgtcaatcgatcttctgggggcctgcaaagcaaacgactcagcctggactcgagctgcctggattcctcacgtgatactgacaatggcacgccgtttaattctccggcatcgaaaagcgattcgcctagtgtgggagagaccgaacggaactccgccgaaccggctgccgttattgtggagaaacccctctcagtgcctccagctcagggtttatcgattcccgtgattggggccaaagtggattctacagtgaagaccgtgagcccgcccacagtctgtaccattccgacagtggtgggtaggaacgtaataccccggatcactaccccccacaatcctgcccagggtcagccacacctgaacggaatgtccaacattaccaagacagtcacaccgaagcgcagtcacagtcccagtattgatgggacccctaaaagattgaaggatgtcgagaaagacgccatagggggcgaaagcatgcctatacctacaatcgatactagccgcaaaaaacgacttcctagcaaggagctcccagattcttctagtcccgtccccgcaaataatatcagggtgattaaaaactctatcagactgactctgaatagatag

SEQ ID NO: 12739 - DNA, 1149 bp, Artificial Sequence
  Description of Artificial Sequence: Synthetic coding sequence
aggaccgtaatggtggaagagttcaaacaaggattagcggttactgatgagatcttgcaaggaaaaagcgattggagtaagctactggagccaccgaacttcttccagaagtaccgccattacatcgtccttactgcttcggcctctaccgaggagaaccatctagaatgggtgggtctcgtggagagtaaaattcgagtactcgttggcaacctcgaacgaaatgagtttattactttggcccatgtcaaccctcagagtttccctggcaacaaggaacatcacaaggataataactacgtgtctatgtggtttcttggaatcatttttcggagagtcgagaacgccgagagcgtcaatattgatctaacatacgatatccagtcattcaccgatactgtatatcggcaggccaacaacattaacatgctcaaggagggcatgaagatcgaggcgactcacgtgaaaaagaaacagctccaccattaccttcctgctgaaattcttcagaaaaaaaagaagcagtccctgtcagacgttaacaggagttcaggaggcctgcaaagcaagagactgagcctggacagctcttgtctggattcaagtagagacacggataacgggacccctttcaattcccccgcatcgaaaagcgacagtccaagcgtgggcgagactgagaggaactcagcggagccggccgccgtgatcgtggagaagcccctgtctgtgccccctgcgcagggcctgtcaatacccgtgatcggcgccaaagtggattctactgtgaaaacggtgagtcccccaacagtttgtactataccaaccgtagttggtcgcaatgtcatcccaagaattacaacaccccacaaccctgcacaggggcagcctcacctgaatgggatgagtaatataaccaaaacagtcacaccaaagagatcccattcaccatcaattgatggaaccccaaagcggctgaaggacgtggagaaggatgccattggcggagaatcgatgccgattcctaccatcgacacgtccagaaagaaacggctcccaagtaaagaattgccagatagttcttctcctgtgcctgctaacaatattcgagtgatcaagaactcaataagactgaccctcaataggtag

SEQ ID NO: 12740 - DNA, 642 bp, Artificial Sequence
  Description of Artificial Sequence: Synthetic coding sequence
atggctgtgttgtccgccccgggtctgcgcggatttagaattcttggtctgaggtcatctgtcggccctgctgtccaggcccgcggggtacaccagagcgtcgccacggacgggccttcatccacacagcctgctctccccaaagcgcgagccgttgccccaaagccaagctcccggggcgagtacgtcgttgctaagttagatgatcttgttaactgggcacgtcgatcctcactatggccaatgacgttcgggctagcttgctgtgcggtagaaatgatgcacatggccgcgccgaggtatgacatggaccggtttggagtggtcttcagggcctccccaagacagagtgacgtcatgatcgtggcagggacactgactaacaaaatggctccagctctccggaaagtgtatgatcagatgccagaaccgcgatacgtggtttctatggggtcttgtgccaacggaggcggctattatcactactcgtactctgtagtaagagggtgcgaccgaatagtgcccgtggacatctacattcctggatgtcccccgaccgctgaggcgttgctgtatggaatcctgcagctgcaacggaaaataaaacgagaaagacggttgcagatctggtaccggagatag

SEQ ID NO: 12741 - DNA, 1035 bp, Artificial Sequence
  Description of Artificial Sequence: Synthetic coding sequence
atgcacaggacaactcgtattaagattacggagcttaatccccatctcatgtgcgccctgtgcggcggttattttatcgacgcaactaccatagtggagtgtctccacagtttctgcaaaacttgtattgtccgttaccttgaaacaaacaagtactgccccatgtgtgacgtacaagtgcataagacaagacccctactgagcatccgctcagataagacactgcaggacatcgtgtataaacttgtacctggtctcttcaaggatgagatgaaacgccgccgggacttctatgctgcttatcccttgactgaggttcctaacgggagcaatgaagaccggggggaggttcttgaacaggaaaagggggcattaagtgacgacgaaattgtgtctctctccattgagttttacgagggtgcccgcgacagggacgagaaaaaaggccccctggagaacggggatggggacaaggaaaagaccggggtgaggttcctgcgctgtcccgctgcgatgacagtgatgcatttagcgaaattcctgaggaataagatggacgtccccagtaagtacaaagtagaggtgctgtacgaagacgagccattgaaagagtattataccctgatggatattgcctatatctacccgtggcgccgcaacggacccttgccactgaagtaccgagttcagccggcatgtaaacgactgactctggccacagtgccaacacctagtgaaggcacaaatacatctggtgccagcgagtgcgaaagtgtgtctgacaaggctcctagcccagcaacactgcccgccacgtcttctagtcttcccagtccagccacaccaagtcacgggtcacccagcagccacggaccacccgctacccacccaacctctcccactcccccgagcaccgccagcggggctaccaccgcagctaatggcgggtccctgaattgtctgcagactccatccagcacatcccggggtagaaagatgactgtaaatggggctcctgtgccccccttaacatag

SEQ ID NO: 12742 - DNA, 729 bp, Artificial Sequence
  Description of Artificial Sequence: Synthetic coding sequence
atgctcaccaggaagatcaagctctgggacatcaatgcccacatcacctgtcgcctgtgctcaggctatcttatagatgcaaccacagtcacggagtgcctccatacattttgtaggagctgtttagtaaagtatcttgaagaaaacaacacttgccctacctgccggattgtgatccaccaaagccatcctctgcagtatattggccacgacagaaccatgcaggatattgtatataaattagtgcccggcctgcaggaggctgagatgaggaagcagcgggaattttaccataagttgggcatggaggtgcctggggatattaaaggagaaacttgcagtgcaaaacaacatcttgattcccacagaaacggagaaaccaaggcggatgattcgagcaacaaggaagctgcagaggaaaaacccgaagaagacaacgactatcacaggagcgatgagcaggtgagtatatgtctcgaatgcaactcctccaagcttcgagggctcaaaagaaagtggatacgatgtagcgcacaggcaacagtcctccacctgaagaaattcattgccaaaaaacttaatctctcaagcttcaacgaactggacatcttgtgcaatgaagaaatcctgggcaaagatcacacactgaaatttgtggtggtgacccgttggcgcttcaaaaaagcaccgcttctacttcactatcggcctaagatggatttgctatag

SEQ ID NO: 12743 - DNA, 123 bp, Artificial Sequence
  Description of Artificial Sequence: Synthetic coding sequence
atgctaactcgtaaaattaagctctgggatatcaatgcccacattacatgtagactctgcagcgggtatcttatcgacgcaactacggttacagaatgtttgcatacgttctgcagatcctag

SEQ ID NO: 12744 - DNA, 189 bp, Artificial Sequence
  Description of Artificial Sequence: Synthetic coding sequence
atgttgacaaggaagataaagctgtgggacataaacgcccacattacctgcaggctttgtagcggatacctgattgatgctaccaccgtaactgaatgccttcacacgttttgccgatcctgcctggttaaatacctcgaggaaaataacacctgccccacctgtaggatagtgattcatcagtcatag

SEQ ID NO: 12745 - DNA, 330 bp, Artificial Sequence
  Description of Artificial Sequence: Synthetic coding sequence
atgctcacgcggaaaatcaagctatgggacattaacgctcacattacctgtcgtctgtgtagtggatatctgattgacgcaaccacagtcaccgagtgtcttcacacgttctgtcgcagttgccttgttaaatacctggaggagaacaatacatgcccaacttgtcgcatcgttatccatcaatctcacccgctgcagtatatcggacacgaccgcactatgcaggacatcgtgtacaagctggtgcccggactgcaagaggcggagatgagaaagcaacgtgagttctatcacaagctggggatggaggttccaggggacataaagtag

SEQ ID NO: 12746 - DNA, 729 bp, Artificial Sequence
  Description of Artificial Sequence: Synthetic coding sequence
atgttaacaaggaagatcaaactgtgggacataaacgcacatatcacgtgcaggttgtgcagcggctatttgatcgatgccaccacagtgaccgagtgcctccataccttctgtcgtagctgcctggttaagtacctggaagaaaacaacacttgtcccacatgcagaattgtgatacaccagagtcatcctcttcagtatattgggcatgatcggacaatgcaggacatagtgtacaaactcgtgcccggcctccaagaggctgagatgcggaagcagagagaattttatcataagctgggcatggaagtgcccggggacatcaaaggcgagacatgcagcgccaaacagcacctcgacagtcaccggaatggcgagacgaaggccgatgattcgtctaataaagaggctgccgaagagaagcctgaagaagataacgattaccataggagtgacgaacaggtttcaatttgcttggagtgcaactcgtccaagttaagaggtctgaaacgaaagtggattaggtgtagcgcccaagccaccgtactgcatctgaaaaagttcatcgcaaaaaagctgaatcttagcagcttcaatgagcttgacatcctgtgcaacgaggagattctgggaaaggatcacaccctgaagtttgtagtggtcactcgctggcggtttaaaaaggcccctctgctgttgcattaccggcccaagatggatctgctatag

SEQ ID NO: 12747 - DNA, 729 bp, Artificial Sequence
  Description of Artificial Sequence: Synthetic coding sequence
atgctcactcgaaagattaagttgtgggatatcaatgcccatattacttgccggctgtgctcaggttacctgatagacgctaccactgtcactgagtgtctccataccttctgcaggtcttgcctggtgaagtacctcgaggaaaacaatacatgccctacctgtcggatcgttatccaccagtcccacccactgcaatatatcggacatgatcgaaccatgcaagacattgtgtacaagctcgtccccggactccaggaggccgagatgcggaagcagagggaattctatcacaaattaggaatggaggtcccaggtgacattaaaggcgagacctgcagcgccaagcaacacttagatagccatcgtaatggtgagacaaaggcagatgacagctcgaacaaggaggctgcggaggagaagcctgaggaagataacgactatcaccgctctgatgaacaagttagcatctgcttggagtgtaactcatccaaactgaggggattaaagcgcaagtggatcaggtgtagcgcacaagccacggtcctgcacctgaagaagtttatcgccaaaaagctcaatctcagctcattcaacgaactggacatcttatgtaatgaagagattctcggcaaggaccacacattgaaattcgttgtggtcactagatggcgcttcaagaaagcacccctactgctgcactaccggccaaagatggacttgctgtag

SEQ ID NO: 12748 - DNA, 627 bp, Artificial Sequence
  Description of Artificial Sequence: Synthetic coding sequence
atgactgtatgcaggagctgcttggtgaagtacctggaagagaataacacctgccccacttgcagaatcgtcatccaccagagtcacccactgcaatacatcgggcatgatagaacaatgcaggatatagtatataagctagtcccaggacttcaagaggcagaaatgcgaaagcagcgtgagttctatcataaattgggcatggaggtgccgggcgatattaaaggggaaacatgttcagccaagcaacacctggattcgcacagaaacggggaaaccaaagctgatgattcgtccaataaggaggctgccgaagaaaagccagaggaggacaacgattatcacaggtctgacgagcaagtctctatttgcctcgagtgcaacagctccaaactgcgcggactcaagcgcaagtggataaggtgtagcgcccaggcgaccgttctgcacctcaagaagttcatagctaagaaattaaatttatcttcattcaatgagttggacatcctctgcaacgaagaaatcctgggaaaggatcacaccttgaagttcgtcgtggtgacacgctggcgctttaaaaaggccccactgttgttgcactatcggccgaaaatggacctcctgtag

SEQ ID NO: 12749 - DNA, 3015 bp, Artificial Sequence
  Description of Artificial Sequence: Synthetic coding sequence
atggagacagaaagcgagcagaacagcaactcaactaatggatctagtagctcaggaggatccagccgcccccagatcgcccagatgtctctctatgaacggcaagctgtgcaggccctgcaggccctccaacgccaaccaaacgcagcacagtattttcaccagtttatgctgcaacagcaactgtctaatgcccagctacattctcttgccgcagtgcaacaggcaaccattgctgccagtagacaagcctctagcccgaatacttctaccacgcagcaacagacaaccacaacacaagctagtattaatttagcgactactagtgccgcacagctcattagtcgttcacaatccgtcagcagcccttccgccactacgctcacgcagagcgttctgctcggaaataccacttccccccctctgaatcagtcacaggctcaaatgtatttaagacctcagctgggtaacctactgcaagtgaaccgtaccctgggccgtaacgtgcctttagcgtcacagcttatactgatgcctaacggcgccgtggccgcagttcaacaggaagtcccttcagcgcagtctccaggagtgcacgccgacgcagatcaagtccagaatctggcagttaggaaccagcaagcctcagcgcaaggcccccagatgcagggtagcacacagaaggcaataccacctggagccagccctgtatcaagcctgtcacaggcttcctctcaggcattagctgtggcgcaagcatcaagtggtgctacgaaccagtctcttaacctgtcgcaagcaggtggcggtagcgggaattccattcctggctccatgggcccgggaggcggtggccaggcccatggtggccttggccaactgccttcaagcggcatggggggtggctcctgtccacgaaagggcacgggcgtggtgcagccactgccagcagcccagaccgtgaccgtgtcccagggctcccagaccgaggcagaaagcgcagcagccaagaaagccgaggctgacggcagcgggcagcagaacgttggaatgaacctgacacggacggcaactcccgctccctcccaaaccctcatatctagtgctacttacacacagattcaaccccatagtctgatacagcagcaacagcaaattcatctgcagcaaaaacaggtagtcattcagcagcaaattgctatccaccatcagcagcagtttcaacatcgtcagtcccagctgctgcataccgcaacacacctgcagcttgcccagcagcagcaacagcagcagcagcagcagcagcagcagcagcagcctcaggccaccaccctgacagctccacagcctccccaagtgcctcccacgcagcaggttcccccctcccaaagtcaacagcaggcacagaccttggtggtgcaacccatgctgcaaagcagccctttgtcgctccctccagacgctgccccaaaaccccccatccccatccaatctaaacctccagtggccccgattaaacctccccagctgggggctgccaagatgagcgctgctcagcagccaccgcctcacattccggttcaggtggtgggtacccggcagccaggaacggcgcaggcccaggctctcggcttagctcagctggccgcggctgtgcccacctcaaggggaatgccagggacggtgcagtctggccaagctcacctcgcctccagccctccctcctcacaggccccaggagcattgcaggaatgcccgccgactttagcccctggtatgacgctggcccctgtccaagggaccgcccacgtagtgaagggcggggcgactactagctctccagtggtggcccaggtccctgctgccttttatatgcaatccgtccatttgccaggcaagccccagaccctggccgtcaagagaaaagccgacagtgaggaggagagagacgatgttagtaccctcggcagtatgctgccggccaaagccagccccgtggctgaatcaccaaaagtcatggatgaaaaatcatctcttggggaaaaagccgaatctgtggcaaacgtaaacgcaaacaccccctcaagtgaactggttgccctgacgcctgccccaagtgtgcctcctccaactttagccatggtgagccgtcagatgggtgacagcaagccaccccaggctatcgtgaaaccacaaattttaactcatatcatagaaggctttgtcattcaggaaggagccgagccttttcccgtgggctgttcgcagctcctcaaggagtccgagaagcccctgcaaaccggcctgccaacggggcttaccgaaaaccaatccggaggccctcttggagtcgactctccctccgctgagctggataagaaagctaatttactcaaatgcgaatattgtgggaagtatgctccggcagagcagttcagggggtctaagagattctgtagcatgacctgcgccaaacgctacaatgttagttgtagtcatcagttcaggctaaagagaaagaaaatgaaggaatttcaagaggcaaattacgcaagagtgagacgaagaggaccacgccgatcaagtagcgatattgctcgggctaaaatccagggaaagtgccatcgcggccaggaggacagctccagaggatcagacaactctagctacgatgaggcactcagccctacatctccagggccactgagcgtaagagccggtcacggagagcgggacctgggcaaccctaatactgcgccccctacaccagaattgcacggcataaacccggttttcttgagttccaaccccagccgctggtctgtggaggaggtttatgagtttatcgccagtctccagggctgccaagagatcgccgaagagttcagatcacaggaaatcgatggacaggccctgctcttgcttaaagaagagcatctcatgagcgctatgaatatcaagcttgggcccgccctgaaaatatgcgctaaaataaatgtgctgaaagaaacctag

SEQ ID NO: 12750 - DNA, 1833 bp, Artificial Sequence
  Description of Artificial Sequence: Synthetic coding sequence
atgcaggggtctactcagaaggcaataccacccggagcaagccccgtgtcctctttgtctcaagcatcctctcaggctctggccgttgctcaggcttccagcggtgcaacaaatcagagtcttaacctgtctcaggcagggggcgggtcaggaaactccatcccaggaagtatggggcccggaggtggcggtcaagcccatgggggtctgggtcagctgccttcatccggcatgggcgggggctcctgcccaagaaaaggtactggggtcgtgcagcccttgccagccgcccaaacagtaacggtgtcccaggggtctcagaccgaggctgagagtgcagccgccaagaaggctgaggccgacgggtccggccagcaaaatgttggaatgaaccttaccagaactgccactcccgcacccagccagaccctcatatcttcagcaacctatacccaaattcaaccccattcccttatacagcagcagcagcagatccacctgcaacagaagcaggtggtaattcaacaacagatcgccatccaccatcaacaacagttccagcaccgacagtcgcagcttcttcatacggcaacccatctgcagttggcccagcaacagcagcaacaacaacagcaacagcagcaacagcagcaaccccaggccactacactgacagcaccccaacctccacaggttccccccacccagcagggcaagccccaaacactggcggtgaaaaggaaggcagactctgaggaagaaagagacgacgtgtctacacttggctctatgctgcctgccaaggcttcacccgtcgcagagagtccaaaggttatggacgagaaatcatcacttggcgagaaggctgagagtgttgctaatgtgaacgctaataccccctcttcggagttagtggctctgacccctgcccctagcgtgccacctcccaccctagcaatggtgtccaggcagatgggcgattcaaagcctccacaagccatcgtgaaacctcagatcctgactcatatcatcgagggctttgtcattcaagagggcgccgaaccttttccagtggggtgttcccagttgttgaaggagtccgagaagccactccagaccgggctgccaaccgggctcacagagaatcagtcaggcggtcccctaggagttgattctccctccgccgaactggataaaaaagccaatctgttgaaatgcgagtactgcggcaaatacgcaccagcagagcagttcagggggtcgaagcgcttctgcagtatgacgtgtgcgaaacgatacaacgtgtcgtgtagtcatcagtttcgcctcaaaaggaagaaaatgaaggagttccaagaagctaactatgcgagggtgcgacgccgcggtccccgaagatcctctagcgatattgctagggcaaagatacagggcaagtgccatagaggtcaggaagattctagtagaggatccgataattcctcctacgatgaagccttatctcctaccagccccggtccgctgtcggttcgcgcggggcatggggaaagagatctggggaaccctaataccgcacccccaacgcctgaactacacgggatcaatcccgtgtttctgtcttcaaaccctagccgatggtccgttgaggaggtctacgaatttattgcgagccttcagggctgccaggagattgccgaagagttccgatctcaggagatcgacggccaggctctgctattattgaaagaagagcacctaatgagcgcgatgaacataaaattaggaccagcacttaaaatttgcgccaagattaacgtgctgaaagaaacatag

SEQ ID NO: 12751 - DNA, 519 bp, Artificial Sequence
  Description of Artificial Sequence: Synthetic coding sequence
atggaaacagaaagcgagcaaaatagcaatagtactaatggaagctctagcagcggcggttcctctcgacctcagattgcccagatgtccttatatgaacgccaggcggtgcaggccttgcaagccttgcaaagacaacccaacgccgcacagtacttccatcagttcatgttacagcaacagctgtccaacgctcagctgcatagcttagcagcggtccagcaggcaactatcgctgcctcgcgtcaagcgtcgtctcctaatacaagcacaacccagcaacagacgacgacaactcaagcctcaatcaatttagcaaccacatccgccgcacagctcatcagccgctcccagtcggtgtcctcaccatcagcaacaacgctcacacagagcgtgctattgggaaacactacgtctccgcctttgaaccagagccaggctcagatgtatctccgcccgcaacttggaaacctcctccaggtcaatcgtaccctgggaaggaatgtcccccttgcttag

SEQ ID NO: 12752 - DNA, 3015 bp, Artificial Sequence
  Description of Artificial Sequence: Synthetic coding sequence
atggagacagagagcgagcaaaacagcaactccacaaatggctcttcttcaagcggcggtagctcacgccctcaaatcgcccagatgagcctctatgagagacaggctgtccaggcgctccaggcattgcagcggcaaccaaatgctgctcagtattttcatcagtttatgctccagcagcagctgagcaatgctcagctccattctttagcggccgtgcaacaggccacaatcgccgcctcgaggcaggcgtcatcacccaacaccagtaccacacaacagcagacgaccacaacccaggcaagtatcaatctggccacaacttccgccgcccagctcataagcaggagccaatccgtatctagtccatcagctacaacactgacccagtccgtgctgctcgggaataccacctcccccccactgaatcagagccaggcacagatgtaccttcgaccccagctgggtaacctgctccaggtgaatcgcactcttggcaggaacgtgcccttggcatcacagttgattctaatgcccaacggcgcagtcgccgcagtgcagcaggaagtgccaagtgcccagtcacctggcgtgcatgcggacgctgatcaggttcaaaatcttgctgttagaaaccagcaggcctccgcgcagggcccccagatgcagggctctacacagaaggcaattccgcctggcgctagcccagtgagcagcttgagccaagcatcctctcaggccctggcagtggcccaagcctccagcggtgccacaaaccagtctctcaacctgtcacaggccggaggaggaagcggtaactccatacctggatctatgggccctggaggcggcggccaagcccatggtggactcggccaactgccttcctccgggatggggggcggcagctgccctcggaaggggaccggtgtggtgcaacctctccctgcagctcaaaccgtaaccgtatctcagggctctcagactgaggctgagagcgccgccgctaaaaaggccgaggccgatggtagcggacagcaaaatgtgggcatgaatctgactagaacagccacacctgccccaagtcagaccttaatatcctcagcgacctacactcagattcagccgcattccctgatccagcagcaacagcaaatccatctccagcagaagcaggtcgtcattcaacaacagatagcaatacaccaccagcagcagtttcagcataggcagagccagttactgcatacagctacccacctgcaactcgcccagcagcagcagcagcagcagcagcaacagcagcagcagcaacagccccaagcaacgaccttgacagcccctcagcccccccaagtgccccctacccagcaggtgcccccctcccaatcccaacagcaggctcagaccctcgtcgttcagcctatgctgcagagtagcccgctctccctgccccccgacgcggctccgaaaccaccgattcccatccagtctaaaccccctgttgcacccatcaagccgccccaactgggcgcagcgaaaatgagcgctgctcagcagcctccaccccatataccagttcaggtggtaggcacgagacagcccggcactgcgcaggcccaggcgctgggacttgcacaactggccgcagccgtgcctacctcacgcggcatgccaggcaccgtgcagagcggacaggcacacctcgcctcgagtccaccctctagccaggcccccggagcgctgcaagaatgtcccccaacactggctcccgggatgaccctggcccctgttcaaggcaccgcacatgtggtgaagggcggagctacaacctctagtccagtggtagcccaggtgccagccgctttctacatgcagagtgtgcacctccctggaaagccacagacgctggccgttaaacggaaggcagactctgaagaagaaagagatgacgtctctacacttggaagcatgctgccagccaaagccagccctgtggcagagagccccaaggtgatggatgagaagtcatccctcggcgaaaaggcagagagtgtagctaatgtgaacgcaaatacaccgtccagcgaactcgtcgctcttacccctgcaccatccgtgccaccaccaacactcgctatggtgagcagacagatgggagattcaaaacccccccaggccatagttaaaccacaaatcctgacacacatcatcgaaggcttcgtcattcaggagggggccgagcctttcccggttggctgtagccagctacttaaagaatccgaaaagcctttgcagacaggactacctacggggctgaccgaaaaccagagtggaggccccctgggcgtcgacagcccgtccgccgagctggataagaaggccaacctcttaaaatgtgaatattgcggaaagtacgccccggccgagcagttccggggttccaagcggttctgcagcatgacctgcgcaaaacgttacaacgtatcttgttcccatcagttccgactaaaaagaaagaagatgaaggagtttcaggaggctaattatgcccgcgtacgacggagaggaccccgcaggagttcctccgacatcgccagagccaaaatacagggcaagtgccatcgcggtcaggaggactcttctcgagggagcgataattcttcatacgatgaagctctctcgcctaccagcccaggaccgctctcggtgagggcgggtcacggagagcgcgatctgggcaacccaaacactgctcctccaacacccgaactgcacgggattaatccagtatttttaagttctaaccctagccggtggtccgtggaagaggtttacgaattcatcgcatccctacagggctgccaggagatcgccgaagaattcagaagtcaggaaatcgacggacaggctctattactgcttaaggaagagcacctcatgtccgcaatgaatatcaaattgggcccagccttaaaaatctgtgccaagatcaacgtccttaaggagacctag

SEQ ID NO: 12753 - DNA, 3015 bp, Artificial Sequence
  Description of Artificial Sequence: Synthetic coding sequence
atggagaccgagtcggagcagaacagtaattccacaaatggctcttctagctcggggggaagttccagaccacaaatcgctcagatgtcgctctatgagagacaagcagttcaagcactgcaagctctgcagcgacaacccaatgcggcacagtattttcaccagtttatgcttcaacagcaactcagcaacgcccagctccactcactggccgctgtccaacaagctaccattgcagcaagcaggcaagcttcgagtcccaacaccagtactacgcagcagcaaaccactaccacccaggccagcatcaacctggcgaccacgtcggcggctcagcttatttctaggtcacagagcgtgagctctccgtctgcaacaacgctcacccagagcgtactgttggggaacaccacatcccctccactgaatcaatctcaggcacagatgtatcttagaccccagctaggcaacctgctgcaggtgaaccgtacattaggaagaaatgttccacttgcgtctcaactgatcctgatgccaaatggtgcagtagcagcggttcagcaggaagttccatctgcgcagagtcccggtgtgcacgcagatgctgatcaggtgcagaatctggcagtgcggaaccagcaggcgagcgcgcaaggcccccagatgcagggctccacccagaaggcgattccccctggcgcatctcccgtgagctctctgtcacaggccagtagtcaggcactggctgtggctcaggcatcctcgggggctactaaccagtccctgaatctgtctcaggctggcggaggttcaggaaacagcatcccgggcagcatgggccccgggggcgggggccaggcgcacgggggcttgggccagcttcctagttccgggatgggaggcggctcctgtccccggaaaggcaccggtgttgtgcaaccactgcccgccgcccagacagtcactgtgtctcagggatcacagaccgaagctgagtccgcagctgcgaagaaagcagaagctgatgggagcggacaacagaacgttgggatgaatttgacacgcacagccacccccgcccccagccaaactctgatcagctcagcaacctatacacagattcagcctcacagcctgatccagcagcagcaacaaattcatctgcagcaaaagcaagtcgtgatacagcagcagatcgctatacatcatcagcaacagtttcagcatagacaaagccagcttttgcacacagccactcacctgcaactggcgcagcagcagcagcaacagcaacagcaacaacaacaacagcagcagccccaggcgaccaccctgaccgcccctcaacctccccaggtccctcccactcaacaagttcctccttcacagtcccaacagcaggcccaaacactagttgtacagcctatgctacagtccagcccgctgagcctgcctcccgatgcggctcccaagcccccgattcctattcaaagcaaaccccccgtagccccgatcaagccaccacagcttggagctgccaagatgagtgcagcgcagcagccccccccacacattcctgtgcaggtagttggtacgcgacagccaggtacagcccaggctcaagcgctcggtctggctcagctagctgcagctgtcccgacctcacgcggcatgccaggtaccgtgcaatctggccaagcccacttagccagttcccctcccagcagtcaggcccctggagctctgcaggagtgccctccaactctcgcgccaggcatgaccttagcaccagtccaggggaccgcacacgtcgtgaagggtggagccacgacaagcagcccggtcgtcgcccaagtgccagctgccttctacatgcaatccgtacacctgcccgggaaacctcagactctggccgtcaagcgtaaggccgattccgaagaagagagggatgatgtgtcgaccctgggctctatgctgccggccaaggctagccccgtggctgagtctcctaaggtaatggacgaaaaaagcagcctgggcgagaaggccgaatcagtggcgaatgtgaatgctaataccccctcaagcgaactcgtggccctcacacctgccccgtcagtgccacctccaaccctagccatggttagtaggcagatgggtgactcaaagcctccacaggccattgttaagccgcaaatcctcacccacatcattgaaggttttgttatccaggaaggcgccgagccatttcctgtgggatgtagccagcttctgaaggaatctgagaagccattgcagactggactgcccacaggtctgaccgagaaccaatccggaggtcctctgggcgtcgattcacctagtgccgaactcgacaagaaggcgaacctcctgaaatgcgaatattgcggcaaatacgcccccgcagagcaatttagaggatccaagcggttttgttccatgacatgtgcaaagaggtacaatgtgtcctgttcccatcagtttagactgaagcggaaaaagatgaaggagtttcaggaggctaactatgcccgcgttcggcgaaggggtccccggcgttcctcctcagacatcgcacgtgctaaaatccaggggaagtgccacaggggtcaggaggattctagccgggggagtgataattcatcatatgacgaagccttaagccctacttccccgggcccattgtctgtgagggcggggcacggcgagagggatctaggtaatcccaatactgcccctccaacgccagagcttcacggtattaatcctgtgttcctgtcgtccaacccgtctcgatggtctgtcgaagaggtatacgagttcatcgcctctttgcaggggtgtcaagaaatagccgaagaatttcggagccaagagatagatggacaggccctactgctgttaaaagaagaacacctgatgtctgctatgaatatcaagctcggccccgctctgaaaatatgcgctaaaatcaacgtgctgaaagagacatag

SEQ ID NO: 12754 - DNA, 2577 bp, Artificial Sequence
  Description of Artificial Sequence: Synthetic coding sequence
atggagaacgagctccccgtacctcacacatcaagtagtgcttgtgccacatccagcacttctggcgcctctagcagcagtggttgtaataatagttcaagcggaggcagcggccgacccaccgggccccaaatctccgtgtactctggtatcccagaccgtcaaaccgttcaggtaatccagcaggctctgcatagacagccgagcaccgccgctcagtatctacagcaaatgtatgctgcacagcaacagcatctgatgttacaaacagctgccttgcaacagcagcacttgtcctcagcacagctgcagagtctagcggctgttcagcaagccagtttggtaagcaatagacaaggctcaactagcggcagcaatgttagcgcccaggcacccgctcaatctagctctatcaacctcgcggcctctcctgcagcagctcagctgctgaaccgcgcacagtctgtgaactcagccgcagcatccggaatcgcacaacaggcagttctgctggggaacacctcctcgccggcattaaccgccagtcaggcccaaatgtacctcagagcccaaatgctaatttttacccccacggctacggtggccaccgttcaaccagaactgggaactggatcccccgctcgcccgcccacacccgcacaggtgcagaatctgacattaaggactcagcagaccccagccgcagcagcgtcggggccaacccccactcaaccggtgctgccatctctggctctgaagcctactcccgggggatctcaacctttacccactccggctcagagcagaaatactgcccaggccagccctgcaggggccaaaccaggaatcgccgactccgtcatggagccacataaaaagggagacggcaacagctcggtgccgggttctatggaaggcagggctggtcttagtaggacggtgcccgccgtagcagcccatcctctgatcgcccctgcctatgctcagctgcagcctcaccagttgctaccccagccttctagtaagcacctgcagccccagtttgtaattcagcagcagccacagccacagcagcaacagccaccaccccagcagagtagacctgtgctccaagccgagccacacccacaacttgcctcagtctccccgtcagtggcccttcagccatcttcagaggcacacgctatgccattagggcctgtgacccccgccctgcccctgcagtgcccaactgcaaacctgcacaagcctggggggtctcagcaatgtcacccgccgacccccgatactgggcctcagaatggacacccagaaggggtgcctcataccccccagaggagatttcagcacacttcagctgtcattctgcagttgcaacccgcaagtccaccacaacagtgcgtccccgacgattggaaggaagtcgctcctggcgagaaaagcgttccggaaaccagaagcggtccatccccccaccaacaggccatcgtcacagcaatgcctggcggcctgccagtaccgacatccccaaacatacagccgtcccccgcccatgaaactggtcaggggatcgtgcatgcactcacggatctgtcatcacccggaatgacaagcggcaatgggaatagtgcttcttccattgccggtaccgcaccccagaatggcgagaataagcccccccaggcaattgtcaaaccccagatcctgacacacgtcatcgagggcttcgtaatccaagagggcgcggagccatttcccgtggggcgctccagccttctggtgggaaatctaaagaagaaatatgcgcagggcttcctgcccgagaaactcccacaacaagatcatactaccaccacagattcagagatggaggaaccctacttgcaagaatcaaaggaagaaggagcacctctcaagctgaagtgtgaattgtgtggacgggtcgattttgcttacaaattcaagaggagtaagagattttgctcgatggcctgtgccaagcggtataatgtaggctgcactaaaagagtcgggctattccattcagatcggagtaaattgcagaaggcaggggctgcaactcacaatcggaggagggcctctaaagcatcactgccacctctcactaaggatactaagaagcagccaactggaaccgtgcctctttctgtgacagctgcgctgcagctgacacatagtcaggaagactcttcacggtgcagtgataattcgagctatgaggagcccctgagcccgattagtgcctctagctctacgagtcggcgcaggcaaggacagcgggatcttgaactccccgatatgcacatgagagatctggttgggatgggccatcacttcttacccagcgagcctacaaagtggaatgttgaggatgtgtatgagtttattcgaagcctacccggctgccaggaaattgccgaagagttccgtgcgcaggagatcgatggtcaggccctgctcctgttgaaggaggaccacctgatgagtgcaatgaacatcaagctgggtcctgcacttaagatttatgcgagaatttcaatgctgaaggacagttag

SEQ ID NO: 12755 - DNA, 1305 bp, Artificial Sequence
  Description of Artificial Sequence: Synthetic coding sequence
tgtctgcgaggaggttgttctccccgggcccctgctgcaagagcccgccagccccgcccaccccccgccctccctcccaggcctcgggcaccagtacccgcctcacgccccggacggccacttctcacacctgccaggccctgcggaagaatgcgccggggctcccccggaccaagactgggcggtagtcggggcgaacggcgccccgctcgggcgagggatcctgctcgggtggggccaggggaggggctgaggcgccctgcacgtcctggccccgctgggccctggactgagactggtcaggggatcgtgcacgcactgacggacttaagcagcccaggaatgaccagcgggaacggaaattctgcctcgtctatagctggaacagcaccccagaatggcgaaaacaagccaccacaagctatcgttaaacctcagatactcactcatgtcatagaagggtttgttatacaggagggagccgagctctcccggtgggatgctaggctacttgtgggaaatctgaagaaaaagtacgcgcaaggatttttgcccgaaaagctgcctcaacaagatcacacaaccaccactgattctgaaatggaggagccctatctccaagagagtaaggaggagggcgcgccactgaagctgaaatgcgaactgtgcggccgcgtggatttcgcctacaagttcaagcggtccaagagattttgctcgatggcctgcgccaaacgctacaatgttggctgtacaaaaagggtggggctgttccacagcgatcggtcaaaactgcagaaggctggcgccgcaactcacaacagaagacgcccggccaagcctgtgtgtcatcatctgcccagaatcccacgcagcagccagcaggcactctgccctttcagattgctgttgctttgcctcactcactcccaggaggatagctctcgttgctcagataactctagctacgaggagccactgtcgcctatatcggccagttcttccacgtcagctggcgacaaagccagtggaacctggtcctcaccaacatgcatttgcggcacatggtgggcttgggatactacatcttgccaagtgtcgcatcaggtcaatgtggaggacgtttacgagtttattcgatctctgccaggctgtcaggagatcgctgaggagttccgcgcccaggaaattgacggtcaggccttgctgctgttaaaggaggaccatctgatgagtgcgatgaatataaagctgggtccagcgctaaagatttacgccaggatctctatgcttaaagatagttag

SEQ ID NO: 12756 - DNA, 954 bp, Artificial Sequence
  Description of Artificial Sequence: Synthetic coding sequence
atgacgagtggaaatggaaattccgccagttccattgcggggaccgcaccgcagaatggcgagaacaaacccccacaggcaatagtcaagcctcagatactgacccacgtcatcgagggatttgtgattcaggaaggcgcagagccatttcctgtggggcgatcgagcctgctggtggggaatctgaagaagaaatacgcccaagggtttctgcccgagaagctcccacagcaggaccatactaccacaacagatagcgaaatggaagaaccttatctgcaggagtccaaagaggagggcgcccccctcaaactcaagtgtgaactgtgcgggagagttgattttgcctataaattcaagcggagcaagcggttctgcagtatggcttgtgctaagaggtataacgtcggttgcacgaaacgggtgggcctttttcactcagatcgaagtaaactgcaaaaagcaggcgcagcgacccacaaccgacgcagagctagcaaagcgagtctcccccctctgacaaaggatactaaaaaacaaccgaccggtacggtcccgctgtccgttactgccgcccttcagctgacccactctcaggaggacagtagtagatgctccgacaatagttcatatgaagagcctctgagcccaatctccgcttcctcttcaacaagccggcggcgtcaggggcagcgggatctggaactgccagatatgcacatgagggatcttgttggaatgggccatcacttcctgcccagcgagccaaccaaatggaatgtagaagacgtgtatgaattcattcggagcctgcctggactcccatccagcttcccaaagggccatgaaacatcgatatactcattgagtaagcacctgagacattctcgcttccctcagtcgccttctggttcttgcctgtggcctgtgctccgcccccgcccccacctgtag

SEQ ID NO: 12757 - DNA, 972 bp, Artificial Sequence
  Description of Artificial Sequence: Synthetic coding sequence
atgacctcgggcaacggtaacagcgctagctctatcgcgggtactgcaccacagaacggcgagaataagccgccacaggccatagtcaagccgcagatcttgacacatgttatcgaaggatttgtcatccaggagggcgctgagccgttcccagtaggaagaagctctctgttggtgggaaatctgaagaaaaagtatgcgcagggtttcttacccgagaagcttccacaacaggaccatacgacaacgaccgactctgagatggaggagccatacttgcaagagagcaaagaagaaggagcaccactcaagttgaaatgtgagctctgtgggcgggtagactttgcctataagttcaaacgctctaaaagattctgctctatggcatgcgcaaagcggtataacgtcgggtgtacgaagcgtgtggggctatttcatagtgatcgaagcaaactccagaaggccggcgcagcaactcacaatcgcaggagggctagcaaggccagcctgcccccattgaccaaggatacaaagaaacaacccaccggaacagtgcctctctcagtgaccgcggcactgcagctgacccattcccaggaggacagttcaagatgctctgataacagctcctatgaggaacctctctcccctattagcgcgagcagtagcactagccgtagacgtcaagggcaaagagatttggagctgcctgatatgcacatgagagatttggttggaatgggccaccacttcctcccatccgagccaaccaagtggaatgtagaagatgtctacgagttcatccggtctctgcccgggtgtcaggaaattgccgaggaattcagggctcaggagatcgatgggcaggctctgctactgttgaaagaggatcacctcatgtccgccatgaacatcaagcttggaccagccttgaagatctacgcccgtatctctatgctcaaggatagctag

SEQ ID NO: 12758 - DNA, 1395 bp, Artificial Sequence
  Description of Artificial Sequence: Synthetic coding sequence
atgcccctcggccccgtcactcctgcgcttccgctgcagtgtcctactgccaatttgcacaaacctggtgggagtcagcagtgtcatcctccaacacctgatactgggccacaaaatggccatcctgaaggtgtaccccataccccccagcgacgctttcagcacacctctgctgtgatcttacagctgcaacccgctagcccagtgccccaacagtgtgtccccgacgattggaaagaggtcgcaccaggggagaaatctgtgcctgaaacaagaagtggcccctccccacaccagcaggccatcgtgacagctatgcctggcggtcttcccgtccccacctcaccaaacattcagccatctcccgctcatgagacaggccagggcatagtgcatgcccttacagatctgtcaagcccgggcatgacctctgggaacggtaactctgcctccagcatcgctggcacagcaccacaaaacggagaaaataagccacctcaggccatagtgaaaccgcagatcctgacacacgtcattgaaggtttcgtcatccaagaaggtgctgagcctttcccagtggggcgttccagtctcctggtggggaaccttaaaaagaaatacgcacaggggtttctgcctgagaagctgcctcagcaggaccatacaaccaccacagattccgagatggaagaaccatacctgcaagagtcgaaagaagagggcgcaccgttaaagctgaagtgtgaattgtgcggacgcgtagactttgcttacaagttcaaaagaagcaaaagattctgctcaatggcatgcgcaaagagatataatgtgggctgtacaaagcgcgttggtttattccatagcgaccggtctaaacttcaaaaagctggggccgcaacccacaataggcgtcgagccagcaaggccagcctgccccccttaacaaaagacacaaaaaagcagcccactggaactgtgcctctgagtgtcaccgcggccctgcagctgactcattcacaggaagactctagtagatgctccgataacagctcctatgaagaacctctctccccaatttcagccagctcgtctacaagcaggcgccgccaagggcagagagacctggaactcccggatatgcatatgagggacctcgtaggcatgggacaccactttttaccgtcagagcccacaaagtggaatgtcgaggatgtgtatgaatttattagaagcctgcccgggtgtcaggagattgcggaagaattccgtgctcaggaaattgatggtcaggctctacttctcctgaaggaggaccatcttatgagcgcaatgaatataaagctgggccccgccctgaagatctacgcacgcatcagcatgttgaaggactcctag

SEQ ID NO: 12759 - DNA, 2580 bp, Artificial Sequence
  Description of Artificial Sequence: Synthetic coding sequence
atggaaaacgaattgcccgtccctcatactagttcttcggcctgtgcaacctcgagcacctctggggcttcttccagcagcggatgcaacaattccagctccggtggttctgggcgcccaacaggcccacagataagcgtctatagcggcattcctgacaggcagaccgtgcaggtaatccagcaggcccttcacagacagccaagcacggcagctcagtaccttcagcagatgtatgctgcccagcaacagcacttaatgctgcagaccgcagcccttcaacaacagcacttatcctctgcacaattgcagtccctcgccgctgtccaacaggcttccctcgtgtctaatagacaaggatccaccagcggaagcaacgtaagcgctcaggcccccgctcagagcagttccatcaatctggccgcctcccctgctgcagcacagctgctgaatcgtgctcagagcgtaaacagcgctgctgctagtggcatcgcacagcaggctgttctgctcggaaacacatcaagtcccgccctgactgccagccaggcacagatgtatctgcgcgctcagatgctcatttttacacctacggcaaccgttgcaacagttcaacccgagcttgggacagggtcccccgcaaggcccccaacacccgctcaggtgcagaacctcaccctgaggactcagcaaactcctgctgctgccgcttccggaccgacaccaacgcagccggtgctcccttcactcgcactcaagcccacccccggaggcagccagcccctgccaactccagctcagagcagaaacaccgctcaggcatccccagccggtgccaagcctggtatcgctgactccgttatggagccacataagaaaggagatggtaactcaagcgttcctggatccatggaaggtagagctggcctgagcagaactgtgccggctgtcgccgctcatcctctgatcgccccagcctatgcccagttgcagccacatcagctgcttccgcaaccttctagtaagcacctgcagccccagtttgtaatccagcagcagcctcagccgcagcagcagcagcctccaccccagcaatctaggcctgtgctccaggctgaacctcacccgcagctcgcgagtgttagtccatcagtggcactgcaaccaagctccgaggcacatgccatgcccctcggccccgtcactcccgctttgccattacaatgccctactgctaacctgcacaagccaggaggatctcagcagtgtcatccaccgactccagataccggaccccagaacggccaccccgagggagtgccccacaccccacagaggcgcttccagcacacgtcggcagttatcctacagctgcaacccgctagcccagttccacagcagtgcgtgcctgatgattggaaagaggttgcacccggtgagaaatccgtgcccgaaacgagatccggtccgtctccccaccagcaggctattgttaccgctatgccaggcggacttccagtgcccaccagccctaacatacagccttccccagctcatgagaccggtcaaggtattgtgcatgctctcaccgacctgagttctcccgggatgaccagcggcaatggaaactccgcttccagcattgctggaacggccccacaaaatggggaaaataagccacctcaggccatcgtgaagcctcagatcttaacccacgtaattgaaggtttcgtgatacaagaaggtgctgaaccattcccggtaggacgatcttccctgctggtggggaacctgaagaaaaagtatgcccagggctttctgccagagaaattgcctcagcaggaccatacaactactaccgatagtgagatggaggaaccctacctgcaagaaagcaaagaggagggcgcccccctgaagctgaagtgcgaactgtgcggacgggtggacttcgcctacaagttcaagcgaagcaagcgattctgctcaatggcctgcgctaaaagatataacgtgggttgcaccaagagagttgggttgtttcatagtgatcgatccaaactacagaaagctggcgccgcaactcacaatagaaggagggcaagtaaagccagcctgccccccctgaccaaagataccaagaaacagcccactggaaccgtgccactttcagtgaccgcagcccttcagctaacccacagccaggaagattcgagccgctgttcagacaattccagttacgaggagccactcagtcctatttcagcaagctcctccaccagccgccgacgccaaggacagagagacttagagctcccagatatgcacatgagagacctagtggggatgggccaccattttctcccatcagagccaactaaatggaacgtggaggacgtctatgaatttattcggagcctgcctgggtgccaggagattgcagaagagttcagagcccaggagatcgatgggcaggccctgctgctgctgaaagaggaccatctgatgtcagctatgaatataaagcttggcccagccttgaagatatacgcacgcatttccatgctcaaagattcgtag

SEQ ID NO: 12760 - DNA, 2490 bp, Artificial Sequence
  Description of Artificial Sequence: Synthetic coding sequence
atggagaatgaactgcctgtgccccacacatcaagctccgcgtgtgccactagctccacctcaggagcaagtagctctagtgggtgcaacaactcctctagtggtggaagcggccggcccaccgggcctcagattagtgtgtactcaggtatacccgatcgccagactgtgcaggtgatacagcaggccctgcatcgacagccatcaactgcagcccagtatcttcagcagatgtacgcagcccaacagcaacatctaatgctgcaaaccgccgcactgcaacagcaacacctaagttccgcccaacttcagtcactggcagcagtccagcaggctagcctggtgtcgaatagacaaggatctacttctggctccaatgtgtcagcccaagcaccagcccagagtagtagcatcaacctcgctgcctcccctgctgcggctcagctactgaaccgggcccagagtgtcaactccgccgccgcctcaggaatcgcccagcaagctgtgctccttggaaacaccagtagcccagccctgactgcaagtcaggcccagatgtacctgagggcccagatggtgcagaacctcaccctgcgcactcagcagacaccggcggctgccgcttcaggacccactcctacacagcctgtgctgccctctctggctctgaaacccaccccaggcgggtctcagcccctgcccacccctgctcagagccggaacacagctcaggccagtccagccggtgctaaacctgggattgctgattccgtgatggagccgcacaagaaaggcgatggtaactcttcagtgcccggatccatggaaggccgagccggcctgtcacgcacagtgcccgctgtcgctgcccaccccttgattgcgcccgcctacgcccagcttcagccacaccagctgttaccccagccatcctccaagcaccttcagccacaattcgtgattcagcaacaaccccaaccgcaacagcagcagccccctccgcaacagtctaggccggtactgcaggcggagccacacccacagctggcctccgtgtctccctcagtcgcacttcagccttcctctgaagcccacgcgatgcccttaggacccgtcacccccgcactgcccctccagtgcccaactgctaaccttcataagccaggggggtcgcagcaatgtcaccctccaacacccgacacggggcctcagaacggacatccagagggtgtgcctcacaccccgcagagacgattccaacacacaagcgcggtgatcttacagctgcagcctgcaagtcccccacaacaatgtgttccagacgattggaaagaggtcgcaccaggcgaaaaaagcgtcccagaaacccgcagcggaccctcccctcaccagcaggctatcgttactgccatgcctggcggcctgccagttcctacatcgcccaatatccagccctctcccgctcacgagaccggccagggtatcgtgcacgctcttactgatcttagttcaccaggcatgactagtgggaatggcaatagcgcgagcagcatcgcagggaccgcccctcagaatggagagaacaagcccccacaagccatcgtgaagccccagatccttacacatgtgatcgagggttttgtgattcaagagggagcagagcctttccccgtgggtcggtcctcattgctggtcggaaacctcaagaagaaatatgcccagggattcttgcctgaaaaactgcctcagcaggaccacaccactactaccgacagcgaaatggaagagccatacctccaggagagtaaggaagagggggctcctctgaagctgaaatgtgagttgtgcgggagagtggattttgcctacaaattcaaaaggtctaaaagattctgctctatggcctgcgcaaagaggtataacgttggatgcactaagagggtgggactcttccattccgatcgatccaagttgcaaaaggccggggccgccactcacaataggaggcgcgcttcaaaagccagcctccctcctctcaccaaggacactaaaaagcagccgaccgggaccgtcccactctccgttaccgcggcattacagctgacccactctcaggaagatagtagccggtgttctgataactcatcatacgaggagcccctgtcaccaatttcagctagctcttcaacttcacggcgccggcaaggccagagagacctcgagctcccggatatgcacatgcgcgatcttgtcggtatggggcaccactttttgccttctgagccaaccaagtggaacgtcgaggatgtttatgaattcattcgcagccttccaggctgccaggagattgcagaggagtttagagcacaggaaattgacggacaggccctgctcttactcaaagaagaccacctaatgtctgccatgaacattaagttaggacctgccctcaagatctatgctcgaatatcaatgctcaaagattcatag

SEQ ID NO: 12761 - DNA, 561 bp, Artificial Sequence
  Description of Artificial Sequence: Synthetic coding sequence
atggatacagagcccaaccccggtacatcctccgtcagtacgacaacatccagcactacaactactacaattaccacttcctcaagcaggatgcaacaaccgcagatcagtgtgtactcagggtccgatcgacacgccgtgcaggccctccataggccacccagttcagccgcccagtatctgcagcagatgtatgccgctcagcagcagcacctgatgctgcatacggctgctctgcagcagcagcacctgtcatcttcacaactccagagcctagcggcagtccaggctagcttatcatctggaaggccctcaacctcgccaaccggctcagtgacccagcagagtagcatgtcccagacttccattaacctcagcacctcacccactccagcccagcttatatcgcgatcgcaggcctctagcagcacctcgggttccatcacccagcaaacaatgctgttaggctcgaccagtcctactctgaccgcaagccaagctcagatgtatcttcgggctcagatggtcaggtatgaacttccgaacttcttttcagtgtag

SEQ ID NO: 12762 - DNA, 744 bp, Artificial Sequence
  Description of Artificial Sequence: Synthetic coding sequence
atggccgaggcagaatttaaagatcatagcacagccatggacaccgagccgaatccgggaacctcgagcgtgtccactacaacctcatcgaccacaaccaccaccattactaccagttcttcacgcatgcaacagcctcagataagcgtctacagcggcagtgatcgtcacgctgttcaggtgatccagcaagctctgcatcgaccccctagcagtgctgcccagtatctgcaacagatgtacgccgctcagcagcagcacctcatgctccacactgctgccctgcaacaacagcatctttcctcttcacagcttcagtccttagccgctgttcaggccagtctttcatccggaagaccttccacatctccaactggaagtgtgacccagcagagttctatgagtcagacctcgatcaacctgagtaccagtcctacaccggcccagcttataagcaggtcgcaggcctcctcctccacctcaggttcaatcacccagcagacgatgcttctggggtcaacaagccccacactgaccgccagtcaggcccagatgtatctacgggcccaaatgctgattttcaccccagctaccaccgtggcagcagtccagagtgatattcctgtggtgagcagtagctcaagttcctcttgccagtccgctgcaacccaggtgcagaatctgactctgcgtagtcagaagctcggagttctgtcaagctcccagaacggccctccaaaatag

SEQ ID NO: 12763 - DNA, 444 bp, Artificial Sequence
  Description of Artificial Sequence: Synthetic coding sequence
atggctgaggccgagtttaaggatcattctacagccatggataccgaacctaacccaggaacaagctccgtgtctactactacttcttcaactacaaccactaccatcacgaccagctcctcacgaatgcagcagcctcagatcagcgtctatagtggctcagatcgtcacgccgtgcaggcacttcaccggccaccctcatccgccgctcagtatctgcaacagatgtacgccgctcaacagcagcacctgatgcttcacaccgccgcgttacaacaacagcacctgtcatcttcccaactccagtctttggccgccgttcaagcaagtttgagtagcggtcgtccttctacaagtcctaccgggtctgtgacccagcagtcatctatgagccaaacttcagtcagctccctgaacttcttttttctcgatctgaagttctag

SEQ ID NO: 12764 - DNA, 486 bp, Artificial Sequence
  Description of Artificial Sequence: Synthetic coding sequence
taacgttggaacagaaagcccgataaccagtctctgggccatcgcggacgccgcccctctgggcccgacggggcagccagagagcatatcttaagacaactgcctattacctatccttcagcagaggaggatctagcctcacacgaagacagtgtacccagtgcaatgacaacgcggctgcgccgacaaagtgaacgagagagagagcgcgaattgcgcgacgtaaggatccgcaagatgcccgagaactccgatttattacccgtagctcaaactgagccctccatctggacagtggatgacgtgtgggccttcatacattccctcccgggatgccaggacattgccgatgagtttcgggcacaagagatcgatggacaggcattattgctgctcaaagaggatcacctaatgtccgccatgaacattaagctggggcctgccctgaagatatgtgcaagaattaacagtctgaaagagtcttag

SEQ ID NO: 12765 - DNA, 2952 bp, Artificial Sequence
  Description of Artificial Sequence: Synthetic coding sequence
atggatacagagccaaatcctggtacttctagtgtgtcaaccaccacctctagtactactaccacaactattactacctcctcatcaagaatgcagcagccacagatttcagtctacagcggaagcgatagacacgctgtacaagtgatccagcaggcgctgcataggccgccatctagtgccgcacagtacctccagcagatgtacgcagcccagcagcagcaccttatgctccataccgccgccttgcagcagcagcacctgtcatcctctcaattgcaaagcctggcagctgtgcaggcctccctgtcatctggcagaccctcaacctcgccaaccggctcagtcacccagcagtcctctatgagtcaaacgtccatcaacctttctacctcccccactccagcccagctcattagcagaagtcaggcaagctcttccaccagtggttcgattacacagcaaaccatgctcctgggcagcactagcccgaccctgacagcctcacaggctcagatgtacctgagagcacagatgctgattttcacccccgcgaccactgtggctgctgtgcagtcagacattcctgtggtttctagtagctctagctcttcttgtcagagtgccgcaacacaggtgcagaatctgacgctgcgaagtcagaaactgggtgtcctctcctcctcccagaacggtccacctaagtcaacatcccagacccaatcactgacaatctgccacaataagacaactgtcacaagtagtaaaatttcacagcgcgacccatcacctgagagcaacaaaaaaggcgagtctccttccctggagtctaggtctactgccgtgacaagaacctcctcaattcatcagctcattgcacccgccagctacagccccattcagccccattctctcataaagcaccagcagattcccctccattccccacccagtaaggtgtcccaccatcaacttatcctgcagcagcagcagcagcagatacaaccaatcacactgcagaatagtacgcaggaccccccccccagtcagcactgtatccccctgcagaaccatggcctaccccccgctccctcaaacgcgcaaagtcaacactgttcccccatccaaagccacccttcccccctaacagtcagtcccaatcagagtcagagcgcccaacagtctgtggtcgtctcacccccacccccacactcacctagccaatcccctactatcatcatccacccacaagcactgattcagccccatcctttggtctctagtgcgttgcaacctgggcctaacctgcagcagtcgacagctaatcaggtgcaagctaccgcacagctcaacctgccttcacacctgccgcttccggcatctcctgttgtacacatcggtcccgtgcagcagtctgccctggtcagcccgggccagcagatcgtctcaccttcacaccagcaatattcctccctgcagtctagtccgataccgattgcatcgcccccacagatgtctacaagtccccccgctcaaatccctcccctcccacttcagagcatgcagtctctacaagtgcaacccgagatcttaagtcaggggcaggtgctggtccagaatgctctggtttcggaggaggaattgcccgctgccgaagccttggtacaactacctttccagacactgcccccgccccagacggtggcggtgaatctccaggtgcagccccccgcccctgtcgatcccccagtggtgtaccaggtggaggatgtctgtgaagaggaaatgccagaggagtcagacgaatgtgtaagaatggatcgcacgcccccacctccaacgttgagtcctgcagccatcaccgtgggacgtggagaggatctgacaagtgaacaccccctgctggaacaggttgagcttccagctgttgctagcgtttctgcaagcgtgattaagtccccttctgatcctagccacgtttctgtccccccaccgccccttctgttgcccgcagcaacaacgaggagtaacagcacatccatgcacagctccattccttctatcgaaaacaagccgcctcaggctatcgtcaagccacagatcctgacacacgtgatcgaggggttcgtcattcaggagggcctggagccctttccggtaagccgatccagccttctaatcgagcagccagtgaagaagaggcctctgctcgataaccaggtgataaactccgtctgtgtccagcctgagctacagaataacacgaagcatgccgacaattcttcagataccgaaatggaggatatgattgctgaggagactctggaggagatggacagcgagttgctgaagtgcgagttttgcggcaagatgggctacgccaacgaatttttgaggagtaagagattctgtaccatgagctgtgctaaacgctacaacgtgtcctgttccaagaaattcgccttaagccgatggaatcgcaagccagacaaccagtcactgggacacaggggcaggaggccttcaggacctgatggagctgcgagggaacatattctcagacagctccctatcacttaccctagcgcagaggaggacctggcatcacatgaggacagtgtgccgtctgccatgactactaggctccggcgtcagagcgaaagggaacgtgagcgagaattgagagatgtgagaattaggaagatgcccgaaaactcagatcttctgccagtggcccagacagaaccttctatttggacagtagatgacgtctgggcttttattcacagcctgcctgggtgccaggacatcgctgacgagttcagagcccaggagatcgatgggcaggccctcctgctgctgaaggaggaccatctgatgtctgcaatgaacatcaagctcggtccagctctgaaaatttgtgcgaggatcaattctcttaaagaatcttag

SEQ ID NO: 12766 - DNA, 2988 bp, Artificial Sequence
  Description of Artificial Sequence: Synthetic coding sequence
atggcggaagccgaatttaaggaccatagtaccgcgatggatactgagccaaaccctggaacctctagtgtgagcaccacaacctcatccacaactacaactacgatcacgacttcgtcttccaggatgcagcaaccgcagatcagcgtctactctggatctgaccgacatgctgtgcaggtgattcagcaagcattacatagaccgccaagctccgcagcgcagtacctgcaacagatgtatgctgcccagcaacaacacctaatgctgcacactgctgctctgcagcagcagcacctgtcctcaagccaactgcagtctctggccgccgtgcaggctagtctgagtagcgggaggccatccacctccccaaccgggtcagtgacccaacaaagcagcatgagccagaccagtattaatctttcaacctctcccacccctgcacagcttattagtaggtctcaggcaagttcgagtacatccggttcgatcacgcagcagactatgttgttgggatctaccagccctaccctgacagcttcgcaggcccagatgtaccttcgtgctcagatgctgatcttcaccccggcgacaacagtcgccgccgtgcagagtgacattccagtggtgtcaagtagctctagtagcagttgccagtccgccgccacacaagtacagaatctgacgctcagatctcaaaaactcggcgttttgagctctagccaaaatgggccaccgaaaagtacaagccagactcagagcttgaccatttgccataacaagaccacggtgacatctagtaagatctctcagagggatccatcaccagaaagcaataagaaaggcgagtctccaagtctagagtcaaggagtaccgccgtaaccaggaccagtagtatacatcagttaatcgcaccagctagctacagtcccatccaaccacactccctcatcaagcatcaacaaattccgctacatagtccacctagcaaggtgtcccaccaccagcttatactgcaacaacagcaacagcagatacagccaatcaccttgcaaaattccacacaggatccacctccatcccaacactgcatccctctacagaaccacggactccctcccgcaccatcaaatgcacagagccagcactgctctcctatccaatcgcacccctccccgcttactgtttctcctaaccagagccaaagtgctcagcagtcagtggtggtgagcccccccccaccacatagccccagccagtctccgacaatcatcatacatcctcaggctctgatccagcctcatcccctcgtgtcctcagccctccagcccggacctaacttacagcagtcaacagccaatcaggtgcaggccaccgcacagttgaaccttccctcccacctgcctttgcccgcttccccagtggtgcacatcggccccgtacagcagtccgcattagtgagtccaggccaacagatcgtctctccttctcatcagcagtacagctctcttcagtctagtcccatccctatcgcttctccgccccagatgagcacatctccaccggcccagatcccccctcttcccctgcagagcatgcaatctttacaagtacaacccgaaatcctgtcccagggccaggtccttgtgcaaaacgccctcgtatccgaggaggaattgcccgctgcagaggcgctagtgcaactgcctttccaaacattgccccccccccagacggtggctgtcaacctgcaggtgcagcccccggcgcccgttgacccccccgtggtctatcaggtggaggacgtctgcgaggaagagatgccagaggagtcagacgaatgtgtccggatggacaggacccctcctccccccaccctgtcacctgctgctatcaccgtgggacggggcgaggatttgacaagcgaacacccactactggaacaggttgaactgcccgcagtggcctccgtttcggcttctgttatcaagtcgccatcggatccaagtcacgtgagtgtgccacctccacctttgctgctccccgcagctactacccgctcgaattccaccagcatgcattcctctatcccgtcaattgagaacaaaccacctcaagcaatcgtgaagccgcagattcttacccacgtgatcgagggattcgtgattcaagaagggcttgagccatttcccgtgagcaggagctctcttctgatcgagcagccggtgaagaagcggcccctgcttgacaatcaggtgattaactcagtctgtgtgcaaccagaactgcaaaacaatactaagcatgccgacaacagctctgacaccgagatggaggatatgatcgctgaagagacactcgaggagatggactctgaactgctgaagtgcgaattctgtggaaagatgggctatgccaatgagtttctgaggtctaaacgtttctgtaccatgtcatgtgccaagcgatacaatgttagctgttctaagaagtttgcgctatcccggtggaacaggaagccagataatcagtctctcgggcatagagggaggcggccatcaggacccgatggcgctgcccgcgagcacatcctcagacagcttcctataacttacccttcggccgaggaggatttggcttcacacgaagacagtgtcccgtctgctatgacaaccaggctgagaagacagagtgaacgagagagagagagggagctcagggatgtgcgcattcggaagatgcccgaaaactccgacctgcttcccgttgctcagacagagcccagcatttggacggtggacgatgtctgggccttcatccactcccttcccgggtgtcaggatatagccgacgaatttcgggcccaggagattgatggccaggctttgctgctgctgaaagaggatcatttgatgtcagcgatgaacattaagttaggacctgcgctaaagatctgtgcacgcatcaatagtttgaaggagtcatag

SEQ ID NO: 12767 - DNA, 456 bp, Artificial Sequence
  Description of Artificial Sequence: Synthetic coding sequence
atggctgaggcagaattcaaggaccacagcaccgcaatggatacggaaccaaatccgggcacctcatccgtgtctacaaccactagcagcactaccaccaccactatcacaacgagctcctcccggatgcagcagcctcaaatctctgtttactcgggcagtgaccgccacgctgtgcaggtgattcagcaagctctccatcgtcctccgtctagcgctgctcagtacttgcaacaaatgtacgccgcccagcagcagcatctgatgcttcacaccgcggcccttcagcagcagcacctgtctagctcccagttacagagcctggccgccgtccaggcatcactgtccagtgggagacccagtacatcccccactggatcagtgacccaacagtctagcatgtctcagactagcgtttctagtttgaattttttctttcttgacctcaaattctag

SEQ ID NO: 12768 - DNA, 1797 bp, Artificial Sequence
  Description of Artificial Sequence: Synthetic coding sequence
atgtctgcttctgcccagcagctggctgaagagttacagatcttcgggctcgattgcgaagaggcccttattgaaaagttggttgagctgtgcgttcagtatggtcagaatgaggaggggatggtgggagaactgatcgccttctgcacatcaactcacaaggtcggactgacaagcgagattctgaactcattcgagcatgagtttctttctaagcggctgagtaaggcaaggcactccacatgtaaggatagtggtcatgctggcgctcgtgatattgtgtctatacaggaacttatcgaggtcgaagaggaagaggagattttactcaatagctacactactcctagtaaaggctcccagaagcgcgccattagcactccggaaacgcctcttacaaagaggtcggtgtcaacacgctcgcctcaccagttgctgtccccaagtagtttcagccccagcgcgaccccttcacaaaaatataacagccgtagcaacaggggcgaagtggtgacttccttcgggcttgcccagggggtgagctggtctgggaggggaggagccggcaatatcagcctgaaagtcctaggatgtccagaggctctcacaggcagctataagtcaatgtttcagaaattacccgatatcagggaagtactcacatgcaagatcgaggagctggggtctgagctgaaggagcactacaaaatcgaggctttcactccgctgttagccccagcccaagagccagtaacacttctcgggcagatcggctgtgattctaacggcaagctcaataataagtctgtaatcttggagggtgatcgggagcacagtagcggagcccaaattcccgtggatctgtctgaactcaaggagtactcactgtttcccggccaagtggtcattatggagggcattaacaccaccggccggaaattagtggcaacgaagttatacgaaggagtgccattgcctttttaccagcccacagaggaagatgctgacttcgagcagagcatggtcctcgttgcctgtggtccctacacgacatccgattctatcacatatgatccattgctggacctgatcgctgtcatcaatcatgacaggcctgacgtttgcatcctttttggcccattcctggacgctaagcacgaacaggtcgagaattgcctcctgacctccccatttgaggatatcttcaagcagtgtctgcgaaccatcattgagggcacaaggtcctccggtagccacctcgtttttgtcccgtcgctgagggacgtgcatcatgaaccagtctaccctcagcctcctttctcttactccgacctctctcgagaagacaagaagcaagtgcaatttgtgagcgagccatgttcattgtctatcaatggtgtaatctttgggctcacctccaccgacctgctcttccacctgggagccgaggagatcagttccagctctggcacttctgatcgcttttcccgtatcctcaaacacatcctcacacagagatcttactatccattgtatcctccgcaggaggacatggccatcgattacgagagtttctacgtgtatgcccagctgcctgtgacacccgacgtactgatcatcccttcagaattacgctatttcgtcaaagacgtgttgggctgcgtttgcgttaatcccggtcggctgactaaagggcaagtgggaggcacatttgcccgcctgtacctccgtagaccagctgccgacggagcagaacgccagtcaccttgcattgctgtgcaggtggtccgcatctag

SEQ ID NO: 12769 - DNA, 1086 bp, Artificial Sequence
  Description of Artificial Sequence: Synthetic coding sequence
atgtttcaaaaactgcccgacatcagagaggtgttgacctgtaaaatcgaggagctgggatctgaactaaaagaacactataagatcgaggccttcacacccctgctggcaccagcccaggaaccagtcacacttctggggcagatcgggtgtgacagcaatggcaaactgaacaacaagagcgtcatcctggagggggatagagagcatagctcgggcgcacagattccggtcgatttaagtgagctgaaggaatacagcctgtttcctggacaggttgtcatcatggagggaattaacactaccggacgaaagctcgtcgcgactaaattatacgagggcgtccctctgccattctaccagccaacagaggaggacgccgatttcgagcagagtatggtccttgtggcttgtggcccctatactacatctgacagcatcacttacgatcccctgctagatcttatcgcagttattaatcatgataggcccgatgtttgcatactctttgggccctttttagacgccaagcatgagcaggttgaaaactgccttctaacttcacccttcgaggatatattcaaacagtgtctgcgtacaataattgaagggacccggagttctggcagtcacctggtgtttgtcccttcattgcgcgatgtgcatcacgaacccgtctacccacaacccccattcagttacagcgatctgtcccgagaggacaagaaacaggtgcagtttgtttcggagccgtgttctctgagtattaacggagtgatctttggcctgaccagtacagacctcctatttcatctgggagccgaggagatttcgtcatcatctggtacaagtgatcgcttttctcggattctaaagcatattctaacccaacggtcgtactatcctctttaccctccacaggaggatatggccatcgactacgagagtttctatgtctatgctcagttgcctgtgacccccgacgttttgatcattccatccgagctaagatattttgttaaggtggggctgaactctgccttctcccagaaacatcagaaccctgttttcgactttcccttctag

SEQ ID NO: 12770 - DNA, 1485 bp, Artificial Sequence
  Description of Artificial Sequence: Synthetic coding sequence
atgttgccaaaacggcgacgggcccgcgtcggatctccttcgggagacgctgctagcagcacccctccgtccacgcgctttcctggtgtggccatatacttggtggagcccaggatggggagaagcagacgagctttcctcaccggcctagccaggagcaaggggtttcgtgtgctggacgcgtgttcctctgaagccacccacgtcgtgatggaggaaacatcagccgaggaggctgtgtcctggcaagagcggcggatggcggcagccccccccggctgtactccaccagcacttctggatattagttggctgactgagtccttaggtgctggccagccagtgcctgtcgaatgcaggcacaggctagaagtggccggtcctagaaaaggacccctctcaccagcctggatgcccgcgtatgcctgtcagcgcccaacaccacttactcatcacaatacaggtctgagtgaggctcttgagatcttggcagaggcagctgggttcgagggatccgaggggagacttctgactttctgcagagcggcttctgttcttaaggcgttaccgagcccagtgaccacactgtctcagctgcagggcctgccccactttggggaacacagctcccgagtcgttcaggaactcttggaacacggcgtgtgcgaagaggtcgaaagagttcgaagatcagagaggtaccagacaatgaagctgttcacccagatcttcggtgtgggcgttaagacagccgatcggtggtatcgggagggactgcggacactcgatgatctcagggaacagccccagaaactgacccagcagcagaaagctggcttacagcatcatcaggatctgagcactccagtgctgcggtccgatgttgacgccctgcaacaagtcgtagaggaagcggtgggacaggccttgcctggtgcgaccgtgacactcaccgggggcttcagacgggggaaactgcagggacacgatgtggatttcctaatcactcaccctaaggagggccaggaggcaggactgcttccaagggtcatgtgtaggctgcaggatcaaggactgattctctaccatcagcatcagcatagctgttgtgaatcacccaccagactcgctcagcagtctcacatggacgccttcgagcgctctttttgtattttcagactaccccagccccccggtgctgccgttggcggctctactcgcccatgtcccagttggaaggccgtgagagtagacctggtcgtggcgccggttagccagttcccattcgcactgcttggttggaccggatctaagctgttccagcgagagctgagacgcttttccagaaaagaaaaggggctttggctcaatagccatggcttgtttgatcctgaacaaaagacgtttttccaggccgccagcgaagaggatattttccgccatctcgggctcgaatacttgcccccagagcagcgcaacgcttag

SEQ ID NO: 12771 - DNA, 1374 bp, Artificial Sequence
  Description of Artificial Sequence: Synthetic coding sequence
atgctgcccaaacgtagacgtgctagagtggggagcccgagcggtgatgcagcgtccagtacgcctccctcaactcgattccctggtgttgctatctatctagttgagccaaggatgggccggtcccgccgagctttcctgaccggactcgcccgctctaagggatttcgtgtcctcgacgcctgtagctcagaggccactcacgtggttatggaagaaacgtctgccgaggaggcagtgtcctggcaggaacgtcggatggctgcagcccctcctggttgcaccccacccgccctgcttgatatctcctggctgacagaaagcctcggtgcgggtcagcccgtccccgtagagtgcaggcacaggctggaagtggcaggcccgcgcaaagggccacttagtccggcctggatgcccgcctatgcttgtcagcgccccactccattgacacaccataacacaggactgtccgaggctctagagatcttagccgaggcagctggcttcgaaggctcagaaggccgtctgctcacgttttgcagggccgcctctgtgttgaaagccctgccttcacccgtgacgaccctttcccagctgcagggcctaccacacttcggggaacactcttctcgagtggtgcaggagctgctggagcatggagtgtgcgaggaggtggagcgcgtaagaaggagtgaaagataccaaaccatgaagttgtttacccagatttttggcgtgggcgtgaagaccgctgatcgctggtatcgggagggactgcggacactcgacgatctgcgcgagcaaccgcaaaagctgactcaacaacagaaggctgccccaccaggaccagagcatccttctcctgcagttagatgccgctgccccgccgccggcggcggagggagctgcggagccggccctgcatggggacaccgacacgccgataggcgccttcctcagggactcattttgtaccatcaacaccagcatagctgctgcgaatcaccgactagactcgcacaacaaagtcacatggacgctttcgagaggagcttctgtatttttcgcttgccacagcccccaggtgctgccgtaggcggctccacccgaccctgcccttcttggaaagctgttcgggtggatctggtcgtcgctcctgtgtcccagttcccttttgccttgctgggctggactggatcaaagctttttcagagagaactcaggaggttttcaagaaaagaaaaggggctttggctgaatagccatggactgttcgaccccgagcagaagacattctttcaagcggcctcagaagaagatattttccggcatctgggactggagtatctcccccccgaacagaggaatgcatag

SEQ ID NO: 12772 - DNA, 1527 bp, Artificial Sequence
  Description of Artificial Sequence: Synthetic coding sequence
atgctgccaaaacgtaggcgggctagagtcgggtctccatcgggtgacgccgcaagttctactccaccgagcacccgctttcctggagtcgccatctatctggtggaacccagaatgggccggtctaggagagcattcctgactggccttgctaggtccaaaggtttccgcgttttggatgcctgtagttccgaagcaacacacgtagtgatggaggagacatcggctgaggaggctgtctcatggcaggagagaaggatggccgcagctccacctggatgtacccctccagccttgctggatatttcgtggcttacggaaagtctcggcgccggtcagccggtccccgtcgaatgcaggcacaggttggaggtggcggggcccagaaagggtcctctgtcccccgcatggatgcctgcttacgcttgtcaacgtccaacgcctttgacgcatcacaacaccggcttgagcgaagccctagaaatactggctgaagcggcaggatttgagggctccgaggggcgcttgctgactttttgtcgtgctgccagtgtactgaaggcgcttccaagccctgtgacgacattaagccagttacagggactgccccacttcggagaacactcaagccgggtggtccaggagctcctggagcatggagtgtgcgaggaggtggaacgtgttaggcgatccgagcgcgctccggcaccgccaggcccagagcatccctccccagccgttaggtgccggtgccctgccgcgggcggcgggggcagctgcggtgctggccctgcgtggggacacaggcatgcggacagaaggcttcctcagggtctcattctttaccaccagcatcagcattcgtgttgtgaatcccccacacggttagcacaacagagccacatggatgcattcgagcgaagtttttgtattttcaggctacctcagccgcccggagctgccgttggcgggagcacacgcccctgccccagctggaaagccgtgcgagtcgacctggtggttgcgccagtgagccagttcccgttcgctcttttaggatggacaggctctaaacttttccagcgggaactccgcaggttctctaggaaggaaaaaggcctgtggctgaattctcacggccttttcgaccccgaacaggggtcaagttcgggcaaaaccccccgaagtcgaaaaagctgtttctgctgcaggcgacattttagcaagagactgcagaggaagacctcgtcagacacatgggccctgtccactttcctgcagagtagggagaccccagaaccagcctgcgtgccacatttccattcgggaaattgggccgcacccaatttggccacggagtgtctgcaagcagatatgctgccgcctgacccccacctccatccatccccaccaagacccggaagctctggaggccagctttgtctgcaggatcagctttcaccatgctggtgcgccgcgggctgcgacgaagtgggggccctgtcagcctccttaatcactgtttag

SEQ ID NO: 12773 - DNA, 480 bp, Artificial Sequence
  Description of Artificial Sequence: Synthetic coding sequence
atgctccccaaaaggcgtcgcgcaagagttggcagtccttctggggacgcagcttccagtacacccccgagcaccagatttcccggtgtggccatttacctggtagagccccggatgggcagatctcgaagagcattccttaccggtctggcccgctctaaaggttttagggtcctcgatgcttgcagctccgaagccacccacgtggtaatggaagaaacctccgcagaagaagctgtgagttggcaagaacgcaggatggccgcagcacctcctgggtgtacacccccagccctcctcgacatctcatggctgactgagagccttggcgcaggtcagcctgtgccagttgaatgtcgtcatagactagaggaggcactggagatcctggctgaagcagcagggtttgagggcagcgaaggaagactccttactttctgtcgcgccgcgtccgtgttaaaagcattgccctccccgtag

SEQ ID NO: 12774 - DNA, 729 bp, Artificial Sequence
  Description of Artificial Sequence: Synthetic coding sequence
atgctgcctaagaggcgccgcgcccgagtaggcagcccatcaggtgacgcagcctcttccactccccctagcacgagattcccgggggtggccatttatctggtggagccacggatgggccgctctagacgcgccttcctcaccggactcgcccggagtaaggggttcagagtcttggacgcgtgttcttcagaggcaacacacgtcgtgatggaggagaccagtgccgaggaggccgtttcttggcaggaacgccgcatggccgcggcacctcctggatgtactccacctgctttgctggacatttcttggctgacagagtcacttggcgctggtcagccagtaccagtagagtgtaggcacaggttagaagtggccggcccaaggaagggtccacttagtcccgcttggatgccggcctacgcttgtcagagacctacgccccttacccatcataatacgggactcagcgaggccctcgaaattttagccgaggcagcgggcttcgaaggttccgaggggagattactcactttctgtcgcgctgcaagcgttctgaaagcactgcctagcccagttacaaccctctctcaactgcagggccttccgcatttcggcgaacacagtagcagagtggtacaggagcttctagaacatggagtgtgtgaggaggtggaaagagttcggcgcagtgagtcctcttccccgaggagttcagggagtgtgtag

SEQ ID NO: 12775 - DNA, 813 bp, Artificial Sequence
  Description of Artificial Sequence: Synthetic coding sequence
atgctgccaaagcggcggcgtgctagggtgggctctccatccggtgacgcagctagctcaacgcctccctcaacgagatttcctggggttgcaatatatctggttgaaccaagaatgggccggtccagaagggcctttctgaccggcctggcaaggtctaagggttttcgagtcctcgacgcttgttcaagcgaagccactcacgtggtgatggaggaaaccagtgcagaggaggcggtttcctggcaggaaaggcgaatggccgcagctcctccgggatgcaccccgcctgccctgttggatatcagctggctaaccgaatcactgggtgctggacagcctgtgcccgttgaatgccgacataggctcgaagttgccggtccacgcaagggacctctgtctcccgcctggatgcctgcctatgcctgccaaagacccacccctctgactcaccacaatactggactgtccgaagcgctggagattctggccgaggccgccggcttcgagggctccgaggggaggctgctgacattttgccgcgccgcaagcgtgctgaaggcactccccagtccagtgacaactctgtcacagctgcagggcctgccacacttcggtgagcactccagcagagtggtgcaggaacttctggaacatggtgtttgcgaagaagtggagagggtacgccgctctgagcgataccaaacaatgaaagtaaggagagccggtcttggccctacacccggaatgagctgtcctgggaacgacaacaccgtccacaccatgcatggagaggctaaccggggaagctag

SEQ ID NO: 12776 - DNA, 5163 bp, Artificial Sequence
  Description of Artificial Sequence: Synthetic coding sequence
atgttgatttccaaaaacatgccctggagaaggcttcaaggcatatcctttggtatgtacagtgctgaagagctcaaaaaactatcggttaagagcatcacgaatcccaggtatctggacagtcttggtaacccttccgccaatgggctgtacgatctggcactgggacccgctgatagtaaggaagtctgctccacatgcgtacaggatttttcaaactgctctgggcacctcgggcacatcgagctcccccttacagtgtataacccattactcttcgataagctgtaccttctcctccgcggaagttgtttgaactgtcacatgctgacatgccctagagctgtgattcacctcctattgtgtcagcttcgggtgttggaggtaggggccctccaggctgtttacgagctagagcgcattctcaatcgctttttagaggagaacccggaccctagcgcatcagagatccgggaagagttggagcagtacaccaccgagattgtgcagaacaatctcttgggaagtcagggggcgcacgtgaaaaatgtgtgtgaatcaaaaagtaaactcatagcattattttggaaagcacatatgaacgccaagcggtgtccccattgcaaaactggccgctctgtcgtgcggaaggaacataattcgaagttgaccatcacctttcctgcgatggttcaccggaccgctggacagaaggactccgaacctctgggaatcgaagaggcccagatcggcaaacgcggctacttaacgcctacaagcgccagggaacatttgtcagccctctggaaaaacgaggggttcttcctcaactatttgttttccggaatggacgacgacgggatggaatcacggtttaaccccagcgtgtttttcctggattttcttgtggtccctccgtctagataccgaccagtgtcaagactcggagatcaaatgttcacaaacggacagactgtgaacctgcaagccgttatgaaggacgtagtgctaattcgtaaattactcgctctcatggcccaggaacagaaattgcccgaagaagttgccacgccaaccacggacgaagaaaaggattcattgatcgccattgaccgctcgtttttgtccacccttcccggtcagtcactcatcgacaagctgtataatatctggattcgcctccagtctcacgtcaacatagtcttcgattctgagatggataaactgatgatggacaaatatcccggtataaggcagattcttgaaaagaaagagggcctgtttaggaagcacatgatggggaaacgtgtcgattatgctgcacgaagcgttatttgtcccgacatgtacatcaacacaaacgagattggcattccgatggtcttcgctacaaagctgacttacccacagccagtgaccccttggaacgtccaggaactgcgtcaggccgtgattaacggaccaaacgtacaccctggggctagcatggtaatcaatgaggatggaagtcggaccgcactgagcgcggtcgatatgacacagcgcgaagctgtcgcaaagcagctgctcactcccgcaacaggggcccccaaaccacagggaaccaagatcgtctgtaggcacgtcaaaaatggagatatcttactgcttaatcgccaacctactctccacagacccagcatccaggctcaccgcgctcgaatcctgccggaagagaaggtgctaaggctgcattacgccaactgtaaagcttacaacgccgattttgatggcgatgagatgaacgcccatttcccccaatctgagttgggcagagctgaagcttacgtgctagcctgcaccgaccaacagtaccttgtgcccaaagatggtcagccactcgccgggctgattcaggaccatatggtttcaggcgccagcatgaccacgcggggttgtttttttaccagggagcactatatggagctggtttacagagggttaactgacaaggtgggaagagtaaaactgctatctcccagtattctgaaacctttcccgctgtggactggcaaacaggtagttagcaccctcttaatcaacattatccccgaagaccatatccccttgaacctctccggcaaagcgaagattacaggtaaagcttgggtgaaggagacgcccaggtcagtccccggtttcaaccccgattcaatgtgcgaatctcaagtcatcattcgggaaggggagctcctctgtggagtgctcgacaaagcgcactacggttcttccgcgtacggtttggtgcactgctgttatgagatatatggaggtgagacctccggcaaagtccttacgtgtctagctcgcttgtttacagcttacttacagttgtatcggggcttcaccctgggggtcgaggacatcttggtgaaacccaaagccgatgtgaagaggcaacgcatcatagaggaatcaacacactgcgggcctcaggctgttagagccgcactgaacctgcctgaagctgcttcttatgatgaagtgcgggggaagtggcaggacgcccacctggggaaagaccagagggactttaatatgattgacctgaagttcaaggaggaagtgaatcattattcaaacgaaatcaataaggcatgcatgccgttcggcctgcaccgccaatttccagagaactcactgcagatgatggtgcagagcggagcaaagggttcaaccgtcaatactatgcagattagctgcctgttgggccaaatagagctcgaaggtagaaggccaccactcatggctagcggcaaatcactgccgtgtttcgagccatatgagtttactcctagggcaggaggcttcgttaccggcagattcttaacaggcataaaacctcccgaatttttctttcactgtatggcggggagggaggggctcgtcgatactgcggttaagactagtaggagcggctatcttcagagatgtataataaagcacctggagggcctcgtggtccaatacgatttgaccgtccgagacagcgacggcagtgttgttcagttcctttatggcgaagacgggctcgatatcccaaaaactcagtttctccagccgaagcagtttccattcctggcaagcaactacgaagtgattatgaagtcacagcatttgcacgaggtcttatctcgggccgaccctaagaaggccttgcaccatttccgggctatcaaaaagtggcaatcaaagcacccaaacaccttgcttcgccgaggtgccttcctgagttacagccagaagattcaggaggcagtgaaagccttgaagctcgagagcgagaatcgcaatggaaggagtcctggtacgcaggaaatgctgagaatgtggtatgaacttgacgaggagagtagaaggaaataccagaaaaaagctgcagcctgtccagacccctccctctccgtttggcggcctgacatctacttcgccagcgtgtcagaaacgttcgagacaaaggttgatgactacagccaagaatgggctgctcagactgagaagtcatacgaaaagtcggagctgagcttagaccggcttagaaccctgttacagttgaaatggcaacggtccctgtgcgagcccggagaagcggtcggcctcctggctgcgcagagcatcggcgaaccttccactcagatgactctcaatacgttccattttgcgggccgcggcgagatgaacgttacactcggaattccgcgcttgagggagattctcatggttgcatcggccaatatcaaaacacccatgatgagcgtgcccgttctcaatacaaagaaggcgctgaaaagagtgaaatctttgaagaagcagcttacaagggtctgtctgggtgaagtcctgcagaaaatagacgttcaggagtctttctgtatggaagaaaaacagaacaagttccaggtttaccagctccgattccagttcctgccccatgcttactaccagcaggagaagtgccttaggcccgaagacatactccggtttatggaaactcgtttttttaaactcttgatggaaagtatcaagaagaagaataataaagccagcgccttccggaacgtgaacacccgccgtgcaacacagcgtgacctggacaatgccggcgagctgggtcgctcacggggtgaacaagagggagatgaggaagaggaaggccatatcgtggatgccgaagccgaggagggagacgccgacgcttccgatgcaaagaggaaggaaaagcaagaggaagaagttgattacgagagtgaagaagaggaggaaagggagggtgaagaaaatgacgacgaagacatgcaagaggaacgtaatccgcatcgtgagggcgcccgcaaaacacaggaacaagacgaagaagtgggactcgggaccgaggaagatcctagcctgcccgccctcttaacccagccgagaaaacctacacatagccaggaacctcaagggcctgaggctatggagcggagagtgcaggcggttagggagattcacccattcatcgatgattaccagtatgatacagaggagagcctctggtgtcaagtcactgtgaagcttcccctgatgaaaatcaacttcgacatgtctagcttggtggtctctcttgctcatggagctgtgatttatgcgacaaagggcatcacgcgttgcctgctcaatgaaaccactaataacaaaaacgaaaaagagctggtcctcaacaccgagggaataaatctgccagaacttttcaagtacgcagaggtcttagacttaaggcgcttatattcaaacgacatccacgcaatcgccaacacttacggaatagaggctgctctgagagtgatcgaaaaggaaatcaaagacgtcttcgcggtgtatgggattgccgtcgacccaaggcacctcagcctggttgccgattatatgtgcttcgaaggcgtctacaagcccctaaatagattcggcatccgctctaatagcagccccctgcagcagatgacattcgaaacttcatttcaatttttaaagcaggctaccatgctcggctctcacgatgagttacgaagtccctccgcttgcctcgtagtgggcaaagtagtcagaggtgggacaggtctatttgagttaaaacagccactacggtag

SEQ ID NO: 12777 - DNA, 4980 bp, Artificial Sequence
  Description of Artificial Sequence: Synthetic coding sequence
atgctcatcagtaaaaacatgccttggcggcgcctccaggggatcagctttggcatgtacagcgccgaggagctcaagaaactgagcgtcaaatctattacaaatcccagatatctcgattccctcggcaatccttccgctaacggtttatacgacctggccctgggtcccgcagatagcaaagaagtctgcagcacatgcgtacaggatttcagtaattgtagcggtcacctgggccacattgaactgcccctcacggtatacaatcccctccttttcgataaactctacttactccttagaggatcgtgtctgaattgtcatatgctgacttgtccccgagccgtgatccaccttctcttgtgccaactccgagtgctggaagttggcgccctgcaggccgtgtacgaactggaacggatcctgaatcggttcctcgaagaaaatcccgatccttccgcctcagagattcgagaggaactggagcagtatactacagaaatagtccagaacaacctgcttggctcacagggggctcatgtcaaaaacgtgtgcgagtcaaaaagcaagctgatcgcacttttctggaaggcccatatgaacgctaaacgctgcccccactgcaagactgggcgaagtgttgtgaggaaggagcataatagtaagctgactatcaccttccccgcaatggtccacaggactgccggtcaaaaagatagcgagcccctgggtatcgaggaggctcagattggtaagcgaggctatcttacacctacctctgcgcgggagcacctgtccgccctgtggaagaatgaggggtttttcctgaattatctgttctctggtatggacgacgatgggatggagtcgagatttaacccatcagtcttttttttggatttcctcgttgtccccccaagtaggtatagacccgtctcccgtctgggtgaccagatgttcaccaatgggcagactgtgaatttacaagccgtcatgaaagatgtcgttctcatccgaaagcttctggcccttatggctcaggagcagaagctgcctgaggaggtcgccacgccaactacagatgaggagaaagactccctcattgctattgataggtctttcttgtctactctgcccgggcagtctctcatcgataagctgtataacatctggatccggctgcagtcccacgtgaatatcgtgttcgacagtgagatggataaactcatgatggataagtaccctggaatcagacagatcttggagaagaaggagggcctctttaggaagcacatgatgggcaagcgagtggattatgccgccaggtccgtaatctgtcctgatatgtacataaacaccaacgaaatcggtatcccaatggtgttcgcgacaaagctgacttatccccagccagttaccccttggaacgtacaggagctgcggcaggctgtgattaacggcccaaacgtgcacccgggggcttccatggtgatcaatgaggatggcagcagaaccgctctatccgccgttgacatgacacaaagggaggccgtggcaaaacaactattgacgccagccaccggcgcacccaagcctcagggcaccaagatcgtgtgtaggcatgtcaagaacggagatatcctattgctgaatcggcagcccactctacataggccttctattcaggcacacagggcaagaattttgcccgaggaaaaggttctgcgccttcattacgccaattgtaaggcttataacgccgattttgacggcgatgagatgaatgcccacttcccacagtccgagctgggaagggcggaggcttatgtgcttgcctgcacagaccagcaatacctggtccctaaggacgggcagcctctggccggactgattcaggaccacatggtttccggagcaagcatgaccaccagaggatgctttttcactagggagcactatatggagctcgtgtatcgtgggctcacggacaaggttggcagagtcaagctgctctcacctagcatcctgaagccctttccactgtggacagggaaacaggttgtaagtactctattgattaatataattccagaggatcacatcccacttaatttgtccgggaaagcgaagattactggaaaggcatgggtcaaggagactccacgctcagtccctggctttaatcccgattcaatgtgcgagagtcaagtgatcattcgtgaaggggaactgctctgtggtgtcctcgacaaagcccactatgggagttcggcctacgggttggtgcactgctgctacgagatctacggaggggagacaagtggaaaggtgttaacctgcctcgctcgcctgtttactgcgtacctgcaactgtaccgaggctttacgttgggtgtggaagacatactggtaaagccgaaggccgacgtgaagcgccagagaattatagaggaaagcacacactgtggcccgcaagccgtgagagccgccctgaatctccctgaagcggcgtcctacgacgaggtacgcggcaagtggcaggacgcccatcttggtaaggaccagcgagattttaatatgatcgatctgaaatttaaggaagaagtgaaccactacagtaatgaaatcaataaagcttgcatgccattcggcctacatagacagtttccggaaaacagcctgcagatgatggtgcaatcaggcgccaaggggtcaaccgtgaacacaatgcaaatctcatgtcttcttggacagatagaattagagggtcgcagacctccgctgatggcttcaggcaagtcattaccatgcttcgaaccctacgaatttactccaagagcaggtggtttcgtaactggccgtttcctcacaggcatcaagcctccagaatttttttttcattgcatggctgggcgggagggactggtagatacagctgtgaagacctctcgctcagggtacctccaaaggtgtatcatcaaacacctggaggggctggtggtgcaatacgacctaacagtgcgggactccgatgggtccgtcgttcagttcctctacggagaggacggcctcgatatcccaaagacacagtttctgcagcccaaacagtttccatttctggcgtcaaactacgaggtgatcatgaaatctcagcatctccacgaggtactatctcgggcggaccctaagaaggccctacatcactttcgggctatcaagaagtggcagtccaagcatcccaatacccttctccggcgaggagcctttttgagttactctcagaagatacaggaagctgtgaaagcattaaaactggaatcagaaaaccggaacgggcgaagtcctgggacccaggagatgctacgcatgtggtacgaattggacgaagagtctcgacgcaaatatcagaaaaaggcagccgcctgcccagatccctccctcagtgtctggaggcccgacatatacttcgcgagcgtgagtgagacattcgaaaccaaagttgacgattatagtcaggaatgggctgcacagaccgaaaaatcctatgagaaaagtgaactgagcctcgacaggttacggaccctgctacagttaaagtggcagagaagtttatgtgagcctggtgaggcagttgggctgctggctgcacaaagcatcggagagcctagcacgcaaatgacactgaacacattccacttcgcaggacgcggggaaatgaacgtaaccctgggtattccccgtctcagagagattctgatggtcgccagcgccaatattaagacccccatgatgagtgtccctgtgctaaataccaagaaagctcttaagcgggtaaaatcccttaagaaacagctcacaagggtttgcctgggtgaagttctgcaaaaaatcgatgttcaggaatccttctgtatggaagagaagcagaataaattccaagtgtaccaactgagattccagttcttgccacacgcgtactaccaacaagaaaaatgtctgcggcccgaggacatcctccggtttatggagaccaggtttttcaaacttctaatggagtccattaaaaaaaagaacaacaaggcatccgctttcagaaacgtcaacacgcgtcgggccacccagagggaccttgacaatgcaggcgagctgggacgcagccggggggagcaagaaggggatgaagaggaggaagggcacatcgttgatgcagaggctgaggagggggacgccgacgccagtgacgccaagcgcaaggagaagcaggaagaggaagtggattacgagagcgaagaggaagaggagagggaaggcgaagaaaacgatgacgaggatatgcaggaggagcgcaatccgcaccgtgagggggcgcggaagactcaggaacaggacgaggaggtgacggtgaaacttcccctcatgaagattaacttcgacatgagttccctggtggtttcactggcacacggggctgtaatatacgccaccaagggaattacccggtgtctgctgaacgagaccactaataataaaaacgaaaaagaactcgtgctcaacactgagggcatcaatctccccgagcttttcaagtacgccgaggtgctagatttgaggagactgtacagcaacgacattcatgccatcgctaacacctatgggattgaggcggcactcagagtgattgaaaaggaaatcaaggacgtgttcgccgtatacggtattgcagtggatcctcgccacctttctttggtggcagattacatgtgcttcgaaggtgtgtacaaacctttgaaccggttcggaatacgcagtaattctagccctctacagcaaatgacttttgaaacgagctttcagttccttaagcaggctaccatgcttgggtcacatgacgagcttcgcagtcctagcgcctgtctggtggtggggaaagttgtgagaggaggcactggactttttgagttaaaacagcccctgagatag

SEQ ID NO: 12778 - DNA, 3408 bp, Artificial Sequence
  Description of Artificial Sequence: Synthetic coding sequence
atggacccaggctctcgatggcgaaaccttcccagtggcccttcgctcaagcacctgactgatcccagctatggtattcctagagaacagcaaaaggctgcgctgcaggaacttacgagagcacatgtcgagagttttaactacgctgtgcatgagggattaggactcgccgtgcaggccatccctccttttgaattcgcatttaaggacgaaaggatctcctttactatcctggatgccgtcatctcacctcccacggtgccgaaaggcaccatctgcaaagaggccaacgtttatcctgccgagtgcagaggcaggcgcagtacatatagggggaagctgacagctgatatcaattgggccgtcaacggcatttcaaaaggaattattaaacaattcctggggtacgttccaataatggtcaagagcaaactgtgtaatctgcggaaccttccaccacaggccctgatcgagcatcatgaggaggcagaggagatggggggctactttattatcaatgggattgagaaagtgatccggatgctcattatgcctcggaggaattttccaatcgccatgatccggcctaaatggaaaacgcgtggccccgggtatacccagtatggagtcagtatgcactgtgttcgcgaagagcattccgcagtcaacatgaatctgcactatctagagaacgggacagtcatgctcaattttatttatagaaaggaactgttcttccttcccttgggtttcgccttgaaagcattggtgagcttcagtgattaccagatctttcaggagctgataaagggaaaggaggacgattccttcctgcgaaatagcgtgtctcaaatgcttcggatcgtgatggaggaggggtgttcgacccagaaacaggtgctaaactatctcggagaatgtttcagagtcaaactcaatgtgcctgactggtatccgaacgaacaggcagccgagtttctctttaaccagtgcatctgtatccatctgaaatcgaacactgagaagttctacatgctttgccttatgacgagaaagctcttcgccctggctaagggggaatgcatggaagacaatcccgacagcttggtcaaccaggaagtactcacccccggccagctctttctaatgttcctgaaggagaaactggaaggctggctggtctctattaagatagcgtttgacaagaaggcacagaagacatccgtcagcatgaacactgacaatttgatgaggatcttcactatgggaattgatcttacaaaaccatttgaatacctgtttgccaccggaaatctgcggagcaagacaggactgggcctccttcaggacagtgggctatgcgtcgtggctgataaacttaactttatccgctacctatcacacttcagatgtgtacatcgcggagctgacttcgcgaagatgaggaccacaacagtgaggcgactactgcctgaatcgtgggggtttctctgtccagtccatacacccgatggagaaccatgcggtctgatgaatcatctgactgcagtgtgcgaggttgtgacgcagtttgtgtacaccgcctctatccccgccttgctgtgtaatttgggtgtgactccaattgatggggctcctcacagatcctattccgagtgctacccggtcttgctggacggagttatggtcggatgggtggacaaggaccttgcccccggcatcgctgacagtctgcggcatttcaaagtgcttcgagaaaagcgcattcccccatggatggaggttgtgctgattcccatgacagggaagccctccctttacccaggactctttttgttcactaccccctgtcgactcgtccggccggttcagaacctcgcacttggcaaggaggagttgatcggtaccatggagcagattttcatgaatgttgccatatttgaggatgaagtctttgccggcgtgacaacccatcaggaactgttcccccactccctcctgagtgttatcgccaactttattcccttcagcgatcacaaccagagtccaaggaatatgtaccagtgccagatggggaaacagactatgggcttcccattgctgacataccaggaccggagcgacaataaactgtatcggctccagacaccacagtcccctcttgtgcgcccctcaatgtatgattattacgacatggataactatccaataggtaccaacgccatcgtggccgtgataagctacactggatatgatatggaggatgccatgatcgttaacaaggcatcttgggagcgtggtttcgctcatggaagcgtatataaatcagaatttatagatctctctgaaaaaataaagcaaggagatagctcactcgtctttggaatcaagcctggcgacccccgggtgttgcagaagcttgatgacgatggtcttccttttattggggctaagcttcagtacggcgacccctactactcttacctcaacttgaatacaggcgaaagctttgtaatgtattacaaaagtaaagaaaattgtgtggtcgataacatcaaggtgtgtagcaatgacaccgggtctggcaagtttaagtgcgtgtgtattaccatgcgggtccctaggaaccctaccattggggacaagtttgcctctcgccacggtcagaaaggcatcttatcccgcctgtggccagccgaggacatgccgtttacagagagtggcatggtaccggatatcctcttcaatcctcacggatttccatctaggatgaccattgggatgctgatagagtcgatggccggtaaatcagcagccctgcacgggctctgtcacgacgccacccccttcatcttctcagaagaaaactctgccctggagtatttcggcgaaatgttgaaggcagctggctacaacttctatggcacagagcggttgtactctggaatctccggactggagctggaggccgatatcttcattggagtggtctattatcagcgcctgaggcatatggtctccgacaaattccaggtgagaacgaccggggccagggaccgcgtgacgaaccagcctataggtgggcggaatgtgcaaggcggaatacgatttggggagatggagagggacgctctgctggcccacggtacgtctttcctgctgcacgacaggctgtttaactgttccgatcggtctgtggctcacgtctgtgtgaaatgcggttcactgttatctcctctgctggagaagccacccccctcgtggagcgctatgaggaatcgcaagtacaattgcactctttgctctcgcagcgatacaattgacactgtatcggtgccttatgtgttcagatattttgtcgccgaacttgcggctatgaatattaaagtgaaactcgacgttgtgtag

SEQ ID NO: 12779 - DNA, 3240 bp, Artificial Sequence
  Description of Artificial Sequence: Synthetic coding sequence
atggaccccggctctcggtggaggaacctgccttctgggccgagtctgaagcatttaacagaccccagctacggtatccccagggagcaacaaaaagctgcgctgcaggaactcacccgggcccacgtcgagtcgtttaactacgcagtccatgagggccttggactcgccgtccaagcggacatcaattgggcggtgaacggcatatccaagggcattatcaaacagttcctggggtatgtacctatcatggtcaagagcaaattatgcaatctaagaaacctcccacctcaggcgctgatagagcatcacgaggaggctgaggagatggggggttattttatcatcaatgggatcgaaaaggttatcagaatgctcattatgcctcggcggaactttccgattgctatgataagacctaagtggaagacccggggaccaggttacacccagtatggtgtctccatgcactgcgttagagaggagcattccgcagtgaacatgaatctccactacctggaaaacgggacggtgatgctgaactttatataccgaaaggaacttttcttcctgccactcggtttcgccctgaaggcactcgtgtccttttccgactaccagattttccaggaacttatcaaagggaaggaagacgatagctttttgaggaatagcgtgtcccagatgctgcgaattgtgatggaggaggggtgctctacacagaagcaggtgctcaattacctcggggaatgctttcgggtcaagctgaatgtgccagattggtatcccaatgagcaagccgccgaatttctgttcaatcaatgtatttgtattcaccttaagtctaatacagaaaagttttatatgttgtgcttaatgacacgcaagctttttgctctcgcaaagggagagtgcatggaggataaccccgattccttggtgaaccaagaagtgctgacacccggacagttgtttttgatgtttttgaaagagaaactggaaggctggctggtctccatcaaaatcgctttcgacaaaaaggcccaaaaaacatcggtttccatgaatactgacaatcttatgagaatatttacgatgggaattgaccttacaaaaccttttgaatatctgtttgccactgggaacctccgatctaaaacaggtctagggctgcttcaggattccggcttatgtgtagtagccgacaagctcaactttattcgctatctctcccacttccgatgcgtgcacaggggggcagactttgccaagatgagaaccacaacggttcgcaggctgttgcctgagagttggggcttcctgtgccccgtacatacaccagacggtgagccctgcggcttgatgaatcatttgaccgcagtgtgcgaggtggttacccaatttgtttacacggcatcaatccctgccctgctttgtaatctcggggtaacccccatcgacggtgcaccccaccgatcctatagtgagtgttaccccgtgctgctggatggcgttatggtgggttgggtcgataaagatctggctcctggtatcgctgactcgcttagacactttaaagttctgagggaaaaacgcattccgccctggatggaggtggtgctgatccctatgaccggcaagccgtccctgtacccgggtctttttctgttcacaactccgtgtagattagttaggcccgtccaaaatctagctttaggcaaggaagaacttatcggcaccatggaacagatcttcatgaacgtggccatcttcgaggatgaagtattcgccggggtgacgacgcaccaggagctatttccacactctctcttgtcagtgatcgccaattttatcccattttccgatcataaccaatcccctcgtaatatgtaccagtgtcagatgggtaagcagacgatgggctttccattgctcacgtaccaagacaggtctgataataagctctataggctgcagacacctcagtccccactggtccgcccatcgatgtacgactactatgacatggacaattacccgattggtaccaacgctattgtagctgtgatttcttataccgggtatgatatggaagatgccatgattgtgaacaaggcctcgtgggagaggggtttcgctcatgggtcagtgtacaaaagcgaattcatagacctgagcgaaaagatcaagcagggagactcgagcctggtgttcggaataaagccaggcgatcctcgggtgctccagaaattggacgatgatggcctccctttcattggagcgaagcttcagtacggcgatccgtactactcataccttaatctcaataccggtgagagtttcgtcatgtattacaaatccaaggaaaattgcgtagtggacaacatcaaggtttgcagcaacgacactgggtctggaaagtttaagtgcgtgtgtatcaccatgagagtgccgcgaaaccccaccataggtgataagtttgcttctcggcacggacagaaagggattttgtcgcgactttggcctgccgaggacatgccattcacagagtctgggatggtccctgacattctgttcaatcctcacggattccctagcagaatgactatcggcatgctgatcgaaagcatggcaggcaagtcagccgcgctccatggcttatgccatgatgccacacctttcattttttctgaagagaattccgcgctcgagtattttggtgagatgctcaaagcagcaggatataacttttatggtacagaacgtctgtacagcggcatttctggactggaactggaggccgatatattcattggagtcgtgtactatcagcggcttcgtcacatggtcagcgacaagttccaagtgcgtacaactggggcaagagaccgcgtgactaaccaaccaatcggtggcagaaacgtacagggaggtataaggtttggcgagatggagcgggacgccctccttgcacacggtacttctttcctgctgcatgacaggctcttcaactgttcagaccgctccgttgctcacgtatgtgtcaaatgcggctctttgctgtctccactgctagagaagccacccccatcctggtccgccatgaggaaccgcaagtacaattgtactttatgctcgcgatccgatactatagacaccgtgagcgtgccatatgtgttccgatactttgtggctgaattggccgccatgaacatcaaagtgaaactggacgtagtctag

SEQ ID NO: 12780 - DNA, 345 bp, Artificial Sequence
  Description of Artificial Sequence: Synthetic coding sequence
atggacccaggttccaggtggagaaacctgccatcggggcccagtcttaaacatcttacggatccatcctacggcatccccagagaacagcaaaaggctgctctccaggagttgacccgtgcccacgtagagtccttcaattacgccgtgcacgagggactggggctagccgtccaggcaattcctccttttgaatttgccttcaaggatgagagaattagcttcaccatcctcgacgccgtgatttcacctccaaccgtgcccaaggggactatatgtaaggaagcaaatgtctaccctgctgaatgcaggggccggcggtcaacctacaggggtaaactctag

SEQ ID NO: 12781 - DNA, 387 bp, Artificial Sequence
  Description of Artificial Sequence: Synthetic coding sequence
atggaccccggctccagatggcgtaacctgccatccggcccaagtctgaagcatttaaccgatccaagctacgggatacctcgcgaacagcagaaggcagctctccaagagctgacccgcgcccatgtggaatcattcaattacgcagtccacgaaggacttggtctggccgtgcaggccatcccacctttcgagttcgccttcaaggacgagagaatctctttcaccatactggacgccgtcatttcacctcccactgtgccgaagggcaccatctgcaaggaggcaaatgtctaccccgctgagtgcagggggcgtcgcagcacctatagagggaaactgactgccgatatcaactgggctgtgaatggtatatctaaaggttag

SEQ ID NO: 12782 - DNA, 1380 bp, Artificial Sequence
  Description of Artificial Sequence: Synthetic coding sequence
atgaacgttgctatttttgaggacgaggtgtttgctggggttactacacatcaggaactttttccacacagcctactgtctgtgatcgcgaactttattcccttctcagaccacaaccagtcacccaggaatatgtaccagtgtcagatgggaaagcagactatgggattcccgctgttgacgtaccaggatcgatccgataataaactttaccggttgcagaccccacagtctcctctggtacgcccatccatgtatgattactacgatatggacaattatccaatcggaaccaacgcaatagtcgctgttataagttataccggatatgatatggaagatgctatgattgtgaacaaggccagctgggaaagaggattcgcccacggatctgtgtacaagtctgaatttatcgaccttagtgagaaaatcaagcagggggactcgagcctcgtattcggaattaagcccggcgacccacgcgtccttcaaaagctggacgatgatggactgccattcataggcgccaaattacagtacggggatccttattacagctatctgaacttgaatacaggggagagcttcgtaatgtattacaagtcaaaagaaaattgtgtcgtggacaacatcaaagtctgctccaatgacactggatctggaaagttcaagtgcgtgtgcattactatgagagttcccagaaacccaaccataggagataaattcgcgtccaggcacggccagaaaggcatcctctcccgcctttggcctgcagaagacatgccattcacagagtctggcatggttcccgacatactgtttaaccctcacggattcccaagtagaatgacaatagggatgctgatcgaatccatggcaggcaagagcgccgcactgcacggcctatgtcacgatgctacgccatttattttctcagaggagaactccgctctggaatattttggcgagatgctgaaggcagctggttacaatttttacgggaccgaaagactctattctggaatctctgggctcgagctcgaggctgacatattcatcggggttgtctattaccagcggctgcggcatatggtgtccgacaaattccaagtgcgcacaacaggagctagagatcgagtgaccaatcaacctattggcggaaggaatgtccaggggggcattcgattcggagaaatggagagagacgccctcctggcacatggcactagcttcctgctgcacgaccgcctgtttaactgctcagatcggtccgtggctcacgtgtgcgaggtgtggcagttcactctgtctacagtcggagaggctacgccattcctggtgtgccacgcccagcagaaaatccaactgtattcagtgtag

SEQ ID NO: 12783 - DNA, 2775 bp, Artificial Sequence
  Description of Artificial Sequence: Synthetic coding sequence
atgcactgcgttcgggaggagcactccgccgtcaacatgaatctgcactacctcgaaaacggaaccgtgatgctgaatttcatttaccggaaagagctgttctttctgccactcgggtttgctttaaaagccctggtgagcttttctgattaccagattttccaggagctcattaagggcaaggaagatgactcttttctaaggaatagcgtctcacaaatgcttagaattgtcatggaggagggatgttcaacacagaagcaggtcctgaactatctgggggaatgctttagggtgaagctgaacgttccagactggtatcccaatgagcaggcagctgagttcctttttaatcagtgtatctgcattcatcttaagagcaacacagagaagttttacatgctatgtctcatgacacgcaagctgtttgccctggcaaagggcgagtgtatggaagacaatcccgatagtctggtcaatcaggaggtgctaacaccaggccaactgttccttatgtttctgaaagaaaaattagaagggtggctcgtgagtataaaaatcgcattcgacaaaaaagcacaaaagacttctgtgagcatgaatacggacaatctgatgcgtatctttactatgggtattgatcttaccaagccgttcgaataccttttcgcgaccggtaatctgagaagcaagaccggactgggcctgttgcaggattctggtctatgtgtggttgctgacaaactgaattttatacgctacctttcgcatttcaggtgcgtgcaccgcggtgccgatttcgctaaaatgcggactactacggtgagacgcttgctacccgagagctggggtttcctgtgccccgtgcacactcctgacggagagccttgtgggttaatgaaccacctcacagcagtctgcgaagtggtcacgcagttcgtttacaccgcgagcatacctgccctgctttgtaaccttggcgtcacacccatcgacggcgccccgcacagatcctatagcgaatgttatccggttttgctggacggtgtaatggtgggctgggttgataaagacttggcaccgggtatagcagatagtttgcgtcacttcaaggtcctgcgggaaaaacgcatccccccttggatggaggtggtgctgattccaatgaccggcaaaccctctctgtatccagggctgttcctcttcacaacaccttgtcggctggtaagacctgttcagaatctggcgttaggaaaagaggaactaatcgggactatggagcagatatttatgaacgtcgccatcttcgaagatgaagtgttcgccggcgtgacaacccatcaggagctctttccccacagcctgttgtctgtcattgcaaattttattccattcagcgatcataaccagagccctcggaatatgtatcagtgtcaaatggggaagcagaccatgggctttccattgctcacctaccaggataggagtgacaacaaactttaccggttgcagacaccgcaaagccccctggttaggccttccatgtatgattattacgatatggacaactaccctattggcaccaatgccattgtggcagtcattagttatacggggtatgatatggaagacgctatgatcgtgaataaagcctcatgggagagaggctttgctcacggatctgtctataagtccgaattcatagacctttccgagaagattaaacagggagacagttctctggtcttcgggatcaagcctggggatccaagggtgctccaaaagctcgacgatgacgggctcccattcatcggggctaagctccaatacggcgatccctactacagctatctgaacttgaataccggcgagtctttcgtcatgtattataaatctaaagagaactgcgtggtggacaacatcaaagtgtgctccaacgataccggatccggaaagttcaagtgtgtctgcatcactatgcgagtaccccgtaacccgactatcggagacaagtttgccagcaggcatggccagaagggcattctgtctcgcttgtggccagctgaagacatgcccttcacggaatctgggatggtgcctgacatcctttttaacccccacgggttcccatccaggatgacaattggaatgctgattgagagcatggcgggtaagagtgccgcgctccacggcctttgccatgacgcaacacctttcatcttcagtgaggagaactccgcccttgaatattttggcgaaatgctcaaagccgcaggctacaatttctatggcaccgagcgcctctactccggaataagtggactcgagctagaggcggacatctttattggggtggtgtattatcagagactccgccatatggtttcggacaagttccaagtgaggaccaccggcgccagggaccgtgtcaccaaccagcctataggaggcaggaatgtgcagggggggatccggttcggggagatggaaagggatgcgctgttggcacacggcacaagctttctgttacacgaccgtctgttcaattgctccgaccgaagtgtggcccatgtctgtgtcaagtgtggctccctcctgagccctctgctggagaaaccccctccttcttggtccgccatgagaaaccgcaagtataactgtacactgtgctctcgaagcgatactattgataccgtgagtgtcccctacgtctttagatactttgttgcggaattggccgctatgaacatcaaggtgaagctcgatgttgtgtag

SEQ ID NO: 12784 - DNA, 3522 bp, Artificial Sequence
  Description of Artificial Sequence: Synthetic coding sequence
atgagggccaaagaggccgccgaaaccggcttacgcccactgctgcctgcatgcactgaacgtctggcttcgggagtctatcgggagaccggagtgagatgtgctgggggacacatggatccaggttctcggtggaggaaccttccctccggaccaagcctgaagcacctgactgacccttcatatggaatccctagggaacagcagaaggccgcactgcaggaattgactcgggctcacgttgaatcctttaactatgcggtacacgaggggttggggctagccgtgcaagcaatcccacctttcgagtttgccttcaaagatgaacgcatcagtttcaccatcttggacgcggtgatttcaccccctaccgtcccaaagggcaccatctgcaaagaggctaacgtttaccccgctgaatgccgaggcagacgctcaacataccggggcaaactgactgccgacatcaactgggcagtgaatggtatcagtaaagggattattaaacagttcctgggttacgtaccaatcatggtcaagtctaaactctgtaatctgagaaatctccccccacaagcgcttatagagcaccacgaagaagccgaggaaatgggcggttattttattattaacgggattgagaaggtcatccggatgttgatcatgccccgccgcaactttccgatagcaatgatcagaccaaaatggaaaacacgcggccccggctatacacaatacggagtgagtatgcattgcgtgagggaggaacactccgcagtgaacatgaacttgcattacctggagaatggcacggttatgctgaattttatttatcggaaagagctgtttttcctgcctctgggtttcgccctgaaagccctggttagtttctccgactatcagatattccaggagctgataaagggtaaggaagacgacagcttcctgcggaattccgtgtctcagatgctaagaattgtgatggaagaagggtgctccacacaaaagcaagtactcaactacttgggtgagtgtttcagggtaaagcttaatgttcctgactggtatcctaacgagcaggccgccgagttcctcttcaaccagtgtatctgtatccatttgaaaagtaacaccgaaaagttctatatgctttgccttatgaccagaaagctgtttgctctagcaaagggagagtgcatggaggataatcccgacagcctcgtgaatcaagaagtcctgacacccggtcagctcttcctgatgttcttgaaggagaagctggagggatggctagtgtccatcaaaatcgcattcgataaaaaggcccagaagaccagtgtctccatgaatacagacaatcttatgcggatttttacaatggggatcgaccttacgaaacccttcgagtatctatttgcgacaggtaacctgaggtctaagaccggcctgggcctgcttcaggattccggactgtgcgtggttgctgacaaactaaactttattcgatatcttagtcattttcgttgtgtgcacagaggggctgatttcgctaagatgaggacaaccacagtgcgtcgcctgctgcccgaaagctgggggttcctctgccctgtacacacacccgatggagagccgtgtggtctaatgaaccacctgacagcagtgtgtgaggttgtcacccagtttgtctatactgccagcatacccgctctgctgtgcaacctgggtgtgactcccattgacggggcaccacataggagttattctgaatgttatcccgtgttgctggacggcgtgatggtgggctgggtggataaggacctggcaccaggtattgccgactctctcaggcacttcaaggttttgagggagaagcgcatcccgccctggatggaagttgtcctaatcccgatgactggaaagccatcgttgtatcctggtctctttctcttcaccacaccttgccgccttgtgcgaccagttcagaacttagcattgggcaaggaagaactgattggaaccatggagcagatctttatgaatgtggccatattcgaggacgaagtgtttgcaggcgtcactacccatcaggaactctttcctcactcactgttgtcagtgattgccaattttatccctttcagcgaccataaccagtctcctcgtaatatgtaccaatgtcaaatgggaaagcagacaatgggattcccactgctcacctatcaagaccggtcagataataagctctatcgcctgcagacgcctcagtctcctctggtgagaccttcaatgtacgactattatgatatggacaattaccccattggcactaacgctatcgtggctgtgatctcttatacgggatatgacatggaagatgctatgatagttaacaaggcctcctgggagcgggggtttgctcacggaagtgtatacaaatccgagtttattgatctgtcagagaaaataaagcagggcgactcttccctcgtctttgggattaagcctggggaccctcgggtgctgcagaaactcgacgacgacggcttaccattcatcggcgctaagctgcaatacggagatccatactactcctacctgaacctgaacacaggggaatcttttgtgatgtattacaaatccaaagaaaattgcgtcgtggacaatataaaagtttgttcaaacgacacagggtccggcaagttcaagtgtgtatgtatcacaatgagggtgccccgcaaccccacgatcggggataaattcgcctctcggcatgggcagaaaggaattctgagcagactttggcctgccgaggacatgcccttcacggagtccggcatggtcccggatatcctctttaacccccatgggtttcccagtcgaatgacaatcggtatgcttatagaatccatggccggaaagtccgctgccttgcatggtctgtgtcatgacgccactccattcatcttcagcgaggagaacagcgccttggagtacttcggcgaaatgctgaaggcagcggggtacaacttctacggaacggagaggctctatagtggtataagtggcctagaactggaagctgacatctttatcggcgtcgtgtattatcagaggctgcgacacatggtgtcagataagttccaagtgaggacaacaggcgcccgcgatcgggtgactaaccagcctatcgggggtagaaacgtccagggcgggattcgttttggtgagatggaacgtgacgccctgctcgctcatggaacaagctttctgctccatgatagactatttaactgctccgaccggtcagtggcacacgtctgcgtgaagtgcggttcattgctgtccccccttctggagaagccccccccctcatggtccgccatgagaaacagaaagtacaactgcaccctgtgctcccgatctgataccatagatacagtctcagtgccatatgttttcaggtatttcgttgccgagcttgcagccatgaatataaaggtcaagctggacgtggtctag

SEQ ID NO: 12785 - DNA, 3525 bp, Artificial Sequence
  Description of Artificial Sequence: Synthetic coding sequence
atgtacgatgccgacgaagacatgcagtatgacgaagatgatgacgagataacaccagacctctggcaggaagcctgctggatcgtgattagcagctattttgatgagaagggactggtgcgacaacagttggactcatttgacgaattcattcaaatgtcggtgcaaagaattgttgaagacgcccctccaattgacctccaggctgaggctcaacatgcatctggcgaggtggaggaaccaccgcgctacctcctgaaatttgaacagatttatctctcaaaacccacccattgggagcgggacggagccccatcccccatgatgcctaacgaggccagactgcgtaatctgacctacagcgctccattgtatgtggacattacgaagactgtgattaaggaaggggaagagcagcttcagacacagcatcagaaaaccttcattggtaaaatcccaatcatgctgcggagcacatactgcctgctcaacggtttgactgatcgcgatttgtgtgagctaaatgagtgccccctcgatcccgggggttatttcatcatcaacggcagcgaaaaagttcttatcgcccaggaaaaaatggctaccaataccgtgtatgtgttcgccaagaaggactccaaatacgcatacactggtgaatgcagatcttgcctggagaactcttcccgccccacctcaacgatctgggtcagcatgctggcacggggaggtcaaggtgcgaaaaaatcggcgattggccaacggattgtggccaccctgccctatattaagcaggaagttccaattataatcgtgtttcgtgccctggggttcgtatctgatcgcgacattttggagcacattatctacgatttcgaggatcctgaaatgatggagatggtcaagccttctttagacgaagcatttgttatccaggagcaaaatgtcgctcttaatttcataggatcccgaggcgccaaacccggcgtgaccaaagagaagcgcatcaagtatgccaaggaggtgctgcagaaggagatgctaccacatgttggcgtttccgatttctgcgagaccaagaaagcatatttcctgggctacatggttcatcgactcctgctcgctgcactgggaagacgcgagcttgacgatcgtgatcactacggtaataaacgtctggatctggctggccccctcctggcttttcttttccgcggtatgtttaaaaacctgctgaaggaggtcaggatctacgcgcagaagtttatcgacagaggaaaggacttcaacctggagctggcaattaaaactcgcatcattagcgatggccttaaatactcactggccacaggaaattggggggaccagaaaaaggctcatcaggctagggccggggtttcacaagtgctgaatagattaacctttgcaagcactctctcccatctacgacgccttaatagcccgatcgggcgcgatgggaagctcgctaaacccagacagctgcataatacactatggggcatggtgtgtcctgcagagaccccagaggggcacgcagtgggtctggttaagaacctcgctctgatggcatacatctcagttggttctcagcctagccctattctggagtttcttgaggagtggtccatggaaaacctcgaagagatctcgcccgccgctattgctgacgcaactaaaatatttgtgaatgggtgttgggtaggaatccacaaggaccctgagcagctcatgaataccctccgaaagctccgacgacagatggacatcattgttagcgaagtatccatgattagagacatccgggaacgcgagattaggatctatacagatgccggtagaatttgtcggcctttgcttattgtggagaagcagaagttacttctcaagaagcgccatatcgaccaattgaaagagcgcgagtataacaactactcctggcaggacttggtcgcgtccggagttgtggagtatattgacacattggaggaggaaacggttatgctcgccatgacccccgatgacctccaggaaaaagaggtggcctattgtagtacctacactcactgcgagattcacccatcgatgatacttggcgtctgcgcttccattattccctttccagatcacaaccagtctcctaggaatacctaccaatcagccatgggaaagcaggctatgggggtttatataacaaactttcacgtcaggatggatactctggctcatgtgctttactatccccagaagcccctcgtgacaacacgctctatggagtatctgcgattcagggaactccccgcaggaataaacagcatcgtggccatcgcgtcctacactgggtacaatcaagaagactccgtgattatgaacagatcagctgttgatcgaggtttttttagatccgtgttttacagatcttacaaagagcaggaaagcaaaaagggttttgatcaggaggaggtgtttgagaagcctactagagagacttgtcaaggcatgcggcacgctatttacgataaactcgatgacgatgggctgattgccccaggagtgagggtgtccggcgatgacgtcatcatcggaaaaaccgtcacactgccggagaatgaagacgagttggagagcacaaaccggcggtatacaaagcgggactgttcaacattcctccggacttccgagactggcatcgtcgatcaggtaatggttacactgaaccaagaggggtataaattttgcaagattcgggtaaggtctgttagaataccacagatcggtgacaaattcgcatcgaggcatggccaaaaaggcacctgcggaatccagtatcgccaagaagacatgccctttacctgcgaaggtatcacgcctgatatcatcatcaatcctcacgcgattccatctaggatgactattgggcaccttattgaatgtctccagggcaaggtatccgctaacaaaggtgaaataggagacgccacccccttcaacgacgccgtcaatgtacagaagatctccaatctcttgtctgattacgggtaccaccttaggggaaacgaggttctgtataacgggttcaccggtcgcaaaatcacaagccaaatattcataggtcccacctattaccagcggctgaagcatatggtggacgataagattcatagtcgggctcgcggacccatccagatactaaacagacagccaatggaggggcggtcccgtgatggaggactaaggttcggtgagatggaacgggactgccaaatcgcacacggggcagcccagtttctgcgcgagaggttattcgaggcatcagacccataccaggttcacgtatgcaatctgtgcggtatcatggccatcgccaacacccggacccatacctacgaatgtagaggctgtcgaaataagacccaaatctcactggttaggatgccgtatgcctgcaagcttctgtttcaggagctcatgagcatgtcgatagcacccagaatgatgtccgtttag

SEQ ID NO: 12786 - DNA, 3525 bp, Artificial Sequence
  Description of Artificial Sequence: Synthetic coding sequence
atgtacgatgccgatgaagatatgcagtacgatgaagacgacgatgaaatcactcccgatctctggcaggaagcatgttggatcgtgatttcgtcctatttcgacgaaaaaggacttgtgaggcagcagttggatagctttgacgaattcattcaaatgagtgtgcagaggattgtggaggatgctccacccatcgatctacaggccgaggcacagcatgcttcaggagaagtagaggagccacctagatacctcctgaagtttgagcagatctacctgtcaaaaccgactcattgggagcgggatggcgcgcccagtccgatgatgccaaatgaggcaaggcttcgtaacctcacatactccgcccccctgtacgtagacataaccaagacggtcatcaaggagggtgaagaacagctgcagactcagcaccagaaaacgtttatcggaaagatcccaattatgctgaggtctacgtattgccttctgaacggactcaccgacagggatctgtgtgagttgaatgagtgccctttggaccccgggggctactttatcattaatggatctgagaaggtgttgatcgcacaggaaaaaatggctacaaacaccgtgtacgtattcgccaagaaggacagcaagtatgcatacacgggcgagtgtcggtcatgcttggagaattcttccagaccaacctctacaatttgggtcagcatgctggcacgaggaggccaaggcgcaaagaaatccgctatcggacagaggatcgtcgcaacactcccatacatcaagcaggaagtgcccataatcattgtcttccgagccctaggtttcgtgagtgacagggatattctggaacatattatttatgacttcgaagatcctgagatgatggaaatggtgaagcccagcttggacgaagccttcgtgatccaggagcagaatgtcgcactcaatttcataggctcccggggagctaaacctggcgtgactaaggagaaaaggattaagtatgccaaagaggtgcttcagaaggagatgctcccccatgtgggggtctctgacttttgtgagaccaagaaggcttatttcctgggctacatggtgcataggctgctactggccgccttggggcgccgggagttagacgatagggaccattacggcaataagcggctcgacctggccggaccactactcgcgtttctttttcgcgggatgtttaagaatcttctgaaggaggtcaggatatacgcccagaagttcatcgaccgcgggaaggatttcaaccttgaactagctatcaagacgcgtataatctctgatggcctcaaatacagcctggcgaccggaaactggggagaccagaaaaaggcacaccaggcccgagccggcgtcagtcaagtgttgaacagacttacatttgcttctactctgtcccacctgcggaggcttaacagtcctattgggagggatgggaagctcgcaaagccaagacagcttcataacaccctatggggcatggtgtgtccggcggagacgcctgaaggccacgccgttggccttgttaaaaatcttgccttgatggcctacatttcagtggggagccagccctcaccaatattggagtttttggaagagtggagcatggagaacctggaagaaattagcccagctgcgatcgcggatgcaaccaagatcttcgtcaatggctgttgggtgggaatccataaggatcccgagcaactgatgaacaccctgagaaagttacggcgacagatggatattatcgtgtccgaagtctcaatgatccgagatataagggaaagggagattcgcatctataccgacgcgggccggatctgtcgacccctcttaatcgtggaaaagcagaaactactgctgaagaagaggcatatagaccagctcaaggagagagaatacaataattatagttggcaggacttggtagccagcggtgtggtggagtatattgacaccttggaggaggagactgtgatgctcgcaatgaccccagacgacttgcaggaaaaggaagttgcgtactgctctacatatacgcactgcgaaatacacccatctatgatccttggtgtctgcgcctcaatcatcccattcccggatcataaccagagtcctcgcaatacctatcagagtgcgatggggaaacaggccatgggagtctacataaccaactttcatgtccgcatggacaccttggcacacgtgctctattacccacaaaagcccctggtaactacgaggtctatggaatatttacgattcagagagctgcccgcagggatcaatagcatagtggctatcgcctcttataccggctacaatcaggaagactccgtaataatgaaccgctctgctgtggaccggggcttctttcgttccgtcttttatagatcttataaggagcaggaatctaaaaaaggtttcgatcaagaggaagtgttcgaaaagcctactagagaaacatgtcagggcatgcgacacgctatctacgataagctggatgacgatggcctcatcgctccaggtgtccgcgtgtctggggatgacgttatcatcgggaagacagtgaccctcccggaaaacgaggacgaattggaatctaccaaccgccgctataccaagcgggactgcagcacgttcctccgaactagcgagactggtattgtggaccaagtgatggtcacgcttaaccaagaaggatacaagttttgtaagatcagggtgagatcagtgcgaatcccacaaattggcgataagttcgccagcagacatgggcagaagggtacttgcggcatacagtaccgacaggaggacatgccatttacgtgcgagggcataactccggacataatcataaatcctcacgcgatcccttctcgaatgaccatcggtcatctgatcgagtgtctgcaaggcaaggtgagcgccaataagggagagatcggcgacgccacaccgttcaacgacgctgtcaacgtccaaaaaatcagcaatttactctcagactatggctaccaccttagaggaaatgaagtgttatacaatggattcacagggagaaaaattacatctcaaatctttattggtccgacttactaccagcgcctgaagcacatggtggatgacaagatccattctagagcacgggggcccatacagatcctgaatcgccagcctatggaagggcgtagcagagacggcggcctgcgatttggagaaatggagcgcgactgccaaatcgctcatggcgccgctcagttcctgcgagagagactgttcgaagcatcagatccgtatcaagtccacgtctgtaatctgtgcggaataatggctattgctaacacccggactcatacatatgagtgtagagggtgcaggaataagactcagattagcttagtgcggatgccttacgcttgtaagctgctgtttcaggaactgatgtcaatgagcatagctccaagaatgatgagcgtttag

SEQ ID NO: 12787 - DNA, 429 bp, Artificial Sequence
  Description of Artificial Sequence: Synthetic coding sequence
atggcagcagggggttcagatcctagggccggggacgtcgaggaagatgccagtcagcttatttttccgaaggagtttgaaactgctgagaccctccttaattcagaagttcatatgttgctagagcaccgcaaacagcagaacgaatcagccgaggatgagcaggaactgtcagaagtgttcatgaagactctcaactacaccgcccgattctcaaggttcaaaaaccgcgagacaatcgccagtgtccgctctcttttgctgcaaaagaaactccacaagttcgagctggcgtgtctggccaatctgtgtcctgagaccgccgaagaatccaaggcactgattccgtcgcttgaaggtcgcttcgaggacgaagaactgcaacaaatactggatgatatccagaccaagcgaagtttccagtattag

SEQ ID NO: 12788 - DNA, 348 bp, Artificial Sequence
  Description of Artificial Sequence: Synthetic coding sequence
atgaacgctcctccagcatttgagagttttctcctgttcgagggcgaaaagattacaattaacaaagacaccaaggtgcctaacgcttgtctgtttaccattaataaggaggaccacaccctaggaaatataatcaagagtcagctgctgaaggacccccaagtgctcttcgcaggctacaaagtaccccatcccctggaacacaagatcatcattagagtgcagacaacacctgactattctccgcaggaggccttcacaaacgccattaccgacctcatttccgagctgagcttactggaggaaaggtttcggacctgcctgcttccattgagattattgccctag

SEQ ID NO: 12789 - DNA, 348 bp, Artificial Sequence
  Description of Artificial Sequence: Synthetic coding sequence
atgaatgccccacccgccttcgaaagttttctgctgtttgaaggtgaaaagatcacaataaacaaggatacaaaagttccaaatgcatgtttgttcacaattaacaaagaggaccatacgttaggcaacatcatcaaaagccagctgcttaaagaccctcaggtgctgttcgctgggtacaaggtgccccatcctctggagcacaaaatcatcataagggtccaaactacccctgattatagcccccaagaggcatttaccaacgccatcaccgacttgatctctgagctgtctctgctggaggaacggtttaggacttgcttgctcccattacgtctcctgccttag

SEQ ID NO: 12790 - DNA, 1107 bp, Artificial Sequence
  Description of Artificial Sequence: Synthetic coding sequence
atgtgctccttacctcgcggatttgagcctcaggccccagaagatctagctcagcggtcacttgttgagctgcgcgaaatgctgaaacgccaggaaaggttgttacggaacgaaaaattcatatgtaaactgccggacaaaggtaagaagattttcgactctttcgccaaactgaaggcagctattgcagagtgtgaggaagtgagacggaagtcggagctgttcaatccagtgagccttgactgtaaactaagacagaaagcaatcgctgaagtggacgttggtacggacaaagcccaaaactctgatcccatcttggacacttcctccttggtgccaggctgttcctctgtcgacaatataaagagtagtcagacttcccaaaaccagggattggggcggcctacgcttgaaggcgacgaagagacctccgaagtagaatacaccgtaaacaaaggacccgcctcttctaatcgagaccgagtgcctcccagctcagaagcgagtgagcaccatccacgccatcgtgtgtcttctcaggccgaagacactagtagctcttttgacaatctcttcatcgatagactacagagaattactatcgccgaccaaggagagcagcaaagtgaagaaaacgctagcactaagaacctgaccggcttgagctcaggcacagagaagaaacctcattatatggaggttctggaaatgagggccaagaaccctgtaccccagctgagaaagtttaagactaatgtgttgccattccgccagaacgactcctcatcgcattgccaaaaatccgggtcccctataagtagcgaagaacgacgtaggagggacaagcagcacctcgatgacattactgctgcccgcctcttacctctgcatcacatgcctacccagctcctctccatagaggaaagtctggccctgcagaagcaacagaagcagaattacgaggagatgcaagccaaactcgcagcacagaaactggcagagcgtctgaatatcaagatgaggtcttacaatccagagggagagtccagcggacgctacagggaagtgcgtgacgaagatgacgactggtcctctgacgaattttag

SEQ ID NO: 12791 - DNA, 636 bp, Artificial Sequence
  Description of Artificial Sequence: Synthetic coding sequence
atgtgttccctccctagggggtttgaaccccaagcgccagaagatctagcacagcggtctctcgtggaactccgcgaaatgttaaaaagacaagaaagactcctgcgcaacgaacttcagagaatcactattgccgatcaaggggaacagcagtccgaggagaacgccagcacaaaaaacctgaccggcctgtcctccggcacagaaaaaaagcctcactatatggaggttctcgagatgcgggccaagaatccagtccctcaattgcgcaagtttaagacgaacgttctgcctttccgccagaacgactcttcctctcactgccaaaagagcggcagccctatctcttccgaagagaggaggcgacgagacaagcagcacctggacgacataaccgccgcgagattactgcctctgcatcatatgcccacacagctcttgtcaatcgaggagagtctggcgctgcagaagcagcagaaacagaactacgaggagatgcaagcaaagttggcggcacagaagttagccgagagactgaatatcaagatgaggagttataatccagagggcgaaagctcaggtcgttaccgagaagtccgagatgaagacgatgattggagctcggatgagttttag

SEQ ID NO: 12792 - DNA, 1092 bp, Artificial Sequence
  Description of Artificial Sequence: Synthetic coding sequence
atgtgtagtctgcctagaggctttgagccccaggcccccgaggacctggctcagagatcgctggtagagcttagagagatgctcaagcgtcaggagagattgctgaggaatgagaagtttatctgcaagctcccagacaaaggcaagaagattttcgatagtttcgccaagctcaaggcggcaatcgccgagtgcgaggaagttcgtaggaagtccgaactatttaatcccgtcagcctcgattgcaagctgcggcaaaaggcgatcgccgaggtggacgttggaacagataaagcccagaatagcgacccgatcctggacacttccagcctggtgcccggatgtagcagcgtggataatatcaagtctagccagacatctcagaatcaggggctggggcgaccaactctcgagggggacgaggaaacatcagaggtggaatacaccgtgaacaaggggccagcctcctcaaatagggatagggtgcccccttccagtgaagcctcggaacaccacccaagacaccgcgtgagttcccaggccgaggacacgtccagctcctttgataacctgttcattgatcgactacagcgcataaccatcgctgatcagggagagcaacagagcgaagaaaatgcttctacgaagaatctcacagggctgtcttccggcaccgagaagaagccccactatatggaggtcctcgaaatgcgagccaaaaacccggttcctcagctgcgaaaatttaagactaacgttctgcccttcaggcaaaacgactccagttcccactgccaaaagagcggcagcccaatttcctccgaggaacgcagacgccgggacaagcaacatctggatgatatcacagctgctagactgcttccattgcaccatatgccaacgcagttgctgtccatagaggagtctctggccctgcagaagcagcagaagcagaactacgaagagagacctttctactctcctcagtaccgctcatccatgaacttgcttagcctggcagccgctgccaaggatacacgcggctccaagtccggaaaaatggggtcccttgccctcctgaccaaattgtag

SEQ ID NO: 12793 - DNA, 1605 bp, Artificial Sequence
  Description of Artificial Sequence: Synthetic coding sequence
atgacccaagccgaaattaagctctgtagtctactgttacaggaacattttggcgagatcgtggagaaaattggggtgcacctcattaggacgggctcccaacctcttcgggttattgctcatgacaccggtacctctctggatcaggttaaaaaggctctgtgtgttctggtacagcacaacctggtgtcgtatcaggtccacaaacggggcgttgtggaatatgaggcacaatgttcgcgagttctccggatgctcagatacccaaggtacatttataccactaaaaccctgtactccgataccggggaactgatcgtggaagaattactgttgaacggcaaacttacaatgagcgcggtggtgaagaaggtggccgataggttgaccgaaacgatggaagacgggaaaacaatggattacgccgaagtttcaaacaccttcgtgcgccttgctgatactcatttcgtacagcgttgtccttccgtaccgaccaccgagaattccgacccaggaccccctcctcctgccccaacacttgtgattaacgagaaagacatgtacctggttccaaagctgtcactgatcggtaagggcaaacggcgcagatcatcggatgaggatgctgcaggcgagcccaaagccaaacgccccaaatataccactgacaacaaggagcccataccagatgatggaatatactggcaggcaaatctcgatagatttcatcagcatttccgcgatcaagcgattgtcagcgcagtcgcaaataggatggatcagacctccagcgaaatcgtccgtactatgctccgcatgtcagaaattacgacctcaagttctgcccctttcactcagcctctgagttcgaatgagatctttagaagtttacccgtcggttataacatttccaaacaggtgcttgaccagtatctcaccctcctcgcagacgatcctcttgagttcgtcggcaagtcaggcgacagcgggggtggcatgtacgtcatcaatctgcacaaagcccttgcctccctcgctacagccacgctggaaagcgtagtgcaggagaggttcggttcccggtgcgctcgaatctttcgactcgtgctgcagaagaagcatatcgagcagaagcaagtggaagactttgccatgatccccgccaaagaggcaaaggacatgctgtataaaatgctgtcggagaatttcatgtcattgcaagagatccctaagacacccgaccatgcaccttcacggactttctatctgtatactgtcaacatcctgagtgccgccaggatgttactccatcggtgctacaaatccatcgctaacctgatcgagagacgtcagtttgagaccaaagaaaacaagaggctcctggaaaagtcacagcgggtggaagcgatcatagcctccatgcaggctacaggagctgaggaggcacagctacaagagattgaagagatgatcaccgcacccgagcgacagcagcttgagaccttaaagagaaatgtgaacaagcttgatgcctcggagatccaggttgacgagacaatatttctgctggagagttacatcgagtgtacgatgaagagacagtag

SEQ ID NO: 12794 - DNA, 1236 bp, Artificial Sequence
  Description of Artificial Sequence: Synthetic coding sequence
atgacacaggccgagataaaactctgttccctcctgttgcaggagcactttggcgagattgttgaaaaaatcggtgtgcacctgatccggacgggttctcagccactgagggtcattgcacacgacacaggcaccagtcttgaccaggtgaagaaggccctatgcgtcctcgtgcaacacaacctcgtgagctaccaggtgcataagcggggagttgtggaatacgaggctcagtgcagtagagtgctgcgtatgctgagataccccaggtacatttacacaaccaagactctgtattccgacaccggcgaacttattgtggaagaattgttgctgaatggtaagctgacaatgtctgcagtggtcaaaaaggtcgctgacagacttactgagacaatggaggatggaaagaccatggactacgctgaggtctcaaatacattcgtccgactggccgatactcattttgtccaacggtgcccaagtgtgccaactacggagaacagcgacccaggcccgccaccacccgcccctactctggtcatcaatgaaaaggatatgtatctcgtgccaaaactgagtctcattgggaaaggcaagagacgccgctcctctgatgaagacgcagccggagaacccaaagccaagcgcccgaaatacaccacggacaataaggaaccgatccctgacgatggaatctactggcaggcaaaccttgaccgcttccaccagcacttccgcgaccaagcgattgttagtgctgttgctaatcgtatggatcagacgtcctccgaaatcgttcggactatgctacggatgagtgagatcaccaccagttcctccgccccattcacacagccactttcaagtaacgagatctttaggtccctgccagtcggctacaatatttccaaacaggtgctggaccagtaccttactctgcttgccgatgacccattagagttcgtcggtaagtccggggatagtggcggcggaatgtatgtgatcaacctacacaaggccctggcgagcctcgccaccgccacactagagtccgtggtgcaagaaagatttggctcccgatgtgcccgtatctttcggttagtgctgcagaagaagcatatcgaacagaaacaagtggaggacttcgctatgattcctgccaaagaggccaaggacatgctctataaaatgttaagtgagaatttcatgtctcttcaagtggggtgccagtag

SEQ ID NO: 12795 - DNA, 1197 bp, Artificial Sequence
  Description of Artificial Sequence: Synthetic coding sequence
atgagcgagggtaacgccgctggagaaccctctactcctggtggcccgcggcccttactgaccggagccagagggctgatcggcagaaggccagcccctccacttacacccgggagactcccatccatcaggtccagagaccttaccctggggggtgtgaaaaagaaaacttttacgccaaatataatctctagaaaaattaaggaggagccgaaggaagaagtaacggtgaagaaagaaaagcgggagagagatcgggaccgccagcgggaaggccacggtaggggacgcggccggccagaggtcatccagtcacactcgatctttgagcaaggacctgccgaaatgatgaagaagaaagggaattgggacaaaaccgtggatgtttctgacatgggcccctcccacattatcaatataaagaaagaaaaaagggagaccgacgaggagactaaacagattttgagaatgttagagaaagacgacttcctggacgatccaggcctgcggaatgacacccgcaatatgcccgttcagcttcctctagcacattcggggtggttgtttaaagaggaaaacgacgaacccgatgtcaagccatggctggccggcccaaaggaggaggacatggaggtggacatacccgccgtcaaagttaaagaagaaccaagagacgaggaggaggaagcaaaaatgaaggccccaccgaaggccgcaaggaagactcctggactgcccaaggacgtgtctgtggcagaactgttgcgggaactgtccctgacaaaagaagaagaactgctgttcctgcagcttccagatactcttcctgggcagcctcccacccaggatatcaaaccgatcaaaacagaagtacagggagaagacgggcaagtagttcttatcaagcaagagaaggacagagaggccaaactggccgagaatgcatgcacactcgcagacctgacagaaggccaagttggcaagttacttatccgaaagagcggacgcgtgcagcttctattgggtaaagttactctggacgtaacaatgggtaccgcttgttccttcctgcaagagctagtcagcgtaggcctgggcgactcacggacaggcgagatgaccgtcctgggtcacgtgaagcacaagttagtgtgttcccctgactttgaaagcttgctggatcacaagcatcgctag

SEQ ID NO: 12796 - DNA, 1197 bp, Artificial Sequence
  Description of Artificial Sequence: Synthetic coding sequence
atgtctgagggaaacgccgccggtgagccttcaactcctgggggccctcgtcccctactcactggcgcccgcggcctgatagggagacgacctgccccaccgctcacacctgggcgcctgccaagcattcgtagccgcgatctcaccctaggcggggtgaagaagaagacctttacccccaacatcattagccgcaaaattaaggaggagcccaaagaggaagtgaccgtcaagaaggaaaaacgcgagcgcgacagagacaggcagagagagggccacggccgtggcaggggacggccggaggtgatccagtctcattccatctttgaacagggccctgccgaaatgatgaaaaagaaaggcaattgggacaaaacagtagacgtctctgatatggggccatcccacatcattaatatcaaaaaagaaaagcgggagacagacgaagagaccaagcagattctccgcatgctagagaaggatgatttccttgatgacccaggactgcgtaacgatactcggaatatgccagtacagctgccgctcgcccactctggctggctcttcaaggaggagaatgacgaaccagacgtaaaaccatggctggcggggcctaaagaggaggatatggaggtggacatcccagccgtaaaggttaaagaggaacccagagatgaggaagaggaagccaaaatgaaggcaccaccgaaggcagccaggaagacccccggcctgcccaaggacgtgtccgtggcagagcttctcagagagttatccctgactaaagaagaggagctgctattcttacaactacccgacacactcccaggacagccccctactcaggacattaaacctatcaaaaccgaagtccagggcgaggacggtcaggtggtcttgatcaagcaagaaaaggacagagaagccaagctcgccgaaaatgcttgtacactagcagacctaacagagggtcaggtcggcaaactcctgattaggaagtctggcagagtgcagctcctgttagggaaagtgactctcgacgtaaccatggggaccgcatgcagcttcctgcaggagctggtctcagtgggactgggcgacagccgtactggagaaatgaccgtgctggggcacgttaagcataaactcgtttgcagcccagatttcgagtcactgcttgatcacaaacatcgctag

SEQ ID NO: 12797 - DNA, 2127 bp, Artificial Sequence
  Description of Artificial Sequence: Synthetic coding sequence
atggccaatgaggaggacgaccctgttgtgcaggagatcgatgtctatctggctaagtcactggctgagaaactgtatctgtttcaataccccgttaggcccgcctctatgacatacgatgacatacctcacctatccgcgaagatcaaaccaaaacaacagaaggttgagctcgagatggccatagacacgctgaatcccaactattgtaggtccaagggggagcagattgccttgaacgtggacggcgcctgcgccgatgagactagtacgtatagttcgaaactcatggacaagcagacattctgttcctctcagactaccagcaacacgtcccgttacgctgctgccctgtaccggcagggggaattgcacctgacgcccctgcacggtatactgcagctgcgaccctctttttcttacctggacaaggcagatgctaagcacagagaacgtgaagccgccaatgaggcgggcgatagcagccaagacgaggccgaggatgacgttaagcagattaccgtcagattctctaggcccgagtctgagcaggctagacagaggcgcgtccagtcttacgagttcctacaaaagaaacatgccgaagagccatgggttcacctacactactatggtctgcgggactctagatcggagcacgagaggcagtacctcttatgtccaggcagcagcggcgtggaaaacacagagctggtcaagtcccccagtgaatatctgatgatgctgatgcctccgtcgcaggaagaggagaaagacaagccagtcgctccttccaacgtcctgtcaatggctcagctgagaaccttgcctctggcagaccagattaaaattttgatgaaaaacgtgaaagttatgccatttgccaacctgatgtccctccttggacctagtatcgatagcgtggctgtgctgcgtggaatccagaaggtcgctatgctcgtccagggaaactgggtggtgaagtcagatattctgtaccccaaagatagctcttccccacacagtggtgtgcccgccgaagttttgtgtcggggcagagacttcgtgatgtggaagttcacgcagtcaagatgggtcgtacgcaaggaggttgccacggtgaccaaactgtgcgcggaggacgtaaaggacttccttgagcacatggccgtggtgcggataaacaaaggatgggagttcatcttaccatacgatggggagttcatcaaaaaacatccagatgtggtgcaaaggcagcacatgttgtggacgggcatccaggcaaaactggaaaaagtgtataacctggtcaaggaaactatgccgaagaaacccgacgcgcagtcagggcccgcgggcttggtgtgcggggaccagagaatccaggtagctaagacaaaagctcaacagaaccatgccctgttggagcgtgaattgcagcggcggaaagagcagcttcgcgttcctgccgtacctccaggcgttcggatcaaagaagagccagtttccgaagagggcgaggaggacgaggagcaggaggcagaggaagagccaatggatacctcaccaagtggactccattctaaattggccaacggcctcccgctgggcagagctgctggaacagacagcttcaatgggcaccctcctcagggatgcgcctctaccccggtggctagggagttgaaagcttttgtggaagccacgttccagagacaattcgttctcactctaagcgagctcaagagactttttaatctgcacctggcatctctgcctccaggccacaccctatttagtggaatctcggacaggatgctgcaagacaccgtccttgcagcgggctgcaaacagattctggtgcctttccccccccagaccgcggcctcccccgatgagcagaaggtgttcgcgctttgggaaagcggggacatgagcgatcaacacaggcaggtgcttctggagattttttccaagaattacagagtgagacgaaatatgattcagtctcgcctcacacaggagtgcggagaagatctgtcgaaacaggaggttgataaggtcctgaaagactgctgtgtgtcttacggcggcatgtggtacctgaaaggcacagtacagtcttag

SEQ ID NO: 12798 - DNA, 2001 bp, Artificial Sequence
  Description of Artificial Sequence: Synthetic coding sequence
atggctaatgaagaggacgatccagtggtgcaggagatcgacgtgtatctggccaagagtctcgccgagaaactttatcttttccagtaccctgtgagaccagcatcaatgacatatgacgacatcccccatctgtcagctaagattaagccaaagcagcaaaaggtggagttggaaatggcaattgatacattgaatccaaactactgtaggtccaaaggggagcagattgctctcaacgttgacggcgcctgcgctgatgagaccagtacatattctagcaaattaatggacaagcagacgttctgtagcagtcagacaaccagcaatacttcacgatatgctgccgcactgtatcgccagggtgagttgcacctgactccgttgcatgggatcctccagctgcgcccttcttttagctacctggacaaggccgatgcaaaacacagagagcgggaggcagcaaatgaggcgggcgattcgtcacaggacgaagcggaagacgacgtgaaacagattactgtgcggttctctcggccagagtccgagcaggcaagacagagaagagtccagagctacgaatttctccagaaaaagcacgccgaggagccctgggtccacctgcactactacggtctacgcgatagtagatccgaacacgagcggcaatacctgctgtgtcccggcagttctggcgtggagaatacggagctggtcaaatccccgagtgaatacttaatgatgctcatgccaccctctcaagaggaggagaaggacaagccggtagccccctccaacgttctcagcatggcccagctgcggactctcccactcgctgaccagatcaaaattctcatgaagaatgtgaaagtgatgcccttcgccaatttgatgagcctcctgggtccaagtattgactcagtggctgtactccgtggaatccagaaggtggcaatgctcgtccagggaaactgggtcgtgaagtctgacatactttacccaaaggattcttcatcaccacactctggagtacccgccgaagtcctgtgccgcggccgggactttgttatgtggaagtttacacagagtcgctgggtggtgagaaaggaagttgccacagtaactaagctgtgcgcagaagatgtcaaggacttcttagagcatatggccgtagtccgaattaataaaggttgggaatttatcctgccttatgatggcgagttcataaaaaagcacccagacgtcgtccagcgacagcatatgctgtggacggggattcaggctaagcttgaaaaagtctacaacttggtgaaagaaacaatgcccaaaaaaccagacgctcagagtggcccagcaggccttgtgtgcggcgatcagcgtatccaggtcgcaaaaaccaaagcacagcagaatcacgctttgctggaacgtgaactgcagcggagaaaagagcagctgcgcgttcctgcagtgccaccaggcgtccggataaaggaagaacccgttagcgaggaaggggaggaggatgaggagcaggaagccgaggaggagccgatggacacatcgccatccgggctgcactccaagctggctaatgggctccctctaggacgcgccgcagggactgatagcttcaacggtcacccacctcagggttgtgctagtacacctgtcgccagagaacttaaggcatttgtggaggccacatttcagcgtcagtttgtattgactctgtctgagctaaaacggctcttcaacctacacttggcatcgttgccccctggccataccctgttctctgggatcagtgaccgcatgctgcaggataccgtgttagcagcaggctgtaagcagatcctggtcccatttccaccccagacagctgcttctccagatgaacagaaagtgttcgctctgtgggagtccggtgatatgtcagaccaagattgctgtgtgtcatacggaggaatgtggtatctgaagggtacagtgcaaagctag

SEQ ID NO: 12799 - DNA, 2019 bp, Artificial Sequence
  Description of Artificial Sequence: Synthetic coding sequence
atggccaacgaggaagacgatcccgttgtgcaagaaataaagcccaaacagcagaaggtcgagctggagatggcaattgatactctgaatcctaactactgtcgcagcaagggggagcaaatcgcactgaacgtcgatggtgcttgtgccgacgagacctctacctattcaagtaagttaatggacaaacagaccttttgctctagccagactactagcaacacatcgagatatgcagccgccctttacaggcagggcgagctgcatctgacccccctccacggaatcttacagctacggccctcgttctcatacctggacaaggcggatgcaaaacatcgcgagagagaggcagccaacgaggctggcgacagttctcaagacgaggctgaagacgacgtcaagcagatcaccgtccggttctctcggccagagagtgagcaggcccgccaaaggcgggtgcagagctacgagttcttacagaaaaagcatgccgaagagccttgggttcacctgcactactacggtttgagagactcccgatccgaacacgagcgtcagtacttgctgtgtcccggaagctctggagtcgagaatacagaactggttaaaagccccagtgaatatctgatgatgctgatgcccccatcgcaagaagaagagaaggacaagccagtggcgccatccaacgttttgtcaatggcccaactgagaacccttccattagcagatcagataaagatcctaatgaagaacgtgaaagttatgcccttcgccaatctgatgtcactcttgggaccatccattgactccgtggctgtcttacgagggatccagaaggtggctatgctcgtgcaaggaaattgggtggtaaagtctgacattctctatcccaaggatagctcttcacctcactcgggcgtacccgccgaggttctgtgtagagggcgtgatttcgtaatgtggaaatttactcagagccgttgggtagtgaggaaagaagtggccacggtgaccaagctgtgcgcagaggacgttaaagatttcctggaacatatggccgtggtgaggattaataaggggtgggaatttatcctaccatatgacggggaatttattaagaagcatcccgatgtagtccaaagacagcatatgttgtggacaggcatccaagctaagctcgagaaagtgtacaacttggtgaaagagacaatgcccaaaaaacctgacgcacagagcggccccgcaggcctagtatgtggggaccagcggattcaggtcgccaaaaccaaggctcagcagaaccatgccctgcttgagagagagctgcagcgtcgcaaggagcagctccgggtgccagctgtgccacctggggtgcgcatcaaggaagagccagtcagtgaggagggggaggaggatgaggaacaggaagccgaagaggaaccaatggacacttctccttcagggctccactccaaactggccaacggtctccctctgggcagagcggctgggacagactcatttaacgggcatccccctcagggatgcgcttcgacccctgtggctagggagctgaaggccttcgttgaggcaacctttcaacggcagtttgtgctgacactatcggaactgaagagactgtttaacctgcacctagcttcgcttccaccaggccatacattgttttccggaatctccgatcgcatgttgcaggacaccgtgttagccgctggatgcaaacagattttggtgccgtttcctccgcaaacagccgcctcaccagacgagcaaaaggtgttcgctttgtgggagtccggagacatgagtgaccagcataggcaagtcctcctggagatttttagtaaaaactatagagtgaggcgaaacatgatccaatcccggcttacacaggaatgcggagaagatttgagtaaacaggaagtcgacaaggtactcaaagattgctgcgtgagctatggggggatgtggtacttgaaaggcaccgtgcagtcctag

SEQ ID NO: 12800 - DNA, 2064 bp, Artificial Sequence
  Description of Artificial Sequence: Synthetic coding sequence
atggctaacgaagaggacgatcccgttgtccaagaaattgatgtgtacctggcaaaatccctcgcggaaaagctttatttgtttcagtaccctgtgaggcctgcttcaatgacttatgatgatatacctcacctaagcgcaaagatcaaacctaagcagcaaaaggttgagctggagatggcgatcgacaccctaaaccctaattactgtcggagcaaaggagaacagatcgctctgaatgtcgacggggcatgcgccgatgagacaagtacttacagctctaagctgatggacaaacagactttttgcagttctcagaccacttccaataccagcaggtatgccgcagctctgtatagacagggcgaactccacctgacccctctgcacgggatcctccagcttcggccgagtttctcctatctggataaagctgatgcaaagcacagggaaagagaggccgccaacgaagctggcgactccagtcaggacgaggcggaagacgatgtgaaacaaatcaccgtacgcttctcacgccctgagtcagaacaggctcgtcaacgacgcgtgcagtcctatgagtttctacaaaaaaaacacgctgaagagccatgggtgcacctgcactactacgggctgcgtgacagcagatctgagcacgagagacagtacctgctatgcccaggcagttcaggtgtggaaaataccgaactagtgaagtctccttccgaatacctgatgatgctcatgcctccgtctcaagaagaagaaaaggataaacctgtcgccccatctaatgttctcagcatggcccaattgcgcaccttgccactcgctgatcagattaaaatcttaatgaaaaacgtgaaggttatgcccttcgcgaaccttatgagtctgctgggcccgagcatcgactctgttgcagttctcaggggaatccagaaagtggctatgctagttcagggcaactgggtggtgaaaagcgacatcctgtacccaaaggattcgagcagcccacatagcggcgtgccagctgaggtcctgtgccggggccgtgactttgtcatgtggaagttcacccagagcaggtgggtggtgcggaaggaggttgccactgtgacaaagctgtgcgcggaggacgtcaaagacttcttagagcacatggccgtcgttcgcatcaataaggggtgggagtttatcctaccttacgatggcgaatttataaaaaaacacccggatgtcgtgcagcgacagcatatgctgtggacgggcatacaggctaaactcgaaaaggtgtacaacttagttaaggaaactatgcccaagaagcctgatgcccagagcggccctgcgggtctcgtgtgcggggaccagcgcatccaggtcgctaagacaaaggcccagcagaaccacgccctgctcgaaagagaacttcagcggcggaaggagcagctgcgggtacctgccgtcccgcctggcgtgcggataaaagaagagccggtgtctgaagaaggagaagaagacgaggaacaggaagccgaggaggagcccatggacacctcgcccagcgggcttcacagcaaactggcaaacggccttccccttggcagggccgccgggacagattcctttaacggtcaccctccccaaggctgtgcttccacacccgtcgccagggagctgaaagcatttgtcgaggctacctttcaaagacaattcgtgttgacactctctgaactgaaacggctattcaatctgcatctggcgagtctcccaccagggcataccctcttcagcggcataagtgatcggatgctccaggatactgtgctcgctgccgggtgtaaacagatattggtgcctttcccccctcagacagcagcctccccagacgagcagaaagtgtttgcactttgggaaagtggggacatgtccgatcaatcaagattaactcaagagtgcggcgaggaccttagcaagcaggaggtggataaagttttgaaggactgctgtgtgagctacggcgggatgtggtatttaaaggggaccgtgcagtcttag

SEQ ID NO: 12801 - DNA, 951 bp, Artificial Sequence
  Description of Artificial Sequence: Synthetic coding sequence
atggcagaggtcaaggtgaaagtacagccccctgacgccgacccagttgaaattgaaaaccgaatcatcgaactctgtcatcaattccctcacgggattacagatcaggtgattcagaacgagatgccacacattgaagcacagcagcgagccgtggcgattaatcgtctcttatccatgggccagctggacctcttgcggagcaatacaggactgctataccggattaaagatagtcagaatgccggtaaaatgaaaggaagtgataaccaagagaaactcgtttaccaaatcattgaggacgccggaaacaaggggatctggagcagggatatccgttacaagagcaacctcccgctgaccgaaattaacaagattcttaagaacctggaaagcaaaaagctgatcaaggccgtgaagagtgttgctgcgtctaaaaagaaagtctatatgctgtataatttgcaacccgacagatcggtgactggcggagcctggtatagcgatcaagacttcgagtccgagtttgtggaagtgcttaaccagcaatgcttcaagtttctccaaagcaaagccgagacggcacgcgaaagcaaacagaatcctatgatccagcggaactcgtcctttgccagcagccacgaagtgtggaagtacatatgtgaactcggtatctccaaagtagagctgtctatggaggacattgagacaatcttgaacactctgatttatgacggcaaggtggagatgacgattatcgctgcaaaggagggcaccgtgggctcagtggacggccacatgaagctatatcgcgccgtgaacccgattatcccccctacaggcctggtcagggcaccctgcggcctgtgccctgtcttcgacgactgtcatgaagggggcgaaatctccccatcaaactgcatatacatgactgaatggctagagttctag

SEQ ID NO: 12802 - DNA, 672 bp, Artificial Sequence
  Description of Artificial Sequence: Synthetic coding sequence
atggctgggaacaaggggagaggacgagccgcttacacgttcaacattgaggccgtcggcttttcgaagggagaaaaattgcccgacgtcgtgcttaagccacccccactcttcccagatactgactataagccagtgccactgaagactggcgaaggagaggagtatatgttagcactcaagcaggaacttagggagactatgaagcgcatgccatatttcatagaaaccccggaagaacggcaggacatcgagcgctattcaaagcgctatatgaaagtgtataaggaggaatggattcctgactggcgccgtctgcctagagagatgatgcccagaaataaatgcaaaaaggctgggccgaaacccaagaaggctaaagatgcgggaaaagggacacctcttactaacactgaggacgttctgaaaaaaatggaagagctggagaaacgcggagacggggaaaagtccgacgaggagaacgaggaaaaagagggtagcaaggagaaatccaaggagggggacgatgacgacgacgacgacgccgcagagcaagaagaatatgacgaagaggaacaggaagaggaaaacgattacatcaactcgtactttgaggacggagatgacttcggcgccgactctgacgataatatggacgaagctacttactag

SEQ ID NO: 12803 - DNA, 672 bp, Artificial Sequence
  Description of Artificial Sequence: Synthetic coding sequence
atggccggtaacaagggaagagggcgggccgcatacacctttaacatcgaagctgttggcttctcgaagggcgaaaagcttcctgacgttgtgctgaagcctccccccctgtttcccgataccgactacaaaccagttccactgaagactggggagggggaagaatatatgttagcactcaagcaggagctgcgcgaaaccatgaagcgaatgccctacttcatcgagacccctgaagagcgacaggacatcgagaggtactcaaaacgctatatgaaagtgtataaggaagagtggattcccgattggcggaggctgccgcgagagatgatgcctcggaataagtgcaagaaggccggacctaagccaaagaaggctaaggacgcagggaaaggcactcccctgactaataccgaagacgttctcaaaaagatggaagaactcgaaaaacgaggagatggagaaaagtcagatgaagaaaatgaggagaaagaagggtcaaaagagaagtccaaggaaggtgacgatgatgacgacgacgatgctgctgaacaggaagagtacgatgaggaggagcaggaagaagagaatgactacataaatagctactttgaagacggagatgattttggggccgactccgacgacaatatggacgaggcaacatactag

SEQ ID NO: 12804 - DNA, 528 bp, Artificial Sequence
  Description of Artificial Sequence: Synthetic coding sequence
atgttcgtgctcgttgaaatggtggataccgtccggattcctccctggcagtttgagagaaagcttaacgacagtatagcagaggaattgaacaagaagctggcaaacaaggtcgtgtataatgtcgggctctgtatatgcctgtttgatatcactaagctggaggacgcgtatgtgtttcccggcgacggcgccagtcacacaaaagtgtctttaggattctttgatgatatcctgattcctcctgagtcccttcaacagcccgccaaatttgacgaagcagaacaggtgtgggtttgggaatacgaaaccgaggaaggtgcgcatgacctttatatggatactggtgaagaaatacggtttcgagtggtcgacgaatcgtttgtagataccagcccaaccggacccagctctgctgatgcaactaccagcagtgaggaattgcccaaaaaggaggctccgtacacgctcgttggatccatttccgagcccggtttgggactgctatcttggtggacgagtaactag

SEQ ID NO: 12805 - DNA, 615 bp, Artificial Sequence
  Description of Artificial Sequence: Synthetic coding sequence
atgttcgtactcgtggaaatggttgatacagtgcgaatccctccctggcagtttgaacgaaagctgaatgacagcattgctgaagagctgaacaaaaagctggctaataaggtggtctacaatgtcggactgtgcatttgtctgtttgacatcaccaaactcgaggatgcatacgtgttcccaggagacggtgcatctcataccaaggtacacttccgctgtgtggtgtttcatccatttctcgatgagatactgattggaaagattaagggttgcagccctgagggtgttcacgtgtctctggggttcttcgatgacattctgatcccccctgaatctctgcagcagcccgccaagttcgatgaagctgagcaggtctgggtgtgggagtacgaaaccgaagaaggggctcacgatctctacatggacaccggagaagaaatccgatttcgagttgtcgatgaatctttcgtggacacctcaccaacgggtccctccagcgctgatgccaccacgtcgtctgaagaattaccaaagaaggaggctccctacacactggtagggtcaatcagcgagcccggcttgggtctgcttagctggtggacatccaactag

SEQ ID NO: 12806 - DNA, 615 bp, Artificial Sequence
  Description of Artificial Sequence: Synthetic coding sequence
atgtttgtgctagtggagatggtcgatacggtacgtattcctccatggcagttcgagagaaaattaaacgactccatcgccgaagaactgaacaagaagctcgctaataaggtggtgtataatgtggggctgtgcatttgtctctttgatattaccaagttggaggacgcatatgtgttccccggcgacggagcgagccatactaaagtgcacttccgctgcgtcgtgtttcacccgtttcttgacgaaatcctgattggaaaaattaaggggtgtagccccgagggcgttcatgtctctttggggttcttcgacgacatcttgattccacccgaatctctccaacaacctgctaagttcgatgaagcagagcaggtgtgggtatgggagtatgagactgaagagggtgcacacgacctttatatggacacaggtgaagagatacggttcagagtggtcgacgagagtttcgtcgatacaagtcctacaggtccctcgtccgcagacgcaacgacttcctccgaagaacttcctaagaaagaagctccctacacgctggtgggatctatttctgaaccaggccttgggctgctgagttggtggacctccaactag

SEQ ID NO: 12807 - DNA, 615 bp, Artificial Sequence
  Description of Artificial Sequence: Synthetic coding sequence
atgtttgtcctggtggagatggtggacactgtacgcattccaccttggcagttcgaaaggaagttgaacgatagtattgccgaggagctcaataagaagttggcgaataaggtggtgtacaacgtgggactctgtatatgcctgttcgacatcactaaactcgaagatgcatacgtgttcccaggggatggtgcctcccatacaaaggtccattttcggtgcgtagtgtttcatccattccttgacgagatcctcatagggaagattaaagggtgttcccccgagggagtgcacgtgagtctgggcttctttgacgacatacttatccccccagagtcccttcagcaacctgccaaattcgacgaggccgagcaggtgtgggtgtgggagtatgagacagaggagggcgcacatgatttatatatggatacaggcgaagaaatcagatttcgggttgtcgatgaatcctttgttgacacaagccccacggggccatcaagcgccgacgcaaccacttcctctgaggaacttccaaagaaggaggccccatacacattggtgggcagtatctctgagccagggcttggcctgctttcatggtggacttctaattag

SEQ ID NO: 12808 - DNA, 327 bp, Artificial Sequence
  Description of Artificial Sequence: Synthetic coding sequence
atgctcctattctgccccggatgcgggaatggcctgattgtagaggagggtcaacggtgccaccgattcagctgtaacacctgtccctatgtccataatattaccaggaaggtaactaatcgaaagtatcccaaactgaaggaagtagatgacgtcctggggggcgccgctgcctgggagaatgttgacagtacagctgagtcctgccccaagtgtgagcaccccagagcctacttcatgcagttgcagactagaagtgctgatgagcctatgaccacattctacaaatgctgcaatgctcagtgcggacacaggtggagggattag

SEQ ID NO: 12809 - DNA, 771 bp, Artificial Sequence
  Description of Artificial Sequence: Synthetic coding sequence
atgtctcgcaaaaagacacccaagagtaagggagcctccacacctgcagcttccacactccccacagcaaacggcgctcgccccgccaggtccggaaccgctctgagcggaccagacgcccctcccaacgggcccctccagccaggacgtcctagcctgggaggcggcgtagacttctacgacgtcgctttcaaagttatgctggtcggagatagtggcgtgggcaagacgtgtctgctggttcgatttaaagatggcgccttcctggccggaacttttatctctacagtggggatcgactttagaaacaaggtgttagatgtggacggcgtaaaggtgaagctccagatgtgggacacagccggccaggagagattccgttcagtgactcatgcatactacagagacgcccacgccctgttgctgttatacgacgtaactaataaggcctccttcgataacattcaggcctggcttacagaaatacacgaatacgcgcagcatgatgtcgccctgatgctcttgggaaataaggtcgacagcgcgcatgagcgggttgttaaaagggaggatggcgagaaactcgccaaggaatatggcctaccctttatggaaacgagcgctaaaacgggcctgaatgttgaccttgccttcaccgccatcgcaaaggagcttaagcagagaagtatgaaggctccaagtgaaccgagattccgattgcatgattacgtaaagcgggaaggccggggtgcttcttgctgtcggccgtag

SEQ ID NO: 12810 - DNA, 1668 bp, Artificial Sequence
  Description of Artificial Sequence: Synthetic coding sequence
atggacggggtagtgacagacctcatcacagtggggcttaaacggggttctgacgaattactgagttcaggcattatcaacgggcccttcaccatgaattctagcacgccctctactggggtttacgccaatggtaacgacagcaagaagttcaaacgggataggccgccttgctctccctcgcgcgtcctgcaccttcgcaagataccttgtgacgtgaccgaggccgaaattatctctcttggacttccctttggtaaggtgactaatctcctgatgctgaagggtaaatcacaggcttttcttgagatggcttcagaagaagccgctgtgacgatggtgaattactacacacccatcacccctcatctgagatctcagcccgtatacatccagtatagcaaccacagggagctcaaaacagataacctacccaatcaggctagggcacaggccgcattacaggcagtgagtgctgtccagagcggaagtttggccctcagcggcggcccctcaaatgaaggaacagtcctcccaggccagtctcctgtgcttcgcattatcatagagaatctattttacccagtcactctcgaagtcctgcaccagatcttctctaaatttggaactgtgttgaaaatcattacatttactaaaaataatcagttccaggcattactgcagtacgctgatcctgtgaatgcccactacgccaagatggcgctggacggacagaacatctataacgcgtgctgtacactgcgtatcgacttttctaaactgacttccttgaacgtcaagtataacaatgacaagagccgcgatttcaccagactagatcttccaactggggacggacaaccttcgctggaacccccaatggccgccgctttcggagcccccggtatcatttcctccccctacgctggggcagccggttttgcccctgccataggcttccctcaggctaccggactgtcagtgccagccgtgcccggagctctggggccgctgaccatcacttcatcagcagtgactgggaggatggcaatccccggagcttcaggtattcctggtaacagtgtcctgctggtgacaaacctgaaccctgacctcattaccccccacgggttgttcatcctgtttggcgtgtatggtgatgtgcatcgtgtgaagatcatgttcaataagaaggaaaacgcactggtccaaatggcggatgcaaaccaagcccagctggccatgaatcacctctctggacagcgcctttatggaaaggtccttagggctacgcttagcaagcatcaggcggtgcagctgcccagggaaggccaggaggatcaggggctcaccaaggatttttccaattcacctcttcatagattcaagaaaccaggaagcaaaaactttcagaacatctttccgccaagcgctaccctacatttaagcaatatccctccttcagttaccgtggatgacctgaagaatcttttcatcgaagctggatgcagcgtgaaagcatttaagtttttccaaaaagacagaaaaatggctctcatacagcttgggagtgtcgaagaagcaatccaggctctgatcgagttgcacaatcatgacctaggggagaaccaccacctgcgcgtttcctttagcaagtccactatttag

SEQ ID NO: 12811 - DNA, 1374 bp, Artificial Sequence
  Description of Artificial Sequence: Synthetic coding sequence
atggctttcctcgagatggcatctgaggaagccgccgtaacaatggtgaactactatacacccattacccctcatcttcggtcacagcccgtgtatattcaatactccaatcaccgagagcttaaaactgataacctacctaatcaggcacgagctcaagcagctctacaagccgtcagcgccgtgcagtccggtagcctggcgctcagcggggggccaagcaacgaaggcaccgtattaccggggcagagtcccgtacttcggatcattattgagaatctgttctacccagtgactttggaagtgttgcatcagatcttctctaaattcggcaccgtgctcaagatcatcaccttcaccaagaacaaccagttccaggctctgttacaatacgccgatccagtgaacgcccattacgccaaaatggctctagacggtcagaacatctacaacgcctgttgcactctgaggattgattttagtaagcttacttcactcaacgttaaatacaataatgacaagtctcgcgattttacccggcttgatctcccgactggagacggccaaccttctctggaaccgcctatggccgccgcgtttggcgcccctggtatcattagcagcccgtacgccggagccgccggcttcgctcctgctattggctttccgcaggccactggtctgagcgtgcccgccgtccctggcgccctcggaccgctaacgataacctccagcgctgtgaccggaaggatggctataccaggcgcttcagggattccggggaatagtgttcttctggttaccaacttaaacccagacctgatcacacctcacgggctgtttattttgtttggcgtgtacggagatgtgcacagagtgaaaattatgttcaataagaaagaaaatgctctggtgcagatggcagatgcaaatcaggcacagttagccatgaaccacctcagtggccagagactctacggtaaggtgctgcgtgccaccttgtcaaaacatcaggccgtccagctacctagggaagggcaagaagaccagggtcttaccaaggacttttcaaactcacctctgcatagattcaagaaacccgggagtaaaaactttcagaatatttttcccccatccgccacactccacttgagcaacatccctccctcggtgactgtggatgaccttaagaacttgttcatcgaagccggttgtagcgtcaaagcctttaaattctttcagaaggataggaaaatggccctgatccagcttggctcagtggaggaagctattcaggcactcatcgagctgcacaaccatgaccttggagagaaccaccatctgcgggtgagctttagcaagtctacaatctag

SEQ ID NO: 12812 - DNA, 1659 bp, Artificial Sequence
  Description of Artificial Sequence: Synthetic coding sequence
atggatggcgtggtaacagatctgataacagtgggtctgaagaggggatcagacgagctcctgagttctggcattatcaatggccccttcactatgaattcttccaccccttcgaccgcgaacggaaatgattcgaagaaatttaagagagaccgcccaccgtgctcccccagcagagtcttgcacctgagaaagatcccatgtgacgtgaccgaggcagaaatcatcagtcttggactgccgtttggaaaagttacaaatttactcatgctgaaggggaaatcccaggcgttcctggaaatggcctctgaggaagcagcagtgaccatggtgaactattatacacccatcacacctcacctacggtcccaaccagtgtacatacaatactcaaatcaccgcgaactcaagaccgacaatctgcctaaccaggctagggcccaggcggcccttcaggccgtgtctgcagtacagagcgggtcactcgcactgtcaggcggaccaagcaacgaaggaaccgttttaccaggacaatcaccggtcttacgaatcattatcgagaatctgttctacccagtgaccctcgaggtgttgcaccaaattttttccaagttcggcaccgtgttgaaaatcatcacttttaccaaaaataatcagttccaggccctgcttcagtacgccgatccagtaaatgcccactatgccaagatggcgctggacgggcagaacatctacaatgcgtgctgtaccctgagaattgatttctccaagctgacatctctgaacgtgaagtataataacgataagtcccgtgacttcacgagactcgacctacctaccggtgacggacagccgagcctggaaccaccaatggcagccgcctttggcgcccccggcattatctcgtcaccttacgccggcgccgccgggttcgcccccgccattggcttccctcaagccacaggtctcagcgtccctgctgttccgggggcccttggcccactgactattacgagtagtgctgtcaccgggcgtatggcgattcctggagcaagcggaatcccgggaaattctgtgctgctggtgaccaacctgaacccggacctgattaccccgcacggccttttcatactcttcggagtatacggcgatgtccatcgggtgaagatcatgttcaacaaaaaggagaatgcccttgtccagatggcagacgctaaccaggcgcagctggccatgaaccacctgtcaggccaacggctttacggtaaagtactgcgcgccaccctctctaagcaccaggctgtgcagctcccaagagagggccaggaggatcagggactgaccaaagatttcagtaatagccccctccaccgcttcaaaaaaccggggtccaagaatttccagaacatctttcctccctccgccacactgcacctgtcaaacatccccccctcagtaacggtggatgatttgaagaacctatttatagaagccggctgcagcgtcaaggcgtttaagttctttcagaaggacaggaagatggccttgattcagctggggtctgttgaggaagcaattcaggccctcatcgaactccataaccatgacctcggtgaaaatcatcatctccgggtatctttctccaagtccactatttag

SEQ ID NO: 12813 - DNA, 1575 bp, Artificial Sequence
  Description of Artificial Sequence: Synthetic coding sequence
atgaactctagcacacccagcaccggggtgtatgccaacggcaacgatagtaaaaagtttaaaagggataggcctccatgctccccctcccgtgtgctgcatctccgcaaaatcccctgtgacgtgactgaagccgaaatcatctcactgggtctcccgttcggcaaagtgacgaacctgctgatgctcaaaggaaagagccaggccttcctcgagatggcttccgaggaagcagcagtcacaatggtaaattattatacgcctatcacaccgcatctaaggtcccagcctgtctacattcaatactcaaaccatagagagctgaagacagacaacctaccaaatcaggccagggcccaggccgcattacaagccgtgagtgcggtgcaaagcgggtctctggccctatcaggaggaccatccaatgagggcacggttctgcccgggcagtcacccgtgctgcgcattatcatcgagaacctattctacccggtaacattggaggttctgcatcagattttctccaaatttgggaccgtgttaaaaatcatcacattcacaaaaaataatcagtttcaggcactgctgcaatacgcagatcccgtaaacgcacactacgctaagatggccttggacggacagaatatttacaacgcttgttgtacattgagaattgattttagtaaactgaccagtctcaatgtaaagtacaataacgataagtctcgggactttacccgcttagacctcccaactggggacggtcagccatcactggaacctcctatggccgccgccttcggagcaccaggaataatctcttcaccttacgcgggtgctgccgggtttgctcccgccattggattcccccaggccaccgggctgagcgtcccagctgtgcccggagcattgggcccgctgacgatcacttcttccgcagtcacaggcaggatggctataccaggcgcatccggcattccagggaactctgtgcttctggtgaccaacttaaacccggacttgatcacgccccacgggctgtttattctgttcggggtgtacggtgacgtccatcgtgtaaagatcatgttcaataaaaaagagaacgcgttggtccagatggcagacgctaaccaggctcagctcgcaatgaatcaccttagtgggcagcgcctgtatgggaaagtccttagagctaccctctccaagcatcaggcagtccagttgccgcgggaaggccaggaggatcagggactaactaaagacttctccaattctcccctgcatcggttcaaaaaaccggggtctaagaacttccagaatatcttcccaccttccgcaacactccatctctctaatatccctccaagcgtgacagtcgacgatctgaagaatctgttcattgaggcaggttgctcggtaaaggcattcaaattcttccagaaggaccggaagatggccctgatccagctcggttcggtggaagaggccatacaggcactcattgaactacacaaccacgacctcggagagaatcatcatctgcgggtaagtttttccaagagcactatctag

SEQ ID NO: 12814 - DNA, 234 bp, Artificial Sequence
  Description of Artificial Sequence: Synthetic coding sequence
atggacggcgtcgtgactgatcttatcaccgtggggctgaaaaggggatccgatgagctcctgtcgagcgggatcatcaatgggccattcaccatgaactcctccacccccagtactggcgtatacgccaacgggaatgactccaaaaagtttaagcgagatcggcctccctgctcgcccagcagagtactgcatttaagaaagatcccatgcgacgtgaccgaagctgaatag

SEQ ID NO: 12815 - DNA, 1677 bp, Artificial Sequence
  Description of Artificial Sequence: Synthetic coding sequence
atggatgcaagccccagccccttctcactccccaagaaattgaacgagttatcagcacggaggggaagtgatgagctgctctcatccggaattataaacggtcctttcacaatgaactcctccaccccaagtactgcgaacgggaacgatagtaagaaattcaaaagggatcgcccaccctgttccccctccagagttctgcatctgaggaaaatcccatgtgatgtgacagaagccgaaatcatttccctggggttaccctttggcaaagtcaccaatctgctcatgctgaaaggtaaaagtcaagcatttctcgaaatggcctccgaggaggccgcggtgaccatggtgaattactatacccccatcacccctcacctccgatcccagcctgtgtacattcagtactcaaatcacagggagttaaaaactgacaatcttcctaaccaggcgcgggctcaggcggccctgcaagcagtaagcgctgttcaaagtgggtctttggctctgagcgggggcccttccaacgagggcactgttcttcccggtcaaagtcccgtgctgcgcatcatcattgagaatctattctatcccgtcacattggaggtgctacaccagatcttttctaaattcggaacggtactcaaaataatcactttcaccaaaaacaaccaattccaggcccttctccaatacgcggaccccgtgaacgcacactacgctaaaatggctctggatgggcagaacatatataatgcatgttgcaccttgagaatcgacttctccaaactgacaagtctaaacgttaaatataacaacgataagtcgcgcgactttacacgactcgatctgcccacaggggacggacagcccagccttgaaccacccatggctgctgcatttggagcccctggaatcattagcagcccgtacgcgggagccgcgggctttgctcctgccataggtttccctcaggcaacgggcctaagcgtgcctgctgtccccggggccctgggtcctttgactattacgtcgagtgccgttactgggaggatggcaataccaggcgcaagcggaattccaggcaactccgtacttttggttactaaccttaacccagatctgatcacaccccatgggctctttatactcttcggggtgtacggcgacgtgcatcgagtcaagataatgttcaataagaaagaaaatgctctggtgcagatggccgatgccaatcaggcccagctggcaatgaaccatctatccggacagcgtttgtacgggaaggtcctgcgcgcaacactgtcaaagcaccaggcggtgcagctgccgagagaagggcaggaggaccaggggctgactaaggattttagcaattccccactccaccgattcaagaagccagggtccaagaacttccagaatatcttccccccctcagccacattgcacttatcgaatatcccccctagcgttaccgttgatgatctcaagaatctgtttattgaagcaggttgctccgtcaaagccttcaaattcttccagaaagaccgaaagatggctctcatccagctggggtcagtagaagaagccattcaggcacttattgaactgcacaaccacgacctgggagaaaatcaccacctgagggtctcattctctaagagcaccatttag

SEQ ID NO: 12816 - DNA, 1500 bp, Artificial Sequence
  Description of Artificial Sequence: Synthetic coding sequence
atggagaatggacagtcaacggccgcaaagttggggttacctccactcactcccgaacaacaggaggcactccagaaagctaagaaatacgccatggagcagtccattaaatctgtactcgtaaagcaaaccattgcgcaccaacagcagcagttaacgaacctgcagatggccgcacagaggcagcgggccctcgctataatgtgccgcgtatacgtaggctccatctactacgaattgggcgaggacacaattcgtcaggcttttgctccattcggcccaattaagtcaattgacatgagttgggactcagtcaccatgaagcacaagggcttcgcttttgtcgagtacgaggtccccgaggccgcgcagttggcgctggaacagatgaactctgtcatgctcggcggtcgaaatatcaaggttggaagaccatccaatattgggcaggctcagcctatcatcgaccagctcgcagaggaggccagggcgtttaataggatatacgtggcctcggtacaccaggacctttccgacgatgacataaaatcggtgtttgaagcctttggtaagatcaaatcctgcacacttgctcgcgacccaacgaccggtaagcataagggatatggattcatagagtatgaaaaggcccagagtagccaggacgctgtctcatccatgaacctgttcgatttaggggggcagtacctaagagtagggaaggccgtgactcctccaatgccattgctgacgccagccacacccggtgggctcccgcctgcagccgccgtcgcagcagccgcagcaaccgcaaaaattacagcacaagaagctgtggcaggcgccgcagtgctcggaaccctcgggacgccaggcctggtcagccctgcactcaccttggcccaacccctggggacactgccccaggccgtaatggcagcccaggccccaggcgtcatcactggtgtcacccccgcccgtcccccaatcccagtgacaattccctcagtcggtgttgttaatccaatcctggcctccccacctacactcggcctgctcgagccaaagaaagagaaggaagaggaggagttattccccgagagcgagcgtcctgaaatgctgagtgagcaggagcacatgagtataagcggatcaagcgccaggcatatggttatgcagaagctccttcggaagcaagagagcacagtaatggtcctaagaaacatggtggacccgaaggacatagacgacgatttggaaggcgaagtgaccgaggagtgcggcaaatttggggccgtgaaccgggtaatcatttatcaggagaaacagggcgaagaggaagatgccgaaatcatcgtcaagattttcgtcgaattcagtattgcttccgaaacacacaaggcaatacaagctctaaacggaaggtggttcgccggtcgcaaggtcgtggccgaggtgtacgaccaggagcggttcgacaattcagacctgagtgcttag

SEQ ID NO: 12817 - DNA, 1629 bp, Artificial Sequence
  Description of Artificial Sequence: Synthetic coding sequence
atggcgaccgcgaccatcgcgctgcaagtcaatggacagcagggaggcggatctgaacccgctgcagctgcggctgtcgtggcagctggcgacaaatggaaaccgccgcagggcacggattcaatcaaaatggagaatgggcaatcaaccgcagctaagcttggactgcctcccctgacccctgaacaacaggaagctttacagaaagccaaaaaatacgcgatggaacaatccatcaagagtgtcctggtcaagcagaccatcgctcaccaacagcagcagctcaccaacctgcagatggcagctcagagacagcgcgcccttgctattatgtgcagggtgtacgtgggaagcatatattatgaactgggggaagataccatacgccaggcttttgcaccattcgggcccatcaaatcgatagatatgagttgggatagtgtgaccatgaaacataaggggttcgcgtttgtcgagtatgaagtacccgaagccgctcagctggccctggaacagatgaatagtgtaatgttgggagggaggaacataaaagtgggccggccaagtaatatcggacaggcccagccaatcatagatcaactcgcggaagaggctcgcgcctttaaccggatatatgttgcctctgtgcaccaggacctgagcgatgacgacattaagagtgtttttgaagcctttggtaaaataaaaagctgcacactggcccgagaccccactacgggaaagcacaaaggctacggtttcatcgagtacgagaaagctcagagcagtcaagatgccgtcagcagtatgaacctcttcgatcttggcggccaatatttgagggttggaaaggctgtcacacccccgatgcccctcttgactcctgccacgcccgggggactgcccccagccgcagccgttgccgcggccgcagcaacagccaagatcaccgcgcaggaagcagtggccggtgctgccgttctgggaactctggggactcctggattggtcagccccgccctgaccctcgcacaaccactgggtactttgccccaggcggtaatggctgcccaagcccccggggtcataactggagtgacgcccgctaggcctcccatccccgtgaccattcctagcgtcggagtcgtcaatccgatcctagcctctcccccgaccctaggcttactcgaacctaagaaagaaaaggaggaagaagagctgttccctgaatccgaacggcccgagatgttgtcagagcaggagcatatgtccataagcggaagctcggcccggcatatggtcatgcagaaattgcttaggaagcaggaaagcacagtgatggtactgcggaacatggttgatcctaaggacattgatgacgatttagagggtgaggtgacagaagagtgtgggaaatttggggcggtaaaccgtgttatcatctatcaggagaagcaaggggaggaagaggacgccgaaatcatcgtgaagatttttgttgagtttagcatcgcgtccgagacccacaaggcaatacaggcattgaatggacgttggttcgccgggagaaaggtagtagcagaggtatatgaccaggagcggttcgataattctgacttaagtgcatag

SEQ ID NO: 12818 - DNA, 1551 bp, Artificial Sequence
  Description of Artificial Sequence: Synthetic coding sequence
atggagaacggccagagtaccgcggccaaactaggactgccaccattaacacctgagcagcaagaggccttgcagaaggccaagaagtacgcgatggagcagtctattaaaagtgtcttggtaaagcagactatagcccatcagcagcaacaactgaccaatttgcagatggcggccgtcaccatgggtttcggggaccctctctctcctctgcagtcaatggccgcacagagacaaagggccctggcaatcatgtgcagagtttatgtggggtctatatactatgaactgggcgaagacaccatcagacaagctttcgcacctttcggacccattaagtccatagacatgtcctgggattccgtcaccatgaagcataagggattcgctttcgtcgaatacgaggtgccagaagccgcgcagctggcactcgagcagatgaatagcgtcatgttgggggggagaaatatcaaagtgggccgccccagtaatatcggccaggctcagccaattatcgatcagcttgctgaagaagccagggctttcaaccgaatctacgtggctagcgtacaccaggacctgtctgacgacgacattaagtcagtgttcgaagccttcggaaagattaaatcttgtacgctggctagggacccgactacaggaaagcataagggctatgggtttatcgaatacgagaaggctcaatcctcacaggatgccgtctctagtatgaacctctttgatctaggcgggcaatatctgcgggtaggtaaggctgttactcctcctatgcccctgctcactccagcaaccccaggaggcttacccccagccgctgccgtggcggctgctgccgcaaccgccaagattactgcccaggaggccgttgctggagccgccgtgctgggcacattaggcacccctggccttgtgtcaccggcgcttacgctagcacagccccttgggacactgccacaggcggtcatggccgcacaggcccctggcgtgatcactggggtgacaccagctaggcctcccatccctgttaccattccttctgtgggagttgtgaatcctatccttgcctcacctcccaccctgggtctgctggaacccaagaaggagaaagaagaggaggaactcttcccagagtcagagcgccctgagatgttgtctgagcaagaacacatgtccattagcggcagcagtgcaaggcatatggtgatgcagaaactgctgcgcaagcaggaaagcaccgtgatggtgttgagaaacatggtggatccgaaagatatcgatgacgatcttgaaggcgaagtgactgaagaatgcggcaagtttggagcagtgaatcgcgtcattatctatcaggagaaacagggagaagaggaagacgctgagataattgtcaagatttttgttgagttcagcatcgcctctgaaacacacaaggctattcaggcgctgaatgggcgttggttcgccggacgaaaagtcgttgcagaggtgtacgatcaggagcgcttcgataattctgacctcagcgcttag

SEQ ID NO: 12819 - DNA, 1680 bp, Artificial Sequence
  Description of Artificial Sequence: Synthetic coding sequence
atggccactgccacaatagctttgcaggtgaatgggcagcagggcggaggatccgagccggcggcagcagcagctgtcgtcgcggcaggcgataaatggaagccacctcagggcaccgactccatcaagatggaaaatggccagagcacagctgccaagttgggcctgccaccccttacacccgaacagcaagaagctctacagaaggcaaagaagtatgcgatggaacagtcgatcaagagcgttctcgtcaagcagaccattgcgcaccagcagcagcaacttaccaatctgcagatggctgcggtaacaatgggatttggggaccctttatcgcccctccagtcaatggcggctcagcggcagcgggctctcgcgatcatgtgccgcgtgtatgtcggatccatttattacgagctgggcgaagatacaattcggcaagcgtttgccccattcggtcctatcaagagtatcgatatgtcttgggatagcgttacaatgaaacataagggctttgcttttgtggagtacgaggtgcccgaagctgcccagctggcattagagcaaatgaactccgtcatgttgggtggtagaaatatcaaagtcggcaggccgagcaatatcggccaagcgcagccaatcattgaccaactggccgaggaggcacgagcatttaatcgaatttacgtcgcgtccgtgcaccaagatctgtcggatgatgacatcaagtcggtatttgaggcattcggaaaaatcaagtcctgtactctggctagagaccctaccactggcaaacacaaaggctacggatttatcgagtacgaaaaagctcaatcctcccaggatgctgtgagttctatgaatttgttcgacctgggcggtcagtatctgagagtgggaaaagcagtgaccccccccatgccgctgcttacgccggccacccccgggggtttaccacccgcggcggcagtagccgccgcggccgctacagcaaagatcactgctcaggaggctgtcgcgggagccgcagtgttgggcactctgggcacccctgggttggtctcacctgccctgaccttggcccagccactgggtaccctgccccaggcggtcatggctgctcaggcgcccggagtaatcacgggcgtgacccccgccagaccccctataccagtaacaattccgagcgtcggagtggtgaacccaatcctggcctctccccctacgttgggacttcttgagcctaagaaagagaaggaggaggaggagttattcccggagagtgaacggcccgaaatgcttagcgaacaggagcacatgagtatttctgggtcctctgcaagacacatggtcatgcagaagctgcttcgaaaacaagaatccacggtaatggtacttcggaatatggtcgatcctaaagacattgacgatgacctggaaggcgaggttacggaggaatgcggaaagtttggagccgtgaaccgtgtgattatttatcaggagaagcagggcgaagaggaggacgccgaaatcatagtaaagatcttcgtcgagttttccatagcttccgaaactcacaaagcaatccaggccctgaacgggaggtggtttgcagggcgaaaagtagtcgcagaagtatatgatcaggaacgctttgacaacagtgacctgtcagcatag

SEQ ID NO: 12820 - DNA, 2232 bp, Artificial Sequence
  Description of Artificial Sequence: Synthetic coding sequence
atgaacaatccctcagagactagcaagccgtcaatggaatctggggatggaaataccgggacgcagaccaacggactggactttcagaagcagccagtccccgtgggtggtgctataagcaccgctcaagcacaggctttccttgggcacttgcatcaggttcagttggcgggcacttcccttcaggccgctgctcagtctctaaacgtgcagtctaagtctaacgaagagtccggcgatagccagcagccctcccagccctcccagcagccttctgtccaggccgccattccccagacccagctgatgctggcagggggtcagatcacgggtctcacgctgaccccagcccagcagcaactgttgcttcagcaggctcaggctcaagctcagctgctggccgccgccgttcagcagcatagcgcctcccagcagcattccgccgctggggccacaatcagcgcaagtgccgcgacccccatgactcagatacccttgtctcagcctattcaaattgctcaggacctgcagcagctgcagcagcttcagcagcagaatcttaacttgcagcagttcgtcctggtacaccccaccactaatcttcagccagctcagtttataatctcccagaccccacagggacagcagggtctgttgcaagcacagaaccttttgacgcaactgccccagcagagccaggccaacctgctgcagagccagccttctattactctgacttctcaaccagctacaccaacgcgcactatagccgccacccctatccagactcttccacaatcccagtctacccccaaacggatcgacacaccgtctttggaggaaccatctgacttggaagagttagaacagttcgctaagacgtttaaacagcggaggattaaactgggcttcacccagggagacgtcggcctggctatgggcaagctgtatggcaatgacttttctcaaacaactatcagccgcttcgaagccctcaacctgtcatttaagaacatgtgtaagcttaaacccctccttgaaaaatggctgaatgatgcagaaaacttatcttccgattcaagtctgtctagtccctcagccctgaatagcccaggcatcgaggggttatcccggagaaggaaaaagcgaacctccattgagacaaacatccgggtcgctctcgaaaagagctttttggaaaaccaaaagcctacctcagaggagataacaatgattgcagaccagttgaacatggagaaagaggtcattcgggtctggttttgcaaccgacgacaaaaagaaaagagaatcaaccctccttcctccggaggcacttcatcttcacctatcaaggcaatctttccgagcccgacttctctggtcgcgaccacgccaagtctggtgacctctagcgctgctacaaccctgactgtcagtcctgtcctgcccttaaccagcgccgccgtcaccaacctgagcgttacaggcaccagtgatactaccagcaacaataccgcgactgttataagtactgcgccaccagctagctctgcagttaccagcccctccctttcccctagcccctctgccagcgcatcaacaagcgaggccagctccgcttctgagaccagcacgacgcagacaacgagtacccccttgtcatccccgctgggcacctcacaggtaatggtaacggcgtctggactgcaaacagctgcagcagctgctctgcagggcgccgctcagctcccagccaatgcctctcttgcggctatggctgcagctgccggactgaacccttccctcatggcgccttcacagttcgcagccggaggagctctactgagcttgaaccctggtacactaagcggggctctctcccctgctctaatgtcgaattctacactggccactatccaagcactggcatcagggggctcccttccgattactagcttagatgccaccggaaatctagtgttcgccaacgccggaggcgctcctaatattgtgaccgcacccctgtttctcaaccctcaaaatctgtcactgcttaccagtaatcctgtatcgctggtgtcagccgccgcagcctctgccggcaacagcgctcccgtcgcatccttgcatgcaacttctactagcgccgaatcaattcagaattcgttgtttacagtggcttctgcctctggggccgcctctactacaaccaccgcgtctaaagcccagtag

SEQ ID NO: 12821 - DNA, 2268 bp, Artificial Sequence
  Description of Artificial Sequence: Synthetic coding sequence
atgcttgactgctccgattatgtgcttgacagtagaatgaacaaccctagcgagacgtccaaaccttctatggaaagtggggacggtaacacgggtacccagactaacggactggacttccagaaacagcccgttccggtggggggagccatcagtaccgctcaggcgcaggccttcttaggacacctgcaccaggtgcagttagccggaacgagcctacaagccgccgctcagagcttaaatgttcaatcaaagagcaacgaggagagcggggacagccagcaaccctcccaaccttcgcagcagcctagcgtgcaagcagctattccacagacgcaactcatgctggctggcggacagattaccggtctgactctgactcccgcccagcaacagttactcctgcagcaggctcaggcccaggctcagctcctagcggccgctgttcagcaacatagcgcatcccagcagcactctgcagctggagctaccatcagcgccagcgctgccacgccaatgactcagatccccctgagtcagccaatccagattgcccaggatttgcagcaactgcagcagcttcagcagcaaaatctgaatctgcagcagtttgtgctcgtgcatcctacaacaaatctgcaacccgcacagtttataattagccagaccccgcaagggcagcagggacttttacaggcacagaacctcctcacacagctgccacagcagagtcaggctaatctgctgcagtctcagcccagtattaccctcacgtcacagcctgctactcccaccagaactatcgccgctacaccaattcagacgctgccccagtcacagagtacacctaaacggatagacactccttccttggaagagccgtcggacctcgaggaactggagcaatttgccaaaacattcaaacaacggagaattaaacttgggtttacccagggggacgtcggactggcgatgggcaaactttacggcaatgacttttcgcagaccaccatatcccgctttgaagctttgaacctgagctttaagaacatgtgcaagttgaagcccctgcttgagaagtggctgaatgatgcggagaatcttagctcagatagtagcctatcatccccatctgctctcaacagtccaggaattgaaggcctgtccagaaggaggaagaagagaacttcgattgagacaaatatacgggtggctctcgagaagtctttcctggagaaccagaagccaactagcgaagaaattaccatgatcgctgatcaactgaacatggagaaggaagtgatccgcgtgtggttctgcaaccgcaggcagaaagagaaaaggattaacccaccctccagtggaggcacatcctcctcccccataaaggcgatcttccccagcccgacgtccctggtcgctaccactcccagccttgtcacctcatccgccgctactaccttgacggtttctccagttttgccactgacatccgctgcggtcaccaatctctctgtgaccggcacaagcgacacaacaagtaataacaccgccaccgtaatatctacagcccccccggctagtagtgcggtgacaagcccctctctgtctccctctcctagtgcttctgccagcacatccgaggcaagcagtgcttccgaaacatcaacaacccagacaaccagcacacctctgagctcacctcttggaacttctcaggtcatggttacagcatcaggactgcagacagctgctgccgctgctctccagggagccgctcagcttcccgccaacgccagcctggcagcaatggccgcggccgccggtctgaacccatctctcatggcgccctcccagtttgcagcaggcggagccctcctcagcctgaatcctggcactctctccggcgccctctcccccgctttaatgagtaatagcactttagccactatccaagccctggcctcgggaggctcacttccaatcacaagtctcgatgcgacaggtaacctcgtctttgctaatgcgggtggcgcgcccaacatcgtcacggcccccctcttcctcaacccacaaaatctatcactcttgacttcaaaccccgtgtccctcgtgtctgctgctgccgcttccgccggcaattccgcgccggttgctagcctgcacgccaccagtacaagcgctgagtccatccaaaattccctttttaccgtggcctcagccagtggggctgcgagtacaaccactaccgcttccaaagctcaatag

SEQ ID NO: 12822 - DNA, 2226 bp, Artificial Sequence
  Description of Artificial Sequence: Synthetic coding sequence
atgaagacccgaatgaagattttcgttatgattcattttcatttaatgaatagtacacagacaaatgggctcgatttccagaaacagcccgttccagtgggaggagccatctcaactgcccaagcgcaagcattcttgggccacctccatcaggtccagctggctggtactagtctccaggcagccgcccagagccttaatgtgcaaagtaaaagcaacgaagagtccggagattcacagcaaccgagtcagccttcccagcagcctagcgtccaggccgcaattccacagactcagttaatgctcgccggaggacagataaccgggctcaccctgacacctgctcaacagcaactgttgctgcagcaggcccaagcacaggcacagctgctagccgcagccgtgcaacagcactcggcttcacagcagcactcagctgccggggccactattagcgcttctgccgccacacctatgacacagatcccccttagccagcccatccagatagctcaagacctccagcaattacaacaattgcagcagcagaatcttaacttacaacagtttgtcctggtccaccccaccaccaaccttcagcctgcacagtttataatctcccagacaccccaagggcagcaaggcttgctgcaagcccagaacttgctaacccagctccctcaacagagccaggctaacctgctccagtcccagccatcaatcaccctgacaagccaacctgccactcctacgagaactattgcagccactccaattcagaccttgccgcaatcccagagcacacccaagcgaatagacactccaagtcttgaagaaccatccgatcttgaggagctcgaacagtttgcaaaaacgtttaagcagcggcgcataaagctaggttttacccagggagacgtgggtctggctatggggaaactgtatggaaacgatttctcgcagaccacaatctcccgcttcgaggcccttaatcttagtttcaagaatatgtgcaagctcaagccccttctcgagaagtggttgaacgacgcggaaaatctatcgagtgattccagcctgagttctccatccgcattgaacagtcccggcatagaaggactgtcccgccgccgcaaaaaaagaacatctatcgaaaccaatatccgcgtggcccttgaaaagtcatttctcgagaaccagaaacctacctctgaagagatcactatgattgctgaccagcttaacatggaaaaggaggttatcagagtctggttctgcaatcgaagacagaaggaaaagcgaattaaccccccctcctctggaggaaccagttcgtcacctattaaggcaattttccccagccctacatccttggtcgctactacaccatccctggtcactagcagtgcggccacaactctcacggtgtccccagtcttgccgctcaccagcgccgcggtaacaaacctgtccgtgaccggtacttcagacactaccagcaataacactgcaactgtgatcagcaccgccccgcctgcttccagcgccgttacttcacccagcctgtctcctagtccgagtgcctctgcctccaccagcgaagcctcttcagcctctgagacttctacaacacagaccacttctacccctctaagctcacctcttgggacctctcaggtcatggtgactgcttccggacttcagacagcggccgccgcagccctccagggggccgcacagctccccgccaacgcgagtctggccgcgatggctgccgccgcggggcttaacccttcgctgatggcaccgtcccagttcgccgcgggaggcgcactgctgtccctgaacccgggtactctctcaggtgccctgtctcctgcccttatgtccaattctacgttggccacaattcaagccttggcatccggcgggtctctccccatcacttccctggacgctactggcaacctcgtgttcgccaacgccgggggcgcccctaatattgtgaccgccccactgtttctgaatccacaaaacctgagcctcttgacttcaaacccagtgtcactggttagtgctgccgcagcgtctgcaggaaacagcgctccggtcgctagccttcacgctaccagcacaagtgccgagtccattcagaactccctcttcaccgtggcctcagccagtggtgccgccagcacaaccacaactgcgtctaaagctcagtag
